United States Patent 11,410,750 (METHYLATION MARKERS AND TARGETED METHYLATION PROBE PANEL) - sequence listing, part 4

SEQ ID NO: 42832 - DNA, 100 bp, Homo sapiens
  chr10:135069848-135069948
  hypo
ttttgccaccaaaggcgatcactgtggatcatgccggttcctgcacacctgtggggtgctctgagcgtggactccccacgcgagccgtccagacgtgctc

SEQ ID NO: 42833 - DNA, 144 bp, Homo sapiens
  chr10:135087501-135087645
  hypo
aggtctctgtgtagccggagcccagcaggtccctggaaaagaagtgctgtgactgcctcggccccctcggtgcagagaggctggcccagaggctggacgccggggacaccagtgtgctggagccaggcccgggcaggggggccg

SEQ ID NO: 42834 - DNA, 34 bp, Homo sapiens
  chr10:135124157-135124191
  hypo
acctcctgcagccgtcggccgtgctcacacatca

SEQ ID NO: 42835 - DNA, 27 bp, Homo sapiens
  chr10:135159617-135159644
  hypo
agggtgtgccagggacggctaaagaag

SEQ ID NO: 42836 - DNA, 30 bp, Homo sapiens
  chr10:135162912-135162942
  hypo
acacacacccgaacacgacaccacccacag

SEQ ID NO: 42837 - DNA, 18 bp, Homo sapiens
  chr10:135208606-135208624
  hypo
acccgtggaagggcccgg

SEQ ID NO: 42838 - DNA, 30 bp, Homo sapiens
  chr11:197439-197469
  hypo
gggtcaggagccaggcgggcaggtgggggt

SEQ ID NO: 42839 - DNA, 30 bp, Homo sapiens
  chr11:299379-299409
  hypo
caagtggtctcgaggcggggggtgcggggc

SEQ ID NO: 42840 - DNA, 167 bp, Homo sapiens; identical to SEQ ID NO: 15456
  chr11:394801-394968
  hypo

SEQ ID NO: 42841 - DNA, 173 bp, Homo sapiens
  chr11:429466-429639
  hypo
cacacacctcagacacggcaggcatatgtgggccgtgcagggcatcgggcgccaacagcccctgctcgggtcggcctcagctgcgctgccagctccacctcacctgttcctcgtcccacacgtacaggtcccagtgcaggaccacgcgggcgcgctgccgcttccagatctcc

SEQ ID NO: 42842 - DNA, 278 bp, Homo sapiens
  chr11:445925-446203
  hypo
cacttcagaagaccccgtccaccagaccgcctccccctgaggcccaacatgcagcagaggcagctcctccgtccctgcagcctccttttaactgtgggatatggcagccacccgtggagcggtccgggtgacaaagccagcgagagctagggagcgcccaggtgaaatcccacaggcaggtgtgagcaccaattgtcattacctttgccctgggcccctcagagacctgtcctccccccccgcccccaacagcctcctgggcgcggccacagacacag

SEQ ID NO: 42843 - DNA, 39 bp, Homo sapiens
  chr11:449334-449373
  hypo
tgggatgacaggcgtgcgccgccgcgcccggcctgccta

SEQ ID NO: 42844 - DNA, 103 bp, Homo sapiens
  chr11:449589-449692
  hypo
gtcaactaaaatcagcgtgtccgcaccattttcgcccgcccaatttcacgcgatcctgcgaaagaatgacccagaccggtccgggcgcggtggctcgcgcctg

SEQ ID NO: 42845 - DNA, 59 bp, Homo sapiens
  chr11:486036-486095
  hypo
agtgtaaacagtgcacgggcgtgtgtgttcaccgtgtgcgcaggcgagtgtaaacacag

SEQ ID NO: 42846 - DNA, 245 bp, Homo sapiens
  chr11:487303-487548
  hypo
ccctggccttcttcccggggtctggcaggtgctgctcaggtgtgggctgatctgccggtgtggggagtgggggtggctgtgccccagggtcaagggtcataccctgtcgcccacaggacaagttggatggctttgttcccgcgcactttcttggctggtacctgaaggtacggcacctcctcttcccggcctccccgccccggttctgaggcctgccgtgggctctggaccgtttctgtccatgg

SEQ ID NO: 42847 - DNA, 54 bp, Homo sapiens
  chr11:493145-493199
  hypo
ccctgggagcccttccggcagcaactcaaccccagacagcgcccaggggctctg

SEQ ID NO: 42848 - DNA, 600 bp, Homo sapiens
  chr11:562246-562846
  hypo
acagctgtccacccccggaacgctgcctaattcgtgccagcctccctgtaaagccacgggctgcgctgggctgtgagccccgcaaaacactgacccccgagccagcccccagcctctcacgccctgggcctgcggcccctgtgacacccacaccaggctgctgcacagacctgcggggcctggagctcagggtgcagaggaatgctgaggagctgggccatgaggccttctgggagcaagagctgcgccgggagcaggcccgggagcgagagggacaggcacgcctgcaggcactaagtgcggccactgctgagcatgccgcccggctgcaggccctggacgctcaggcccgtgccctggaggctgagctgcagctggcagcggaggcccctgggcccccctcacctatggcatctgccactgagcgcctgcaccaggacctggctgttcaggagcggcagagtgcggaggtgcagggcagcctggctctggtgagccgggccctggaggcagcagagcgagccttgcaggtgagcccggggacctgatcccctgtcactcccccacccctgatatgggcagatacggggatcacagggt

SEQ ID NO: 42849 - DNA, 30 bp, Homo sapiens
  chr11:571791-571821
  hypo
ggcaggggcagcacacggcagtgtcgacca

SEQ ID NO: 42850 - DNA, 42 bp, Homo sapiens
  chr11:707906-707948
  hypo
gcaaacactcaggctcgccactgagcccgtgaacattccaga

SEQ ID NO: 42851 - DNA, 30 bp, Homo sapiens; identical to SEQ ID NO: 15461
  chr11:762939-762969
  hypo

SEQ ID NO: 42852 - DNA, 74 bp, Homo sapiens
  chr11:763302-763376
  hypo
cgccctcacctgccccgccctcacctgtccccgccccgcagggagctcgaggagcagcacggcatccactgcaa

SEQ ID NO: 42853 - DNA, 30 bp, Homo sapiens; identical to SEQ ID NO: 15463
  chr11:763637-763667
  hypo

SEQ ID NO: 42854 - DNA, 281 bp, Homo sapiens
  chr11:782269-782550
  hypo
ggggaggggtggggccgttccctcccaagcacacttctggagctgctgcagtcgggggtgaccctaacctaccttgtgccttccttcccatgtgccggggcgggtcccacacacctctctcctgccccgactggctcccacctggggcacgcagttgggcaacccaggccctgctctgcccgtcgagcctccagggcaagtgcaagctcagcctgggcctggagacggcggatcggagcgtgtccaggtgctcagggactggtcaccgaaaggcaaggagc

SEQ ID NO: 42855 - DNA, 104 bp, Homo sapiens
  chr11:823903-824007
  hypo
agagagaggagaggacggtgagcaggggagggaagccgagcgggtcctgggccccgctgcctccactggccgccgacctcccgcccacccgcagccctgctgga

SEQ ID NO: 42856 - DNA, 132 bp, Homo sapiens
  chr11:824852-824984
  hypo
ggggctgtgagaccccgaccctctcgaggaaccctgcctgagacgcctccattaccactgcgcagtgagatgaggggactcacagttgccaagaggggtctttgccgtgggccccctcgccagccactcacc

SEQ ID NO: 42857 - DNA, 277 bp, Homo sapiens
  chr11:850546-850823
  hypo
gaaggtttgcaccatcgcggggtccgccccctgcactcagagcggctgccccacgccctggtcccctctcctctcctctcctctcctcacttgatgagacgggacacgttgcacacgtgcgcgccggacagggccacccgggcactgcgcctctcctagggtcggggttcgagtccgggtcgtggccagttttgcgcggggccccggtgcctcctctgcgcccgctccctcctcggtgcagccgttatccttgcctcggccccgcccctccaggcag

SEQ ID NO: 42858 - DNA, 30 bp, Homo sapiens
  chr11:851077-851107
  hypo
agctgaggtagagggcggacagggttccac

SEQ ID NO: 42859 - DNA, 58 bp, Homo sapiens
  chr11:858498-858556
  hypo
ggctcacatgcaccccggatcccacccccgctgacactcaccccggttcccatgcacc

SEQ ID NO: 42860 - DNA, 383 bp, Homo sapiens
  chr11:859019-859402
  hypo
gcaccccagctctcacgcacccccgggctcacaccaacagcttgcacccccggcacacatgcaccccggctcacacgcacccccgggctcacacgtgccctggctcacacgcacccctgggctcacatgcaccccggctcacacgcaccccaggtcacacgcatcccctcacatgcacccaggctcacacacccacccccagcccacactcatccccgctcacacacacccccactcacacacaccctggcccacacgcaccttggctcacgtgcaccccggctcacacgcaccccccctttcacacgcaccccgggctcacacgcaccccgggctcacacgcaccccccctttcacacgcaccccgggctcacatgcacccc

SEQ ID NO: 42861 - DNA, 33 bp, Homo sapiens
  chr11:860888-860921
  hypo
ccagaaccagtcaaccgtcggcaccccaggacg

SEQ ID NO: 42862 - DNA, 476 bp, Homo sapiens
  chr11:862616-863092
  hypo
tgtcctcttccttcccgtccctgtcggctgccaacttgctcatcatcaccggcgcctttgtcatggccatcggcttcgtgggctgcctgggtgccatcaaggagaacaagtgcctcctgctcactgtgagtgccggggcccaagcgatgctccgggtgggaccacgcagggtggggctccggtggcccccaggccttggctgccgcagtgaccccccagacgtgggcaccacctctggggccggacctccaggctggcagtgtggcccggggccctggccactgttgggtcttccaggccacactggggctggggggtgatttgcagagcggtgtgggggtcactcaagagaacgtgctgtaccttgtcaggggcctcccctgacgggacactggccctggtgagtgcaggcacagccccgcacacacgtacacacgcatgcgcagcctttcacgggcttgcggtctccgtgactc

SEQ ID NO: 42863 - DNA, 68 bp, Homo sapiens; identical to SEQ ID NO: 15467
  chr11:864749-864817
  hypo

SEQ ID NO: 42864 - DNA, 470 bp, Homo sapiens
  chr11:865657-866127
  hypo
cctcctgcctcagcccgacctgagcttgccccccagttccgctgctgtggcgtctccaactacactgactggttcgaggtgtacaacgccacgcgggtacctgactcctgctgcttggagttcagtgagagctgtgggctgcacgcccccggcacctggtggaaggcggtgagtgagacccccaccctgggggctggtaggggcctagagggcgggaccagcaggccctgccgtgacacgcatgacatccctccctgcagccgtgctacgagacggtgaaggtgtggcttcaggagaacctgctggctgtgggcatctttgggctgtgcacggcgctggtgcaggtatggcctgggggcctgcgggctccctgcccccactttgttaggaccttctgagcccagggaacaaagtagcaaagaccttgcccccaggaacccacgatcgggggaggccggggcaaaagcagg

SEQ ID NO: 42865 - DNA, 30 bp, Homo sapiens; identical to SEQ ID NO: 15469
  chr11:866956-866986
  hypo

SEQ ID NO: 42866 - DNA, 30 bp, Homo sapiens; identical to SEQ ID NO: 15470
  chr11:875487-875517
  hypo

SEQ ID NO: 42867 - DNA, 152 bp, Homo sapiens
  chr11:985308-985460
  hypo
ctgggtacacaaatgtgaatgaactatattaaaaatgctctcatgatgtatgggtgcagccgggaggggcagggtgggctgcgggccactggagactggtgagcaccgttctgtcttgcccagaagaccctgcagtgcgaggccgcctgact

SEQ ID NO: 42868 - DNA, 107 bp, Homo sapiens
  chr11:986906-987013
  hypo
atgaggctgtcaagacgcacatcgagacggtcatcaacgccctgaaggcgagtgccctgtccttgggttctgctcactccctgagcaggtgccgtgggtcttcctgt

SEQ ID NO: 42869 - DNA, 30 bp, Homo sapiens
  chr11:1008527-1008557
  hypo
cagttgagctcagatcgtaccactttgctt

SEQ ID NO: 42870 - DNA, 344 bp, Homo sapiens
  chr11:1024866-1025210
  hypo
tctggctgttgatgacgctgcacttgcgctcggcccaggagcgccggaaggcattgagactgcaggggtctgtcacgaagctcacgtccccgcacagcgggctctccttccacgagttcaccaactccagctcgctggatgccacgtacctgctgcgcgtctcgaagtcgtccttcatgttcccgttgaagttgccacacaagccgcagaggggatcctgcagacggtggcatcaggccgggcccaggggccgtgccatctgtctccacccctgcatcagggagggcctgggaggaggcagagggcgtgcggtacctgggaggcacgggcgatcctgatgagga

SEQ ID NO: 42871 - DNA, 293 bp, Homo sapiens
  chr11:1025896-1026189
  hypo
cgttgacaccacagacgtcctgcagggagagggcgctgaggaggagccctggaggccgtgcctctgggtccccggcccctgcggcctggcacccgatggttaccgtggccaggatgtactcgcagttgccgtcgaatacgaagcgctggccgtcgaaggtgatgacgtggccctccccgtagagggtgcaggtggatgggcagtgggtgccctgctgacaggcccacctcccccttgagcaggagctgtggagacagcaggtgtgggtggtgggcctgcggccctcctgccat

SEQ ID NO: 42872 - DNA, 159 bp, Homo sapiens
  chr11:1027415-1027574
  hypo
cgctgtggtggcactcggtggcacggtccgacagcgacaggcaggtgcgctcacaggcttggctgttgtagctgaaggtggtgttacccgtgcaggggatggctgtgggggacccgggcatcagactctccgggagggggcggccgggagggcaatctc

SEQ ID NO: 42873 - DNA, 61 bp, Homo sapiens
  chr11:1028309-1028370
  hypo
gcgaggcggtgccctcggcgatacccatgctagtggtgaagtcatccgttgtgtccccgtt

SEQ ID NO: 42874 - DNA, 243 bp, Homo sapiens
  chr11:1029178-1029421
  hypo
tggggtcaccgggagcgcccctccccacgggccacagggctcgtcctacctggaggaggatgtaggtgcaggtgccgtggaagcggtagggcctggcgtcaaatgtggtaacaaaggagccaccttccagggagcagtgtccggggcacggccgctccgtgcacacccagcggcccagggtgcaccggctgtgggtgggcgtgggggtagcggcatggtgggcagggccgctggagccagaca

SEQ ID NO: 42875 - DNA, 143 bp, Homo sapiens
  chr11:1030165-1030308
  hypo
tctctctaggggtcccggggagagagagtgcctgcgactgccctcaccttccgggcagaagcacccgaaggtgcaggagctggagcagctgtgctgcgggttggagcaggtcttcacgcaggccgagccgcactcctggtaca

SEQ ID NO: 42876 - DNA, 33 bp, Homo sapiens
  chr11:1043870-1043903
  hypo
tgctgccacttctcccggcgtggactggctgga

SEQ ID NO: 42877 - DNA, 151 bp, Homo sapiens
  chr11:1075796-1075947
  hypo
gctgtgcacctgaagcggggtccgggccaggctgaggcccccgccggggtggagtccatcctgctgaccatcaaggatgacaccatctacctcacccgccacctggctgtgcttaacggggccgtgtgagtgtggtcggtggcacccctcc

SEQ ID NO: 42878 - DNA, 155 bp, Homo sapiens
  chr11:1077593-1077748
  hypo
ccagggtcagcaccccgcactacagccccgggctgctcattgagaagagcgatgcctacaccaaagtctactcccgcgccggcctcaccctcatgtggaaccgggaggatgcactcatggtgctcaggggtccccggactcgtggggctggtggg

SEQ ID NO: 42879 - DNA, 16 bp, Homo sapiens
  chr11:1079536-1079552
  hypo
ccgggcaccgggagct

SEQ ID NO: 42880 - DNA, 30 bp, Homo sapiens
  chr11:1080245-1080275
  hypo
cagccggggtgacatcgcctccctggctgt

SEQ ID NO: 42881 - DNA, 41 bp, Homo sapiens
  chr11:1083467-1083508
  hypo
tcaggctcacatctgcggggaagctgcgggctgtctgtggc

SEQ ID NO: 42882 - DNA, 30 bp, Homo sapiens
  chr11:1085664-1085694
  hypo
ccctgccaactggggcgggtgtgccccggg

SEQ ID NO: 42883 - DNA, 198 bp, Homo sapiens
  chr11:1094942-1095140
  hypo
agatcgcagtagaagcgtctcaggaggcagcagccgtcgagggtggctgtgtccagggcacggcttcccttgggtggcctctgtggggacctccgctgtggggacctccacggggtccagcggctagccctgcctccggatagccctgcctctggacggtgtgatcgtgggtctgtctcccttcgcaggtgaggaggt

SEQ ID NO: 42884 - DNA, 30 bp, Homo sapiens
  chr11:1095639-1095669
  hypo
acgtcccttgcctcccgtccccaggagaac

SEQ ID NO: 42885 - DNA, 199 bp, Homo sapiens
  chr11:1103985-1104184
  hypo
gaggcgagaggccagcgctggccccggaaggtcacccctcactccgccctccccccaggtactcggccaaggcccaggccctggaccacagctgctcctgctgcaaagaggagaaaaccagccagcgtgaggtggtcctgagctgccccaatggcggctcgctgacacacacctacacccacatcgagagctgccagtg

SEQ ID NO: 42886 - DNA, 62 bp, Homo sapiens
  chr11:1115115-1115177
  hypo
gcgggtggtaaactgcgggtgcccctttgcggtgcccggatacctggcggggagccctgggg

SEQ ID NO: 42887 - DNA, 73 bp, Homo sapiens
  chr11:1140450-1140523
  hypo
tcccgctctggaggccgcgtctcttccccggcggaccgtcctctacctgcagagccatcgggagcctctgctc

SEQ ID NO: 42888 - DNA, 30 bp, Homo sapiens; identical to SEQ ID NO: 15479
  chr11:1142462-1142492
  hypo

SEQ ID NO: 42889 - DNA, 30 bp, Homo sapiens
  chr11:1148164-1148194
  hypo
ccctggccagggtcccggtcacacctgcag

SEQ ID NO: 42890 - DNA, 54 bp, Homo sapiens
  chr11:1151771-1151825
  hypo
ctttgccctgggttccgggcaggctgcatgtgccatgaacggctcccagcagca

SEQ ID NO: 42891 - DNA, 30 bp, Homo sapiens
  chr11:1152610-1152640
  hypo
gcaggaattctgtcccggggctgctcccag

SEQ ID NO: 42892 - DNA, 30 bp, Homo sapiens
  chr11:1155200-1155230
  hypo
gaggtgagtggagcccggaggcctgggtgg

SEQ ID NO: 42893 - DNA, 123 bp, Homo sapiens
  chr11:1155629-1155752
  hypo
gttctccgagcactgcggtgccgcctacgaggattttaacatccagctacgccgcagccaggagtcagcggcccccacgctgagcagggtcctcatgaaggtggatggcgtggtcatccagct

SEQ ID NO: 42894 - DNA, 302 bp, Homo sapiens
  chr11:1214665-1214967
  hypo
gagatcgggagaggccggaccctgcaggtctctgtgcttctgcagaaaggtgagacctgggccacacccaactgctccgaggccacctgtgagggcaacaacgtcatctccctgcgcccgcgcacgtgcccgagggtggagaagcccacttgtgccaacggctacccggctgtgaaggtggctgaccaagatggctgctgccatcactaccagtgccagtgtgagtggagcgccgagcgggacccagggcagccggggcagccactccccacccaggtggaaatgggcggggcagaggaggg

SEQ ID NO: 42895 - DNA, 30 bp, Homo sapiens
  chr11:1215395-1215425
  hypo
tcctggacaactgcacgtacgtgctggtgc

SEQ ID NO: 42896 - DNA, 183 bp, Homo sapiens
  chr11:1215816-1215999
  hypo
ccaggtcatgttctccggcctcatcttctccgtggaggtgcccttcagcaagtttgccaacaacaccgagggccagtgcggtgaggccacagggctcccgggcatcgtctggcattcgcgggggcgggggtgccgggcaggggcgaggccaccacgtgccgcgtgtgccggtgtctctgcttt

SEQ ID NO: 42897 - DNA, 30 bp, Homo sapiens
  chr11:1229945-1229975
  hypo
cccctctgccagcctcgcaggcgctaagtc

SEQ ID NO: 42898 - DNA, 30 bp, Homo sapiens
  chr11:1241768-1241798
  hypo
ggaggggggatgtcacgagggcttggctaa

SEQ ID NO: 42899 - DNA, 183 bp, Homo sapiens
  chr11:1244348-1244531
  hypo
ccaggatgggtgccccgagcgcgtgccggacgctggtgttggctctggcggccatgctcgtggtgccgcaggcaggtaagagccccccactccgccccctctcgatgctgtcttcacggcgggggtctctgcaggtcgcttgcctgggagcttctcctgcagagtgcacgggcagatccccct

SEQ ID NO: 42900 - DNA, 67 bp, Homo sapiens; identical to SEQ ID NO: 15484
  chr11:1247815-1247882
  hypo

SEQ ID NO: 42901 - DNA, 486 bp, Homo sapiens
  chr11:1250865-1251351
  hypo
gaccttggtgtcccccgtgcatgggccggccctgcctcacgccgcgccccacaggcacggtgctggatgacatcacgcactctggctgcctgcccctcgggcagtgcccctgcacccacggcggccgcacctacagcccgggcacctccttcaacaccacctgcagctcctggtacttatgagcccaccagcctccgcctggggtggggtgtggagctcctggtatttatgaacccgccagcctctgcctggggtgggggtgtggagctcctggtgtgcacccaccagcctccgcctgcggtgggggtgtggagggtggggcccacctcctcccgacatgccggttctgctcacggcctccctccccagcacctgctccggggggctatggcagtgccaggacctgccgtgccctggcacctgctctgtgcagggcggggcccacatctccacctatgatgagaaactctacgacctgcatggtga

SEQ ID NO: 42902 - DNA, 178 bp, Homo sapiens
  chr11:1252902-1253080
  hypo
gcccccagggcatggcggagatcctggtgccagcgcaggacaccagcattggaccagcggccccggaagcagccagctgggaggatggagcgggcagccctgccctggctcaggccgactttgcacaggggctggctttgcacaggggccgactgcacaggggcgccccccgccaggg

SEQ ID NO: 42903 - DNA, 30 bp, Homo sapiens
  chr11:1254339-1254369
  hypo
ctgcagcgtttccttcgtgcctgtggacgg

SEQ ID NO: 42904 - DNA, 321 bp, Homo sapiens
  chr11:1254973-1255294
  hypo
ctgcggggtgagggccgcagatccaggctgtgccgtctgtctcttgtagttcatgtacgggtgggaagctaagctgcctgggagcctctctgcagaaaagcacaggtaagtgccacccctgccctgccctgccctgccccgccccgcatcaccccgcctggcctggccccaacacgccccaccctgccccaccccacctgaaccctgccgggccaggtcagtcctcacctgggctctgccacaggcacccatgccctgacacgccagggacggaggggccagtgggtctctgccccgcagtgtggccggggtgtcctgggg

SEQ ID NO: 42905 - DNA, 48 bp, Homo sapiens
  chr11:1256469-1256517
  hypo
cccactcctgcaggccgggcacactccagcccgcggccagcagcttgt

SEQ ID NO: 42906 - DNA, 141 bp, Homo sapiens
  chr11:1257678-1257819
  hypo
ccaccctacaagatacgctacatggggatcttcctggtcatcgagacccacgggatggccgtgtcctgggaccggaagaccagcgtgttcatccgactgcaccaggactacaaggtgagctcgggccgtgcactcctaggc

SEQ ID NO: 42907 - DNA, 178 bp, Homo sapiens
  chr11:1263199-1263377
  hypo
cagcccttccagggacgacggggagcttgggcacatggcgcccctcacagccacccacgctggccccaacaacaatggcaacctccagagctcgcccgacaggcacagccagcaccgcttccaaagagccgctgaccacgagcctggcgccaacactcacgagcgagctgtccacctc

SEQ ID NO: 42908 - DNA, 99 bp, Homo sapiens
  chr11:1263602-1263701
  hypo
ggcggagaactaccccgaggtaagcatcgaccaggtcgggcaggtgctgacctgcagcctggagacggggctgacctgcaagaacgaagaccagacagg

SEQ ID NO: 42909 - DNA, 30 bp, Homo sapiens
  chr11:1274002-1274032
  hypo
tggtccaggtgaggacgtgcatgttccctg

SEQ ID NO: 42910 - DNA, 35 bp, Homo sapiens
  chr11:1275653-1275688
  hypo
gggtgacccaggtgccgcagcgatggcccagtgcc

SEQ ID NO: 42911 - DNA, 445 bp, Homo sapiens
  chr11:1276293-1276738
  hypo
gacgactgtctccagcgggacggaaccactgccgccagttgcaaggacatggccaagacgtggctggtccccgacagcagaaaggatggctgctgggccccgactggcacaccccccactgccagccccgcagccccggtgtctagcacacccacccccaccccatgcccaccacagccgctctgtgatctgatgctgagccagtgagtcctcccctcgggggttgcaggccctggggcgcccccgcccgcccgcatgcacgcacgcacgcagctccctggggctgggggccctccgtcctgatcgctttgccccacagggtctttgctgagtgccacaaccttgtgcccccgggcccattcttcaacgcctgcatcagcgaccactgcaggggccgccttgaggtgccctgccagagcctggaggcttacgcagagctctgccg

SEQ ID NO: 42912 - DNA, 20 bp, Homo sapiens
  chr11:1359706-1359726
  hypo
aatctcgggaccaggtggag

SEQ ID NO: 42913 - DNA, 40 bp, Homo sapiens
  chr11:1368324-1368364
  hypo
acagggtgcaggtctcggtccccgacgtcaccctccagtg

SEQ ID NO: 42914 - DNA, 44 bp, Homo sapiens
  chr11:1374959-1375003
  hypo
agctacctgtggagccggcgccttctctccgtccttctcacact

SEQ ID NO: 42915 - DNA, 183 bp, Homo sapiens
  chr11:1382225-1382408
  hypo
catggcacagatgggcggccacctgaacgagtgggaggagtgcagtcccaggccctcccagagactgtgccatagtctccaccccaagtgacggtggagggatgctgggaacggtaagctttaatgcttggtgaatcttgcattgcctcattcatgaccggtaggtcacgtggtcatctgaca

SEQ ID NO: 42916 - DNA, 120 bp, Homo sapiens
  chr11:1393300-1393420
  hypo
agcggccgaccttggcggcctgcagtgcccttggcctcccctcgggttgggctggcccatcaggctctgtacccgccctgctgcggctccacgtcgggctggcgccggctgaggaacaga

SEQ ID NO: 42917 - DNA, 30 bp, Homo sapiens
  chr11:1420766-1420796
  hypo
ggattgtggcaaggccgggctggtcagctg

SEQ ID NO: 42918 - DNA, 30 bp, Homo sapiens
  chr11:1422084-1422114
  hypo
cctccccaggctcctcgtggtgctgggacc

SEQ ID NO: 42919 - DNA, 408 bp, Homo sapiens
  chr11:1430714-1431122
  hypo
ctgctcagggtgtgccgggggctttgagtcacttctgtgtctccttggaggctgtgtggcgtccgcggaagttggtgtctgtgcggtgtggttctgtttatgggtgttgtagagaaggcgccgtccagagacagagccactgctgaggtgggtggggggtgtatgaagggcacaaggacgctttgggggtgtcaggtatgatggccctcaggtcatggtttcacacgcgtgtgctttaaatgcgtgctggctgtcacgtgtcagtcgtgcctccacagagcttcaggaaccaccgagatggggagcctgccggagacacaggttttctgagcgcaccagcggctccaaaagcagagggaagagccctgcgtgcaggtggggcgctcatggcgtcggcctcgcagagcg

SEQ ID NO: 42920 - DNA, 42 bp, Homo sapiens
  chr11:1433065-1433107
  hypo
tcctgcccactggcccggcctggcatccgggccctcatcttg

SEQ ID NO: 42921 - DNA, 30 bp, Homo sapiens
  chr11:1434266-1434296
  hypo
catgttaggagcctgcgttcagaacccgca

SEQ ID NO: 42922 - DNA, 128 bp, Homo sapiens
  chr11:1442699-1442827
  hypo
gccaggcagaggcagcggagcggctgcagtgcgtgtgaaatgcttcagggtggcacgaatttaactagagaggttcttttccaacgtgagcagttgtctcccaagagatgcgccgccccttccctctg

SEQ ID NO: 42923 - DNA, 373 bp, Homo sapiens
  chr11:1444579-1444952
  hypo
ccttcagttaggagccgaggcctctggccaggttcaggcacgtggagagtgtgtgtggggagaagttctgagactgtgggaggggtaggggtgtgctgtggccacagtggttctggaatttgaggtgccttaggaggttcatgatgaaggatgcggcccacagtcgtgtgagcagaggacggcactcgcgagctccctggggctcctcagacccggtcaccgaacagcagagacgtgctctttcacattctggaggcgggaagtccaaggtccagggtgggctggctcttccaaggcctcaaggaagccctgccccaagcctcccccgctgggcgttccgggtgccccaggcctcccccgctgggcgttccgg

SEQ ID NO: 42924 - DNA, 61 bp, Homo sapiens
  chr11:1446330-1446391
  hypo
tgatgggaagcctgacgtctgcatcgtcctgcgctgcgtggccggtcggtcccggcgctct

SEQ ID NO: 42925 - DNA, 30 bp, Homo sapiens
  chr11:1447472-1447502
  hypo
gggatgtgtgtggggcgtgctccggggatg

SEQ ID NO: 42926 - DNA, 35 bp, Homo sapiens
  chr11:1450725-1450760
  hypo
gccctgctgctctgtcgccagcatcctgctgtgcc

SEQ ID NO: 42927 - DNA, 66 bp, Homo sapiens
  chr11:1455198-1455264
  hypo
cacagatgaaactgacggaaagggcaaaataaagctaaaagccgatggggccgggggaatggaggt

SEQ ID NO: 42928 - DNA, 30 bp, Homo sapiens
  chr11:1455520-1455550
  hypo
atctgggtgtctgggcgcacctaggagtgg

SEQ ID NO: 42929 - DNA, 65 bp, Homo sapiens
  chr11:1461955-1462020
  hypo
tgggatgaggaggggcggcgggcagccacagctgggcgcactggtggccccgtctcctgcaggta

SEQ ID NO: 42930 - DNA, 30 bp, Homo sapiens
  chr11:1463761-1463791
  hypo
gaacaacatccgcatcgcagactttggcat

SEQ ID NO: 42931 - DNA, 767 bp, Homo sapiens
  chr11:1464204-1464971
  hypo
cagggaatgtgggggcgtctggcaccacagccctggaggcctccttgagggccctgcggtgcaccatcaccctggggggagggcctggcagcgcccggagccccgccgctgacctctgcccttgcccgcaggtccccccactacgcctgccccgaggtgatccgggtgagtcagcgccgccgcgtgcagctctgtggggcccagggtggcggggacctgaccctggtgggaccccagcctgccgcacccccaggtgctgctaggctgcctgtccccgggccgactccctctgagcccaggccctccaaggcccccgccctgccctgcgccccccaacagcccgggcactgctgtccacagggggagaagtatgacggccggaaggcggacgtgtggagctgcggcgtcatcctgttcgccttgctggtggtgagaccctggccccctcaaccctgccctggcctctccccaaacctgcccccccacgctgacccccacacccggccgcccgcagggggctctgcccttcgacgatgacaacttgcgacagctgctggagaaggtgaagcggggcgtgttccacatgccgcactttatcccgcccgactgccagagtctgctacggggcatgatcgaggtggacgccgcacgccgcctcacggtgcgtgccctcggagcggggcggccccagagcgtggcgggggggcgcgggggcgggcgtgtgcctgtgtgtgcacaggtgtgtgcccagacgtgtgggcacccag

SEQ ID NO: 42932 - DNA, 292 bp, Homo sapiens
  chr11:1466910-1467202
  hypo
gggtggcctccagcccggcctgcactgccccaccggggtccgggggctgtctggcctgaccttcgtctgtactcagaccctccccggaagcgtgtggactccccgatgctgaaccggcacggcaagcggcggccagaacgcaaatccatggaggtgctcagcgtgacggacggcggctccccggtgcctgcgcggcgggccattgagatggcccagcacggccagaggtgtgtgtgccccgaggctgctgggcctccctccctgggccctggctgcgcggcactgccgcctg

SEQ ID NO: 42933 - DNA, 510 bp, Homo sapiens
  chr11:1469123-1469633
  hypo
tcccagccccagacacgctgtcctgcctcaggccgggcaggcacatgggcgggtctggtggcgggctgggctgcagggctcctgctgcggtgaagccagccagcaagccaggcaagggcccgcgggccaggcagaggccgaggaggggtggggctgctgaggcgtggcccacgcctgcctgtgagggaccacgcaccatggcttacagggcctggggctagagcccggcgtggctgcaggccgagccgctcctcctgccagcccctgtgctgtgtccggtgggcctcggtggccctgctgcccctggggccggccagagttgaagccgagcagccgtcctgtgcccacctgcaggagctgaggagggcaggaggcgccgccgtcaagaggggcctctacctggggccagttttgcgagcctgggcgggtggcgccgcccccaaggctgcagtgtgctggctgccggtcggggtccttctctttgagccctggccccgtgcctacctggga

SEQ ID NO: 42934 - DNA, 47 bp, Homo sapiens
  chr11:1471413-1471460
  hypo
tgcccccaccccgctcgctccctgcgcctccccgtagcctattagga

SEQ ID NO: 42935 - DNA, 193 bp, Homo sapiens
  chr11:1471865-1472058
  hypo
ggacacctgtccacacgccaaaggagagcccggctggcacgcccaaccccacgcccccgtccagccccagcgtcggaggggtgccctggagggcgcggctcaactccatcaagaacagctttctgggctcaccccgcttccaccgccggaaactgcaaggtgagtgtctgcccggaggcgccagagtggggct

SEQ ID NO: 42936 - DNA, 127 bp, Homo sapiens
  chr11:1473513-1473640
  hypo
gtggcctttctgcgccgatcaggtggcccttccagctgggtgcccaggtcggaggtgtgtaggtattgtcgcaagcccagatgcacagggctcagcagacttgggaaccttccgcctaggccctgac

SEQ ID NO: 42937 - DNA, 140 bp, Homo sapiens
  chr11:1477763-1477903
  hypo
ctggcgcccccagggcggctccgggcccaggcccgtccagggcataaccccctgtctcccctaggccccagccgtcgcttcaagagggtggtggagaccatccaggcccagctgctgagcacacacgacccgcctgcggc

SEQ ID NO: 42938 - DNA, 168 bp, Homo sapiens
  chr11:1478164-1478332
  hypo
gcgcctcttgtccaccgtagaaccccccccaccagcgccaggactaagctggggtgctgggcttaagggccagaaggtggccaccagctacgagagtagcctctgacgctggcaggtaaggcgcccggcctgtgctggggcggggaggggctgcgggcaggtcctcgg

SEQ ID NO: 42939 - DNA, 399 bp, Homo sapiens
  chr11:1483506-1483905
  hypo
caggcgggcacagcccgggtgcggcggccgtgggggacggcgggtctgatgcatgcctctgccatggagtcgtctgtctgcttcggtgcctgcccctgcctcccacccacctcgtgtatagattttaacgcttctgttaacattagacctctgccacaggctgggatttctatacataagaacaaaagcaaacacctaggacagcaaacgccaggcggtacaggcgggaaggggctctccacggagatcgaggacacgaagcaaactgcctcttgcttgccttccccttttgtgcttcggacacacgcggactccagcaggcgccacggaaatgggcaagcccctgcagtgtacccctgtcataactgtgagcagctgcagctccggaacaataaatcc

SEQ ID NO: 42940 - DNA, 30 bp, Homo sapiens
  chr11:1517598-1517628
  hypo
accaggagactgatgcgctacaggcagggc

SEQ ID NO: 42941 - DNA, 47 bp, Homo sapiens
  chr11:1553685-1553732
  hypo
aggagcttccgtagacggtgcaggccaaaccccgagacaacagcccc

SEQ ID NO: 42942 - DNA, 35 bp, Homo sapiens
  chr11:1560806-1560841
  hypo
aaattgtggcagagcgaattcgagtttgcaggacc

SEQ ID NO: 42943 - DNA, 176 bp, Homo sapiens
  chr11:1669565-1669741
  hypo
tcaccggccagagggcgcagccacccggccttcccgaagcaggacagcggcctttccaagaccgcggagtccccgtgagggatggtgcctccggagcctggcatctcgggcggatgagaagctgagcgcggtcagatggcccgcagggtcccactgcgggccgagccctggctggg

SEQ ID NO: 42944 - DNA, 84 bp, Homo sapiens
  chr11:1760346-1760430
  hypo
gtggttacaggaatataggaacggatgccagactggaagggcaggtgcacagatgggtttctgaatgcacgctggatggctgga

SEQ ID NO: 42945 - DNA, 30 bp, Homo sapiens
  chr11:1790238-1790268
  hypo
ggaaaggaagcagtccgaggtcagagagag

SEQ ID NO: 42946 - DNA, 91 bp, Homo sapiens
  chr11:1795195-1795286
  hypo
tggaataactgaatacgcagctcactgtcccccaagcttggttggggactcttccttcatattttaacaaaatccacggcacctctgggat

SEQ ID NO: 42947 - DNA, 30 bp, Homo sapiens
  chr11:1801108-1801138
  hypo
aggccctcacctgcccgggccttcgctgct

SEQ ID NO: 42948 - DNA, 45 bp, Homo sapiens
  chr11:1825207-1825252
  hypo
gtctggggcaccccacgatggaggggaagacggcccagggggcat

SEQ ID NO: 42949 - DNA, 57 bp, Homo sapiens
  chr11:1856532-1856589
  hypo
ctgggctctcattgccggcgcccttgccgcgggcgtcctcctcgtctcctgcctcct

SEQ ID NO: 42950 - DNA, 102 bp, Homo sapiens
  chr11:1857426-1857528
  hypo
cgtctccacccaggccggacacagacatgagacaaaagtgcaccgaggcacgctctgccccgtgtttgacgagacctgctgcttccacgtgagtcagggatg

SEQ ID NO: 42951 - DNA, 30 bp, Homo sapiens
  chr11:1857873-1857903
  hypo
tgccctatgggccatcggaaagacaggcct

SEQ ID NO: 42952 - DNA, 30 bp, Homo sapiens
  chr11:1863098-1863128
  hypo
ccaccccaggctgcacggggctgtttggtg

SEQ ID NO: 42953 - DNA, 30 bp, Homo sapiens
  chr11:1867693-1867723
  hypo
acatggagatgagagcgcctgcctcactgg

SEQ ID NO: 42954 - DNA, 257 bp, Homo sapiens
  chr11:1868053-1868310
  hypo
catttgttcactgtccgtctcttcctctgggagggaaaatccacgaagtcagggacctggagttatttgcagctgtgtcagtgctgctggggcgaggcatacacctgtgacgggacctcaggacggggacacgggtctgcatgaggattgtctaacagtccctacaagacgctggggccaccatgtacactggagtcctctggcagccagtgttccccgttgtgcggggctggccgtgaccacgctggaaacccccc

SEQ ID NO: 42955 - DNA, 58 bp, Homo sapiens
  chr11:1935022-1935080
  hypo
cgttccagtcctagacgcctcaccccgcgctctgcggtgagcacgagctgtgcactgg

SEQ ID NO: 42956 - DNA, 30 bp, Homo sapiens
  chr11:1949952-1949982
  hypo
ccaccccggctgcaacgccctcttggtgga

SEQ ID NO: 42957 - DNA, 83 bp, Homo sapiens
  chr11:1955308-1955391
  hypo
aggccttccttctcccggggttcccattgtcattggccaatgatcagaaccactggctaaggccccggcgccctgcagaaccc

SEQ ID NO: 42958 - DNA, 158 bp, Homo sapiens
  chr11:1957372-1957530
  hypo
aagctagcccacagccgggcctcgatgccccagccgcccatccagccttgtaaccatcttggtctttctagatcatgaatgtccgggccagagtgcagatgctggccaagttgtaagtagccgggtccgccctgggccaggcccgtgggtgtgcgttg

SEQ ID NO: 42959 - DNA, 482 bp, Homo sapiens
  chr11:1957864-1958346
  hypo
ctccccagccccatccgtgctccgtaccccccgccccacatcctgccgcaggctgaaggtaagtggccagctacgggctgctgtgtgtggcagtccaggccagtacaggctggcgagagtaagtccaggcatgagcccaggggccacgggacggtgtccccctgcacaaggagccaggagacagtaagggagccgaggagccctcatgggggcccagcagccctgggtcgcgcagcccagcccaccctgcggtggagacaggccttcacccagtacacgcaggcctggccctcgggtcgtcgcagtgagtcactcatgttgttcacagatcaccacgctcaggagccgcattgaccaggcccagaagcagtgagtagccctgccgtcctcgctccgcactgggcacaggggcccttggggccagccgctgtagccagtccctaacaagggccggtggtggctggcctcggcagggcagtaac

SEQ ID NO: 42960 - DNA, 354 bp, Homo sapiens
  chr11:1958885-1959239
  hypo
ggctacttggagtttcgatgttttctgggattcttctccctcctcctgtcgccttggcttccctgcggcgcccagggcgggctcctccgtggtgcacgtgacctcacggcctccctgttgtgccgtcaggggtcattgcagacccctctgagggtgggcagtcggcgtggtgtgcatgtgcctgcgtgtgtgcatgtgtgcatgtgccgagagtgcccaggaacgtgtgtgagggcacggcctttgccagccaggtgtcctgctgagcagccgcgtctgaatggggccggcctcgcgggccgaagcactcctgtcctccacccgccttcacccctcacccgcacccagctcctc

SEQ ID NO: 42961 - DNA, 88 bp, Homo sapiens
  chr11:1959951-1960039
  hypo
tctgcatgggggccccggaggacacgagaggaggcaggtaggggctagccaatggcacagcgtcctggtcatccgcggggccagctca

SEQ ID NO: 42962 - DNA, 30 bp, Homo sapiens
  chr11:1976039-1976069
  hypo
cggcagcccccagggcgccctgggattcct

SEQ ID NO: 42963 - DNA, 335 bp, Homo sapiens
  chr11:1981002-1981337
  hypo
tctggacatcctcagcgtggcaggagtgggagagggaccctgacccaagagatagcaagtgggcccgcggccttgcctcggtcgcccccaacatgacagcccttcccctcgtggacatctccagctgggagcagggtcggggacagccagagacaaaggcaacaggacgagggagagagccgacagcgctgctccgtgtccccattcatgttcatttattgccatgcaggggtgatgcaaggcccaggcagtgccatgctgcgtgcatgggaaggggtggagggccctcgggaccgcaccgggctgtgctcatagctggacggccccacttctct

SEQ ID NO: 42964 - DNA, 133 bp, Homo sapiens
  chr11:2036968-2037101
  hypo
tctctcctgccactccgcaggagccacttctgcccatcccagaaccagccctcagggcaggcttggtgccaccgctgtgctgggtgtgcacgatgcccgtgggccgccggctcccctccgtgctaatgccacc

SEQ ID NO: 42965 - DNA, 160 bp, Homo sapiens
  chr11:2040029-2040189
  hypo
cctccagaggggccccgccacagtccatccccttcgcccaggtcccctcggatcagggcctgccagggtggtgtggcaaaggggcctgcatcgcgccaacctctcgcagctctccagcgggtgcagccaggctctggcccccacacgcttgggctttgct

SEQ ID NO: 42966 - DNA, 220 bp, Homo sapiens
  chr11:2042281-2042501
  hypo
taccattggctcctgcgtctggggcacccacgtcacacccttcatctgctcagtcagcccgaggcagctcccagcctcaggaaagcccagaagcaattggaagagtctgggggtgggaggcgcgaggacatcggacagacctggcgcggccgggcggtgcaggcctgcttcagccttctttggcctgggcttgaaggcaggcctgcgcctgaggggtctg

SEQ ID NO: 42967 - DNA, 71 bp, Homo sapiens
  chr11:2048987-2049058
  hypo
tctcgccactgcccacgccagcaccaaggcctgtcctctccaggcggtgccctcgccggtcctgctggctc

SEQ ID NO: 42968 - DNA, 30 bp, Homo sapiens
  chr11:2108079-2108109
  hypo
tgggcgtgggggagtcggagctgcctgtgc

SEQ ID NO: 42969 - DNA, 30 bp, Homo sapiens
  chr11:2110642-2110672
  hypo
tctgaacaccataaacgccaacacaaggtg

SEQ ID NO: 42970 - DNA, 30 bp, Homo sapiens
  chr11:2133297-2133327
  hypo
tgtctttgcactttgcgaatctctgtggct

SEQ ID NO: 42971 - DNA, 94 bp, Homo sapiens
  chr11:2151140-2151234
  hypo
cccaagcaacctggtcgatgggcagacctggcagctctcctgctctgtgggctcagacccgcctgacctccctactccccggcctcaccccacc

SEQ ID NO: 42972 - DNA, 30 bp, Homo sapiens
  chr11:2152412-2152442
  hypo
accccgcccaccctacgggtgtatcccaaa

SEQ ID NO: 42973 - DNA, 39 bp, Homo sapiens
  chr11:2156080-2156119
  hypo
tggggcccaaggaggcgcatgcaccgctcacccctgcca

SEQ ID NO: 42974 - DNA, 444 bp, Homo sapiens
  chr11:2209876-2210320
  hypo
tcggggagtagtacccggaacccacagagaacccctaaaacacaaccgccaaacaccagattcaaaagtgggcgaaggacgtagacgggcgcctctccagggaaggtgtatccaggacagcagccgcagggaaaggtgctcaatgccacgaatcattagggcaatgccaatcaaaatcacggcgcgacaggattccacacccgttagggtggccaccgtcaacaaacccaaacaatgcagaacacaaaatagcaagtgctcacgagaatgtggagaaatcagagcccctgcggtgggtcgtgccgcagggcagccgctgcggacagcaccctggcagctcccccgcgggttaaagaggcactacaggctgccgcaatcctgttcctacgtggatgcccagaagaaatgaaacctatgtccacccaggaacgtgtgtgtgactgc

SEQ ID NO: 42975 - DNA, 128 bp, Homo sapiens
  chr11:2224689-2224817
  hypo
tctgtcagctgcaggcgggtggcgggcggccgctctgataaggcctggtccctgcccctgtgcctctgtggggtgccggcacagcaagcctgggacctggccgccggcccctccgccaggtcaccggg

SEQ ID NO: 42976 - DNA, 30 bp, Homo sapiens
  chr11:2226048-2226078
  hypo
tgacatccagtcacacggagagggacttgg

SEQ ID NO: 42977 - DNA, 470 bp, Homo sapiens
  chr11:2278369-2278839
  hypo
ggaatccagccccagcgggcgggcggcagcagcagtgccggccctgcccagaacaggttcgacctgagccggcactgcccggctgccctggggctagggaggctgagacagagaagggaagccagagggtgggggtgggggcccggcactggcagagctgcctgccctcaacgaccgcccctgccggagacccccgccccacccgctgtggttctgctggcccaggtttcgctgggcccactcccagggtttggcatcactggagcccagggtcccccccgcaccctccccacagccttggccctgctgctgcctgcctcctccagggtaccccgaggcccacgtcaggagacccgcctcaggcagcagtggcccggtggctgcttctgcctagcccgcagcacgtgccaccctgggcgcactgccttcccgaaggctctcctccctccccggggcgctccctcccactc

SEQ ID NO: 42978 - DNA, 76 bp, Homo sapiens
  chr11:2289224-2289300
  hypo
aaaacccaaagctagcgagagggcagcctccaggcacctctcactaactcctcccagaggccgttgaggtgggtct

SEQ ID NO: 42979 - DNA, 35 bp, Homo sapiens
  chr11:2428079-2428114
  hypo
gcccaggcctggtcccggggcgaggtgggccaggc

SEQ ID NO: 42980 - DNA, 30 bp, Homo sapiens
  chr11:2435384-2435414
  hypo
agcagggcgaaggcgcgggcctcactgttg

SEQ ID NO: 42981 - DNA, 42 bp, Homo sapiens
  chr11:2436543-2436585
  hypo
aagagcaggctcttgcgtgacacggagcggtagagctcctgc

SEQ ID NO: 42982 - DNA, 207 bp, Homo sapiens
  chr11:2437991-2438198
  hypo
gtgtctgcctgccagcgtccagcccttcagcacgcgttcgtctccagcaaaaagcacatcaaatgctcatcaaaattttccatcagcgggtgaacagacgcatcaaccacggtctgtccacaggctggaacctgactccgccttacaaaaggaatgaagcatggaatggcatacgcttcaacacggaggaaccgtcaaaccctcccg

SEQ ID NO: 42983 - DNA, 44 bp, Homo sapiens
  chr11:2491365-2491409
  hypo
ttttttgtagagctggggtctggctatgtcgctgacaatcaaaa

SEQ ID NO: 42984 - DNA, 135 bp, Homo sapiens
  chr11:2541224-2541359
  hypo
caggacgcgggagcccgcagaggctggaaggctgaaaagggccctgtcgcccccaccccccaggatgacgtatggcctgatgtggcattcctgcctcaggaccatggcaccaagtggtggcgctggggcccctgg

SEQ ID NO: 42985 - DNA, 167 bp, Homo sapiens
  chr11:2543288-2543455
  hypo
atgttgaaatgatgtcggataattcaccgggtgccttcggggctggtactcgccgtcactgctcctgaggcctatttgctgtcaaggggaacaagtaggaggttgttttctggggtgcggtgggctccccgctcatgcagctccccgccccccgcatgaccacgccc

SEQ ID NO: 42986 - DNA, 207 bp, Homo sapiens
  chr11:2596517-2596724
  hypo
ctgcagcccgagcctcggccatcgcgcgccctggcctggccattgttcccgccaggccccgcgcccctggtcgccctgggccccccaccgcccagggctgtggggcaaacagctcccattcagctgccctgcagctgtctggggggagcggcccctgaggcctgagttatgggctgtgttcctggcatttctcggacaaacagaact

SEQ ID NO: 42987 - DNA, 213 bp, Homo sapiens
  chr11:2753802-2754015
  hypo
gcgagcgaaggggcccgaggcaccggtgcttccgacggggcccgagggccgtctgacctttccggccacggggcagcagttgcgtgagcaggaacaatcgccccagtgtgcaaggcacaagcggccttttcttcctcaccgggccggcgcacacagctcccagcctggcttcccttgaacaaacatatttattgtggccgccaccgaggcctc

SEQ ID NO: 42988 - DNA, 30 bp, Homo sapiens
  chr11:2770653-2770683
  hypo
gtgtgaccctgggcacgctgctgagcctct

SEQ ID NO: 42989 - DNA, 178 bp, Homo sapiens
  chr11:2818207-2818385
  hypo
aggcgaaattagatccgtggggagagattttacaacgtatgggctggtggcaagtggcggcaaaccgtccccacggggccacaacggggcattgttcacggcctcacctgggctgtctccagcaccccaggatttacgaggactcggcccagagcctcgatgccggccgctccgggca

SEQ ID NO: 42990 - DNA, 30 bp, Homo sapiens; identical to SEQ ID NO: 15520
  chr11:2829204-2829234
  hypo

SEQ ID NO: 42991 - DNA, 30 bp, Homo sapiens
  chr11:2933495-2933525
  hypo
cccacacctccccctcgggggctcaccgaa

SEQ ID NO: 42992 - DNA, 30 bp, Homo sapiens
  chr11:3150813-3150843
  hypo
catggagaagatgcacgggggtgagaccag

SEQ ID NO: 42993 - DNA, 381 bp, Homo sapiens
  chr11:3164562-3164943
  hypo
gtgggcgaaaacgcacggacgcgacacacccaagagaaacaagcacacgcccccaggtggtccgcgcacgcacgctcccagcagcatggctcagggccatcagagagcggacacagccagacatccacatgggtgaacggataaacatggatcacatctgtgcaacggatggaagaacattcggccttcaggaggcaggaagcacggcactcacacatgcgacgacacggatgagccgcagagatgcaccaagtcaaagaagccagataccaaaggccacatcttgtccgcttccacgcccacgcagtgtccaggacgggcaggtctggacacggaacgcagactggtgcttgccagggcccggcccggttctgtcccggt

SEQ ID NO: 42994 - DNA, 82 bp, Homo sapiens
  chr11:3169805-3169887
  hypo
gcagggcgggggcaccgtcctctgcacttttgtacatctttgacattttctatcatacgaagccaaacgggagaggacacag

SEQ ID NO: 42995 - DNA, 48 bp, Homo sapiens
  chr11:3187905-3187953
  hypo
ggtgggaccctgctccgcgtggcctgtggcaggcggcctctgcctctg

SEQ ID NO: 42996 - DNA, 162 bp, Homo sapiens
  chr11:3249641-3249803
  hypo
aggctgggaagagggcggccaggcactgctccacgctgacggccgccaggagactcaggcccacgatgtagcagaagaagcgcagcgttgccaggctggtctgcacgaagcccgggaagtccagccggccttgcagcaagtcggggacgatggccaccatgt

SEQ ID NO: 42997 - DNA, 30 bp, Homo sapiens
  chr11:3398724-3398754
  hypo
gggcagaaatgatttcggtcttttccctct

SEQ ID NO: 42998 - DNA, 93 bp, Homo sapiens
  chr11:3697398-3697491
  hypo
ccaacagccagttctcgcagataggactgggtaaggctgcgcagttcgtccatggcatagtcctcaggcatgggaagccggccaatgtgggga

SEQ ID NO: 42999 - DNA, 30 bp, Homo sapiens
  chr11:3766731-3766761
  hypo
tttagaagtgtaaaacggggaagaatatgg

SEQ ID NO: 43000 - DNA, 159 bp, Homo sapiens
  chr11:3828803-3828962
  hypo
ctgggattacaggcgtgagctaccgcgcctggccctcacagggtttttatgaggattaaataaatgagataagaagtaagagtgcctgggatatactgggtgttcagaatgtgttattgctgtgaggatttaagtggaaaagtgcgatgttaggtatgg

SEQ ID NO: 43001 - DNA, 21 bp, Homo sapiens
  chr11:4785810-4785831
  hypo
gaatactgggcagggcgcagt

SEQ ID NO: 43002 - DNA, 26 bp, Homo sapiens
  chr11:5169023-5169049
  hypo
tttttttttttttttcggagacagag

SEQ ID NO: 43003 - DNA, 27 bp, Homo sapiens
  chr11:5177841-5177868
  hypo
agccactgcacccggcctactgaatat

SEQ ID NO: 43004 - DNA, 159 bp, Homo sapiens; identical to SEQ ID NO: 15524
  chr11:5192016-5192175
  hypo

SEQ ID NO: 43005 - DNA, 30 bp, Homo sapiens
  chr11:5192457-5192487
  hypo
ttctgcctccagtcccgggatgccaacgag

SEQ ID NO: 43006 - DNA, 83 bp, Homo sapiens
  chr11:5330681-5330764
  hypo
catacagaaaacttgcgcctacacctatttttttaagcattccatagattggatctcatttctctccacatttttatgtcttc

SEQ ID NO: 43007 - DNA, 104 bp, Homo sapiens
  chr11:6257172-6257276
  hypo
aaaaaaaaagaaaagaaaaaaagaaaagtattttgccaatgttaaatacctggtttttatcattgtgctatagttatgtaagatcataacgttaggggaagatg

SEQ ID NO: 43008 - DNA, 82 bp, Homo sapiens
  chr11:6497227-6497309
  hypo
ctttcaaactgacatccccatttccaccccagtccatgccagatgcccctcctttgtgctcccacagcgccctctgtacttc

SEQ ID NO: 43009 - DNA, 30 bp, Homo sapiens; identical to SEQ ID NO: 15526
  chr11:6731043-6731073
  hypo

SEQ ID NO: 43010 - DNA, 30 bp, Homo sapiens
  chr11:7439190-7439220
  hypo
cctatgtgaaagtctcgctgatgtgtgatg

SEQ ID NO: 43011 - DNA, 157 bp, Homo sapiens
  chr11:9405392-9405549
  hypo
tggtaattactaatacgtaatgtgataaaaacctttcacacataaagttcatttaatcttccgtgttattgccttaggataaagtctcataagtggaattactgggtcagagtttaaacatttcgtttcgttttgtttttttgagacggagtttcgc

SEQ ID NO: 43012 - DNA, 37 bp, Homo sapiens
  chr11:9405789-9405826
  hypo
tacaggcgtgaaccaccgcgcccggcagtttaaatat

SEQ ID NO: 43013 - DNA, 30 bp, Homo sapiens
  chr11:9830639-9830669
  hypo
gacttagggataaagcgcttgcacaaaaga

SEQ ID NO: 43014 - DNA, 30 bp, Homo sapiens
  chr11:10509593-10509623
  hypo
tggttttgcatccttcgggatcatgtggat

SEQ ID NO: 43015 - DNA, 40 bp, Homo sapiens
  chr11:10815867-10815907
  hypo
acatttgaagctgggcgcggtagctcacgcctgtaattcc

SEQ ID NO: 43016 - DNA, 100 bp, Homo sapiens
  chr11:10865202-10865302
  hypo
gagtcttgaaatgactgcagctcttgctaacaccttcatcgcagccagtgagagactctgaagctaagctccacctgattcctgacgtatagcaactgtg

SEQ ID NO: 43017 - DNA, 30 bp, Homo sapiens
  chr11:12288561-12288591
  hypo
ttgggaactagacagcggtctcgattcaca

SEQ ID NO: 43018 - DNA, 18 bp, Homo sapiens
  chr11:13691880-13691898
  hypo
gctggagtgcagtgacgc

SEQ ID NO: 43019 - DNA, 23 bp, Homo sapiens
  chr11:14558164-14558187
  hypo
tttttatttttgagacggagtct

SEQ ID NO: 43020 - DNA, 42 bp, Homo sapiens
  chr11:14564357-14564399
  hypo
atctttgcaggttggcgaagctaatggattccttctcagaat

SEQ ID NO: 43021 - DNA, 84 bp, Homo sapiens
  chr11:15084438-15084522
  hypo
gtgggacacccaatgcgtgcctgtgaagcagagggcctagtctgggaattgtgccatgctatggcatatcgggggaacctgccc

SEQ ID NO: 43022 - DNA, 23 bp, Homo sapiens
  chr11:16255262-16255285
  hypo
aacataaaacaggcccggtgcgg

SEQ ID NO: 43023 - DNA, 108 bp, Homo sapiens
  chr11:16988399-16988507
  hypo
ctgaattcaggccaccgtttctactgccaccaccttcactgggctatctcacagcaagaagagctgccccagccttgtggcttcatgaagtggcgaaatggttcatct

SEQ ID NO: 43024 - DNA, 16 bp, Homo sapiens
  chr11:17037317-17037333
  hypo
ccgagatcgcgccgct

SEQ ID NO: 43025 - DNA, 154 bp, Homo sapiens
  chr11:17100671-17100825
  hypo
aaatcaaactcctgtcgacaagcttaaagtaactggcaagacgctgggaaactagatactgaaacatccgctcttaacttttaacctgtcactatttgaaataaagttatcagggatagccgggcgcggtggctcacgcctgtaatcccagcac

SEQ ID NO: 43026 - DNA, 33 bp, Homo sapiens
  chr11:17566248-17566281
  hypo
tacacgggcggggggcggggcaatctagtccgt

SEQ ID NO: 43027 - DNA, 97 bp, Homo sapiens
  chr11:17633812-17633909
  hypo
tgggatcctgggcctcgccgtgcgggtgggtggggaccgctgctgcccactctgggagtgtgcctgtgagtcatgggatcagcggagcctcctgcat

SEQ ID NO: 43028 - DNA, 44 bp, Homo sapiens
  chr11:17784927-17784971
  hypo
ccctgggttgagtctcggctcagagaacacgtgcccagagtgcc

SEQ ID NO: 43029 - DNA, 43 bp, Homo sapiens
  chr11:18656839-18656882
  hypo
acatgtactaaaaatcgtacacttaagacgggtgagaatgata

SEQ ID NO: 43030 - DNA, 30 bp, Homo sapiens
  chr11:18950570-18950600
  hypo
ctatgcttttattaacggtgccactgtaaa

SEQ ID NO: 43031 - DNA, 179 bp, Homo sapiens
  chr11:19567961-19568140
  hypo
gaggctgagctgctgcgggaaggtaggaaacagcctggcagctgggcagtgcggccacctccactgcccctttgcagaatcctcagctttccaaagccacctgcagggtggggcggcttcatgaagaatggagggctgtgtacagaaggaaggactggtcaccacggcaaccaccctct

SEQ ID NO: 43032 - DNA, 30 bp, Homo sapiens
  chr11:23326534-23326564
  hypo
agctgcctgcatgtgcggtggcctgctggc

SEQ ID NO: 43033 - DNA, 138 bp, Homo sapiens
  chr11:27495243-27495381
  hypo
gcctaatagaccccacggaatcattacctgtaccaactacggctttaagggtacttcgtttcttgctctctgccatggcgttgagtcgttttactctataatggagacatttttaatgaatacattaaaacaagcagg

SEQ ID NO: 43034 - DNA, 210 bp, Homo sapiens
  chr11:32728943-32729153
  hypo
taaccactatagatacgtgttgtgctttctatactgtccctttagatcaagatagtcaacacctatttgttttttcctgggaaagtcaaaaatttacctggatagtgatgcgtcagggatttactgaggaacctcaaggatattaaatttccttgtaacactacacttgcataatatggggacaagttttttcgacgttctaaagatgtg

SEQ ID NO: 43035 - DNA, 17 bp, Homo sapiens
  chr11:32859995-32860012
  hypo
tccggaaaaaaaaaaaa

SEQ ID NO: 43036 - DNA, 37 bp, Homo sapiens
  chr11:32935022-32935059
  hypo
gctaccgcacccggtctttcctcgtccttttaatact

SEQ ID NO: 43037 - DNA, 104 bp, Homo sapiens
  chr11:33181185-33181289
  hypo
gcgcgcgcctgtactcccagctacggaggaggctgaggtggcaggatcacagagcgcagggaggtcgaagctatggtgagctgtgatggcgtcacagcactcta

SEQ ID NO: 43038 - DNA, 29 bp, Homo sapiens
  chr11:33202774-33202803
  hypo
acacctgtaattagccgggtgtggtggtg

SEQ ID NO: 43039 - DNA, 15 bp, Homo sapiens
  chr11:33262877-33262892
  hypo
cgcaaagaaattaat

SEQ ID NO: 43040 - DNA, 224 bp, Homo sapiens
  chr11:33269863-33270087
  hypo
tagaggcctgaaccacggtgcccggcctgttctgaaagttttaaaggcacagctatcttcaacgttcatccactctggcgccctgggaacagttccttacattatgtcctctagaagagctggactaacacatatgcaggataggttatgatgcggtacgagaattgaacttcaacccgggaggcggaagttgcagtgagctgagatagcgccactgcactcaa

SEQ ID NO: 43041 - DNA, 37 bp, Homo sapiens
  chr11:33277673-33277710
  hypo
ggattacatgtgcgagccaccgcgcccggcctccttt

SEQ ID NO: 43042 - DNA, 32 bp, Homo sapiens
  chr11:33874352-33874384
  hypo
tccaagaagaatgaggtcgcacagatacttga

SEQ ID NO: 43043 - DNA, 33 bp, Homo sapiens
  chr11:33880993-33881026
  hypo
aatgcttctgacaggcggcgcatttgaaacatt

SEQ ID NO: 43044 - DNA, 23 bp, Homo sapiens
  chr11:33951225-33951248
  hypo
gggcacggtggctcacgcctgta

SEQ ID NO: 43045 - DNA, 30 bp, Homo sapiens
  chr11:33976661-33976691
  hypo
gcacaggctcagtgccgacagatctttctg

SEQ ID NO: 43046 - DNA, 30 bp, Homo sapiens
  chr11:33993944-33993974
  hypo
ttttaagttttctgccgtaaacatacagca

SEQ ID NO: 43047 - DNA, 30 bp, Homo sapiens
  chr11:34517691-34517721
  hypo
aaggattcggagaaacgcccaggcggggag

SEQ ID NO: 43048 - DNA, 30 bp, Homo sapiens; identical to SEQ ID NO: 15538
  chr11:34534277-34534307
  hypo

SEQ ID NO: 43049 - DNA, 195 bp, Homo sapiens
  chr11:34535053-34535248
  hypo
gcaagccgtcacatccgtgtcaaacagctcccggaggccctgggactgcacccagcgcaggtgccggccctggagctggagatggacgagcagacccaggccccaggccgagcctctgagccctgacaccccttacgattcatccaaaaaagcaaagaaaaggcgcttacgtgagggcagcggtggctaggtcca

SEQ ID NO: 43050 - DNA, 30 bp, Homo sapiens
  chr11:34536053-34536083
  hypo
gccatcttgggcagccgagatgttgtattc

SEQ ID NO: 43051 - DNA, 20 bp, Homo sapiens
  chr11:34577250-34577270
  hypo
aactcaaatctgaagcgtcc

SEQ ID NO: 43052 - DNA, 166 bp, Homo sapiens
  chr11:35134173-35134339
  hypo
gcggggggcggggggcggaggggggtgagcaacccgtttcaggtttcttccaaaaagacgtgtgcaggaggctagctgaacttagccacagtttcagagatgcatagaaatgaaactactggaagcatttggcttcagttaaacttggggccgagcagagccaaga

SEQ ID NO: 43053 - DNA, 290 bp, Homo sapiens
  chr11:35684922-35685212
  hypo
gagggagatagaaagcgaggcaggggaagagagtgagtcggaggaagagagcgagtcagaggaagagagcgagacagaggaagagagtgaggatgagagcgatgaggagagtgaagaagacagcgaggaagaaatggaggatgagcaagaaagcgaggccgaagaagacaaccaagaagaaggggaatccgaggcggagggagaaactgaggcagaaagtgaatttgacccagaaatagaaatggaagcagagagagtggccaagaggaagtgtccggaccatgggcttg

SEQ ID NO: 43054 - DNA, 98 bp, Homo sapiens
  chr11:36687119-36687217
  hypo
gtcaacccaatcccctgaggcctatgtaaatcagtcaccgccccctcaactttctgtacaaaccaattgcagtccgccacaaacgaggccctcttcca

SEQ ID NO: 43055 - DNA, 36 bp, Homo sapiens
  chr11:43544024-43544060
  hypo
gccttgggagtggtccgcatccgtgggtagacgctg

SEQ ID NO: 43056 - DNA, 83 bp, Homo sapiens; identical to SEQ ID NO: 15542
  chr11:44922891-44922974
  hypo

SEQ ID NO: 43057 - DNA, 33 bp, Homo sapiens
  chr11:46298483-46298516
  hypo
ttacaagctgaaaatcggctgggcatggtggct

SEQ ID NO: 43058 - DNA, 30 bp, Homo sapiens
  chr11:46405775-46405805
  hypo
actgtcatggaaacccgagtgagccaccag

SEQ ID NO: 43059 - DNA, 17 bp, Homo sapiens
  chr11:46614283-46614300
  hypo
ggcgacagagctagcct

SEQ ID NO: 43060 - DNA, 30 bp, Homo sapiens
  chr11:46774904-46774934
  hypo
aagaggttcacagagcggatgacctgttgt

SEQ ID NO: 43061 - DNA, 19 bp, Homo sapiens
  chr11:46777041-46777060
  hypo
ccaccgcacctggccccat

SEQ ID NO: 43062 - DNA, 30 bp, Homo sapiens
  chr11:46916192-46916222
  hypo
ttggcacggaggatccggtccagggtgaca

SEQ ID NO: 43063 - DNA, 266 bp, Homo sapiens
  chr11:47358971-47359237
  hypo
tgggcctggacatgccgatggcgttgaccgcgtagacgcgcatctcgtacaccacgccctcgatcatgcgccgcgcttcatgactcagctcctgaatcaggtcgaagttcagccgcatccaccggtagctcttcttcttcttgcgctccaggatgtagcctggctcaggggaggtggcagctctggtctggaacccaggcatccccacaccaccttccctcggatctgtttggcgccctcacacctccatccggtgcccttgcact

SEQ ID NO: 43064 - DNA, 65 bp, Homo sapiens
  chr11:47367760-47367825
  hypo
tgctcttcttctcatcgcgcctcatgcccttgagcctctttagcatgccgcgcaggtcagtgacg

SEQ ID NO: 43065 - DNA, 56 bp, Homo sapiens
  chr11:47599259-47599315
  hypo
gctggaaaacagactcgctgacatcctgcagcacaatcacccggttgtgggcctcc

SEQ ID NO: 43066 - DNA, 35 bp, Homo sapiens
  chr11:49212608-49212643
  hypo
cctgaggtcaggaggcgcgatctcggctcactgca

SEQ ID NO: 43067 - DNA, 30 bp, Homo sapiens
  chr11:50205839-50205869
  hypo
atcgatgagctggcacggaagctggaggga

SEQ ID NO: 43068 - DNA, 156 bp, Homo sapiens
  chr11:50256725-50256881
  hypo
cctcccgtgcttgatcgcttatataatctctgctcactgtaatctcaacctcccgggctggattccatatatataaatacatacatatatttgtttgtttagacgttatctcagtctgtccaacaggctggagtgcagtggcgcgatctcggccca

SEQ ID NO: 43069 - DNA, 35 bp, Homo sapiens
  chr11:55743005-55743040
  hypo
attacaggcgtgagccaccgcgcccggcccaggat

SEQ ID NO: 43070 - DNA, 30 bp, Homo sapiens; identical to SEQ ID NO: 15545
  chr11:57150498-57150528
  hypo

SEQ ID NO: 43071 - DNA, 203 bp, Homo sapiens
  chr11:57235255-57235458
  hypo
acaacctcatccgcacgctgcggccaggcacctttgggtccaacctgctcaccctgtggctcttctccaacaacctctccaccatctacccgggcactttccgccacttgcaagccctggaggagctggacctcggtgacaaccggcacctgcgctcgctggagcccgacaccttccagggcctggagcggctgcagtcgctg

SEQ ID NO: 43072 - DNA, 30 bp, Homo sapiens
  chr11:57311435-57311465
  hypo
tcctgcttccctcagcgtccaccatcaact

SEQ ID NO: 43073 - DNA, 37 bp, Homo sapiens
  chr11:57423900-57423937
  hypo
aaatgtttactattattataaccggactcagaaactc

SEQ ID NO: 43074 - DNA, 36 bp, Homo sapiens
  chr11:57437198-57437234
  hypo
gggattacaggcgtgagcccccgtgcccagctggca

SEQ ID NO: 43075 - DNA, 31 bp, Homo sapiens
  chr11:57500991-57501022
  hypo
gtgctgcgattacaggcgtgagtcaccgcgc

SEQ ID NO: 43076 - DNA, 41 bp, Homo sapiens
  chr11:57548681-57548722
  hypo
tacaggcgtgagcaaccgcacctggccgagaagctgctatt

SEQ ID NO: 43077 - DNA, 16 bp, Homo sapiens
  chr11:58821650-58821666
  hypo
gcgtggcctcctattc

SEQ ID NO: 43078 - DNA, 139 bp, Homo sapiens
  chr11:58835182-58835321
  hypo
actttatctctgtatcgcttaggaggagttatttaattcactttagactttgttaagttaaatattaatgttaaaatgcccagggctattttgttcaagacagttgccactaatcacgtgatttttttttttttttttt

SEQ ID NO: 43079 - DNA, 30 bp, Homo sapiens; identical to SEQ ID NO: 15547
  chr11:59312651-59312681
  hypo

SEQ ID NO: 43080 - DNA, 19 bp, Homo sapiens
  chr11:59328895-59328914
  hypo
accttaaaggctgggcgcg

SEQ ID NO: 43081 - DNA, 138 bp, Homo sapiens
  chr11:59329214-59329352
  hypo
agaaaggacctcgggtctccagggacagcaaattgtgggaaagcaaatatatgggaaattaatgttagataaaggcaggttcctaaagcttgttaaatgtacttctgtggtcccctctgttcacgtctccaagctgtt

SEQ ID NO: 43082 - DNA, 30 bp, Homo sapiens; identical to SEQ ID NO: 15548
  chr11:59609810-59609840
  hypo

SEQ ID NO: 43083 - DNA, 170 bp, Homo sapiens
  chr11:59807961-59808131
  hypo
tgtcttgatttggaccggtgctgagaacctccatggtaaataacaagttttagagaatgcttcctcgaaggagttaatcataatgatcgctttccatgcaggtgttttactccctgaagaaatctgatcttattctaactggctagaagaagaagcgctttcaggccaag

SEQ ID NO: 43084 - DNA, 120 bp, Homo sapiens
  chr11:59841396-59841516
  hypo
ggaaagagagggagagagagaccgtggggagcggcagcgggagcaggagcgggagagggagagggagagggcagcactatgagttttaagaagcaattgaaaatgtatgcaggttccagg

SEQ ID NO: 43085 - DNA, 30 bp, Homo sapiens
  chr11:60282848-60282878
  hypo
gttgccattgcagaccgtcactccctgagg

SEQ ID NO: 43086 - DNA, 33 bp, Homo sapiens
  chr11:60409097-60409130
  hypo
aattagaatacatggcggggcacggtggctcac

SEQ ID NO: 43087 - DNA, 30 bp, Homo sapiens
  chr11:60892552-60892582
  hypo
ccccacagcctcccacgtggataacgaata

SEQ ID NO: 43088 - DNA, 47 bp, Homo sapiens
  chr11:60897862-60897909
  hypo
catttggtaaagaaccggcagcgctgacctagcgtcacgcggatggc

SEQ ID NO: 43089 - DNA, 171 bp, Homo sapiens; identical to SEQ ID NO: 5117
  chr11:60941596-60941767
  hypo

SEQ ID NO: 43090 - DNA, 335 bp, Homo sapiens
  chr11:61038940-61039275
  hypo
actgccaagcaccatcgtcctcacacatctactgagagcaggataaactcggtccaaccctttttgtgaaagtggaacttgacagcaccggagggagactgcggccagcctgaggccagcctctggaggggccaggacgcttgtctcctctgggtgaggcggggcagccaggtaaagcagctgaaggcgagcaggttgtcattcacctggcagatgcataactcacaggggtcaccaggcgaccagatctgtccaatcggaaactcaaccccgttgtcgtcaagagagcagcctggatgaggacaatggcagagaaaagacggcacaagacctag

SEQ ID NO: 43091 - DNA, 124 bp, Homo sapiens
  chr11:61049497-61049621
  hypo
ggtccatgcctgccccgaggtgcgggatgtgactcagacagctgggagcggggctgaaatctagtgcttgtcttgttaataggttcacacatcgagcaggtatttaatgcgagtatcagagact

SEQ ID NO: 43092 - DNA, 129 bp, Homo sapiens
  chr11:61058212-61058341
  hypo
aggagatataattcccgctgtccccctccccctcccccaccactcccaggcgtctcacctgtacacctgatgccaacagctgtctccgtcatcgagaagcccacggggcacactcgggccacctcctga

SEQ ID NO: 43093 - DNA, 89 bp, Homo sapiens
  chr11:61058795-61058884
  hypo
tgccactcccacagccgaaggagcagagggctgagaggagaagtgcaggtgagacacgaggaactggggcctcccgtctgcccctcgga

SEQ ID NO: 43094 - DNA, 30 bp, Homo sapiens
  chr11:61633635-61633665
  hypo
cttcactctccctgacggctgccattggtc

SEQ ID NO: 43095 - DNA, 81 bp, Homo sapiens
  chr11:61641410-61641491
  hypo
catggtaagtgtgagcggagatccccattccctgtgggttcccttccctgggggcaggcagcgatgcgggctggagggtgg

SEQ ID NO: 43096 - DNA, 454 bp, Homo sapiens
  chr11:61664512-61664966
  hypo
gcaggccaccagccacggggagagggaggcctggctcatcccccagtaacccacagccctctgaatactaagggaggactcaaatagtcctccccacagcaagtaagtggtgatggcggaggtggggtggcttcaggatttgggtttaatcccaagcacgagggcgggcagggaaaggatttggtttcattccttcagatgcccaagccttggccagagccccagggtgcaggagtgagggcgcgtggccacccagcctgtaccaacaaagcctgcctttattaaatagagatcgcgttacattccatccaaagaaggaaatccggacgtggtgagggatgcgtccaggtgggagctccgaacgctggtcctgagtgggctctgatgggtgggagggcccaggtcctgcctgcccacccaggccccacatgccagggcgcgtgtctgcatggcc

SEQ ID NO: 43097 - DNA, 59 bp, Homo sapiens
  chr11:61665728-61665787
  hypo
ccttcaggcctgggccgcgccctaagcctcctgggggaagaagccgagcttggccagtg

SEQ ID NO: 43098 - DNA, 48 bp, Homo sapiens
  chr11:61666088-61666136
  hypo
agacaagcaggtacacgctgtcacatgccacagcggtggtccagacct

SEQ ID NO: 43099 - DNA, 134 bp, Homo sapiens
  chr11:61669877-61670011
  hypo
aaaggagtcaagtaacgcttgcaaaggctgactcaccctggcccgggaagatggcgagatgtagtaatggcttttggagtccccgagccggattcggtggcggcaggtgcgggtcagcccgctcagggcacatg

SEQ ID NO: 43100 - DNA, 87 bp, Homo sapiens
  chr11:61675013-61675100
  hypo
gttcccgcgcccagccggtgtacctcaaacaggctggccgtcagctcttccagctcctgttctagctgctcccgcaccttggacagc

SEQ ID NO: 43101 - DNA, 23 bp, Homo sapiens
  chr11:61736670-61736693
  hypo
ttgcctggggctgggcgcggtgg

SEQ ID NO: 43102 - DNA, 82 bp, Homo sapiens
  chr11:61736993-61737075
  hypo
aatgttggcctggaaagtacagtttatgttgggggatgctggttagggtggagaataggggcaagatcgggcagggttgtgt

SEQ ID NO: 43103 - DNA, 30 bp, Homo sapiens
  chr11:61784772-61784802
  hypo
ctacaatttcccagacggatgattcattcc

SEQ ID NO: 43104 - DNA, 228 bp, Homo sapiens
  chr11:62370522-62370750
  hypo
tggactctcacccaacgacacacgcccagcgttccaagcccaaactgggctccaccttgtcccccacccttccagcaggtttccacgcccctgctcaccgtagacgtgaaagcccagcacacaggtgtaggtagcccattcccggtctcggctctcatagcgattcttcagctgcttgcagcctccagccacgtcccctggggagagggagcccgcccagctcagctc

SEQ ID NO: 43105 - DNA, 95 bp, Homo sapiens
  chr11:62421710-62421805
  hypo
aactcaggactttaaaaaaatgaagcataggaaggtttttttgttggtgttgttgttgttattgttgtttattttgtgaccgtgcagtgatagga

SEQ ID NO: 43106 - DNA, 30 bp, Homo sapiens
  chr11:62440622-62440652
  hypo
acttccagggataaccgtgggacattcttg

SEQ ID NO: 43107 - DNA, 60 bp, Homo sapiens
  chr11:62445431-62445491
  hypo
ctctcctcagcagcccggcgcatctcatcttcctgtagccgctgtcgtgctgctgacaac

SEQ ID NO: 43108 - DNA, 46 bp, Homo sapiens
  chr11:63572099-63572145
  hypo
tttatgtcctgggtccggttattcctaaagtcggcctgtatccctg

SEQ ID NO: 43109 - DNA, 44 bp, Homo sapiens
  chr11:63609969-63610013
  hypo
gccgggcctgattcctgtattctttaaaacgggaaaaaagacaa

SEQ ID NO: 43110 - DNA, 102 bp, Homo sapiens
  chr11:63779116-63779218
  hypo
atcagggctgcgggacgaagacatggagcagggcagtgcatcagggttctgggcagagtggccagggcaggcaggatggcccttgtgcgtgttcgaacaatg

SEQ ID NO: 43111 - DNA, 30 bp, Homo sapiens
  chr11:63780950-63780980
  hypo
ggaggccagggtggccggagcaaagtggag

SEQ ID NO: 43112 - DNA, 82 bp, Homo sapiens
  chr11:63783734-63783816
  hypo
cctgggctccagccccgatccgcagcctgcgtccgtggtaactgccagagctcatcagggaaagcagcgggtgaggccaggc

SEQ ID NO: 43113 - DNA, 233 bp, Homo sapiens
  chr11:63849387-63849620
  hypo
tggactcccggctctcgagtgccgcgttctacctgctgtgttctaaatggacatgccatccccacagctgtgtcaataaagcagccatttacagagcgggcgccggatcccgtgacaggttgaaaagtgtgtgagctgcagcgtcctgggctggggcagaggggccgtggcgagaacagatggggctgtgcccatctccccaggccctcctgtggctgcgcctggagcctccc

SEQ ID NO: 43114 - DNA, 79 bp, Homo sapiens
  chr11:63955145-63955224
  hypo
atttctggaataagacgttgctcttttacctttaagaaaggatctggggccgggcaccgtggctcagcctgtaatccca

SEQ ID NO: 43115 - DNA, 47 bp, Homo sapiens
  chr11:63978814-63978861
  hypo
taccacatgctgagccggccccagccgccacccgaccccctcctgct

SEQ ID NO: 43116 - DNA, 30 bp, Homo sapiens
  chr11:64042980-64043010
  hypo
aggaaagccccctaccggcccctcatagcc

SEQ ID NO: 43117 - DNA, 30 bp, Homo sapiens
  chr11:64054355-64054385
  hypo
aaccaactgtggtcccgggtggggggcggg

SEQ ID NO: 43118 - DNA, 77 bp, Homo sapiens
  chr11:64105954-64106031
  hypo
cataaaacagccaggcgctcttaagccagctttacaattgtgcagatgaagtggagccgagttttcactctgctcta

SEQ ID NO: 43119 - DNA, 38 bp, Homo sapiens
  chr11:64120222-64120260
  hypo
cagctgcaggcccagcgggccagcgtggaggcacagga

SEQ ID NO: 43120 - DNA, 30 bp, Homo sapiens
  chr11:64120879-64120909
  hypo
gttcaggccctgagccgggagaacagggag

SEQ ID NO: 43121 - DNA, 54 bp, Homo sapiens
  chr11:64124704-64124758
  hypo
ctccacggtcagcgccggggcccggagatggagctgggacgagtgtgtggacag

SEQ ID NO: 43122 - DNA, 30 bp, Homo sapiens
  chr11:64292470-64292500
  hypo
acccgaggaagaggtcgtggggacctctta

SEQ ID NO: 43123 - DNA, 82 bp, Homo sapiens
  chr11:64488590-64488672
  hypo
gaggtgtattgtgtacgcaggtgtgtgtgcctgtgtaggtgtgtgtctgggtgggtgccaccgagcgcgtgtatcattgtca

SEQ ID NO: 43124 - DNA, 30 bp, Homo sapiens
  chr11:64507459-64507489
  hypo
tgaccccccagccctcgggccgcaccagga

SEQ ID NO: 43125 - DNA, 30 bp, Homo sapiens
  chr11:64572043-64572073
  hypo
ccaccttcagggcctcgggctgtgccagcg

SEQ ID NO: 43126 - DNA, 23 bp, Homo sapiens
  chr11:64578577-64578600
  hypo
gtttgttttgagacacggtcttt

SEQ ID NO: 43127 - DNA, 30 bp, Homo sapiens
  chr11:64610130-64610160
  hypo
ttgtctggtcaagaacgtcctctttcctca

SEQ ID NO: 43128 - DNA, 87 bp, Homo sapiens
  chr11:64667987-64668074
  hypo
aggacatggtgctgccgcccgctgcccccctgcgtgcgccatgagttctggggccggttggggccagagcagcgggaaggggagctc

SEQ ID NO: 43129 - DNA, 96 bp, Homo sapiens
  chr11:64669480-64669576
  hypo
ccagggtgtctccatcgccctcctcttccctttcatcttccttctcctctgagcatgaccctaagctgccagcagggcccccgacaggtggtgaag

SEQ ID NO: 43130 - DNA, 24 bp, Homo sapiens
  chr11:64809584-64809608
  hypo
tttttttttgagtctcgctctgtc

SEQ ID NO: 43131 - DNA, 24 bp, Homo sapiens
  chr11:64809848-64809872
  hypo
gagccaccgcgcccggctgatttt

SEQ ID NO: 43132 - DNA, 30 bp, Homo sapiens
  chr11:64878823-64878853
  hypo
agatcagcctgaagacgctgctggagtgtg

SEQ ID NO: 43133 - DNA, 142 bp, Homo sapiens
  chr11:64883942-64884084
  hypo
ttggggcaggtggcacggggcctccccaaagccgctccagctccccagtgagggcggccacctcctcggctaccacagcatgggcttggtgagccctggcgcagtctagggccaggggtgtgagggccgcctcattttcgtt

SEQ ID NO: 43134 - DNA, 44 bp, Homo sapiens
  chr11:64903259-64903303
  hypo
ttccccgtaaggccacgtataactttttttcccccttttctttt

SEQ ID NO: 43135 - DNA, 44 bp, Homo sapiens
  chr11:64903423-64903467
  hypo
tcagccccacaaggtgttgggattacaggcgtgagccacaacac

SEQ ID NO: 43136 - DNA, 36 bp, Homo sapiens
  chr11:64950292-64950328
  hypo
gattatgagcagctgcgggtgcgatgcctgcagagt

SEQ ID NO: 43137 - DNA, 102 bp, Homo sapiens
  chr11:64951749-64951851
  hypo
tcggaacccagggtgcggaacccacagtgcggatccactttggcccagcgccacacccacctgctccagtctgcaggggcgcagtctcgcccccttccctcg

SEQ ID NO: 43138 - DNA, 40 bp, Homo sapiens
  chr11:64975460-64975500
  hypo
ccagctgcctccacacgggcagggccggggcctctcttac

SEQ ID NO: 43139 - DNA, 52 bp, Homo sapiens
  chr11:64977482-64977534
  hypo
cctcagtccatcttccggaagtttgacctggacaagtcgggcagcatgagtg

SEQ ID NO: 43140 - DNA, 81 bp, Homo sapiens
  chr11:65028546-65028627
  hypo
cgcacctggcctgggatggacattttaaaggttcctgatacatattgctaaattgttttctcgaaacgctctataccatcc

SEQ ID NO: 43141 - DNA, 140 bp, Homo sapiens
  chr11:65091300-65091440
  hypo
tgttacaaatggttgcagtgtgtgatgaaggaaagaactggggctcgggaagggcgggactgtgaagctggaacacaggctggcggcagcagggaagagtttcgctggccaggctgacgctgaggcgatggggtgctgct

SEQ ID NO: 43142 - DNA, 169 bp, Homo sapiens
  chr11:65127486-65127655
  hypo
tctgaaactccttgacgatgagactgttcctgtctgacccttgtcccgtgctgctctgtaaaatggaacgctggggagctggggcctgtttttgccccttgcttgtaggttttagtgaatgaaaagaagcttttgtgttactttcagcttgcttcgttgtcctaattga

SEQ ID NO: 43143 - DNA, 30 bp, Homo sapiens
  chr11:65306390-65306420
  hypo
gggggccggtaggggcgcctcgggtctcaa

SEQ ID NO: 43144 - DNA, 30 bp, Homo sapiens
  chr11:65309028-65309058
  hypo
gggagttgtccagtccgagggaggagctgg

SEQ ID NO: 43145 - DNA, 232 bp, Homo sapiens
  chr11:65413881-65414113
  hypo
ggcatggagtcctgccgcccctcactaacgcctccctccccgcagggtggccgtgagccgcacccaggacacccctgccttcgggccagctctgcctgctggcggaggccccttcgcagccaacgccgacttccgggccttcctgctggccaaagcgctgaatggtgagcaggcggccggccacgcgcgccagttccacgccatggccacgcgcacccgccagcagtacctg

SEQ ID NO: 43146 - DNA, 30 bp, Homo sapiens
  chr11:65463016-65463046
  hypo
ccccatggtggcaaacgtctacagttctag

SEQ ID NO: 43147 - DNA, 83 bp, Homo sapiens
  chr11:65478528-65478611
  hypo
gcgtgagccaccgcgcccagccgttttgtcccattattttagatgccaagaacctgtacaccctccaccggtgacaccttcac

SEQ ID NO: 43148 - DNA, 149 bp, Homo sapiens
  chr11:65511031-65511180
  hypo
gctgggattacaggcgtgagccaccgcaccctcttggccctttttaataagggcactgatctcattcatgacagttccaccctcatgactaatcatctcaccccaagccctatctcctagttccatcgcctttacggttgggatttcaa

SEQ ID NO: 43149 - DNA, 30 bp, Homo sapiens
  chr11:65511454-65511484
  hypo
agcctcaccccctgccgagttggcagggca

SEQ ID NO: 43150 - DNA, 154 bp, Homo sapiens
  chr11:65551581-65551735
  hypo
aggcagaaggagcatcgggaggaggggccagagctgggaacaggccaaggcttgttcaggggacgcgggagacagcagtgtggctggcatacagggacccagctggaaggggattgggaggtcaacggcggccccagcacgccaggcctcaggc

SEQ ID NO: 43151 - DNA, 69 bp, Homo sapiens
  chr11:65629450-65629519
  hypo
agctactggccagctcggcactcaggagcccgagtgatactgctggtgctctaccgggagcacctggtg

SEQ ID NO: 43152 - DNA, 87 bp, Homo sapiens
  chr11:65685085-65685172
  hypo
caggcacttaatgcccgctgcacggatggctgaatccgcctccagtacacccaagcggtccgtgaagtcgtccgtgtaaacacagat

SEQ ID NO: 43153 - DNA, 41 bp, Homo sapiens
  chr11:65722778-65722819
  hypo
aaagagttaggtactcggctgtacgccgtggctcacacctg

SEQ ID NO: 43154 - DNA, 30 bp, Homo sapiens
  chr11:65741409-65741439
  hypo
gccatgaagacaagccggtgagtcatgacc

SEQ ID NO: 43155 - DNA, 101 bp, Homo sapiens
  chr11:66048072-66048173
  hypo
ggggggctgagtcagcgccaggcagcctggggggtgggaggggtgacgcccgccgcctgctggtggtgccagctctggggtacagacggcacccttctgct

SEQ ID NO: 43156 - DNA, 33 bp, Homo sapiens
  chr11:66324511-66324544
  hypo
gtgagccaccgcgctcggcggggctctgggttt

SEQ ID NO: 43157 - DNA, 124 bp, Homo sapiens
  chr11:66325272-66325396
  hypo
ggcgtctgcacaagccgccccgcattcaggaaaagtgccagctggagatcaacttcaacacactgcagaccaagttgcggctcagccaccggcctgccttcatgccctccgagggcaagctggt

SEQ ID NO: 43158 - DNA, 189 bp, Homo sapiens
  chr11:66411368-66411557
  hypo
tgctgcagcagcagccgctgctgctgttactgcagcttccacttcatattacgggcgggatcggagccccctgcgtcgcgctacagccccagtccccactgttggagagggctacggttacgggcatgagagtgagttgtcccaagcttcagcagccgcgcggaattctctgtacgacatggcccggta

SEQ ID NO: 43159 - DNA, 156 bp, Homo sapiens
  chr11:66511194-66511350
  hypo
ttcagtgcagtcaaacgtggaaaggggcctggatagggaggggtcgactcccaggtcccacctttgcgggggaagctggtccccctggattaggctgggagatgcttggggctggttgtaaggtaaaagacggggggtcgttttttctttttttga

SEQ ID NO: 43160 - DNA, 94 bp, Homo sapiens
  chr11:66513159-66513253
  hypo
cattttacaaataaccgaacctaggctagaacccagggcgctgactcataggccagtgttcttttcccaactgcgctgtcataccgacatgaga

SEQ ID NO: 43161 - DNA, 93 bp, Homo sapiens
  chr11:66513553-66513646
  hypo
ccggcgtgagccaccgtgcccggcccgatatgggaatatcgtaacagaggacgtgtgaaggaatagttagactctacacgtacctggaaacca

SEQ ID NO: 43162 - DNA, 16 bp, Homo sapiens
  chr11:66515380-66515396
  hypo
gcgcagggcagcatta

SEQ ID NO: 43163 - DNA, 82 bp, Homo sapiens
  chr11:66557367-66557449
  hypo
acttattcatccagacgtgtgtttgttcaagtcagtgtcagtgagctagatactatctgtaggtacagtgtcttaagatatg

SEQ ID NO: 43164 - DNA, 864 bp, Homo sapiens
  chr11:66625148-66626012
  hypo
ccaagtgggcacctgcgccagccccacctgtgcctgggctgtggccccttcctacagggcgctcaccatggccccgccgctcctgctgctgctgctggccagtggagcggccgcctgcccgctgccctgcgtctgccagaacctgtccgagtcgctcagcaccctctgtgcccaccgaggcctgctgtttgtgccgcccaacgtggaccggcgcacagtggagctgcggctggctgacaacttcatccaggccctggggccccctgacttccgcaacatgacgggactggtggacctgacactgtctcgcaatgccatcacccgcattggggcccgcgcctttggggacctcgagagcctgcgttccctccaccttgacggcaacaggctggtggagctgggcaccgggagcctccggggccccgtcaatctgcagcacctcatcctcagcggcaaccagctgggccgcatcgcgccgggagccttcgacgacttcctagagagcctggaggacctggacctgtcctacaacaacctccggcaggtgccctgggccggcatcggcgccatgcctgccctgcacaccctcaacctggaccataaccttattgacgcactgcccccaggcgccttcgcccagctcggtcagctctcccgcctggacctcacctccaaccgcctggccacgctggctccggacccgcttttctctcgtgggcgtgatgcagaggcctctcccgcccccctggtgctgagctttagcgggaaccccctgcactgcaactgtgagctgctgtggctgcggcggctggcgcggccggacgacctggaaacgtgcgcctccccgcccggcctggccggccg

SEQ ID NO: 43165 - DNA, 96 bp, Homo sapiens
  chr11:66626839-66626935
  hypo
ctgaagcacatggcccgcgcccgcgtgttatttctgcctctgctggtgccatccccccaccccattcccctcgcttgcctgcgtcctgtgccagtg

SEQ ID NO: 43166 - DNA, 250 bp, Homo sapiens
  chr11:66631300-66631550
  hypo
tggggtggtctttgccgtgggcaatgactttgaccagcagggagtcgtagtggggcgagatgacggctccttggaaggcggaagcattatccaggcggatgcccatgccctctccgctccggaacacctgtgggaagggtgaggcgtgaggacctgcgccagaaactgcggtcaaaagtgccccacccaccccgaggctggccaggtgtgcacccagcagctgctgagagcagagcgtggggtgtctgca

SEQ ID NO: 43167 - DNA, 67 bp, Homo sapiens
  chr11:66648961-66649028
  hypo
tcaggaaggcacctacgacgacctgcaggctgaggcagggcgagggcctggccgtcacctgccccgc

SEQ ID NO: 43168 - DNA, 149 bp, Homo sapiens
  chr11:66897593-66897742
  hypo
tggctaatttttttttttttcttgcaccaaagctttctaaagttagtgatttatttctgacaagtttgcaaaacccaagagagagcagttttctgggttgaactcatacttcgtgtttactcgagtctgagtcacggcacctgacttcc

SEQ ID NO: 43169 - DNA, 295 bp, Homo sapiens
  chr11:67072101-67072396
  hypo
ccactctagacctatcgaccgcgtgggggcccatgaatccgtgtagacaagggctgcaggtgaatgtgatgcatgctagactttgagagcccctaccctaaggggaatgaggagccatgacagttgcccactgccctgccaggcagagctttgcggtgctccgtggggctgtcctgggactgcaggatggaggggacaatgatgatgcagcagaggccagttctgagccaacagagaaggccccgagtgaggaggagctccacggggaccagacagacttcgggcaaggatccca

SEQ ID NO: 43170 - DNA, 40 bp, Homo sapiens; identical to SEQ ID NO: 15582
  chr11:67210017-67210057
  hypo

SEQ ID NO: 43171 - DNA, 30 bp, Homo sapiens
  chr11:67442110-67442140
  hypo
gtgttacccaacaggcgtggggcagggctg

SEQ ID NO: 43172 - DNA, 202 bp, Homo sapiens
  chr11:67462628-67462830
  hypo
agatccgccttaagccgtatgaggtagccacggaaccgcaggcaagactcactcgctcggtccagcagtaggacttatcatgatttacacaagcaacaccagctgcagtgaggcttgtgactattcacacacacttttaacctccagaatatcccgaccaccaagcaagtactttgtcgcacccttgcgacgtttctttact

SEQ ID NO: 43173 - DNA, 159 bp, Homo sapiens
  chr11:67764095-67764254
  hypo
agagcacctcgaagccgctgtagataaagaaaggcacgaggtggcgcaggcggtagtcacgcacgtgcttgaagggcagctggaagatgttgccccagcccacgctgcgcagatcgatctcctccgtgggccggtaagcggctccgcacaaacccagca

SEQ ID NO: 43174 - DNA, 147 bp, Homo sapiens; identical to SEQ ID NO: 15585
  chr11:67781462-67781609
  hypo

SEQ ID NO: 43175 - DNA, 165 bp, Homo sapiens
  chr11:67797137-67797302
  hypo
tgtcctccctctgcacgggcatgggacatgccctctgcctccttcctgtcctggcctgcccaactcctacctaccctcagcgcagatcctcccaacacacacatgcaggcagcctcggggcctctgcgggtccctctaccacagcattcccggggaaaggcccgg

SEQ ID NO: 43176 - DNA, 119 bp, Homo sapiens
  chr11:67811705-67811824
  hypo
cctgaaccagtgcagcgtgagcaccacgcacaagtgcctcattgccgaggcctggtgctctgtgcgagacctgcccgccctgcaggaggccctgcgggacagctcggtgagcagcctga

SEQ ID NO: 43177 - DNA, 30 bp, Homo sapiens
  chr11:67915948-67915978
  hypo
tgaccagccgttattcggcactcaaatagg

SEQ ID NO: 43178 - DNA, 154 bp, Homo sapiens; identical to SEQ ID NO: 15587
  chr11:68111091-68111245
  hypo

SEQ ID NO: 43179 - DNA, 227 bp, Homo sapiens
  chr11:68132977-68133204
  hypo
ttcagaaacaagtgacggtcctcttctggaaccttctctcactctgtcctggttttctcagtccacactcgctgtgaggaggacaatggcggctgctcccacctgtgcctgctgtccccaagcgagcctttctacacatgcgcctgccccacgggtgtgcagctgcaggacaacggcaggacgtgtaaggcaggtgaggcggtgggacgggacggggcgggcgggcg

SEQ ID NO: 43180 - DNA, 30 bp, Homo sapiens
  chr11:68210102-68210132
  hypo
gccttttgctgctaacgatgtataaaagct

SEQ ID NO: 43181 - DNA, 30 bp, Homo sapiens
  chr11:68225302-68225332
  hypo
ggtgctccctgctctcgcttccagccatct

SEQ ID NO: 43182 - DNA, 37 bp, Homo sapiens
  chr11:68226712-68226749
  hypo
gggattacaggcgtgaccgcgccgtgacctcctgtgg

SEQ ID NO: 43183 - DNA, 82 bp, Homo sapiens
  chr11:68385159-68385241
  hypo
aataaatgcgttaagcaaaagaagtaagatatgtaagcatctatacgaagctctaaaaccgaccaaacgaattgatgggaga

SEQ ID NO: 43184 - DNA, 143 bp, Homo sapiens
  chr11:68385590-68385733
  hypo
cagcctggatttgcccgcccatggagaggacacgttccggatcgtcctcttccacacagtagactctgtcctgccgaagggagaagtctgcatccctgggttagacacgtctcatggagtcctctgcccgtgaccaggggggg

SEQ ID NO: 43185 - DNA, 30 bp, Homo sapiens
  chr11:68412854-68412884
  hypo
acaaagcccagaagccgcccaaccatgtga

SEQ ID NO: 43186 - DNA, 161 bp, Homo sapiens
  chr11:68417837-68417998
  hypo
aggccctggggacatcgtggccctggggacatcatggtccctgcctccatggagctgacgctctagaggagccggacacaaaaggcaaaatgaaagcacgcgagcttcatcatcagccagactacaggcttaaaagagcgttggcgccacaactaaaattc

SEQ ID NO: 43187 - DNA, 242 bp, Homo sapiens
  chr11:68432989-68433231
  hypo
gacccagaaataagacgtgaagaagttgggataatgccatcaaaagggtcacggcgccctcatgattctcttgacaggcatgaatttatataataatcaaaaagcattttcaccattaagcagccccacagcctgccaaggccatcgtggatgacggtcgcattactcacgcgcgttgccacccaaccggctggggcatcgccgcacttcccattctgctgggaacacgtagaattaagatg

SEQ ID NO: 43188 - DNA, 30 bp, Homo sapiens
  chr11:68564345-68564375
  hypo
accatgagcggccctcgtcctcggaggtag

SEQ ID NO: 43189 - DNA, 30 bp, Homo sapiens
  chr11:68672906-68672936
  hypo
cagtcaggtgctcagcgtggtgccaaggac

SEQ ID NO: 43190 - DNA, 30 bp, Homo sapiens
  chr11:68692056-68692086
  hypo
gtgttggctggaggccgctcttagctgttt

SEQ ID NO: 43191 - DNA, 38 bp, Homo sapiens
  chr11:68771669-68771707
  hypo
gacaagccacaggagcgggaacacgggtgtgtgcagac

SEQ ID NO: 43192 - DNA, 76 bp, Homo sapiens
  chr11:68804728-68804804
  hypo
acctggagcaggtcccgggtgctcaaccgcagacggccagtctccaggctgcggggacgctcgggtccttcttggg

SEQ ID NO: 43193 - DNA, 161 bp, Homo sapiens
  chr11:68965052-68965213
  hypo
ccccagtggtggatccgtttttggtcctcatagctctgccttttctagaatcgcatcaatagacccatgcagttggcagtctcttcagtgtggcttctttcactttgtattatgcctttaacatccagccatagttacagggacatcgctggcacctcgca

SEQ ID NO: 43194 - DNA, 334 bp, Homo sapiens
  chr11:69192486-69192820
  hypo
tggcagaggctgttccgaggctgctccgatgtgtgggaactgagggggttcccaggatgtgagactttcagtgctgaaactgggaaagtcctgggcgagccgggacaagtcgctcaccctactagagacagttgggcgaaggagacacattgggatcagtctcccatggccttcaagtgtcagggcaggggctggggacctcccatataacgagcagcctcaggagactccaggcaggcaggagcgtcgggggctgcgactccagaatggccaaggcttctaccgtccagcccctttgtaacacagagcacccaacgggcgcagccgcccccat

SEQ ID NO: 43195 - DNA, 30 bp, Homo sapiens
  chr11:69206384-69206414
  hypo
ccctgacactggctgcgagcacttttcact

SEQ ID NO: 43196 - DNA, 104 bp, Homo sapiens
  chr11:69280529-69280633
  hypo
tctccaggtgattctcgtgtgcagccaagttagagaacactgactcccggggaggtggattacctgtcctcccggcaaagcgcaggactcgcagtttggcaagc

SEQ ID NO: 43197 - DNA, 67 bp, Homo sapiens
  chr11:69339948-69340015
  hypo
gccctcatccctgcccgccccgtccccatgcttgcctccacgggcctctcctcgcacaggaggaggg

SEQ ID NO: 43198 - DNA, 167 bp, Homo sapiens
  chr11:69360946-69361113
  hypo
gaccagccacattgacgtcacgtggaagcttgttagactggcccacttggacccagtaagccagaatgtgcattgtgataagatcccctgatctcccctgcaccgcatgctttgagaagctctgctctaggacgcggagcctgaggccaggacgttggtgccgaccc

SEQ ID NO: 43199 - DNA, 30 bp, Homo sapiens
  chr11:69458784-69458814
  hypo
cctccccttgagagccggctccttaggtga

SEQ ID NO: 43200 - DNA, 30 bp, Homo sapiens
  chr11:69466053-69466083
  hypo
cgccaggcaggcgggcgccaccgccacccg

SEQ ID NO: 43201 - DNA, 147 bp, Homo sapiens
  chr11:69498970-69499117
  hypo
acgcatagtggctaccggggacccagccctgccatggcctgaggcattgtccctctaggtgggagcgtgtaggactcatgcacccccccgggaggctccaagagagtcccccatttgacctacaccccttatttcttagaaggccct

SEQ ID NO: 43202 - DNA, 75 bp, Homo sapiens
  chr11:69970448-69970523
  hypo
ccctcagctcctgtacgaagagtgggcacgctatggagttttctataagtaccagcccatcgacctggtcaggta

SEQ ID NO: 43203 - DNA, 30 bp, Homo sapiens
  chr11:70005678-70005708
  hypo
aggatgtgccccacacgcccctggtcctgg

SEQ ID NO: 43204 - DNA, 30 bp, Homo sapiens
  chr11:70022959-70022989
  hypo
tgcgtcagaataactcggggctcccagccc

SEQ ID NO: 43205 - DNA, 258 bp, Homo sapiens
  chr11:70050908-70051166
  hypo
tttaaaggcggtctacgaaacatagctgacatttgagatgtatgtgtgcttggttttatttatatcgtcatgtagttactgtgtgctgggaaaagtacaccagaaggtgagcggtgggtatggacaggttggtagcgggcgactctgccttcctccccagaagttcagcatagcggttaagggtcgactctggcaccacactcttagggtttcagaacatggctctgccatcgtctagctacacgatctcaggaatgt

SEQ ID NO: 43206 - DNA, 30 bp, Homo sapiens
  chr11:71098989-71099019
  hypo
acatcctgacagtcccgacattctgacagt

SEQ ID NO: 43207 - DNA, 57 bp, Homo sapiens
  chr11:71117658-71117715
  hypo
atctgagatcttccacgtcacgacgctgctccctaccacggacgattggaacttcca

SEQ ID NO: 43208 - DNA, 111 bp, Homo sapiens
  chr11:71192722-71192833
  hypo
tgcgtatctgcagttcgtcggtggagtcagcctctgacacgccccgcagtgaagtgtcttttttccctctgaaaaatccattcatcctgccacgtgcgggtatttgtcctg

SEQ ID NO: 43209 - DNA, 30 bp, Homo sapiens
  chr11:71507973-71508003
  hypo
ccacgtggggcagcccgttaactacagagc

SEQ ID NO: 43210 - DNA, 29 bp, Homo sapiens
  chr11:71781578-71781607
  hypo
cccagtggctcacagcggtaatcccagca

SEQ ID NO: 43211 - DNA, 30 bp, Homo sapiens
  chr11:72109516-72109546
  hypo
taagtaaagcatcaccgagaggttgtaaca

SEQ ID NO: 43212 - DNA, 46 bp, Homo sapiens
  chr11:72475677-72475723
  hypo
ccatctttgttcctgcgggcggcggtggccacgccccaaaggtgta

SEQ ID NO: 43213 - DNA, 78 bp, Homo sapiens
  chr11:72532300-72532378
  hypo
ctgggaacatcatggcgcccgagggccggatgggcatttggcagcctctgcgcgaggagtcctcgcagtggttatgca

SEQ ID NO: 43214 - DNA, 30 bp, Homo sapiens
  chr11:72532613-72532643
  hypo
gggcaggtgagcagccgactcccttagcgc

SEQ ID NO: 43215 - DNA, 30 bp, Homo sapiens; identical to SEQ ID NO: 15597
  chr11:72905832-72905862
  hypo

SEQ ID NO: 43216 - DNA, 155 bp, Homo sapiens
  chr11:73073174-73073329
  hypo
tgcctgctgagcctgcgcgccgagccggacgtggaggcctgcatcgccgtctgttccgcccgcatcctctgcatcggggcggtgcccgggctgcagcctcgctgccaccggtgaggcctgggcggcggggtgggcggcaccgcgggcctgggaga

SEQ ID NO: 43217 - DNA, 98 bp, Homo sapiens
  chr11:73310342-73310440
  hypo
gggtgtcagattgcacgtaggttttttttgttttttgagacggagtctggatctatagccaggctggagtaaagtgggggcgatcgcaggtcactgca

SEQ ID NO: 43218 - DNA, 30 bp, Homo sapiens
  chr11:73805524-73805554
  hypo
ttctggaacatacaccgaatggcaaaaagt

SEQ ID NO: 43219 - DNA, 40 bp, Homo sapiens
  chr11:74246636-74246676
  hypo
agccacggcacccagcccaagatgacgtttatatcttctc

SEQ ID NO: 43220 - DNA, 48 bp, Homo sapiens
  chr11:74302595-74302643
  hypo
acatgtgaacaggctcggtttattattgctcatagctgcagccccagc

SEQ ID NO: 43221 - DNA, 35 bp, Homo sapiens
  chr11:75100584-75100619
  hypo
cattaaaagcaatgacggccgggcgcggtggctca

SEQ ID NO: 43222 - DNA, 56 bp, Homo sapiens
  chr11:75152480-75152536
  hypo
cagagggccaagctccgggacaagcccgggtctgcccgacacgctcaccctcttgt

SEQ ID NO: 43223 - DNA, 91 bp, Homo sapiens; identical to SEQ ID NO: 15601
  chr11:75459473-75459564
  hypo

SEQ ID NO: 43224 - DNA, 30 bp, Homo sapiens
  chr11:75879446-75879476
  hypo
gccctcctggcatcccgttgggaaacacgt

SEQ ID NO: 43225 - DNA, 609 bp, Homo sapiens
  chr11:76371627-76372236
  hypo
gctcaagaaagctgtcggggatgagctcaatctcattgtagctcaaatccagattcaagagctgggaaagggggcggccgctggcattcccgctgggggctgagaggggcagggctgaccagccctcggaaggtgcgtggatgcccttgctgtcctggggtggccctgtggggagccggatgaggttgttggacaagttcaggtagatgagtctcgggagcgcggccaggtcggggaaatggagcagtttgttctcccgcaggtcaagccaggtgagctggaactcagcctggggctgggaggccgtctgaaaggcctcgatgctgttgcagctcaggtctagcacccgcagctgctggaggctgaagtcggagatgcaggtgagggaattcctggagaggttgagatgggtcaggcggggcagaccctcgaaggcgccatcctcgatgtccatcagcacgttgctatgcaggtcaagctgctccagcgcaggcatgtcccggaaggtgtggcgggtgaggcgagtcagactgttctccgccagtgagagggtatgcaggctgggtgcctcccccagcagccgctccagcaggccgctgtacaggctgt

SEQ ID NO: 43226 - DNA, 169 bp, Homo sapiens
  chr11:76902500-76902669
  hypo
ctgatgggagggctgcgcagcccttgtgtgcagatgggaatggaattccctctcaggttgccacggcatctgatggagaaactcctcagcaaacaggagttccttcacacttgccctgaagcagctggagtgtgggcgtcccgcagactcacctcggaggctggagcct

SEQ ID NO: 43227 - DNA, 18 bp, Homo sapiens
  chr11:77025115-77025133
  hypo
aaaaatatttaaggccgg

SEQ ID NO: 43228 - DNA, 85 bp, Homo sapiens
  chr11:82214234-82214319
  hypo
tctcaaaaaaaaaaaaaaaaaaaagagttaaaatcaggtctctatcttttaccagtcatatgaccttggtcggttattcaaattc

SEQ ID NO: 43229 - DNA, 30 bp, Homo sapiens
  chr11:83561479-83561509
  hypo
gccaccgcggcagcccggggtaagttttct

SEQ ID NO: 43230 - DNA, 30 bp, Homo sapiens
  chr11:85359853-85359883
  hypo
caaatgacctcttatcgatataaaacaggt

SEQ ID NO: 43231 - DNA, 24 bp, Homo sapiens
  chr11:85379748-85379772
  hypo
agattaagaaacatgcggccgggc

SEQ ID NO: 43232 - DNA, 150 bp, Homo sapiens
  chr11:85564833-85564983
  hypo
aaaataaaaaaatctcgttaagctgtaaaaaataaaaataaaaataaaaatacatatccaggtacatactctttctttctttgagacagaggctcgctctgtcacccgtgcagtggcagtctcggctcactgagatctcagccttccagg

SEQ ID NO: 43233 - DNA, 30 bp, Homo sapiens
  chr11:85906245-85906275
  hypo
cccagccgcacccaccgctgccccaggagc

SEQ ID NO: 43234 - DNA, 21 bp, Homo sapiens
  chr11:92929514-92929535
  hypo
aattgctgggtcaaacgataa

SEQ ID NO: 43235 - DNA, 20 bp, Homo sapiens
  chr11:94064787-94064807
  hypo
gccaccgcgcctggcccaag

SEQ ID NO: 43236 - DNA, 26 bp, Homo sapiens
  chr11:94892054-94892080
  hypo
tcctccctgggcgacaaagcaagact

SEQ ID NO: 43237 - DNA, 30 bp, Homo sapiens
  chr11:94924721-94924751
  hypo
acaagaaagttagtacgttcatccactgtg

SEQ ID NO: 43238 - DNA, 41 bp, Homo sapiens
  chr11:95020639-95020680
  hypo
ggattacaggcgtgagccaccgcgcccggcctggttgctcc

SEQ ID NO: 43239 - DNA, 30 bp, Homo sapiens; identical to SEQ ID NO: 15603
  chr11:95488699-95488729
  hypo

SEQ ID NO: 43240 - DNA, 30 bp, Homo sapiens; identical to SEQ ID NO: 15604
  chr11:95658721-95658751
  hypo

SEQ ID NO: 43241 - DNA, 17 bp, Homo sapiens
  chr11:102158484-102158501
  hypo
cccggcccctgtttact

SEQ ID NO: 43242 - DNA, 38 bp, Homo sapiens
  chr11:102961347-102961385
  hypo
aaagcatttctcagtcgggcgaggtggctcactcctgt

SEQ ID NO: 43243 - DNA, 30 bp, Homo sapiens
  chr11:109880267-109880297
  hypo
ctgtctccaggtggccgggcatggggctca

SEQ ID NO: 43244 - DNA, 40 bp, Homo sapiens
  chr11:111154502-111154542
  hypo
gtcttcctagcacagcgccggtcaccgggaaggtactcag

SEQ ID NO: 43245 - DNA, 100 bp, Homo sapiens
  chr11:111156679-111156779
  hypo
tgaggaagcagacaccggttccctccatgacccttccccttgggtgaaagaagatgggagtattgcctgggggtcatatgaatgccgcagagcttattga

SEQ ID NO: 43246 - DNA, 23 bp, Homo sapiens
  chr11:113373844-113373867
  hypo
cgagactccgtctcaaaaaaaaa

SEQ ID NO: 43247 - DNA, 185 bp, Homo sapiens; identical to SEQ ID NO: 15606
  chr11:113552799-113552984
  hypo

SEQ ID NO: 43248 - DNA, 151 bp, Homo sapiens
  chr11:113560972-113561123
  hypo
cgtccaggtagccagcgcaaagcatgcggggggtgagggctccgctgtacacgcaagagctgttgcagagctgagtgctgaacaagggcaccaccgtgtcctggagcatatccgagctgtaagctatgagagacaccgagaaaaactgcag

SEQ ID NO: 43249 - DNA, 67 bp, Homo sapiens
  chr11:113800743-113800810
  hypo
caccgcacccggcctcgcccattttaaaacagggctgcttgtcttttgttgtcgttgagttgtggga

SEQ ID NO: 43250 - DNA, 171 bp, Homo sapiens
  chr11:114115465-114115636
  hypo
taaattcctaaaaatcggatcaaacaaactcctctgtcttaaccctttgttttttaaattgttagggacccctctggaggggaaaggcacaggcagccgcccccttcccccccaccgccgccttcacccccacccggctgggtggctgccgatgtacgttttaattaccgg

SEQ ID NO: 43251 - DNA, 30 bp, Homo sapiens
  chr11:114121201-114121231
  hypo
gaagggccacaagcccgaggagatcccgcc

SEQ ID NO: 43252 - DNA, 30 bp, Homo sapiens
  chr11:115763341-115763371
  hypo
cagaaatggcactgccggggaggtcttaag

SEQ ID NO: 43253 - DNA, 32 bp, Homo sapiens; identical to SEQ ID NO: 15607
  chr11:116890012-116890044
  hypo

SEQ ID NO: 43254 - DNA, 75 bp, Homo sapiens
  chr11:116952331-116952406
  hypo
tccgtctcaaaataaataaattaatcaaaaaaataaagtctttgaggctagaaaacgtcccgggaaagagagagc

SEQ ID NO: 43255 - DNA, 30 bp, Homo sapiens
  chr11:117010343-117010373
  hypo
tttgagttctctaaacgtgaattctttcta

SEQ ID NO: 43256 - DNA, 30 bp, Homo sapiens
  chr11:117054963-117054993
  hypo
ctggtggggtaggaacggggagtgttcttg

SEQ ID NO: 43257 - DNA, 52 bp, Homo sapiens
  chr11:118768516-118768568
  hypo
aaaccagcacaaaagcgcagcgctctatttacagctccggctggcacctgcc

SEQ ID NO: 43258 - DNA, 32 bp, Homo sapiens
  chr11:118781045-118781077
  hypo
attcctgctcccagacgcgcccctcacccagg

SEQ ID NO: 43259 - DNA, 46 bp, Homo sapiens
  chr11:119524180-119524226
  hypo
tgagggacacatccccgttcctccagacccgcgcccctccaacagg

SEQ ID NO: 43260 - DNA, 284 bp, Homo sapiens
  chr11:120008071-120008355
  hypo
cgggcctcaaagtcccggatgggctcgagcagctggtggtctcggaaggcggcgccctccaggtggggcttgagatgcagctcgcagaaggaggcctggcacaccaggcaggacttgaccgccttctgcttgttgccgatgcaggagtcgcacagcacctcctcggagccggacttggaccgtgaaaaaaggcccgtgtcggcccgggggtagctgttccgccgggtctccccgggctccatgatggacaccgtgggcttccgggactccgagaaaatggactt

SEQ ID NO: 43261 - DNA, 63 bp, Homo sapiens
  chr11:120008655-120008718
  hypo
gctgccactggggcccgacgggctccgggcatccctggcttctgggctcgacccgttgctcct

SEQ ID NO: 43262 - DNA, 30 bp, Homo sapiens; identical to SEQ ID NO: 15610
  chr11:120367603-120367633
  hypo

SEQ ID NO: 43263 - DNA, 30 bp, Homo sapiens
  chr11:120384093-120384123
  hypo
gactgtctgtgctcgcgtggtcaggggcga

SEQ ID NO: 43264 - DNA, 30 bp, Homo sapiens
  chr11:120410117-120410147
  hypo
aaggaaccacttgtgcgaacatgatcttat

SEQ ID NO: 43265 - DNA, 109 bp, Homo sapiens
  chr11:120748772-120748881
  hypo
gtcattaagaaacagcgtcatcagcccccagggctcatccttcagcccccaacccaggccagcaagggaccgtgccctgaggcatcctccacagcggctgcagtttctt

SEQ ID NO: 43266 - DNA, 32 bp, Homo sapiens
  chr11:120772673-120772705
  hypo
ttggttcttttcttgcgcgtgtgtgcctacag

SEQ ID NO: 43267 - DNA, 30 bp, Homo sapiens
  chr11:120837904-120837934
  hypo
ctcggttttccgggacgagtttgatctggc

SEQ ID NO: 43268 - DNA, 30 bp, Homo sapiens
  chr11:120998803-120998833
  hypo
ccccaagcgggagaccgtgtgcctgctcag

SEQ ID NO: 43269 - DNA, 30 bp, Homo sapiens
  chr11:121000904-121000934
  hypo
acctatgacttctgccgtaagttggggttg

SEQ ID NO: 43270 - DNA, 162 bp, Homo sapiens
  chr11:121023638-121023800
  hypo
ccagccccgctgcgccgccatccgcctgaagagtgactgcagccactactgcgtggagggctgtcactgcgacgctggctacgtcctcaacggcaagagctgcatcctgccccacagctgcggctgctactccgatggcaaatattacgaggtatgggaggc

SEQ ID NO: 43271 - DNA, 144 bp, Homo sapiens
  chr11:121152141-121152285
  hypo
atagtgtgtgcttccagagctcggggacttcgcagcctccatagtagcgttcactccctggagccactttatgtactcttaacttgtcttgtctcattcctttgactatgccagactttgtagcccccacggcctggtgttggg

SEQ ID NO: 43272 - DNA, 30 bp, Homo sapiens
  chr11:121910451-121910481
  hypo
gtgagcaactgcgcccggccactattctct

SEQ ID NO: 43273 - DNA, 21 bp, Homo sapiens
  chr11:122402739-122402760
  hypo
aagacatattgttgccgggca

SEQ ID NO: 43274 - DNA, 95 bp, Homo sapiens
  chr11:123169348-123169443
  hypo
agtgggaggcacagccggaactgcgccctccatggagcaggtggagctgggaacaggtgggagggagccctgcctccttccgagttggcagggtg

SEQ ID NO: 43275 - DNA, 30 bp, Homo sapiens
  chr11:123457234-123457264
  hypo
gtccctctgggggtccgccctcgggtgaca

SEQ ID NO: 43276 - DNA, 30 bp, Homo sapiens
  chr11:124526915-124526945
  hypo
gacttgccactgagccggctgtgcccaata

SEQ ID NO: 43277 - DNA, 30 bp, Homo sapiens
  chr11:124743216-124743246
  hypo
gggcttctacagctgcgtggccaagagttc

SEQ ID NO: 43278 - DNA, 69 bp, Homo sapiens
  chr11:125220613-125220682
  hypo
gtccaggccgtcctccgtctcacagtctgaggacgggtgagccctggggaggggcgagcttggtgcttg

SEQ ID NO: 43279 - DNA, 73 bp, Homo sapiens
  chr11:125755569-125755642
  hypo
ccaacccccaggccacggacaggcacctaggaaccaggccgcaaggcagggggtaagccgtaggagcttcatc

SEQ ID NO: 43280 - DNA, 81 bp, Homo sapiens
  chr11:126083885-126083966
  hypo
tccttaatgtttctccggtgagtctaggcacttggtgatttaaagtagagttgttctcagtataaagaatttatgtggccg

SEQ ID NO: 43281 - DNA, 20 bp, Homo sapiens
  chr11:126154214-126154234
  hypo
cactgcgcccagcccttcat

SEQ ID NO: 43282 - DNA, 231 bp, Homo sapiens
  chr11:126273042-126273273
  hypo
cccacaaggggagggcgtggctcgtgaaattcctgattgggtatagcccagcaagccccaagactcgcccagtttgcttagcgcaacactgacgctgttttggaatgaagacaagacaatgtagaactttactggggaagaggtcgaagaagggctaattgtcttgttgttcaagactggttagcgctgctcacctctgacgctgctcacctctgacgccaaaggtttttc

SEQ ID NO: 43283 - DNA, 35 bp, Homo sapiens
  chr11:128657930-128657965
  hypo
tcctgacctcatgatctgcccgcctcggcctccta

SEQ ID NO: 43284 - DNA, 66 bp, Homo sapiens
  chr11:129866993-129867059
  hypo
gggcaaaactgtcaacggtgcaaacgtggaagtaaaaaaatatggattttacgtgtaggttatgtt

SEQ ID NO: 43285 - DNA, 35 bp, Homo sapiens
  chr11:130058066-130058101
  hypo
tggaaaagcatggcccggggcgctgggtggtgctg

SEQ ID NO: 43286 - DNA, 102 bp, Homo sapiens
  chr11:130060305-130060407
  hypo
agccctgcccccacacgtgccctccttcttgtctcctgcgcagacagctgcagctttggcctgcacgcccgcggtgtggagctgatgcgcttcaccacgccc

SEQ ID NO: 43287 - DNA, 30 bp, Homo sapiens
  chr11:130090184-130090214
  hypo
tggctattcttgtaacggcaccgtggacaa

SEQ ID NO: 43288 - DNA, 190 bp, Homo sapiens
  chr11:130515653-130515843
  hypo
taaaatcctagactccgcttctgtttcggtattcagtatctaccacagtgcacggcacacattaggccctcaacaatatttgctgaatgaaaaaaacatgggaggaggcaaaactcagaagtggcagagccaggaattaaaaccaggacctcttactcctgaccccatgttctcccgcggacatccccca

SEQ ID NO: 43289 - DNA, 30 bp, Homo sapiens; identical to SEQ ID NO: 15616
  chr11:130717573-130717603
  hypo

SEQ ID NO: 43290 - DNA, 226 bp, Homo sapiens
  chr11:130785458-130785684
  hypo
ctggctcctggctcacggaacggtaccaagataacacaaaatctcgaataatcatctggatggtgcggttgatctcccgttccagctgcctttctgcctcagggcatggaggacaggtggccaacgggatgaagcgttccagatgcagtcgacctgaagccactccagcgaggctggagcccagccatcctcccagcaccactagcaatgccgacagaaggcacag

SEQ ID NO: 43291 - DNA, 112 bp, Homo sapiens
  chr11:131522754-131522866
  hypo
ggtggccatgggtggcggtcactccgccttcagaaagccacttggaatgcaacctgcacaattgccttcatcctttaccgccctgccagattgttgacggaagcaaccttat

SEQ ID NO: 43292 - DNA, 169 bp, Homo sapiens
  chr11:131631013-131631182
  hypo
agactaaatcagagacgccgtgaaagtggcaagaggcagggaggagaatcgactttgcaggacctgttatgcgttacggctttttctgtgtgaacacatcctattcctcacagcagttcagtgtagtaggcttattagtcacattttacaggtgcggtaactgaaattc

SEQ ID NO: 43293 - DNA, 101 bp, Homo sapiens
  chr11:131766877-131766978
  hypo
ggcctaggcttagatttttgaaagaaaaaggtttcactcacctaaatgtctggcaggcatttgacgtccgtggctgaatagccatgcgttgctgcgtctct

SEQ ID NO: 43294 - DNA, 38 bp, Homo sapiens
  chr11:131799626-131799664
  hypo
tcgtgaaggtttcctcgaaggatcgtgaaattccacga

SEQ ID NO: 43295 - DNA, 48 bp, Homo sapiens
  chr11:132484374-132484422
  hypo
gggcctctgcactgacgtgtcttcatgttataccgcttgtgtgtctgt

SEQ ID NO: 43296 - DNA, 30 bp, Homo sapiens
  chr11:132792371-132792401
  hypo
gggaagacggagcaccgagaccaggagacc

SEQ ID NO: 43297 - DNA, 104 bp, Homo sapiens; identical to SEQ ID NO: 15619
  chr11:133231728-133231832
  hypo

SEQ ID NO: 43298 - DNA, 192 bp, Homo sapiens
  chr11:133386010-133386202
  hypo
agagcttggggactgcgacccccgcagagggagagcaaggctggcagctggtgggtggaggcagacagcacagtgcagctctggggaaggctctgaggtacctggagaggcttcgtgtcagtctccatcagaggagacgcatctcccaccagcagacctgacttgatatctccactgcgttctgttatggcc

SEQ ID NO: 43299 - DNA, 30 bp, Homo sapiens
  chr11:133805206-133805236
  hypo
cagcccgaggaccaccgttcagaaggaact

SEQ ID NO: 43300 - DNA, 219 bp, Homo sapiens
  chr11:134011075-134011294
  hypo
tggtgctggggttgccgatggggagaaaacacggtgtaccctgaagtgacatcctcccgggtgggaggatggtggtcagggaaggctccccaaagtggcctctctgggtgcggtgtgaagggtggctggttagcaggcaagatggtatggagggaggtggtgatcaggagagaatgctgtgtatgaagacgcagaagcaacagacggactggctgatgg

SEQ ID NO: 43301 - DNA, 34 bp, Homo sapiens
  chr11:134274891-134274925
  hypo
gtcctccccgtgccacgagcggccgtctctccca

SEQ ID NO: 43302 - DNA, 30 bp, Homo sapiens
  chr11:134458505-134458535
  hypo
tgctggattccctgccgagagctgcacctg

SEQ ID NO: 43303 - DNA, 30 bp, Homo sapiens
  chr11:134526234-134526264
  hypo
aggcccggaggctggcgcgtaggaggctaa

SEQ ID NO: 43304 - DNA, 30 bp, Homo sapiens
  chr11:134607499-134607529
  hypo
caggcaaagtcataccgaagcctcaggctc

SEQ ID NO: 43305 - DNA, 94 bp, Homo sapiens
  chr11:134608582-134608676
  hypo
gtgtgtctctctgtgcgtgtctgtgtgagtccgtgtgtctctccatgagtgtctgtgcgagtctgtgtgtctctccgtgcgtgtctgtgcgagt

SEQ ID NO: 43306 - DNA, 30 bp, Homo sapiens
  chr12:299633-299663
  hypo
actgcaagaacagtgcggaactagggcagg

SEQ ID NO: 43307 - DNA, 35 bp, Homo sapiens
  chr12:709027-709062
  hypo
cagtgtcccattgcccgtctcgggcacaggagtag

SEQ ID NO: 43308 - DNA, 34 bp, Homo sapiens
  chr12:1650728-1650762
  hypo
caggtgctggctcaaccctcgccccaaaacctca

SEQ ID NO: 43309 - DNA, 76 bp, Homo sapiens
  chr12:1651130-1651206
  hypo
ataatattgcattttcgacacatacagcatgttatacagtaaccaaatcaagaatcctggtcgaaaccttaccaaa

SEQ ID NO: 43310 - DNA, 34 bp, Homo sapiens
  chr12:1716758-1716792
  hypo
tctcctccgacatgccgagcgtctttgagtctcc

SEQ ID NO: 43311 - DNA, 42 bp, Homo sapiens
  chr12:1948142-1948184
  hypo
cacgaccagtgacaccgggcttctacccgggcaatttggcaa

SEQ ID NO: 43312 - DNA, 173 bp, Homo sapiens
  chr12:1948419-1948592
  hypo
caggatggctgagctcgaatgcctgttggatcgcgcaacttttcagaacacagctgggtcccaggtactgaagctaaaacaagggtaaggagcgcttcatcgcagggacctgatcgttctcagacagctaggcagagacaccaaggactctgcaggcacgaagaaactgaaag

SEQ ID NO: 43313 - DNA, 45 bp, Homo sapiens
  chr12:2017790-2017835
  hypo
ccacgccaactcccacgccggactgcctcacggacatccccacgc

SEQ ID NO: 43314 - DNA, 32 bp, Homo sapiens
  chr12:2018113-2018145
  hypo
cacgacactgtggcccgcgctggccttccacg

SEQ ID NO: 43315 - DNA, 134 bp, Homo sapiens
  chr12:2040511-2040645
  hypo
ctggtggcagagtggcggatgccgtggtggagcactgcatggagcactgacggatgacacgtgcacatggcgatgaggacgacacctaaacgtggcagtcagtggagggaaagccagaacgggattcatgacac

SEQ ID NO: 43316 - DNA, 30 bp, Homo sapiens
  chr12:2046347-2046377
  hypo
ggtgctcagagcactcgtttctaatgtgcc

SEQ ID NO: 43317 - DNA, 53 bp, Homo sapiens
  chr12:2088785-2088838
  hypo
ttaagtaaataactacgaacggaacttgttggatcatacgctagttatatgtt

SEQ ID NO: 43318 - DNA, 40 bp, Homo sapiens
  chr12:2245461-2245501
  hypo
ctattcggccatcttggctcctcctcgagacctttcttgt

SEQ ID NO: 43319 - DNA, 194 bp, Homo sapiens; identical to SEQ ID NO: 5128
  chr12:2566053-2566247
  hypo

SEQ ID NO: 43320 - DNA, 30 bp, Homo sapiens; identical to SEQ ID NO: 15624
  chr12:2590465-2590495
  hypo

SEQ ID NO: 43321 - DNA, 37 bp, Homo sapiens
  chr12:2921106-2921143
  hypo
attctggtttgagcacgcaccccgccccacaatcctt

SEQ ID NO: 43322 - DNA, 313 bp, Homo sapiens
  chr12:2964499-2964812
  hypo
tggtggtaggcttgccgggtgaagccagggaactcccaggactcgctggggaggaagaactcacgctgagcccacgtttgggagggtgggagggactcgctggcctggaccatctagggagagacaaaagggagcctggggaaggttgtgcagacaggggtgcagaaaggtgggtgaggcactccgctctccttcccaggcacgacctctgccagcccaggattctcatgaggacgcagaagtcctggcagggccgcatctccatccctctccttcccggcggaagttatggctgctgcgtatcatcttcaca

SEQ ID NO: 43323 - DNA, 30 bp, Homo sapiens
  chr12:3640833-3640863
  hypo
tgagggcggccttcgcgtcaagcgtctcag

SEQ ID NO: 43324 - DNA, 30 bp, Homo sapiens
  chr12:4019070-4019100
  hypo
cacctatcaagtgctcgacagccacgtgtg

SEQ ID NO: 43325 - DNA, 196 bp, Homo sapiens
  chr12:4194712-4194908
  hypo
ttgttcactgagacccgtatggagtaaaaggaaggcagggactgttatcctgattcttgcagacttgcaaatggaaatataaagacgttaatcaactttgccaaagtcacacagtaagctgagaggggaaccgaaacataagtcaggcctctgctcctgacatagggcctcatgcataagtcgcagtaaacttcaa

SEQ ID NO: 43326 - DNA, 30 bp, Homo sapiens
  chr12:4217500-4217530
  hypo
cccacaatggaggaccgggtcccctcaggt

SEQ ID NO: 43327 - DNA, 84 bp, Homo sapiens
  chr12:4268526-4268610
  hypo
aggttgtgactggcacggaaggcttctgggatgctggtaacgttctatttcttgatttgggtgctggttacataagtgttctgt

SEQ ID NO: 43328 - DNA, 17 bp, Homo sapiens
  chr12:4272614-4272631
  hypo
agcgagactctgtctca

SEQ ID NO: 43329 - DNA, 30 bp, Homo sapiens
  chr12:4280922-4280952
  hypo
tgtacccagtgttagcgctaacttgtgagt

SEQ ID NO: 43330 - DNA, 30 bp, Homo sapiens
  chr12:4356247-4356277
  hypo
agtgcaatgagaatccgagcatctcctcta

SEQ ID NO: 43331 - DNA, 75 bp, Homo sapiens
  chr12:4405652-4405727
  hypo
agctattgtctaccacgcctcgtgtgcacacgcacacacacgcaagttccctcagtcagccgagaatcctgccat

SEQ ID NO: 43332 - DNA, 30 bp, Homo sapiens
  chr12:4411192-4411222
  hypo
aaaggcaatgattcacgcttttgttttcat

SEQ ID NO: 43333 - DNA, 132 bp, Homo sapiens
  chr12:4554801-4554933
  hypo
ctccctccggcatggcggcaggggcttatttttggaaggcagatgaaggctgctgacatgaaaccaaagcctccatcgggcactcgggttgagagcagagggacccaggctgagccgcggccggtagagacc

SEQ ID NO: 43334 - DNA, 30 bp, Homo sapiens
  chr12:4734872-4734902
  hypo
gagagagagagcaagcgagcgagaaggcag

SEQ ID NO: 43335 - DNA, 146 bp, Homo sapiens
  chr12:4829055-4829201
  hypo
actcctcacacctgacgctgctcagggagaagccaggcagctataatagtgttcttggccggagaacatctggcctagcaggcagggtgtcatctatgaagctgggtggagagaaagctgttggggaaaccagccccacaccaccc

SEQ ID NO: 43336 - DNA, 30 bp, Homo sapiens
  chr12:4959461-4959491
  hypo
gagagggggacccctcgaccatgtggatgg

SEQ ID NO: 43337 - DNA, 141 bp, Homo sapiens
  chr12:5315393-5315534
  hypo
cccaaagtgctgggattacaggcgtgacccagaaagttgagtaacttcttaaaggctatgtgaattattttcatttcacatcactattcacttgagcagtgagatttacacacttatcagctcttacgcttgctctttaaa

SEQ ID NO: 43338 - DNA, 106 bp, Homo sapiens
  chr12:5323880-5323986
  hypo
gcagggggctagtggcgttctattttcttgtggagtgatggcctggaaaatataatgtacgggagatgtaatggtgacccaccgacctggccgggatgccttgctt

SEQ ID NO: 43339 - DNA, 141 bp, Homo sapiens
  chr12:5335908-5336049
  hypo
tgctgaaattgaaaacgcctgttaatagcacaagtgacacatcatagatcactcgctgacaggctgaactgggcgccatcttgaagaacgtaggctgcatgctaatgacgcccaggaggagctgcgcgctgcattgtggag

SEQ ID NO: 43340 - DNA, 30 bp, Homo sapiens
  chr12:5384595-5384625
  hypo
ggccaggtcctgccccggctgtggatccca

SEQ ID NO: 43341 - DNA, 20 bp, Homo sapiens
  chr12:5561269-5561289
  hypo
ttttttttttgttgacggag

SEQ ID NO: 43342 - DNA, 54 bp, Homo sapiens
  chr12:5713384-5713438
  hypo
tgtggttggtggtgccgatggctacgatagagaatacaacgtaagaggcagttt

SEQ ID NO: 43343 - DNA, 21 bp, Homo sapiens
  chr12:5720406-5720427
  hypo
ttacagcggtgagccaccaca

SEQ ID NO: 43344 - DNA, 30 bp, Homo sapiens
  chr12:6180349-6180379
  hypo
gagagggcaacttctcgctgccttgagttg

SEQ ID NO: 43345 - DNA, 30 bp, Homo sapiens
  chr12:6316943-6316973
  hypo
ttccagaggaggtcccggtagagagaagtt

SEQ ID NO: 43346 - DNA, 218 bp, Homo sapiens
  chr12:6483568-6483786
  hypo
gaagacgagcttgtccgagttgaggttgatgttgaggctgacggggtagctgaagtactctccgaaaagcaggccgaattgccagtacatcatgccaaaggtgcagagccacagcactgcccagaaggccgtcttcatgcggttgtgctgggagcacaccaggcggatggcgccgtggatggtggtgttgttgcagaagaactcgaagagctctcggt

SEQ ID NO: 43347 - DNA, 30 bp, Homo sapiens
  chr12:6484000-6484030
  hypo
ccccttcatgagccccggagtggattgggg

SEQ ID NO: 43348 - DNA, 30 bp, Homo sapiens
  chr12:6495108-6495138
  hypo
gaaaggtgagagctacgcaatggggtggat

SEQ ID NO: 43349 - DNA, 69 bp, Homo sapiens
  chr12:6623485-6623554
  hypo
aagaaccgccccactcgggaagccataacacacctgcttggtgtagccttgacccgttataaccatatg

SEQ ID NO: 43350 - DNA, 30 bp, Homo sapiens
  chr12:6804680-6804710
  hypo
gggtaggtgagtccccgaaggcccccagca

SEQ ID NO: 43351 - DNA, 16 bp, Homo sapiens
  chr12:7462672-7462688
  hypo
gcgcctggcaggagac

SEQ ID NO: 43352 - DNA, 81 bp, Homo sapiens
  chr12:7767211-7767292
  hypo
gcatatgtttgtaaccgccctcgatccctggtggatcgaggagggaaaatgtgggaataaagacaagagaccaaagaagac

SEQ ID NO: 43353 - DNA, 33 bp, Homo sapiens
  chr12:7864862-7864895
  hypo
gaacgcggctcgtagcgtcgttgcatcagtatc

SEQ ID NO: 43354 - DNA, 84 bp, Homo sapiens
  chr12:7921500-7921584
  hypo
tataggcatgagccaccacgccgggccttgttactggcatttttagatgtaattaaaatccatattaatcgtcttcaagtaaaa

SEQ ID NO: 43355 - DNA, 43 bp, Homo sapiens
  chr12:7960433-7960476
  hypo
ttagctttagaaaattgggtagcaagcccgcaggtgtgtatga

SEQ ID NO: 43356 - DNA, 41 bp, Homo sapiens
  chr12:7963835-7963876
  hypo
tttaagtaggatagtgatatacagtccgacttctgtatctg

SEQ ID NO: 43357 - DNA, 18 bp, Homo sapiens
  chr12:7973388-7973406
  hypo
aattaaacaacagtccgg

SEQ ID NO: 43358 - DNA, 30 bp, Homo sapiens
  chr12:7980007-7980037
  hypo
actacagaggcacaccgccaccatgcctgg

SEQ ID NO: 43359 - DNA, 30 bp, Homo sapiens
  chr12:7986413-7986443
  hypo
gtggggagaaccagtcgtcttcaccttgcc

SEQ ID NO: 43360 - DNA, 30 bp, Homo sapiens
  chr12:8023514-8023544
  hypo
tgtcttcgtgatgttcgaccagttccacat

SEQ ID NO: 43361 - DNA, 96 bp, Homo sapiens
  chr12:8117682-8117778
  hypo
agatgtggagaacagcgcaggaataataactttagtggaattagtccctgaataaaccattataaatagaatacatttagctgggcgtggtggcac

SEQ ID NO: 43362 - DNA, 18 bp, Homo sapiens
  chr12:8122686-8122704
  hypo
gcccgaactacaattctt

SEQ ID NO: 43363 - DNA, 22 bp, Homo sapiens
  chr12:8127118-8127140
  hypo
ccgtgcccggccaaggtcataa

SEQ ID NO: 43364 - DNA, 38 bp, Homo sapiens
  chr12:8168255-8168293
  hypo
ttgaaagtggctgggcgaggtgcctcatgcctgtaatc

SEQ ID NO: 43365 - DNA, 32 bp, Homo sapiens
  chr12:8170444-8170476
  hypo
atggcatcggctgggcgcggtggacttgtcag

SEQ ID NO: 43366 - DNA, 89 bp, Homo sapiens
  chr12:8322396-8322485
  hypo
taggaggtcacaagtcggcctcttaatttttacagttgccgttaaaacattaaggtaatattgagggtgcagaatggctccttcctcat

SEQ ID NO: 43367 - DNA, 21 bp, Homo sapiens
  chr12:8748055-8748076
  hypo
ccaaagcgctgggattacagg

SEQ ID NO: 43368 - DNA, 30 bp, Homo sapiens
  chr12:8748716-8748746
  hypo
tggcttgaactaaagcgtgtcaatggcttc

SEQ ID NO: 43369 - DNA, 28 bp, Homo sapiens
  chr12:8751148-8751176
  hypo
aggtttacttgacttcgaagtcatactg

SEQ ID NO: 43370 - DNA, 198 bp, Homo sapiens
  chr12:8790007-8790205
  hypo
tgcagagggagacatcgcagctgtctttgggcttggcttcccgccttgttttggagggcctttctgctttgtggctctgtatggcccccagaagatagtggcccggctcaagaagtatgaggctgcctatggaaaacagttcactccatgctagctgctagctgaccatgctaatagccctaacgagaagttgtacca

SEQ ID NO: 43371 - DNA, 61 bp, Homo sapiens
  chr12:8799944-8800005
  hypo
tccaaccttacttcccgactagacaactgcatgaaaaattggatagcgaattatgagtcca

SEQ ID NO: 43372 - DNA, 81 bp, Homo sapiens; identical to SEQ ID NO: 15635
  chr12:8808559-8808640
  hypo

SEQ ID NO: 43373 - DNA, 25 bp, Homo sapiens
  chr12:8869424-8869449
  hypo
caggctcaagcgatcttcccacctc

SEQ ID NO: 43374 - DNA, 80 bp, Homo sapiens
  chr12:8908240-8908320
  hypo
atctcttcctaacaccgcagtgatatgacggatgcttttacattgcaagtcaaatcagcctttgctcaaaatcctccgat

SEQ ID NO: 43375 - DNA, 179 bp, Homo sapiens
  chr12:8975182-8975361
  hypo
gtatataaagctacgcggagcgatctctgcccctgaccctggaaaaatctgtctcacccacaaagatgtgggctcagctccttctaggaatgttggccctatcaccagccattgcagaagaacttccgtgagtgcttggtgtcagaattggtttattagggcagcggcttcttcgccta

SEQ ID NO: 43376 - DNA, 147 bp, Homo sapiens
  chr12:8982341-8982488
  hypo
catggatagcaacttcgttccagtgaatgacaaggtgagttgggaggaggagaaggagtggcgcagggagaacagggaaaaggatgagagattctctagggtggaagtcctctcagcctgggcgtggcaaggcgaggccctctgggt

SEQ ID NO: 43377 - DNA, 103 bp, Homo sapiens
  chr12:8983831-8983934
  hypo
gccactgcacccggcctgagtgcttacttcttaacagactgttttctctagagctgcaacaaggaagtgctgggttcaaagcgtggcccgcagcagcactatt

SEQ ID NO: 43378 - DNA, 30 bp, Homo sapiens
  chr12:9006991-9007021
  hypo
cctaatccacacccacggcctatgaaagca

SEQ ID NO: 43379 - DNA, 135 bp, Homo sapiens
  chr12:9016413-9016548
  hypo
aacctactccatcatcgaacgccagcccttggtctgagcctgcggctgtagatgtggaactcacagcatatgcattgttggcccagcttaccaagcccagcctgactcaaaaggagatagcgaaggccactagca

SEQ ID NO: 43380 - DNA, 21 bp, Homo sapiens
  chr12:9018124-9018145
  hypo
aaactccgtctcaacaacaac

SEQ ID NO: 43381 - DNA, 30 bp, Homo sapiens
  chr12:9026553-9026583
  hypo
ctcatagggcagtagcggtacatagagggt

SEQ ID NO: 43382 - DNA, 105 bp, Homo sapiens
  chr12:9203172-9203277
  hypo
acagccgcccaaatgcgcttgtggatatgagcctccctgtgctcccggagggggccgggagtaggcaggatctgctcttttgggtgcagctgcagctgcccaatc

SEQ ID NO: 43383 - DNA, 29 bp, Homo sapiens
  chr12:10085916-10085945
  hypo
gtaaaactggctgggcgcggtgtctgtca

SEQ ID NO: 43384 - DNA, 28 bp, Homo sapiens
  chr12:10086245-10086273
  hypo
gcttttggtgcttcggtgcagagacaga

SEQ ID NO: 43385 - DNA, 41 bp, Homo sapiens
  chr12:10363278-10363319
  hypo
agtttaattttcagtcgctcatgttaggttttttttttttt

SEQ ID NO: 43386 - DNA, 30 bp, Homo sapiens
  chr12:10364485-10364515
  hypo
ctcttttccagaagacgagccccctttctg

SEQ ID NO: 43387 - DNA, 32 bp, Homo sapiens
  chr12:10823904-10823936
  hypo
taatagcgttgaaatagcgaaggggaattaag

SEQ ID NO: 43388 - DNA, 166 bp, Homo sapiens
  chr12:12848390-12848556
  hypo
acctttaagatgttgcggggccaaatccaatgccggtgcaggtgtcccatatatcctgagagacaaaaagaggtcagattggtcagatccctcgagacagttcccaaattcctgacttctgttaccgcgactgttcttcgcaattccacctcggcctgtgttcagg

SEQ ID NO: 43389 - DNA, 93 bp, Homo sapiens
  chr12:13025675-13025768
  hypo
ggctgatgggtggagcggaggagttttgaggagccagatgagatgaggcacctggggacaggtgaccccagcagctgccgcttgcaggagaga

SEQ ID NO: 43390 - DNA, 187 bp, Homo sapiens
  chr12:13030748-13030935
  hypo
gccagcccggctcagcgaagtcaattcatcagctattttcacttgggaaagagaaattaagggcagagccgcagtccctgccaaacctaacagtctaaaaagcagactgtgtaacttaccaaggcctcagggcaacattagctgcaaatgagctcagcagggcgggggcctccgcacagttctctag

SEQ ID NO: 43391 - DNA, 16 bp, Homo sapiens
  chr12:13035999-13036015
  hypo
gtgtttaaggccgggc

SEQ ID NO: 43392 - DNA, 385 bp, Homo sapiens
  chr12:13079626-13080011
  hypo
gagcaagtatcccggcgattcttctgcttggacagggttgggacaaggcgtcggccagtcatccacattgtctttttgcagatccactaatcttccatgcaggctccaacagctccttcccggcctgggaacccaaatccgcaggaagaatctcggggtgttgtcttggcttattcattcagagctgtcgtgtgtggttctgcaaacagtactcagatgcgttccctctccccgtagggatcttgctggagatgcccagggttaacagtggaactccatatggagacagaggcatggggggagcttcgctggagatgggacagcctgctccaccgcgaagcctactgaggctctcttcttacgtaccccgcgcaatctcatctcc

SEQ ID NO: 43393 - DNA, 94 bp, Homo sapiens; identical to SEQ ID NO: 15639
  chr12:13215216-13215310
  hypo

SEQ ID NO: 43394 - DNA, 30 bp, Homo sapiens
  chr12:13229039-13229069
  hypo
tctggccaacaccaccggcacagtgacggc

SEQ ID NO: 43395 - DNA, 30 bp, Homo sapiens
  chr12:13716358-13716388
  hypo
cgccactggggcagccggctggtccagttc

SEQ ID NO: 43396 - DNA, 36 bp, Homo sapiens
  chr12:14817857-14817893
  hypo
taagccctgagggggcgcggtgtctcacacctgtaa

SEQ ID NO: 43397 - DNA, 18 bp, Homo sapiens
  chr12:14905519-14905537
  hypo
aaaaaaaaagctggccgg

SEQ ID NO: 43398 - DNA, 30 bp, Homo sapiens
  chr12:14926203-14926233
  hypo
agtcaaatctttattcggatagtgagaagg

SEQ ID NO: 43399 - DNA, 52 bp, Homo sapiens
  chr12:14929885-14929937
  hypo
aacatagacaagatacgaggcattgtaactgccctgtcgccacccgcctctc

SEQ ID NO: 43400 - DNA, 82 bp, Homo sapiens
  chr12:17629461-17629543
  hypo
ttccagctcccactccgacgggccagtatttttgtctcctctatcactcccgcctactcttctgaaaacctgctctaccagt

SEQ ID NO: 43401 - DNA, 35 bp, Homo sapiens
  chr12:19636251-19636286
  hypo
aggtaaggttaaatccgtctcgtctcccatgatct

SEQ ID NO: 43402 - DNA, 25 bp, Homo sapiens
  chr12:21833068-21833093
  hypo
aattcaagtttgggccgaagtttaa

SEQ ID NO: 43403 - DNA, 81 bp, Homo sapiens
  chr12:22698115-22698196
  hypo
gatcactcctctgtctccaaaaaaagaaaaaaaagaaagaaagaaatagagataccaggcacatctcgaatagtgaaataa

SEQ ID NO: 43404 - DNA, 187 bp, Homo sapiens
  chr12:25059405-25059592
  hypo
ctgaagctatgggtgcgaaagagaatctctatgtcagttttctccgctgtaaaatgagacaatagcaacacttcatgtttgtcaactgggatagatgagcattaatatatgaaacttatgtatattacttagaaccatgcctgatgtcagccatgcagaataggtgaaagaacgggcatggctctgt

SEQ ID NO: 43405 - DNA, 77 bp, Homo sapiens; identical to SEQ ID NO: 15643
  chr12:25081492-25081569
  hypo

SEQ ID NO: 43406 - DNA, 25 bp, Homo sapiens
  chr12:25191255-25191280
  hypo
caaaattgcaaatgacgaactataa

SEQ ID NO: 43407 - DNA, 30 bp, Homo sapiens
  chr12:25195744-25195774
  hypo
aaagttcataaaacacgttgttatattggt

SEQ ID NO: 43408 - DNA, 30 bp, Homo sapiens
  chr12:25262919-25262949
  hypo
gaaattttaaaattccgtattgaatgttaa

SEQ ID NO: 43409 - DNA, 30 bp, Homo sapiens
  chr12:25537400-25537430
  hypo
tcacctgacaccttccgtgtttaaccggga

SEQ ID NO: 43410 - DNA, 30 bp, Homo sapiens
  chr12:26555243-26555273
  hypo
acttcccatcactaccgtctatctagcgtc

SEQ ID NO: 43411 - DNA, 37 bp, Homo sapiens
  chr12:26555819-26555856
  hypo
cactactccaacagccgctggacgaggtgctaggaat

SEQ ID NO: 43412 - DNA, 153 bp, Homo sapiens
  chr12:27489449-27489602
  hypo
ctatgtatgccctgccgcaccctgtttccttctcttactcaggtgctgtcacacttactggtccctgacacatactgtttacattgtatcacactaggctataatatcccatttacccacccaattttttaacttaaaatatttttaaacctg

SEQ ID NO: 43413 - DNA, 30 bp, Homo sapiens
  chr12:29374034-29374064
  hypo
ctcccttaccaggggcgtattcctgtaagg

SEQ ID NO: 43414 - DNA, 20 bp, Homo sapiens
  chr12:30859424-30859444
  hypo
acaagcgtaagccactgtac

SEQ ID NO: 43415 - DNA, 41 bp, Homo sapiens
  chr12:30947564-30947605
  hypo
gcccctcaaagtgctgggattacaggcgttatccactgcgc

SEQ ID NO: 43416 - DNA, 30 bp, Homo sapiens
  chr12:31255181-31255211
  hypo
ccaggaacctaagagcgcacaccaggtgga

SEQ ID NO: 43417 - DNA, 16 bp, Homo sapiens
  chr12:32087179-32087195
  hypo
gtgccacagctactcc

SEQ ID NO: 43418 - DNA, 27 bp, Homo sapiens
  chr12:32340317-32340344
  hypo
aatctatgggctgggcgcggtggctca

SEQ ID NO: 43419 - DNA, 151 bp, Homo sapiens; identical to SEQ ID NO: 15647
  chr12:32597645-32597796
  hypo

SEQ ID NO: 43420 - DNA, 40 bp, Homo sapiens
  chr12:32831140-32831180
  hypo
ttttttcatgaacaccgccccccgctgctccgacccctgc

SEQ ID NO: 43421 - DNA, 240 bp, Homo sapiens
  chr12:32831300-32831540
  hypo
caccgcgctcggtcctgaacacacattttgtttgtttgtttgtttgtttacaaaacccctggagaacccgcgtattctaacctgggctggtttttgtatttttgcaaaataacaccccacacattctcgtatcagcgtgcagatttttttgcacccagtttggttgtttgcggccataagcttttctttaagcctttccaacccgtccttctagagaaagtgtcttcataaggaagtcac

SEQ ID NO: 43422 - DNA, 157 bp, Homo sapiens
  chr12:33205564-33205721
  hypo
cagaggccaagaccccggggtgggatcagggaccatcccctcacggggcataaggtcatttttcccccagagcctggatccctgtcccccacggggcaagctgggtccctggagccctggagtggagcggcgagtcccggggcggtgcctgtctcag

SEQ ID NO: 43423 - DNA, 43 bp, Homo sapiens
  chr12:34362659-34362702
  hypo
aggccggcaggctcccgtgcacctcagtcggcctctgcactgc

SEQ ID NO: 43424 - DNA, 30 bp, Homo sapiens
  chr12:34364426-34364456
  hypo
cccccccagtctcggcgcagaggctgccgg

SEQ ID NO: 43425 - DNA, 25 bp, Homo sapiens
  chr12:34463931-34463956
  hypo
tgcgtgtcgtgctcacggggacacc

SEQ ID NO: 43426 - DNA, 85 bp, Homo sapiens
  chr12:34464016-34464101
  hypo
ggtgcctctccctccctttcaagccttatcttcccttctgggtcttcttgccactttgggctgcacgccgcgcgtgccacacgct

SEQ ID NO: 43427 - DNA, 81 bp, Homo sapiens
  chr12:34494888-34494969
  hypo
accacgcaccccattcggtgcatacacggggtcccgggtttgcactccccgagcggctggacactgcggggggctgcccaa

SEQ ID NO: 43428 - DNA, 268 bp, Homo sapiens
  chr12:34502619-34502887
  hypo
atttggcctaacccacgcggggtccagcctctccgggggtgtgaaccccggacctcagggtcctcaggacccagtgcatgcgcagcaggtgggacttggggttggccgggggccaagagccccactttgcggtaccggttttttccttccaccagtgtttcggcctccccgttcaagcctccctgcggctgtgggcggctaccccaggggaccagctgctccgagggcgcgagcctaggaccctgcttatgcacggcaggggtggtgt

SEQ ID NO: 43429 - DNA, 93 bp, Homo sapiens
  chr12:34519278-34519371
  hypo
ggaccgtaggcactccgtggccatgagtcagggatgccaagggtcccctgggccccgcgcatgctcagtagagaggcaatgcctcccatgttg

SEQ ID NO: 43430 - DNA, 113 bp, Homo sapiens
  chr12:34520137-34520250
  hypo
acaaaacagctgccacgacctccactttcaagtcttcgtgcaccttgggctagccgcctttggccggaggcgctcagtgtgtgcgaaccagggatgcgcggggtcccctgggc

SEQ ID NO: 43431 - DNA, 30 bp, Homo sapiens
  chr12:34522309-34522339
  hypo
gggatccacgcattgcggtggggaggcact

SEQ ID NO: 43432 - DNA, 30 bp, Homo sapiens
  chr12:38543382-38543412
  hypo
aggcttgacctgagacgcaggggcattgtg

SEQ ID NO: 43433 - DNA, 30 bp, Homo sapiens
  chr12:38549417-38549447
  hypo
cccctgcgccgggcccgggggagttgtgga

SEQ ID NO: 43434 - DNA, 177 bp, Homo sapiens
  chr12:38550692-38550869
  hypo
gcgggcaccccaaagcgtcaagaatgaccccacgggaaggggaaagcatgtcggtcttaaagagggacgttgaggcagcccggagaaaaaaacagggaggctggggtccttccaccgatgacagtgccttcccggcatcccatgtgccatctccgggcgggtcgtggagtccctggc

SEQ ID NO: 43435 - DNA, 207 bp, Homo sapiens
  chr12:38551229-38551436
  hypo
tcccggcagcccctgcgccagactcggggttgtcgtggagttcctgacttgaacccagggtgcgtgtcgcgcccacggggggacaccccaaagcggcaagaatgccccctgggaagggaacaggacgccaggcttgaaaggggactttgaagcagtccaggaaaaaacttcccacggaccacggtgccttcccggcagcccctttgc

SEQ ID NO: 43436 - DNA, 43 bp, Homo sapiens
  chr12:38551858-38551901
  hypo
gtccctggcttgcaccgagggtgcgggtcgcacccatgggggc

SEQ ID NO: 43437 - DNA, 36 bp, Homo sapiens
  chr12:38553830-38553866
  hypo
cctctgcagtgggcccgggagcgtcctggagtccct

SEQ ID NO: 43438 - DNA, 96 bp, Homo sapiens
  chr12:38595440-38595536
  hypo
tctgagggcccagctcgggcctgccgggtggccagggaagatgttggtagcggcagtggtggggctggcgcccctgcgttgcggcccctgggctcc

SEQ ID NO: 43439 - DNA, 30 bp, Homo sapiens
  chr12:40501737-40501767
  hypo
acagttatgtatctgcggtcaggttacatt

SEQ ID NO: 43440 - DNA, 30 bp, Homo sapiens
  chr12:41925162-41925192
  hypo
tgtcggtgcttacaacgtcctctccaagtc

SEQ ID NO: 43441 - DNA, 24 bp, Homo sapiens
  chr12:42654216-42654240
  hypo
gataatagtacttgccgggaggcg

SEQ ID NO: 43442 - DNA, 83 bp, Homo sapiens
  chr12:42654300-42654383
  hypo
ccatctcaaaaaaaaaaaaacaaaaaagaattattgtgggttgataacacaaagtactgtggctggtacggtaagttctatgc

SEQ ID NO: 43443 - DNA, 21 bp, Homo sapiens
  chr12:43957389-43957410
  hypo
ccaccgcgcccggccctcaga

SEQ ID NO: 43444 - DNA, 86 bp, Homo sapiens
  chr12:47628723-47628809
  hypo
ccaacctgcactgggcgctccgcccagaggtgagtccctcccagcccttctctccttctgtcctagccatccgcagagccatcctg

SEQ ID NO: 43445 - DNA, 140 bp, Homo sapiens
  chr12:47629068-47629208
  hypo
aactaccgtgaggtccgcgagttccgctccgaccaccatctggtacgtttttacttcctcacccgcgtgtactccgattacctccagaccatcttgaaagagctgcagtcgggcgagcacgcccccgacctggtcatcat

SEQ ID NO: 43446 - DNA, 30 bp, Homo sapiens
  chr12:48590883-48590913
  hypo
taagtctgatggtctcggtacatgcgatac

SEQ ID NO: 43447 - DNA, 18 bp, Homo sapiens
  chr12:49108598-49108616
  hypo
tataaggcggccaggcgc

SEQ ID NO: 43448 - DNA, 25 bp, Homo sapiens
  chr12:49174695-49174720
  hypo
cattctggccaggtgcggtggctca

SEQ ID NO: 43449 - DNA, 17 bp, Homo sapiens
  chr12:49455664-49455681
  hypo
agagtctcgcactgtcg

SEQ ID NO: 43450 - DNA, 35 bp, Homo sapiens
  chr12:49596187-49596222
  hypo
aatcagacagccgggcgcggtggctcacgcctgta

SEQ ID NO: 43451 - DNA, 147 bp, Homo sapiens; identical to SEQ ID NO: 1598
  chr12:49657607-49657754
  hypo

SEQ ID NO: 43452 - DNA, 30 bp, Homo sapiens
  chr12:50790622-50790652
  hypo
tctagatgtgttggccgggtgcagtggctc

SEQ ID NO: 43453 - DNA, 32 bp, Homo sapiens
  chr12:50897742-50897774
  hypo
tttcttttctttagacggagtgtttgctctct

SEQ ID NO: 43454 - DNA, 497 bp, Homo sapiens
  chr12:51421089-51421586
  hypo
ccagcctgggtggcagagcaaaaccctgtctcaaaaaaaaaggatagccacctggaaggaacatttcctcgcgcccccagagccacatcatagtatctgctgccccaccaagagcaccccacacctgggaggaaccgagaaacatcagctagtgcagccagtttgaccgccttaggtgtcctcccaagcctccgtagtgaattgttttcctcctcgcccagctgactcgattctccccagacttcatcctacctacccaaaagcaatcccactctatcgccagtttcagcctcacaccgtatcttttgctctgaagatgagactgccaaactggtgaagagggaataaatggcctaacaaattaccgtaattttctgcaatgtcgtttacagccaccaaaaacattagatcctcccgccaccctcactccccgacccctcgcactgcttacagcattaaaggtaattgagcttctttattcacgtaaaaacagctag

SEQ ID NO: 43455 - DNA, 21 bp, Homo sapiens
  chr12:51565449-51565470
  hypo
cgcacccggccgaaaggagat

SEQ ID NO: 43456 - DNA, 98 bp, Homo sapiens
  chr12:51930708-51930806
  hypo
ctctcaccagcagtgcgtagatggatgtggtgagccactcccaagtttttgctcttaaaaagactgagcatgaagctgggcgctgtggctcatgcctg

SEQ ID NO: 43457 - DNA, 148 bp, Homo sapiens
  chr12:52387912-52388060
  hypo
cggagctcctggcagcgagaactacgcacagctgccgcgttgagcgtacgatggaggcctacctctcgtttctgcccagccctctgtggccaggagccctggcccgcaagagggacagagcccgggagagactcgctcactcccatgt

SEQ ID NO: 43458 - DNA, 94 bp, Homo sapiens
  chr12:52388344-52388438
  hypo
caggcagctctgagccgcgctttcccctcctccctgggatggacgctgccgggagactgccagtggagacggaatctgccgctttgtctgtcca

SEQ ID NO: 43459 - DNA, 30 bp, Homo sapiens
  chr12:52467638-52467668
  hypo
tctgaggaactggatcgtgccctgcgcaag

SEQ ID NO: 43460 - DNA, 30 bp, Homo sapiens
  chr12:52913808-52913838
  hypo
gcaccagcaccaaaccggttcctgaagctg

SEQ ID NO: 43461 - DNA, 30 bp, Homo sapiens
  chr12:52914057-52914087
  hypo
gacacacttgactggcgagacatggtggct

SEQ ID NO: 43462 - DNA, 102 bp, Homo sapiens
  chr12:53069161-53069263
  hypo
tgctgcttccggagccgtagctgccatggccgccgccgccacctccagagccatagctgccacctccggagccgtagctgctacctccggagccatagctgc

SEQ ID NO: 43463 - DNA, 210 bp, Homo sapiens
  chr12:53189513-53189723
  hypo
agccacctccatagccgctcccaaagccacctccatagccacctgcaaaggcacagctgctccgccctcccccaaagcctccagcccgggagccgccagctgccacgctgatggagatgctcttgttgccgcccaggttgtagaggctgcgactgccaaagccacctgctccgctccggaagccataggcccctccgccagctcccccag

SEQ ID NO: 43464 - DNA, 30 bp, Homo sapiens
  chr12:53455806-53455836
  hypo
ctgtgctggccatgccgctgtagaggggag

SEQ ID NO: 43465 - DNA, 30 bp, Homo sapiens
  chr12:53456042-53456072
  hypo
gcctggggaaggctacgttgggtcggttta

SEQ ID NO: 43466 - DNA, 240 bp, Homo sapiens
  chr12:53662984-53663224
  hypo
gtgtctaccccacagcgtcctcccctctacctggaacgaattctctttgtcttactgcggaatgctgctgcacaaggaagcccagaggccacactccgccttgctcagcccctccatgcctgcttggtgcagtgctctcgcgaggctgctccccaggactatgaggccgtggctcggggcagcttttctctgctttggaagggggcagaagccctgttggaacggcgagctgcatttgca

SEQ ID NO: 43467 - DNA, 30 bp, Homo sapiens
  chr12:53813830-53813860
  hypo
ggaaacacagttttccggttgcttgtcaat

SEQ ID NO: 43468 - DNA, 120 bp, Homo sapiens
  chr12:53885488-53885608
  hypo
ttacaggcgtgagccaccgcgcccggcaggcatagaggtattaaataatctgcccacagggccatagctattaagaagctcaagctctgctgggcgcagtggctcacgcctgtaatccca

SEQ ID NO: 43469 - DNA, 97 bp, Homo sapiens; identical to SEQ ID NO: 1599
  chr12:54720206-54720303
  hypo

SEQ ID NO: 43470 - DNA, 111 bp, Homo sapiens
  chr12:55356770-55356881
  hypo
tggggtggtggtggccggtctcgggggcatgtgtacagacacatcttggagatggctttccgaaggcggtctctgggtgactggggttcaggctctcgggacagaatcctg

SEQ ID NO: 43471 - DNA, 30 bp, Homo sapiens
  chr12:55786344-55786374
  hypo
tgctgagggaccgggcgcctgcctgctcca

SEQ ID NO: 43472 - DNA, 30 bp, Homo sapiens
  chr12:56094359-56094389
  hypo
ctcagccagcagcagcgtgcggagacggga

SEQ ID NO: 43473 - DNA, 43 bp, Homo sapiens; identical to SEQ ID NO: 15661
  chr12:56441277-56441320
  hypo

SEQ ID NO: 43474 - DNA, 30 bp, Homo sapiens
  chr12:57493886-57493916
  hypo
gggaaaggtgtgagccgagggagggccaga

SEQ ID NO: 43475 - DNA, 56 bp, Homo sapiens
  chr12:57559766-57559822
  hypo
gcctgcagggcagctcggctctggcagtgcctatactggagcgggcaggaagctgg

SEQ ID NO: 43476 - DNA, 214 bp, Homo sapiens
  chr12:57881112-57881326
  hypo
ctttgtcactaattccgcacatggtaactccgaactctaaaactctgaccgttaagagcttgcatcgagagccactgcgagtagctgctgttatgacatggccatttcattctccacaacaagagaagcagccgcggcttcagtcaccgccctccagcagcgtaagaggataaaagtgcgacttgccctaaaacctaaacgtctcttctggatc

SEQ ID NO: 43477 - DNA, 90 bp, Homo sapiens
  chr12:58241509-58241599
  hypo
accttcgaatcccgaaaggggtgtgtgcgtgtgggcggacctaggactccagagtataagagctggaactgacctcgggactgtgtcccc

SEQ ID NO: 43478 - DNA, 39 bp, Homo sapiens
  chr12:62429791-62429830
  hypo
attacaggcgtgagccaccgcgcccggccaatgattctt

SEQ ID NO: 43479 - DNA, 31 bp, Homo sapiens
  chr12:62539074-62539105
  hypo
cctcctgtcagttggcggtggcctcagattc

SEQ ID NO: 43480 - DNA, 31 bp, Homo sapiens
  chr12:62539225-62539256
  hypo
cctccgcacccccgtccgtggaaaaattgtc

SEQ ID NO: 43481 - DNA, 42 bp, Homo sapiens
  chr12:62563338-62563380
  hypo
atagatgttttaggccgggcacagtggctcacgcctgtaatc

SEQ ID NO: 43482 - DNA, 168 bp, Homo sapiens
  chr12:62580835-62581003
  hypo
aacgagaatagtacacgccaatgtaatacatagtttgtgcattgactatggaggtgtatattcaataaagacagcagcacacagatatgttcagcgttcaaaatgtgtcaaaattcccagttgtagtgtcaataaaaacatccacagtgtctccgcattgaggacaaa

SEQ ID NO: 43483 - DNA, 22 bp, Homo sapiens
  chr12:62603703-62603725
  hypo
aggcgcaggggctcacgcctgt

SEQ ID NO: 43484 - DNA, 40 bp, Homo sapiens
  chr12:62630994-62631034
  hypo
atccattctgttcgccgggcgcggtggctcacgcctgtaa

SEQ ID NO: 43485 - DNA, 30 bp, Homo sapiens
  chr12:63788043-63788073
  hypo
aaagaaaaaaaaaagcgggaggagtgagta

SEQ ID NO: 43486 - DNA, 163 bp, Homo sapiens
  chr12:64783185-64783348
  hypo
ttggatcaagtgagccgcctgagattgccaagcgtcctgtgcgcatctcattaacgcatctgcttattcatgcatttattcttttgctggggagggggtggaggggaacggtgtctcactcattctgtagctcaggctggagtgcaggtggggcgatctcggc

SEQ ID NO: 43487 - DNA, 42 bp, Homo sapiens
  chr12:64797450-64797492
  hypo
aaataaattttggaccggacaccgtggctcacgcctgtaatc

SEQ ID NO: 43488 - DNA, 20 bp, Homo sapiens
  chr12:64799707-64799727
  hypo
ttgatcgtccaaatgccttc

SEQ ID NO: 43489 - DNA, 170 bp, Homo sapiens; identical to SEQ ID NO: 15669
  chr12:65516360-65516530
  hypo

SEQ ID NO: 43490 - DNA, 29 bp, Homo sapiens
  chr12:65530856-65530885
  hypo
ctagaaaaggccaggcgtggtggcctttt

SEQ ID NO: 43491 - DNA, 22 bp, Homo sapiens
  chr12:65557212-65557234
  hypo
gagaagtgatagcatcggccgg

SEQ ID NO: 43492 - DNA, 23 bp, Homo sapiens
  chr12:65562063-65562086
  hypo
ttgactaacgtttttctgtacag

SEQ ID NO: 43493 - DNA, 30 bp, Homo sapiens
  chr12:65787081-65787111
  hypo
agaatttcaacctttcgttttattataagg

SEQ ID NO: 43494 - DNA, 44 bp, Homo sapiens
  chr12:66208320-66208364
  hypo
aatagacagataggccgggcgccgtggctcacgcctgtaatccc

SEQ ID NO: 43495 - DNA, 30 bp, Homo sapiens
  chr12:66211140-66211170
  hypo
tgttcacttaaagtccggaaggattaaaat

SEQ ID NO: 43496 - DNA, 22 bp, Homo sapiens
  chr12:66242342-66242364
  hypo
ttaaaagtttaaggccgggtgc

SEQ ID NO: 43497 - DNA, 81 bp, Homo sapiens
  chr12:68978219-68978300
  hypo
aaatctcatagtctccgaggtcactaagagctttatttccttgccaggagcggtggctcacacctgtaatcccagcacttt

SEQ ID NO: 43498 - DNA, 21 bp, Homo sapiens
  chr12:68978600-68978621
  hypo
tttttccgttttcactagaaa

SEQ ID NO: 43499 - DNA, 19 bp, Homo sapiens
  chr12:69751028-69751047
  hypo
tttttgtttttgagacgga

SEQ ID NO: 43500 - DNA, 16 bp, Homo sapiens
  chr12:69754426-69754442
  hypo
acacagcccctggcac

SEQ ID NO: 43501 - DNA, 120 bp, Homo sapiens
  chr12:69754562-69754682
  hypo
gccaccgcgcccagccgtggttcattctttttaaagaaaaatttcctttcctttataaataaaaatcagaaggggtacaaatagttgtttttatcaggagccagtgggtcctgccttaaa

SEQ ID NO: 43502 - DNA, 114 bp, Homo sapiens; identical to SEQ ID NO: 15674
  chr12:69964176-69964290
  hypo

SEQ ID NO: 43503 - DNA, 23 bp, Homo sapiens
  chr12:69999350-69999373
  hypo
atcacaattactggccgggcgcg

SEQ ID NO: 43504 - DNA, 30 bp, Homo sapiens
  chr12:70024017-70024047
  hypo
agccctactgcagtgcgtgggcttcttcct

SEQ ID NO: 43505 - DNA, 254 bp, Homo sapiens
  chr12:70087493-70087747
  hypo
cacagcagtgctcaccgagcgaaagatgagcagggaggtgagattgacgtagcgcatcagcgtccttctaagcaggcgcccgtgctcgtcgcttccgtgaacactgctagagatgaggaacattagcctgtctggccagggcaaattcacaaactggttccaccatcggttcactaccagagtaacataaaaccctgtagaataacaggaaattataaagcagtttcttacagcagacacgttggtgacactga

SEQ ID NO: 43506 - DNA, 30 bp, Homo sapiens
  chr12:70173245-70173275
  hypo
tgaactccaattactcgaacattttctctt

SEQ ID NO: 43507 - DNA, 137 bp, Homo sapiens
  chr12:71626492-71626629
  hypo
aaaatgctggtattacaggcgtaagccaacacacatggccctatttacttctttagtccattagattagatatcatttgcctgaaaaatcaggttagccattgtttcaaatgggctacttaccgtctaatatttcat

SEQ ID NO: 43508 - DNA, 37 bp, Homo sapiens
  chr12:72054795-72054832
  hypo
cacattggctgggcacggtggctcatgcctgtaatcc

SEQ ID NO: 43509 - DNA, 30 bp, Homo sapiens
  chr12:72077720-72077750
  hypo
ttttcggattgttaccggtggaaggtgtcc

SEQ ID NO: 43510 - DNA, 16 bp, Homo sapiens
  chr12:72634641-72634657
  hypo
gcgcctggcctctcca

SEQ ID NO: 43511 - DNA, 20 bp, Homo sapiens
  chr12:73732468-73732488
  hypo
gcgcccggccatttactggt

SEQ ID NO: 43512 - DNA, 30 bp, Homo sapiens
  chr12:74092079-74092109
  hypo
gctataaacttgcttcgttttttctttaaa

SEQ ID NO: 43513 - DNA, 25 bp, Homo sapiens
  chr12:74930406-74930431
  hypo
catgtaaggcactgtcgcaagattt

SEQ ID NO: 43514 - DNA, 43 bp, Homo sapiens
  chr12:77085862-77085905
  hypo
gtactgagtgtgtaacgccaaaggttcttttgtttgtttgttt

SEQ ID NO: 43515 - DNA, 30 bp, Homo sapiens; identical to SEQ ID NO: 15677
  chr12:77150018-77150048
  hypo

SEQ ID NO: 43516 - DNA, 30 bp, Homo sapiens
  chr12:79842607-79842637
  hypo
tttccaattctttagcgctcaaggacgctt

SEQ ID NO: 43517 - DNA, 96 bp, Homo sapiens
  chr12:80488160-80488256
  hypo
tgtagggaagaggaacgaggaacaacaaacaggtaaataaatacattaaattgtttccttgtttaccgtctattctttgtgggtttggtgactcat

SEQ ID NO: 43518 - DNA, 30 bp, Homo sapiens
  chr12:89794228-89794258
  hypo
tgcaaacatttttggcgtgggaacactccc

SEQ ID NO: 43519 - DNA, 156 bp, Homo sapiens
  chr12:90313545-90313701
  hypo
ggcctcctccttggccgggcgctgggcgggaggcgggagcgagcgtgctagccaagcatgtgggccgcgctgaggcttgacgaggccggcgtcccttttcctgaggcacgtgcgccgccgccgccatcatgccgtgcgcgccgccctaatgctttt

SEQ ID NO: 43520 - DNA, 33 bp, Homo sapiens
  chr12:93711081-93711114
  hypo
ttacagtccaatgaccgccgtgggtcataatcc

SEQ ID NO: 43521 - DNA, 30 bp, Homo sapiens
  chr12:93797551-93797581
  hypo
tgaaaagtaatctatcgctggtgctacttt

SEQ ID NO: 43522 - DNA, 30 bp, Homo sapiens; identical to SEQ ID NO: 15678
  chr12:94641622-94641652
  hypo

SEQ ID NO: 43523 - DNA, 81 bp, Homo sapiens; identical to SEQ ID NO: 15679
  chr12:95465839-95465920
  hypo

SEQ ID NO: 43524 - DNA, 20 bp, Homo sapiens
  chr12:96881018-96881038
  hypo
agccacgacacccagccaat

SEQ ID NO: 43525 - DNA, 30 bp, Homo sapiens
  chr12:97073402-97073432
  hypo
ctgcgtgcccgtggacgtgacagacacctt

SEQ ID NO: 43526 - DNA, 133 bp, Homo sapiens
  chr12:98763899-98764032
  hypo
ctatgaatgaggtaccggctagattgttggcaacacagcaggtagacaagagtcagtccctgttatcaagggatcacagttcagtgagctaaatagaaacgtgccttcaactgcactgcgctacactgaaaca

SEQ ID NO: 43527 - DNA, 38 bp, Homo sapiens
  chr12:98947863-98947901
  hypo
ctaggattacaggcgtgagccaccgcgccgggccaata

SEQ ID NO: 43528 - DNA, 42 bp, Homo sapiens; identical to SEQ ID NO: 15681
  chr12:98948376-98948418
  hypo

SEQ ID NO: 43529 - DNA, 24 bp, Homo sapiens
  chr12:98986204-98986228
  hypo
ttaagaatttcaagccgggcatgg

SEQ ID NO: 43530 - DNA, 35 bp, Homo sapiens
  chr12:100595448-100595483
  hypo
ccgaggctggagtgccgtggtgcgatctcagctca

SEQ ID NO: 43531 - DNA, 30 bp, Homo sapiens
  chr12:101025517-101025547
  hypo
ttgtgagaggctactcggagcgtaacactg

SEQ ID NO: 43532 - DNA, 30 bp, Homo sapiens
  chr12:102158693-102158723
  hypo
ctcaaaaaggatttccgcctctggaagaag

SEQ ID NO: 43533 - DNA, 30 bp, Homo sapiens; identical to SEQ ID NO: 15682
  chr12:104690709-104690739
  hypo

SEQ ID NO: 43534 - DNA, 85 bp, Homo sapiens
  chr12:104695389-104695474
  hypo
caggcgtgagccaccgtgcccggctgcttttgttgaatttaaagtggatgtgagaagctcctaagaatatcgttcactgtaaaag

SEQ ID NO: 43535 - DNA, 102 bp, Homo sapiens
  chr12:104696536-104696638
  hypo
gattgcaggcgtgagccaccgcgcccggccattcccattgttatgtatactttgctatttgctgctggtgagacagataaggagtcacgtctttaactgcac

SEQ ID NO: 43536 - DNA, 30 bp, Homo sapiens
  chr12:104698273-104698303
  hypo
caccagaaaaaagttcgcaagatggaagaa

SEQ ID NO: 43537 - DNA, 30 bp, Homo sapiens
  chr12:104975785-104975815
  hypo
gcactacgtcattatcgtcagcatcatcat

SEQ ID NO: 43538 - DNA, 78 bp, Homo sapiens
  chr12:105018625-105018703
  hypo
tctttttggctcacagacggccacctttttggctgtgtcctcacatggtctttccacggtgcccgtgcactcctggtt

SEQ ID NO: 43539 - DNA, 30 bp, Homo sapiens
  chr12:105056939-105056969
  hypo
ttccagaggcctgggcgagccctgtctaac

SEQ ID NO: 43540 - DNA, 141 bp, Homo sapiens
  chr12:105069324-105069465
  hypo
aaccgaactaacaaccgctgttatgagccgagtgcttactcagtgccaagtgctttgtttggactttattcaatccaggggttgaagaaccactcactctggagtcagattcctggtcctaaaccacgtacttaagcaaat

SEQ ID NO: 43541 - DNA, 30 bp, Homo sapiens
  chr12:105104162-105104192
  hypo
cttcggtggcacttccgtgggctctctggg

SEQ ID NO: 43542 - DNA, 200 bp, Homo sapiens
  chr12:107138858-107139058
  hypo
taggaagaatttgggcggcatgtttcacctcattctgaattgcattttttgcctccaattctgcttttctttcttctttcattcccacttccattttattgtctcgaatcttttatattgctatacactcccttaaattcttttggatttaaccatcagtttcctcatctataaatgggggataacgttcttttaagggt

SEQ ID NO: 43543 - DNA, 158 bp, Homo sapiens
  chr12:108898965-108899123
  hypo
gtcagacatagatgccggcagttgagccaatcatgttaaagacagcggctccatctccccttgtctttgtcagccacgtgtacagcaaacaccagacatgatgaccccagtcaactggaaagcctattcacataacaagattagggtggggtggccag

SEQ ID NO: 43544 - DNA, 58 bp, Homo sapiens
  chr12:109208616-109208674
  hypo
ggtgggaaggaagagcgccatgggggcggtgcggacgagcgcacgggccagtctcctc

SEQ ID NO: 43545 - DNA, 30 bp, Homo sapiens
  chr12:109343659-109343689
  hypo
agaatttaaacttcccgggagtagccctca

SEQ ID NO: 43546 - DNA, 30 bp, Homo sapiens
  chr12:109719635-109719665
  hypo
ccacccagcagttaccgggccccagcccag

SEQ ID NO: 43547 - DNA, 37 bp, Homo sapiens
  chr12:110506967-110507004
  hypo
aggcacggtgcctcacgcctgtaatcccagcattttg

SEQ ID NO: 43548 - DNA, 38 bp, Homo sapiens
  chr12:110563206-110563244
  hypo
ttttttctgttgagacggagtctctctctgtcccccag

SEQ ID NO: 43549 - DNA, 258 bp, Homo sapiens
  chr12:110717541-110717799
  hypo
ggagaagaattggtacgaaatggtgcagagctggtctcagagggcaacaacagccagccctccatgaccacactcccaccgtgcactcacgtgcccctcttgaagcggctctgatcctgtgacctaaccagtttccacctggcttctctcagtgcgttgccatatagtataattttttgtttgtttgtttcgtgtagggttttgttggttcttttccaagtatcaatcaaaactacatgccaacgtccactccttgga

SEQ ID NO: 43550 - DNA, 30 bp, Homo sapiens; identical to SEQ ID NO: 15684
  chr12:110782730-110782760
  hypo

SEQ ID NO: 43551 - DNA, 23 bp, Homo sapiens
  chr12:110840421-110840444
  hypo
agccactacgcccggccaataaa

SEQ ID NO: 43552 - DNA, 39 bp, Homo sapiens
  chr12:110908132-110908171
  hypo
gacctcgtgatccgcccgcatggccgtcctttttgtctc

SEQ ID NO: 43553 - DNA, 35 bp, Homo sapiens
  chr12:110915431-110915466
  hypo
attacaggcgtgagtcaacgcgcccagtcttgtca

SEQ ID NO: 43554 - DNA, 30 bp, Homo sapiens; identical to SEQ ID NO: 15686
  chr12:111296630-111296660
  hypo

SEQ ID NO: 43555 - DNA, 30 bp, Homo sapiens
  chr12:111355976-111356006
  hypo
tgtgagccctcgcaacggctggaaaatgaa

SEQ ID NO: 43556 - DNA, 224 bp, Homo sapiens
  chr12:111369069-111369293
  hypo
caggatcccagagctcggatccagcctcaacgacccagatagccctgcagtggctttcttgtccctggtatttttagccctcggtcatctatcttgcctgcactggggacagcggcactcagacaagcccatttttactggtgcccttcagatgcccgcgggctcagctgtctcggtgcctggcattccgggggtattgttcctctctacgagtcccagattcc

SEQ ID NO: 43557 - DNA, 30 bp, Homo sapiens
  chr12:111535459-111535489
  hypo
gactgcacaagacagcgttttctcacagca

SEQ ID NO: 43558 - DNA, 30 bp, Homo sapiens
  chr12:111763122-111763152
  hypo
gctaatgctaatgaccgctgccacttacca

SEQ ID NO: 43559 - DNA, 23 bp, Homo sapiens
  chr12:112281623-112281646
  hypo
tgtttgtttttgagacggagtct

SEQ ID NO: 43560 - DNA, 68 bp, Homo sapiens
  chr12:112605535-112605603
  hypo
gagacacacactgcccgccaccccagccactgcgcaggacatgagctcgggggcgtggagcctcctcc

SEQ ID NO: 43561 - DNA, 91 bp, Homo sapiens
  chr12:112610355-112610446
  hypo
gtgttcataagtgttcgttcgatggacgtctaaatgaatctagcccttgtaaatgccccttgtcatggggcatgcccgcatcaggcagcag

SEQ ID NO: 43562 - DNA, 30 bp, Homo sapiens; identical to SEQ ID NO: 15688
  chr12:112628549-112628579
  hypo

SEQ ID NO: 43563 - DNA, 30 bp, Homo sapiens
  chr12:112630855-112630885
  hypo
gcaacttactctttgcggaatccagattga

SEQ ID NO: 43564 - DNA, 30 bp, Homo sapiens
  chr12:112820695-112820725
  hypo
ttggtgctcaatgcccgacacttaatatgt

SEQ ID NO: 43565 - DNA, 152 bp, Homo sapiens
  chr12:112825982-112826134
  hypo
ctccagcctgggcaacctaacgagtccatctcaaaaaataaaaataaaaataaaaataaaaaagttgttagcacaaaggaaaagtggacaaaagatattattgaagagttttcactcaaggaaaagcaaacactgtacgtttttgttccttc

SEQ ID NO: 43566 - DNA, 30 bp, Homo sapiens; identical to SEQ ID NO: 15690
  chr12:112919571-112919601
  hypo

SEQ ID NO: 43567 - DNA, 36 bp, Homo sapiens
  chr12:113677751-113677787
  hypo
gctgctccaagctgccggctgcgctgcctttcactt

SEQ ID NO: 43568 - DNA, 98 bp, Homo sapiens
  chr12:113725864-113725962
  hypo
gtcttcaccgcatggcgtgtggaaggcggggccggcatgttctgagggcgggggctgaggcgtgcacctgtgtgtggaggtgacgggtgtcctcctcg

SEQ ID NO: 43569 - DNA, 36 bp, Homo sapiens
  chr12:113795723-113795759
  hypo
ggcgtgagccaccgcgcccgacggcatctaggtttt

SEQ ID NO: 43570 - DNA, 143 bp, Homo sapiens
  chr12:114130077-114130220
  hypo
gcatgcgcacccatgcgccgcacacactccgacacatgcaccctccagctcaaataggtggacgtgcttgggaaaaccatggagtaagtgagccccacagagagggaccgtgaaatccctgttgccgccggggccaccagaat

SEQ ID NO: 43571 - DNA, 49 bp, Homo sapiens
  chr12:114236483-114236532
  hypo
ctgtcacctcatcagcgaggccgtgcctgggtcccgagtgagggcgctc

SEQ ID NO: 43572 - DNA, 180 bp, Homo sapiens
  chr12:114240258-114240438
  hypo
ccctacagatggggacgtggctcagggaggtacagtgcttgcctgagtcacacagccgggaggcgacacgcccgggtgcgctcagttaatcctcggagatgagtgttcctctcatgcccgttttacagaggaggaaactgaggcacagaacaaccctgaggtaaccgccctgaggtcaca

SEQ ID NO: 43573 - DNA, 30 bp, Homo sapiens
  chr12:114295503-114295533
  hypo
gctggcgaggctctccgagggtccccatgc

SEQ ID NO: 43574 - DNA, 152 bp, Homo sapiens
  chr12:114329563-114329715
  hypo
aagataaaacttttgcgaacacgcctctgttaaagggacttgatttaaatttcaggtaggcagagtataattgccccacgaagtgtaatcacactgcctggattcaaacctctccaatgtgattccctctgtcttcccgctcatttccctgt

SEQ ID NO: 43575 - DNA, 49 bp, Homo sapiens
  chr12:114337939-114337988
  hypo
ggaagcccgagcctgcgaaatctcaaaggaaggacgaaaacaacggcaa

SEQ ID NO: 43576 - DNA, 74 bp, Homo sapiens
  chr12:116756120-116756194
  hypo
gggttgaactgtggccgcacctggttagcaccgttctttttcttcttctgaaggaaaggcgtggctgttccgag

SEQ ID NO: 43577 - DNA, 59 bp, Homo sapiens
  chr12:116842266-116842325
  hypo
tgtctggtcaccgcacgtcgttattcagttcacacacagctaagcgtgcagctgtgttg

SEQ ID NO: 43578 - DNA, 172 bp, Homo sapiens
  chr12:116941191-116941363
  hypo
acacagggcgtgggacgctggataaaacctaaagagacctgacccactgccctctaggtgcttagcctctgaccacaccaagctagcgacattccaatctctcataaaaagcatttcaaaatgaaagagactgggcaaataaatcgtggtacatgcacggaatgcgatggcc

SEQ ID NO: 43579 - DNA, 30 bp, Homo sapiens
  chr12:117472788-117472818
  hypo
agccgggcaggagagcgccaggtgatttct

SEQ ID NO: 43580 - DNA, 30 bp, Homo sapiens
  chr12:117473067-117473097
  hypo
gggcacaggggctgacggaagatgatttat

SEQ ID NO: 43581 - DNA, 211 bp, Homo sapiens
  chr12:117473987-117474198
  hypo
gcctggggtggcacacgctgctgtctggtgtctactaggctctgccaggtgcttacaatgacaatgacagcacagagtcaagagcctctcagccgcagcttggcacctacccaggaggtcgtgcgcattaaccaaaagctgagcctccccaggccgcactcactttcccggggccattcgcccgctccctgtgtagcgggtcacctggccc

SEQ ID NO: 43582 - DNA, 198 bp, Homo sapiens
  chr12:117474577-117474775
  hypo
cctgcctagggttcccgctgggaccacaccaggctcaacgctagagtggagatggggcatctcagcaccatctgggctccgtgcgtttgcagccttaagcacaagtcacggtcccctagaacagtgtccggggcctgtgcttatgatgggctgtaccgaatgaactcccccagcctttaatgtagaaggggtagggcc

SEQ ID NO: 43583 - DNA, 30 bp, Homo sapiens
  chr12:117484341-117484371
  hypo
ggagggctgcaggggcgctcaccatctgcc

SEQ ID NO: 43584 - DNA, 347 bp, Homo sapiens
  chr12:117529912-117530259
  hypo
cctcaaagggcttttcggcagatcagatgattgacaagtgctcaagaaagagcagctgtcacctcattcacagctggctgcgttttttaaggagcggaactggtggctcaaagaaggacacagcctggatgagacatctgagcgaagtggcacaggacggctccagcaccgagctcagtgcacatggaacgccatcctccagggtcccgctctgtggctgcgacagatggtgagatgatggggcccaggtgaacagaatgaaaaataccagcatgggctagagcaggcaggtgcctttggttgatccccagccctgtgggaagcttccacagcgggcattctcctgc

SEQ ID NO: 43585 - DNA, 87 bp, Homo sapiens
  chr12:117530986-117531073
  hypo
ctggagggcagggaccgcatctggtccaccctggtagcagaatatggcaattggtgaatgagccgaggccaccgtctgaggccactt

SEQ ID NO: 43586 - DNA, 151 bp, Homo sapiens
  chr12:117532401-117532552
  hypo
tgcgggctccaggagcgctgaggatgggtgtttaacccttaaaggtcggatggagagatggctttctggatgggagcagcaggtaagccaacccctgaacaataatgagcattcgtttcataaagagacagggttaacgctgtgcgcggtg

SEQ ID NO: 43587 - DNA, 20 bp, Homo sapiens
  chr12:117533167-117533187
  hypo
acgcccggcctagaccttac

SEQ ID NO: 43588 - DNA, 67 bp, Homo sapiens
  chr12:117544227-117544294
  hypo
cctcaatgtcttcatcggtataataggccccacaatcccatctttgaagagtcggaacaagggtgaa

SEQ ID NO: 43589 - DNA, 60 bp, Homo sapiens
  chr12:117563240-117563300
  hypo
gagggtgactcatgccgaatatatactgcctagacagtgacaattcgcagcatctctcac

SEQ ID NO: 43590 - DNA, 38 bp, Homo sapiens
  chr12:118177130-118177168
  hypo
gcctgggcgacagagcaagactccgcctcaaaaatata

SEQ ID NO: 43591 - DNA, 37 bp, Homo sapiens
  chr12:118198752-118198789
  hypo
caaggggcagcccctcgcaggccgggtttcgaccgcc

SEQ ID NO: 43592 - DNA, 39 bp, Homo sapiens
  chr12:118860397-118860436
  hypo
aaagtcaaatagtagcgtgtgtttaacatacatcacaag

SEQ ID NO: 43593 - DNA, 87 bp, Homo sapiens
  chr12:120148309-120148396
  hypo
cagacaccagctggccgtgcccatgcaagcattacctggtcactgaagggcagcgtgcagttcatgtctagacggtcatcaccttcc

SEQ ID NO: 43594 - DNA, 30 bp, Homo sapiens
  chr12:120152067-120152097
  hypo
gcatgttcagtcctacgttgaatcggtgag

SEQ ID NO: 43595 - DNA, 30 bp, Homo sapiens; identical to SEQ ID NO: 15699
  chr12:120574326-120574356
  hypo

SEQ ID NO: 43596 - DNA, 63 bp, Homo sapiens
  chr12:120580446-120580509
  hypo
agctgggtgtctgagcggcccatgtacagccctgccaacacccggttccgccgctctaccccc

SEQ ID NO: 43597 - DNA, 30 bp, Homo sapiens
  chr12:120740933-120740963
  hypo
aaaataaaaggaatgcgtgtgtgtgcttaa

SEQ ID NO: 43598 - DNA, 42 bp, Homo sapiens
  chr12:120932999-120933041
  hypo
acgtcatctctctaacggccgctttttcgtccattagaatac

SEQ ID NO: 43599 - DNA, 155 bp, Homo sapiens
  chr12:121366974-121367129
  hypo
caagtgagccctcttcgtctcagagcagtgaaggctatgggaggatgaggaggggctgaatctgggggttcaaacacagcctcagattgtttctggaaccccccttctctccaatctccagactcagccctcaagtcaggcgggctgggtgtctt

SEQ ID NO: 43600 - DNA, 30 bp, Homo sapiens
  chr12:121641645-121641675
  hypo
gaactaaaaagaggccgggcgcggtggctc

SEQ ID NO: 43601 - DNA, 30 bp, Homo sapiens
  chr12:121688301-121688331
  hypo
tctcaccaacatctacgtggcttggtctct

SEQ ID NO: 43602 - DNA, 82 bp, Homo sapiens
  chr12:122107201-122107283
  hypo
gctctgaccccactccggccgcccgtcccggagtcccactcaccgtgtttcacgttgtccttccactcgcccacatagtagt

SEQ ID NO: 43603 - DNA, 46 bp, Homo sapiens; identical to SEQ ID NO: 15700
  chr12:122141060-122141106
  hypo

SEQ ID NO: 43604 - DNA, 104 bp, Homo sapiens
  chr12:122204974-122205078
  hypo
gacatgctgtccctacgtctggccattgatgcacctgctcctcctggagctcataaaataaaaaaaggccgtgagctcctgcaaggtttcttttttgttttgtt

SEQ ID NO: 43605 - DNA, 85 bp, Homo sapiens
  chr12:122213608-122213693
  hypo
gcaagacaaagcagccgtgagcctcgggctcctgtgccctcggcccggacttcagactgcagggggctcccgggctccttcccag

SEQ ID NO: 43606 - DNA, 166 bp, Homo sapiens
  chr12:122281163-122281329
  hypo
tctgacctaggtcatcgctcaaaaacagcctcccatccactctagcctattctttctgttcctcagacgctcagggcatgctcctacctcggcccttgctgatccctctgccaggaatgcctttcttcccgctgttcacatggccagctcccgctcatgatctaga

SEQ ID NO: 43607 - DNA, 81 bp, Homo sapiens; identical to SEQ ID NO: 15702
  chr12:122285027-122285108
  hypo

SEQ ID NO: 43608 - DNA, 30 bp, Homo sapiens; identical to SEQ ID NO: 15703
  chr12:122292767-122292797
  hypo

SEQ ID NO: 43609 - DNA, 112 bp, Homo sapiens
  chr12:122439399-122439511
  hypo
caggtgagcatatgacggaggaggagatgttggattgctttgcttcactgtttggcctgaatcccgagggatggaaatccgagcctgcaacctgctccgtcaaaggtacccc

SEQ ID NO: 43610 - DNA, 53 bp, Homo sapiens
  chr12:122458643-122458696
  hypo
ctaggaaaaggcctgcggtctctccatttccacagtagcgtgttccccaaaga

SEQ ID NO: 43611 - DNA, 30 bp, Homo sapiens
  chr12:122591572-122591602
  hypo
ctggcaggggttcaacgtcaccagccctcc

SEQ ID NO: 43612 - DNA, 50 bp, Homo sapiens
  chr12:122602863-122602913
  hypo
ggtaaagcacaataccgcagaaaagggaggaatgccgtacattccagtgt

SEQ ID NO: 43613 - DNA, 30 bp, Homo sapiens; identical to SEQ ID NO: 15707
  chr12:122622042-122622072
  hypo

SEQ ID NO: 43614 - DNA, 41 bp, Homo sapiens
  chr12:122622344-122622385
  hypo
aagcctgggagccaacgctgagtccacgtagtgtgcaggta

SEQ ID NO: 43615 - DNA, 89 bp, Homo sapiens
  chr12:122623990-122624079
  hypo
gcagcacggctctcacggggagtggttcccgcctggtcactccccaccctgccaccgctctgcctctgagtaaacggtcggcacatgtg

SEQ ID NO: 43616 - DNA, 30 bp, Homo sapiens
  chr12:122691182-122691212
  hypo
ggtcacgtggagcgacgtgcggctatccgc

SEQ ID NO: 43617 - DNA, 240 bp, Homo sapiens
  chr12:123128928-123129168
  hypo
ggagccagaaaggagatggttttcttcgggagtcgggcggcttcttcgcagcccgggctctcctccgactgcccaggccaaactccgcctcattcccccagtcaatggcctgatggcctgtaggcatgccagtgtctgactatgtgctcttccgccagcgtgctaccctcgatgtcctctcgatgtccagccacctgtgtctgcctgctagggtctcggggttttattttattttatttt

SEQ ID NO: 43618 - DNA, 41 bp, Homo sapiens
  chr12:123333308-123333349
  hypo
acactcccccactcccgtattccctgcgctgcaggtgctgc

SEQ ID NO: 43619 - DNA, 38 bp, Homo sapiens
  chr12:123881693-123881731
  hypo
gccagctggcctatgcgggcctccgctgccatgtttgc

SEQ ID NO: 43620 - DNA, 32 bp, Homo sapiens
  chr12:124117199-124117231
  hypo
aaagctactggtggccgggcgcggtggctcac

SEQ ID NO: 43621 - DNA, 30 bp, Homo sapiens
  chr12:124284067-124284097
  hypo
agagtggagatggcacgatgccatggctag

SEQ ID NO: 43622 - DNA, 30 bp, Homo sapiens
  chr12:124393574-124393604
  hypo
ccgcaccattccaggcgcctggtctggaac

SEQ ID NO: 43623 - DNA, 30 bp, Homo sapiens
  chr12:124397588-124397618
  hypo
atcgcggccccaccacggtccttttcccca

SEQ ID NO: 43624 - DNA, 92 bp, Homo sapiens
  chr12:124404180-124404272
  hypo
gtccctggcagtcaccgctctgccttccatctgtaaggatttacttgctctgaacacttcatgtcaatggcatcatacggtgtgtgacttca

SEQ ID NO: 43625 - DNA, 47 bp, Homo sapiens
  chr12:124651773-124651820
  hypo
gccgcctcccccactcgggtctgtttttcagccgtggctccggcagt

SEQ ID NO: 43626 - DNA, 207 bp, Homo sapiens
  chr12:124716795-124717002
  hypo
gcttaggagcaccagcgctgcctagggaaaccctggcccctccttccctgggatcatctgggtcccccagggctcaggctttacaacccctgctgcttggttacccacctcccacctggggcccctgacagatcaggggacaagcagatagagggctcaccagtgcagtccagtgtatgctgccgggcgggccggagcagagtgagt

SEQ ID NO: 43627 - DNA, 173 bp, Homo sapiens; identical to SEQ ID NO: 15711
  chr12:124778198-124778371
  hypo

SEQ ID NO: 43628 - DNA, 30 bp, Homo sapiens
  chr12:124782655-124782685
  hypo
ccactatccagtgaacgacaccacctttct

SEQ ID NO: 43629 - DNA, 223 bp, Homo sapiens
  chr12:124788775-124788998
  hypo
ccagccctgcagctccgcgggagtgtcctgggccttggcggggacttcccgagccgtctcaccgcccaggcccacgggacgccagcctatatcggtctgggctttcacggcttctggtgtctcctgcccagcgcttccagcttgggtggactttaggtgttttttcagcgggaccctttggcaaatggtgcccggagctctggcttcccgggccagcctgtga

SEQ ID NO: 43630 - DNA, 33 bp, Homo sapiens
  chr12:124843830-124843863
  hypo
aggtgtcatctatcacgccgcctccagatgaac

SEQ ID NO: 43631 - DNA, 129 bp, Homo sapiens
  chr12:124869876-124870005
  hypo
ggcaggggagccactcgctcaggacccatttgcctccgggtcctcattccaacgcgctgacagcccgaattcctggctgagtcagtctggtccaccgcgctccttcccccacaccgtgagacagggctg

SEQ ID NO: 43632 - DNA, 60 bp, Homo sapiens
  chr12:124893479-124893539
  hypo
ccagttccaagtcagcggcagcacgttgtcacgtggcactgggcacggtgagaggattta

SEQ ID NO: 43633 - DNA, 45 bp, Homo sapiens
  chr12:124989304-124989349
  hypo
aaaaggcaaagaagccgctcagaaaggccacgcactgcatgattc

SEQ ID NO: 43634 - DNA, 54 bp, Homo sapiens; identical to SEQ ID NO: 15714
  chr12:125009346-125009400
  hypo

SEQ ID NO: 43635 - DNA, 70 bp, Homo sapiens
  chr12:125092426-125092496
  hypo
ccgaaagccaagctccgtgtccatcgcgaaggcactgggcatgtggctatgcagccgtgacaaaggatga

SEQ ID NO: 43636 - DNA, 33 bp, Homo sapiens; identical to SEQ ID NO: 15716
  chr12:125102143-125102176
  hypo

SEQ ID NO: 43637 - DNA, 40 bp, Homo sapiens
  chr12:125102525-125102565
  hypo
tgtggctgttttctccgctcccctgcggtggagaaggaag

SEQ ID NO: 43638 - DNA, 65 bp, Homo sapiens
  chr12:125102819-125102884
  hypo
ctcagtgttctcatccgtaaaatagggaaaataacagtttccagggccatcgttcaccttttttt

SEQ ID NO: 43639 - DNA, 58 bp, Homo sapiens
  chr12:125119323-125119381
  hypo
ctttgctctgtgtcccgtggttacaaaatggctgttgccaattcgacattttaggcag

SEQ ID NO: 43640 - DNA, 146 bp, Homo sapiens
  chr12:125152108-125152254
  hypo
cttgctaaatgcttgcgtagtgaggcccctgcatctccttttgccgagactgggggaggctgaatggcaccaggccctgtctctcagccccgctcagccccatccctctagttcagtcctgtgggaccgcccgatccttgtgcagc

SEQ ID NO: 43641 - DNA, 30 bp, Homo sapiens; identical to SEQ ID NO: 15719
  chr12:125167715-125167745
  hypo

SEQ ID NO: 43642 - DNA, 30 bp, Homo sapiens
  chr12:125200849-125200879
  hypo
gtcttgagcacttcccgtgtgcccagcaca

SEQ ID NO: 43643 - DNA, 188 bp, Homo sapiens
  chr12:125565948-125566136
  hypo
aagggcctaagcagccgattattggctcgggggctttaagatcattgtgcttcgttttctgcatgtttttcctgacttgttccttacccagctgggtgcaggtgctcacggagctctgctccatgctcactcaggcgttctcagcaaaactcatctctcctatgggtaatccccgtcgaggccatgcg

SEQ ID NO: 43644 - DNA, 30 bp, Homo sapiens
  chr12:125578422-125578452
  hypo
ggcatttggtggcttcgtggcaggcattat

SEQ ID NO: 43645 - DNA, 186 bp, Homo sapiens
  chr12:125813536-125813722
  hypo
tatggactgaatgttcgcattctcccccacccccaaatgtatttgctgaagccctaatctccaatgtgatggtatcaggaggtggagccctcgaggggtaattagatttaggtgaggttgcgagggtggggccctcatgagtgcttttataagtagagaaagaagtaccagcgcttcctccctcat

SEQ ID NO: 43646 - DNA, 34 bp, Homo sapiens
  chr12:125977301-125977335
  hypo
tcagccactcagccacgcccgcagatctcacttg

SEQ ID NO: 43647 - DNA, 29 bp, Homo sapiens
  chr12:126243099-126243128
  hypo
tgagccaccgcgcccggctgatgattgtg

SEQ ID NO: 43648 - DNA, 43 bp, Homo sapiens
  chr12:127051899-127051942
  hypo
cttcccgaagggagccgcccctgctccccggcacctgctccca

SEQ ID NO: 43649 - DNA, 40 bp, Homo sapiens
  chr12:128310415-128310455
  hypo
agtgaggaaacagcacggagacaaccggtgaatgaggaag

SEQ ID NO: 43650 - DNA, 35 bp, Homo sapiens; identical to SEQ ID NO: 15721
  chr12:128311016-128311051
  hypo

SEQ ID NO: 43651 - DNA, 166 bp, Homo sapiens
  chr12:128899701-128899867
  hypo
agggtctttgctttccgagaaaccagagaggtgcggggcagctgccggctgaagggggacctggggctgtgtgtggctgagctggagctcctgtccagctggttcagtgccccgacggtgggtgccgggaggaagaagtccatggaccagccggaggggacccctg

SEQ ID NO: 43652 - DNA, 193 bp, Homo sapiens
  chr12:128964823-128965016
  hypo
gaattcatggacagtcgggcccaggcaatttgatacatttggcttctgtgattattctgcatggaccttcttcgtggaatctaaaacctctgtatttcttaagctaaagtagacagcaataagccagtaagcttgcgcccaaagtctgagatagttccagatctacatcagaggtctccgccagctactggag

SEQ ID NO: 43653 - DNA, 30 bp, Homo sapiens
  chr12:129028675-129028705
  hypo
tgtggttcctggtcccgggcccaggccggc

SEQ ID NO: 43654 - DNA, 30 bp, Homo sapiens
  chr12:129441934-129441964
  hypo
ttgagattgggatatcgttttggaaaggcg

SEQ ID NO: 43655 - DNA, 120 bp, Homo sapiens
  chr12:129520220-129520340
  hypo
agcactggttttcagcaactgtctgtggagctgcattgagtgctgctgggagaggcagtgttcccagattttactctgaaatcgagagtgaaggaaagcacttgcacagtcaaaaaaatg

SEQ ID NO: 43656 - DNA, 173 bp, Homo sapiens
  chr12:130037653-130037826
  hypo
ccccttttgagactccgagagtgttgcgcgtttgctcccagctgtgtctgagtcactgcttgtggctcatcagtcaggctccctgctggtcgctctcaccactgctgccccgatgcccagctcttcactctgccacagtggcccgtggtccctggctgcgtgagtccatcctg

SEQ ID NO: 43657 - DNA, 30 bp, Homo sapiens
  chr12:130216152-130216182
  hypo
gaaggtgcagtgggccgatataaggaaatt

SEQ ID NO: 43658 - DNA, 30 bp, Homo sapiens
  chr12:130308451-130308481
  hypo
atttaatctcattcccgttaaaataactaa

SEQ ID NO: 43659 - DNA, 65 bp, Homo sapiens
  chr12:130325114-130325179
  hypo
tatcttttatgtctccgagaaggcacacacagaaagtaaaaagcccagggcgggggctgcgcagc

SEQ ID NO: 43660 - DNA, 301 bp, Homo sapiens; identical to SEQ ID NO: 5141
  chr12:130821371-130821672
  hypo

SEQ ID NO: 43661 - DNA, 106 bp, Homo sapiens
  chr12:130918507-130918613
  hypo
catggccggaggagtcgggggacttgttcacctgtggtctgtaaccagccgggacataaacccaggcctgagagatgccagtccccctctccgggtatggggctgt

SEQ ID NO: 43662 - DNA, 86 bp, Homo sapiens
  chr12:130920592-130920678
  hypo
cacctcaggtggaaacgggctcaacacaacaggagagatgagagcgggttctgggtggggatgcgggcacacgttctggctcccag

SEQ ID NO: 43663 - DNA, 30 bp, Homo sapiens
  chr12:130947254-130947284
  hypo
atcatggggccaaagcgcaagcaccctcct

SEQ ID NO: 43664 - DNA, 39 bp, Homo sapiens
  chr12:131077323-131077362
  hypo
gtgagaagagcgtttcgcccagcacgtggatttgtttcc

SEQ ID NO: 43665 - DNA, 30 bp, Homo sapiens
  chr12:131159790-131159820
  hypo
acgatgggtgtctcacgcttctacctaagg

SEQ ID NO: 43666 - DNA, 30 bp, Homo sapiens
  chr12:131229952-131229982
  hypo
acacataaacccaaacgtgccacccaattt

SEQ ID NO: 43667 - DNA, 123 bp, Homo sapiens
  chr12:131268359-131268482
  hypo
cagctattggctgaccgctgacatatgtagacaaggggacaacccctgggaagcagacgtaaaatagaaacaataaatttaaaaactgatgagggacatcaacgcctacgtaccagagacagg

SEQ ID NO: 43668 - DNA, 56 bp, Homo sapiens
  chr12:131271976-131272032
  hypo
agcagctggagagtccgctgcccacaccaccccgggctccacggcctcacccccag

SEQ ID NO: 43669 - DNA, 30 bp, Homo sapiens
  chr12:131335293-131335323
  hypo
gtgtgtattcatgtgcgtgtgtgtgagaat

SEQ ID NO: 43670 - DNA, 166 bp, Homo sapiens
  chr12:131383570-131383736
  hypo
ctagctgctgcttaacggcctgcactattgtgctgctcacattcccattagcagagtgggagcgctctcgttctcccgtagctttgataccagcctgtgttattaaacttttggaactctgccattctgataagtgaaaaatgtaattccgcgtggctttaatttg

SEQ ID NO: 43671 - DNA, 30 bp, Homo sapiens
  chr12:131387248-131387278
  hypo
ctagagatccaggtccggtttgtctttcct

SEQ ID NO: 43672 - DNA, 34 bp, Homo sapiens
  chr12:131389290-131389324
  hypo
acgggatctgggagccggccgcctgggcacgggc

SEQ ID NO: 43673 - DNA, 30 bp, Homo sapiens
  chr12:131402594-131402624
  hypo
caccgggtcatcctccgtcattagatgatg

SEQ ID NO: 43674 - DNA, 263 bp, Homo sapiens
  chr12:131433182-131433445
  hypo
attgggactaacttacgcgagtgtctcgttcttggttctctgagagcagagcccagtgccaacactcacgtgtgagcagtgctttagagtgtgagtccagggggccaaagtgggggacgggggcaacagacacagaagtggggaagcggcaatgcagggaaatgctaccgtgttgcaaccatgatggttggagggagaaaagcgggtttgtccactggatcctgcacttcatgggctcgagtacctcacgtttctgggtgctt

SEQ ID NO: 43675 - DNA, 53 bp, Homo sapiens
  chr12:131500873-131500926
  hypo
tggaggctcaggagacgcttgctgagtgagtgctgtgccggagtcagtgccct

SEQ ID NO: 43676 - DNA, 30 bp, Homo sapiens
  chr12:131513475-131513505
  hypo
gcccttcagaaaggtcgtaaccatttatcc

SEQ ID NO: 43677 - DNA, 53 bp, Homo sapiens
  chr12:131535504-131535557
  hypo
gttcctaacaggccacgggctggtcccggttcacggcccgggtgttgggaacc

SEQ ID NO: 43678 - DNA, 27 bp, Homo sapiens
  chr12:131547329-131547356
  hypo
atacaagggtcacgtggtaaatatatt

SEQ ID NO: 43679 - DNA, 30 bp, Homo sapiens
  chr12:131569185-131569215
  hypo
tcatgcaggtggtcccgctggaggtaagag

SEQ ID NO: 43680 - DNA, 75 bp, Homo sapiens
  chr12:131615224-131615299
  hypo
aggggtgcaggtgtgcggaacagcgatgctggcccatcccgtgcgggggaagagcgaggccggcccatcccgtgc

SEQ ID NO: 43681 - DNA, 190 bp, Homo sapiens
  chr12:131619032-131619222
  hypo
tgatcctttcagatacggtttcccgggacctaaagattgtagctgaataatgcatgatattgttgtttcccagaaacaggtgttttatttttattgcattagcattatgagaacaagctggctgcggcttctctgagagctgaagtgctggaacacttctgggttttacaggcaccggttgcccggagct

SEQ ID NO: 43682 - DNA, 61 bp, Homo sapiens
  chr12:131623336-131623397
  hypo
ccacggctacagctgcgccgggtgtgtggcacgctccatgagtcaccgtggaatgaacgca

SEQ ID NO: 43683 - DNA, 30 bp, Homo sapiens
  chr12:131624881-131624911
  hypo
agggctggtgacagccgtgtcttctgtgtt

SEQ ID NO: 43684 - DNA, 42 bp, Homo sapiens
  chr12:131687270-131687312
  hypo
gcagtccctcctccccgcgacgtgacgcggcctgtgcatttt

SEQ ID NO: 43685 - DNA, 87 bp, Homo sapiens
  chr12:131725445-131725532
  hypo
aaaaaaaaaaataaataaaataaaaagaaattcattgcttcaccacacatagctaaacagaacactggagaacgtagtttgtgttct

SEQ ID NO: 43686 - DNA, 33 bp, Homo sapiens
  chr12:131767017-131767050
  hypo
cgttgtcaccatcctcgacgtcagccccacaag

SEQ ID NO: 43687 - DNA, 39 bp, Homo sapiens
  chr12:131768368-131768407
  hypo
cacaacacaccacaacgccatgaccgcagcaccacaaca

SEQ ID NO: 43688 - DNA, 30 bp, Homo sapiens
  chr12:131769387-131769417
  hypo
gtgagcacgtgctcacggcagcgccagagc

SEQ ID NO: 43689 - DNA, 37 bp, Homo sapiens
  chr12:131772177-131772214
  hypo
gacaatgatcacagacggggcacgtatggcattgtat

SEQ ID NO: 43690 - DNA, 30 bp, Homo sapiens
  chr12:131834216-131834246
  hypo
atttccaacatcgtccgagaatttatgaag

SEQ ID NO: 43691 - DNA, 30 bp, Homo sapiens
  chr12:131850690-131850720
  hypo
gacgtcccctatgaacgaggcccacaggca

SEQ ID NO: 43692 - DNA, 30 bp, Homo sapiens
  chr12:131852434-131852464
  hypo
ccctcacttggtctccggcctgccctctgc

SEQ ID NO: 43693 - DNA, 62 bp, Homo sapiens
  chr12:131928846-131928908
  hypo
acgctgggctctgagcggttctggccagtcccctccatcagggcccccgagtccctccggct

SEQ ID NO: 43694 - DNA, 122 bp, Homo sapiens
  chr12:131979037-131979159
  hypo
gctcttcccgtggcccggagggccctgtcggaaacagcttgaggacccggagttcccaggagtctcctgccagccttcgtctctgcctgcccctctcgccatagtagcgggaagggtggtag

SEQ ID NO: 43695 - DNA, 197 bp, Homo sapiens
  chr12:132044061-132044258
  hypo
tctatgaaccagcagcgctgaggtcactggtgctgaggccatgggactcgtggaggtgttctgtccatgggagagaagccctgagcatctgggagccatgaggaggaatctccagagacaaacgggagaattaaccagaggccccgccccattatcataactcggctccactcacatggccccgccctgttcattca

SEQ ID NO: 43696 - DNA, 30 bp, Homo sapiens
  chr12:132068982-132069012
  hypo
agaactcatcaataccgggacaccgtgacg

SEQ ID NO: 43697 - DNA, 300 bp, Homo sapiens
  chr12:132076528-132076828
  hypo
ccgacaccagggagacgcgttttctgcactgactcctacgctcccgcgtggacatccccagcatgatttctgtctccacccacttcgcacacaccccgccccggccagacacccccaaacccacacagggtgcagggacaccgccctggccttggctgtggctgtcacactcgcctgtcccgccttggccccaagtcctgccagcccggctccgtccccgccccactcccagtggctctgtgcctgcctccctcccgggctctgccagccctgcctctcccgccacgcacagctcaggcg

SEQ ID NO: 43698 - DNA, 157 bp, Homo sapiens
  chr12:132106066-132106223
  hypo
ttcagctctgggcgacgctgccgggctgcttcccaagttccagatccaccacacccccagggggttccagcctgcagcgggggctgagacccacagctctgctgtgtacatgagaacacacacaggcacatgcacacctacgcgcatgtacacacat

SEQ ID NO: 43699 - DNA, 80 bp, Homo sapiens
  chr12:132168266-132168346
  hypo
atttctgggtggggccgtgcctggcgctaggaggtgagctgggcccaggcctgggggcagctctgcgtccccaccacctt

SEQ ID NO: 43700 - DNA, 34 bp, Homo sapiens
  chr12:132171651-132171685
  hypo
agaatgggaatcacgcgtgcgtgtttcctgctct

SEQ ID NO: 43701 - DNA, 522 bp, Homo sapiens; identical to SEQ ID NO: 1602
  chr12:132221602-132222124
  hypo

SEQ ID NO: 43702 - DNA, 62 bp, Homo sapiens
  chr12:132240207-132240269
  hypo
gaaagcatctgcccacgttcacagcattgatgattgtttgtccagcacgttctaaacaaaca

SEQ ID NO: 43703 - DNA, 21 bp, Homo sapiens
  chr12:132244054-132244075
  hypo
aaatagtaggccgggcgcggt

SEQ ID NO: 43704 - DNA, 30 bp, Homo sapiens
  chr12:132279981-132280011
  hypo
gtggtccctggctaccgcagctctgtctaa

SEQ ID NO: 43705 - DNA, 133 bp, Homo sapiens; identical to SEQ ID NO: 15732
  chr12:132280877-132281010
  hypo

SEQ ID NO: 43706 - DNA, 82 bp, Homo sapiens
  chr12:132284411-132284493
  hypo
gggcccccagccctccgacagcagccactggactccccttccccgtctccacgcctcctgcggtcaccgcacaccccttctt

SEQ ID NO: 43707 - DNA, 104 bp, Homo sapiens
  chr12:132325069-132325173
  hypo
acgtggcctgttctccgtgactcactctgggctgacccctgcctgcagggtccggacgttcccacgggactcaccactggggcacgacacggtgcgtgcactca

SEQ ID NO: 43708 - DNA, 84 bp, Homo sapiens
  chr12:132329560-132329644
  hypo
atgcctgtcccatgccgctcaggtcaggggctctgccgcaggatgccctgtcccgcgctgcccaggccccgcctcccagcccac

SEQ ID NO: 43709 - DNA, 166 bp, Homo sapiens
  chr12:132329877-132330043
  hypo
tggtgtccctgcagccggcacagatgcaccgcttctggcggggcctgccgctgcacctggacagcgtggacgccgtgtacgagcgcaccagcgaccacaagatcgtcttctttaaaggtgggtgggcctccccgtcgcactccgggcttcccgggccctctgtccg

SEQ ID NO: 43710 - DNA, 45 bp, Homo sapiens
  chr12:132333398-132333443
  hypo
ggacgctgctatgagcgtgagtgtgcaaacgtctctccaagaccc

SEQ ID NO: 43711 - DNA, 164 bp, Homo sapiens
  chr12:132333503-132333667
  hypo
tatttttgacgttttggggagcctatgttctgtctcccgcagcggctgcacaatttcatactccctccccggcagcgcccggctctgccgtccccatatcctcccgacacaggtgactttccacgttcttgacagtgggggcgagggggcgtctcattgtggtt

SEQ ID NO: 43712 - DNA, 80 bp, Homo sapiens
  chr12:132335471-132335551
  hypo
gcctcctacttcttccgtggccaggagtactggaaagtgctggatggcgagctggaggtggcacccgggtacccacagtc

SEQ ID NO: 43713 - DNA, 95 bp, Homo sapiens
  chr12:132348589-132348684
  hypo
accctggctgtctgtcgggcagccccggcgaggagttgagtccccttaccgctgcgaatgagctgtcctccaccccacgtcggagacctcagcgc

SEQ ID NO: 43714 - DNA, 42 bp, Homo sapiens
  chr12:132349937-132349979
  hypo
ggacagtgactcactcgtcaggaacgacggggcacctgccag

SEQ ID NO: 43715 - DNA, 109 bp, Homo sapiens
  chr12:132377954-132378063
  hypo
agcgcgcaacgtgtacggtgaacagcactaacttttccccggtcctctctcccagagcaatcgctgttggctgtgtcttctgtgagtgagcccccgggctcttttggct

SEQ ID NO: 43716 - DNA, 37 bp, Homo sapiens
  chr12:132415173-132415210
  hypo
tttttctttttgaggcgtggtctccctttgtggtcca

SEQ ID NO: 43717 - DNA, 37 bp, Homo sapiens
  chr12:132415270-132415307
  hypo
agatcctcccacctcagcctcccgaacatcgagggct

SEQ ID NO: 43718 - DNA, 157 bp, Homo sapiens
  chr12:132423589-132423746
  hypo
agatgcatttttaacagctgaattcatgtgtgaaatgacgtaaggtccgcgtagtccttctttctcagagaccagcgtgcgaggcccaagggacccaccttccgtcacccgttctgctttgtttacagggtgtgtccgcagccggccaggtggtatc

SEQ ID NO: 43719 - DNA, 238 bp, Homo sapiens
  chr12:132617211-132617449
  hypo
ggactgcagtaaggacgcctcgtgggatgtgccaaaccgctgcgtggagcctgggctgacttctctggatcttggtgcaactggcgtggcccttccaggaagccgggccacctggctcagagacgccagaccctggccggcaatggggctgccaggggcggggacgctggaggagctaggggtgtgggccactgtgctgcctgccccggcctggcggcctctccgtagcagagctgag

SEQ ID NO: 43720 - DNA, 30 bp, Homo sapiens
  chr12:132617675-132617705
  hypo
ccaccctgacctgggcggagtgtgggggtg

SEQ ID NO: 43721 - DNA, 134 bp, Homo sapiens
  chr12:132643874-132644008
  hypo
tgcccctgtgtgctccgcaccacgtctgtctcgatggcgcccctcgaagacctcgggaagctccccgttcgctgtggccccccggggtctgtcccctgcagcactgttctctgggggctcgtggtccgagttct

SEQ ID NO: 43722 - DNA, 30 bp, Homo sapiens
  chr12:132648490-132648520
  hypo
accgcagagcctgggcgtgcaggtggcacg

SEQ ID NO: 43723 - DNA, 161 bp, Homo sapiens
  chr12:132653008-132653169
  hypo
gggtcctctgggggccgatgctgagacggggtctaggccgggataacgggatagtccattgctgggccagggctgctgagcgtgggtggggactgccgactgcagtacagacccagacggcaggagcccggcaaagcctgcccttccgaggagcctcacgt

SEQ ID NO: 43724 - DNA, 44 bp, Homo sapiens
  chr12:132666377-132666421
  hypo
ctcgtgtgcccgccacgctgtcttcctgccgctggtgaagtctg

SEQ ID NO: 43725 - DNA, 84 bp, Homo sapiens
  chr12:132682582-132682666
  hypo
gccttgagctgcaaacggggccctgcgcggctgccttggagcctcccaccccggggacgctgttgcgggcgggagaggaccgcc

SEQ ID NO: 43726 - DNA, 288 bp, Homo sapiens
  chr12:132687989-132688277
  hypo
ccgtggcattgaccccgaccctggggcatggccccggctcccggcctgtgggggactcaccgacatggggatgttccaggccatgtacacgtgggacttgaagtcatccatccacacctcggcggcgcgcagggcgttgcgcttggcatagtagtcaatgtcgttgttgtagggcttcctggtgcgctcgatgtgggccacgcgggagcagggcagcacctccatgctgccgccacactgccacacctgcggggagacggcgctgggtgccggcgtccttcccaacgg

SEQ ID NO: 43727 - DNA, 23 bp, Homo sapiens
  chr12:132691177-132691200
  hypo
cgagactccgtctcaaaaaaaaa

SEQ ID NO: 43728 - DNA, 41 bp, Homo sapiens
  chr12:132694981-132695022
  hypo
tagaggggaggcaggcgaggctcagacgtcacactcatcac

SEQ ID NO: 43729 - DNA, 115 bp, Homo sapiens
  chr12:132983629-132983744
  hypo
ccagaagagaagccacgtccactgcgagggccatccggtgtcatgtccctgcctccactcagccccaggcccacagctgcagccacgcagccccgcacagcgtcaccgtctccag

SEQ ID NO: 43730 - DNA, 48 bp, Homo sapiens
  chr12:132985665-132985713
  hypo
ccccacatggagccccgtccagtcagccggccccgttctctgctgagc

SEQ ID NO: 43731 - DNA, 205 bp, Homo sapiens
  chr12:132986451-132986656
  hypo
acccagagctgccaccgtcctgtgggtgacggcagaacatctggctgccgggtggcctccgtaaccgccacacacctgcctctgctggaatcacctgaggctctggtgcctcacacggattggccaaaacagggagcggagccgggaaggccacggacatctgtgtggtgtcacgaacaaggtccggccacgtgtgtgggagacg

SEQ ID NO: 43732 - DNA, 45 bp, Homo sapiens
  chr12:132987467-132987512
  hypo
ggcagggatgggaaccgaactcttgtccaccgaggagcctgggag

SEQ ID NO: 43733 - DNA, 278 bp, Homo sapiens
  chr12:133002792-133003070
  hypo
gagtctacagtcagccggctcttccagctttctgggagtgtcatattttgaaatctccttgttcactttcacgcctgctggcaggatggacaattcctgtctgggtctggctcctcaaaagatctcactggcatgtctgccgacgtgcgattttccagcctttccctagagctgcggtttcgtcaggttcatggtccaacttccaagttgccgagtccagtctgaccgagtgttccacaccgagtgtgctccggcctctgccccgccttctctctgtc

SEQ ID NO: 43734 - DNA, 60 bp, Homo sapiens
  chr12:133003308-133003368
  hypo
tgacacacctttctgcgaggactcagttggccagaggagatgtggcgaaacgcgctgggc

SEQ ID NO: 43735 - DNA, 17 bp, Homo sapiens
  chr12:133019687-133019704
  hypo
cccgaaaaaaaaaaaac

SEQ ID NO: 43736 - DNA, 190 bp, Homo sapiens
  chr12:133035657-133035847
  hypo
ccaccacgcccagcccgatttctccagttttgtgtggtctagttctattccgcactgctcagcacacaaaggcttttgtgtctgctgaacctttggaaggcacaggacatttttgtccctttataaactcaaagcatgatcctatctatgtttaaaaagcagacgcggacagcggcggacatgaggaaag

SEQ ID NO: 43737 - DNA, 58 bp, Homo sapiens
  chr12:133060930-133060988
  hypo
agccctgcctgaagccggggcctgtcaggaaccccacggggtacggggtgctgcctga

SEQ ID NO: 43738 - DNA, 46 bp, Homo sapiens
  chr12:133100409-133100455
  hypo
ccccgcgttgagaaccgctaggagtgggacacgtggcttcctgcag

SEQ ID NO: 43739 - DNA, 30 bp, Homo sapiens; identical to SEQ ID NO: 15744
  chr12:133100990-133101020
  hypo

SEQ ID NO: 43740 - DNA, 30 bp, Homo sapiens; identical to SEQ ID NO: 15745
  chr12:133122176-133122206
  hypo

SEQ ID NO: 43741 - DNA, 30 bp, Homo sapiens
  chr12:133167902-133167932
  hypo
gggcctcagcattcacgctgcttcctcctg

SEQ ID NO: 43742 - DNA, 256 bp, Homo sapiens
  chr12:133169847-133170103
  hypo
gggcctgcatagaaacggaagctcacagtcggggctgtgtgtctggcttctgtcccccatcgccattctccaggctcaccccctgcagccgtgcgggcctcattcttttcctggtggaatcctgttccctggtgtggagggccacgctgggcttatctgtcgatcgtttgtggacacctgagcagctatgaagagtctgctttgaacatctgtggacaacaatttgtgtgacgtctgtttccgattctcttgggtt

SEQ ID NO: 43743 - DNA, 102 bp, Homo sapiens; identical to SEQ ID NO: 15747
  chr12:133188357-133188459
  hypo

SEQ ID NO: 43744 - DNA, 30 bp, Homo sapiens
  chr12:133199671-133199701
  hypo
gaagggcgggtaagacgaccctggtctgac

SEQ ID NO: 43745 - DNA, 43 bp, Homo sapiens
  chr12:133200007-133200050
  hypo
gctgactggcgcccacggctgcaccgggcgacccctggtcctg

SEQ ID NO: 43746 - DNA, 43 bp, Homo sapiens
  chr12:133262739-133262782
  hypo
ggtgtgagccaccgcgccgggcctcatccgttttctgcttatg

SEQ ID NO: 43747 - DNA, 79 bp, Homo sapiens
  chr12:133705743-133705822
  hypo
atctaaaacagaatacgaactaaaaaacctaatcaatgagactttttaaaaaattgagtcagggccgggtgcggtggct

SEQ ID NO: 43748 - DNA, 162 bp, Homo sapiens
  chr13:19517741-19517903
  hypo
gacacagggtgaagccggggactccacgaccccctgggccccacgcaggggctgcagggaaggcactggcctctgagggatgatcccagcctcctcggcctcaccgctttttcccccggctacctcaacctccccctgcaagcctggcgtcctgtacccgtg

SEQ ID NO: 43749 - DNA, 101 bp, Homo sapiens
  chr13:20078200-20078301
  hypo
ctcacagttcactgatagctccactccagggtactgatttgaatttagacttggcagcgctacagaatttaaatatatatatgtatcgtccaacaccaata

SEQ ID NO: 43750 - DNA, 87 bp, Homo sapiens
  chr13:20392358-20392445
  hypo
agatgacattcatgacgccagctcttctggaagtcatagtaaggcaccgaggggtggctcctctccctgcagcggctgtcgcttacc

SEQ ID NO: 43751 - DNA, 27 bp, Homo sapiens
  chr13:20692250-20692277
  hypo
cgtgagccactgcgcctggccacattt

SEQ ID NO: 43752 - DNA, 165 bp, Homo sapiens
  chr13:21057336-21057501
  hypo
acaataaaagataaacgtgtgaggttctggatatcctaatacaccgggattttaccatgacacactgaacacacaaatcaatcacacatgaatcccaaatatgtacaattaagatacagcaagtaattttttatttattattatttttttaagacggagtctcac

SEQ ID NO: 43753 - DNA, 30 bp, Homo sapiens
  chr13:21711382-21711412
  hypo
gactattcttgaggtcgggtatcttcatat

SEQ ID NO: 43754 - DNA, 23 bp, Homo sapiens
  chr13:22049000-22049023
  hypo
tttttttttttgagacggagtct

SEQ ID NO: 43755 - DNA, 30 bp, Homo sapiens
  chr13:22336937-22336967
  hypo
cagtcgctgccgaaacgatcacccagtcgc

SEQ ID NO: 43756 - DNA, 30 bp, Homo sapiens
  chr13:22391874-22391904
  hypo
ttttctcttgtctcacgtccttcctttttt

SEQ ID NO: 43757 - DNA, 30 bp, Homo sapiens
  chr13:23717527-23717557
  hypo
gtgagccactgcacccggccccaatgtctg

SEQ ID NO: 43758 - DNA, 92 bp, Homo sapiens
  chr13:23896875-23896967
  hypo
cggcgatgcacagaccgccccccacccatccacctccccccccccccccccccgccaacaggtgtaacgtggtgccgcgggcagaggattca

SEQ ID NO: 43759 - DNA, 62 bp, Homo sapiens
  chr13:24289608-24289670
  hypo
gtttggggtgctatccgggtttgcattgcaggcggtggggccagctgcggtatggcggtggc

SEQ ID NO: 43760 - DNA, 30 bp, Homo sapiens
  chr13:25561078-25561108
  hypo
tgtgggaaccatgcccgtgaccggtcctcg

SEQ ID NO: 43761 - DNA, 27 bp, Homo sapiens
  chr13:25668696-25668723
  hypo
ctactctaggctaggcgcggcggctca

SEQ ID NO: 43762 - DNA, 71 bp, Homo sapiens; identical to SEQ ID NO: 15753
  chr13:25670585-25670656
  hypo

SEQ ID NO: 43763 - DNA, 30 bp, Homo sapiens
  chr13:27278150-27278180
  hypo
tagggtttgtaatttcgtgtcctatttatg

SEQ ID NO: 43764 - DNA, 108 bp, Homo sapiens
  chr13:28239991-28240099
  hypo
tacaagcacagcttccgcgctcgaggttccgccagttactccccgccacgaaagcggagcagccaggacaagtacgaaaagcggtccaaccggcggtgaggctggaac

SEQ ID NO: 43765 - DNA, 84 bp, Homo sapiens
  chr13:29914132-29914216
  hypo
tccgaagtctgcggccggggccaagtgtgctgagcttggtgaccgttggaatcaggacgccagaaagcgcgcaaagcatcgcaa

SEQ ID NO: 43766 - DNA, 30 bp, Homo sapiens
  chr13:29933609-29933639
  hypo
ggtgaggccccatttcgtgaaggtccaagg

SEQ ID NO: 43767 - DNA, 19 bp, Homo sapiens
  chr13:30031261-30031280
  hypo
acagcgagactccattcaa

SEQ ID NO: 43768 - DNA, 57 bp, Homo sapiens
  chr13:30107065-30107122
  hypo
tgcctatcagctcgtcgaaggtggcgctccaggccctcgctacgcttgaagtacctg

SEQ ID NO: 43769 - DNA, 41 bp, Homo sapiens
  chr13:30123237-30123278
  hypo
gaggcctcctctttacgtggagcggacgtgctagtgggcac

SEQ ID NO: 43770 - DNA, 36 bp, Homo sapiens
  chr13:30149052-30149088
  hypo
ttaccggcatgagccaccgtgcgtggccagagcagc

SEQ ID NO: 43771 - DNA, 64 bp, Homo sapiens
  chr13:30574503-30574567
  hypo
tagcacgagagaacccgaaacacaatatttacatgctgttattctttttcgtttctctttcttc

SEQ ID NO: 43772 - DNA, 26 bp, Homo sapiens
  chr13:30707178-30707204
  hypo
aggtccaggccatagcgacggggacc

SEQ ID NO: 43773 - DNA, 117 bp, Homo sapiens
  chr13:30707244-30707361
  hypo
cgtccctgcactgggtgggccgtgctgggagaaggtcccggggatcactcctcctaggccgccggggcagtctctccagccaccctctttccccagagccagcgggctggggttctt

SEQ ID NO: 43774 - DNA, 30 bp, Homo sapiens
  chr13:30707569-30707599
  hypo
gctggctgcctgagccgagggttttacttc

SEQ ID NO: 43775 - DNA, 186 bp, Homo sapiens
  chr13:30761001-30761187
  hypo
attaacaagccagagcgggggcaccagagtctacgtcagtctcatagaaaaggcatctttcaggtacttctcttctgggcatgactttgaagcaagaataaccgttctggccctttgtttgattaaatggctttgggaactgtgtttccgatctctgtgacaggcttatatcgcttcagtggctgt

SEQ ID NO: 43776 - DNA, 97 bp, Homo sapiens
  chr13:31742917-31743014
  hypo
cccaggcagataacccgccggctggtgcctcccaactcccaaagctcctttcgcctgggttctggtgtgccatccatgcttacgcatctctctgtgc

SEQ ID NO: 43777 - DNA, 89 bp, Homo sapiens
  chr13:31821217-31821306
  hypo
tacttccgttgttaccgcagtacgtttgtttaactcacctgtgaattactgacattcctacctgaacacttttacgcccttagtctttt

SEQ ID NO: 43778 - DNA, 21 bp, Homo sapiens
  chr13:32244681-32244702
  hypo
acaggctaggctgggcgcggt

SEQ ID NO: 43779 - DNA, 30 bp, Homo sapiens
  chr13:32670558-32670588
  hypo
tgctagggaaaactgcgggggggggcttca

SEQ ID NO: 43780 - DNA, 30 bp, Homo sapiens
  chr13:33113918-33113948
  hypo
tacagatttctactacgacctttgtctcct

SEQ ID NO: 43781 - DNA, 29 bp, Homo sapiens
  chr13:36883103-36883132
  hypo
aggtgtggtggctcacgcctgtaatccca

SEQ ID NO: 43782 - DNA, 300 bp, Homo sapiens
  chr13:37643672-37643972
  hypo
gtcccctgtgccccacgtcccggaagcaacctcctgtgctgcccccaaactcatgcagccaggtgggacccgaccctaggcccggagctttcatcactcgggactctggccccacactgctgctctcacccacgcactgctgctgtggggagggcgtggggaggaggcggagctgggcccggggctgtgccacgcttcacgcttcacggaaccagcgggagccaaggacaagcaggagccgccccgcagccccttgggggccgccgctatgaggccaggccaagtcgcccagcccagagg

SEQ ID NO: 43783 - DNA, 30 bp, Homo sapiens
  chr13:40020880-40020910
  hypo
caatagcaaacttcacgatactaagtggca

SEQ ID NO: 43784 - DNA, 32 bp, Homo sapiens
  chr13:41103319-41103351
  hypo
agtctgagaaactgtcgcggtcaagaggaggc

SEQ ID NO: 43785 - DNA, 53 bp, Homo sapiens; identical to SEQ ID NO: 15760
  chr13:41681520-41681573
  hypo

SEQ ID NO: 43786 - DNA, 30 bp, Homo sapiens
  chr13:41705935-41705965
  hypo
tctgctcactctccacgtccagactatcca

SEQ ID NO: 43787 - DNA, 181 bp, Homo sapiens
  chr13:42540722-42540903
  hypo
ccaggcacacaggttcggcatgtgatttggcctcatagtgcttgacccggcaccaatcagagagctttgtcagagatggatataggtgcagggactctttctaagattatggatgcttatagcctcacataactccagaactgtcagggccatcttggctttaattcgagaagagcttgac

SEQ ID NO: 43788 - DNA, 30 bp, Homo sapiens
  chr13:43543197-43543227
  hypo
ccctcattccggcagcggctgtgcttgctt

SEQ ID NO: 43789 - DNA, 108 bp, Homo sapiens
  chr13:43986042-43986150
  hypo
aaagcttaccagacacgagctgctgtccaggcaaccctacgggaaccatgcccaggttattcatggctgtagcccaggctgtgggatctgtcacggacatgttgagct

SEQ ID NO: 43790 - DNA, 30 bp, Homo sapiens
  chr13:45165574-45165604
  hypo
tcgagggggcgctgccggttgccggtgcga

SEQ ID NO: 43791 - DNA, 17 bp, Homo sapiens
  chr13:45562261-45562278
  hypo
ctgcactacctggcccg

SEQ ID NO: 43792 - DNA, 229 bp, Homo sapiens
  chr13:45564574-45564803
  hypo
ctttctttttgccctcgggttttttcctaattacattgcatatttagtacactgtatttgaataatttgtcgacataatctgtctccaccattgcactatggtcttctacctgaacacgcaacaggcacttggtatatacgaaacgaatgcttctcggattccggcatgcatacctatctgctttaatgtttattcacatttgtagactagcaccgacacccagttgga

SEQ ID NO: 43793 - DNA, 28 bp, Homo sapiens
  chr13:45905236-45905264
  hypo
gctttgcttttgtcgatttgtcttttgt

SEQ ID NO: 43794 - DNA, 30 bp, Homo sapiens
  chr13:45939250-45939280
  hypo
caggcagcagcaggacgagactcctttctg

SEQ ID NO: 43795 - DNA, 34 bp, Homo sapiens
  chr13:45950905-45950939
  hypo
agggccccagagtttcggttaaaattccagctgc

SEQ ID NO: 43796 - DNA, 85 bp, Homo sapiens
  chr13:46659255-46659340
  hypo
attacaggcacgagccactacacgtactttttcaaagcactttcacactcatttcctttgatatttataacgctttgatatagac

SEQ ID NO: 43797 - DNA, 120 bp, Homo sapiens
  chr13:46660682-46660802
  hypo
ttcagatgggaggaagtgagtgctgattggttcatgggtggccataggcgggtgcggaaaaatcaccgtcagttcccactgcggtccacgggactggcagccttcctgggcttgaaggtg

SEQ ID NO: 43798 - DNA, 75 bp, Homo sapiens
  chr13:46661292-46661367
  hypo
gggcagctgcagctgcgcctggggagcatgaggctgccgccctgccatcacagaagggggcgggacttttacctc

SEQ ID NO: 43799 - DNA, 172 bp, Homo sapiens; identical to SEQ ID NO: 15765
  chr13:46920144-46920316
  hypo

SEQ ID NO: 43800 - DNA, 142 bp, Homo sapiens
  chr13:47528522-47528664
  hypo
acacattttagtgctcgtgtagtgaagaatagttcctttacagtctctttagtgtacagattttctttccatctcccctttctcgcttgcaatttatttgttgaaaaaaccgagatctttgatccatcgtgtttcccccggt

SEQ ID NO: 43801 - DNA, 30 bp, Homo sapiens; identical to SEQ ID NO: 15766
  chr13:48667877-48667907
  hypo

SEQ ID NO: 43802 - DNA, 63 bp, Homo sapiens
  chr13:49922188-49922251
  hypo
agggagaccataggacgctggcaggctgaatggaggcctgtggacacccgagcaggctgcaaa

SEQ ID NO: 43803 - DNA, 49 bp, Homo sapiens
  chr13:49923030-49923079
  hypo
cctccagggagaccacgccccgtccctcaccctccgccaggcattcttc

SEQ ID NO: 43804 - DNA, 19 bp, Homo sapiens
  chr13:50367846-50367865
  hypo
agagctgctttcggccggg

SEQ ID NO: 43805 - DNA, 75 bp, Homo sapiens
  chr13:52532595-52532670
  hypo
ccaggacgatgagcacgtccatgttggctgacctgtgtctcagagatttgtaggcctgaacgtagaagtaccacc

SEQ ID NO: 43806 - DNA, 36 bp, Homo sapiens
  chr13:53025686-53025722
  hypo
ctctcacccaccaggcggcctcgtgcccctagccat

SEQ ID NO: 43807 - DNA, 17 bp, Homo sapiens
  chr13:53580919-53580936
  hypo
ggcgtgagccaccgcgc

SEQ ID NO: 43808 - DNA, 30 bp, Homo sapiens
  chr13:56180149-56180179
  hypo
ttgtggacaagtactcggaaccgctgaacg

SEQ ID NO: 43809 - DNA, 30 bp, Homo sapiens
  chr13:60614880-60614910
  hypo
aactccatagaaatacgatgtgaatctgct

SEQ ID NO: 43810 - DNA, 31 bp, Homo sapiens
  chr13:64311606-64311637
  hypo
ctggctctcagttcccgcctcgcggcggggg

SEQ ID NO: 43811 - DNA, 30 bp, Homo sapiens
  chr13:65904937-65904967
  hypo
gggttctcctccgatcgccctggccaaact

SEQ ID NO: 43812 - DNA, 51 bp, Homo sapiens
  chr13:68343951-68344002
  hypo
tctcctactgcttggcgagcgggagggcgtggtacccgcagcttggcgaat

SEQ ID NO: 43813 - DNA, 30 bp, Homo sapiens
  chr13:74987640-74987670
  hypo
gagccccctcagcctcgcgggctcagaagt

SEQ ID NO: 43814 - DNA, 28 bp, Homo sapiens
  chr13:77553713-77553741
  hypo
gggcgcggtgactcacgactgtaagtcg

SEQ ID NO: 43815 - DNA, 44 bp, Homo sapiens
  chr13:78081890-78081934
  hypo
tcggcctcccaaagtgctgggattacaggcgtaactcatagtaa

SEQ ID NO: 43816 - DNA, 16 bp, Homo sapiens
  chr13:78567988-78568004
  hypo
gcgcctggcatgtagt

SEQ ID NO: 43817 - DNA, 30 bp, Homo sapiens
  chr13:91948489-91948519
  hypo
agcagcggcagcaaccgaacagatgagcca

SEQ ID NO: 43818 - DNA, 30 bp, Homo sapiens
  chr13:95711256-95711286
  hypo
tagaaaatatcagggcgcagaagcatggag

SEQ ID NO: 43819 - DNA, 50 bp, Homo sapiens
  chr13:95718425-95718475
  hypo
cttggcatatgccatcgtgcctttcacatgcatttcgacctgctgaaatc

SEQ ID NO: 43820 - DNA, 37 bp, Homo sapiens
  chr13:95858839-95858876
  hypo
gaagaagagggtaaccgtcagccgcacagccccatac

SEQ ID NO: 43821 - DNA, 30 bp, Homo sapiens
  chr13:95888816-95888846
  hypo
ccaacaagcctgtctcggcatgtgaacgcg

SEQ ID NO: 43822 - DNA, 25 bp, Homo sapiens
  chr13:96031705-96031730
  hypo
ataaaaagaaatgaccggccgggca

SEQ ID NO: 43823 - DNA, 66 bp, Homo sapiens
  chr13:96409578-96409644
  hypo
taagaaagtgaaaaacgtgctttccttcctccgttcttctctgtcctttcacgtgcctacatgtat

SEQ ID NO: 43824 - DNA, 18 bp, Homo sapiens
  chr13:97599727-97599745
  hypo
tctcgcctcactgcaacc

SEQ ID NO: 43825 - DNA, 16 bp, Homo sapiens
  chr13:98426774-98426790
  hypo
tgcctgatctcagctc

SEQ ID NO: 43826 - DNA, 30 bp, Homo sapiens
  chr13:98866341-98866371
  hypo
ctcagcagctggagccgttggagccgctgg

SEQ ID NO: 43827 - DNA, 30 bp, Homo sapiens
  chr13:99083172-99083202
  hypo
ggaaattaaacaaatcgtgaaatagagagt

SEQ ID NO: 43828 - DNA, 42 bp, Homo sapiens
  chr13:99083425-99083467
  hypo
aacaccttcctcctgcggccactgcaccggctcatgcactac

SEQ ID NO: 43829 - DNA, 30 bp, Homo sapiens
  chr13:99189615-99189645
  hypo
tgctttgaacagcagcgggctcattcacaa

SEQ ID NO: 43830 - DNA, 30 bp, Homo sapiens
  chr13:99428706-99428736
  hypo
ttttcaggcagggcgcggtggctcaaggcc

SEQ ID NO: 43831 - DNA, 30 bp, Homo sapiens
  chr13:100095884-100095914
  hypo
cagagacagcaaattcgcagctttctgtct

SEQ ID NO: 43832 - DNA, 37 bp, Homo sapiens
  chr13:100146505-100146542
  hypo
ggttccctccactatcgggggaaattcagcccctgat

SEQ ID NO: 43833 - DNA, 81 bp, Homo sapiens; identical to SEQ ID NO: 15770
  chr13:100356871-100356952
  hypo

SEQ ID NO: 43834 - DNA, 276 bp, Homo sapiens
  chr13:100575337-100575613
  hypo
aacccatacccaggccgtctggggccttcccttctgccccggcctgcctggtctctgctgccagagcaaggtctgcagcttccgatctccccgcctttcccaaatatgcacgccctgtaccgccgtcccaggctccgtgccaggcggcagcagccactgtgctcacactcatgtgtcgtgtctctcctcccaggtaacttgtttccgtgttaacaggtaatcttcctgctgaggatgtcaggcaacatgccaacctgggaacgaccacctttgggg

SEQ ID NO: 43835 - DNA, 30 bp, Homo sapiens
  chr13:100583792-100583822
  hypo
ttagcttggatgagccgcttcttaggatga

SEQ ID NO: 43836 - DNA, 30 bp, Homo sapiens
  chr13:102206088-102206118
  hypo
ttcacaaggcattctcggtgtgcctgccgc

SEQ ID NO: 43837 - DNA, 30 bp, Homo sapiens
  chr13:102385630-102385660
  hypo
aagcataattatgtacgagtttaagagaca

SEQ ID NO: 43838 - DNA, 27 bp, Homo sapiens
  chr13:103569166-103569193
  hypo
ccggccgtcccccgttaatcttactcc

SEQ ID NO: 43839 - DNA, 143 bp, Homo sapiens
  chr13:108218849-108218992
  hypo
acactaagcagccaacgtgatccaacaagaagcaggtccaagggcactaggcaggccaccctaaccagagcctcaccaacctcacggaaaggggttcgcacggtaacaccagattcacgttgtggttccgtttcagacatctt

SEQ ID NO: 43840 - DNA, 24 bp, Homo sapiens
  chr13:110053866-110053890
  hypo
tacctgagattcaatcgctgaggc

SEQ ID NO: 43841 - DNA, 2065 bp, Homo sapiens
  chr13:110434379-110436444
  hypo
cctcctcacctttcacgatggtggcctccttcaagtggtgggacaagaagtcaatgctggcgtaggtgttggcagggggcagggcaccgggacccggccccccgcacccgccgccggtgctgccgacgcccacagcgctgatgagacccccgaggcttcgggtccggccccaggagctcttgtctcccggctgaggaagcggcggcggcggcggctgcggctggggtggcagcccgggctcctccctcacgtcgatggcgatgtagttgagaccattctggaagccggcagaggtctctctgcgcatgggcgatccaccgctcccaggacaaccgaccaagcccccgggctgacccggggtccacggccggccctgcggtgccaaagggggcgccggctgcaactgtcgtggggaggtgggcggctcgtcgccccctccagggccgacacccacgccgccctcgctgcttttcctgagagagacattttccacggaggccgagttgtggcgcttggggttgtgggcgaaggacggggacacgggggtgaccgtcgtggtggaggagaaggtctcggaactgtggcggcggcggcccccctgcgggtctgcgcggatgaccttggcgccgcggtgggggtccgggggctggctggcctgcaggaaggcctcgactcccgacacctgctccatgaggctcagcctcttcacgcccgacgtcgggctggccacgcgggcagcttctggcttcgggggggccgcgataggttgcggcggggtggcggccacaccaaaagccatctcggtgtagtcaccattgtccccggtgtccgaggacaacgatgaggcggcgcccgggccctgggcggtggcaacggccgaggcggggggcaggcggtacagctcccccggggccggcggcggtggcggcggctgcagagacgacgacggggacgcggacggacgcgggggcaacggcggatacggggaggaggcctcgggggacaggaggccgtccaaggagcccacggggtggccgctcggggcgcccggcttaggagacttgggggagctgaagtcgaggttcatgtagtcggagagcggagaccgctgccggctgtcgctgctggtgcccggggtgcctgagcccagcgacgaggccgggctgctggcggacaagagcgaggaggacgaggccgccgacgccagcaggggaggcgcgggcggcgacaggcgggccccgggctcgccaaagtcgatgttgatgtactcgccggggctcttgggctccggtggcagtgggtactcgtgcatgctgggcaggctgggcagcccctccagggacaggcgcgtgggcctcaccgcccggccgcgctggcccaagaagccctccgggcggccgccgctaggccgcacgggcgaaggcactacagggtgagggggctgcgtggggccggccccgaaggcgctggccgcctggctgggccctggcgtggcctgaggctccagacgctcctcctccaggatgcgccccacgggggagctcatgagcacgtactggtcgctgtccccgccacaggtgtagggggccttgtaggagcggggcaaggagctgtagcagcagccgggaacgcccctgagcggctccccgccggggtgcagggctgcggagaagaagtcgggcggggtgcccgtggtgaccgcgtcgctgggggacacgttgaggtagtccccgttgggcagcagcttgccatctgcatgctccatggacagcttggaaccgcaccacatgcgcatgtacccactgtcctcgggggagctctcggcgggcgagctggccttgtagccgcccccgctcgccgggaatgtcctgcccgccgcagaggtgggtgctggccccgcaggccccgcagaaggcacggcggcggcggcggcggcggcggccctgggctgcaagatctgcttgggggcggacacgctggcggggctcatgggcatgtagtcgtcgctcctgcagctgccgctcccactgcccgcgagggccgcgccgggcgtcatgggcatgta

SEQ ID NO: 43842 - DNA, 30 bp, Homo sapiens
  chr13:110659714-110659744
  hypo
acaaactgcatctagcgtaacaggatcaaa

SEQ ID NO: 43843 - DNA, 77 bp, Homo sapiens
  chr13:110998830-110998907
  hypo
agtgaccaagacattcgaagacaggcaaggaaaccttcaaatgcaggcaactcatatttcgacggggcaccctccag

SEQ ID NO: 43844 - DNA, 149 bp, Homo sapiens
  chr13:111144888-111145037
  hypo
gcctccttacagccccgagacgggccaccctgccatgctcactgcccatgtaacagaaggaattgccacctgtttgctgtgtcctgctttagaaatatttaccctcagaaatccagagggaatggaaatgacaccgggctatttgttcc

SEQ ID NO: 43845 - DNA, 496 bp, Homo sapiens
  chr13:111277129-111277625
  hypo
aacctaaagcgtgatttgtattgtactccaccaaagtgcacctgggatgcctttgtaggtcgcagctgaagccgctgatcctgcagtttcccatgagctgagcaagtgctaacggccggcctcttcctgtgacccttcctcctggagggtgaccagaccgagctgggccgtgctggtgtgtgtggctctgaccctgcctctgcagtggcggcaaaagtctttctttttaggtattgtgctctgcgccctggccctttgctaagccacctggctgggtgtaatccgagctagtacgtttctcatgcacgtcaccagggctgagtaatgagcgctggacgcctgtgtctggcgggtgggcagcgatgccggagcgatccctgagtcggcctcttgtgctccttcatcagggcgcagacttgtcccacgtgttctgtgccagtgcggccgcacctgtgattaaggcctacagcccggagctgatcgtccacccagttct

SEQ ID NO: 43846 - DNA, 89 bp, Homo sapiens
  chr13:111278321-111278410
  hypo
agcacagtgtgatgacgcctgggtcgagcccggcctctccacaccagagaggagccggcgcggagctccaggtgcggtgctgtgatgtg

SEQ ID NO: 43847 - DNA, 56 bp, Homo sapiens; identical to SEQ ID NO: 15777
  chr13:111289222-111289278
  hypo

SEQ ID NO: 43848 - DNA, 141 bp, Homo sapiens
  chr13:111363831-111363972
  hypo
attacaggcgtgagccaccgcgtccggccaagtgttatagtcttttgtgcagaccaagtagtggccaataaatcttgtagaaactaaagtactcatttgcttttaactaggccaagactagaatagcgtgatctgtaagta

SEQ ID NO: 43849 - DNA, 31 bp, Homo sapiens
  chr13:111704359-111704390
  hypo
cccagaagcaggtcacgagaccctcatgtga

SEQ ID NO: 43850 - DNA, 30 bp, Homo sapiens
  chr13:111764740-111764770
  hypo
gtcccccaaaagatacgttgggctctgctg

SEQ ID NO: 43851 - DNA, 234 bp, Homo sapiens
  chr13:111978711-111978945
  hypo
tggggtggaggagaccgcgggcagcgtgaggctgtctggtggggtggaggagacggtgggcagcgtgagcctggcgctggtgggtgtctggtggggtggaagagactgcgggcagtgcgagcctgtctggtggggtggaggagaccacgggcagcgcgaggctgtctggtggggtggagactgcgggcaacgcgagcctggtgctggcgggtgtctggtcgggtggaagagact

SEQ ID NO: 43852 - DNA, 30 bp, Homo sapiens
  chr13:112062748-112062778
  hypo
gaaaacctattctggcgtggggtaaagatt

SEQ ID NO: 43853 - DNA, 56 bp, Homo sapiens
  chr13:112078451-112078507
  hypo
gtctcatttaaccagcgccgctgactgggaaggaaccactgcggccacctccacct

SEQ ID NO: 43854 - DNA, 30 bp, Homo sapiens
  chr13:112090544-112090574
  hypo
gacagcagacacccccgggagtcagaatcc

SEQ ID NO: 43855 - DNA, 30 bp, Homo sapiens
  chr13:112243149-112243179
  hypo
ctctgactacacttccgaggccttcaattg

SEQ ID NO: 43856 - DNA, 30 bp, Homo sapiens
  chr13:112272991-112273021
  hypo
acatggtgagaccaacgtctggaatggcca

SEQ ID NO: 43857 - DNA, 68 bp, Homo sapiens
  chr13:112274715-112274783
  hypo
tcaatcagacagaaacggtcccttggggcccggcctcctgggtgctgcccgggcgctgccatccaccc

SEQ ID NO: 43858 - DNA, 30 bp, Homo sapiens
  chr13:112320732-112320762
  hypo
gcagacaatccctgtcgttaacctggaact

SEQ ID NO: 43859 - DNA, 41 bp, Homo sapiens
  chr13:112559680-112559721
  hypo
agtggactagcaaggcgggaggagcacgtgtttggagtgtg

SEQ ID NO: 43860 - DNA, 30 bp, Homo sapiens
  chr13:112573448-112573478
  hypo
ccatgccggggactgcgtgagagcccccat

SEQ ID NO: 43861 - DNA, 35 bp, Homo sapiens
  chr13:112573696-112573731
  hypo
gttgtaaggaggaggcgattcggcagacctaagcc

SEQ ID NO: 43862 - DNA, 30 bp, Homo sapiens
  chr13:112618950-112618980
  hypo
agcgctctggtccagcgtttccacccacag

SEQ ID NO: 43863 - DNA, 38 bp, Homo sapiens
  chr13:112682862-112682900
  hypo
cagagggaggaaaaacggcccagcgggagggaggacaa

SEQ ID NO: 43864 - DNA, 50 bp, Homo sapiens
  chr13:112690800-112690850
  hypo
agcaggcctgagagccggacatgcttccgtgtggccgtcacatccccaga

SEQ ID NO: 43865 - DNA, 30 bp, Homo sapiens
  chr13:112800543-112800573
  hypo
agcttggacttgattcgagatcacttttac

SEQ ID NO: 43866 - DNA, 41 bp, Homo sapiens
  chr13:112830483-112830524
  hypo
tcctgcccaggatagcggcagcacctcggggaatggagccc

SEQ ID NO: 43867 - DNA, 32 bp, Homo sapiens
  chr13:112882268-112882300
  hypo
acatctcttcatttacggaggaagtttcagtg

SEQ ID NO: 43868 - DNA, 32 bp, Homo sapiens
  chr13:112882360-112882392
  hypo
attcaaggttatgatcacgcactttcgtggag

SEQ ID NO: 43869 - DNA, 42 bp, Homo sapiens
  chr13:113099281-113099323
  hypo
agaaagcctcctcagcgacagcggctgcgacccagaaagccc

SEQ ID NO: 43870 - DNA, 73 bp, Homo sapiens
  chr13:113107030-113107103
  hypo
actcctggcagcagacggaagggcggctgccgggccctcagacccaggacgggcaccacgctggagctcagcc

SEQ ID NO: 43871 - DNA, 30 bp, Homo sapiens
  chr13:113319347-113319377
  hypo
ttggtgaacctgcatcgttggcagagctgc

SEQ ID NO: 43872 - DNA, 210 bp, Homo sapiens
  chr13:113400400-113400610
  hypo
tgatggactcttgggcgtctgccgtaggccgctgtgaatgctggcggcggtgatcgtgtgctgacgtctcctccacgtactgagttcgtgtcttttggatgcgcgcccagaggtggcactgctggatcctgtgctgggtcatacctatgtttaattctctgaggaacctccgtgctgtctccatagcagccgtgtcgtttcacacttgca

SEQ ID NO: 43873 - DNA, 39 bp, Homo sapiens
  chr13:113401430-113401469
  hypo
atcacccgtctgctccggagggatcgcttgttgagatga

SEQ ID NO: 43874 - DNA, 30 bp, Homo sapiens
  chr13:113424905-113424935
  hypo
aaggtgggagagaaccgtgcatctcagcac

SEQ ID NO: 43875 - DNA, 125 bp, Homo sapiens
  chr13:113598563-113598688
  hypo
atgaagggagggtcccgggtgaagagcaagctcatgaccctcatttactgggaatccattgctctggccccgtcatgagtggggttcgcagactgggccaatccctacagcgtatgtgtgctctg

SEQ ID NO: 43876 - DNA, 30 bp, Homo sapiens
  chr13:113608292-113608322
  hypo
tgtctgctctgagaacgctgtggcatgctg

SEQ ID NO: 43877 - DNA, 79 bp, Homo sapiens
  chr13:113648553-113648632
  hypo
actatgcaggtgtctcgggcaggggctggcgtggctgtcggcgtgacggggcgcggcgcgtgggacgccaagctgacgt

SEQ ID NO: 43878 - DNA, 44 bp, Homo sapiens
  chr13:113763552-113763596
  hypo
tgtcccgggggtcgtgggtgtcccgggagcgtgggtgtcgggga

SEQ ID NO: 43879 - DNA, 42 bp, Homo sapiens
  chr13:113776004-113776046
  hypo
gaggaccaggctgtgcgtggtgcccgccgtgggaggccagcc

SEQ ID NO: 43880 - DNA, 277 bp, Homo sapiens
  chr13:113985679-113985956
  hypo
gagtgaccacagctgcggggctgggataccaggaggcacgggctgcagcatgggaggcggcccaggaggagatgccaagaaggcacagcaaggacagccagtgcaggagccacccgggtgcccacccagcagctgcgcacccccactgcccgagccagcctctctgcatctcttttcctgagaagacttcggcgtggcacagcccttacagggcgtgagccttctcagacgcagctcaggttacagcaaggaagctgcaaggctggttttgctgttt

SEQ ID NO: 43881 - DNA, 182 bp, Homo sapiens
  chr13:114055958-114056140
  hypo
gggagctgtggggaccggccccccagagctcagcacagcccggccctccttccagacaccagcactcgcatgtcccagcaggtgagggtgggtcaaacctgctggatctgaagttaattgttcgactggaaggaaacctgtgcgctccccggagcatgacgccacgccgcctccttggcgct

SEQ ID NO: 43882 - DNA, 30 bp, Homo sapiens
  chr13:114059583-114059613
  hypo
agatggggagggccccgctggtgggtgcca

SEQ ID NO: 43883 - DNA, 479 bp, Homo sapiens
  chr13:114059986-114060465
  hypo
cctctgggtgctggacgagggccacgcctctcaggaggctcctccctgctgctccactcttgggctccaaggatcccccaggggccaggaggccgtggctgtgagggtctcgagggagagcctctcctctggggtggctttcggacaaggctctgcttccccactggcccagcgtctctggctctcccgctgtgcggtctccagggctctgggtgctgcctggcgctggtgcaggcgtggcgcggctcgcaacgctccctgcagctgccatcgccccacaggctttcatacctggtttgggtggttcatttaatgaggacagtgggttctcgcgaacatcatggctggtgatttcctcggcagccttcaggggctgagaagactctattagcagcggccttctgcattcctccagcgcaccgggcactgtcatgcccatcggggtgacaccctcaggccccgtacgccccttggatgat

SEQ ID NO: 43884 - DNA, 106 bp, Homo sapiens
  chr13:114060775-114060881
  hypo
ctgggacactgtggtcggcgcccacagcccctcttgctgctgccagacgcggagctgcccgtggcccctgcggcgaagaggcgctgagtcccgcctgcatccctga

SEQ ID NO: 43885 - DNA, 33 bp, Homo sapiens
  chr13:114064741-114064774
  hypo
aaccactgaggcagacggcgctccttccaaacc

SEQ ID NO: 43886 - DNA, 715 bp, Homo sapiens
  chr13:114074574-114075289
  hypo
gccagcttttgtttacgatgcttgtggattttgtgtttgtgtgttttaatctataatcagtttgtaaatagactcactttctgattctcacggaggggtttgatttgcggatggagaccgagtccaccctgtttgaatgcagccgcgccctgctcatgcgagctggccttctcttccatacagcagggtggagagggaagcccactttccggtaagcgggcaaaacaggtactacgaccgtgttacttatgctagcaacagttccgacttaccttaattgggtttcttttcctgaaaggtaattctcagttaatttccccacacccacgggtgctgggaccacactccatggacgtgtgtgacgtgaggcccttcgcccccgtgtgcctgtctctctggttcttctgacttaaagcaccagtagcagcacagttagtccagttattcggaagctcagcacggagccacattgctgcagcatagaaggccacggattcctccatcagcatggactacacttcccacaaaacgaacggggcatctctatggaaaaagcaaagcgtgtccctatccctgggacacctctacccctgggacacacctagccccaggacccgcccacccccgggacccgctcaccccgggacaccactacccctgggacatgcccacccctgggacaaccctaccccccccgacacgccctgggacacgc

SEQ ID NO: 43887 - DNA, 30 bp, Homo sapiens
  chr13:114108109-114108139
  hypo
gcagatgtgtgcaggcgtgcctgtcactgc

SEQ ID NO: 43888 - DNA, 43 bp, Homo sapiens; identical to SEQ ID NO: 15787
  chr13:114122929-114122972
  hypo

SEQ ID NO: 43889 - DNA, 86 bp, Homo sapiens; identical to SEQ ID NO: 15788
  chr13:114188403-114188489
  hypo

SEQ ID NO: 43890 - DNA, 30 bp, Homo sapiens
  chr13:114189602-114189632
  hypo
tgggcttctgcttaccgagacgacagtctt

SEQ ID NO: 43891 - DNA, 57 bp, Homo sapiens
  chr13:114220577-114220634
  hypo
ggcgacagcggggctcggagccaccgccacagccctgcccgacgtaggtaattcacc

SEQ ID NO: 43892 - DNA, 42 bp, Homo sapiens
  chr13:114221622-114221664
  hypo
taaaccaccagtttccgacttctgtactaaaacatgttctct

SEQ ID NO: 43893 - DNA, 62 bp, Homo sapiens
  chr13:114271940-114272002
  hypo
gctcacctgcagagccgctcacctgcagagccgctcacctgcagagccgctcacctgcagag

SEQ ID NO: 43894 - DNA, 30 bp, Homo sapiens
  chr13:114285192-114285222
  hypo
cagtgtccacactggcgttgcctctggtgg

SEQ ID NO: 43895 - DNA, 30 bp, Homo sapiens
  chr13:114285597-114285627
  hypo
aaacttgaccgttagcgccttgtgtgcggt

SEQ ID NO: 43896 - DNA, 159 bp, Homo sapiens; identical to SEQ ID NO: 5147
  chr13:114304752-114304911
  hypo

SEQ ID NO: 43897 - DNA, 53 bp, Homo sapiens
  chr13:114312349-114312402
  hypo
cacctggacagggtgcggcccagcatctgccccgtgtccgggttccagcagta

SEQ ID NO: 43898 - DNA, 30 bp, Homo sapiens
  chr13:114318203-114318233
  hypo
ttcttcaaaactaaacgtgcaattacgaca

SEQ ID NO: 43899 - DNA, 30 bp, Homo sapiens
  chr13:114426896-114426926
  hypo
gcacacatgtgtatccgtgtgcctgtgtct

SEQ ID NO: 43900 - DNA, 46 bp, Homo sapiens
  chr13:114450608-114450654
  hypo
tctgggcacagaatccgccgggcacagattccgctgggcacagaat

SEQ ID NO: 43901 - DNA, 22 bp, Homo sapiens
  chr13:114454880-114454902
  hypo
cagttgtgccagctccgtggct

SEQ ID NO: 43902 - DNA, 59 bp, Homo sapiens
  chr13:114479383-114479442
  hypo
cgcacctctcttctgcgggcggcacctgcttcctgtcgtcctcccgacagctacgtcca

SEQ ID NO: 43903 - DNA, 30 bp, Homo sapiens
  chr13:114497409-114497439
  hypo
cgggacggaaccaagcgagatgccaactcg

SEQ ID NO: 43904 - DNA, 434 bp, Homo sapiens
  chr13:114497844-114498278
  hypo
gttgcttctcagaggcgcgtgccgagggcccggggatggcaacgcccttccgtgcagaaggcgcctgggtgggtcttgcggaatagacgcgtgaggacgacccgcagggtggagtccggcctggccagggctggaagtcataggacgaaaggtagaggtgagaagaggcagttctgtgaaagaagccccgacctcgagctgggactttgaattggtttgcgtttgaaaaccggggttggtaaaagctgggcacccacacctctccttctgttgcagctggtggcagcgatcgtgtttatcagttttggcgtggtggccgccttctgctgcgccatcgtggacggcgtatttgcagcacagcacattgtgagtacattgtcattgtgtgcacagtcgctttccggggctgaaagagtcgacgtgaaaaaagtaca

SEQ ID NO: 43905 - DNA, 175 bp, Homo sapiens
  chr13:114502787-114502962
  hypo
caggtgagtgagatgcggggagtaatgacccgcgggcggccgccgccttcgccaggaccgtcggagggcacagctctgtgacggcgctctctgtgtgtctcgcacctgccctgtgtggattcctggctttaactaaacgcagcctctcatcctcagcacgcgtgtcagaggagga

SEQ ID NO: 43906 - DNA, 45 bp, Homo sapiens
  chr13:114506372-114506417
  hypo
acattccaagctggacgtgcccttcgtagacgagggcaaattact

SEQ ID NO: 43907 - DNA, 123 bp, Homo sapiens
  chr13:114526487-114526610
  hypo
aggttgattcagtcccgacgtccagaggggtccgcactgcaatgaaagcggtgcattatagggtggtatgcacggtggagaggccacagtgaggtcggagcagggcctcgagagatgcagtcc

SEQ ID NO: 43908 - DNA, 154 bp, Homo sapiens
  chr13:114742788-114742942
  hypo
ctgctcatgaaaaaccgcagtcacggagccggacgaggatacaagtgactctccctctagtcccctcacgtgtaaattgtgtgttcagtgaaaggctgatcgagacccaaagaatgcagccctgtgtctcctctacctacgacctggaagcccc

SEQ ID NO: 43909 - DNA, 77 bp, Homo sapiens
  chr13:114746775-114746852
  hypo
aggttatcacagggccggactctcacctgaggcaccacaggtgaatgccactgtcagagcagcgctgcccatcacca

SEQ ID NO: 43910 - DNA, 783 bp, Homo sapiens
  chr13:114748353-114749136
  hypo
tgcacgcaagacagacgtgcacgagactgacgcacacacggccggaggtgcatgtcacagtcgactagacgggccgtggctccctgaggctggctgtggtgtggctagggcacagcccacacttcctgatccttcagctgatccccagatccccacaaacaaggagcaaaaagcacagaatcaaatgacgacacgttccacagggccaggtgggctttctgcggagggcgtggcggtggtggcagcggttctgggagagggaaaccccagcgccacttgtctatgggccgggacggcgtgcatctcactttgccggctctgcgctcttccttctcttctccctcccaaaggctgcggctttgcatgggcagcttgctggcgccactgggcgcgtcccgcagactttaaatggaatgagtggaggtctcggactgctgccggatgtagttctggaagctcttgtctccgatggggtgctccctgaaaagggggatgggagagggaatgaggcacagaccccgttgcctggtgctcacccgtggctgcgggagcttttcctgttcctaaatgtgacacactcacactgcaatccacacaaaaaatagaggagccaaaggaaccacagtgcccccggaagcacccacggtgactctgatgtgtgtgcacaggtgggtcaggcgtgcaagtacatgtgcacgtgtgctctccctgtggcacgtgtgtagcgcatatacatgtgcagatgtggaatatgtagagtgtatggcacgtgtgcagaatgtg

SEQ ID NO: 43911 - DNA, 32 bp, Homo sapiens
  chr13:114749950-114749982
  hypo
aacagcatcatgcttcgcgcattttcaacctg

SEQ ID NO: 43912 - DNA, 30 bp, Homo sapiens
  chr13:114751360-114751390
  hypo
tacacatccttccaacgcaagctcctccag

SEQ ID NO: 43913 - DNA, 64 bp, Homo sapiens
  chr13:114760951-114761015
  hypo
tggccacaacaacagcgaggtgcatctcacggagcataaccagggggaccgccaggcacccagg

SEQ ID NO: 43914 - DNA, 56 bp, Homo sapiens
  chr13:114765157-114765213
  hypo
gactgtcagtgggtgcgggccccgctgtcccggctggggtccgggtggggctgagg

SEQ ID NO: 43915 - DNA, 137 bp, Homo sapiens
  chr13:114767508-114767645
  hypo
gggccctctgaggctcggccttcattgccgggcaggggtccctgaccagaaccggcggccgagctggaggagaagaaagtggccagacagagtgactggaggacagaggtggaagctgaggacgagaagccaagctg

SEQ ID NO: 43916 - DNA, 81 bp, Homo sapiens
  chr13:114767926-114768007
  hypo
ggacccagtgggatgcgcagggcggggcctacacagacgggggttggggggggactgggagctccacgacatgccggcctc

SEQ ID NO: 43917 - DNA, 206 bp, Homo sapiens
  chr13:114769986-114770192
  hypo
tgtgaccccacctcacgccaggcagaacgaagccacctgcgaccccagctcacgccaggcagaatggagccgcctgaacccagctcacgccgggcagaatggctgggatcaaataaaacacggaaaaatgacagacgctgcagagctgtggaggacgtgagcgcttgcacgctgtggggaatggaaattagcgcttaaggaaaccc

SEQ ID NO: 43918 - DNA, 124 bp, Homo sapiens
  chr13:114770941-114771065
  hypo
cccctccaaggtcaccgagaaggtggcagaggggtcccaggctgaaggcgcaggggccagacccccagggctgtcccctctgactctggttccctgagcaaagagccctcgggagcctggaggg

SEQ ID NO: 43919 - DNA, 179 bp, Homo sapiens
  chr13:114774968-114775147
  hypo
cagcccgaagtacctcggctcacggcccaaatctgaaaaagctagaggcaagaactgtccaagcctaaatgacgataaacaggcaaagaacccggtgttaccgggcaagtgagagcccgcagggctgcccggaggacgaatcacataaatcgctcaggcgccaacgaagaccatcagac

SEQ ID NO: 43920 - DNA, 64 bp, Homo sapiens
  chr13:114776318-114776382
  hypo
gcaacgcccaggaggcgccaggttaggccatctgcctggcctgttcagccgcttcccacacctg

SEQ ID NO: 43921 - DNA, 40 bp, Homo sapiens
  chr13:114777010-114777050
  hypo
gtcatggctctggggcgctgagtctcggggtgctgagtct

SEQ ID NO: 43922 - DNA, 34 bp, Homo sapiens
  chr13:114778697-114778731
  hypo
ctgcagtgtacctgacgtccgggtcatctgcggg

SEQ ID NO: 43923 - DNA, 78 bp, Homo sapiens
  chr13:114779945-114780023
  hypo
tgtctgcagctgtcccgaggccacaggacacgcaaggaagagaggagccggcagcaaggccctcgctgagcctctcag

SEQ ID NO: 43924 - DNA, 528 bp, Homo sapiens; identical to SEQ ID NO: 1603
  chr13:114780555-114781083
  hypo

SEQ ID NO: 43925 - DNA, 30 bp, Homo sapiens
  chr13:114784556-114784586
  hypo
agcagggctggtcaccggggatccccagga

SEQ ID NO: 43926 - DNA, 66 bp, Homo sapiens
  chr13:114785766-114785832
  hypo
gtctgaggcattagccgccccccatcgccccaggtaggtagagcctgtgtgcgaggcattagcacc

SEQ ID NO: 43927 - DNA, 35 bp, Homo sapiens
  chr13:114786866-114786901
  hypo
aacatcatcttaccacgcctcgtaggagctggact

SEQ ID NO: 43928 - DNA, 30 bp, Homo sapiens
  chr13:114789401-114789431
  hypo
acccgccaggccctgcgacctctgagtgag

SEQ ID NO: 43929 - DNA, 36 bp, Homo sapiens
  chr13:114802282-114802318
  hypo
aattacaagcatgagccaccgcgcccagcctggagt

SEQ ID NO: 43930 - DNA, 30 bp, Homo sapiens
  chr13:114802665-114802695
  hypo
tttgtggagatgcaacgtctgagtcctgat

SEQ ID NO: 43931 - DNA, 225 bp, Homo sapiens
  chr13:114807622-114807847
  hypo
gaaacattcccgaggcgcggcaaacgtgtgcccatcccatccccggcaggacagggcttgtcaggcgctgggcaccgagccatctcccatcctgcgtcccttcatggcaccaccatgtcaaccctgccagtggcctccgcacactgcggaccacgccacccaccacggtgagcacccacggcagcacatgcacctctgttgaccgatgcacgtgaactcctaggg

SEQ ID NO: 43932 - DNA, 18 bp, Homo sapiens
  chr13:114812180-114812198
  hypo
gtccgagccctgccttca

SEQ ID NO: 43933 - DNA, 53 bp, Homo sapiens
  chr13:114843043-114843096
  hypo
ctggcaccaatgcaccggattcatccttcctccctgcccgacaatgcccagtc

SEQ ID NO: 43934 - DNA, 195 bp, Homo sapiens
  chr13:114855474-114855669
  hypo
tgatatttcatgtcacggatggaacgcattctgtgtatttgttaatcactgatggatgtttgggctgttcccagctttcagttgttgtgaatggtgccgctgtgaagtgtgcacaagttcccatgtgaacacggacagctttgggattctcttgattatttaccaacgggtggggccgcacggcaacaggtttaa

SEQ ID NO: 43935 - DNA, 38 bp, Homo sapiens
  chr13:114917035-114917073
  hypo
cactcaccagtgccacgtgcacacggatcatctaattc

SEQ ID NO: 43936 - DNA, 189 bp, Homo sapiens
  chr13:114961744-114961933
  hypo
ttcagaacttcaggccgtgtgctgacatggaatccctggtgccacgaaagaccccagagcagcacaatctgagctcactctgtttccaatactgcgcccaggtaacgctgcctcctcatgccacaggtccagagcgcccagccgctggtagacacccgcgccccgctgacgttccgccatctccacctg

SEQ ID NO: 43937 - DNA, 50 bp, Homo sapiens
  chr13:114989948-114989998
  hypo
ctctccaggcagccccgcccccctgtgtcgtgaagcgcaactgggcacag

SEQ ID NO: 43938 - DNA, 30 bp, Homo sapiens
  chr14:19828313-19828343
  hypo
gcccagcgcaagggtcgatgggaagacact

SEQ ID NO: 43939 - DNA, 30 bp, Homo sapiens
  chr14:20928272-20928302
  hypo
tacattctctgtatacgctcatcctttttt

SEQ ID NO: 43940 - DNA, 107 bp, Homo sapiens
  chr14:21190405-21190512
  hypo
gctgccgttaactgacgccatctttctggcacggatgtcacagccaaatcacgcaaagtggaaggtggtggtaaggagggatggggtgatgccggcagacagaggaa

SEQ ID NO: 43941 - DNA, 24 bp, Homo sapiens
  chr14:21265229-21265253
  hypo
gcacctggccgtagcttctaattc

SEQ ID NO: 43942 - DNA, 23 bp, Homo sapiens
  chr14:21282035-21282058
  hypo
atgtttctggctgggcgcagtgg

SEQ ID NO: 43943 - DNA, 32 bp, Homo sapiens
  chr14:21657875-21657907
  hypo
agctttcccactggccgggcgcggtggctcac

SEQ ID NO: 43944 - DNA, 30 bp, Homo sapiens
  chr14:21721854-21721884
  hypo
ttaagtattagtggccgctaacactgccaa

SEQ ID NO: 43945 - DNA, 42 bp, Homo sapiens
  chr14:21980230-21980272
  hypo
gaggtgaggagggggcggtggtgggtgcgggcatgcttcttt

SEQ ID NO: 43946 - DNA, 38 bp, Homo sapiens
  chr14:22551269-22551307
  hypo
aattgttttagtggccgggcgcggtggctcacgcctgt

SEQ ID NO: 43947 - DNA, 30 bp, Homo sapiens
  chr14:23183874-23183904
  hypo
tacacccctcccccccgtgatatagttcct

SEQ ID NO: 43948 - DNA, 46 bp, Homo sapiens
  chr14:23355390-23355436
  hypo
cgttggaaacaagagcgacttggcccgctcccgggaggtatcactg

SEQ ID NO: 43949 - DNA, 41 bp, Homo sapiens
  chr14:23426904-23426945
  hypo
ggccaggcctcgtttagttcttaaagcgtcctgtgagaaag

SEQ ID NO: 43950 - DNA, 38 bp, Homo sapiens
  chr14:23706727-23706765
  hypo
aaattttcctgtttccgattttacgctattctttcaaa

SEQ ID NO: 43951 - DNA, 141 bp, Homo sapiens
  chr14:23707497-23707638
  hypo
aaagttagtgtatcacgatcgaacaaataggacaacgaagctcgtggcactgtgggatgcgtttgcgttgagctgtttattcagtacattttttatcgtaaatcttacgaagtttgtatccctcagcggttacacacacac

SEQ ID NO: 43952 - DNA, 285 bp, Homo sapiens
  chr14:23776954-23777239
  hypo
cttgcctcttatagccgcccggatggcgaccccagcctcggccccagacacacgggctctggtggcagactttgtaggttataagctgaggcagaagggttatgtctgtggagctggccccggggagggcccagcagctgacccgctgcaccaagccatgcgggcagctggagatgagttcgagacccgcttccggcgcaccttctctgatctggcggctcagctgcatgtgaccccaggctcagcccaacaacgcttcacccaggtctccgatgaactttttca

SEQ ID NO: 43953 - DNA, 94 bp, Homo sapiens
  chr14:23884288-23884382
  hypo
tcattctccagctcccgcacccgcgcttccagcttctgcagctgcttcttgccgcccttgagggcgatctgctcggcttcgtccagccggtgct

SEQ ID NO: 43954 - DNA, 93 bp, Homo sapiens
  chr14:24021398-24021491
  hypo
tctgcctcctccacacggttacatagtcccctgagctgggttgggggaggttcgggctcctcctcatcttcagtttatcgcttattaagtgct

SEQ ID NO: 43955 - DNA, 153 bp, Homo sapiens; identical to SEQ ID NO: 15809
  chr14:24862082-24862235
  hypo

SEQ ID NO: 43956 - DNA, 30 bp, Homo sapiens
  chr14:24901976-24902006
  hypo
cagtacttctgggaccgtggtcaccgtgac

SEQ ID NO: 43957 - DNA, 100 bp, Homo sapiens
  chr14:31027393-31027493
  hypo
aggcgtgagccaccgcgcccggccctcaaactgtatttttgacaaaggctaaaggtatgctgtcatggtttggtttgtactgatccgtttaggtaattca

SEQ ID NO: 43958 - DNA, 119 bp, Homo sapiens
  chr14:31534496-31534615
  hypo
gtagctcattcttcacgacctcacatcagtgccccttctccgggaagcagttcttcactctcctgtgatgttccttgtccctcccttctgtacacctatggaagcggacctgtcccagt

SEQ ID NO: 43959 - DNA, 100 bp, Homo sapiens
  chr14:31925624-31925724
  hypo
taaaaaataaaataaatgtaaaataataactaaaattgttttaagtaatgctagatctgggaccgaattcagcagaaaaggcgagcgaatgagattttgc

SEQ ID NO: 43960 - DNA, 97 bp, Homo sapiens
  chr14:32597741-32597838
  hypo
gtgctgaggctggcccgcctctgcgtgggcaggatcttggcattccttttgctccatggacgctgcctccctgggctcgccgcgcctggccgcccgg

SEQ ID NO: 43961 - DNA, 23 bp, Homo sapiens
  chr14:34920639-34920662
  hypo
caattctaggctgggcgcggtag

SEQ ID NO: 43962 - DNA, 16 bp, Homo sapiens
  chr14:34921211-34921227
  hypo
tagcgtggtggctcac

SEQ ID NO: 43963 - DNA, 30 bp, Homo sapiens
  chr14:35017114-35017144
  hypo
cttttaggagagtctcgtgacagcctctgt

SEQ ID NO: 43964 - DNA, 443 bp, Homo sapiens
  chr14:35023168-35023611
  hypo
aatacttaataacaataaagaagaattcgtccattcaacaaccgttcactgagcgcatagcctgtgcccagacactgttccaggcctctgggagcaaaaaggcctcggtgcccgtattctagttagacaacgagaagcgcggggaggtggggggcgggggtgggagagagaaaatctacaccgggctgcataggtaaattcgtaggttaggtgctaagtgctttgaaaaagcaaacaaacacagggaaagtgagataaggagttgcggcaaggggcaggtggctgtgttaaatcgagtggttggaagaagctgctatgagaaggtaccgtatgagcaaaggacttgaagcaggtgaagggagttggtcacggggcatccccagcacaaacatcagctacagcaaaggcccaggtaggactgggtttggcgaacagcaaggagg

SEQ ID NO: 43965 - DNA, 20 bp, Homo sapiens
  chr14:35024446-35024466
  hypo
tatttatttttgagacggag

SEQ ID NO: 43966 - DNA, 17 bp, Homo sapiens
  chr14:35507705-35507722
  hypo
ttacgaatagagcgccg

SEQ ID NO: 43967 - DNA, 30 bp, Homo sapiens; identical to SEQ ID NO: 15815
  chr14:35866882-35866912
  hypo

SEQ ID NO: 43968 - DNA, 30 bp, Homo sapiens
  chr14:36458365-36458395
  hypo
ttgtcttagttttggcgagtgttccacact

SEQ ID NO: 43969 - DNA, 20 bp, Homo sapiens
  chr14:40125126-40125146
  hypo
tcccagtatgagcaacgcag

SEQ ID NO: 43970 - DNA, 23 bp, Homo sapiens
  chr14:40221669-40221692
  hypo
cgagagtccgtctcaaaaaaaaa

SEQ ID NO: 43971 - DNA, 25 bp, Homo sapiens
  chr14:45382862-45382887
  hypo
ggtctcgaaacgctagcctccagtt

SEQ ID NO: 43972 - DNA, 27 bp, Homo sapiens
  chr14:48095553-48095580
  hypo
attcttcttcctgtccgctacactgtg

SEQ ID NO: 43973 - DNA, 30 bp, Homo sapiens
  chr14:48135049-48135079
  hypo
caccatggactcctgcgttgcctcagcctc

SEQ ID NO: 43974 - DNA, 40 bp, Homo sapiens
  chr14:50098049-50098089
  hypo
cagaagatttgcagccgggcgcggtggctcatgcctgtaa

SEQ ID NO: 43975 - DNA, 180 bp, Homo sapiens
  chr14:50233117-50233297
  hypo
gcactcaagcctgggggacaagagcgagacttctctcgaacaaacaaaaaacaaaaacgatgatagaagggtaatgtagctggaaggaggacacagccaggaattgaagctggaaaggcaagctgggtctggaccatgctgggtcttcttgcacagcactgtgatatgaatttttttttt

SEQ ID NO: 43976 - DNA, 144 bp, Homo sapiens
  chr14:50233597-50233741
  hypo
ccgagatattaattttggattctactaaggacgacgggagccagctcaaggtttttaagtgactcgatcagattcacgaggttggttcacaaggaacttcgataaccccaaagtctagtgagcataattcgactgggagaagac

SEQ ID NO: 43977 - DNA, 30 bp, Homo sapiens
  chr14:50287126-50287156
  hypo
gtcactgcatgacttcgctgaagttcctta

SEQ ID NO: 43978 - DNA, 120 bp, Homo sapiens
  chr14:50333963-50334083
  hypo
caggcgtgagccaccgcgcccggccagccgtttgcttttttaacagtgcaaaaaacaaggccgtgtctggctatatggggctttgcttgttcaaaatgtaacctctatacggccgcgcgc

SEQ ID NO: 43979 - DNA, 29 bp, Homo sapiens
  chr14:50434015-50434044
  hypo
catttatgcataaacgatcacatgacatg

SEQ ID NO: 43980 - DNA, 27 bp, Homo sapiens
  chr14:50681830-50681857
  hypo
ggcgtgagccaccgcgcccggcaaggt

SEQ ID NO: 43981 - DNA, 54 bp, Homo sapiens
  chr14:50777944-50777998
  hypo
ttttaaatagcttcccgtggctcttagaataaaagtcaacgtgtggttaaaata

SEQ ID NO: 43982 - DNA, 43 bp, Homo sapiens
  chr14:52226966-52227009
  hypo
ggtgcctcacccccccgtccatgtggatcgtcatatccagggt

SEQ ID NO: 43983 - DNA, 30 bp, Homo sapiens
  chr14:52321518-52321548
  hypo
ccgcacccggccggccgtggctctttctta

SEQ ID NO: 43984 - DNA, 15 bp, Homo sapiens
  chr14:54956536-54956551
  hypo
cgctgggatcacagg

SEQ ID NO: 43985 - DNA, 39 bp, Homo sapiens
  chr14:55517158-55517197
  hypo
aaaatgtatattggccgggcacagtggctcacgcctgta

SEQ ID NO: 43986 - DNA, 30 bp, Homo sapiens; identical to SEQ ID NO: 15822
  chr14:55664068-55664098
  hypo

SEQ ID NO: 43987 - DNA, 234 bp, Homo sapiens; identical to SEQ ID NO: 15823
  chr14:55765372-55765606
  hypo

SEQ ID NO: 43988 - DNA, 30 bp, Homo sapiens
  chr14:56077686-56077716
  hypo
tttatttagcaatttcggtaggatgttgat

SEQ ID NO: 43989 - DNA, 267 bp, Homo sapiens
  chr14:57045520-57045787
  hypo
tgctggccccatgaccgtcaaggtaggtatatgttactctatagtttagtcactgtgtctctatcaaattgcgcgtaacacgtttgagattgtcactggttttcagtgtgtctttgagatacattttatgcgggttgctctcctccccgcccactccaggataattgctttaataataaaacataagcttaaaaagcttaactgcgctgttatgtagttgtccttattaacggctccgattctttttttttgcgttacagctcattg

SEQ ID NO: 43990 - DNA, 30 bp, Homo sapiens
  chr14:58410326-58410356
  hypo
ctcttcaccaatctgcgacttcccaccgcc

SEQ ID NO: 43991 - DNA, 23 bp, Homo sapiens
  chr14:58599589-58599612
  hypo
actgcgcccggccaacccttgtc

SEQ ID NO: 43992 - DNA, 40 bp, Homo sapiens
  chr14:58893188-58893228
  hypo
ctgggattacaggcgtgagccaccgcgctcagactttaaa

SEQ ID NO: 43993 - DNA, 88 bp, Homo sapiens
  chr14:64022981-64023069
  hypo
aaagagaaacagaggcggtgatactggttatactcagaattctccttcaggcctggcctggcacacttggcctccttttgtttgttta

SEQ ID NO: 43994 - DNA, 30 bp, Homo sapiens
  chr14:65086478-65086508
  hypo
cagcttcttctagagcgaggtgggacttca

SEQ ID NO: 43995 - DNA, 161 bp, Homo sapiens
  chr14:65233318-65233479
  hypo
ggggaggatggagggcggggctgcgccagctcatctcgcctccacctgggctgagcctagtaggggtgagagggctctggctgcagtgactcccaggaactagacaaacgagaccagagactgaccggggacgttctctcggtggccgcatggtgggaaac

SEQ ID NO: 43996 - DNA, 399 bp, Homo sapiens
  chr14:65239395-65239794
  hypo
cgcggtgcttctcgtcgatgaggcccaggatctcggcacccgtgtagaagtagcggtgcaggtcataggaggcggccagcagctgcatgcgcgtgtcaatgagctccaggaggtctgcccacatctcgttcagcccgtccttccactcggcgatggtggccgcctcgctgtggcccgcgtcgatgagtcgctcgatgaaggcattcacattgtccacccgctcctgcccaatcgccccggtctcccgggcaaagtcccggaacttgtcccgcagaagctaggcatggggcagacagaaatgtggttatggggggcacaggggttacaggtgtcaccagcttagccaaagactttcccaggcagcaactgcagctccgggagctgcgctgtcacaccttc

SEQ ID NO: 43997 - DNA, 63 bp, Homo sapiens
  chr14:65273132-65273195
  hypo
tggcctagccaggagcggggtctgcccggtcggagcaggctgtgtgctcgactgagcctcaac

SEQ ID NO: 43998 - DNA, 107 bp, Homo sapiens
  chr14:65406280-65406387
  hypo
gaagggctctccctccggccctatgaggaacttctcaaagttccaggccacatctgagcggcgcacagggctccaaatgatgagcttgggatcggtcatgagggaaa

SEQ ID NO: 43999 - DNA, 17 bp, Homo sapiens
  chr14:66499286-66499303
  hypo
accggagctgttcctgt

SEQ ID NO: 44000 - DNA, 41 bp, Homo sapiens
  chr14:66560653-66560694
  hypo
cacctgcccaggctgcgacagcgtccaggcttgactacaac

SEQ ID NO: 44001 - DNA, 189 bp, Homo sapiens
  chr14:66792112-66792301
  hypo
atggcactccattcccgaatacagatccagcatctgacagcaatgccagcagcgggaacttccagtgtgggaatgtagatgggagtggtgcaacaggccacctgggcattccagacaatccagatacagtggtactgcccggcagcctcagcacccaccctgaatccacctggccgtgaggcatcacgt

SEQ ID NO: 44002 - DNA, 181 bp, Homo sapiens
  chr14:67688245-67688426
  hypo
gattacatattattacgtacaataaacttttacggcttttacagattgaatagtccacatgttgcagaaatttaggtaattttattctcatatgttctataatcagcaatggcctaggtttgctaaacgtgtttcattactacccacagagcatttaaagaatgaccggttattttatatc

SEQ ID NO: 44003 - DNA, 30 bp, Homo sapiens
  chr14:67879219-67879249
  hypo
ggacagtgggtgagccgaaactggtatggg

SEQ ID NO: 44004 - DNA, 83 bp, Homo sapiens; identical to SEQ ID NO: 5152
  chr14:67886562-67886645
  hypo

SEQ ID NO: 44005 - DNA, 139 bp, Homo sapiens
  chr14:68067690-68067829
  hypo
actcttttcctgtgccgggtagtttgaggtgcttgaggatgcagcagtgaacgatgttgatgacagtctctgccctcgggcagcttcctttctagtaggagacaatatggaaataagagagtatcgttggcaatactat

SEQ ID NO: 44006 - DNA, 30 bp, Homo sapiens
  chr14:68231335-68231365
  hypo
aagtgatttgcatggcgacacatgtgagca

SEQ ID NO: 44007 - DNA, 36 bp, Homo sapiens
  chr14:68284131-68284167
  hypo
gagcaaaggctttttcgcaaacacaataatctgaaa

SEQ ID NO: 44008 - DNA, 30 bp, Homo sapiens
  chr14:69014075-69014105
  hypo
cctttcacttcctgtcggcacgtacaggcc

SEQ ID NO: 44009 - DNA, 30 bp, Homo sapiens
  chr14:69245934-69245964
  hypo
agtgccaggcatcagcgttgacatgaaata

SEQ ID NO: 44010 - DNA, 160 bp, Homo sapiens
  chr14:69867036-69867196
  hypo
acgttttgacattttcgttaatttgattggcaccttgaacagatgttaagcgagggtcccgggaagagggatagatgaaagcactgttcagtgaacatgctgataggtcctttaggtaggcaaaaggaattcacgaagtgcacagcgttcaaagatttag

SEQ ID NO: 44011 - DNA, 132 bp, Homo sapiens
  chr14:70701228-70701360
  hypo
ctgggaccccaactacgaagccaaagcaggacctcggctggtttggggggccaactgtagctcaggagcctcgttctcaggccagacggtgtgtcacccctcgttctggccgctgtacgaggcagcctcggg

SEQ ID NO: 44012 - DNA, 30 bp, Homo sapiens; identical to SEQ ID NO: 15833
  chr14:72892242-72892272
  hypo

SEQ ID NO: 44013 - DNA, 30 bp, Homo sapiens
  chr14:72976891-72976921
  hypo
atggggcttctctttcgatgagatattgaa

SEQ ID NO: 44014 - DNA, 73 bp, Homo sapiens
  chr14:73029715-73029788
  hypo
caggcactgctttcacgtaaaatgtccaaatcacatcttcagcaagaaagcaacctcacggattgccccgcct

SEQ ID NO: 44015 - DNA, 250 bp, Homo sapiens
  chr14:73140612-73140862
  hypo
cactacaagaaagcacgttgccttctctccaggtttttccactctacctcgctgtggtccgtaaaaacacgcacaaagaaatatgcacctcatggaaaggccagacacaaacccaaaacttctctttgccctttcccccggatcctagggcataacttttggttcttgagacccaaagaagaaaaatatcagaatgagctgaaaactcctctccactcgaaagcattgccaccatcgcttccctctccag

SEQ ID NO: 44016 - DNA, 30 bp, Homo sapiens
  chr14:73146807-73146837
  hypo
gagggttaaaagtggcgtgatagagactgt

SEQ ID NO: 44017 - DNA, 221 bp, Homo sapiens
  chr14:73147279-73147500
  hypo
aagtaaaggggactacgctggagcggatgcggaaggcgctgaggccagggctgctgtcatgagtcctcacatttatggatggggctgataaactgtcacactccgcaccgtcaaggacaaggtgagaagatgagctggaatggcagcacatgccacaggagagctggaaaggcaggtggctaacaacgaaagccatggccagagggcgggcttctctggag

SEQ ID NO: 44018 - DNA, 30 bp, Homo sapiens
  chr14:73150302-73150332
  hypo
tcagctaaggtcacacgttagtcagtggct

SEQ ID NO: 44019 - DNA, 37 bp, Homo sapiens
  chr14:73157349-73157386
  hypo
cacgcatagacacacacacacccggctcataatgagg

SEQ ID NO: 44020 - DNA, 149 bp, Homo sapiens; identical to SEQ ID NO: 5153
  chr14:73167750-73167899
  hypo

SEQ ID NO: 44021 - DNA, 151 bp, Homo sapiens
  chr14:73172944-73173095
  hypo
tcaattccatccatgcgccctaagggccttcttggcatcccggggctgcactctctgacacagcagcccctcttcgtgtgaccactccctgccctgttccttcagtgctcactgtcccctcaattaaataccgccccggcagtgtgctatc

SEQ ID NO: 44022 - DNA, 92 bp, Homo sapiens
  chr14:73175118-73175210
  hypo
ctttcctcccctccccgatcctacccccatccaaggacctgcaagacaactgagtgatgagcccagcttcccttccgcgacaaaggcagtga

SEQ ID NO: 44023 - DNA, 30 bp, Homo sapiens
  chr14:73176464-73176494
  hypo
gcctcagtttcttcacggtaaagtgaggtc

SEQ ID NO: 44024 - DNA, 30 bp, Homo sapiens
  chr14:73178102-73178132
  hypo
gaaggaataatcaaacgcataagtagaaaa

SEQ ID NO: 44025 - DNA, 117 bp, Homo sapiens
  chr14:73178835-73178952
  hypo
agccaagaaagcagccgctgagacttccagaaagcctgccgtcaggcctcccaggcactacagggcacacagaaggtgggagagagcctgcggggagggcatcgagagaagcaaacg

SEQ ID NO: 44026 - DNA, 146 bp, Homo sapiens
  chr14:73180113-73180259
  hypo
gccccacccctaccccgccttgccagctctctccctgccttcagggagactgcagaccctggcgagatgggtgggacacccagagggagacccgtgccagggtccagcctcgactgtttcactgccatcctcgctgcagcctcttc

SEQ ID NO: 44027 - DNA, 37 bp, Homo sapiens
  chr14:73185482-73185519
  hypo
tttttttttttgagacggagtcactctgtcatgcagg

SEQ ID NO: 44028 - DNA, 146 bp, Homo sapiens
  chr14:73194579-73194725
  hypo
aagtcaataaaaacacgtaaactcatttgacttatggtcctggctttgtcttctagcacagtagacagcagacccatgcgctgcactcagcagaccttcagtttacataggagatgatggtgacatgatgacgacaatacagcacc

SEQ ID NO: 44029 - DNA, 166 bp, Homo sapiens; identical to SEQ ID NO: 15840
  chr14:73195193-73195359
  hypo

SEQ ID NO: 44030 - DNA, 79 bp, Homo sapiens
  chr14:73195581-73195660
  hypo
aaagcagagtggaatcgggaggcaggggcagtcagggcaagggtgtgagatgaagtacggcacggtcagggacatcttt

SEQ ID NO: 44031 - DNA, 30 bp, Homo sapiens
  chr14:73196936-73196966
  hypo
tgttgaaggcacagtcgacaaggctcctga

SEQ ID NO: 44032 - DNA, 30 bp, Homo sapiens
  chr14:73197190-73197220
  hypo
attcaatgcctttatcgagactcaactcta

SEQ ID NO: 44033 - DNA, 35 bp, Homo sapiens
  chr14:73198555-73198590
  hypo
tcttctcaaccccctcgccacggagcaaggcttcc

SEQ ID NO: 44034 - DNA, 152 bp, Homo sapiens
  chr14:73202868-73203020
  hypo
ataagatattgtatccgatctggtatttctaaaacattaccattcaacatgaaatcaacataaaaatatggacgcaaaattttacattcttttatctgcattgtcttcaaagtctggtgggtattttccatttagagcgtatctcaattcag

SEQ ID NO: 44035 - DNA, 445 bp, Homo sapiens
  chr14:73209603-73210048
  hypo
agactcaagtccctccgcctggaccacccctttgggagatacccctctgcaggtccctacgacttgcttgttggccagcctgtggccctctctgctttgggacaccttaagccactgtcgtcttcggggtgcatgccctcttgtctgagtttcccccaacgacatgggatgggggcgatcatcctggtcgttcatccccagtcattgaaggactgccaaaaacagaaaaaatacaagagaaagaacactatccctggctgccctccctcccatcaccctcggaattcggcaagggtggcaaagagccaccctgctccccaagagtcctggagcagaagggatcgacaaggcctcaggtgcattccaggtacaggaggagcgtcaactgtaaagcccttttcatctgcgggtccaggataagtgagtgtgtcgggccttcaagcaa

SEQ ID NO: 44036 - DNA, 96 bp, Homo sapiens
  chr14:73226814-73226910
  hypo
acatgaataattatacgagatgtttttcttattattttaaactcattaaaagatgatcaactatttttaaaaatacaatgatggccgggcgcggtg

SEQ ID NO: 44037 - DNA, 114 bp, Homo sapiens
  chr14:73273305-73273419
  hypo
cccacccgcactgggcgaaagaacctattcttgcaaccaacactatcctgaaaatgtggaaaacctctaatggaagtgcaaccaagtgctcctggaattcgacatgctttttta

SEQ ID NO: 44038 - DNA, 30 bp, Homo sapiens; identical to SEQ ID NO: 15844
  chr14:73275087-73275117
  hypo

SEQ ID NO: 44039 - DNA, 30 bp, Homo sapiens
  chr14:73300028-73300058
  hypo
caacactcaccctgacggggaatccgggag

SEQ ID NO: 44040 - DNA, 32 bp, Homo sapiens; identical to SEQ ID NO: 15845
  chr14:73313912-73313944
  hypo

SEQ ID NO: 44041 - DNA, 244 bp, Homo sapiens
  chr14:73318385-73318629
  hypo
cacaaactaacttcccgagggatgagtattttgatgcagatacttcttcaagtgaaaaatgtacaatgtacaaaatgtccactcgaggatctgttcctccccgtgtgggtaatcgccctcctaccacgggcaacgggtaggcaaccgatatgcccagaaaggcggccaatgggaggacagctcgcccagcctcccgattggccaggcccgccaccagctggaaccatggcgagctttgaggaca

SEQ ID NO: 44042 - DNA, 30 bp, Homo sapiens
  chr14:73318945-73318975
  hypo
tcccctaggagaccacggagtgaaaaaagt

SEQ ID NO: 44043 - DNA, 30 bp, Homo sapiens
  chr14:73331141-73331171
  hypo
gggactttgttttatcgactgccatatccc

SEQ ID NO: 44044 - DNA, 138 bp, Homo sapiens
  chr14:73333156-73333294
  hypo
gaacccaagcttattcgaatgcacaggctcaggtacccgcctctgctccatcgataccagccatggagtcttgggcaaatcttgggcaactccttggagttttctcatcgataaaaaagttaatatggctgggtgtgg

SEQ ID NO: 44045 - DNA, 81 bp, Homo sapiens
  chr14:73602385-73602466
  hypo
ggatttttaaagaaactttagaagaatgtaacttgcccagataccatgtaccgttaatttcattttcggttttttgaatac

SEQ ID NO: 44046 - DNA, 30 bp, Homo sapiens
  chr14:73691528-73691558
  hypo
tgatgagaatgaggacggactttgagcagg

SEQ ID NO: 44047 - DNA, 30 bp, Homo sapiens; identical to SEQ ID NO: 15848
  chr14:73958845-73958875
  hypo

SEQ ID NO: 44048 - DNA, 109 bp, Homo sapiens
  chr14:73959120-73959229
  hypo
cagattctaaggatccgcgaagaaccgctttcatggagaaggtgcgggtcttggttgcccgcctgggacactttgctcctgttgatgctgtggccgaccagcgagccaa

SEQ ID NO: 44049 - DNA, 60 bp, Homo sapiens
  chr14:74717689-74717749
  hypo
aacacccagcaattccgatttaattggtttaaaatcaaacatcttcggcaggtcacagtg

SEQ ID NO: 44050 - DNA, 38 bp, Homo sapiens
  chr14:75389373-75389411
  hypo
caaagggatgacagccgtggctgcgggaagggaagggg

SEQ ID NO: 44051 - DNA, 18 bp, Homo sapiens
  chr14:75390699-75390717
  hypo
gatcgtgtcactgcactc

SEQ ID NO: 44052 - DNA, 30 bp, Homo sapiens
  chr14:75446328-75446358
  hypo
ggcaagaaggcaagacggattgcatttcag

SEQ ID NO: 44053 - DNA, 18 bp, Homo sapiens
  chr14:75517394-75517412
  hypo
gcccggccagaaggtcat

SEQ ID NO: 44054 - DNA, 153 bp, Homo sapiens
  chr14:75760140-75760293
  hypo
taatatagtctggggcgcagaggtctgctcaagatcatccaactggagtggcagcgctggaattagagtccaggcagtgtggcttcaatgcctgaactcttagccattagaaaggaaaaacaaagcaaaatcagtatccgcaacaaccttgca

SEQ ID NO: 44055 - DNA, 30 bp, Homo sapiens
  chr14:76101271-76101301
  hypo
gaagaattggcctgacgatcgtcattgcag

SEQ ID NO: 44056 - DNA, 172 bp, Homo sapiens
  chr14:76998049-76998221
  hypo
gtcacaggcatctgccgtacagcacacactaatttctggcgataattatctcttgggtttcccaccctctcctccttgtgtcaccctggctaaatgacacacgcagatttcattgaccagccatgaacctcaccttcatggagaccgacgatgtgatcgggtttccgcttct

SEQ ID NO: 44057 - DNA, 30 bp, Homo sapiens
  chr14:77242483-77242513
  hypo
ccagagcgtgtcacacgacccgcacagcgt

SEQ ID NO: 44058 - DNA, 30 bp, Homo sapiens
  chr14:78141401-78141431
  hypo
ataccaaaggtcactcgctttgcttttatg

SEQ ID NO: 44059 - DNA, 34 bp, Homo sapiens
  chr14:78247790-78247824
  hypo
aaaaataattaggtgcggccgggtgcggtggctc

SEQ ID NO: 44060 - DNA, 30 bp, Homo sapiens
  chr14:79111630-79111660
  hypo
ctctgaaggatggtgcggtctccttggtca

SEQ ID NO: 44061 - DNA, 30 bp, Homo sapiens
  chr14:81489175-81489205
  hypo
aaaaaagatgtggggcgtttgggaggtgat

SEQ ID NO: 44062 - DNA, 30 bp, Homo sapiens
  chr14:88673478-88673508
  hypo
atacaatactagtttcgatttcaaggtcac

SEQ ID NO: 44063 - DNA, 33 bp, Homo sapiens
  chr14:89606032-89606065
  hypo
ctttaaaagatgactcggcggcttttctttagg

SEQ ID NO: 44064 - DNA, 98 bp, Homo sapiens
  chr14:89657653-89657751
  hypo
gaacatctgccccagcgcagcgtcccagctgccctggggcgaaattcactaatagtgcggtgatgccgcgtgacagaagctgccgcctgtgccctgtc

SEQ ID NO: 44065 - DNA, 30 bp, Homo sapiens
  chr14:89895234-89895264
  hypo
aatggcagagctctccggaggctgcccagg

SEQ ID NO: 44066 - DNA, 30 bp, Homo sapiens
  chr14:89918720-89918750
  hypo
cccatctccccagcacgctggggagggccg

SEQ ID NO: 44067 - DNA, 20 bp, Homo sapiens
  chr14:89962546-89962566
  hypo
aactccgtctcaaaaaaaga

SEQ ID NO: 44068 - DNA, 30 bp, Homo sapiens
  chr14:90043896-90043926
  hypo
aaatccatatattcccggggcaatcacggg

SEQ ID NO: 44069 - DNA, 30 bp, Homo sapiens
  chr14:90650692-90650722
  hypo
gccctccgtgtactacgtcatgctgatcct

SEQ ID NO: 44070 - DNA, 32 bp, Homo sapiens
  chr14:90724207-90724239
  hypo
acaggcgtgagccaccgcgcccggcctcatag

SEQ ID NO: 44071 - DNA, 30 bp, Homo sapiens; identical to SEQ ID NO: 15852
  chr14:90983280-90983310
  hypo

SEQ ID NO: 44072 - DNA, 30 bp, Homo sapiens
  chr14:91059804-91059834
  hypo
gggttgtgggtgaggcggagggtacctgca

SEQ ID NO: 44073 - DNA, 40 bp, Homo sapiens
  chr14:91691266-91691306
  hypo
gtaaacactggtcttcggtgagcaacgaacactcgcctgg

SEQ ID NO: 44074 - DNA, 114 bp, Homo sapiens
  chr14:91747935-91748049
  hypo
acctcgcctggcacccggatcccagtagctccagctcttggggatgagggaatggcatgcagatgctgcctttgggacctgcctctcctacccctccaccgtttctcctgctgg

SEQ ID NO: 44075 - DNA, 30 bp, Homo sapiens
  chr14:91754764-91754794
  hypo
tatatacatggagaacgtgttgagtgcacc

SEQ ID NO: 44076 - DNA, 251 bp, Homo sapiens
  chr14:91766265-91766516
  hypo
ctcacctgtccagctcgccccgcagcctctggttctcgcccatggcgagggcgtttgtcctctgctcctgctgcagcgcctctcgctcagtggtcaagaccttctcccgctcctccagctccgccttgcgcttcagcatgtcaccgtgcctgttggagggaagcacctgccgtgagtctggccagggccttcttttccgacaggtaactcacatcccagaggatctgcgtgcctcccgtgagaaaatggga

SEQ ID NO: 44077 - DNA, 90 bp, Homo sapiens
  chr14:91849645-91849735
  hypo
ggctggccatgctgccgtggggggcccagccaggaatctcagggggccatgaacagaacccccaagaaagactgtcgttgtttccaccaa

SEQ ID NO: 44078 - DNA, 30 bp, Homo sapiens
  chr14:91850063-91850093
  hypo
agacacaaggactcccgcaggtcacaaacc

SEQ ID NO: 44079 - DNA, 30 bp, Homo sapiens
  chr14:92801258-92801288
  hypo
catcatcatcgtcatcgaggtgaagtccag

SEQ ID NO: 44080 - DNA, 191 bp, Homo sapiens
  chr14:92829024-92829215
  hypo
gtgatccccccgaggcggcaccagtgtgctgcgtcccaagtctcctgtgtcaccatgcgctcctcctctctgaatgtctacagtgcttttctggtgcctgggcttgtgctgggtcaacacattttgctcaaaaagttttgcagaatgaatgcgcagagagaggcggcagctccgggcgggatcaggcatgc

SEQ ID NO: 44081 - DNA, 30 bp, Homo sapiens
  chr14:93065511-93065541
  hypo
cctggggaaccccagcgaaggacattaagt

SEQ ID NO: 44082 - DNA, 79 bp, Homo sapiens
  chr14:93151456-93151535
  hypo
actctcaacaaggcccgggcctcccgctcctccgtacaggtgaggcctgagagcgggaggggcccggtggggccatgtc

SEQ ID NO: 44083 - DNA, 309 bp, Homo sapiens
  chr14:93154937-93155246
  hypo
cacccaccccatcctcggtctttgcaaagaagggcccgagcttagtttccccaggactggcctaggaaggagcaccggccacagctgctccccgtgccactcagggtggacccagcatctcaggagcacctcagggtgtcggttaagagacaggcctccacccctgcaccagagcctgctcttagctcccggtgcccccagaccccgcagctctgtgcccggcaagaagcagctagacacacgccagggcgccaagcacggccagctccgcggacccatggacaagcccagccccgcctcagggaaaac

SEQ ID NO: 44084 - DNA, 30 bp, Homo sapiens
  chr14:93454054-93454084
  hypo
tctgtaaagggggaacgctacagctgaggg

SEQ ID NO: 44085 - DNA, 37 bp, Homo sapiens; identical to SEQ ID NO: 15855
  chr14:93697020-93697057
  hypo

SEQ ID NO: 44086 - DNA, 30 bp, Homo sapiens
  chr14:93706848-93706878
  hypo
gccctgcatagttttcgagtgagtgtgagt

SEQ ID NO: 44087 - DNA, 30 bp, Homo sapiens
  chr14:95200361-95200391
  hypo
ctggccttagacccacgacagactcaggga

SEQ ID NO: 44088 - DNA, 55 bp, Homo sapiens
  chr14:95522889-95522944
  hypo
aaacaatgtgccactcgtcagaccccagcgtacccccctccgccccacccatcag

SEQ ID NO: 44089 - DNA, 30 bp, Homo sapiens
  chr14:95906326-95906356
  hypo
acaacgatccactgccgcagctccagcagc

SEQ ID NO: 44090 - DNA, 130 bp, Homo sapiens
  chr14:95927934-95928064
  hypo
aaaatgggttttcctcgttggagcagtggcctgttctagcatggcaagcagtggcaatgggctctcataggtaaaagtaggggcactaacctgaacctagagaccaatcccaccccgaggccaggcctcg

SEQ ID NO: 44091 - DNA, 39 bp, Homo sapiens
  chr14:96967321-96967360
  hypo
tgcaatatatccaaaatatttcaacgtgcaatcaatata

SEQ ID NO: 44092 - DNA, 30 bp, Homo sapiens
  chr14:97045401-97045431
  hypo
gtgctcttctgtgtgcgtggaagttcttgc

SEQ ID NO: 44093 - DNA, 109 bp, Homo sapiens
  chr14:97188235-97188344
  hypo
ttcacaaggagagcacggaagtagatacagcagggtctgtgggctggtggaggctgagccagcctccctctgaccaagtctgtcccgggagctgcggggagcagcaagg

SEQ ID NO: 44094 - DNA, 205 bp, Homo sapiens
  chr14:97262648-97262853
  hypo
aaagaaaagtaaaatcgacaaataaacccccaaagctatgtaaactcattgagggacctgcgcaagtgaggtcctgaagcttacgcttcattggcttcattgttaatctccctctgcctgtgacttcagtgattttgacctagaacaatgacccagtgcccaataagctctcagcctcatgggtgatggagacttagctgattat

SEQ ID NO: 44095 - DNA, 32 bp, Homo sapiens
  chr14:99532995-99533027
  hypo
cagagcctggaaacacgcggggcttcccagga

SEQ ID NO: 44096 - DNA, 30 bp, Homo sapiens
  chr14:99615561-99615591
  hypo
gcccattcggtcaaacgctgccgagagcac

SEQ ID NO: 44097 - DNA, 30 bp, Homo sapiens
  chr14:99626459-99626489
  hypo
agcatgagagggaggcgggaaaacagacgg

SEQ ID NO: 44098 - DNA, 30 bp, Homo sapiens
  chr14:99804005-99804035
  hypo
atgtgatctgtgcaacgtatgttttttggg

SEQ ID NO: 44099 - DNA, 30 bp, Homo sapiens
  chr14:99848008-99848038
  hypo
agccctaggacccttcggctctcacatctg

SEQ ID NO: 44100 - DNA, 154 bp, Homo sapiens
  chr14:99849909-99850063
  hypo
tgggtggagcacaggcgggaagccctgccccgtctctttgtgagctgtgggtgcgcttggcgagtcacaagcctctctgggcccagttctttctatggaagtcatgggttgcagtgttgttgagggagccggtggtgcacgtggtgaagacctg

SEQ ID NO: 44101 - DNA, 36 bp, Homo sapiens
  chr14:100209839-100209875
  hypo
ggacaggcccccttccgtgtgcggcctgagagatgc

SEQ ID NO: 44102 - DNA, 38 bp, Homo sapiens
  chr14:100591043-100591081
  hypo
gacgccaggtgtaagcgtacaggcgtggatggctaaat

SEQ ID NO: 44103 - DNA, 30 bp, Homo sapiens; identical to SEQ ID NO: 15860
  chr14:100611919-100611949
  hypo

SEQ ID NO: 44104 - DNA, 82 bp, Homo sapiens
  chr14:100637036-100637118
  hypo
gccaccgcgcccggcccaaaggcattaaaattaactccaccccagtcaacaaccatgaagtattttgcgctgacagctttgg

SEQ ID NO: 44105 - DNA, 196 bp, Homo sapiens
  chr14:100643285-100643481
  hypo
ggcaccgagtccctacggtgggaccatgcccgcagcggcagtgtggaagatgggacagacacagcgaaatgcctccagggcgtggtgggaggggccggaacagggagatggcgcgtgagtagcatctgttcttacagcaaaacctgtaaaagtaaaatatacgtaggtttgtcactaaagacgtgtctgcataaat

SEQ ID NO: 44106 - DNA, 79 bp, Homo sapiens; identical to SEQ ID NO: 15862
  chr14:100644399-100644478
  hypo

SEQ ID NO: 44107 - DNA, 27 bp, Homo sapiens
  chr14:100747273-100747300
  hypo
gaagcctgataatttcgggaggctgag

SEQ ID NO: 44108 - DNA, 35 bp, Homo sapiens
  chr14:100780162-100780197
  hypo
ggggcagccctgggacgctgcgggggcctggctgt

SEQ ID NO: 44109 - DNA, 19 bp, Homo sapiens
  chr14:100843965-100843984
  hypo
tttgcgtgtggaagttgtt

SEQ ID NO: 44110 - DNA, 32 bp, Homo sapiens
  chr14:101198835-101198867
  hypo
aaaagattggagctccgcggggctgaggctgt

SEQ ID NO: 44111 - DNA, 116 bp, Homo sapiens
  chr14:101200602-101200718
  hypo
cacccccaacccatgcgagaacgacggcgtctgcactgacattgggggcgacttccgctgccggtgcccagccggcttcatcgacaagacctgcagccgcccggtgaccaactgcg

SEQ ID NO: 44112 - DNA, 44 bp, Homo sapiens
  chr14:101201633-101201677
  hypo
ctgtgcaaagagctacgattgctttcgttcgttaattctcacac

SEQ ID NO: 44113 - DNA, 212 bp, Homo sapiens
  chr14:101250082-101250294
  hypo
ggggagctggggtggcgacccatgaattagggtccattgacccggaggtcgaggcttccagagcgggccagccggcagccccaacgtgtgaggctgtgcacctgctggggagggtttttttgatggcgacggcgtgaggtgagcgggtttgctctgggcggtcgaggattagcgccgactgagagggtcaggtgcaccggggctttgttcag

SEQ ID NO: 44114 - DNA, 30 bp, Homo sapiens
  chr14:101532280-101532310
  hypo
cgcttttattaatgacgaatataacacaga

SEQ ID NO: 44115 - DNA, 30 bp, Homo sapiens
  chr14:101532816-101532846
  hypo
cacacaagacacgagcggcctctcttcagt

SEQ ID NO: 44116 - DNA, 30 bp, Homo sapiens
  chr14:101591942-101591972
  hypo
tccagccgtgcagaacgacatgcaattgaa

SEQ ID NO: 44117 - DNA, 30 bp, Homo sapiens
  chr14:101694589-101694619
  hypo
ccgcggggtctgtgccgcctggtggggagc

SEQ ID NO: 44118 - DNA, 152 bp, Homo sapiens
  chr14:101713576-101713728
  hypo
ctttcctctccacttcgtcctgtggatccaatcatccctgtggaaggacgatgggaaaatctgcctcttggggcctcagatttccagatctaagttccagctgccaagaggacacaacacagggttctcagagccgccgcaccctaatttca

SEQ ID NO: 44119 - DNA, 32 bp, Homo sapiens
  chr14:102094096-102094128
  hypo
caggccgccctcctacgcgggcctgctgcaac

SEQ ID NO: 44120 - DNA, 30 bp, Homo sapiens
  chr14:102325042-102325072
  hypo
tatattaagtttacacgtgtggaagatttt

SEQ ID NO: 44121 - DNA, 51 bp, Homo sapiens; identical to SEQ ID NO: 15865
  chr14:102335848-102335899
  hypo

SEQ ID NO: 44122 - DNA, 105 bp, Homo sapiens
  chr14:102418526-102418631
  hypo
ggcccaggagttgctcgcatgagccaccacgcccagtgtattcagattttcttcgtgtttcttttctcttccgggatcccatgcaggacaccacgtcgcatttag

SEQ ID NO: 44123 - DNA, 30 bp, Homo sapiens
  chr14:102474565-102474595
  hypo
tttgacgagttcaaccgcctggaggagcgg

SEQ ID NO: 44124 - DNA, 38 bp, Homo sapiens
  chr14:102493613-102493651
  hypo
taccagattaaggtgcgtctggtcggtggcctcttaat

SEQ ID NO: 44125 - DNA, 138 bp, Homo sapiens
  chr14:102521620-102521758
  hypo
cccacccaacagagccgaccaggctgggaacaccgagaccgagagcgcgtggctgtgtctacaaaggcctcctctttgagggagacacgcgaggcacgggtggggcgatgagacaggatcggccggtccttgacagtc

SEQ ID NO: 44126 - DNA, 28 bp, Homo sapiens
  chr14:102529474-102529502
  hypo
aatagaatggaaacgttagggagtagca

SEQ ID NO: 44127 - DNA, 37 bp, Homo sapiens
  chr14:102530007-102530044
  hypo
ccacgcctgggggagcggcggccggtagggccgggcg

SEQ ID NO: 44128 - DNA, 51 bp, Homo sapiens
  chr14:102530479-102530530
  hypo
gctccttctccccagcgtggttcctaagagccttagcgtgagctgagactc

SEQ ID NO: 44129 - DNA, 61 bp, Homo sapiens
  chr14:102673269-102673330
  hypo
gctgagaaaattgcacgaaggtctaatggaaatcctgccagagcagcgctgggttttaggt

SEQ ID NO: 44130 - DNA, 162 bp, Homo sapiens
  chr14:102682083-102682245
  hypo
caccaggcccgtcgtcggtgcagagcgcttcctacacagggcagtgggggacgttccatttgggatgagaagaactcatgatttacattgtcttactatgaaataccatccctcactcttgacagacgacgtagctgatctgagcagcgccctggcacccgc

SEQ ID NO: 44131 - DNA, 30 bp, Homo sapiens
  chr14:102909162-102909192
  hypo
atacagggttgtaggcgacagttggtctgt

SEQ ID NO: 44132 - DNA, 152 bp, Homo sapiens
  chr14:103007088-103007240
  hypo
tgcctccgggatgagcgcattgggcaacactgcatgctttgcattgggaacatgtttgtgtgtgtgcgttgggggtgtgtgtgcggtggggggctatgggctgggatgtcccttgaggtgatcagctctctacgttccgcacacacaaacac

SEQ ID NO: 44133 - DNA, 37 bp, Homo sapiens
  chr14:103018826-103018863
  hypo
tgttttgttttgagacgaagtctcactgtcaccaagg

SEQ ID NO: 44134 - DNA, 30 bp, Homo sapiens
  chr14:103144541-103144571
  hypo
ggagagagagggagacgagagggagaggga

SEQ ID NO: 44135 - DNA, 66 bp, Homo sapiens
  chr14:103216392-103216458
  hypo
ctgcagccgcagtggcgcctgcatggagggggccccctaatcatggtgcctcggctgtggaatgtt

SEQ ID NO: 44136 - DNA, 177 bp, Homo sapiens
  chr14:103277520-103277697
  hypo
tccttaaggggatgccgaattgctgcatccccatgatttttgctgctttgattcttctcatgagccccgttgctgctgtctgtattagcgtccttctgagcaaacaatgggtacctttttttttttttttcttaagagagagtcttgctatgttgcctcaggcgggagtgcagtggc

SEQ ID NO: 44137 - DNA, 30 bp, Homo sapiens
  chr14:103456678-103456708
  hypo
aaccgcaaacaaacccggaatgcctgcggg

SEQ ID NO: 44138 - DNA, 30 bp, Homo sapiens
  chr14:103477626-103477656
  hypo
ctaggcaaagccaaccggacccagagccac

SEQ ID NO: 44139 - DNA, 44 bp, Homo sapiens
  chr14:103699549-103699593
  hypo
cagccaatgccccagcgcccccagcagcccggcccactctctcc

SEQ ID NO: 44140 - DNA, 89 bp, Homo sapiens; identical to SEQ ID NO: 15869
  chr14:103820833-103820922
  hypo

SEQ ID NO: 44141 - DNA, 30 bp, Homo sapiens; identical to SEQ ID NO: 15870
  chr14:103996414-103996444
  hypo

SEQ ID NO: 44142 - DNA, 49 bp, Homo sapiens
  chr14:104048933-104048982
  hypo
acctgcaggagtgtgcgtgatgaaacccgtcactcgttgtgtatggtag

SEQ ID NO: 44143 - DNA, 30 bp, Homo sapiens; identical to SEQ ID NO: 15871
  chr14:104061854-104061884
  hypo

SEQ ID NO: 44144 - DNA, 30 bp, Homo sapiens
  chr14:104121128-104121158
  hypo
ggagatgttggagctcggcctgagtgaggc

SEQ ID NO: 44145 - DNA, 55 bp, Homo sapiens
  chr14:104194695-104194750
  hypo
ctggaatctgaacaacgagcagcgccttctccccactgtccgtccacctctggcc

SEQ ID NO: 44146 - DNA, 30 bp, Homo sapiens
  chr14:104195285-104195315
  hypo
gaaactatgacttgtcgtctttccaataac

SEQ ID NO: 44147 - DNA, 136 bp, Homo sapiens
  chr14:104202705-104202841
  hypo
gatacctcccctgcccggcccagctgctgctcctgctgccggccctttctaagtcctgcaggacagacaggacaaacgagctcctgagccccagggcaagagtgtgctgttcttaaggtgacgcttagcaatcaca

SEQ ID NO: 44148 - DNA, 40 bp, Homo sapiens
  chr14:104355130-104355170
  hypo
gtgtttgatttgacacgccctccccgtcttcttttttttt

SEQ ID NO: 44149 - DNA, 35 bp, Homo sapiens
  chr14:104387085-104387120
  hypo
cgtgaaccaccgcgcccggccggcccctttcttga

SEQ ID NO: 44150 - DNA, 44 bp, Homo sapiens
  chr14:104572072-104572116
  hypo
tgtccagaagaagggcgggtgagtgggggcggtgcttgctctgg

SEQ ID NO: 44151 - DNA, 30 bp, Homo sapiens
  chr14:104600477-104600507
  hypo
cccaggaaaggtccccgccttcataagcat

SEQ ID NO: 44152 - DNA, 30 bp, Homo sapiens
  chr14:104609469-104609499
  hypo
ttctcatttagctcccgtgcatctcttgct

SEQ ID NO: 44153 - DNA, 611 bp, Homo sapiens
  chr14:104617674-104618285
  hypo
cagggtgcatcccagcgtacagctcagacctgggtgggggagctggtggagtgtgcggcggggggtggggccctgggctgtacccgatcctgcggctcttgcgccccttcggtgagctcatgtgccctctaggagcgtctccgagggaggccttcgcttctgttgacacctttacagcagcactgatttgattttccacctgccccaccggggctggagacctgaagaggaagggagagggtctcctgcccctggctctgccttgagtgagtgtgggtgagggaggccctcgtggctctgaagagacgttgcttttaaggggccctgcttcttgccagtctcctgcgtgtccccggccaggcggccttagctgacagtggtccggttgtccgggagccgcaaacctgccttgttagccgcaggccggggcgcttaatgacggctggggaaggtggacagttaacaaggacattgtgagcctcacgatgaagcccgatcattattttcctgctgggcttgtgtgggtgaaagtgtttgggcttattaatctgttacggatggtgcggtggccaggcgggagctcgcagcgtcatggacggtgagagtgctgg

SEQ ID NO: 44154 - DNA, 139 bp, Homo sapiens
  chr14:104618691-104618830
  hypo
cgggtcttggaggggcgctgagcacggtcaccatccaggcccagcagtgcctggagggcatgtggagtgtctcgcgggtcaacagcttcctcccgccggcgtgcctggtgagtgtcttgctcagcggatgggagctgct

SEQ ID NO: 44155 - DNA, 242 bp, Homo sapiens
  chr14:104619085-104619327
  hypo
cagcacagggcttggcgatgcacagggcaccgtgtgtagatcggggctcacgaggcagatggagtaggagggcccttgtggcagagcgagggcctgtgtggaggcctgggggtgtgaggcgtccatggacgtcgggcgggggaccggcagttgcaattgctggagatgcgttgcctgcccctgtggcaccctgggggcagagggacatgtgggtggctgtgaagagccgtgtttctgcctgg

SEQ ID NO: 44156 - DNA, 193 bp, Homo sapiens
  chr14:104620411-104620604
  hypo
cctgaaccagggcatcgatcattagcgtggccctggaatgttaatggtgcctgttagactctagagttaaatacttgtggagagatgcgctgcaaatctccaccacagaccgtcaaccacccctgggtcgaatgagattgttccaaggcaaacactgatctggggccagcgggtgggacgggggtgctgcagc

SEQ ID NO: 44157 - DNA, 314 bp, Homo sapiens
  chr14:104622939-104623253
  hypo
ttgggcagggtgagccggccatgggttgggcagggtgagccctccatggtggtgaggagggatactgtctgggatggcagggcctctgtctggagtgtccctcctgggtcccggggcggcttgttctgctgacgtgccgtgcctggcctctggcctgtgccacttgggacaccctgaggacgctgggccttccagaccagcccacgtcccctcagcacggggaccccagtcctctgctagcctgggtacaaaggacgcctcgggcagtggttatcgactggacacttggggccgaatgacgcttggcacctggg

SEQ ID NO: 44158 - DNA, 264 bp, Homo sapiens
  chr14:104623478-104623742
  hypo
tttgctgggctgtcccgggcgtttaattacgtttgtgcttcattatgaggaggcctccctttctgggatttatttgagctaatgagttggaaatgccagggtagtatttcagatgagggagcgccacacatcaccgtacgtggggcaattagtgttcctgccaaatagttatcgtggtttcttctctaattacgccgctgggtgctcccaggaggctcaggggtgagagggtggggggtctgtgtccatcggtcttgaccagtg

SEQ ID NO: 44159 - DNA, 216 bp, Homo sapiens
  chr14:104626773-104626989
  hypo
cgggtacccgagtttcgttaatgctaacaggggcatagatagagcaggggctgagccccatgccctcaccccctgggtggggcctggggaagctgcagggattgaggcagcgcagctgtgacagagcttggcatgctggcccagcaagtgttcgggagggtggggcgcgtgggccgggtggccccggggttaggagttctccgaaggctctggtga

SEQ ID NO: 44160 - DNA, 171 bp, Homo sapiens
  chr14:104627664-104627835
  hypo
tccgtccaccagcctcgcacggcccagtgtggaagctctgggttggccataagtgattcctgcacgcgacagaacaggctcgtgtgtctccttggggtaattaagggcctcaccatcaaggccaactgcctgtgaaattaccctcttgtttggaagcggtgatttttctct

SEQ ID NO: 44161 - DNA, 78 bp, Homo sapiens
  chr14:104628609-104628687
  hypo
ggtggagatgtggggcgaacaaccttccagacttccagggctgatggaaccacagaggacgcccggtcccagcctctg

SEQ ID NO: 44162 - DNA, 140 bp, Homo sapiens
  chr14:104630035-104630175
  hypo
atgcgcggcacggggcggccatgggccccgacccctgctctgactcacacctgcatcctggggcccaggcccgtgtgcctgagacccctggacctcacccggcatcgccagcatttacccaataccgtgccagctgtggg

SEQ ID NO: 44163 - DNA, 45 bp, Homo sapiens
  chr14:104630962-104631007
  hypo
gccagggctcagaggcgcggcgggcctgtactctgtgtgtgtgcc

SEQ ID NO: 44164 - DNA, 49 bp, Homo sapiens
  chr14:104637029-104637078
  hypo
ctgccgggtcagagccgccgcctcctggcatcgacgcaccagacccacc

SEQ ID NO: 44165 - DNA, 33 bp, Homo sapiens
  chr14:104638185-104638218
  hypo
ggcagcgcaggcccccggcgagccgccactgct

SEQ ID NO: 44166 - DNA, 752 bp, Homo sapiens
  chr14:104639103-104639855
  hypo
gtcctacacatgggccgtggtgggcatatggggtgaggggcttgtggagaggaagctgaacccctgccgaactgaaaggcagagggcttaggatggatccaaagaggcccctgagatctcggtgcccctggttggcccccggggacgccagtagccataaaggctccttgcgtggtgtgtggtggggcctgacgcctgcgtggcccccaggcaagtcgtacaccatgatcgggaaggacagctcaccccagagcctgggcatcgtgccctgcgccatctcctggctcttcaggctcatcgaggagcgcagggagaggacgggcacccgcttctccgtccgggtctcagccgtggaggtgtgcgggcgcgaccagagcctgcgggacctgctggccgaggtggcccctggcagcctccaggacacccagtctccgggagtgtacctgcgggaggaccccgtgtgtggggcgcaggtgcgcctgcctactgtcccaccttgggggaggggggctgcacttggccctgagccactgaagacgccgctgcctctgcctttcctgcagctccagaaccaaagcgagctgcgggcacccacggccgagaaggcggctttctacctggatgcggccctggcggcccgcagcaccagccgagcgggctgtggcgaggacgcccgacgcagctcccacatgttgttcacgctgcacgtctaccagtaccgcatggagaagtgcggccggggaggaagtagg

SEQ ID NO: 44167 - DNA, 30 bp, Homo sapiens
  chr14:104640459-104640489
  hypo
gcatctgaaccgcctcgacccgcagggacc

SEQ ID NO: 44168 - DNA, 427 bp, Homo sapiens
  chr14:104641348-104641775
  hypo
tcctgtgaggaaggccgggcccgtcggcccccgcacctgcggcccttccacccacgcactgtggccctggaccccgaccgcacgcctccctgcctgcccggtgaccccgattactcctccagcagcgagcagtcctgtgacacggtcatctacgtggggcccggtggggcggcgctgtcagaccgggagctcaccgacaacgaaggtccgcctgacttcgtgcccatcatccctgccctgagccgccaccggccctccaagggtccccgagacgcagaccacttccgctgcagcaccttcgcggagctgcaggagcggctggaatgcatggacggcaacgagggtccctcaggaggtccaggtggcaccgacggagctcaggccagccccgcccgagggggccggaagccctcgccaccagaggctg

SEQ ID NO: 44169 - DNA, 30 bp, Homo sapiens
  chr14:104642691-104642721
  hypo
cagggagccccaggccgggccctcgcggtg

SEQ ID NO: 44170 - DNA, 390 bp, Homo sapiens
  chr14:104643013-104643403
  hypo
ccagaggctgtggctcggatcccaccgctgcggaggggtgccaccacgctgggtgtgacaacgccagctgtgtcctggggagatgctcccacggaggtggtggcctgctcggggagcctgaaggcctcccccaccagcaagaagggtctggctcccaaggcgggcttcctcccgaggcccagtggggcggcccccccggccccacccacgcggaagtccagcctggagcagaggagcagcccggcctcggcccctccgcatgctgtgaacccggcgcgggtcggggctgctgctgtccttcgaggggaggaggagcccagacccagcagccgggctgaccactctgtccccagggccacgtccagcctgaaggcccgggccagcaaggta

SEQ ID NO: 44171 - DNA, 489 bp, Homo sapiens
  chr14:104643693-104644182
  hypo
gggcaggagccctggcggccctgtggccggtcccagagcagccccacgggccgggcccagtgtcggggcgaaggctggccggggtaccgtcatgggcacaaagcaggcgctccgggctgctcacagccgcgtccatgagctgtcagccagtggagccccgggccgaggtggctcctcgtggggctcggcggactcagacagcggccatgacagcggcgtgaacgtgggggaggagcggccacccacgggcccggccctgccctccccctacagcaaggtgaccgccccacggcggccccagcgctacagcagcggccatggcagcgacaacagcagcgtgctgagtggagagctgccgcccgccatgggccgcaccgcccttttccaccacagcggtggcagcagtggctatgagagcctgcggcgcgacagcgaggccaccggcagcgcctcctccgcccctgactccatgagcgagagtggggctgc

SEQ ID NO: 44172 - DNA, 382 bp, Homo sapiens
  chr14:104645126-104645508
  hypo
tggtggggagcctgccgcggatggcagagtgagccatttgatgggctcgccaggcctctgggggtgtggctgggcagcccctgacctcactttctgtccacgttcctcccaggacgcaaaggtaggagcggccctgcccagcccaagcctgttgcagctccgacactccccttgggcagtgggtgggtggctggggggtcctgaggccactgctgctgtccgctggaattctcccctgtcgtggggagggtggtcctagagccgagccaggacccagacgggcatgggtgggctgccccaggtccgccccctgcccgcccttggagccccactgtgtgcctgccaaggcctggcaggtgaagggaggcgggggccacatcag

SEQ ID NO: 44173 - DNA, 400 bp, Homo sapiens
  chr14:104645716-104646116
  hypo
gagcagtgtgagtcccgcccgcccacggacccagcccggcccaccgtgtgccctgacagctgccctcccctcccagagccctgttgctctcctgtacctcgtggtgggaaggctggaaggcagggtcggccgggccaagatgcctttcctggggcctctggggggccaggtggctgcccccagcctcgggcctgacgcaggtgcccctcccctctcctcccctccccagttgaggtggacccggagctggagcccgagtcggccgagtacctggcggccctggagcgagccacggcggccctggagcagtgcgtgaacctgtgcaaggcgcacgtcatgatggtcacctgcttcgacatcagcgttgcagccagtgctgccatcccggggccgcaggagg

SEQ ID NO: 44174 - DNA, 359 bp, Homo sapiens
  chr14:104646327-104646686
  hypo
aagaccgtcaccacccgacagcaacgcaagtgcctttgaccttgatttggacttttctcccttttgcatttggtgctacagacttgagacaccagcagaagttgtgttcagcccggccccgctgcgcctgtccgggccggggctggcgccggttgtgtttgtgtccaccttgccttctttgcagccaagcagtttttgtggagtggagtgggacttacctgcacgccccaggggtctttcaggattcaggatgacttttcttttacaatggtttcctctcggcagagcccgggttgtgggggatctgtgtggggttctcaacgcagatccatcctggggtctcccgggcagggatggct

SEQ ID NO: 44175 - DNA, 207 bp, Homo sapiens
  chr14:104647208-104647415
  hypo
gaattaaagatgcatcgatggttcccacggctgccgagttcactgggcgtcggcagactcctcacgccctggtgtgccgccctctgagggtccctggggtgacgggcagtaagcgtgggaaggacacatccacggggacccagggcttcgggtgctgtgccagggcctgccttgcagcccctgtggggcccacggtgccatgagggc

SEQ ID NO: 44176 - DNA, 30 bp, Homo sapiens
  chr14:104647924-104647954
  hypo
gcctcctggcctcttcggagtcctatctgc

SEQ ID NO: 44177 - DNA, 54 bp, Homo sapiens
  chr14:104648777-104648831
  hypo
gggcagggttgttcccgagaagccgagggccacgcatgccggctctgtgctggg

SEQ ID NO: 44178 - DNA, 30 bp, Homo sapiens
  chr14:104682616-104682646
  hypo
acatcgggcatcgggcgggggcactcggct

SEQ ID NO: 44179 - DNA, 160 bp, Homo sapiens
  chr14:104705230-104705390
  hypo
ggaggagccaggctacgcctgccctcaggcccccgagagtgtggaggcccctggccatgcaccggaggagcctctgatggatgcttcataagagtggtgcccacactgcagccacctccgctgccagggacccctccggtgaacacgttggctcctcctc

SEQ ID NO: 44180 - DNA, 30 bp, Homo sapiens
  chr14:104768222-104768252
  hypo
cctttccagggcaaccgatgtctcagagtc

SEQ ID NO: 44181 - DNA, 30 bp, Homo sapiens
  chr14:104798505-104798535
  hypo
gagacacaaggcagccgtgcagcacagaga

SEQ ID NO: 44182 - DNA, 38 bp, Homo sapiens
  chr14:104800605-104800643
  hypo
gggccggggaggcaccgggtggccgtgcctgtcagggc

SEQ ID NO: 44183 - DNA, 37 bp, Homo sapiens
  chr14:104801369-104801406
  hypo
gtcaggtggctccctcggccctcggcaccctccctgc

SEQ ID NO: 44184 - DNA, 30 bp, Homo sapiens
  chr14:104820337-104820367
  hypo
ggaagcgtgcagaggcgcagcagagcctgg

SEQ ID NO: 44185 - DNA, 174 bp, Homo sapiens
  chr14:104842214-104842388
  hypo
agcagatgcacagcccgtatagatgcccaggacttgcttcatttgtgttaattaccttcttttgattttcctgatcaataaattatcccgacgtaattggattatttgcatggctggcaagaggtcgctgtgatttagcgcctggcatcctggcagctgcgtggggtcccattc

SEQ ID NO: 44186 - DNA, 103 bp, Homo sapiens
  chr14:104897622-104897725
  hypo
gttcattcatctcactgcggaggcagcaccatatccattcactaattccactgcggtggcagcaccctatccattcatcgtcccactgcgggctcatctgggt

SEQ ID NO: 44187 - DNA, 54 bp, Homo sapiens
  chr14:104899461-104899515
  hypo
caggcgctgatgcttcggtttccgtggttgccccggccccgttgtttgagggcc

SEQ ID NO: 44188 - DNA, 38 bp, Homo sapiens
  chr14:105026775-105026813
  hypo
acacacccatatacacgcacatgcgtgcattgcacaca

SEQ ID NO: 44189 - DNA, 119 bp, Homo sapiens
  chr14:105174275-105174394
  hypo
aacccacccacactgcgcatgaagaagctgaactggcagaagctgccatccaacgtggcacgtggtgagggtccccagacccccaagggaagcttcccctaggacgggggctggtctct

SEQ ID NO: 44190 - DNA, 30 bp, Homo sapiens
  chr14:105194964-105194994
  hypo
gccgggcacagtcgtcgtacaaactgccat

SEQ ID NO: 44191 - DNA, 18 bp, Homo sapiens
  chr14:105195822-105195840
  hypo
ggagggaggaggtagcgt

SEQ ID NO: 44192 - DNA, 196 bp, Homo sapiens
  chr14:105196366-105196562
  hypo
actgagtggccactccgtgccagctcagcccacccctcaccttcccagtgcctgtggaggcccaactagggtgacgctgggagaggagagggcttggaggagccacgggtcaaatgcaggaggccacacctgcctgcccaggaggactgcaggagccggatccttaacacctggaggggagcgggtgggtgcggtg

SEQ ID NO: 44193 - DNA, 92 bp, Homo sapiens
  chr14:105241003-105241095
  hypo
ggcctcctggagcctcggcagagtgcaaggaagaccagggccacctgccccacccacctgcccgcacacgggagcagcgagcacagccccta

SEQ ID NO: 44194 - DNA, 30 bp, Homo sapiens
  chr14:105254641-105254671
  hypo
tgaggggagagtctgcgggctccctccctc

SEQ ID NO: 44195 - DNA, 35 bp, Homo sapiens
  chr14:105268737-105268772
  hypo
tccggggacctctaccgccacgtccgcaagtttca

SEQ ID NO: 44196 - DNA, 30 bp, Homo sapiens
  chr14:105538919-105538949
  hypo
ggagcttggcagagccgtgactccaggagg

SEQ ID NO: 44197 - DNA, 30 bp, Homo sapiens
  chr14:105590655-105590685
  hypo
atgaggccatcaccacgttcgagcccagtc

SEQ ID NO: 44198 - DNA, 62 bp, Homo sapiens; identical to SEQ ID NO: 15887
  chr14:105658349-105658411
  hypo

SEQ ID NO: 44199 - DNA, 186 bp, Homo sapiens; identical to SEQ ID NO: 35579
  chr14:105714232-105714418
  hypo

SEQ ID NO: 44200 - DNA, 30 bp, Homo sapiens
  chr14:105739229-105739259
  hypo
ccctaggacacagcacgaggcagctcttag

SEQ ID NO: 44201 - DNA, 30 bp, Homo sapiens
  chr14:105739632-105739662
  hypo
accgccttccccaaccgcacagagtctggg

SEQ ID NO: 44202 - DNA, 30 bp, Homo sapiens
  chr14:106334145-106334175
  hypo
tgccgcaggtctccacgccttccaggccta

SEQ ID NO: 44203 - DNA, 29 bp, Homo sapiens
  chr15:20499470-20499499
  hypo
ttaggagaaacaggccgagcgcgctgact

SEQ ID NO: 44204 - DNA, 35 bp, Homo sapiens
  chr15:22515501-22515536
  hypo
gtctggcagcatgggcgtcacgctgcctgccgggc

SEQ ID NO: 44205 - DNA, 30 bp, Homo sapiens
  chr15:22876959-22876989
  hypo
aggaatttttaaatgcgtccacgcagagat

SEQ ID NO: 44206 - DNA, 128 bp, Homo sapiens
  chr15:22977063-22977191
  hypo
gggcgtgccctaatacgattatagtcaattggaggaaaggatgcttgttggaaggatgtgcagggcaaagtctgggaggtttccatgtgcaaagctttccctgtcctcagggacgcatcaccctccga

SEQ ID NO: 44207 - DNA, 19 bp, Homo sapiens
  chr15:23087577-23087596
  hypo
tttgagacagagtctcgct

SEQ ID NO: 44208 - DNA, 30 bp, Homo sapiens
  chr15:23182596-23182626
  hypo
ccagctcagccctgtcgtcatggaactcat

SEQ ID NO: 44209 - DNA, 107 bp, Homo sapiens
  chr15:23662038-23662145
  hypo
tgccagtgagagctccgcgaggcctggcccgagatgtggctggcgtgaggggtcccggacctgctgtggtggggacgcacccagttctgtggcgcttggtccagcga

SEQ ID NO: 44210 - DNA, 30 bp, Homo sapiens
  chr15:25449793-25449823
  hypo
ttgtccctgagtacccgttctcccctgtgt

SEQ ID NO: 44211 - DNA, 30 bp, Homo sapiens
  chr15:26869355-26869385
  hypo
tttcgctggtgtgggcggtgcgctggaact

SEQ ID NO: 44212 - DNA, 66 bp, Homo sapiens
  chr15:28389827-28389893
  hypo
gcatgatgggatagacggtgaagcgccagccccagccattcacagacccatcgctgatgaacttcc

SEQ ID NO: 44213 - DNA, 122 bp, Homo sapiens
  chr15:28517076-28517198
  hypo
accaacaaagcaggccgctattttcgttgttcttttctggtatttatttaaaagtgaatgtttcaagcttggttttgtgctgacaaggaagtcagtgctcactgatccgagtcttctccaca

SEQ ID NO: 44214 - DNA, 30 bp, Homo sapiens
  chr15:29087614-29087644
  hypo
gcaccgctcctcctgcgtcttctcctgctc

SEQ ID NO: 44215 - DNA, 48 bp, Homo sapiens
  chr15:29112193-29112241
  hypo
tatgccatcccactccggaatatgctctgtattcgttacctatagctg

SEQ ID NO: 44216 - DNA, 297 bp, Homo sapiens
  chr15:29133536-29133833
  hypo
tttgtttggattgggcggcggtggctgtggtgagggctgttggagtggggagagtgggggttgagcctggcttcagagaccccctcgaggcctcagctcctctccggcgctcctggctgtcctctgccacgcatacctgccccggtgactcaacaggtgtgggcctcaggtgacaccatggtccgaagtcgtggagaaacctttactgtccaggggaggagaggactggcggtcggtggggatcgagacccagcacacatcactgggtggctcgaatgtcttcggcagagatcacat

SEQ ID NO: 44217 - DNA, 158 bp, Homo sapiens
  chr15:29145324-29145482
  hypo
cttcccagcctcctccgcctggactcaggcttcttcgggctcatcagacctgaacagcctggcagtgtggctgtgtgggaatgggtgacaggtgctgttctccccagtgcaaatcaccaatgctgggcaccgtgcatcagcgtcgtggtgacggcagc

SEQ ID NO: 44218 - DNA, 30 bp, Homo sapiens
  chr15:29221674-29221704
  hypo
gggtgtagcacttcccgcctatcactggga

SEQ ID NO: 44219 - DNA, 30 bp, Homo sapiens
  chr15:29397531-29397561
  hypo
ggggagcctgtgccacgtgcctgtctccag

SEQ ID NO: 44220 - DNA, 34 bp, Homo sapiens
  chr15:29409363-29409397
  hypo
gacaccgggcagggccgcccgggcccagaggagc

SEQ ID NO: 44221 - DNA, 30 bp, Homo sapiens; identical to SEQ ID NO: 15892
  chr15:29449033-29449063
  hypo

SEQ ID NO: 44222 - DNA, 153 bp, Homo sapiens
  chr15:29721877-29722030
  hypo
tagaagggacaaattcgtctgtggttgaaatctacggacagccatgagctgaaactacggaccccgtagttctcaaaggaatacagagaagcaggtatggaatgccaacagggctgtgcaatgcccgatccgggccggcgtgagggcacctcc

SEQ ID NO: 44223 - DNA, 30 bp, Homo sapiens
  chr15:31083776-31083806
  hypo
atagcagaagaaactcgacagagcaaattg

SEQ ID NO: 44224 - DNA, 30 bp, Homo sapiens
  chr15:31121996-31122026
  hypo
tctcagtgatgttctcggttagaagtaatg

SEQ ID NO: 44225 - DNA, 30 bp, Homo sapiens
  chr15:31221190-31221220
  hypo
gtccacccagctaagcgaaaagctgttttt

SEQ ID NO: 44226 - DNA, 167 bp, Homo sapiens
  chr15:31377678-31377845
  hypo
ttttgtcaacattgtcggggctttactgtgaaaatgtgagcacacgcccaattgtttttagagttgtcattgcagttgtcattacatgatttatagtccaatcgcatgtgttgatgtcctaattcaaggtggtgctggtcagataccaggaacgcttgtcgcttttg

SEQ ID NO: 44227 - DNA, 30 bp, Homo sapiens
  chr15:31509535-31509565
  hypo
tcataaggttaacaacgaggcctcccactt

SEQ ID NO: 44228 - DNA, 30 bp, Homo sapiens
  chr15:31539632-31539662
  hypo
agcaaatgctgccttcgtatctaccctctg

SEQ ID NO: 44229 - DNA, 56 bp, Homo sapiens
  chr15:31603992-31604048
  hypo
ccatgagaggcaggacgatgctccccactttaggatgagggcgccaggcatttggg

SEQ ID NO: 44230 - DNA, 30 bp, Homo sapiens
  chr15:31813319-31813349
  hypo
gaagctatgacaggccggagggttcgcggg

SEQ ID NO: 44231 - DNA, 30 bp, Homo sapiens
  chr15:33438087-33438117
  hypo
aactaaagacttgaacgttttagaaaaaat

SEQ ID NO: 44232 - DNA, 27 bp, Homo sapiens
  chr15:33541634-33541661
  hypo
gcctcagcctcccgtaaaggtttttaa

SEQ ID NO: 44233 - DNA, 43 bp, Homo sapiens; identical to SEQ ID NO: 15893
  chr15:33632093-33632136
  hypo

SEQ ID NO: 44234 - DNA, 17 bp, Homo sapiens
  chr15:33633532-33633549
  hypo
cccggtctgattcagtg

SEQ ID NO: 44235 - DNA, 30 bp, Homo sapiens
  chr15:33727786-33727816
  hypo
ctccatattgtgtctcgcatttattccttc

SEQ ID NO: 44236 - DNA, 30 bp, Homo sapiens
  chr15:33746640-33746670
  hypo
aagaccctggccaagcgaaactccatccat

SEQ ID NO: 44237 - DNA, 155 bp, Homo sapiens
  chr15:33954397-33954552
  hypo
ggttccattaccacacgctgaggctctacagcgcggtgtgcgccctgggaaacagccgcgtggcctacgccctgtgcagccacgtggacctctcccagctcttctatgccattgacaacaagtacctccccggcctccttcgatctggtttctat

SEQ ID NO: 44238 - DNA, 36 bp, Homo sapiens
  chr15:34879893-34879929
  hypo
ggcatgagccaccgcatccggcgtgagtgcattctt

SEQ ID NO: 44239 - DNA, 163 bp, Homo sapiens
  chr15:38218484-38218647
  hypo
ggaacttaaacaacacgctcctaaacaaacaataggtcgcagaacaaataaaaaatgaaatcaatattaccttgagacaaactaaactggaaacacaacataccaaaacatttgagatggagcaaaagcatttctaagagagaaatttatggtgataaacatc

SEQ ID NO: 44240 - DNA, 30 bp, Homo sapiens; identical to SEQ ID NO: 15894
  chr15:40228636-40228666
  hypo

SEQ ID NO: 44241 - DNA, 39 bp, Homo sapiens
  chr15:40368182-40368221
  hypo
tcagcctcagagctgcggtcagtgcgtggagccggctac

SEQ ID NO: 44242 - DNA, 92 bp, Homo sapiens
  chr15:40423336-40423428
  hypo
ccaggcggggagaagacgatattaatcccaatattgcagaaggtgtagacctcccctgatattcaggggaaagagcacgatattgctcccaa

SEQ ID NO: 44243 - DNA, 75 bp, Homo sapiens
  chr15:40532146-40532221
  hypo
ctgatgctgggtgggcgcaggccctgagatgggcgtcagggagaggggacgccagacacacggcctgagcagggt

SEQ ID NO: 44244 - DNA, 30 bp, Homo sapiens
  chr15:40532791-40532821
  hypo
gcctgaagggagtgccgcttcctgggctag

SEQ ID NO: 44245 - DNA, 56 bp, Homo sapiens
  chr15:40545776-40545832
  hypo
gggtgagggtgtcaccgcggcagagtgcagggaattcatgccggggaagaggttcc

SEQ ID NO: 44246 - DNA, 30 bp, Homo sapiens
  chr15:40546043-40546073
  hypo
ccagggtgtaggttgcgttttctgtatctt

SEQ ID NO: 44247 - DNA, 300 bp, Homo sapiens; identical to SEQ ID NO: 15895
  chr15:41165245-41165545
  hypo

SEQ ID NO: 44248 - DNA, 30 bp, Homo sapiens
  chr15:41291830-41291860
  hypo
atttaattcataaaacgccatctttatgat

SEQ ID NO: 44249 - DNA, 141 bp, Homo sapiens
  chr15:41835678-41835819
  hypo
gggattacaggcgtgagccaccgtgcgcggcctctatgctgtcttaagtcccatttccacaactgtaaaatgtgagtaacaggtcctatataataggaaatgtgtgaggatttaaatgactatacacgcaaaacgcctagc

SEQ ID NO: 44250 - DNA, 30 bp, Homo sapiens
  chr15:41878349-41878379
  hypo
tataacaacatataacgtggatgaaaacaa

SEQ ID NO: 44251 - DNA, 30 bp, Homo sapiens
  chr15:42448030-42448060
  hypo
taacgatggctgtcacgcaccacacacctg

SEQ ID NO: 44252 - DNA, 104 bp, Homo sapiens
  chr15:42562548-42562652
  hypo
cacagcaaaactccgtctcaaaaaacaacaacaaaaaataaagtgcctcaaatcctccaaaaacaatgaaatataaacacttcaaaatacgcagttagggctgg

SEQ ID NO: 44253 - DNA, 248 bp, Homo sapiens
  chr15:42684673-42684921
  hypo
gggccactgaaggtccgttcgtggtcgtgaggcacactttcagggagcagagtggtctgtgtcttcacagagcccggaaaatgaactagtatgaactttgcctccaagcagcagaacttctgttcccccgcccctaatgggttctctggttactgctctacagacaatcattccggttcagtatgagacaagaatggcctgcgggctggtcagaggtcacgcctactctgtcacggggctggatgagg

SEQ ID NO: 44254 - DNA, 40 bp, Homo sapiens
  chr15:42784374-42784414
  hypo
ctggtattacaggtgtgagccaccgcgcccggccgcctat

SEQ ID NO: 44255 - DNA, 141 bp, Homo sapiens
  chr15:43020219-43020360
  hypo
actgctcagaacctgcgaaacagaactacagagtcaggggctaggggagggctgggtgcaacaaaggatgccagagtcgagcactgaccccgcccccacacaccctcccgcagcctcagactactccgtgcacctccccac

SEQ ID NO: 44256 - DNA, 20 bp, Homo sapiens
  chr15:43511855-43511875
  hypo
aacgatttggccaggcgcag

SEQ ID NO: 44257 - DNA, 51 bp, Homo sapiens
  chr15:43661941-43661992
  hypo
atctgctccttggtgcgcacctccggccttagccaccgacagcaaagttcc

SEQ ID NO: 44258 - DNA, 160 bp, Homo sapiens
  chr15:44037474-44037634
  hypo
atgtacccacatctacgaactaggagcagttgggcagaacaaacattctactaagactcagggttttttgaaacaaaaggggctaagagtggtaaagacattgagcagtcgaccaagtggccaggcatcttcactttgtgacggcactaccaattaaaag

SEQ ID NO: 44259 - DNA, 221 bp, Homo sapiens
  chr15:44092138-44092359
  hypo
ggcccagggaggtgccggggctggggccggccttggcacccaccatccttgtcccagggattaggcttaggtccaccagatggaaggcagatgagagcagcagttgcttctgtcctcagcccattggactgccactgtgttggggctgagcacccggtcccgggcagaatggagacgtccggaagagaacactgacctccaggttgcggtaaatgcaaatg

SEQ ID NO: 44260 - DNA, 17 bp, Homo sapiens
  chr15:44116023-44116040
  hypo
tgttgagactagatacg

SEQ ID NO: 44261 - DNA, 30 bp, Homo sapiens
  chr15:45471850-45471880
  hypo
ggcagagactgagcccggttcacccagggc

SEQ ID NO: 44262 - DNA, 23 bp, Homo sapiens
  chr15:45544201-45544224
  hypo
cggcctcccgaagtgctgggatt

SEQ ID NO: 44263 - DNA, 20 bp, Homo sapiens
  chr15:48906097-48906117
  hypo
ctgggcgacagagtgagact

SEQ ID NO: 44264 - DNA, 204 bp, Homo sapiens
  chr15:49182759-49182963
  hypo
cagtgtcaggcaactcggaaagatttgagggacaagagcagttttgagtgcagctctgatatcacgccacctaataaaggccaggctggaccttggtcatatggtgggatgaacgaacagcgattttcatactatctttgccataattagggaaacataaacaagaaaaccacatcatcatttacctttcgctttttaatggct

SEQ ID NO: 44265 - DNA, 22 bp, Homo sapiens
  chr15:51202484-51202506
  hypo
aggcgctcgatggttgcacgga

SEQ ID NO: 44266 - DNA, 29 bp, Homo sapiens
  chr15:52967811-52967840
  hypo
aacttagtgttaggccgggcgcggtggct

SEQ ID NO: 44267 - DNA, 145 bp, Homo sapiens; identical to SEQ ID NO: 15900
  chr15:53976280-53976425
  hypo

SEQ ID NO: 44268 - DNA, 22 bp, Homo sapiens
  chr15:55452971-55452993
  hypo
gagccaccgcacccagccaaca

SEQ ID NO: 44269 - DNA, 43 bp, Homo sapiens
  chr15:55689108-55689151
  hypo
aaacacaagataagccgggcgcggtggctcacgcctgtaatcc

SEQ ID NO: 44270 - DNA, 80 bp, Homo sapiens
  chr15:55699080-55699160
  hypo
ttttgactgaaattccgccctcagcgtaaaaggttaaaaattatgaattaacgcccgcgcggtgggtcacgcctgtaatc

SEQ ID NO: 44271 - DNA, 92 bp, Homo sapiens
  chr15:55806620-55806712
  hypo
gcacaagggttacttcgtaggccttttcggttcgtgttggggaagactccgcccacccagagtaagtacacacaagaaccagcaaatacttg

SEQ ID NO: 44272 - DNA, 77 bp, Homo sapiens
  chr15:59158460-59158537
  hypo
gcccggccccaggtttggattctttcacacagcaggtatgggccgactcactgtctggggcccgcccagcccagccc

SEQ ID NO: 44273 - DNA, 30 bp, Homo sapiens
  chr15:59243729-59243759
  hypo
catttaaagctggagcgaggcaagtgaggc

SEQ ID NO: 44274 - DNA, 30 bp, Homo sapiens
  chr15:59453484-59453514
  hypo
tcagagatcccgccacggagttctgctgct

SEQ ID NO: 44275 - DNA, 30 bp, Homo sapiens
  chr15:60915264-60915294
  hypo
aaccctgaggaatgccgtgtcttccctgtg

SEQ ID NO: 44276 - DNA, 30 bp, Homo sapiens
  chr15:61305596-61305626
  hypo
tgctgacttctgctccggatgactgctgtg

SEQ ID NO: 44277 - DNA, 30 bp, Homo sapiens
  chr15:62361320-62361350
  hypo
ttttgtttaagaccccggataagaaaatga

SEQ ID NO: 44278 - DNA, 44 bp, Homo sapiens
  chr15:62367703-62367747
  hypo
ccaatacagataggccgggcacggtgcctcacgtcggtaatcct

SEQ ID NO: 44279 - DNA, 223 bp, Homo sapiens
  chr15:63753342-63753565
  hypo
aaaagaatgttactgcggggcctccctaaaagacaagggaggaatcaagagaattccaagaaaggcgtccgagcaggaggtaagacagtagatttgaaagcaggactgagggagcaggaatgggaagaggggcccagccccagcgggtcaggggccggactaggctagcgaggcccaagtgcggtggccccatgcagagatcctggctcggtgcaaaggagat

SEQ ID NO: 44280 - DNA, 30 bp, Homo sapiens
  chr15:64440388-64440418
  hypo
atatagagtctggaacgtggtgttcatatg

SEQ ID NO: 44281 - DNA, 30 bp, Homo sapiens
  chr15:64443222-64443252
  hypo
tgcctgaaggagccacgttatccctatttt

SEQ ID NO: 44282 - DNA, 152 bp, Homo sapiens
  chr15:65043526-65043678
  hypo
tctcgaggaaaaaaaaaaaaagattcttactgtctccatttaactggcgaggaaacagaggctcagaaggcagcatgtgaattcgcagaaccaggacacgggctggacctgcccccacagcttctgccacgccttcccgcatcatcctgctg

SEQ ID NO: 44283 - DNA, 45 bp, Homo sapiens
  chr15:65127716-65127761
  hypo
gctaggattacgggcgtgagccaccgcgcccggcctggatttatg

SEQ ID NO: 44284 - DNA, 44 bp, Homo sapiens
  chr15:65622974-65623018
  hypo
gcttgaagccgccctcgtgctgggccagccggggccaaggctcc

SEQ ID NO: 44285 - DNA, 103 bp, Homo sapiens
  chr15:65862091-65862194
  hypo
tttataggggtcccacgtttgtagtgctctatttcttaacttgggttatataaactcaaatgtttatttggcagtattctttagactgcgtttgaacatgtgt

SEQ ID NO: 44286 - DNA, 33 bp, Homo sapiens
  chr15:66147762-66147795
  hypo
gcattccactcccacccccgccaaaaaaaaaag

SEQ ID NO: 44287 - DNA, 192 bp, Homo sapiens
  chr15:66598802-66598994
  hypo
ctctctgcttgcctccgtgcactcaggctttgaagaaggggctaggcagggcaaggtggtataattacataataaaatggctggaagtctctgaaggggaaaggagagggaaggagtttaattgatctgcaaactaattaactaggccctgcccaagcaccttctagcaggcaaaatcgagaaacaatagca

SEQ ID NO: 44288 - DNA, 30 bp, Homo sapiens
  chr15:66788210-66788240
  hypo
tacttgtaagggtaccgtggcaatatagaa

SEQ ID NO: 44289 - DNA, 34 bp, Homo sapiens
  chr15:66789324-66789358
  hypo
tctcaattttttgtagagacgaggtctcactata

SEQ ID NO: 44290 - DNA, 131 bp, Homo sapiens
  chr15:66963229-66963360
  hypo
ttagtaagtgctggacgtgtttgctccttctaggtctacatttttagcagagggaatagcaagggcaaaggccctgaggtgggaaacacgttccaggaatgggaagaaggttaggacgacacaaggggagt

SEQ ID NO: 44291 - DNA, 35 bp, Homo sapiens
  chr15:66963682-66963717
  hypo
gtgcccgcctcccaccgcaccgcctgctgtgatca

SEQ ID NO: 44292 - DNA, 72 bp, Homo sapiens
  chr15:66964011-66964083
  hypo
gagcacattggtgtccgagcctttttaatgctaagcacactgttcctcagagagaaacggtgtgtgaggctg

SEQ ID NO: 44293 - DNA, 39 bp, Homo sapiens
  chr15:67457364-67457403
  hypo
caatatgaagaaggacgaggtctgcgtgaatccctacca

SEQ ID NO: 44294 - DNA, 81 bp, Homo sapiens; identical to SEQ ID NO: 15907
  chr15:67545405-67545486
  hypo

SEQ ID NO: 44295 - DNA, 23 bp, Homo sapiens
  chr15:69324757-69324780
  hypo
tttttttttctgagacggagtct

SEQ ID NO: 44296 - DNA, 30 bp, Homo sapiens
  chr15:69754387-69754417
  hypo
ggaaccagatgaggacgaaggcggagatgc

SEQ ID NO: 44297 - DNA, 30 bp, Homo sapiens; identical to SEQ ID NO: 15908
  chr15:70075720-70075750
  hypo

SEQ ID NO: 44298 - DNA, 18 bp, Homo sapiens
  chr15:71117912-71117930
  hypo
tttttttttttgagacgg

SEQ ID NO: 44299 - DNA, 176 bp, Homo sapiens; identical to SEQ ID NO: 15909
  chr15:72102772-72102948
  hypo

SEQ ID NO: 44300 - DNA, 17 bp, Homo sapiens
  chr15:72411795-72411812
  hypo
tggaggtcatttagccg

SEQ ID NO: 44301 - DNA, 197 bp, Homo sapiens
  chr15:72412112-72412309
  hypo
gtcatttaactacagagaggcttggagatggaatgagaaacttgagcggcgttatgtttggaataactggtctgggaaatgggagaaggagccactcttgcctttctcttcagcactgttcattcctcagtgtttatcaggtccaaattagttacttgtctctttgctctcccgttcccttccgtccaggattggtc

SEQ ID NO: 44302 - DNA, 30 bp, Homo sapiens
  chr15:72462639-72462669
  hypo
gagactcgcttatgccgagaacaaaagtgt

SEQ ID NO: 44303 - DNA, 319 bp, Homo sapiens
  chr15:72581481-72581800
  hypo
gataaggggagagcccgttattgtagagcgtgtcggagcccggctggccattggtctggggggtcagagggccgaatccattgaccccgatgggcgccggaagacctgggagggtgccagggccgctgccaggcggggagttggctgctgatggcggaaaaggtctgagagtcaggccgccaccccgccccgcccggcccctcccaggcgcgccccagtccctgggggccgtacctgccgcgggcaacagaggcgcagctaccaggctaaaggccgccacgtgttgcatctgggccgccactgccgccaccgggcctag

SEQ ID NO: 44304 - DNA, 30 bp, Homo sapiens
  chr15:72743660-72743690
  hypo
gcgactccaaggcagcggagctgaccgcca

SEQ ID NO: 44305 - DNA, 36 bp, Homo sapiens
  chr15:72768976-72769012
  hypo
acaggcgtcagccaccgtgcccggcctgtagaagat

SEQ ID NO: 44306 - DNA, 30 bp, Homo sapiens
  chr15:73919229-73919259
  hypo
taatacctgggtgaccgatgatttttaata

SEQ ID NO: 44307 - DNA, 96 bp, Homo sapiens
  chr15:74790274-74790370
  hypo
gcctacagaggagagcgagtacttatctttttagtactttttattctggtgagcctctcaccagcaaattctttctttttttttttgagtcagagt

SEQ ID NO: 44308 - DNA, 17 bp, Homo sapiens
  chr15:74818772-74818789
  hypo
taataactcctttgccg

SEQ ID NO: 44309 - DNA, 30 bp, Homo sapiens
  chr15:74903896-74903926
  hypo
aggtccttctctgcccgcctccagtcccgc

SEQ ID NO: 44310 - DNA, 30 bp, Homo sapiens
  chr15:74911603-74911633
  hypo
aggaggtcctacagtcgggaacatgaaggg

SEQ ID NO: 44311 - DNA, 101 bp, Homo sapiens
  chr15:75143124-75143225
  hypo
tgaaacagaggagcccgctctgtacctaggcagggatagttcccatatcctggttttctgggacctcaaaaccagggatcaaactacgttcctgagaggtg

SEQ ID NO: 44312 - DNA, 22 bp, Homo sapiens
  chr15:75205459-75205481
  hypo
gagatgccgtctcaaacaaaac

SEQ ID NO: 44313 - DNA, 76 bp, Homo sapiens
  chr15:76197445-76197521
  hypo
gagccaccgcgcccggcatgttgggccttttaagtatccacattttcactattaacaacaacgctgtgcagaacct

SEQ ID NO: 44314 - DNA, 30 bp, Homo sapiens; identical to SEQ ID NO: 15913
  chr15:76510088-76510118
  hypo

SEQ ID NO: 44315 - DNA, 81 bp, Homo sapiens
  chr15:77852830-77852911
  hypo
tccagggaggcagatggtggtattaatcctcatatcgcggggggtgtacaacctcctgttatggttcgtaacatttagggt

SEQ ID NO: 44316 - DNA, 51 bp, Homo sapiens
  chr15:77906947-77906998
  hypo
acctgctgggccttgcggtcccggatgcgggcgcggcggcaggtgaagtag

SEQ ID NO: 44317 - DNA, 30 bp, Homo sapiens
  chr15:78252931-78252961
  hypo
acaagtcccattaagcgcaattcttatgtt

SEQ ID NO: 44318 - DNA, 30 bp, Homo sapiens
  chr15:78277490-78277520
  hypo
gggggcctctcctgccgggccatgctctgc

SEQ ID NO: 44319 - DNA, 151 bp, Homo sapiens
  chr15:78501791-78501942
  hypo
cgtgtgcttccggggcgaggcctcctgtgccgggcagacagaggcgtgtgaatgctgcagaactcgtcctactgactttggatccttggttacagctctctgggatagccaggtagaagctgcctccactttgggccgcaatgttaccaaa

SEQ ID NO: 44320 - DNA, 30 bp, Homo sapiens
  chr15:78503615-78503645
  hypo
tgagcacgccgaaggcgattaacatattat

SEQ ID NO: 44321 - DNA, 157 bp, Homo sapiens
  chr15:78596061-78596218
  hypo
ccgcgcccggccactgtttacactattgttgcagtagctgctgccatcaccgggctgcggcagggaggcacagctggggctgcatgctggtggatgcctcccccttctgagttggggagagctccccaggtgctgctgcagccgcccaaacagcagt

SEQ ID NO: 44322 - DNA, 139 bp, Homo sapiens; identical to SEQ ID NO: 15917
  chr15:78609750-78609889
  hypo

SEQ ID NO: 44323 - DNA, 68 bp, Homo sapiens
  chr15:79055979-79056047
  hypo
ccaagactgaccaggcgccaccaagcacttgctccctgctcctccccgcagcccggctcacctggccc

SEQ ID NO: 44324 - DNA, 30 bp, Homo sapiens
  chr15:79057117-79057147
  hypo
acccacctaggctagcgagacctcagcaag

SEQ ID NO: 44325 - DNA, 66 bp, Homo sapiens
  chr15:80624497-80624563
  hypo
tccccaaccagttcccgcggggaccaacaggacagaagaagctggcagctgcggggggcaaggctg

SEQ ID NO: 44326 - DNA, 48 bp, Homo sapiens
  chr15:82042541-82042589
  hypo
catccctgagccagccggcctctgagcatcttgcgctggcagtgccgg

SEQ ID NO: 44327 - DNA, 162 bp, Homo sapiens
  chr15:82205642-82205804
  hypo
gctgtctgactccagcgttcatgcttggaacactaactaccctctactagttcattagaggcaactgggtaaaagtggaactaggtgtgcccgtgataaagcctgtgattaagtagttaaaatgaggatggattccggtaagccaaacgtacacataaggtt

SEQ ID NO: 44328 - DNA, 21 bp, Homo sapiens
  chr15:83572455-83572476
  hypo
ctgaacaagactgggcgcagt

SEQ ID NO: 44329 - DNA, 95 bp, Homo sapiens; identical to SEQ ID NO: 15918
  chr15:83655934-83656029
  hypo

SEQ ID NO: 44330 - DNA, 29 bp, Homo sapiens
  chr15:83665114-83665143
  hypo
tggcgcggtggctcacgcctgtaatccca

SEQ ID NO: 44331 - DNA, 37 bp, Homo sapiens
  chr15:84582058-84582095
  hypo
ctgaggacagtgagacgacttacgactgggagtacgc

SEQ ID NO: 44332 - DNA, 30 bp, Homo sapiens
  chr15:84950141-84950171
  hypo
aacctgcaggagctgcggggcaggtgttgc

SEQ ID NO: 44333 - DNA, 159 bp, Homo sapiens
  chr15:85143074-85143233
  hypo
tgcaggtgcctccagtaattgctcagtgcaaacatacataactattctatcacagaccattaagggtgtctctctccatttttagattttccgcttgagtttccaggtagtttctcacctgttttcaagcagggttggggcagccgtttcttcaacagc

SEQ ID NO: 44334 - DNA, 47 bp, Homo sapiens
  chr15:85728800-85728847
  hypo
ttttctggttttccacggtgttcatggatttccgtgacttgaaccta

SEQ ID NO: 44335 - DNA, 27 bp, Homo sapiens
  chr15:85886665-85886692
  hypo
gattttaacttgcgttagtgaactaat

SEQ ID NO: 44336 - DNA, 38 bp, Homo sapiens
  chr15:89142361-89142399
  hypo
tctaactttaaaggccgggcgcggtggctcacgcctgt

SEQ ID NO: 44337 - DNA, 30 bp, Homo sapiens
  chr15:89145873-89145903
  hypo
taccccacttctggccgtgcgcagtggctc

SEQ ID NO: 44338 - DNA, 20 bp, Homo sapiens
  chr15:89448511-89448531
  hypo
taataaatcattcatcgggg

SEQ ID NO: 44339 - DNA, 214 bp, Homo sapiens
  chr15:89876593-89876807
  hypo
tagaggggcggcaggcgcagctccacgtcgggcaagggcacggctggctgcccccagagcccgtgcttctgcaggtgctcgacgctgcggcgcaccgcggcctcgccaggcatctcccctccttgcccgaagatttgctcgtgcagccctctcgagagcatctggatgtccaatgggttgtgccgcagctgcccgccctccgaggatagcactt

SEQ ID NO: 44340 - DNA, 214 bp, Homo sapiens
  chr15:89876867-89877081
  hypo
gctgcccgtcgctggggtcggacgcggggacggagctggagacccagcgccccggagctggaaccggccctggcccgacggtggcgccggccaccttcctccagagcaggcggctcatggttggtgcagggacccccacgctgggagtcagaacacctggctttgggctccagcttggcttcttttactggctggaagacgtggagagagacac

SEQ ID NO: 44341 - DNA, 199 bp, Homo sapiens
  chr15:90109400-90109599
  hypo
atcactgatgtaaaccgaaggtatgagagccataacccaggttcgatttttgcttttttacaaatatgcttttcaggggtagaaattccatgctattaggctgttcttaaacttttccattagaaaaatgccataggaatgcagaaaagggtgtggtaattccgcctggggaattcaggaagagcgagagagaagctac

SEQ ID NO: 44342 - DNA, 30 bp, Homo sapiens
  chr15:90501049-90501079
  hypo
aaatttaacaaaaaccgtggcctgcctata

SEQ ID NO: 44343 - DNA, 30 bp, Homo sapiens
  chr15:90501399-90501429
  hypo
aacatacctcatgcccgatgctccctaggc

SEQ ID NO: 44344 - DNA, 30 bp, Homo sapiens; identical to SEQ ID NO: 15919
  chr15:90630578-90630608
  hypo

SEQ ID NO: 44345 - DNA, 43 bp, Homo sapiens
  chr15:90667422-90667465
  hypo
cctttttttttgagacggagtttcactcttgttgcccaggctg

SEQ ID NO: 44346 - DNA, 82 bp, Homo sapiens; identical to SEQ ID NO: 15920
  chr15:90703242-90703324
  hypo

SEQ ID NO: 44347 - DNA, 20 bp, Homo sapiens
  chr15:90741434-90741454
  hypo
caccgcgcctggctggtaaa

SEQ ID NO: 44348 - DNA, 30 bp, Homo sapiens
  chr15:90755834-90755864
  hypo
gagtgagtgcgcaagcgtggacaagccctg

SEQ ID NO: 44349 - DNA, 55 bp, Homo sapiens
  chr15:90866273-90866328
  hypo
taaggaaaagaccaccgcagtggctcagtgctcttgctgacgtgccccactgcac

SEQ ID NO: 44350 - DNA, 35 bp, Homo sapiens
  chr15:90896205-90896240
  hypo
ttttttttttttagacggaatttcgctcttgttgc

SEQ ID NO: 44351 - DNA, 116 bp, Homo sapiens; identical to SEQ ID NO: 15922
  chr15:91189343-91189459
  hypo

SEQ ID NO: 44352 - DNA, 22 bp, Homo sapiens
  chr15:91313693-91313715
  hypo
ccgtgcccggccaatccccaca

SEQ ID NO: 44353 - DNA, 30 bp, Homo sapiens; identical to SEQ ID NO: 15924
  chr15:91409404-91409434
  hypo

SEQ ID NO: 44354 - DNA, 30 bp, Homo sapiens
  chr15:91500770-91500800
  hypo
gagaagcaagcggagcgggaccccttaatg

SEQ ID NO: 44355 - DNA, 46 bp, Homo sapiens
  chr15:92459343-92459389
  hypo
cacgcgggcaccggccgcgcctgatcggctgcggcggcatcgtcat

SEQ ID NO: 44356 - DNA, 98 bp, Homo sapiens
  chr15:92459593-92459691
  hypo
ggtgctcctgggcatcggtgctacccctgtgcagcccctgggcgtctcctacatcgacgaccacgtgcggaggaaggactcctcgctctatataggta

SEQ ID NO: 44357 - DNA, 30 bp, Homo sapiens
  chr15:92701704-92701734
  hypo
tggttatggaggggacgcataatggatgtg

SEQ ID NO: 44358 - DNA, 18 bp, Homo sapiens
  chr15:93364650-93364668
  hypo
tctcgggggaaaaaaaaa

SEQ ID NO: 44359 - DNA, 121 bp, Homo sapiens
  chr15:93594841-93594962
  hypo
tgaaaaccagcagcccgcagtggcctcgtggggccgctcagaatatgccaggttctggagtcacccgggcctggggcaaattctagctcagcattccagctgactacgcacttggggtggg

SEQ ID NO: 44360 - DNA, 45 bp, Homo sapiens
  chr15:93609520-93609565
  hypo
tcctgtggatgaatccgtaaccattccggacgttgaaccatttga

SEQ ID NO: 44361 - DNA, 63 bp, Homo sapiens
  chr15:93609815-93609878
  hypo
taccaccccgggcatcgtcgccgtggggactgccgtcaccaccgccgccgcctccacctcgct

SEQ ID NO: 44362 - DNA, 33 bp, Homo sapiens
  chr15:93902389-93902422
  hypo
caaatgttatataaacgccgggcaaagggatga

SEQ ID NO: 44363 - DNA, 30 bp, Homo sapiens; identical to SEQ ID NO: 15927
  chr15:94347602-94347632
  hypo

SEQ ID NO: 44364 - DNA, 40 bp, Homo sapiens
  chr15:94478454-94478494
  hypo
aaagaaggaggaggccgggcgccgtggctcacgcctgtaa

SEQ ID NO: 44365 - DNA, 30 bp, Homo sapiens
  chr15:94925846-94925876
  hypo
tgctgtacctcagagcgcctggttattaag

SEQ ID NO: 44366 - DNA, 180 bp, Homo sapiens
  chr15:97006353-97006533
  hypo
catgtctgtgacatccgtgagcgctgatggtgcacgcttccagtcattttcctggtaagtgtattcagtgatggcatcaaattcagcggttggaagtcttgcctcaggccttggagctaaatacactgaagtcacttgaatatgaaattccttaaagtcgtttaacgtactcattaattt

SEQ ID NO: 44367 - DNA, 30 bp, Homo sapiens
  chr15:98417575-98417605
  hypo
tcctggggggtgtgtcgggcccctcactgg

SEQ ID NO: 44368 - DNA, 31 bp, Homo sapiens; identical to SEQ ID NO: 15930
  chr15:98454964-98454995
  hypo

SEQ ID NO: 44369 - DNA, 38 bp, Homo sapiens
  chr15:98776801-98776839
  hypo
ctgggattacaggcgtgagccaccgtgcccggcccagc

SEQ ID NO: 44370 - DNA, 26 bp, Homo sapiens
  chr15:99168900-99168926
  hypo
acctcagagtcctcacgtataaaatg

SEQ ID NO: 44371 - DNA, 90 bp, Homo sapiens
  chr15:99183400-99183490
  hypo
actgtgtctctgaaaacaaaaaaaatcatcataataacgatgtcttaatattggttcattagttatgacaaatgtcgcatagcagtatgt

SEQ ID NO: 44372 - DNA, 42 bp, Homo sapiens
  chr15:99254581-99254623
  hypo
cctactcgattttgtcgtgctgttgcgcggttttcacttggc

SEQ ID NO: 44373 - DNA, 41 bp, Homo sapiens
  chr15:99295597-99295638
  hypo
tagagtgtttattaacgaaaatatgtgagccttggctgggc

SEQ ID NO: 44374 - DNA, 30 bp, Homo sapiens
  chr15:99454637-99454667
  hypo
tctcatcagcttcaccgtttactacaagga

SEQ ID NO: 44375 - DNA, 33 bp, Homo sapiens
  chr15:99456398-99456431
  hypo
gccctggactcagtacgccgtttacgtcaaggc

SEQ ID NO: 44376 - DNA, 48 bp, Homo sapiens
  chr15:99460220-99460268
  hypo
ccactgagacggagccgaaaaagatgacaggttcggtgaagtgagtcc

SEQ ID NO: 44377 - DNA, 38 bp, Homo sapiens
  chr15:99484067-99484105
  hypo
tccctaggtttggcacgttgagacgtcctcacgtttgg

SEQ ID NO: 44378 - DNA, 132 bp, Homo sapiens; identical to SEQ ID NO: 15933
  chr15:99484456-99484588
  hypo

SEQ ID NO: 44379 - DNA, 30 bp, Homo sapiens
  chr15:99506147-99506177
  hypo
tctgcgagaacataacgatcactcattttt

SEQ ID NO: 44380 - DNA, 30 bp, Homo sapiens
  chr15:99974913-99974943
  hypo
ccctgggctagaagccggtgcacctccctt

SEQ ID NO: 44381 - DNA, 30 bp, Homo sapiens
  chr15:99981097-99981127
  hypo
tggataactataaagcgactaggcaatttg

SEQ ID NO: 44382 - DNA, 30 bp, Homo sapiens
  chr15:100378951-100378981
  hypo
gcaatgctgccagagcggcagctacaactc

SEQ ID NO: 44383 - DNA, 30 bp, Homo sapiens
  chr15:100888957-100888987
  hypo
tgactcatcctgtgacgaagaatgcctaac

SEQ ID NO: 44384 - DNA, 326 bp, Homo sapiens
  chr15:102043003-102043329
  hypo
ccgtgacctgagagccgcaccactccacctcctgggcctcactccgccctatacacgcgcacacttaatgacatctctgatcatgtcttcaggacgcataccctctttgacttgaaaaagtaacaactgtttgtggccttctcacaggccgaaaagaacaagcggggtccagtggagaaaggtgaggcatgggaaggcctggcccgagcactgtgacttcagcgaggcaccctccacccctctcagctttcctggtctgaaagtagaatttcgccagagggtgagccgacaggtagagctgtttccacctgcgtgtgctgcctgtg

SEQ ID NO: 44385 - DNA, 22 bp, Homo sapiens
  chr15:102193729-102193751
  hypo
gagactccgtctcaaaaaataa

SEQ ID NO: 44386 - DNA, 30 bp, Homo sapiens
  chr15:102276370-102276400
  hypo
catcatgggaaaatacggtaaatgcttttt

SEQ ID NO: 44387 - DNA, 57 bp, Homo sapiens; identical to SEQ ID NO: 15935
  chr16:142626-142683
  hypo

SEQ ID NO: 44388 - DNA, 120 bp, Homo sapiens
  chr16:189557-189677
  hypo
agatctttgagaccttgggcgaggcagtgacactaaaggcaggagcgactacagaagaataaattaaacttcatcagattaaaaactttactgcggccgggcgcggtggctcacgcctga

SEQ ID NO: 44389 - DNA, 23 bp, Homo sapiens
  chr16:208745-208768
  hypo
ttttcttttttgagacggaatct

SEQ ID NO: 44390 - DNA, 30 bp, Homo sapiens
  chr16:318060-318090
  hypo
atcacacatgctatgcgtacacacacttgt

SEQ ID NO: 44391 - DNA, 38 bp, Homo sapiens
  chr16:319924-319962
  hypo
aaacaaggtaggccacgcatggtggctcacgcctgtga

SEQ ID NO: 44392 - DNA, 158 bp, Homo sapiens
  chr16:323428-323586
  hypo
ccctgcgctggccagcgacccccaccctcaccgcaggtgggctcaccgggggcctgttcaccagccagtaggtctgctcctggcacgcaatgaccagcctgtcccccttgctgcgctgcttggctgccctgggaggaggaggccgagttgagggcacg

SEQ ID NO: 44393 - DNA, 92 bp, Homo sapiens
  chr16:332635-332727
  hypo
tgggcagctatggcccgagcgcccaggagtatgagtttgtgactccggtggaggaagcgccgaggggtgcgctggtgcggggcccctatctg

SEQ ID NO: 44394 - DNA, 218 bp, Homo sapiens
  chr16:337560-337778
  hypo
atgtacatatttacacgggccctcagaaaggaggacccaggactgcacagccggcggctggaggcaggtgcagtgctccgtcgccgattcacacagtggcaggcaagagacaagctgtgttgaaggcactcggtggcgcgtacaattgacagaggccctgcaggcctctgcatccgggcctgggccccacccagacctgggtacgtgggcaaatccca

SEQ ID NO: 44395 - DNA, 456 bp, Homo sapiens
  chr16:410258-410714
  hypo
taggaaccctgaggccgcggccaagttctgagcgtgtgactgtgtgtgctgggccccaggcccctttgtcgccgcggcgtctgtcgtggcaaacaaaagtgaaccggattagccacagtggattaaaagatttacgtctcagagtttacctaataacctaacaatcgtgtcaacgggagctttgaacccccagggcgcgcctgccaggccaactgagagctcaaggcctctgtgggcagcaggacgtggtcggggggaggagacgcagccacggctgtcctcacacccagctcggcccctgcgggctcctctgggcagaacctggggaaggcacggcctctagcaggaggtggaggcctttgaaagggtgcaggtgttgggaccaggtacccggcccaggcccccagccgcgtccacacacgtcgcacacggcagcaaggacgcaagcagtgtgga

SEQ ID NO: 44396 - DNA, 461 bp, Homo sapiens
  chr16:411043-411504
  hypo
aaaatgctgcttaaacggcaccgacttgacatggcttgtctcctaaccttggagtggcggccgggacgccggcctggatcagtcgggggtctttgatgccgcctccatgtgaaacctgacgtggaagacccaccggggcggttttggggtccgaggtccgtcaggattcatcctgcctcaccctgctccctttgtctcttcccctgacccttcctcgggacacccggagagggtctgagggtgagggtgcgggcgctgcgtgtgggcttgcactcgagggtggggtgggccgagggcagggccgcagccgcgagaacaatgggcagaggaggcgcgtccacctgtccgcccggccgcctgcccggcttacctcacctgcctggctccgtgtgcctgctcacgccccaccgtcccgctgtccgccatgatgggcttggccgtccgtccgagcactttcagcc

SEQ ID NO: 44397 - DNA, 309 bp, Homo sapiens
  chr16:412764-413073
  hypo
ccaccttcaagagagcgacttcggggccagtcccagggaaccgggcttggcatgggcctgggcgccgggggtctcgggccgcggctgctcccccaggactctgggcgccgggggtctcgggccgcggctgctcccccaggactctgggcgccgggggtctcgggccgcggctgctcccccaggactctgggcgccgggggtctcgggccgcggctgctcccccaggactctgggtccggatccaagcttcttcgcactggcctggttgtgagccgcctgtcccaggatggaacccggccttgaagccct

SEQ ID NO: 44398 - DNA, 30 bp, Homo sapiens
  chr16:501353-501383
  hypo
cctccccacgcttcccgtatcagggagctt

SEQ ID NO: 44399 - DNA, 49 bp, Homo sapiens
  chr16:611950-611999
  hypo
gtgcagccagggccccgcacttggtggcagactccgttctgagcttagg

SEQ ID NO: 44400 - DNA, 117 bp, Homo sapiens
  chr16:612203-612320
  hypo
ttggctgagtgtggccgctgcaggctcggccgctgacctgcccgaagccacccagatggagctgggctgagcaggtggctgagccgtggggccatgctgggacgtccactccccaca

SEQ ID NO: 44401 - DNA, 168 bp, Homo sapiens
  chr16:612869-613037
  hypo
gtgtgtagggtcaaccgataaaataaaggacgcctagttaaaatcgaatttccgataaacaatgaacacctttctagtgtgcctttccaatattgcctaggctacacttaacactcagaaatgacgtgctgctgatcggcgtcagatgcagctcgctgtcctggactt

SEQ ID NO: 44402 - DNA, 72 bp, Homo sapiens
  chr16:613552-613624
  hypo
gcacccaccccagaccgccctggggagtccgaccccggcaggcaaccccagggagcacggcccacaggtgct

SEQ ID NO: 44403 - DNA, 134 bp, Homo sapiens
  chr16:613908-614042
  hypo
cctgtctctgctgggcgtcaactacccgctcagccccggcctcttctcctacttggggccctcactggccgctgcagcccatgtgcccttcctggcctcggccagccccctgctgcccccggccacggccttcc

SEQ ID NO: 44404 - DNA, 30 bp, Homo sapiens
  chr16:614353-614383
  hypo
acaaggttctgttcccggagcaggtgggcg

SEQ ID NO: 44405 - DNA, 480 bp, Homo sapiens
  chr16:614777-615257
  hypo
cagtgccaggaagcccggagcatgtgggcgaggacctgacccgagccctcggtgactacgccagggtggagcagcgcctgggacagttggggcccgcggggggcctggccccgagacccctgcgggagcagctgggcaagatccgcctggagctgctcaccattcaccaggcgctggagcaggccgtgaggccgccagacgcacccctcgacctctctgtgaaacgtgcgcccgccaaggggccccaggctcttggagaggcgtgggggcggcccgagctgggtcccgtgttgaccgggggcacccccgagccacccggcatgctgggccctgcagcgccccaacccttctctggccacaccaccaagtgtgaggccgactccagcgtcccacccccagggctccccctcgcagccccagatgaccctgtcattcctggcagtggctggggcacctgtgttgcgacgaggagttcccaga

SEQ ID NO: 44406 - DNA, 30 bp, Homo sapiens
  chr16:623234-623264
  hypo
gtttctccacacctccgggacctgtaagcc

SEQ ID NO: 44407 - DNA, 84 bp, Homo sapiens
  chr16:643882-643966
  hypo
cctgggtgatggtggcgagttacccggcaggaattatgcttcatccaggagtgtgggtggtgcacgcggcggggaggagaaagc

SEQ ID NO: 44408 - DNA, 117 bp, Homo sapiens
  chr16:666790-666907
  hypo
ccctttctccaggcacgctggagtccacgccctgcctttgcccaatgccctctgagggagaggccctgtgccttgcacccagcgcgggccacaggcggaggccccattccaggcaag

SEQ ID NO: 44409 - DNA, 65 bp, Homo sapiens; identical to SEQ ID NO: 15945
  chr16:667484-667549
  hypo

SEQ ID NO: 44410 - DNA, 61 bp, Homo sapiens
  chr16:677848-677909
  hypo
tggtcggaaacaagccgggcctccccagctgcctgggcttgaccggcggggagcctggttg

SEQ ID NO: 44411 - DNA, 205 bp, Homo sapiens
  chr16:700124-700329
  hypo
gcccagcaagcacttcgtcatccacctcgatgtgtcctccaaggtacggagcccgcggctgggggctgcgtgggagccccggcacccctgcggcccctgtctcctcacggccctgctccgtccccacaggacaaccaagtcatccgtgtgtctttctccaacctcttcaaggagtttaagtctacggccacgtggctccagtttc

SEQ ID NO: 44412 - DNA, 64 bp, Homo sapiens
  chr16:700572-700636
  hypo
gacctgcctgcagctcgatctgcaggacgttctcctggtctacctgaaccggtgctacggccat

SEQ ID NO: 44413 - DNA, 30 bp, Homo sapiens
  chr16:721696-721726
  hypo
gatccacgtgccccccggctgcagcacgga

SEQ ID NO: 44414 - DNA, 421 bp, Homo sapiens
  chr16:726626-727047
  hypo
tgccatggggaggtccgtggcccacactcaggcccctgcccccagatcagcagcaagcgctccagcagtttcaagcgggccattgctaacggacagcgggcactgccccgggacgggccgctggatgagccaggcctaggtgtctacaagcggtttgtgcgttacgtggcctacgagatcctgccttgtgaggtggaccgccgctggtacttctaccgtcaccgcagctgcccaccccccgtgttcatggcctcggtcactcttgcccaggtgggccccccggccgctgccccgggagcctcccgcgctcctggccatgaccagcctaacactcgtgtccccagatcatcgtgttcctgtgttacggggcccgcctcaacaagtgggtgctgcagacctaccaccccgagtacatgaagag

SEQ ID NO: 44415 - DNA, 257 bp, Homo sapiens
  chr16:731353-731610
  hypo
ggctgacaagctgcccggttgtggggcctctggggccaggcgggtggactggccagagagtgacgtgaagcccccgttccccagcttacagcctggccaaggagcagcggctgaacttcggggacgacatccccagcgctcttcgaatcgcgaagaagaagcgctggaacagcattgaggagcggcgcatccaccaggagagcgagctgcactcctacctctccaggctcattgccgcggagcgtgagaggtgggac

SEQ ID NO: 44416 - DNA, 1210 bp, Homo sapiens
  chr16:734741-735951
  hypo
actcgcagaggtggccgcagcctgcgggacagtgggagctgccttccagccacttcatgatgtgctgcaggtggccgccgtggctgcagccctggcaccacacgaagagacccttgactacgtggtggcagacggcacacatgctggcgcagcggtggcacctgggggcgggcgggagggagggtgcctcagcgggggctgctgcgctgcctgcaggcccctgccccacctcccgaccccactgccccacctgtcgcagacccagccccggctgctcatgggccgcttgcagtggctgcagttgacgtgcagggtggtggaggcctggttgaggcagctgacggcgcggctggtgctcagcttgaccacctcgttggacacgttccagaggcggaagcgctgcagcaggtcgatgtaggaagtgtaccagtgctcctgggggagggagcgcccggcagtcaggatctgggtgccaggggcggcgctgcaggggggaggccccgcccaccacacacctgggtctgctcgtcgatgtccttgcgcacccgttcacccaggacgatgagcacagacacagccatctgcacgtcgccctgctcagcgtagaagtgcagcatgtcgcgcaccagcacgccgaagaagtcgggcggcaggcggctgtcgtagagcgcgtgtgagacagacaggagcgagaaggaggagtccacgggggccagggaggccacatccgcctcgctgccgctcacgtgcggggagtcggccttgtcctgcaggtgctcgggcccgggaggcgtgtccacgatctcgtggcgcagcggaaaggcctcctgcggcagcacgcactcagggtcctcggctggaaggcagggaccagcggaggctctgagtctgtcctccatccgcctctgaaccccaccctgcccggacccccactcacggtgcgcgtgttccggatccagcaggtacagctcgtcctcctcaccttccacgtcacccagcaggtagtcggcaggtacgtcgctgccctcggtttcctcgttatctgcccgacaatggggcgggcattcagggtcgtctgggacacccccacccctctcccatcagcacccctacccaccccagcctaccctcattggtgatgagtgtggccgaggagtcgagcagaactgtgtcgctccgtgcatctcctttgctgcggtccagccgcgtc

SEQ ID NO: 44417 - DNA, 145 bp, Homo sapiens; identical to SEQ ID NO: 15952
  chr16:741376-741521
  hypo

SEQ ID NO: 44418 - DNA, 30 bp, Homo sapiens
  chr16:760916-760946
  hypo
gtgtcctccacgggccggaacctgtgtctg

SEQ ID NO: 44419 - DNA, 244 bp, Homo sapiens
  chr16:775524-775768
  hypo
ctggtgccatctcctcgcagctccagctccagtacccggctctccagccgaaggatctgtgggacaactggcatgagcaggtgcacctgcccgcgggccacctggggtaggtgaacattcacccggtgcacgctcaggggcgcgcagcactcagaggcaggctgagacccacagatgccatgtgcgtgtgcatgcccatgcagggcacgtgtcctgggcctgcaccccccgtcccccatgcact

SEQ ID NO: 44420 - DNA, 126 bp, Homo sapiens
  chr16:798233-798359
  hypo
catgggaaaggctgccgggccccgggctcgccggtgggtggccccgtgcagcctgttattcataaaacttggagagaaagtgcctttttgtaggaaagtgtggggtgctggcggccatttccacct

SEQ ID NO: 44421 - DNA, 30 bp, Homo sapiens; identical to SEQ ID NO: 15953
  chr16:809500-809530
  hypo

SEQ ID NO: 44422 - DNA, 267 bp, Homo sapiens
  chr16:809787-810054
  hypo
ttcagttgttctctgcggaagggagtttttaaaaggcccttaatcccttcttgacatttgtaagttgacgcttacacctggcagccttgctgaattctgtgtgcgtgaaggtccgattccaccgcgagtcacgatagaaaacccactctgtggagagaccagagatgaccgccgcgcacacctccgttcagcacacaaacctttgcaggtgttcatagcggaggcagattccgtactggggataagagctcacgacatgctgggagg

SEQ ID NO: 44423 - DNA, 193 bp, Homo sapiens
  chr16:816004-816197
  hypo
gaagaaggggtcaaacgaactccggccctgacccctgacccctgtgccctgcagagacagcctgtccttcaggcaagaaggcccgcgagatagacgagagcctcatcttctacaagaagtgggagctggaagcctgcgtggatgcggccctgctggccacccagatggaccgcgtgaacgccatccccttcac

SEQ ID NO: 44424 - DNA, 19 bp, Homo sapiens
  chr16:822477-822496
  hypo
actccgtctcaaaaaatga

SEQ ID NO: 44425 - DNA, 30 bp, Homo sapiens
  chr16:822951-822981
  hypo
tgatgctccactggccgatctcggtgcggg

SEQ ID NO: 44426 - DNA, 289 bp, Homo sapiens
  chr16:824923-825212
  hypo
gcatgtgggggtctgcggcaccgatgctggacgcgtccatgtcacacaccagggccccgagcagttgctggtcggaggcgctgagtcgcaggcgggccaccccctgcagggccagcaggtcggcgcccagcgggaggctgcctccaatgcaccgggcccatcctgcccaggcgcccaccagacaggccacagccaccccccacacgctccggcccaccccacccagcgcccaccaggcaggccacagccgcacgccacagggcgaccctctggtcgggtagatggctca

SEQ ID NO: 44427 - DNA, 250 bp, Homo sapiens
  chr16:837308-837558
  hypo
aatcctgagtccccacgccccaccccaggactgaccaggtcttaccaatgccaggtaagccttggtcacgcgccgctccttgaagcacctgtacgcgctgccggcggctgccttgtttagggccacgcacagcgccccgctggtggagaaatccagctggtggcagaacctggagtgggacagagtccagagtctgagccactttcctccacagacgccaccgtggggctccggccgccccccctacctg

SEQ ID NO: 44428 - DNA, 537 bp, Homo sapiens
  chr16:845955-846492
  hypo
cagctgtacagcacccgtgaaaagcaacagctggccagcctggtgggcacgatgctcgcttacagcctgacctaccgccaggagcgcacgcccgatggccagtacatctacaggctggagccgtgagtcccccagtgcctggggtgtgctccagggtcatgctccccggctgtgctccatgttcagggcccgcatggggccaggagtctgaaagcacggtcatggcgtctgggggtggcgggccccagcttatcttttgctcagatgtaaccgtgaaggggggtcacttccagctacttgagattggctctgggacctgagttttgctgcagagctgctcccagccttagcacccccacatggaactggagccgggggccccgagagtgactgcactttccaacactccgtttcccgctgtgggatggccatgggggtggtgggggtgaggcatggggcagtggccccggggtcctgctgccccagcgacggcaccaacttgcaggacgctgagtcactctccgtggcagccatcgg

SEQ ID NO: 44429 - DNA, 66 bp, Homo sapiens
  chr16:847020-847086
  hypo
caccgacctgccccacgcaaccatgagcagcggctggagcacatcatgaggcgagcggcccgggag

SEQ ID NO: 44430 - DNA, 53 bp, Homo sapiens; identical to SEQ ID NO: 15959
  chr16:858748-858801
  hypo

SEQ ID NO: 44431 - DNA, 185 bp, Homo sapiens
  chr16:870944-871129
  hypo
tcttttgttcgctgccgcgtgcttgtcaatcaagtttttcatcctatggatccgtcttttgtcagtttaatttgcaggccccagtcgcagaatttaagaggacagaagaatggtcttttgttcccaacagcctccttcaccaccacaaccccactggctgcctcaccttacgtgtgacacgctcg

SEQ ID NO: 44432 - DNA, 79 bp, Homo sapiens
  chr16:882403-882482
  hypo
ggtgtagggtgaaggcgtgagccacagtgcccggcctctctcttttttttagagctgggtctcactctgctgtccaggc

SEQ ID NO: 44433 - DNA, 139 bp, Homo sapiens
  chr16:882542-882681
  hypo
aaagtgctgggacaacaggtgtgagccactgcgcccccctccaggtttagctgtgggatgtttgggctttgaaaggagctgatctgacggagccaggagggctggctgcaggacagagacaggacggctgtcacagcag

SEQ ID NO: 44434 - DNA, 30 bp, Homo sapiens
  chr16:883678-883708
  hypo
agccagagccttggccgggtctaggggagg

SEQ ID NO: 44435 - DNA, 131 bp, Homo sapiens
  chr16:888838-888969
  hypo
tgagtcttgactgagcgtctgaggggcagctgggccccgaggctgatgggaagagccagacgaggcctgggaagatggatccgtcccagtgtggccgcgcggctgtcaggagggcacggggactgggcgcg

SEQ ID NO: 44436 - DNA, 30 bp, Homo sapiens
  chr16:891770-891800
  hypo
cctgctattgcatttcgggagactggtgcc

SEQ ID NO: 44437 - DNA, 233 bp, Homo sapiens
  chr16:894890-895123
  hypo
cagagcctgcctctccgggactgggcttcggccgagcagacaccgcctagctgctctttgaccagcgttctctgctctgcgtctggctggcatcggcggcttgctgagtccagcctggcatctcgctggcatcggcggctcgctgggtccagcctggcgctgacacgtttctgtgctcatttcattttacaaatcaactccccaaggtgaggtgggctcgtgccagcaggtgg

SEQ ID NO: 44438 - DNA, 285 bp, Homo sapiens
  chr16:924548-924833
  hypo
tctccaggcaggcagcggccccagggccccgcggaaccctccggaacagctgtgtaaactgcgtgggaggagggaggctgctcatgccgcaactccccaacggaaggatcacgggaaccaggacaggctccgggggacggtgctcagatgggaacacacggaaccaggacgggatccggggaggcggcgctcagatgggaacacacggaaccaggacaggctccaggcaggcggcgctcagaagtctcagggcactcggctgtcacagcgcggcacaggggagta

SEQ ID NO: 44439 - DNA, 154 bp, Homo sapiens
  chr16:943459-943613
  hypo
ggatgagcccaaagtcggagggagcacccagtgcacacgcgtctcagccccgccccctgcggcacaaagggagccgaggcgcaggccccgtgtgtctcccacacactgcagctcgcctgctgtgaggactcctggggcacgggacaggcttcca

SEQ ID NO: 44440 - DNA, 132 bp, Homo sapiens
  chr16:963266-963398
  hypo
ctgtgaggagcctgacgcgttctgcctgggtaacggggcagtagctcttgtggggaacattcacttccacggccgctgctctccttcctgcgacacagacagcgttggcccaatcagcggagaagctgcatg

SEQ ID NO: 44441 - DNA, 76 bp, Homo sapiens
  chr16:965804-965880
  hypo
gatgagcaccatcaccgggggccggagcaggtgagatgcaggggccggagcacgtgggacgcgggggccggagcag

SEQ ID NO: 44442 - DNA, 30 bp, Homo sapiens
  chr16:968262-968292
  hypo
gccgcgcggcttgttcgtacttggttgccg

SEQ ID NO: 44443 - DNA, 45 bp, Homo sapiens
  chr16:968601-968646
  hypo
aaaagtgctggccatcgtgggctgcggggacgttgtgcccacgga

SEQ ID NO: 44444 - DNA, 77 bp, Homo sapiens
  chr16:981729-981806
  hypo
ctgccgaagctactacgagtcttctgaatttctgcgcgacagtccaaagtgacgtgctgagccgctgcagggtcaga

SEQ ID NO: 44445 - DNA, 30 bp, Homo sapiens
  chr16:1022784-1022814
  hypo
cagcgctccgggctccggctctgcatttgc

SEQ ID NO: 44446 - DNA, 131 bp, Homo sapiens
  chr16:1040337-1040468
  hypo
tcaaagtgaaactggcgaagaaagggccggcctcacgagaccccggggactcagacccagtgagcgcacctcttgctgcctcctgctgtgtctggggcatccacaccgccaccccgcgggaaggcaggacg

SEQ ID NO: 44447 - DNA, 155 bp, Homo sapiens
  chr16:1052472-1052627
  hypo
cacatgtgcacctgccgcagccccgatgtccctccccgggtgaaggaacccacggacgtggctcatccataccgcggaacgtgagccatgaaaaggggcagcctcggctcagccaccgcagggaaggactcgacacacgccgagcagaagaggcc

SEQ ID NO: 44448 - DNA, 30 bp, Homo sapiens
  chr16:1061426-1061456
  hypo
gcggcagggcagagacgcagggcaaagcgg

SEQ ID NO: 44449 - DNA, 32 bp, Homo sapiens
  chr16:1062412-1062444
  hypo
caggcaggcagggtccgcgggatggggagtct

SEQ ID NO: 44450 - DNA, 30 bp, Homo sapiens
  chr16:1072992-1073022
  hypo
cccttcccgctcctccgagtcccagcacct

SEQ ID NO: 44451 - DNA, 42 bp, Homo sapiens
  chr16:1073516-1073558
  hypo
gcatgtttaggctggcgctgccaggcacgttctccacccacg

SEQ ID NO: 44452 - DNA, 51 bp, Homo sapiens
  chr16:1076434-1076485
  hypo
ctatttcaccttcttcgctgtggacaccagaacgttcgcagttgcacatgt

SEQ ID NO: 44453 - DNA, 78 bp, Homo sapiens
  chr16:1077581-1077659
  hypo
gggaacagttgttcccgtgctattttttacccccgtgggctgcgagttctggaacgttccaaacgacagtgacaacgg

SEQ ID NO: 44454 - DNA, 217 bp, Homo sapiens; identical to SEQ ID NO: 15968
  chr16:1081773-1081990
  hypo

SEQ ID NO: 44455 - DNA, 30 bp, Homo sapiens
  chr16:1089739-1089769
  hypo
aactgaggcaggggccgagtgatgtccccc

SEQ ID NO: 44456 - DNA, 30 bp, Homo sapiens
  chr16:1092742-1092772
  hypo
cttcaaggggtggggcgggtggcgtggaca

SEQ ID NO: 44457 - DNA, 69 bp, Homo sapiens
  chr16:1101038-1101107
  hypo
agccacttagcacttcgcaggggccccgaagcccggtgtcggcaaggtgtccgtcgctggagcaggggt

SEQ ID NO: 44458 - DNA, 30 bp, Homo sapiens
  chr16:1103161-1103191
  hypo
acagctgctcttggtcggggctgcagtgag

SEQ ID NO: 44459 - DNA, 134 bp, Homo sapiens
  chr16:1128967-1129101
  hypo
ccctcggcaggggcccgggcggtgctggtgcccgtgctgtacctgctggtgtgtgcggccgggctgggcgggaacacgctggtcatctacgtggtgctgcgcttcgccaagatgaagaccgtcaccaacatcta

SEQ ID NO: 44460 - DNA, 85 bp, Homo sapiens
  chr16:1155111-1155196
  hypo
ggggccagcagcaggcgggtctcagcggcggtgctaccacctcccactcaggctccaacttccagccgcgcgtgtcctacggctg

SEQ ID NO: 44461 - DNA, 206 bp, Homo sapiens
  chr16:1166561-1166767
  hypo
agtgcatcggagggacgccaggtctgcgggcggcaggcagatagcctggccaggccctcacatgcccaccgccagcaccagcctggaaatggacctggaggggccgggctccacccggcacttagaccaaagagccctgaaaatagacgcagagaaaatcagccacggctcccaggccccagaggtcctcccgggagcaggacgtg

SEQ ID NO: 44462 - DNA, 67 bp, Homo sapiens
  chr16:1171222-1171289
  hypo
ggcgacacccctccacgcacccgtagtggccaagcccacctccgggggttcccgggccccagagtgg

SEQ ID NO: 44463 - DNA, 143 bp, Homo sapiens
  chr16:1173250-1173393
  hypo
gttctgagcagcccccggcacctggggccgatctacaggtgcattttgtacatagaatctgacccacaggttgtttgttggataaggggaaaatcccggaatccaggaggcccgtgcgccttcacctccggcctcccgcgcgc

SEQ ID NO: 44464 - DNA, 33 bp, Homo sapiens
  chr16:1188925-1188958
  hypo
caagagctccgcttcccacgtcctcaccaacgc

SEQ ID NO: 44465 - DNA, 152 bp, Homo sapiens
  chr16:1195670-1195822
  hypo
tgaccccggcccctccgcacaggcccccgccccgggtctggctcagctggttcctcagatgtccctgggcggcctggcaccttctctgaggagcccccgggtgaaattcccccaaaaacacacactctaggcccacgcgtggtcatctgtgg

SEQ ID NO: 44466 - DNA, 308 bp, Homo sapiens
  chr16:1217195-1217503
  hypo
cccgtggggatgaaacgggctctttgcggggggcctgtggggtatgggcctcctgtcagcagcccgtcccggtgggtggggcttgccggccgcccgcgaatgtcaggaaccttggattcctgacacacgggtgcgggggcgatatcggcgcggagcgggcggggtggcgcccgggccgcgggtgggagaatctggcgtgtgtgtttgcacggcatccatccctccatccgtcctctggagaatttcaacacccacacttggaataaaaaaaaaaattattaatgagcttggtgcggttgccatgggaa

SEQ ID NO: 44467 - DNA, 156 bp, Homo sapiens
  chr16:1217908-1218064
  hypo
ccagtgcgtggagcacgtggggcctcaggagccaggcctgttccccggggctgcctggaggcggccgcttgtccccaaggcctggtgaccgcacctctgtctgccctaggccttcgagttgggggacattttgtaaggagccgctgtgcctaggcc

SEQ ID NO: 44468 - DNA, 30 bp, Homo sapiens
  chr16:1220508-1220538
  hypo
cccgacaccggcctgcggacccccacaagc

SEQ ID NO: 44469 - DNA, 30 bp, Homo sapiens
  chr16:1222610-1222640
  hypo
gcttctgtaattaaacgatttattattaaa

SEQ ID NO: 44470 - DNA, 151 bp, Homo sapiens; identical to SEQ ID NO: 15975
  chr16:1228780-1228931
  hypo

SEQ ID NO: 44471 - DNA, 283 bp, Homo sapiens
  chr16:1230013-1230296
  hypo
cgtgagccaccatgcccggcccggccttgttttttaatatacatctggttgccgggtgatactgagggggccgggctctgcaggcacagggctgaggggcgtcgtgtggatggacggccagcccgttgggtgccctggctgggtccctgtccctgcacaccgggtcagccggctcctgggtgcacaggcaggtggtgtgcgtccgcattgcagaacacggggcgttgcaggccggagctgggttttcacacagattgagaccaggcgtcgcccacagagcata

SEQ ID NO: 44472 - DNA, 205 bp, Homo sapiens
  chr16:1236691-1236896
  hypo
tgcccgtggcaccaccgcctcctcaacgggtggccacgtaatgcttcctggccggtgaatgtgccacggcagtggagatattctgcccttctagctcttctgtatacaagcagtgcgccctggttctcagggccgtgaccaccaccatgaccggcagacttcagggcggtccgtcccactcccgtggcctcgagggtcctttgga

SEQ ID NO: 44473 - DNA, 30 bp, Homo sapiens
  chr16:1245806-1245836
  hypo
aggtcctccgggtgccgggctggccggttc

SEQ ID NO: 44474 - DNA, 424 bp, Homo sapiens
  chr16:1248466-1248890
  hypo
caccagggggtggcccgagtcagtgtgcagtgggcgtggacacccactgtgaacagtggacggggctcgggggtcccgggaggggctgcagccccgaggacactcctgcagggcttagcagtgccaatcctggccctgctgcccacaggcatgcggatcctggtcactctgctgctggatacgctgcccatgctcgggaacgtccttctgctgtgcttcttcgtcttcttcattttcggcatcgttggcgtccagctctgggctggcctcctgcggaaccgctgcttcctggacagtgcctttgtcaggtgcccaggccccacccccgtgaggcccctgcccagatggccctgcccaccatgcagataacgcaccatgtggctccaccgccccacgtggctctgcccaccgtgcagtcacccgc

SEQ ID NO: 44475 - DNA, 79 bp, Homo sapiens
  chr16:1250278-1250357
  hypo
ggccgtactaccagacggaggagggcgaggagaacccgttcatctgctcctcacgccgagacaacggcatgcagaagtg

SEQ ID NO: 44476 - DNA, 100 bp, Homo sapiens
  chr16:1251693-1251793
  hypo
tggtggtgattgccacgcagttctcggagacgaagcagcgggagagtcagctgatgcgggagcagcgggcacgccacctgtccaacgacagcacgctggc

SEQ ID NO: 44477 - DNA, 51 bp, Homo sapiens
  chr16:1253065-1253116
  hypo
cgggggtgtgtcccccgtggtggggagaggtgcgagcgagggtgccgaggg

SEQ ID NO: 44478 - DNA, 32 bp, Homo sapiens
  chr16:1259204-1259236
  hypo
tgaggacggcagggccgcgcccgggccccgtg

SEQ ID NO: 44479 - DNA, 38 bp, Homo sapiens
  chr16:1261601-1261639
  hypo
gccaggtgggctgggcggccgggcgggagctgggggtc

SEQ ID NO: 44480 - DNA, 133 bp, Homo sapiens
  chr16:1262013-1262146
  hypo
cgtgctcaacatgttcgtgggcgtcgtggtcgagaacttccacaagtgccggcagcaccaggaggcggaggaggcgcggcggcgagaggagaagcggctgcggcgcctagagaggaggcgcaggagtaaggcg

SEQ ID NO: 44481 - DNA, 47 bp, Homo sapiens
  chr16:1262447-1262494
  hypo
ggagggctccaggcccgagtgcgccacgccctcggccctcagaccat

SEQ ID NO: 44482 - DNA, 52 bp, Homo sapiens
  chr16:1265614-1265666
  hypo
ctcagcgcaggcccccggaagacggggttgcagggagcgcctcgccgtcccc

SEQ ID NO: 44483 - DNA, 30 bp, Homo sapiens
  chr16:1267184-1267214
  hypo
cgagtctcgtgttgacgcagaggcatgtgc

SEQ ID NO: 44484 - DNA, 577 bp, Homo sapiens
  chr16:1267961-1268538
  hypo
caccttcagcaacttcggcatggccttcctcacgctgttccgcgtgtccacgggggacaactggaacgggatcatgaaggtacccgccgcggccatgcctctggcacctggcagccccagcggtttttcaggctctcccaggaacgggtcggatccgtccttgcagggcagggggaaggggacggcactgccagggtggcacccgcgggtgggtgtggaccccggcccacagctgtcccccaccgcaggacacgctgcgcgagtgctcccgtgaggacaagcactgcctgagctacctgccggccctgtcgcccgtctacttcgtgaccttcgtgctggtggcccagttcgtgctggtgaacgtggtggtggccgtgctcatgaagcacctggaggagagcaacaaggaggcacgggaggatgcggagctggacgccgagatcgagctggagatggcgcagggccccgggagtgcacgccgggtggacgcggacaggcctcccttgccccaggagagtccgggcgccagggacgccccaaacctggttgcacgcaaggtgtccgtgtccaggatgct

SEQ ID NO: 44485 - DNA, 150 bp, Homo sapiens
  chr16:1270207-1270357
  hypo
ggcctcggacccagccgacgaggaggtcagccacatcaccagctccgcctgcccctggcagcccacagccgagccccatggccccgaagcctctccggtggccggcggcgagcgggacctgcgcaggctctacagcgtggatgctcaggg

SEQ ID NO: 44486 - DNA, 30 bp, Homo sapiens
  chr16:1271505-1271535
  hypo
gggccttcccagaagcgtcctgtgactctg

SEQ ID NO: 44487 - DNA, 38 bp, Homo sapiens
  chr16:1272194-1272232
  hypo
cctggcaggcatccccggggccccgggcacacagcatg

SEQ ID NO: 44488 - DNA, 30 bp, Homo sapiens
  chr16:1288468-1288498
  hypo
agtaacacccaagagcgatgggcaatccct

SEQ ID NO: 44489 - DNA, 39 bp, Homo sapiens
  chr16:1307000-1307039
  hypo
cggagaccttccccccggggatgccgtgctgggtcactg

SEQ ID NO: 44490 - DNA, 267 bp, Homo sapiens
  chr16:1312443-1312710
  hypo
cccgaacatcctgatcgctccccagccagtcacccagcactggtccttcggggtgagctccagcgagaccggggagagcttgaccgtcctgacattagcggctcagatcatggggctcaccagctggagcagggccacatccgcacccagccccgcagtgacatagttggggtggacgatgatccggctgacgttcagcagcccccggcccccgtagagatacacgtccccagcgtggatccggtagatggacgggtcggtgtcctt

SEQ ID NO: 44491 - DNA, 133 bp, Homo sapiens
  chr16:1315371-1315504
  hypo
gagggagtgggtccccgaggctgggcctgcagctgtgaaatcctctgcagccagacttccacctgcatgcccagccctgcacctccctgcatggggaggagagaagccccaggctgcccgagatggactccca

SEQ ID NO: 44492 - DNA, 44 bp, Homo sapiens
  chr16:1323678-1323722
  hypo
ggactcacgtgtagacgccaatgctgggccgatcactgtaaaat

SEQ ID NO: 44493 - DNA, 127 bp, Homo sapiens
  chr16:1323976-1324103
  hypo
caccaggaaaagcatcgtaggtctgccgctcacagtctgcattgctcagtgtgaggaccttcacctgctgcgggcggtaaggaggcggcagcatatctgcagagacaagccacgggtggcgggagca

SEQ ID NO: 44494 - DNA, 30 bp, Homo sapiens
  chr16:1329677-1329707
  hypo
gacagctagctcatccgtgggctctgggaa

SEQ ID NO: 44495 - DNA, 191 bp, Homo sapiens
  chr16:1391751-1391942
  hypo
tggactccctgaccccggcctgggcagagcctcgccggggaccctcatgggcatctctgttctccttgtagcgagattgaggatgtgagcacggaccagctgcacctggacatctggtacaggcccctgcgccatgcagggcggcggggatgcacaccttttgcgggggagcaggacggactcagggcccg

SEQ ID NO: 44496 - DNA, 30 bp, Homo sapiens
  chr16:1397121-1397151
  hypo
gatggcctttccccacgcttcctgggagct

SEQ ID NO: 44497 - DNA, 311 bp, Homo sapiens
  chr16:1397548-1397859
  hypo
ctgaaggaggagctgcggctgcacaaatgttccacccgcgagtgcatcgagcagttctacctggacaagctcaaacaggtagggaggcgccagggacagggtgctgcctccgaggctcccagagcccagctgcgctcacccgcctttccgcagaggaccctggagcagaaccggtttggacgcctgagcgtccgttgccattacgaggcggctgagcagcggctggccgtggaggtgctgcacgccgcggacctgctccccctggacgccaacggtgagttgcagcggggacgggtcgggtggtggtggga

SEQ ID NO: 44498 - DNA, 83 bp, Homo sapiens
  chr16:1407453-1407536
  hypo
agtcacccagcacctcgtgtgtatttcgactttattattattattattattattattagagccgagtgtcgctgtgtcgccca

SEQ ID NO: 44499 - DNA, 142 bp, Homo sapiens
  chr16:1407776-1407918
  hypo
gtgctgggatgacagtcatgagccaccgcgcctggcctcgactttattattaatacggtaaaactacagagagtttgaaacatcagtctggggcgtcctcctctaaccagtgcacttgctgctgcagcgcaggcccttcagg

SEQ ID NO: 44500 - DNA, 282 bp, Homo sapiens
  chr16:1417076-1417358
  hypo
ccagagcaggactcacgccgtccaccgcctccaggtccaggcgcagctgactctgcagcgagtgcagcttcggcaggggaatggtgccgatgtccccacagccccgcagccccggcagtgtggaggctacgcccaggccctccagctcctcctgcagctgcttcacctgtgcctccacctcctccttcttctgcagcgccagctgccggtcgctatcggccacacgggcacgctccttggcctcctgcgcctctcgctgccaggcatcgcagacctgaaacc

SEQ ID NO: 44501 - DNA, 411 bp, Homo sapiens
  chr16:1417675-1418086
  hypo
gactcctcccactgccggatcttcctcttggcctcgtccagctgccgcctgacccgggccagctcagctccgtttggacttgcactcgaagaggatggggggccggcactcaggatgggggaggggctgggggagaagctgccggaaacaaagtcccagatgctcccggggacaccgttcaaacctgagtgtgaaacggtcgatgacggcccagccctgctgtgctcgcggcctggtgggattggtgggtgctatgccccaggccccaccgctacgtgggcaccctctggggctcacctgccctggcagcaggggtgcagccacgcctgccccttgccccactcctggaccccaccaggctcaggaagaggcgctgacagtgacacctgccccggccggtctccccaccag

SEQ ID NO: 44502 - DNA, 200 bp, Homo sapiens
  chr16:1425484-1425684
  hypo
tgtccttccccatcccgtcacagaggcagcagggcccagggcagagaacctgaacccctggggcgtccgggacggcacacggcgcatgcgggagtggcctccactcccacggagacaccgttccaatgaagcttttagggactttcgaaggtcttatccagaaactagagtaacaggttgggggtcggggcagccaggcc

SEQ ID NO: 44503 - DNA, 794 bp, Homo sapiens
  chr16:1428113-1428907
  hypo
ccccagaaagctgctcggcctccaagccctgcatggaatgccccccactacatccttgcaggtgtcagcctgaaccatgtcagggccctggacagactcactgaggacaggcaccgaccccccaacccgcaggcctgcccacagccccctcatgctcccatacgggggcttgatgacgggcagggccaagcggtttgcccatagtcaggtcagccaggctcgggaacctggacctgccctctgcacccaagtcccaggatcaggatatggcagccccttcagagctcaccgcccctcacacctggcagagatccagaaactcctcatgaaaatcaaagacgcaaagaagttgggggacaggaacggaggcgccttttctccccttggagtggggtgatcccaccaggctccgtgctaagtcggcagaagcttcacccaccagctgcagagtgcgcagcatgtggaggggctaagctgccttcaatgctcacccgacaaactacggctcgcactcaactcagagggcgtcagccaccacctacctcagccaagtcacctgtgctgaagcccgggaagctgcctggagaggggacgttcagggagcgtgtgggtgcccccgagagactccggccccgcttcaaagccaagtgcccctcatccaaagagagcaccggagagggtcctggaggctccaccacccctagggtgctatctagggctcactcccagaaatcaaggggggagacggctgctgcaccgtcctggcccactttctcacccgcagcttctccccc

SEQ ID NO: 44504 - DNA, 48 bp, Homo sapiens
  chr16:1430200-1430248
  hypo
cttaaatacagaatccgctcatttcttctattccgtgctccagtcaca

SEQ ID NO: 44505 - DNA, 30 bp, Homo sapiens; identical to SEQ ID NO: 15991
  chr16:1486627-1486657
  hypo

SEQ ID NO: 44506 - DNA, 30 bp, Homo sapiens
  chr16:1488680-1488710
  hypo
tggtcagctgggccacggcagcatccaggc

SEQ ID NO: 44507 - DNA, 82 bp, Homo sapiens
  chr16:1491115-1491197
  hypo
tctcaaaacaaaaaacgagtgtcggcctggctttgctgcctctggccctagagagcactcagacacccggactcagggaaag

SEQ ID NO: 44508 - DNA, 30 bp, Homo sapiens
  chr16:1491482-1491512
  hypo
cctccccacccacagcggaggcccctgctg

SEQ ID NO: 44509 - DNA, 101 bp, Homo sapiens
  chr16:1493574-1493675
  hypo
agccctgcagctgcacgcgggcccgcacctggagcagctcccgcagcaggctccgcgtggcgcgctcacagcgctgcttgtgctcccgcaggcaggccacc

SEQ ID NO: 44510 - DNA, 120 bp, Homo sapiens
  chr16:1729690-1729810
  hypo
ccgtctcaaaaaaaaaaaaaaccctttagatttgagggagttaggtcagtattcagtaatacttgtaaccaaataattacccgtggcagggtgcagtgactcaacggctgtaatcccggc

SEQ ID NO: 44511 - DNA, 455 bp, Homo sapiens
  chr16:1730306-1730761
  hypo
tattatcaccctgagcgacgccgatgtttttatattgactttcacgctccagaagttagctgcacagggccgcactaaagtcatactcacactaccctgggggactggtttctggacaaggtgttgagaaagggagaaaactcttccttttaggatggtgaggaaggaaagccggtctgaactggatgatgaggtatcactggaagcttctgcttggggtccaccagacgctgcacatttgccactcatctgaacggggtcgagtcgcagggcgggcgccttgtaagcgtcacatttagttttgctgtgaagcgagtcaggtggtggctgtaagattacctagccaggttttcctctcctgagacctcacatctctcctttccttgctgagggattgtcttgtgttaaaggggtttcgtaaaagcgttatgctttagccgcgattaacctgaggt

SEQ ID NO: 44512 - DNA, 30 bp, Homo sapiens
  chr16:1734955-1734985
  hypo
gcagaagtagtctggcgtctgtaaactagt

SEQ ID NO: 44513 - DNA, 353 bp, Homo sapiens
  chr16:1741726-1742079
  hypo
ctcagggctggcactcggggttcctatgagaggaggtctccaaagcactgcgggggtggggtggggtggggtccggtggacgtctggttgctcagtgttctgtgatcgtttctgcagggggtaaaggaagtggtatctttgacgaatcaacccccgtgcagactcgacagcacctgaacccacctggagggaagaccagcgacatttttgggtctccggtcactgccacttcacgcttggcacacccaaacaaacccaaggtatggactgcattcagacgtgacagcgcagcagcgggtatgccaggtgctctttccaaaaaggctccaaggcagatgcgacatgtttttagg

SEQ ID NO: 44514 - DNA, 262 bp, Homo sapiens
  chr16:1813482-1813744
  hypo
ctgggcacccagtgccgggaaagccacccttcccagctgggcacccggtggccgggaaaaggcgaggatgggcccaggcgggcctccctgccgtgacctcccccaggacaagcctggggcactgtgggggccgctcaccctggacagagacatcacccatcattcttccactcagcgactgcacgtcctccgcccgtcgagagcagaagcgcgagcagtaccgccaggtgcgtgagcacgtgcgtaacgacgacggccgtct

SEQ ID NO: 44515 - DNA, 55 bp, Homo sapiens
  chr16:1813946-1814001
  hypo
aggggtctggagggtcggagaaggagccccgcggctcccacgcccccacctgcct

SEQ ID NO: 44516 - DNA, 48 bp, Homo sapiens
  chr16:1814297-1814345
  hypo
gcagctgtggtgtgccgcgggcgtcaacctgagcgggtggaggcccaa

SEQ ID NO: 44517 - DNA, 30 bp, Homo sapiens
  chr16:1831357-1831387
  hypo
cctgcccatcagagtcgtagccccagttag

SEQ ID NO: 44518 - DNA, 39 bp, Homo sapiens
  chr16:1833960-1833999
  hypo
tgggattacaggcgtgagccacggcgcctggcccagtgc

SEQ ID NO: 44519 - DNA, 30 bp, Homo sapiens
  chr16:1946973-1947003
  hypo
gttataattggctcccgccagccctgtctc

SEQ ID NO: 44520 - DNA, 30 bp, Homo sapiens
  chr16:1962525-1962555
  hypo
ctgtgcaatccctgccgtcctcgcttccag

SEQ ID NO: 44521 - DNA, 96 bp, Homo sapiens
  chr16:2028658-2028754
  hypo
ggaaacccataaaggcgcactgccctagccggtccggcctctctccagtccatcctgaacccctggaaaacccataaaggccgctctcctggccgg

SEQ ID NO: 44522 - DNA, 225 bp, Homo sapiens
  chr16:2028972-2029197
  hypo
ctggccagggagatccgccctccccgctcctccccagccctgggatggcgcggtccatcccctcatcgggatcctcgcgctcactgctccgtcgtggggtgcggcacagagtccacgcaccctcgagggcggccctggcgccgtgggcgccgctccagggccctgcgtgtgacggtgcagcagcggctctggatggcgcccggcgaaggtcgggtgggcacggtg

SEQ ID NO: 44523 - DNA, 200 bp, Homo sapiens
  chr16:2105061-2105261
  hypo
gctgggggtggggaacgcccaggagtctggtgatgtcggcgtctcccagcctcgggttgggccctgagtgtacggcatacacacttctgctgccgcctcggcacagaccctctgtgcagccccaggggcggtagatcctagtgtccgtgcgtagccggcctgccctgggctcccctgagcctcttcgggcccagtgcgtg

SEQ ID NO: 44524 - DNA, 119 bp, Homo sapiens
  chr16:2129118-2129237
  hypo
tccacctggagctcacggaaacctgtctggacatgatggctcgatacgtcttctccaacttcacggctgtcccgaagaggtccaggcggcactacagggctgggcgggcctgcgggagc

SEQ ID NO: 44525 - DNA, 102 bp, Homo sapiens
  chr16:2145625-2145727
  hypo
aaaggagccacgggacgcgctggaggctgcagtgaggaaggacgcagaggggtccaggacaaacccaagcctccgacctggtcagcccgaagcactgtccga

SEQ ID NO: 44526 - DNA, 30 bp, Homo sapiens
  chr16:2146363-2146393
  hypo
gggcatggcagagcccggggtcacacgcgt

SEQ ID NO: 44527 - DNA, 23 bp, Homo sapiens
  chr16:2151275-2151298
  hypo
cgcccggccgacagtttttaaaa

SEQ ID NO: 44528 - DNA, 112 bp, Homo sapiens
  chr16:2193270-2193382
  hypo
gatccctgcacctgccgtgaggccatgtgtgtcactctgaggctgccgggagagcctgcagccaggagccctgatgctgcctcctccaatggctaagcggacaccctcactc

SEQ ID NO: 44529 - DNA, 142 bp, Homo sapiens
  chr16:2212716-2212858
  hypo
cctcatggggtgctgcgcatgggcctcgaggtggacagtgcaggtgggcccggggcaggagtcctgggcacgtggccttcctccccacagggagctcagcttcaagccggggctcggctgcgctatccgctgccagcaggag

SEQ ID NO: 44530 - DNA, 52 bp, Homo sapiens
  chr16:2213671-2213723
  hypo
agccgcctgcctgcccgggcctctgcatacctgggatcggggtgaaggacct

SEQ ID NO: 44531 - DNA, 30 bp, Homo sapiens
  chr16:2229690-2229720
  hypo
gacaggcggcttggccggcttccgggcttc

SEQ ID NO: 44532 - DNA, 231 bp, Homo sapiens
  chr16:2229967-2230198
  hypo
tggttctgcttggcccggatgcgcctcttgagtgtggcgctggcttccaccttggccaagggcgggccttcgacacccgcctcgcccttggagggaccccgaggccgctgccggccagtgccatcctccacaaaggggcctgggtctgccgactccccaggcccccggcgggcagtggccagaagtccggtgactggcccgctgagcgtgcggcgccggttcaccacctcc

SEQ ID NO: 44533 - DNA, 605 bp, Homo sapiens
  chr16:2230512-2231117
  hypo
gcgcttgggtgggggcggcgggggccccttctttcggggccgcacggcaaaggactggctgcggttgacgttcttgtcggcacctgcgggcgccctcactgagtggctgcggcccacgcgccgctggaccgtggcataggggccggcagccgcaggcaccagcagctcgtcccgctccggctcgctgtcggacgccgcatagcgattcaggctgtgggcccgcttcttgggccgccccggctccgcgtcggcctcagggggcaggcacagtgtgggcacagccgtcggcacgggtgggggcgcaggccccggggcagccggccccacctcgccctccacgggctggggcagcacgtaggcaaagccgcggtgcgtcggtgactgaggcagggagcggggtgacatggggcgctctgtcggcggcagcagctgcggggtgggcttcaccttggccgtagctggggctggaccatgaggtcccccaagggcctggggagagcctggtcgggttttggtgggcgtctgggggggcgtgaagtggctagtgcctggtgggaggacctgccgtggcttgccaggcacggggggcacgctggccctcttga

SEQ ID NO: 44534 - DNA, 81 bp, Homo sapiens
  chr16:2232745-2232826
  hypo
caccttcttcaggcccggaacccatcccactgcacaggcacctccctgttgttttgctttgtttgagacggagcctcgctc

SEQ ID NO: 44535 - DNA, 141 bp, Homo sapiens
  chr16:2233066-2233207
  hypo
cgtgagccaccgcgcccggccgcacctccgtgttaatgacgattggccatggcgtgtgcaggtatcgctgagaatgggggtgtcagctattggtgagggccacacgtgcggtggagcatgtgtgcacgcacacaagctggt

SEQ ID NO: 44536 - DNA, 725 bp, Homo sapiens
  chr16:2234314-2235039
  hypo
ggcctcgggctggaccggaaggtgggctctgtgcccacaggcaggggcaccttgcctcctccaccgtgcaggactcagccagcagcttacagctctccggcacacgagtgcactcacacaccatacgccgtgcccatgcacacgctgcaccatctcatacccatccccttccacctgtacacagacacgcgtgcccagctcgcagtcccaccatcacacacacacacgcacacacagaggcacaggttggcccacacgcacagcctgcacaatgacgacacccgtacacacaggcagacacacacacaacacacagactgacagacagaggagagggtctggcctggcaatgcccccgaccccgccgctgccaggccaggcaggccgtgtaagcacccatcagcccatcggccttacagcctctccccggagcccacgctgagaacacccccaagccctgtaccttgccctccgatgctggctccagcttcttgggcggctgctccccatagacctgcccggcgtgggccactggaggctgggaccgggccacacctgaggacgagagtgggtgggggacaagggctgtcgggctgctttcctccatcgggctgcgtggcagcacccttgctcttacctgcagagccttccggaggcttggcggggctgtcccccgggccggactcagagacggacttctgggaaagcaccgttgccaggagctg

SEQ ID NO: 44537 - DNA, 51 bp, Homo sapiens
  chr16:2237472-2237523
  hypo
ggcaaggtggacaggcggggccttccagcaggaggccggccccagcacccc

SEQ ID NO: 44538 - DNA, 387 bp, Homo sapiens
  chr16:2278383-2278770
  hypo
gtgcacagatgcggccgctgccaggcagagttcaccgccttggaggattttgttcagcacaagattcagaaggcctgccagcgggcccctccggaggccctgcctgccacccctgccaccacagcgttgctgggccaggaggtgagccctcacccactcccccatcccctcccgggttcacctgacaggtgggggaggtggccgcgcttcaggatggacctgtgcagccggttccgggggccacgtgggcgggcagagggcaggcacctggctgcggtgtgggagggtccgggtgtgtgagcctgtggtgctctggggcgtcctggagggcctgcggtggcccagccttcttggcagcctctggtcgaagcccgtgctgttgggggc

SEQ ID NO: 44539 - DNA, 30 bp, Homo sapiens
  chr16:2281284-2281314
  hypo
cgtctcctctggcctcgcagcagccatgtt

SEQ ID NO: 44540 - DNA, 33 bp, Homo sapiens
  chr16:2294623-2294656
  hypo
gggagcccaggtgcacgacgcacagcagggcca

SEQ ID NO: 44541 - DNA, 30 bp, Homo sapiens
  chr16:2324195-2324225
  hypo
cagcctcctgagctgcggatcattttccta

SEQ ID NO: 44542 - DNA, 30 bp, Homo sapiens
  chr16:2436229-2436259
  hypo
cggcatcgccctcatcgcaggctccaaggt

SEQ ID NO: 44543 - DNA, 34 bp, Homo sapiens; identical to SEQ ID NO: 16004
  chr16:2466336-2466370
  hypo

SEQ ID NO: 44544 - DNA, 56 bp, Homo sapiens
  chr16:2474253-2474309
  hypo
gaccccgtggcccggcgcctgttctggaatgctgtggcacacgcccacgagtctgg

SEQ ID NO: 44545 - DNA, 174 bp, Homo sapiens
  chr16:2497879-2498053
  hypo
cgtctgcagcccccacgctggcaggtgtagtccctgcgcctcttgtcctcttggtcaagtgaatgacgcatgcaacctgcagagtccccaggacagagcagccaagggacttggcctcagtccaaggggaaggtgccttgcggggggccgctggagcagcgtgttccctgatag

SEQ ID NO: 44546 - DNA, 16 bp, Homo sapiens
  chr16:2508540-2508556
  hypo
gcgcctggcccccaaa

SEQ ID NO: 44547 - DNA, 59 bp, Homo sapiens
  chr16:2531804-2531863
  hypo
agccacagttaggcacgtttgcacttccaaccatcacaggcaggcgggccaaccggccc

SEQ ID NO: 44548 - DNA, 37 bp, Homo sapiens; identical to SEQ ID NO: 16006
  chr16:2540828-2540865
  hypo

SEQ ID NO: 44549 - DNA, 48 bp, Homo sapiens
  chr16:2546458-2546506
  hypo
tactgcctgaatgcacgcggcgagggggccgtgcgcaagatcctcctg

SEQ ID NO: 44550 - DNA, 76 bp, Homo sapiens
  chr16:2589044-2589120
  hypo
aaatttaattgatcccgtgtcttccaggatgcggcttttttttttttttttttttgatggagtctccctctcgacg

SEQ ID NO: 44551 - DNA, 120 bp, Homo sapiens
  chr16:2731629-2731749
  hypo
tatttgtattgaattcatgttcggggccacgttgttatatgtattgatatacagccttgaatgtgaataattactatatattttacaacttttttctggctttattacaaaaactttctt

SEQ ID NO: 44552 - DNA, 82 bp, Homo sapiens
  chr16:2762758-2762840
  hypo
ccccgcctgcagccacgactgacccacgaggcacaccagggggccgcccgagtcgccctgcgggggacgcagagtcaccgtc

SEQ ID NO: 44553 - DNA, 598 bp, Homo sapiens
  chr16:2764111-2764709
  hypo
cgtctcaaagatcaccgaggggtcaggcaggcacacggggaggatgtaattggtgaagggcactggtgcctccagctccaccagggccacgtcagcgctggaggccgtgccctggtacagggggttgctctccacctgcctcacccgggcatacatagcgtgtggtcccggctgcactagctgccttgcccccagcaggacctggtacagggacgtctcagaggtgctggcgggagaaacagagaggcggcgtgaggcggcccctcgtgtggggacaggcccgggaggggctggggctcctctggccaccaccgtgccccacacctctctctgcacaatgtcttcgagagtcatctctaggacagccaggtgcagcggtgatgcgtgttgacattgaagccagaccgcccgactcagatttccacctccacccctggccgctgtgtggccttgggcaagtcacttaacaagttctctgtgatgcagctttctcacctgtgctgtggggacagtcacagtgcctacctgaaaggctggctcggagagaaccaccctccaggtgcagcagggccagccccacctgcgggcctctggcagg

SEQ ID NO: 44554 - DNA, 399 bp, Homo sapiens
  chr16:2770122-2770521
  hypo
cagcagcagcaggagcggcaccgccgccggccgcctcatgtcctcaggcctggctggggcgcagggccgtggtcggcggtggcagaagcgttggagcacgagcgaggtgcaggctccatgaagtggagttttatgctggagatgagcacaggcccggctatgcggcccaacccgtcggcccggcctgcccagctcctctcctcaggaaggaagcgcccagagccgactcctccgtgacctagccctgaaccccgagaccccagggcagacccctcaccccagcgcagcacggggtgccgttggcctcggttcctggaccctgagctgacccagaccccccagcagaccccgagctgaccgcggtgcacgcgaagtccgtccagcttcattcattattat

SEQ ID NO: 44555 - DNA, 133 bp, Homo sapiens
  chr16:2806261-2806394
  hypo
gacttgggtgtggggcggtaagtggttagtttggggccaggggcctgacccgtgtctccccgctccccctcaggagcggtggtgccccccccgggcacggggccatgtacaacgggatcgggctgccgacgcc

SEQ ID NO: 44556 - DNA, 30 bp, Homo sapiens
  chr16:2849391-2849421
  hypo
cattgtgaaccctgacgcacttggggtttt

SEQ ID NO: 44557 - DNA, 30 bp, Homo sapiens; identical to SEQ ID NO: 16011
  chr16:2877506-2877536
  hypo

SEQ ID NO: 44558 - DNA, 138 bp, Homo sapiens
  chr16:2975835-2975973
  hypo
cgttgtctccggagccgaccaggccttcgggagtggaatgtggggccccaggccagggaactttggatcaaagtgggagaccagtgggaactggagctgcagcatgtgaggtgggggtgaggacgctgaaaatgtcag

SEQ ID NO: 44559 - DNA, 34 bp, Homo sapiens
  chr16:3021547-3021581
  hypo
tgcaggccctggctgcgcccggctgccctggtgg

SEQ ID NO: 44560 - DNA, 30 bp, Homo sapiens
  chr16:3139240-3139270
  hypo
tcttcccgcactccacgcactcctgcgggg

SEQ ID NO: 44561 - DNA, 30 bp, Homo sapiens
  chr16:3142599-3142629
  hypo
ctccccatccctgagcggctgcccctgcag

SEQ ID NO: 44562 - DNA, 30 bp, Homo sapiens
  chr16:3151067-3151097
  hypo
tcagggactggcctccgtgtagagctgctc

SEQ ID NO: 44563 - DNA, 37 bp, Homo sapiens
  chr16:3211673-3211710
  hypo
acctccctcagctcccgtggtgcgcccgggggaaatg

SEQ ID NO: 44564 - DNA, 120 bp, Homo sapiens
  chr16:3211830-3211950
  hypo
aaaccccacctctgcaaaacaattttaaaagttagcagggcgtggtggtgcgcgcctgtgatccaagctactcctgtgtctgaggcaggaggatcgcttgagcctgtctcaaataaacaa

SEQ ID NO: 44565 - DNA, 30 bp, Homo sapiens
  chr16:3286293-3286323
  hypo
gcactgatcagggttcggacaacttgtggg

SEQ ID NO: 44566 - DNA, 86 bp, Homo sapiens
  chr16:3492669-3492755
  hypo
gtatcaaaaaaaaaaaaaaaagaacttttaaaagtagccagacactgtggtatgcgcgcctctcagatactcgagaggctgaggcg

SEQ ID NO: 44567 - DNA, 33 bp, Homo sapiens; identical to SEQ ID NO: 16015
  chr16:3598920-3598953
  hypo

SEQ ID NO: 44568 - DNA, 108 bp, Homo sapiens
  chr16:3696694-3696802
  hypo
ctaattacacatttgcgagatgttctgagagctgtggggacggctgggacatgtacctggaagcagggcagccaaagggagaggcagtgatgacgggtggtatggagg

SEQ ID NO: 44569 - DNA, 30 bp, Homo sapiens
  chr16:3925449-3925479
  hypo
agcccacacacgtcacgctgaggataacac

SEQ ID NO: 44570 - DNA, 37 bp, Homo sapiens; identical to SEQ ID NO: 16016
  chr16:3957870-3957907
  hypo

SEQ ID NO: 44571 - DNA, 76 bp, Homo sapiens
  chr16:4203919-4203995
  hypo
tctcaaaaaaaaaaaaaaaaaaagaactgatcaatgagccgccagatgccgagcaccacaccggcaagggctgcgg

SEQ ID NO: 44572 - DNA, 30 bp, Homo sapiens
  chr16:4264664-4264694
  hypo
cgtggaccgggcaaacgtgggccagcagcc

SEQ ID NO: 44573 - DNA, 30 bp, Homo sapiens
  chr16:4308074-4308104
  hypo
cccgacggctcctcccggctctggtccatg

SEQ ID NO: 44574 - DNA, 34 bp, Homo sapiens
  chr16:4385394-4385428
  hypo
gtaagaggccggggccgggcggcttggcccatga

SEQ ID NO: 44575 - DNA, 66 bp, Homo sapiens
  chr16:4410920-4410986
  hypo
ccccacctctgcagccgtcctacctggtcttggtggccctgcagcttcagccgatcagctccagcc

SEQ ID NO: 44576 - DNA, 30 bp, Homo sapiens
  chr16:4474675-4474705
  hypo
tgacacacttttcatcgatgttcagtttga

SEQ ID NO: 44577 - DNA, 30 bp, Homo sapiens
  chr16:4655417-4655447
  hypo
tgtaagatgcccctgcgaccaagggctcca

SEQ ID NO: 44578 - DNA, 30 bp, Homo sapiens; identical to SEQ ID NO: 16018
  chr16:4840446-4840476
  hypo

SEQ ID NO: 44579 - DNA, 84 bp, Homo sapiens
  chr16:4841600-4841684
  hypo
agaagtctgactcaccggaaccactccctgccacagcctcctcctcctgttactgtcctgcctgggactgggcggggctctgtg

SEQ ID NO: 44580 - DNA, 223 bp, Homo sapiens
  chr16:4846233-4846456
  hypo
cctgtgtctcctgcccggtggcagtaacaaagccttctgtctgcccagagcctgagtctgcagtgtcttccagtccccgtctgggtgggtgacgcgggactcgccgccccactcaggtggccacctggcctctccaagccttcagtcagcacgactgtgccaggtcatcctcagtcacctagctgggaggggagctggtctcaggccgggcgcggtggctcac

SEQ ID NO: 44581 - DNA, 44 bp, Homo sapiens
  chr16:4846780-4846824
  hypo
ggcttcttggcagcccgagggtcccctctcgacagtaggttctg

SEQ ID NO: 44582 - DNA, 30 bp, Homo sapiens
  chr16:5090604-5090634
  hypo
ccttgagccgggagccggaaggaatgcact

SEQ ID NO: 44583 - DNA, 30 bp, Homo sapiens
  chr16:5115567-5115597
  hypo
ctctctccttatagccgaggcaggctatac

SEQ ID NO: 44584 - DNA, 30 bp, Homo sapiens
  chr16:5130557-5130587
  hypo
gagtggtttggaacccgcgccatatgctct

SEQ ID NO: 44585 - DNA, 41 bp, Homo sapiens
  chr16:5412627-5412668
  hypo
gctgggattgcaggcgtgagccaccgcgccaggccacatca

SEQ ID NO: 44586 - DNA, 30 bp, Homo sapiens; identical to SEQ ID NO: 16020
  chr16:5439313-5439343
  hypo

SEQ ID NO: 44587 - DNA, 141 bp, Homo sapiens
  chr16:5541176-5541317
  hypo
caaaaaagcaatcaacgcaagagtacagctggatgaattgtcacagtgtgaacacatctaggacgccagcacccacttgaagaactggaatattaccagccaccccgagccacccacctagcgactcggcagccaccctcc

SEQ ID NO: 44588 - DNA, 152 bp, Homo sapiens
  chr16:5559744-5559896
  hypo
taaggccaagatgggcgcatacacaggggagtggatggacccaggaggtactcttggaggcaaagttgacagggcttagtgatgggtatataagtaagggagtgcggggtgtcccagatggtgcccaagaaccttggcgcagacgagtggag

SEQ ID NO: 44589 - DNA, 30 bp, Homo sapiens
  chr16:6186354-6186384
  hypo
gccgtattccagatacgtgtgagccatatg

SEQ ID NO: 44590 - DNA, 30 bp, Homo sapiens
  chr16:6314961-6314991
  hypo
tctgataagagcaaacgcttgacacccaac

SEQ ID NO: 44591 - DNA, 161 bp, Homo sapiens
  chr16:7489023-7489184
  hypo
ttcagcggaaaccaccgcactttgttttgttgagccaacgcagagtctctctgtgcactctcagtgtgcacagaggagcatggtcctcgcgctggcaaatggatgcccttgtccttctgcttaagtcttctttacgcaggccttcgcgctgtgtcgtcttc

SEQ ID NO: 44592 - DNA, 34 bp, Homo sapiens
  chr16:8222706-8222740
  hypo
aagtggctaggctcacggccgccttccaacttta

SEQ ID NO: 44593 - DNA, 147 bp, Homo sapiens
  chr16:8781004-8781151
  hypo
ggacgcacatctggacggaaagtgtttgccgagagcacttggccgcctgccctcccacggagcaggtgctagtcttgggtcccgctcttccgggttcttcagaagctgagctccggtctgtaatcccagcactttgggaggctgagg

SEQ ID NO: 44594 - DNA, 30 bp, Homo sapiens; identical to SEQ ID NO: 16022
  chr16:8870353-8870383
  hypo

SEQ ID NO: 44595 - DNA, 29 bp, Homo sapiens
  chr16:8963909-8963938
  hypo
gggtgcggtggctcacgcctgtaattcca

SEQ ID NO: 44596 - DNA, 76 bp, Homo sapiens; identical to SEQ ID NO: 16023
  chr16:9005728-9005804
  hypo

SEQ ID NO: 44597 - DNA, 30 bp, Homo sapiens; identical to SEQ ID NO: 16024
  chr16:9010029-9010059
  hypo

SEQ ID NO: 44598 - DNA, 208 bp, Homo sapiens
  chr16:9888740-9888948
  hypo
tactagagttgtgcacgggcaactatggtgatgatgagaaggagaaggatgaagaggaggaggagggtggtggtgatggccatgatgatggtggtgatgatcgtggtaatgaggatgatggcaatggtcatgatgatgatgatgatgacggtgatggtggtggtgatgataatgataataatgatatcagaggcgtgtgaaccagaac

SEQ ID NO: 44599 - DNA, 47 bp, Homo sapiens
  chr16:10721519-10721566
  hypo
tgttggccttgatggcgagctcgtgctccagccggcacttggtcatg

SEQ ID NO: 44600 - DNA, 30 bp, Homo sapiens; identical to SEQ ID NO: 16025
  chr16:10804588-10804618
  hypo

SEQ ID NO: 44601 - DNA, 30 bp, Homo sapiens
  chr16:11712101-11712131
  hypo
ttggaagagacattccgttctgccactgtg

SEQ ID NO: 44602 - DNA, 20 bp, Homo sapiens
  chr16:11808484-11808504
  hypo
gactccgtctcaaaaaaaaa

SEQ ID NO: 44603 - DNA, 42 bp, Homo sapiens
  chr16:11853669-11853711
  hypo
taagaaaaaaggtcccgggccgggcacggtggctcacgcctg

SEQ ID NO: 44604 - DNA, 33 bp, Homo sapiens
  chr16:12012098-12012131
  hypo
ggtgtgagccaccacacccggcagagtttgcct

SEQ ID NO: 44605 - DNA, 27 bp, Homo sapiens
  chr16:13064659-13064686
  hypo
tgtgagccaccgcgcctggccggggca

SEQ ID NO: 44606 - DNA, 147 bp, Homo sapiens
  chr16:13676585-13676732
  hypo
atttgtttatattctaactacagccccagaaagatagtcatcattaatccctactttacagaggaggaacccggggcttagagaagggaattgaactgcccaggctcatattgctaggagttagccaagctgcgtatgaaacgacta

SEQ ID NO: 44607 - DNA, 32 bp, Homo sapiens
  chr16:14464204-14464236
  hypo
ccaggctgggcgtggcgcgccaagcagcaggc

SEQ ID NO: 44608 - DNA, 21 bp, Homo sapiens
  chr16:14724506-14724527
  hypo
aatgggatccgggtgcggtgg

SEQ ID NO: 44609 - DNA, 85 bp, Homo sapiens
  chr16:14725771-14725856
  hypo
tgaactgggaagcagcgtattaataaatctgtataaataactgtttaatgggggcctggcgccatgactcacacctgtaatccca

SEQ ID NO: 44610 - DNA, 30 bp, Homo sapiens
  chr16:14728494-14728524
  hypo
ggcaacatagggagacgctgtctcttaaaa

SEQ ID NO: 44611 - DNA, 48 bp, Homo sapiens
  chr16:14761842-14761890
  hypo
agcctgtgggtggcacgagcaaggactgacatccgcacagggaggatt

SEQ ID NO: 44612 - DNA, 30 bp, Homo sapiens
  chr16:15052961-15052991
  hypo
taaattacttcattacgttgatgcttcatc

SEQ ID NO: 44613 - DNA, 106 bp, Homo sapiens
  chr16:15241283-15241389
  hypo
gcaaccctgcagtgccgtgatgagctatggagagacaagaacacagagggctcagcgcagggcccggcgtggccaccgcggggagagggtgcggactcttcctaga

SEQ ID NO: 44614 - DNA, 30 bp, Homo sapiens
  chr16:15555102-15555132
  hypo
cactcctggcaggagcgacccccgggctca

SEQ ID NO: 44615 - DNA, 80 bp, Homo sapiens
  chr16:15595921-15596001
  hypo
ggttagggcatttgccgaggtcggccgttagaaagatgccggaccatctactcatgtctgcttgacgccaatgcctgcgt

SEQ ID NO: 44616 - DNA, 42 bp, Homo sapiens
  chr16:15604294-15604336
  hypo
tgggcagagcaggtgcggcggtcataacgagggcaattgcaa

SEQ ID NO: 44617 - DNA, 47 bp, Homo sapiens
  chr16:15692124-15692171
  hypo
gctgcctttattccacggctctcacctggagccgtggtaagagttaa

SEQ ID NO: 44618 - DNA, 22 bp, Homo sapiens
  chr16:15708051-15708073
  hypo
agtttcggccaggtgcggtggc

SEQ ID NO: 44619 - DNA, 42 bp, Homo sapiens
  chr16:15762689-15762731
  hypo
gttgacattggagcccggatcatcctccgttgggagggactg

SEQ ID NO: 44620 - DNA, 92 bp, Homo sapiens
  chr16:15820825-15820917
  hypo
gcctggcccaggacccgcagctccccggccaggtctgcgttctctttctccagcgtctgcttattcttgtctaggttcgccttggcctggcg

SEQ ID NO: 44621 - DNA, 16 bp, Homo sapiens
  chr16:17049595-17049611
  hypo
ccggccacaacagatt

SEQ ID NO: 44622 - DNA, 30 bp, Homo sapiens
  chr16:17341523-17341553
  hypo
aagtggcagaggggccgcaagtcttttgag

SEQ ID NO: 44623 - DNA, 100 bp, Homo sapiens
  chr16:17866410-17866510
  hypo
agagaattagtgcagcgtaggaaattagccttcttcctgactcctcatacactcttcatgtctaaagttgacttcttctattgctgcttttttttttttt

SEQ ID NO: 44624 - DNA, 146 bp, Homo sapiens
  chr16:18802485-18802631
  hypo
ttaattaaaaagttaagttcagacaaaagtcacccaacagttgtttactgagcacccatgtaccagacgctagcaaggccctggggtacgaggtgcccacacaggcaccatttagccagttctgtccctgccggttcttccagctt

SEQ ID NO: 44625 - DNA, 37 bp, Homo sapiens
  chr16:18804505-18804542
  hypo
atagtacagcagaaacggttcccggggcaatgggtgc

SEQ ID NO: 44626 - DNA, 30 bp, Homo sapiens
  chr16:18950653-18950683
  hypo
ttacatgctgcaccccgcactttaaatgac

SEQ ID NO: 44627 - DNA, 37 bp, Homo sapiens
  chr16:18950981-18951018
  hypo
tacaggcgtgagtcaccgtgcccggccctcctgcaac

SEQ ID NO: 44628 - DNA, 31 bp, Homo sapiens
  chr16:19534839-19534870
  hypo
cgtaagccatcacgcccggtgggttcagcaa

SEQ ID NO: 44629 - DNA, 30 bp, Homo sapiens
  chr16:19708504-19708534
  hypo
gattgggctctttgccgtcggctctgctgc

SEQ ID NO: 44630 - DNA, 30 bp, Homo sapiens
  chr16:19929817-19929847
  hypo
gtgagccaccgatcccggtcggaaatttat

SEQ ID NO: 44631 - DNA, 194 bp, Homo sapiens
  chr16:20327311-20327505
  hypo
ggctaggtcgatggccggtacttcactgcggacttgacttcttgagcaagactgtagggatgatgaacttttattatatcaaaatttaaatgcctggattctatctagactgctcctacaatgggcagctctggaccaagaactgtgtccagaactggttcacgctatggccctaattccgatgctgtggttat

SEQ ID NO: 44632 - DNA, 35 bp, Homo sapiens
  chr16:21539162-21539197
  hypo
tccccagaccaatggcgctgcgagcttctggggcg

SEQ ID NO: 44633 - DNA, 18 bp, Homo sapiens
  chr16:21541457-21541475
  hypo
agcttgatccagacccga

SEQ ID NO: 44634 - DNA, 38 bp, Homo sapiens
  chr16:21566671-21566709
  hypo
agtggggtctggagtcggacgcacgttcagaggctggg

SEQ ID NO: 44635 - DNA, 33 bp, Homo sapiens
  chr16:21719131-21719164
  hypo
ttcttgatggagtgtcgctctgttgccaggctg

SEQ ID NO: 44636 - DNA, 30 bp, Homo sapiens
  chr16:23093885-23093915
  hypo
cagaagcatgactcccgttaagtgccactt

SEQ ID NO: 44637 - DNA, 30 bp, Homo sapiens; identical to SEQ ID NO: 16032
  chr16:23303315-23303345
  hypo

SEQ ID NO: 44638 - DNA, 30 bp, Homo sapiens
  chr16:23444796-23444826
  hypo
cccgaggcagtcacccgttcccttgtcacc

SEQ ID NO: 44639 - DNA, 29 bp, Homo sapiens
  chr16:23606614-23606643
  hypo
tcactgcctcccggcgtttcagcctcacg

SEQ ID NO: 44640 - DNA, 91 bp, Homo sapiens
  chr16:23716327-23716418
  hypo
gcagctggcgcaggccgtcctggtgccaggtgtagacgcccatcacaggcacgcccaggtcctgtgtccacagcaccgtcccgcttcctgg

SEQ ID NO: 44641 - DNA, 151 bp, Homo sapiens
  chr16:23990960-23991111
  hypo
cgggggtgaggaaagcgggggaggctttctcctggaacagtgagatgaatgacaaacacacatgtaactgcactgtgtgagttgagagtgtgggctctagaggaagacaaactggtttcaaatacaagtgttaacacggactagctgaaca

SEQ ID NO: 44642 - DNA, 33 bp, Homo sapiens
  chr16:24013932-24013965
  hypo
tacaggtgtgagccactgcgcctggccagcata

SEQ ID NO: 44643 - DNA, 30 bp, Homo sapiens
  chr16:25077168-25077198
  hypo
gtgagccaccgtgcccggcctaagtagctg

SEQ ID NO: 44644 - DNA, 28 bp, Homo sapiens
  chr16:25692519-25692547
  hypo
ttaagatatgtaggccgggtgcggtggc

SEQ ID NO: 44645 - DNA, 16 bp, Homo sapiens
  chr16:26388437-26388453
  hypo
ccgtctcaaaaaaaaa

SEQ ID NO: 44646 - DNA, 42 bp, Homo sapiens
  chr16:26664733-26664775
  hypo
gggattacaggtgtgagccaccgcacccggcccttttgtcca

SEQ ID NO: 44647 - DNA, 30 bp, Homo sapiens
  chr16:26732577-26732607
  hypo
cacagcaaaactgagcgctgttcatctttc

SEQ ID NO: 44648 - DNA, 32 bp, Homo sapiens
  chr16:27038943-27038975
  hypo
tgtgtctttatcagcagcgtgaaaaaggacta

SEQ ID NO: 44649 - DNA, 36 bp, Homo sapiens
  chr16:27279055-27279091
  hypo
tttttttttttgagacggagtttcgctcttgttgcc

SEQ ID NO: 44650 - DNA, 40 bp, Homo sapiens
  chr16:27853439-27853479
  hypo
ttcacatcagtagcacgatgtcgcgcgtgccgaatttcac

SEQ ID NO: 44651 - DNA, 103 bp, Homo sapiens
  chr16:28560175-28560278
  hypo
ccatgtagaatgaagcgagcccagacatcattgtcgccctccgcaacggtgcatctgtgctcccatttttgcaagaaaaattattttctttttctttttcttt

SEQ ID NO: 44652 - DNA, 78 bp, Homo sapiens; identical to SEQ ID NO: 16035
  chr16:28878714-28878792
  hypo

SEQ ID NO: 44653 - DNA, 26 bp, Homo sapiens
  chr16:28947344-28947370
  hypo
cccgtccgcctcgcaatttgaactcc

SEQ ID NO: 44654 - DNA, 91 bp, Homo sapiens
  chr16:29009366-29009457
  hypo
agcagggactacaggcgtgcaacatcatgcccacttaattgtttgtattttctgtacaaacagttttctgtgacaccccgtctctactaaa

SEQ ID NO: 44655 - DNA, 34 bp, Homo sapiens; identical to SEQ ID NO: 16036
  chr16:29139111-29139145
  hypo

SEQ ID NO: 44656 - DNA, 102 bp, Homo sapiens
  chr16:29153203-29153305
  hypo
catggcacaagggagcggtggaataatcctctgtggcacgcgggggggggtgtggaataatcctccgtggcacgagggggtggtggaataatcctccgtggc

SEQ ID NO: 44657 - DNA, 162 bp, Homo sapiens
  chr16:29153365-29153527
  hypo
gagggggcagtggtataatcctctgtggcacgaggggtcggcggtataatcctccgtggcacgaggatggtcaccgcattcgtcactcttagctgcagtgcgtgtgacagtcgccagggctgctgtttgaggaatgggagttgcctgcgtctgctctgcccc

SEQ ID NO: 44658 - DNA, 96 bp, Homo sapiens
  chr16:29244717-29244813
  hypo
ggaagggccctgagccgggtgccacggccgacgccctgtcctttgccgtgacagtctctgtgcagtgcaggcagcccccaccgaatccaggtacag

SEQ ID NO: 44659 - DNA, 30 bp, Homo sapiens
  chr16:29262965-29262995
  hypo
ccaggattatagtggcgaggcagggtgtta

SEQ ID NO: 44660 - DNA, 30 bp, Homo sapiens
  chr16:29266418-29266448
  hypo
atcaaggagcctgcccgggggtgccagcca

SEQ ID NO: 44661 - DNA, 34 bp, Homo sapiens
  chr16:29324812-29324846
  hypo
cgtccaggatctcagcgtgcggggggcatccggg

SEQ ID NO: 44662 - DNA, 73 bp, Homo sapiens
  chr16:29691644-29691717
  hypo
ctggtcacattccaacgcttcaaggaagtgtttcagcccagagcattctgtgtaaagccgcagagcaggtcat

SEQ ID NO: 44663 - DNA, 171 bp, Homo sapiens
  chr16:29830952-29831123
  hypo
gaggagcagatccttcgtaccgggagggacctcttcagcctggactcggaggaccccagccccgccagccccccactccgatcctccgggagtagtctcttccctcggcagcggaaatactgattcccactgctcctgcctctagggtgcagtgtccgtacctgctggagc

SEQ ID NO: 44664 - DNA, 433 bp, Homo sapiens
  chr16:30017228-30017661
  hypo
gcgggggcctggggccgggctctgagcactgcccgggtgtgcagatgatggggggtttgcatatttgcagggactagcgagtcaggcaggaggtttgcatatgtgaatatagaactccgcagcccctcatgagcagacagacccgggtcacggagactcacaaaaataggtagtgcagggtgggggcagcccaccctgtgtaaacgtgcaacacactcgtgcgaaggttgggtactggacccggctcgatgggcctgtgccgggacactgctgtccactcaggctgaggacagagccccggccgcagggggcagctcactggtcagggtgtgccagcgctccagggctgcgtccggctgctgcaggcagtcactccagtgcttccgagcctcgcctcgggcacctggccccagggacacgccacctggggagc

SEQ ID NO: 44665 - DNA, 67 bp, Homo sapiens
  chr16:30116248-30116315
  hypo
gataatccgttatgacgccagtggctcccacgctgaaggctgcttcaaaatccgactcttcattaag

SEQ ID NO: 44666 - DNA, 346 bp, Homo sapiens
  chr16:30124515-30124861
  hypo
cagcatcttcttcctcgtccacaccctgccctgccacttcgctctccttctctcttggtccctgccccgtttctagcatgcccccttggacctacccctctgtgctgtccactttggcacctgttctcacccctacccggctcacctcctcggtgggcccccaggcggatgcggaaggtgggagccctgggcgtgtgcagcagatgaggccggcgcaggaagaagatggagagcatggcatagctgcccagggcagggagggcatagtacagcaaaaggctcatgaccgtactcccacagaagctcctgcagccacacgctcagccgtccgcgggactgtgctgcc

SEQ ID NO: 44667 - DNA, 30 bp, Homo sapiens
  chr16:30354712-30354742
  hypo
cagggtcaggggcttcgcggagaaggcgga

SEQ ID NO: 44668 - DNA, 30 bp, Homo sapiens
  chr16:30430132-30430162
  hypo
gttcacgatcagacacgcactgcattcggc

SEQ ID NO: 44669 - DNA, 32 bp, Homo sapiens
  chr16:30567477-30567509
  hypo
ttgaatcccacagcccgcgtggacagggacag

SEQ ID NO: 44670 - DNA, 30 bp, Homo sapiens
  chr16:30803924-30803954
  hypo
gttcctggccaggtgcggtggctcacacct

SEQ ID NO: 44671 - DNA, 39 bp, Homo sapiens
  chr16:30826344-30826383
  hypo
attaccggcgggagccaccgctcccgtccaggacaggga

SEQ ID NO: 44672 - DNA, 76 bp, Homo sapiens
  chr16:30906986-30907062
  hypo
tccagcaattgctcacggcaatacacacacccactcacacgaacacacgcacacacatgcacgcgcacatgcacac

SEQ ID NO: 44673 - DNA, 196 bp, Homo sapiens
  chr16:30907122-30907318
  hypo
gcacacacgtccgcatgcacgcacacacgcagacacacgcaagcgcacacacacacgggcctcctcgtcttcattcacaaaccccattagcttctgttgtctatgggcttcctcgacagaccgcgagcccctcgcgggggccagaaaccaagtatggatcatccctatgtgccttcctttccgtctacaccaggtt

SEQ ID NO: 44674 - DNA, 30 bp, Homo sapiens
  chr16:31018076-31018106
  hypo
agagggaacagcatgcgcgaaggtccttgg

SEQ ID NO: 44675 - DNA, 120 bp, Homo sapiens; identical to SEQ ID NO: 16045
  chr16:31138607-31138727
  hypo

SEQ ID NO: 44676 - DNA, 39 bp, Homo sapiens
  chr16:31149942-31149981
  hypo
gtctatggcgggcagcgagggcagcgggtctgagcaggg

SEQ ID NO: 44677 - DNA, 144 bp, Homo sapiens
  chr16:31373926-31374070
  hypo
ctcaggttactccaccgagctggccctctggaaaggggtgcagagcctggtcctgggggccccccgctaccagcacaccgggaaggctgtcatcttcacccaggtgtccaggcaatggaggatgaaggccgaagtcacggggac

SEQ ID NO: 44678 - DNA, 30 bp, Homo sapiens
  chr16:31384803-31384833
  hypo
gtgccatctggggcacgcctctgctcgtgt

SEQ ID NO: 44679 - DNA, 337 bp, Homo sapiens
  chr16:31446888-31447225
  hypo
gtgtgagtcaccgcccgcagccgcacctgcctaaatcccttaatgtataagggaaaggagcgagaattcaggggaaaaaaaacaaacaaaatagcccccagcacttctgagaaagatctgccatacagaaaagccgtcctgagcgggtctgtgtggagggaggggactgcatctcagatccacagtccaccggcggctgcaacaattccacccagggctgcagcacgctggttcttcagtgtcgggccaggttggacctccggctggaggccttccacaccggaaacactggtagggctcctctccagtgtgggttcgagggcggtggaggagctcg

SEQ ID NO: 44680 - DNA, 92 bp, Homo sapiens
  chr16:31500544-31500636
  hypo
cccagctttcctctgcggcgtgcactacctctacttcgccattgtgctgttcttctgctctggcctcctcaccctcacggtctccctgtgca

SEQ ID NO: 44681 - DNA, 33 bp, Homo sapiens
  chr16:31526376-31526409
  hypo
tagagatggggaggccgggtatggtggctcatg

SEQ ID NO: 44682 - DNA, 16 bp, Homo sapiens
  chr16:31658246-31658262
  hypo
aatggaaggactgggc

SEQ ID NO: 44683 - DNA, 30 bp, Homo sapiens
  chr16:32485550-32485580
  hypo
tgggaacatggtgtccgcactcccggctag

SEQ ID NO: 44684 - DNA, 18 bp, Homo sapiens
  chr16:33396766-33396784
  hypo
tatgagatggattttcgc

SEQ ID NO: 44685 - DNA, 120 bp, Homo sapiens
  chr16:33893446-33893566
  hypo
cgatgattccatttgcttccatttaattccattcgatgattcaattggatgtcattcgatgattccataagattccctttgatgatgattctattccgtcctttcaatgatgataccaat

SEQ ID NO: 44686 - DNA, 92 bp, Homo sapiens
  chr16:33897833-33897925
  hypo
atgattccatttgcttccatttagttccatttgaagattacattggatgccatttgatgattccataagattccattcgatgatgattctat

SEQ ID NO: 44687 - DNA, 30 bp, Homo sapiens
  chr16:34983961-34983991
  hypo
gaagctaggcagggtcgagcctggctgggg

SEQ ID NO: 44688 - DNA, 79 bp, Homo sapiens
  chr16:46721647-46721726
  hypo
aagggccaaaggggccgccaacacttgctttcggatgcaaaagtgcgacaccaagaagactaagcgagctgcctaaatt

SEQ ID NO: 44689 - DNA, 37 bp, Homo sapiens
  chr16:46803066-46803103
  hypo
tcgggcggtggctaacgcctgtaatcccagcactttg

SEQ ID NO: 44690 - DNA, 120 bp, Homo sapiens
  chr16:48642029-48642149
  hypo
acatacatcctttctttctgacattctccgagcgttttattactattaatggtttttttccgattctcaagaacacggttttcaccgtgtgacacaggacagtctcaatctcctgatctc

SEQ ID NO: 44691 - DNA, 30 bp, Homo sapiens
  chr16:49500178-49500208
  hypo
catgggatttgggctcgcattaagtgattt

SEQ ID NO: 44692 - DNA, 30 bp, Homo sapiens
  chr16:49533007-49533037
  hypo
ggtttgcctcatttacgcagatggcagggc

SEQ ID NO: 44693 - DNA, 161 bp, Homo sapiens
  chr16:49545215-49545376
  hypo
aggtgaggcccacttcgagaccctgcacccagagacctacccttggcttctaagggctttgagagtcatctccaaccccactgcctcagcccgcaggctgcgaacacaggcactcatgtcagactgcctggcctcacatttctccacgctggcagctatgt

SEQ ID NO: 44694 - DNA, 90 bp, Homo sapiens
  chr16:49623675-49623765
  hypo
cactgaagccgggaacgctacagtgggataattacttggctcccacacagctgagttccatagatgcattattaacggcacattcctcgc

SEQ ID NO: 44695 - DNA, 30 bp, Homo sapiens
  chr16:49634741-49634771
  hypo
gccgaaataaatcaccgtcgctcaggaggg

SEQ ID NO: 44696 - DNA, 30 bp, Homo sapiens
  chr16:49638060-49638090
  hypo
tcagcaccccgctggcgggcacccgggccc

SEQ ID NO: 44697 - DNA, 19 bp, Homo sapiens
  chr16:50070334-50070353
  hypo
ccaccgtgcctggcctctt

SEQ ID NO: 44698 - DNA, 80 bp, Homo sapiens
  chr16:50218595-50218675
  hypo
gaataatgctgccatcatgcttgagggtttttttttattttgttttgttttgtttgtggggggagcggagggcacagtct

SEQ ID NO: 44699 - DNA, 30 bp, Homo sapiens
  chr16:50335767-50335797
  hypo
tttcactctggtcctcgctatgccttgggg

SEQ ID NO: 44700 - DNA, 30 bp, Homo sapiens
  chr16:50336356-50336386
  hypo
gcaggctgcctgggccgacttgaatttcag

SEQ ID NO: 44701 - DNA, 152 bp, Homo sapiens
  chr16:50336625-50336777
  hypo
ccacagggattttcacggacaccgagtgaactgcgagtccccccacccttcttgctaaggtggcagtggcgggccccatggtcgcgcaccctgcatttttcctaccttggggacatccctcctgtgtgcagggtgctcgtctgtagctcctg

SEQ ID NO: 44702 - DNA, 30 bp, Homo sapiens
  chr16:50958718-50958748
  hypo
gcaacaaagctgttccggttacagttctac

SEQ ID NO: 44703 - DNA, 34 bp, Homo sapiens; identical to SEQ ID NO: 16051
  chr16:53448517-53448551
  hypo

SEQ ID NO: 44704 - DNA, 200 bp, Homo sapiens
  chr16:53563454-53563654
  hypo
ccttcatatagcaatcggctcctcttatcccccaggcaactggctgcctttcacctccgcggcacagcaattatgtggtgtaatggaggcagcgcaaataagcagaaagattttattaaaccaaatgagcaaatcatctgcgtattattgcgatttgattgacactgacaagtgtcgagcagacgcggatgtgaatatga

SEQ ID NO: 44705 - DNA, 221 bp, Homo sapiens
  chr16:55203739-55203960
  hypo
tacatagagttagagcgcatattttattaatgttcatcctttagagaccagatttgtgcgttcgctaaaataaacactacagtctttagggcgtggttgggtggagactgcagaagtatgagggcaaagaacattttgcaaggaagtagccactccagagccatcgtcgggtgatgggaggcgcccagagctgggatccagggacccggagtcttgcatct

SEQ ID NO: 44706 - DNA, 30 bp, Homo sapiens
  chr16:56460223-56460253
  hypo
atgctacaataggaacgaaccttaaacacg

SEQ ID NO: 44707 - DNA, 27 bp, Homo sapiens
  chr16:56774935-56774962
  hypo
ggagagggagagcgctaaatttctttt

SEQ ID NO: 44708 - DNA, 63 bp, Homo sapiens
  chr16:57222193-57222256
  hypo
tactagtgtttggttcgtcgtacttgttagagatggttttccaaatatcgggcaatcatttcc

SEQ ID NO: 44709 - DNA, 21 bp, Homo sapiens
  chr16:57222700-57222721
  hypo
tacaggcgtgagccactgtgt

SEQ ID NO: 44710 - DNA, 30 bp, Homo sapiens
  chr16:57321322-57321352
  hypo
tcagatagtgacaaacgctgtgactaaagt

SEQ ID NO: 44711 - DNA, 30 bp, Homo sapiens; identical to SEQ ID NO: 16055
  chr16:57759922-57759952
  hypo

SEQ ID NO: 44712 - DNA, 122 bp, Homo sapiens
  chr16:58120963-58121085
  hypo
tctctccagcatccacgactacaggtgatggccacgctactcccatgtcctcacatgcacctgggttacgtcagcggcagccatgcgtgcacatgcacactcacacacgcacactcacactc

SEQ ID NO: 44713 - DNA, 21 bp, Homo sapiens
  chr16:58462002-58462023
  hypo
atacatcgtggacatccttcc

SEQ ID NO: 44714 - DNA, 39 bp, Homo sapiens
  chr16:58548346-58548385
  hypo
agtaacagaccaggccgcgcgcggtggctcacgcctgta

SEQ ID NO: 44715 - DNA, 30 bp, Homo sapiens
  chr16:58886327-58886357
  hypo
aaaaaaaagaggggacgttgaaagtggcca

SEQ ID NO: 44716 - DNA, 33 bp, Homo sapiens
  chr16:58932088-58932121
  hypo
tttgcctaggctgagcgcagtggtgtgatctca

SEQ ID NO: 44717 - DNA, 35 bp, Homo sapiens
  chr16:58969757-58969792
  hypo
ctgtaggtagtggaacgaagcgatgttccaaattt

SEQ ID NO: 44718 - DNA, 30 bp, Homo sapiens
  chr16:59046529-59046559
  hypo
ggaaccccatgtattcggttaatttttttt

SEQ ID NO: 44719 - DNA, 174 bp, Homo sapiens
  chr16:67241603-67241777
  hypo
gttgatgccagggcacgtggccacatccaacacccggagctgcctgcacgcctgcccaatagcatccagtgtcctgtggggaggccacctgatgagtgcctggcccggtgtgggacccagcccagcccctgcaccgtggctccatctgcctggtgtcatcggacacacttactg

SEQ ID NO: 44720 - DNA, 93 bp, Homo sapiens; identical to SEQ ID NO: 16057
  chr16:67313865-67313958
  hypo

SEQ ID NO: 44721 - DNA, 48 bp, Homo sapiens
  chr16:67578633-67578681
  hypo
gcatgggccctggagcggctgctgcgggaagcccgagtactggaggca

SEQ ID NO: 44722 - DNA, 27 bp, Homo sapiens
  chr16:68770701-68770728
  hypo
aaaaaattagcctggcgtggtggtgtg

SEQ ID NO: 44723 - DNA, 147 bp, Homo sapiens; identical to SEQ ID NO: 16060
  chr16:68770848-68770995
  hypo

SEQ ID NO: 44724 - DNA, 45 bp, Homo sapiens
  chr16:68787504-68787549
  hypo
gctgggattacaggcgtgagccaccgcgcccggcacatcttacaa

SEQ ID NO: 44725 - DNA, 18 bp, Homo sapiens
  chr16:68876852-68876870
  hypo
tttgagatggagtctcgc

SEQ ID NO: 44726 - DNA, 30 bp, Homo sapiens
  chr16:69133585-69133615
  hypo
attgtgtctcctgttcgttacttaacactg

SEQ ID NO: 44727 - DNA, 30 bp, Homo sapiens
  chr16:69352566-69352596
  hypo
gtgaaggggataatccggagaaaaagaaac

SEQ ID NO: 44728 - DNA, 121 bp, Homo sapiens
  chr16:70380004-70380125
  hypo
aaagaaacgaaaaaacgcattgtgtgttgtgtttattggatggtggaattatggggtttacgggtcttctgttgcgttttggtttttgttttcttacctgttatcgcgttcctaacagtag

SEQ ID NO: 44729 - DNA, 137 bp, Homo sapiens
  chr16:70416085-70416222
  hypo
agttccatttttacacgaagtaggcctggggctcagagctggtgggggcagtcgtccagctgaaattcaactacatacactctccattctatttatgtttttttttcttttctttttcaagacagcgtctcattctg

SEQ ID NO: 44730 - DNA, 126 bp, Homo sapiens
  chr16:70427606-70427732
  hypo
accctcaggtggctccggggtcctggacagggtccactccaacctgctcaccctcccacttgcaccatttcccaacatgaggaaggtcttacatggaatgctgaatgcctccgagacatattgctg

SEQ ID NO: 44731 - DNA, 77 bp, Homo sapiens
  chr16:70595623-70595700
  hypo
catcgggttttgcctcggaacagtgtcccgagggcattgtggccatctccaccaacaccctacggtgagtgagtctc

SEQ ID NO: 44732 - DNA, 50 bp, Homo sapiens
  chr16:70680482-70680532
  hypo
agaaatcagagaaagcgtcacccagccccagattccgaggggcctgccag

SEQ ID NO: 44733 - DNA, 30 bp, Homo sapiens
  chr16:70795276-70795306
  hypo
ctcacagtgccttggcgctcagaagaggaa

SEQ ID NO: 44734 - DNA, 23 bp, Homo sapiens
  chr16:71266650-71266673
  hypo
gggtgcagtggctcacgcctgta

SEQ ID NO: 44735 - DNA, 29 bp, Homo sapiens
  chr16:71841040-71841069
  hypo
actttttgccaggcacggtggctcacgcc

SEQ ID NO: 44736 - DNA, 36 bp, Homo sapiens
  chr16:71919045-71919081
  hypo
actgtgcccggcctggttggacgcacttctagtcaa

SEQ ID NO: 44737 - DNA, 84 bp, Homo sapiens; identical to SEQ ID NO: 16064
  chr16:72461607-72461691
  hypo

SEQ ID NO: 44738 - DNA, 51 bp, Homo sapiens; identical to SEQ ID NO: 16065
  chr16:72957744-72957795
  hypo

SEQ ID NO: 44739 - DNA, 30 bp, Homo sapiens
  chr16:73033457-73033487
  hypo
catgctcacagcaaccgctaaccagaaaac

SEQ ID NO: 44740 - DNA, 30 bp, Homo sapiens
  chr16:73062471-73062501
  hypo
ccaacagacaggggacgattgttagaactc

SEQ ID NO: 44741 - DNA, 30 bp, Homo sapiens
  chr16:73397239-73397269
  hypo
tacgtattttaaaaacgattccaaattcta

SEQ ID NO: 44742 - DNA, 30 bp, Homo sapiens
  chr16:74331835-74331865
  hypo
aatctgattagactccgtctcaaaaaaaaa

SEQ ID NO: 44743 - DNA, 18 bp, Homo sapiens
  chr16:74901527-74901545
  hypo
ctggtccaccctatccgt

SEQ ID NO: 44744 - DNA, 72 bp, Homo sapiens
  chr16:75019649-75019721
  hypo
agaaaaatcaaagctcgtgcaaaccgaagatacctcttctcctgatgcctatcccatcgagatatttaaaag

SEQ ID NO: 44745 - DNA, 308 bp, Homo sapiens
  chr16:75148816-75149124
  hypo
ttcagctccaggattcggtccatatgcgtcaggttaacgcagacgccgccctggttggggcaggtgctaagaccactgcagacctgggtctctgacctggccacgtccccggaccacaccccgcgggtgtccccccagcagccagaccagacccccagaggcaggcagcccacgggcgggagcagacccaaggtgccgtgtgtggcgggggaggcagccacaggtgtgccaaggtgtgctgggaccatcctcgggccgggcgagggagccccactgtacctgcacagcacagacgccaccctcaagcc

SEQ ID NO: 44746 - DNA, 37 bp, Homo sapiens
  chr16:75171636-75171673
  hypo
tacaggcatgagccaacacgcccggccccaaaatatt

SEQ ID NO: 44747 - DNA, 120 bp, Homo sapiens
  chr16:75183598-75183718
  hypo
ggcgtgagccaccgcgtccggccagacacaatttattgatgtaactgttcctctaaatactactttaactacatcactcaaatttttatatcttgtattttcttttctgttgttgttgtt

SEQ ID NO: 44748 - DNA, 29 bp, Homo sapiens
  chr16:75469090-75469119
  hypo
gtgagccaccgcgccgggcaccttcaagg

SEQ ID NO: 44749 - DNA, 38 bp, Homo sapiens
  chr16:75658302-75658340
  hypo
gctggattacaggcgtgagccaccgcacctggctgccg

SEQ ID NO: 44750 - DNA, 30 bp, Homo sapiens
  chr16:75733411-75733441
  hypo
gtaaaatacataaaccgcatccttgttttt

SEQ ID NO: 44751 - DNA, 88 bp, Homo sapiens
  chr16:77247382-77247470
  hypo
tctgttaaatgtgtccgccactctggaggccggcatttgggacccaaatccaaaggcacccagcagcaggctgcggccattgactgag

SEQ ID NO: 44752 - DNA, 30 bp, Homo sapiens
  chr16:77754041-77754071
  hypo
attttattaatatcacggtgtgtacacact

SEQ ID NO: 44753 - DNA, 95 bp, Homo sapiens
  chr16:80644760-80644855
  hypo
gcccccagtggaccccgggcagaccttgctgaggcaggcacaacacagaaggcccagcaccctccccggcatgccaggctcgcaggggccactcc

SEQ ID NO: 44754 - DNA, 59 bp, Homo sapiens
  chr16:80654771-80654830
  hypo
gcagcagtttgctgtcgtctgtggctgcgttgcagagcgctcgccggacttctttcatg

SEQ ID NO: 44755 - DNA, 132 bp, Homo sapiens
  chr16:80704564-80704696
  hypo
taatgacacgaggtgcgcaaacctatttccaggctcattttgccccagggtctcgattttctttctgggacaggatgaaagaaagagaagccatgttgcaacataaaaagtgtgaatcgaggcctcgaggct

SEQ ID NO: 44756 - DNA, 30 bp, Homo sapiens
  chr16:80718633-80718663
  hypo
agtcctgtaagacaccgtcttggtggccct

SEQ ID NO: 44757 - DNA, 19 bp, Homo sapiens
  chr16:81042228-81042247
  hypo
ggcgcgctcccggcccctc

SEQ ID NO: 44758 - DNA, 30 bp, Homo sapiens; identical to SEQ ID NO: 16070
  chr16:81533258-81533288
  hypo

SEQ ID NO: 44759 - DNA, 151 bp, Homo sapiens
  chr16:81569552-81569703
  hypo
cctcccagagagagtcgtgtcacctgagggcccagggaacctcggtgacaagggacctcttgtctgctgtgtgctgtgggctgatgtgatccctgtttgcagtgtaaactcataagcagggacccgaagcatcccccgacccctggctttg

SEQ ID NO: 44760 - DNA, 30 bp, Homo sapiens
  chr16:81627246-81627276
  hypo
gtattgagtgcccgccgaccacctggcgcg

SEQ ID NO: 44761 - DNA, 180 bp, Homo sapiens; identical to SEQ ID NO: 16071
  chr16:81632932-81633112
  hypo

SEQ ID NO: 44762 - DNA, 68 bp, Homo sapiens
  chr16:83968763-83968831
  hypo
gtgtagcacctaaagcgccaatgagactgtgtagaaaaatgtagctgcgtgagcgggagggagttccg

SEQ ID NO: 44763 - DNA, 41 bp, Homo sapiens; identical to SEQ ID NO: 16073
  chr16:84075186-84075227
  hypo

SEQ ID NO: 44764 - DNA, 30 bp, Homo sapiens
  chr16:84129364-84129394
  hypo
cacttctggctccaccgggtttcattgcag

SEQ ID NO: 44765 - DNA, 30 bp, Homo sapiens
  chr16:84152910-84152940
  hypo
tcctagtaaacctgccggtggcactacagg

SEQ ID NO: 44766 - DNA, 30 bp, Homo sapiens; identical to SEQ ID NO: 16074
  chr16:84153364-84153394
  hypo

SEQ ID NO: 44767 - DNA, 30 bp, Homo sapiens
  chr16:84593218-84593248
  hypo
gagccagcacccaggcggagaaagccagaa

SEQ ID NO: 44768 - DNA, 30 bp, Homo sapiens
  chr16:85001619-85001649
  hypo
ctgaaagcataatgccgagtgaaagaagcc

SEQ ID NO: 44769 - DNA, 58 bp, Homo sapiens; identical to SEQ ID NO: 16075
  chr16:85007798-85007856
  hypo

SEQ ID NO: 44770 - DNA, 30 bp, Homo sapiens
  chr16:85010139-85010169
  hypo
aaaagcaagtggcagcggctccaggaagct

SEQ ID NO: 44771 - DNA, 173 bp, Homo sapiens; identical to SEQ ID NO: 16076
  chr16:85028164-85028337
  hypo

SEQ ID NO: 44772 - DNA, 30 bp, Homo sapiens
  chr16:85028787-85028817
  hypo
ttctaccctaatggccgatttaatgggatt

SEQ ID NO: 44773 - DNA, 55 bp, Homo sapiens; identical to SEQ ID NO: 16077
  chr16:85033827-85033882
  hypo

SEQ ID NO: 44774 - DNA, 16 bp, Homo sapiens
  chr16:85043890-85043906
  hypo
gcgctgggattacagg

SEQ ID NO: 44775 - DNA, 51 bp, Homo sapiens
  chr16:85075519-85075570
  hypo
cgattcccgggattccgagcgtttgcccctatgctgcgcactcctgtccct

SEQ ID NO: 44776 - DNA, 214 bp, Homo sapiens
  chr16:85083548-85083762
  hypo
agtggaaggccaagtcggtctctgtccgagttgaattcagctgtcccggagtcagccgctgtgtccttttgtgaaagaagtacagcccgtcacccagggagggcgcgccttatggcgggttctaacacgcagttgcaatggaaccaactcagtcaatggtgatcgctgatggtaaacaacccctcaccctgcactgtctcggtgcctgaaactc

SEQ ID NO: 44777 - DNA, 30 bp, Homo sapiens
  chr16:85318173-85318203
  hypo
cgattctcgggaactcggtgcagatgctgt

SEQ ID NO: 44778 - DNA, 30 bp, Homo sapiens
  chr16:85328964-85328994
  hypo
ttttcaaggttcacgcgtgctgcagcgcgg

SEQ ID NO: 44779 - DNA, 239 bp, Homo sapiens
  chr16:85336342-85336581
  hypo
atctgaacctgagaacgtgatgagctccaggaggtcaattcttggccttggccttgtcgaggtgcggtgtgctgggcagggtgggtgaggtcagcggctgtcacaagtaaccctgcgtcttcagtggcgtgatgcagccgaagcgcattctccttcaatcgggtccaacggggtgctcagtgggtcttccacaaggtgactcggggtccggtttcccggagcctcggcctccccactgc

SEQ ID NO: 44780 - DNA, 68 bp, Homo sapiens; identical to SEQ ID NO: 16082
  chr16:85455150-85455218
  hypo

SEQ ID NO: 44781 - DNA, 30 bp, Homo sapiens
  chr16:85464272-85464302
  hypo
gatagtccccaggtacgggctgggcacagg

SEQ ID NO: 44782 - DNA, 86 bp, Homo sapiens
  chr16:85485769-85485855
  hypo
caccctggcctgcatcggggccccgcaattaagccgattatgttttgagagtcaagctgtctgactcctcgcgtccctaatgtgat

SEQ ID NO: 44783 - DNA, 45 bp, Homo sapiens
  chr16:85516822-85516867
  hypo
tgaaacctgaaaaagcgaggctctctgtcccgagctttcagagga

SEQ ID NO: 44784 - DNA, 135 bp, Homo sapiens
  chr16:85517218-85517353
  hypo
gggatcaagtgtctccgaggcggcgggctgagacggatgggcctcctggccgcacacctgagaacatgctggcaaaagcgtttgcttaattaattgactttgagcgagggagcccgtccccgtgtaaacctagca

SEQ ID NO: 44785 - DNA, 30 bp, Homo sapiens
  chr16:85517571-85517601
  hypo
aggaaacctcctcagcgaccctccccgaga

SEQ ID NO: 44786 - DNA, 70 bp, Homo sapiens
  chr16:85617748-85617818
  hypo
gcgtgcgtgccggtgcgtgggcccctgtctgtttggagaccttcctccccctctgcgtgttccccaagat

SEQ ID NO: 44787 - DNA, 47 bp, Homo sapiens
  chr16:85668941-85668988
  hypo
aggcacaggcaggaccgccagaaaaccctccacgcccttggcagggg

SEQ ID NO: 44788 - DNA, 32 bp, Homo sapiens; identical to SEQ ID NO: 16084
  chr16:85671134-85671166
  hypo

SEQ ID NO: 44789 - DNA, 55 bp, Homo sapiens
  chr16:85673184-85673239
  hypo
aagaggtgtttgccccgagggtgccccgggaacgcctgtgcgtggagccaggccc

SEQ ID NO: 44790 - DNA, 48 bp, Homo sapiens
  chr16:85673838-85673886
  hypo
tccctgcccacacttcgctcccttaacaccggccgggggctcatggta

SEQ ID NO: 44791 - DNA, 144 bp, Homo sapiens
  chr16:85674157-85674301
  hypo
ggtgccacctgaaaccgagatcccagctgagtgagtggggactacgtgtgcggggaccacggagcagggaccacagacccatcctcatgagctgccgtgggaatgcttccaccgtggagccggcctgggcgggggagaggctcc

SEQ ID NO: 44792 - DNA, 541 bp, Homo sapiens
  chr16:85678216-85678757
  hypo
gcccttctttagagacggagagccaatgcgtgcggggcctggggagacgggagtggttgctcatgggtagggggttccttttggggtgacggaaatgctctgaaatggattgtggtgatggtcgcacaactctggacgtgctagaaccgtggggccgcgcgctgggtgggtgaattacgcgggatggaatcatagctcggtgaagctataacaactgaaacccaagagccatggaggttccatggaatttttttttttaaacaacgatcctttccctagtttttattttttttccccaaaaacttaaagtgaactttttctcaaaatctaaatacatacagaaaagcgcctagactgccagtgtccagaacgaacccacagatcaggagggctgaggcctgttctcctgtccccaccctctgcccctgaggtgaggggcgtggtgccccgccctgcagccagcgtttcccctcctcaggtggatctagtagcccgccggcacagtgcccagtcccaggtgttggcccggtcgacttggggt

SEQ ID NO: 44793 - DNA, 531 bp, Homo sapiens
  chr16:85684063-85684594
  hypo
ccactgccttgaccccgaccagagctcctggcctagacccaggacgcctcgaggggattccagcgccttttccggcgactcctccgctctgagctggtccctcctcggagggtccttaccgcctcgggaacattgagctaccccagagcagagcaggggcgcgacaggcccgccccagcagtgtaccaccgcggcgcttaatggaacacggtgccgccagggaaggcgcggggccggcagctggattagcaggtgatgtacggctcctcgctcgggcacagaggctcagcggggcatttaatcctctcggagtggggaggcagagagaggattcccctcccacccggcccaaagctgtggccatgagtctccgaggctgcggacgtgggtggcagttgccgggccggaggcttctcggccccttctcggggtcacccctctctcccaggtgtagtgggagctgcgagaggagaaatgagatgaaaaagcctgttttaaagctaacagggcatgtcccgcctgtctgactat

SEQ ID NO: 44794 - DNA, 61 bp, Homo sapiens
  chr16:85699784-85699845
  hypo
atgcttcactatatccggggcgctgcacccaaggacattcctgtgccgctgtcccacagca

SEQ ID NO: 44795 - DNA, 40 bp, Homo sapiens
  chr16:85721581-85721621
  hypo
ctgaaaacgcaaagccgggcgggcgcgggggctcacaatc

SEQ ID NO: 44796 - DNA, 163 bp, Homo sapiens
  chr16:85731450-85731613
  hypo
tggaagtggtttattcggaatgcagtcccaggaagggaggttgagaccgggaacttgagaaggagctggttcaggttagcgagaaggtttctatggccggcaaccagggctcagttccaccgggaacctctgggcagctatgacgcctcgctcctcagtgtgg

SEQ ID NO: 44797 - DNA, 30 bp, Homo sapiens
  chr16:85741538-85741568
  hypo
aggcagccacgcccccggacacctgaagcc

SEQ ID NO: 44798 - DNA, 30 bp, Homo sapiens
  chr16:85752258-85752288
  hypo
tcactccagccaatgcggtgcgatgattct

SEQ ID NO: 44799 - DNA, 30 bp, Homo sapiens
  chr16:85758266-85758296
  hypo
gaatcatggggatgacgaggataatgggga

SEQ ID NO: 44800 - DNA, 55 bp, Homo sapiens
  chr16:86119064-86119119
  hypo
tgtggaaaaggcctccggactgcctcctgcttggagaagccgcattcctgagaac

SEQ ID NO: 44801 - DNA, 62 bp, Homo sapiens
  chr16:86215345-86215407
  hypo
gccaggccatgagcacgtgctgggctaaggctgcagtgagagacggccgcccaggtcagtga

SEQ ID NO: 44802 - DNA, 45 bp, Homo sapiens
  chr16:86878195-86878240
  hypo
gctgggattacaggcttgagccaccgcgcccggctggtgacttct

SEQ ID NO: 44803 - DNA, 38 bp, Homo sapiens
  chr16:86903475-86903513
  hypo
cggagaggtgatggccgcgcaggcgcagtttggaactg

SEQ ID NO: 44804 - DNA, 30 bp, Homo sapiens
  chr16:87022637-87022667
  hypo
ctatgacacaggtgacgtgcgtgacgcacc

SEQ ID NO: 44805 - DNA, 177 bp, Homo sapiens
  chr16:87092376-87092553
  hypo
tgacaaatatgctctcggatagaacagcccagaaagggcaagagggagagttggaacactcagataattacccttcagcgacgcagtgcacttaagtggtgaaaggagattcactggttggaaaaacactccagggcgaagggccagcgtgtgcaaaagcaccgaagcatgaccgag

SEQ ID NO: 44806 - DNA, 30 bp, Homo sapiens
  chr16:87188016-87188046
  hypo
aagtgcccagtccctcgagatgcttaaagt

SEQ ID NO: 44807 - DNA, 147 bp, Homo sapiens; identical to SEQ ID NO: 16090
  chr16:87296936-87297083
  hypo

SEQ ID NO: 44808 - DNA, 135 bp, Homo sapiens
  chr16:87354991-87355126
  hypo
gcacaaaggctgagccgcaccctgccaaaggagaaaggcagacagactccctgctgggagagcccactccccagacgttctggttgaggctgaactacggggtggagagcagatcaggggcgccaggggctggag

SEQ ID NO: 44809 - DNA, 46 bp, Homo sapiens
  chr16:87356783-87356829
  hypo
acgcatggagcggcccggcgcacgactcacccggccccaaacacca

SEQ ID NO: 44810 - DNA, 85 bp, Homo sapiens
  chr16:87421370-87421455
  hypo
ccacatgcactgggcaatggtgcattccagcctgggcgacagagagaaaaaaaagaaagaaagaaagccacgttaactgtatccc

SEQ ID NO: 44811 - DNA, 130 bp, Homo sapiens
  chr16:87594957-87595087
  hypo
cctaaggattggaaacgaccatcggcaggggacgggttaaaccgattaaggtgactgacaccgcgcagtgatgcgcagccagtgtaacggccctgtggaggacatctaggtgcatcgtctggtagaaggt

SEQ ID NO: 44812 - DNA, 93 bp, Homo sapiens
  chr16:87648265-87648358
  hypo
gcaggtccctgcacacgtgaggagccgcgcgtcccctcccgggataaactctggtccctgcacacacgaggagccgcgcgtcccctcccggga

SEQ ID NO: 44813 - DNA, 112 bp, Homo sapiens
  chr16:87688591-87688703
  hypo
tttgttgcagtcccccgggggcatggcccggcaagtttccttagccaggggccagtttgcctggggtcagtgggcagcgcctgggagtcgagtgtctcgagtggggctctgc

SEQ ID NO: 44814 - DNA, 30 bp, Homo sapiens
  chr16:87701846-87701876
  hypo
cggagccggcacatgcgtctgacagcagcg

SEQ ID NO: 44815 - DNA, 171 bp, Homo sapiens
  chr16:87723156-87723327
  hypo
tgaggttccctctggcgccctggcccggggaccgcggcctcgctgtggaatgtgctgggtaacgccgtctggcgtcgtcttgtgtccccatacagggctggagtaccagaggccgaagcgtcagacctcctgtgacgacatcgaggtgctgtccaccgggacacccctgca

SEQ ID NO: 44816 - DNA, 507 bp, Homo sapiens
  chr16:87723606-87724113
  hypo
gcgcggcggcctgctcgtggatgacttccgcacccgaggttcgggccgcaagcagcccgggaaccccaagccgcgggagcggcggacggagtcaccccccgtgttcacgtggacttcccaccaccgggccagcaaccacagccccggaggctccaggctgctggagctgcaggaggagaagctgagcaactaccggatggagatgaaacccttgctgaggatggagacgcatccccagaaaagacgctacagcaagggcggcgcctgccggggcttgggggacgaccaccgccccgaggaccggggcttcggggtgcagagactgcggtccaaggcccagaacaaggagaacttcaggccggcctcctccgcggagcccgccgtgcagaaactggcgagcctgcggctgggcggggccgagccccggttgctgcgttgggacttgaccttctccccgccccagaaatccttgcctgtcgctctagagtccgacgaggagaatgggga

SEQ ID NO: 44817 - DNA, 48 bp, Homo sapiens
  chr16:88101496-88101544
  hypo
cttcccgcagttacacgttgcacggggcctccccgtagcatccactgt

SEQ ID NO: 44818 - DNA, 86 bp, Homo sapiens
  chr16:88164472-88164558
  hypo
cgcgtgggaaggccccgcggagtgggggtgtgaagtggccgcggggtgtcggcagagacaggcggaagtggcgtcccgatgaggac

SEQ ID NO: 44819 - DNA, 191 bp, Homo sapiens
  chr16:88165560-88165751
  hypo
cggcccgcgcatctccggggctgctgaagacagggcagcgatgctccgcccgtgggaagctgggcagcggcaggacggcactcccagcctctccatcggctttgaatcacggcctggagttccgatgcttcgtggccactctcctctccatgtgtggacatcgctgtctgtggccccggccataccgatgg

SEQ ID NO: 44820 - DNA, 85 bp, Homo sapiens
  chr16:88375259-88375344
  hypo
gtggactgggtatctcggttttgccatctgcgggggcatggatgcatgctccctgaggcaggtggtgcagcgtccacagactggg

SEQ ID NO: 44821 - DNA, 159 bp, Homo sapiens
  chr16:88476104-88476263
  hypo
acgtgtgcagctctgcgtgaggaaaatgcaaacaaagctcggtaaagcaggccggggcccacacatgcgggcagggcatccaggcagcttgggcagagtgatcagaggtcctcgctcagtggcctgtgagcggaggcctgagtgcgacaggtgtggtgg

SEQ ID NO: 44822 - DNA, 170 bp, Homo sapiens
  chr16:88495551-88495721
  hypo
tcagcccctgttcttcggggtggcccagccccaggtttcaccccacgggacacccagcctgcccccaccgagggtagtgggagcctcccccagcgagtccccactgccgtcaccggccaccaacacggccggcagcacctgctcttccctgtcgccgatgtccagcagcc

SEQ ID NO: 44823 - DNA, 36 bp, Homo sapiens
  chr16:88498199-88498235
  hypo
caggcagggctgcatcgccaccgaccttggagtcct

SEQ ID NO: 44824 - DNA, 305 bp, Homo sapiens
  chr16:88498512-88498817
  hypo
ggggagtggatgtagcgttgctcttatgagtcacctgtccgaggatgaactggagatccagaaattggtcaccgaattagaaagtcagctgcaaaggagcaaagacacacgtggggccccgagagagcttgcagaagctgagtcggtgggcagggtggagctcggcacaggcacagagccaccctcccaacggcgcacctgccaggccaccgtgccccacgaggacacgttctcggcagctgacctcacgcgcgttggagaatccactgcacatcgggagggtgcggaatcggctgtggccaccg

SEQ ID NO: 44825 - DNA, 30 bp, Homo sapiens
  chr16:88502327-88502357
  hypo
gcctccagggcctcccggacaacccagaca

SEQ ID NO: 44826 - DNA, 30 bp, Homo sapiens
  chr16:88502901-88502931
  hypo
ctcctcctcttctctcggagatgtgagccc

SEQ ID NO: 44827 - DNA, 30 bp, Homo sapiens; identical to SEQ ID NO: 16096
  chr16:88503235-88503265
  hypo

SEQ ID NO: 44828 - DNA, 161 bp, Homo sapiens
  chr16:88503557-88503718
  hypo
ttctgaacagcatcacggaacccgcgcccaaacaccacaggggcaagcgctccgccggcaaggccgccgggagcccgggagacccgtgggggcaagagggagaagccaagaaagacagcccgggcgagagggcgaaaccccgggcacgcagcacccccagc

SEQ ID NO: 44829 - DNA, 336 bp, Homo sapiens
  chr16:88504017-88504353
  hypo
gctggcacacctgggcggggcgcacgggctgctggagcggccggagctgcagcacacgccgctgtatgcctgcgagctctgcgccacggttatgcgcatcatcaagaagtccttcgcctgcagctcctgcaactacaccttcgccaagaaggagcagttcgaccgccacatgaacaagcacctcaggggggggcggcagcccttcgcgttccgcggcgtgcggaggccgggagcgccgggacagaaggcccgggccctcgagggcacactgcccagcaaacggcgcagggtggccatgcccggcagtgcccctgggcccggcgaggacaggcctcc

SEQ ID NO: 44830 - DNA, 30 bp, Homo sapiens
  chr16:88504602-88504632
  hypo
ggagaggccagagaacgaggcttccccagg

SEQ ID NO: 44831 - DNA, 153 bp, Homo sapiens
  chr16:88506388-88506541
  hypo
cttgaccccaggaaccgggttcccgtatggaactgggaagaaaccgcccctgtgccagctcccgcgggccctcctcgttccctcccagcctccatggccgccctctagagcctccctgctgtacggagctctgggctccgcctatttgcaatg

SEQ ID NO: 44832 - DNA, 250 bp, Homo sapiens
  chr16:88507040-88507290
  hypo
gtaggccattcaaaacgcctccggagtgtcgcaaaccaagtgcggaggggccctgaggttgtactgtaaacatcatagtgacttgtcttttcaaatatattcccactattttcgcagaaaacctccagctgcgtgacgtctgtcctcccgccggcccccatccctggtctgcacctccctgagcctcagaacttggctcccagggtgtctgcgccagctgccactctcgggccaccgtgggccaagggcc

SEQ ID NO: 44833 - DNA, 90 bp, Homo sapiens
  chr16:88507982-88508072
  hypo
cctcccccaggtgggcgctgggcctcccctgctttccacttgttgctggcggaactcacaccgtaagggcgtctgcgaaggggcccagcg

SEQ ID NO: 44834 - DNA, 123 bp, Homo sapiens
  chr16:88512427-88512550
  hypo
ctcaccgtgtctcagcgtcaggctcaggcccggggccctgacatttagatagggccaggtgtggctgaggccatcgagtcattcctccggtgaagtatgcccgtgcgtcggggtgcagggcac

SEQ ID NO: 44835 - DNA, 124 bp, Homo sapiens
  chr16:88551425-88551549
  hypo
cgacaagtctgtgagcgcctcctttgtgctgggtgagggtgtcaccccagggagttcccagaccgagggaatgagtgtgagggaagtgcacggggactgggcccctgggcggggcactggcagg

SEQ ID NO: 44836 - DNA, 30 bp, Homo sapiens
  chr16:88601644-88601674
  hypo
gtacacaggccactgcggcccggagtggct

SEQ ID NO: 44837 - DNA, 51 bp, Homo sapiens
  chr16:88602946-88602997
  hypo
aggcaaagaaggcagcggcctcttgcctcagaagcccgaggcacttcccag

SEQ ID NO: 44838 - DNA, 46 bp, Homo sapiens; identical to SEQ ID NO: 16101
  chr16:88603730-88603776
  hypo

SEQ ID NO: 44839 - DNA, 39 bp, Homo sapiens; identical to SEQ ID NO: 16102
  chr16:88623960-88623999
  hypo

SEQ ID NO: 44840 - DNA, 61 bp, Homo sapiens
  chr16:88624831-88624892
  hypo
tccgggggtgtgagtcgcgcatccccccgtcggggggtgagtcgcccgtccccccgtgctc

SEQ ID NO: 44841 - DNA, 83 bp, Homo sapiens
  chr16:88683834-88683917
  hypo
gtagagctaagggggcggtcccttatgtgaaacctaatctttatagctaggccgatgggtgtgctcaccgccgaggcacgtca

SEQ ID NO: 44842 - DNA, 96 bp, Homo sapiens
  chr16:88722642-88722738
  hypo
ctgcctgagccccggcgagccacttctgagaggtcactctccacgccgtagacacgggccagggtgtaggctgcaggcatgcggattcagggaggg

SEQ ID NO: 44843 - DNA, 107 bp, Homo sapiens
  chr16:88757527-88757634
  hypo
tgagccatcaagcagcgaggcagcgtgcgtgtgagtctgcaggccacaggcgtgttcgtgcgtgtgtccatgggcgtatgcgtgtgggaagtcgcagtagctgctct

SEQ ID NO: 44844 - DNA, 120 bp, Homo sapiens
  chr16:88791699-88791819
  hypo
tgcggacaggacaggcgggctgggagccctgtgggacgtcacatgggcacagacgcagcacacgccagcaggcacagacatgctggacacggggccctgggtgcccgactccagctgcac

SEQ ID NO: 44845 - DNA, 42 bp, Homo sapiens
  chr16:88793407-88793449
  hypo
tcccagaaggttccccgtggagggtgacgtggaacccacctg

SEQ ID NO: 44846 - DNA, 157 bp, Homo sapiens
  chr16:88794604-88794761
  hypo
tgctggggatgggagcggccggggcctgctggggagggagccgtggcactgccggcccccggccacacttcctgggaggcgtgtgaggcagggagggtcggtccctaaggactgagggcatggatgtgactccacgcatctgcgaaacccacagccc

SEQ ID NO: 44847 - DNA, 30 bp, Homo sapiens
  chr16:88798777-88798807
  hypo
agtacttgaggcagccgagcagatcctggt

SEQ ID NO: 44848 - DNA, 30 bp, Homo sapiens
  chr16:88803397-88803427
  hypo
ccctttccagctctgcgcacctgaagactc

SEQ ID NO: 44849 - DNA, 54 bp, Homo sapiens
  chr16:88805867-88805921
  hypo
tccccatctgtgactcgggggctctcctggtggctgaggcgccaggtgcccggg

SEQ ID NO: 44850 - DNA, 30 bp, Homo sapiens
  chr16:88827321-88827351
  hypo
ctcatctgacctacacggggcagggtcctg

SEQ ID NO: 44851 - DNA, 36 bp, Homo sapiens
  chr16:88831239-88831275
  hypo
ccaaaacgaggactccgccctcggcaccaggggcag

SEQ ID NO: 44852 - DNA, 143 bp, Homo sapiens
  chr16:88832684-88832827
  hypo
aggaattcccaggaccgccacagagaagcccggcctgagcgcacagcctggactcgagactgcaacagcggctcttgacagccagcgcgccctgcgaacttcagacgtgacagccccacaatcgcgtgcgtcagctccttaaa

SEQ ID NO: 44853 - DNA, 137 bp, Homo sapiens
  chr16:88879970-88880107
  hypo
aacagcaaggagccccgagtcctgcccttcaacaaccaatgtggcgctggcctctggaggaggccggccgggaggcagcgggagctgggcacctgattcttggcagctgctgagaaggtgtgaaaggaaaataaatc

SEQ ID NO: 44854 - DNA, 21 bp, Homo sapiens
  chr16:88881425-88881446
  hypo
ccaccgcgcttggcctcgagc

SEQ ID NO: 44855 - DNA, 633 bp, Homo sapiens
  chr16:88882841-88883474
  hypo
gtccagaggcggggacgccagctgcccaggtccctttgaaggaagggccctgaatatcttcctatgaaacttgccaggcacccccgccccccgccccccaactaacggaggtggccctgccctgcccagtcctaaataaccctgcagggtggactgtccctgggcagggacaaggccatctgccctccatggtcctcactgctggtaggtgctcccgatggccggtgctctcctgttacatccgccggcccacgctgtggctccctggctgttcagagccaccaccttccttcccacggcacggcgggcacccagcggctcccacgctgcagccgggtctggccctggaaagaggcttcagctgggccttttcgcccgcacagcaggagcccaggctgaagtctgcagctgccgaggggccttcttcccgaatcctgcgcggcagatccaggggctgtgggcagccacgcccagcccgtgtaaacaggtgagcgacggcccaggggcctcgaggctgggctcggccatctccactgtgctcggtgggctctgggcacccaggagcgacaccgcagacctgtgtgtggctcgtttttgccgactagagcgagggccgcacgtgtcccatctgaa

SEQ ID NO: 44856 - DNA, 72 bp, Homo sapiens
  chr16:88884207-88884279
  hypo
cgttgttctggtccccgagtcgcttggctcctgcctcccgaatcccggacgccgccgcgtgtgctctgaggc

SEQ ID NO: 44857 - DNA, 91 bp, Homo sapiens
  chr16:88931237-88931328
  hypo
ggacctggggagcaccggcgcaccttgatgacccggccccggaagaggctctggtccagctccacggcggcctgcacggagcccttggtgg

SEQ ID NO: 44858 - DNA, 30 bp, Homo sapiens
  chr16:88933367-88933397
  hypo
cactgcatgaacactcgatctaagtgggaa

SEQ ID NO: 44859 - DNA, 30 bp, Homo sapiens
  chr16:88941444-88941474
  hypo
aactcctgatagccacgcacacagatgcca

SEQ ID NO: 44860 - DNA, 156 bp, Homo sapiens
  chr16:88941985-88942141
  hypo
aggttggagttggggcgatggggctgagagaggtcggagctggggtgagggggccgagagaggtcggagggcgcggagaggagagaggtagaggaggacgggctggccgagaagcagtgtttcagggaggcctgctggctccgcatgctcgaaaag

SEQ ID NO: 44861 - DNA, 78 bp, Homo sapiens
  chr16:88943090-88943168
  hypo
tgtctaaagctcagtcgaggcttctgaggatgcttgaagagacgttgtcaggaggtctccgcgcggaatcattaggta

SEQ ID NO: 44862 - DNA, 582 bp, Homo sapiens
  chr16:88943442-88944024
  hypo
ccgcagagccggcttcgctggggctggcagcacccacaggcagggaggggcccaggctgtgggcggcttcgggcggtccaggcaccgggtcggccaccacggctgtggggccctgcaggctctggccacacacgtggtgatgcttctcccagtcccgatgctggcagaaggacccgcagtagcgtgccgcgttgcagccgctgcacgtctcactggctttccgcccgcagttccagcagctctgggtgggggcagaggggccagtcagggctgggtctggccacccgaatccccaacacacgcctcaaccaagccattcagacccagccacgtcatcaccaggtgagaagagagaaactccaaagccccacagccctcgggccatgctccagatacagccactcactgggccattttgcgggacggcatcccactaccgtgtctcacgctccagcccacccagataggtctgcgctgtgctaactggacaacgacccctgcctcctctccaggaagccctcctgagctcaccaggctccaaaaccgcaaaaccaaagggcgtggccccggcaggattgaggc

SEQ ID NO: 44863 - DNA, 63 bp, Homo sapiens
  chr16:88944955-88945018
  hypo
aattctcaggcctgccgtgtgcaccgggagggagccgggcgcctcggacgccacctggggccc

SEQ ID NO: 44864 - DNA, 477 bp, Homo sapiens; identical to SEQ ID NO: 16111
  chr16:88945602-88946079
  hypo

SEQ ID NO: 44865 - DNA, 440 bp, Homo sapiens
  chr16:88948329-88948769
  hypo
agcccagttccgggccgtccccgaacacgtcctgcctcaaagaggcctcggcactgcttttgcccacacttcttgcaagactcaggatagactctgggaagagccagtgagcagaaagtaagtggagggaagcaaggcccgccatgagggttttaggaatcctcctccctgggcctctcgagatgcctgggctgcgctgacagctgggaggaggggggctcaggtgaaggacccagccgctgcgcagggacggcgcaggccacacaggagggcactgagctcaggggcgcccacacagccctgctgtctccagcagccccaggccccatggggcagagccatggccgtgtttatgcataggcatacaggtgtggctgtgtggggacatggctgtgtgggtgtagctgtgtgtgggcatggctgtgcgtgggtgtggctgt

SEQ ID NO: 44866 - DNA, 579 bp, Homo sapiens
  chr16:88952219-88952798
  hypo
tagtacacctcgccacgctccctcagcccgagagagccggccgggctggctgcagccccagaggaggttccctctcttacccagaggggagcagggtgagccgcgtgtccacggcacccccagcccagatccccggagcccacaggtacctgtcgggcgtcctcctcttgccgttctcgttgacttccagtagcagctctgaggagtcgatgggggaggaggcgctggcgtccagcaggagctgctcatgctgggccaagtactgggcgggcgtctgcttggccaggcgtgcacagtgcaggagctcccgctgcagcaagggcaggtttgcctgtggggtggggaaggagggcctgggtagcatgcaggggtgcacagccctgctcaggtccgagcagagggggcctgggctgggtggccgaaagctcaacttgacctcgggcctcaaaggtcaaggtgctcgacctctctgggcctcaagttccttcctagcagtgccatgggagggtggcgtgggagggtgggcacagagcttcgcaggagtgcctcacctgggccacacggcgatgtggggcatgt

SEQ ID NO: 44867 - DNA, 179 bp, Homo sapiens
  chr16:88955189-88955368
  hypo
atgtcccactggccccgggccccgggtgggggcacgaggtgggctggccctgagctccagctaccccacacaggccgtgggatcccctgtgtaccaaggggagactgaggtggacacggccctcacgagagccgggccgcgggcggcacctgctggggcgtggccgggggacaccaggg

SEQ ID NO: 44868 - DNA, 198 bp, Homo sapiens
  chr16:88956141-88956339
  hypo
cttcaaatccctggacgacgccccgcgattcctcctcctccagggacgacgccacgcgattcctcctcctccagggacacttcaaatccctggacgatgccccgcgattcctcctcctccagggacacttcaaatccctggacgacgccccgcgattcctcctccttcagggacgacgccccgcgattcctcctcctc

SEQ ID NO: 44869 - DNA, 118 bp, Homo sapiens
  chr16:88956594-88956712
  hypo
agattcccctgagcccgggagtgaggccccgttctttccgcgtgtccctccacgctgtctcctcaacagcctgaggatgattccattttgcagatacagaaaccgaagcacagaggaa

SEQ ID NO: 44870 - DNA, 622 bp, Homo sapiens
  chr16:88957373-88957995
  hypo
agactggcatctttaaaaatgcaggctctgattcagcaggtttgggccgggccgagagcctgcaaagctgacaagccccgcgtgctgccaccctggtccacggttgatctgggtgtgaccatctgacctgctttcacctgacacctcttcatccatcggcctgcgcagccacagaagccccttcccgcctgtctaccgccctcacctcccgccctcacctctgctctctccaccccacgtattctgttccagtcacactgacccctctgctgttcctcaagcacagcgggcgccccatacctcagggcctctgcacgtgcagttactgctgtctggaaaaccctgcgctggctctgcacctagctccgccctcatcctcagccctcaccaacacgcctccaagcaaaggactttcggaatacttctccaccacgtgcagctgcagatttgagagtggctgtggaccgaacgccttcccaccccagggtgctggctccaggagggacctgctgcatgtcctgggccctatccccgagccttgcccccacactggcacgtcgtcagtgctcaaaaatcacccgtggagtgagcgagcacattcggccaacggcaaccagaggcg

SEQ ID NO: 44871 - DNA, 104 bp, Homo sapiens
  chr16:88958345-88958449
  hypo
tggaatgaaactcctcgatcgtcaatgtcgagttctgcaggggagaaaacccacctcacatcagcaccgctcggcatgtgagccagcgccgacccacccatgcc

SEQ ID NO: 44872 - DNA, 99 bp, Homo sapiens
  chr16:88962807-88962906
  hypo
tggagcgcgcggcaccgataacggcgtcgtattctggggctttccctcttctggggggacagtggacgctgacacaggatgcaccgagcccctggtctc

SEQ ID NO: 44873 - DNA, 549 bp, Homo sapiens; identical to SEQ ID NO: 5180
  chr16:88963214-88963763
  hypo

SEQ ID NO: 44874 - DNA, 30 bp, Homo sapiens
  chr16:88965028-88965058
  hypo
ctcagggacctgggccgaagccgcgtgtcc

SEQ ID NO: 44875 - DNA, 443 bp, Homo sapiens
  chr16:88966387-88966830
  hypo
agggtgatcccagcccggccacatcgccgtgtgacaaggacatgtgagaaaaagcccagccagcctctcactagaaaccgtggccagctccgcagagccaggacctgcacgctgggcccgccgtcccccaggacctgcaaaatcgtgagtgcggcgtcccgactctctgaggcagggccggccccgcgggtgcagggagtagccgttaggctgtttggctcctactgagtgccgggcacatttccagctgtacctgcctctgggcggcacacctgggggcaccccattgctgggccaccccattccccaaccaagtcgggaggctgactcggagccaacatcctacaaacagggccgcaaatctgctgcctgaccgcacagccagtgctctctccagatggaggggagatgatggccaaagccctcggcggagcaggccccca

SEQ ID NO: 44876 - DNA, 224 bp, Homo sapiens
  chr16:88967701-88967925
  hypo
ggcaaggacatgacccggagctacccagtgggaagcagggaagctgggatttgaaccggccaagcctgggctctgggccacacgagctcctcacactcagggctcacagaaggtgcccgctggctccgggcaggaagctcagaatttcaaacaacacaagggcctcccctgaaacacctggccctcggctgccaggtgggggctacttacgtgtgtgtggcgtg

SEQ ID NO: 44877 - DNA, 520 bp, Homo sapiens
  chr16:88968292-88968812
  hypo
tggagctggggccctcggtgtgtggccgccctgcgagagccgtgccccactccaggcttgaggcttctacagaccagggagtgggcagtgccccgaggcagcggtgccttgctcccacctccatgagcatcccccggggggtgttcagacagacctcagcctcttcccccagtcctgattcagcaggtcaggctgagacccagaatttgcatttccggcatgttcccaggtggcgctgctgctggtctggccctggaagccatggttctaagagtcccttccactttcagatgctagaaggctcccctgggctggggggcgggggacggtgtctgcccagggagaggccggcaggcaggccatttagggcggcaaaacctctattttaaccgtcttctgccccggtgattcacaggacagccaagacagaggcggcattgacttcaggatggccgaggcctggctgcgctgggcgcagcccccggcaggtggtaacgccaggacacgtgattaatgagaa

SEQ ID NO: 44878 - DNA, 30 bp, Homo sapiens
  chr16:88970496-88970526
  hypo
catggccaccacctgcgtgctcacggccac

SEQ ID NO: 44879 - DNA, 50 bp, Homo sapiens
  chr16:88976653-88976703
  hypo
aggctgcctccttcccggtgatgctgcagcccgcgcggcccttcaccctg

SEQ ID NO: 44880 - DNA, 172 bp, Homo sapiens
  chr16:88977950-88978122
  hypo
ctctccctgcaggaacggagttggcttttccgtctcctaatctggcctcagttttctcatctgtaaaatgggaatggggatggaattcccgcagaatcacggagggacgaagtacatgagctcacgaaaagcgtctagaacagagcgcctggccgctcgccctggccaccca

SEQ ID NO: 44881 - DNA, 30 bp, Homo sapiens
  chr16:88980132-88980162
  hypo
tgtttgtcacagcatcgtttatgagaatga

SEQ ID NO: 44882 - DNA, 81 bp, Homo sapiens
  chr16:88993078-88993159
  hypo
agctggccatggtcccgtgcgtgccagggtggggcctgctgagcctcagtttcctcggctgtaagacgggacggaggtgtt

SEQ ID NO: 44883 - DNA, 272 bp, Homo sapiens
  chr16:88994398-88994670
  hypo
tctgtccacaggcagcggctcccggcacccaccgctgctgaccgagcccctggcacccccaagccgagcctttgaaccccagcagggaaggccacctggccgagaccctggccaccacggggccatcactgtcccacggggctctgttccgactccttggcccgagggtctctgagcaccaccagggttgcctcacgcctctgagtttggggtggtttgttcggcagcactggggcccggggcagcttcttgcccggcgtgtggcacagctg

SEQ ID NO: 44884 - DNA, 88 bp, Homo sapiens
  chr16:89000151-89000239
  hypo
tctatacgcctcacacgcctcacagtgccacacgtctgcgtccccacagccatagtggccacttcatgccacgcgtatgtgacttggt

SEQ ID NO: 44885 - DNA, 161 bp, Homo sapiens
  chr16:89001001-89001162
  hypo
ggaggcccagaggagcggagaggagtctggcctcgctgcctgcctattcttgctgttggcagggcctggtaaaggaggcagagatgccacgaaagaggcacgaagggccgtgccctgccctcttccacccccgaagttcagaaggacgcattctttttttc

SEQ ID NO: 44886 - DNA, 38 bp, Homo sapiens; identical to SEQ ID NO: 16126
  chr16:89025782-89025820
  hypo

SEQ ID NO: 44887 - DNA, 93 bp, Homo sapiens
  chr16:89026022-89026115
  hypo
ggagagggaaggtcccggggaaaccctccttttcctcctccttcctcccagcagctgggaaaggcgatggagagaaaacgggagcagggcaga

SEQ ID NO: 44888 - DNA, 30 bp, Homo sapiens
  chr16:89028699-89028729
  hypo
tttccactgcatactcgtacttttttactt

SEQ ID NO: 44889 - DNA, 30 bp, Homo sapiens
  chr16:89029708-89029738
  hypo
atcttctgccaggggcgggcgctcatcttc

SEQ ID NO: 44890 - DNA, 535 bp, Homo sapiens
  chr16:89055410-89055945
  hypo
acccactcagtgtctcgtgcatggcacacacgtgtcctgcgggcccgctgggagctggctgctggtccctgtacgaggctgggggtctgacctcaccaccagggacagacagcaaagcagaccatgagacaggggagcaaagccgtgcggtgggaggggtgaggcgtgcggcatgactgcagggcggggagggcctcaaggggagaggcaactcggggcagcccgcatggcccaggcgtgggtcaagctctgggaggcacgctccccgcaggaccagccgcacgtgcaaagctcctcctgcccccagccccggccagcatctcggagccactgcggattcagtcgtggggtccctggaaggcaaggccttccctaatctgggcaccggggcctcccaggtggcgacgacagactcccaggctggcttgaggcaaaaacacggcgcgctgggacgtatttggatgtaaatgttttcagcacagagcagctgggagatgcggcctccgtgggagctgggagccggggccatatggcc

SEQ ID NO: 44891 - DNA, 324 bp, Homo sapiens
  chr16:89072503-89072827
  hypo
ggagcagaaggccaacgcgggtggctgaggagagggcaaggaagaagaggcaggagtccaccgccagtgccaaccaggggcctcggggcaccgctccaggagcaaccccagagtgcatccacctcctcccgggtgggccacgccttgaggtgctgacggcgccccaaactccactccccggaatcggcccaggctcagccacatcggcccgggctcctacagaagccgacctggagacgaggaactgacctggagacgaggaactgacctggagacaaggaactgactgcaagtggaccatttgcagggcgaccccaagggcag

SEQ ID NO: 44892 - DNA, 30 bp, Homo sapiens
  chr16:89103482-89103512
  hypo
ctccattctcttggccgcctgaaagtcatc

SEQ ID NO: 44893 - DNA, 123 bp, Homo sapiens
  chr16:89105547-89105670
  hypo
caaggtggaggtctgcggggcgcaggtctctgtctggggctgccatccacatacgctgtggctcatgtacagtgaccacctgctgcaggatgagacggtggcacccgccgctccctgagagcg

SEQ ID NO: 44894 - DNA, 137 bp, Homo sapiens
  chr16:89107647-89107784
  hypo
ggagggcaaccgagtcggcctgggttcaagttctccagagtgccggccctccactcgagttcccctgccccggggaatgccctttccctacacctgcaatcccctgagggacgggaggaggccggtagtccatgagc

SEQ ID NO: 44895 - DNA, 177 bp, Homo sapiens
  chr16:89109482-89109659
  hypo
attcccgtgaggtggcgggagaagattctatgattgatccgtcatgcctgccgtggctcaggatgggaccggcctctcaagctacagatcaagaaactgagaagggagtagcctaaagtcaccatgagagtggccaggtctgggccggcctggcctccaccccgcagagaccatctc

SEQ ID NO: 44896 - DNA, 30 bp, Homo sapiens
  chr16:89110091-89110121
  hypo
atctcctgggagaaccggtattgccaggtt

SEQ ID NO: 44897 - DNA, 30 bp, Homo sapiens
  chr16:89115322-89115352
  hypo
tgtggggcagactcccgctcagaggggcct

SEQ ID NO: 44898 - DNA, 368 bp, Homo sapiens
  chr16:89120038-89120406
  hypo
tgaggctgctccctccgcaaggtgggcgaggagccaggaagagccaagggagtggccaccctgccctgacggccaccaacggccaccacgtcaccctagaagacaacccaagcccgtctccccacacctcgcggatggtgcagtgcagagagaaggccgggcgggtgctggggggcccatctccccgagccttgcaaatagtgcagtgcagggagaaggccgggcgggtgctggggggcccgtctccctgtgactcgtggacggtgcggtgcagggagaagggcgggcaggtgctggaggactgagtgaggcccctccaggatggctccctgcccctccatgcgctgggtcctcgggccaggacaggt

SEQ ID NO: 44899 - DNA, 180 bp, Homo sapiens
  chr16:89120684-89120864
  hypo
tggctggggctcctgcggccaccctgctccccagaacctcgtcgtcttcccggtgccctgcggcaggaacacagggctggagccgacccccagggcatggctgggagctgcgggagtgaacggggagttaacccccagggcatggctgggagctgcgggagtgaacggggagctgcctgt

SEQ ID NO: 44900 - DNA, 107 bp, Homo sapiens
  chr16:89138016-89138123
  hypo
gaggaaagacagacacggcgttggctgcgcgggggcctgcatccctcccgaccttctcatttgatcctcctgccctatgcggttggtgccaacgttcatcccatttt

SEQ ID NO: 44901 - DNA, 25 bp, Homo sapiens
  chr16:89139536-89139561
  hypo
cacttacctggagtgcggtggcccc

SEQ ID NO: 44902 - DNA, 52 bp, Homo sapiens
  chr16:89140367-89140419
  hypo
gagccatgtcatgaacgactcatgcatgcaccagtcacgtgaggacctgtca

SEQ ID NO: 44903 - DNA, 30 bp, Homo sapiens
  chr16:89141923-89141953
  hypo
agacaggcctccagccggggcacctcccaa

SEQ ID NO: 44904 - DNA, 402 bp, Homo sapiens
  chr16:89172134-89172536
  hypo
agcaacggccattgtcgtggaccgtgccagggcgagatgcagctggcaggggcagaggcagaacatctcccagggagctgagggcaggttggttccatcgtcccggagggcaggttggttccatcctcccaagtaaagagtgtgttaccctcagggcgagaggcaggtgggtgtgggtgctggcgcaggccagctgtcaaggatctgggctttctggtcttgctgcttctccagcactgcatgaatgacaccacctggccctttccagtgcccacaggcacacggcttgggagctgctgctgcggcgtctctgcccaggggcatctgccagggggtccctgccttggggtctgtgtcccaagggcgtctgcccagggatttctgctccgagagtgtctaccc

SEQ ID NO: 44905 - DNA, 44 bp, Homo sapiens
  chr16:89189859-89189903
  hypo
tgcccctcactaccacggtcccggatccacgtggctcaagtgag

SEQ ID NO: 44906 - DNA, 54 bp, Homo sapiens
  chr16:89219318-89219372
  hypo
tggaaatgtggaggtcgaggttgacagcgacaccgaggtcgaagccagttgccc

SEQ ID NO: 44907 - DNA, 707 bp, Homo sapiens
  chr16:89220327-89221034
  hypo
gggcagagacagctgcggtggcccggtgcacctgcctggcctcaggatggccgaggcgcctggcaaggctgcagggtcccaggggcacctgtccgtactgctgggcgcctgagttcctcctgctgggcactgtcagggcagtgcgcctcaggctgtgcttgtctctgcagaaatgtcctggccccgtacgcggtgccctcggagctggtgctggtggaggagatcccgcggaaccagatgggcaagattgacaagaaggcgctcatcaggcacttccacccctcatgacccggcagactgggactgcgggtctggtggggagcagcagacgtccccttcacaccgagaaccacgggggcccgtccaagacctggcctcccttaaacctgaaccccccaaatcaggtcacgtagaatcaagaactgtttgggatgaaatcaccatgtggggtccccagcctcgggccagttgttgcagctcaaggagaccgtccctggtgtcacctctgcctggtcaccgccgacctcatctgtgcagcgcggtgcagccagcccctggccccacgtgctgaggcacctcccgccccacagtgccctgcagttgccaggctctccagggcaggtcccagaggtttcccacaaaaaacaaagactccactggaggaaacaagcccctgtcccacgccgtctgcacgtgcctgtgcctca

SEQ ID NO: 44908 - DNA, 82 bp, Homo sapiens
  chr16:89225881-89225963
  hypo
ggcggagggcgctgccgcaggtccccacatacccagcgcacgctcaccccacactggaggcacctgccgggttctgacaccc

SEQ ID NO: 44909 - DNA, 390 bp, Homo sapiens
  chr16:89226330-89226720
  hypo
gcagatctggagaggcggagggatggggacggagcgccatgcagaggccgctcggtcctcaggagctgagcatcaccctgggagtctcaaggagggtgtcccctggccttagcgggcagccagggccagcatgtggtctgtggcagccggtctcagaggtggcctggttcgcagtcttgctggatggagatccccagctcctagggcaagggcaggtggggtggggccgcctcggtcagctgataggaactgaactgagaaggctgtgagccgctgagtcgccctaactgcagggtggtcctgcgggcagtactgagcccgccctgctgggcaccccacagcccctgtggctctccagctgccactgaggccggacgcctcatgaggagg

SEQ ID NO: 44910 - DNA, 112 bp, Homo sapiens
  chr16:89242936-89243048
  hypo
actcggtgctccctccgctcgcacaatgtggggagctgttctaggtgttggtgtggcgtggccggcacacctctgtagtaggcacaggacttggtgccggctggggagtccc

SEQ ID NO: 44911 - DNA, 151 bp, Homo sapiens
  chr16:89245291-89245442
  hypo
tgtgcccacaggcaccgccactggcttcttggggtcattccgtgtcaggaccccacgctctccccagccctggctggcccaggggctttccgtgtgcaccgctaccctggcacctggggcgaggctgtgtccccgccgggtgaatctcagg

SEQ ID NO: 44912 - DNA, 102 bp, Homo sapiens
  chr16:89245643-89245745
  hypo
tttgcccttgtgctacgcagccccgtgtgtggaagccgccttgcgccaatgggcaccgacccgtgggctgagggaaacactgcgccccgtggcctcctcacc

SEQ ID NO: 44913 - DNA, 159 bp, Homo sapiens
  chr16:89254633-89254792
  hypo
gggcagttcaccatccgcacggaccccaagaccaacgagggtgttctgtccattgtgaaggtgagcggcccccggctggcacacagatgccggcagacgcagatgccgacacacacagatgcccacacacagatgccggcacacacagatgcccacaca

SEQ ID NO: 44914 - DNA, 30 bp, Homo sapiens
  chr16:89311109-89311139
  hypo
ttaggtagcttcgcccggctggcagacatg

SEQ ID NO: 44915 - DNA, 30 bp, Homo sapiens
  chr16:89531824-89531854
  hypo
ttacagcagaggccacgacagagaacaggg

SEQ ID NO: 44916 - DNA, 134 bp, Homo sapiens
  chr16:89558631-89558765
  hypo
tggatgaggggtgagcgcctgataaaaacagccggcgtatgcgctgatgtgcgttcacgaagaggtgatccaagtgtttccatatttgcctcactggacgaagtatttggtaaaattgacgaaattcagagtcc

SEQ ID NO: 44917 - DNA, 44 bp, Homo sapiens
  chr16:89575654-89575698
  hypo
aggttgttgttttttcggttatttttgagacagagatctcgctc

SEQ ID NO: 44918 - DNA, 30 bp, Homo sapiens; identical to SEQ ID NO: 16146
  chr16:89576068-89576098
  hypo

SEQ ID NO: 44919 - DNA, 26 bp, Homo sapiens
  chr16:89637111-89637137
  hypo
acaggaggaggtgagcggggattgga

SEQ ID NO: 44920 - DNA, 30 bp, Homo sapiens
  chr16:89651651-89651681
  hypo
tggaggcacagggctcggaaatgtgtctcc

SEQ ID NO: 44921 - DNA, 79 bp, Homo sapiens; identical to SEQ ID NO: 16147
  chr16:89655054-89655133
  hypo

SEQ ID NO: 44922 - DNA, 30 bp, Homo sapiens
  chr16:89667452-89667482
  hypo
actgcctgcagcaggcggaggagctcctcc

SEQ ID NO: 44923 - DNA, 30 bp, Homo sapiens; identical to SEQ ID NO: 16148
  chr16:89668379-89668409
  hypo

SEQ ID NO: 44924 - DNA, 79 bp, Homo sapiens
  chr16:89688162-89688241
  hypo
tgcgtttactcatcccgtgggaaagtctgcacatgtctgttctaggtacgcggacgtatctgaccgtgtgggcttgcga

SEQ ID NO: 44925 - DNA, 255 bp, Homo sapiens
  chr16:89702746-89703001
  hypo
gtccaccgcatgtgccggatgtacccggagaccttcctgtatgtcaccagcagtgcaggtggggtcctgacctgggtcctccaggtcctgcgtcttctcacccagccctcatcctgagcagcaggtgccggtcaggacacctcaccctccagataccaggtgcccactcccctgcaccctgactctccccgcaggcattcggcaggccttccgggaagggaaggtggccagcctgatcggcgtggagggcggcca

SEQ ID NO: 44926 - DNA, 48 bp, Homo sapiens
  chr16:89704648-89704696
  hypo
cccctttagggttcccggagctccgggaagacccgcccatcccaggac

SEQ ID NO: 44927 - DNA, 30 bp, Homo sapiens
  chr16:89713595-89713625
  hypo
gtaggggccacataccgatgtatggacgtc

SEQ ID NO: 44928 - DNA, 37 bp, Homo sapiens
  chr16:89763835-89763872
  hypo
agcgagtggcctggacggcaggcgggcagggctgcac

SEQ ID NO: 44929 - DNA, 420 bp, Homo sapiens
  chr16:89883922-89884342
  hypo
ggcagagcgagactctgtctcaaaacaaaaccaaacataagaattcgtaaaagcgagtgcctaggcgaagctaatgtgcctcaaagtcctgggtaagtagaggccctggagacccgtccgcatcctctggcagtggccttggaaccaccgaagggattcagccgaagggccgcgttcccggcaggcgtctttattgtgttgattacgtagatggcgtagatgacgtagatgacgttcagcaccacaaacgaagagccgaggcacagagtggggccttggattcatgagatggggatggagcagaaatgagaattcggagtccatgaaacccccacaaagactcctgcacggcccgactcggacactttgcaatctgctggttgagggggatggtgtgaactcagggaacagcctgagatc

SEQ ID NO: 44930 - DNA, 93 bp, Homo sapiens
  chr16:89884896-89884989
  hypo
aaccatgaagatggccggaggaaaaagatacgttaaatacagtaacaaaggtaagaattccagcctgggcaatatggcaagacctcgtctcta

SEQ ID NO: 44931 - DNA, 33 bp, Homo sapiens
  chr16:89885109-89885142
  hypo
atttcagtataataaaatcgttacaataagaac

SEQ ID NO: 44932 - DNA, 30 bp, Homo sapiens
  chr16:89896219-89896249
  hypo
tgaggcgcaggcttgcgctggcactcagac

SEQ ID NO: 44933 - DNA, 56 bp, Homo sapiens
  chr16:89900124-89900180
  hypo
ctgcacctgtgcactcgctggacctgccttggggagcagcacgtgtgggtccaggc

SEQ ID NO: 44934 - DNA, 431 bp, Homo sapiens
  chr16:89900384-89900815
  hypo
tgtagatggcattcccgatatagtctcacctctgagcaagggttacctcacaggaaggcagtcctgcagcaagactcttctctttacggagacatctgtgaacctgcctgcgctcgcggttggccgtcgtagaagcatggataagcatagcccgtgtgaatctgtgaacctgcctgcgctcgcggttggccgtcgtagaagcctggataagcatagcccgtgtgaatctgtgaacctgcctgtgctcacggttggccgtcgtagaagcatggataagcatagcccgtgtgaatctgtgaacctgcccgcgctcgcggttggccgtcgtagaaggccccataagcatagcccgtgtgaatctgtgaacctgcctgtgctcacggttggccgtcgtagaagcctggataagcatagcccgtgtgaatctgtga

SEQ ID NO: 44935 - DNA, 30 bp, Homo sapiens
  chr16:89972205-89972235
  hypo
actgctctccaagagcgatttccagcaggg

SEQ ID NO: 44936 - DNA, 40 bp, Homo sapiens
  chr16:90037700-90037740
  hypo
cagcattctcttcctcggaaataaacgttcctttgggcat

SEQ ID NO: 44937 - DNA, 321 bp, Homo sapiens
  chr16:90066626-90066947
  hypo
cgaggtccggcacctcgtcagtgccacctacaggtgcaccctggacctgctgacacggtgccgggagcatgtggagaaggtgagtgtggcctctgcccagacaggtcgtgggtcccatgttgagtcacggtcatgccacacccgaaggccacacccgtccttcagcttgcttaggtttgggctgtgatcatgtcctcagagccgtctgacaggtgggccgttgtttccaggtgggccagcggctcctggagaaggaagtactggagaaggcagacatggtggagctgctgggcccccggcccttctcggagaagtctacct

SEQ ID NO: 44938 - DNA, 133 bp, Homo sapiens; identical to SEQ ID NO: 16154
  chr16:90069191-90069324
  hypo

SEQ ID NO: 44939 - DNA, 37 bp, Homo sapiens
  chr17:616989-617026
  hypo
gcaggcagggccgcgcgtggtggctcacgcctgtaat

SEQ ID NO: 44940 - DNA, 57 bp, Homo sapiens
  chr17:706526-706583
  hypo
tccctctgatgagatcggcccactgcagccagcgcggaggcacgaacccagcatttt

SEQ ID NO: 44941 - DNA, 121 bp, Homo sapiens
  chr17:745667-745788
  hypo
tgtgggctgcagttccgtgatcccggcggggaaggccacgtgggttactggggaggatgaaggatgaacacggggccgcgtctcacatgcaacccaccttcgaagacgccaaccagaggca

SEQ ID NO: 44942 - DNA, 30 bp, Homo sapiens
  chr17:876870-876900
  hypo
ttctaggtctttcttcgcagttataatctc

SEQ ID NO: 44943 - DNA, 30 bp, Homo sapiens
  chr17:896321-896351
  hypo
ctggaggaccccatccggagcctggagtgc

SEQ ID NO: 44944 - DNA, 30 bp, Homo sapiens
  chr17:915987-916017
  hypo
ttcaggctcatatctcggctggtgaatttc

SEQ ID NO: 44945 - DNA, 34 bp, Homo sapiens
  chr17:1136687-1136721
  hypo
tctttctttctttctaactcggtgtgccactggc

SEQ ID NO: 44946 - DNA, 30 bp, Homo sapiens
  chr17:1193094-1193124
  hypo
atactcatggcaccccgcacctctgcccaa

SEQ ID NO: 44947 - DNA, 121 bp, Homo sapiens
  chr17:1387772-1387893
  hypo
ccgggtgcggaaagccgggtgtggagggcccgggtcccagtgtggcagcagagggatcaccgaggctgcgggcacagaacagagacaacatgaaccacttgggactcggacacagggcatg

SEQ ID NO: 44948 - DNA, 51 bp, Homo sapiens
  chr17:1412412-1412463
  hypo
gttagtgggggttagcgtggggcagagggcggggaacggtctgccagaccc

SEQ ID NO: 44949 - DNA, 18 bp, Homo sapiens
  chr17:1471448-1471466
  hypo
acccggccactctttcat

SEQ ID NO: 44950 - DNA, 18 bp, Homo sapiens
  chr17:1520967-1520985
  hypo
agccgccacacccagccg

SEQ ID NO: 44951 - DNA, 30 bp, Homo sapiens
  chr17:1536225-1536255
  hypo
atatccaggatatgtcgttaagtaaaaaag

SEQ ID NO: 44952 - DNA, 49 bp, Homo sapiens
  chr17:1543917-1543966
  hypo
tgtgtctggagagcacggctcattgtgtttgcagcggccacagctggga

SEQ ID NO: 44953 - DNA, 30 bp, Homo sapiens
  chr17:1544312-1544342
  hypo
ttttccacactgagccgtccccaggtctgg

SEQ ID NO: 44954 - DNA, 16 bp, Homo sapiens
  chr17:1545305-1545321
  hypo
gcgcccagccagggat

SEQ ID NO: 44955 - DNA, 139 bp, Homo sapiens
  chr17:1546311-1546450
  hypo
cgttcctctgctttgtatgttttttgagaggagcaccgcgaagccctgacccctcctcccggcgccccgccgcggccacctgtctccgctccgccccgcccgctcacaggtctccgcgcagcctcgctcacctgtgtcc

SEQ ID NO: 44956 - DNA, 32 bp, Homo sapiens
  chr17:1623703-1623735
  hypo
gcatcagaattacctcgcgtacttgttaaaca

SEQ ID NO: 44957 - DNA, 30 bp, Homo sapiens
  chr17:1819565-1819595
  hypo
aggggacgtctcttccgtggaaaagcagca

SEQ ID NO: 44958 - DNA, 180 bp, Homo sapiens
  chr17:2207801-2207981
  hypo
gctgggattacaggcgtgagccaccgcgcccggccgccccctgacttttaaaaactagatacgatatagttggaatcgtgtggaaggaagtacatcaggaggcatataagtccatttgggacctgtaatcccggcgactcggaacgctgagacgggcggatcgcttgaacccgggaggcg

SEQ ID NO: 44959 - DNA, 22 bp, Homo sapiens
  chr17:2208041-2208063
  hypo
gagactccgcctcaaaaaaaaa

SEQ ID NO: 44960 - DNA, 25 bp, Homo sapiens
  chr17:2220972-2220997
  hypo
gccgggataacggagactccatctc

SEQ ID NO: 44961 - DNA, 30 bp, Homo sapiens
  chr17:2264699-2264729
  hypo
tgtgtgcgcaccaggcgagggagagggaca

SEQ ID NO: 44962 - DNA, 126 bp, Homo sapiens
  chr17:2298883-2299009
  hypo
cagcccagccaggcacgggggaaagtgccgggggcacagcagtgaacaaatcaagcagacctgttccccgccaccagggaatagtaggacagtcacgggggctgacagtcacgggggctgacagtc

SEQ ID NO: 44963 - DNA, 33 bp, Homo sapiens
  chr17:2495626-2495659
  hypo
ttaaaaatcaagggtcggctgagcacggtggct

SEQ ID NO: 44964 - DNA, 30 bp, Homo sapiens
  chr17:2634361-2634391
  hypo
aagccccagttgcgccgtattccccacggc

SEQ ID NO: 44965 - DNA, 30 bp, Homo sapiens
  chr17:2859488-2859518
  hypo
catctggatgtttggcggctcacttctggt

SEQ ID NO: 44966 - DNA, 30 bp, Homo sapiens
  chr17:3541079-3541109
  hypo
tcccacttgacaatgcgtgctttacatctc

SEQ ID NO: 44967 - DNA, 43 bp, Homo sapiens
  chr17:3658849-3658892
  hypo
gcacacagaaaaaagcgacctcctgtcatcaatatggccaccc

SEQ ID NO: 44968 - DNA, 30 bp, Homo sapiens
  chr17:3686152-3686182
  hypo
gacatcgcactctcacgggaagacacactc

SEQ ID NO: 44969 - DNA, 191 bp, Homo sapiens
  chr17:3741605-3741796
  hypo
ctcgggaccagaggtcgacaggtgtgataaagctatgacgccctcgcggtagagttgtgagagagactcacaggtatgcttgcgcccggctgtgcaggcacatgaaggtcaagccacacctggccttcacaggacttctcctcaaacagaaaccccgcccatgagggaagcaagggcgtgtttctgacttg

SEQ ID NO: 44970 - DNA, 30 bp, Homo sapiens
  chr17:3792191-3792221
  hypo
ggaccagggtggtggcgtgtgtgtgtgtgt

SEQ ID NO: 44971 - DNA, 39 bp, Homo sapiens; identical to SEQ ID NO: 16163
  chr17:4236673-4236712
  hypo

SEQ ID NO: 44972 - DNA, 30 bp, Homo sapiens
  chr17:4446308-4446338
  hypo
gcaggtagagagaggcgttgaagtggtaga

SEQ ID NO: 44973 - DNA, 41 bp, Homo sapiens
  chr17:4699211-4699252
  hypo
ccgcctcagcctcccaaagtgccgaacggtttttgggtttt

SEQ ID NO: 44974 - DNA, 21 bp, Homo sapiens
  chr17:4976841-4976862
  hypo
gtgtaataaagcagacggtgg

SEQ ID NO: 44975 - DNA, 20 bp, Homo sapiens
  chr17:5320631-5320651
  hypo
aagtaaatagccaggcgtgg

SEQ ID NO: 44976 - DNA, 120 bp, Homo sapiens
  chr17:5320771-5320891
  hypo
agaaagaccccatttcaaaaataaaaaataaaatacgtttttaaaaaatgacaagggcagacccagcccctgccttggagcttacagtctagaaaagaagacagaggcagagtgccatgg

SEQ ID NO: 44977 - DNA, 98 bp, Homo sapiens
  chr17:7047830-7047928
  hypo
tcatcttggttttggcgggcttcgatccacttatgtaccgcatcttgtttcagcagcggggtcctcgtgacctgtaccttgcaaaacctgtcctgaca

SEQ ID NO: 44978 - DNA, 30 bp, Homo sapiens
  chr17:7107670-7107700
  hypo
tagccaagcccactccgccaccctgagagc

SEQ ID NO: 44979 - DNA, 30 bp, Homo sapiens
  chr17:7156905-7156935
  hypo
tctacttcctagtcccggcaactcagtgga

SEQ ID NO: 44980 - DNA, 59 bp, Homo sapiens
  chr17:7369017-7369076
  hypo
tggatcactcacctgcgctcccccgtgtgccacacttcatgcttcgtgcggtactccgc

SEQ ID NO: 44981 - DNA, 153 bp, Homo sapiens
  chr17:7466711-7466864
  hypo
acctcccagcggccccgcccttcccgccccactcatcgaaaaacctgctcacagcgccgccgccgagccatgagagccttccggatgctgctctactcaaaaagcacctcgctgacattccactggaagctttgggggcgccaccggggccgg

SEQ ID NO: 44982 - DNA, 30 bp, Homo sapiens
  chr17:7727283-7727313
  hypo
tgctgaatatgaagtcggtcggtggctcgg

SEQ ID NO: 44983 - DNA, 25 bp, Homo sapiens
  chr17:7856920-7856945
  hypo
ccgctcacctcgtgctttgcagtcc

SEQ ID NO: 44984 - DNA, 225 bp, Homo sapiens
  chr17:8104414-8104639
  hypo
gggcaacagagcaagattccgtcttgagaaaaagcaaaaaccttgcctttatctcgtttgaattcttgccctcgagaaaacagaggagagaggttgctgcagagttgcaactccggagtttcccggatagctgcaggcttacccgcaggtaacagtagaagtaggagtcagcgttaaggctgtgggaaaataggtgtccttcattattgccggtgggagtgtaaa

SEQ ID NO: 44985 - DNA, 23 bp, Homo sapiens
  chr17:8104911-8104934
  hypo
tataggctgaaaggccgggcgcg

SEQ ID NO: 44986 - DNA, 25 bp, Homo sapiens
  chr17:8123524-8123549
  hypo
cccatcccaccggttttgtttttca

SEQ ID NO: 44987 - DNA, 30 bp, Homo sapiens
  chr17:8287729-8287759
  hypo
tggtttctgaggcagcggcagtgcagcagg

SEQ ID NO: 44988 - DNA, 149 bp, Homo sapiens
  chr17:8296142-8296291
  hypo
cccagggcaggatggcggccaccacggccaccacagcgatgagcgtgatgagcagcagggcccgcgatcggcagcagaaggcgcgggcggagcggggcgccagggaggcctccgagagctctgccaggctgcggcggggcagcacgctg

SEQ ID NO: 44989 - DNA, 228 bp, Homo sapiens
  chr17:8384676-8384904
  hypo
catctctctcctgctcggcgtgtcggcgggctcgctcagatgaggcaagttcctaagcagtggagactgcgttaagctctggctgtgaatagtttcctcacctgtggaatctgacagtgcctggagctacagcgaccttgctcctgtcactgtttacctgcacctcaagctgtcatttagatttgagaaattaaactgtcaagaaaatctgctcggtgcaggccagcc

SEQ ID NO: 44990 - DNA, 18 bp, Homo sapiens
  chr17:8464515-8464533
  hypo
ggggcctctcctctccgg

SEQ ID NO: 44991 - DNA, 30 bp, Homo sapiens
  chr17:8572387-8572417
  hypo
ttgttcttgaataaccgggcctggggaaac

SEQ ID NO: 44992 - DNA, 30 bp, Homo sapiens
  chr17:8732186-8732216
  hypo
gacagcacagaaacccgggccaactcccgg

SEQ ID NO: 44993 - DNA, 38 bp, Homo sapiens
  chr17:8789494-8789532
  hypo
tcgcgtcccaggccccgcctcaccgtctgtctctgctc

SEQ ID NO: 44994 - DNA, 30 bp, Homo sapiens
  chr17:8789780-8789810
  hypo
agggaggccttacctcggtctgatagactt

SEQ ID NO: 44995 - DNA, 36 bp, Homo sapiens
  chr17:9808139-9808175
  hypo
tcttgctgatggtcccgttaccgtccacgtcgtaga

SEQ ID NO: 44996 - DNA, 137 bp, Homo sapiens
  chr17:9810182-9810319
  hypo
gtgcactttccttagcggagcgcagtgctcgaggggacacactcagaaccccagccttgccaccgtggatggagagttgtctctttttgccctggggtgagaatgatgaagaataaaccccacggtctccaggcagg

SEQ ID NO: 44997 - DNA, 194 bp, Homo sapiens
  chr17:10212814-10213008
  hypo
cgcagaggcggccaccgtgctcaccttgagctggccctggaccgtgcgcagatgcttctgggtctctgccatctggcggttggagtggcccagctgaatctccatctcattaaggtctccctccatcttcttctttagcctcagggcgtcgttccggctgcggatttcagcatccagcacgctctgcagggcct

SEQ ID NO: 44998 - DNA, 30 bp, Homo sapiens; identical to SEQ ID NO: 16169
  chr17:11572707-11572737
  hypo

SEQ ID NO: 44999 - DNA, 165 bp, Homo sapiens
  chr17:11637555-11637720
  hypo
ctccagtgattactacgcacaataaaatcggggactgtgccgctctggcacagtcatctcaaccctggctgcacattagaatggcctgggtaattctacaaaatagtaatgcacagtgtccaccccgaaaagatgttgatttaattcctgcggaataggaccagt

SEQ ID NO: 45000 - DNA, 144 bp, Homo sapiens
  chr17:11672360-11672504
  hypo
aatgcttcggaacgccgctggtgcatctgtttctccctagagcccacccttggcaggcttattgtgctcccattccaggcgtgtttggtgcacacgagtgagaccatccgtgtgtgctacttcatggagcggttgatggcgcgg

SEQ ID NO: 45001 - DNA, 24 bp, Homo sapiens
  chr17:15702893-15702917
  hypo
gattacaggcgtgagccaccgcgc

SEQ ID NO: 45002 - DNA, 24 bp, Homo sapiens
  chr17:16120077-16120101
  hypo
cagcctgggcgacagagcctctca

SEQ ID NO: 45003 - DNA, 30 bp, Homo sapiens; identical to SEQ ID NO: 16171
  chr17:16282207-16282237
  hypo

SEQ ID NO: 45004 - DNA, 85 bp, Homo sapiens
  chr17:16282438-16282523
  hypo
tcagcaacaggtttccggtccccgcagagggtcccactctgaactcccgatttacagactgttctcgggccgtgatgaggattaa

SEQ ID NO: 45005 - DNA, 54 bp, Homo sapiens
  chr17:17123922-17123976
  hypo
tgcccagcacacctgcgtttccagctctcacaaaggcttcgacagacctggctc

SEQ ID NO: 45006 - DNA, 30 bp, Homo sapiens
  chr17:17146203-17146233
  hypo
aaacggactgtgagccgatgagtagcattt

SEQ ID NO: 45007 - DNA, 77 bp, Homo sapiens
  chr17:17395970-17396047
  hypo
ctcgaggaggaggtgcgaagtcctggagtattgtttgggtctcggaatgggcgcataacctgcgctgaccagtttag

SEQ ID NO: 45008 - DNA, 187 bp, Homo sapiens; identical to SEQ ID NO: 16172
  chr17:17579341-17579528
  hypo

SEQ ID NO: 45009 - DNA, 39 bp, Homo sapiens
  chr17:17592178-17592217
  hypo
tgggattacaggcgtgagtcactgcgcccagccttgggc

SEQ ID NO: 45010 - DNA, 108 bp, Homo sapiens
  chr17:17891258-17891366
  hypo
caacattgagaccatcgaggggctggacacactggtgaacctggaggacctgagcttgttcaacaaccggatctccaagatcgactccctggacgccctcgtcaagct

SEQ ID NO: 45011 - DNA, 40 bp, Homo sapiens
  chr17:17910311-17910351
  hypo
ggcctttgcttaactcggggctgcacgatggctcagtgcc

SEQ ID NO: 45012 - DNA, 38 bp, Homo sapiens
  chr17:18070928-18070966
  hypo
tcttcagcagtgtgccggccagccggcccagcgagcag

SEQ ID NO: 45013 - DNA, 283 bp, Homo sapiens
  chr17:18163071-18163354
  hypo
gcgtgagccaccgcgccctacccagtttcctcatttgtaaaatactttctaaggttgtcaccatgagcaaattaacaaagaatgcacgtgtagctcgcagcatacagcaggcgctcagtgagtggcaggttattattccgttttgttttgttttgtgcgccaggttattattcccacttagtgtcagcacccctgtgctcgtacccccctacaaagggaggctccagaagagaagcatccgtcttggtccttgctgttcaagggggctcgccctggctgacac

SEQ ID NO: 45014 - DNA, 21 bp, Homo sapiens
  chr17:18272614-18272635
  hypo
tttttgagaaagtctcgatct

SEQ ID NO: 45015 - DNA, 34 bp, Homo sapiens
  chr17:19230161-19230195
  hypo
ggtaaccataagggacgatcggtaaaagactcaa

SEQ ID NO: 45016 - DNA, 179 bp, Homo sapiens
  chr17:19622428-19622607
  hypo
actgcacacaacagacggatcagcagctcactctcaggaacagggctgccaatcccctagaatatacaagcaagtccgggcgatgctggaccctttcccttctcagctgatcacttgtttccaaggcccttatttcctggggcacatggcctatgacattctcccgatgccagttgccg

SEQ ID NO: 45017 - DNA, 89 bp, Homo sapiens
  chr17:19769823-19769912
  hypo
aataaataaataaataaataagaaaagtagcattacttcatccgataagcaacaaagtcagcccacttttaacacgccccttgggcaac

SEQ ID NO: 45018 - DNA, 118 bp, Homo sapiens
  chr17:19771594-19771712
  hypo
actccaggctttgcccgcgctctggaaaaccagagttcacgctgccaaactgccagccttcggacgcctctcggggtttactcgcttaggatccctagagggacggtgacaggcggga

SEQ ID NO: 45019 - DNA, 30 bp, Homo sapiens
  chr17:20008410-20008440
  hypo
ttttcggtgggggggcgggagacagggttt

SEQ ID NO: 45020 - DNA, 162 bp, Homo sapiens
  chr17:20771807-20771969
  hypo
taaatgatgctgaagcggaaacacgttttttcaagttcctgtatttttatgtggagttgctcactgcccaacgtagaggactaggaatcaggagtcggtggccgtatgctggaggctggagccgcgggagcgcggctcgcctcgctgcggttgttggcagtg

SEQ ID NO: 45021 - DNA, 30 bp, Homo sapiens
  chr17:20773688-20773718
  hypo
tctgctttgctgaggcgttttttttgtttt

SEQ ID NO: 45022 - DNA, 102 bp, Homo sapiens
  chr17:20813557-20813659
  hypo
aacaatacactgtaacgatgatgacagaataatataaaatgagacccctttctgctctaatcatatgaaaatagcacagatggccgggcgcggtggctcacg

SEQ ID NO: 45023 - DNA, 38 bp, Homo sapiens
  chr17:20817586-20817624
  hypo
aatgtgactcttggccgggcgcggtggctcacgcctgt

SEQ ID NO: 45024 - DNA, 70 bp, Homo sapiens
  chr17:21104001-21104071
  hypo
atgtacctgaagctccgaatgtgcctgacaggaactagcttcctttcatggctaacgagaagcacagccc

SEQ ID NO: 45025 - DNA, 53 bp, Homo sapiens; identical to SEQ ID NO: 16179
  chr17:21147486-21147539
  hypo

SEQ ID NO: 45026 - DNA, 30 bp, Homo sapiens
  chr17:21150794-21150824
  hypo
ccatcccactaaacacgattctcacagccc

SEQ ID NO: 45027 - DNA, 27 bp, Homo sapiens
  chr17:21168792-21168819
  hypo
acctgaggctcttaacgattctctgga

SEQ ID NO: 45028 - DNA, 37 bp, Homo sapiens
  chr17:21860030-21860067
  hypo
cacctggtccatgcccgccgcccggtgagcactgaga

SEQ ID NO: 45029 - DNA, 30 bp, Homo sapiens
  chr17:25432186-25432216
  hypo
tcttggctcctcccccgtggagattttttt

SEQ ID NO: 45030 - DNA, 142 bp, Homo sapiens; identical to SEQ ID NO: 1616
  chr17:25620573-25620715
  hypo

SEQ ID NO: 45031 - DNA, 108 bp, Homo sapiens
  chr17:25676881-25676989
  hypo
cccccgcctggtgtgcgcatgctaggggcagtgctgacacgctccactggtttcagatcaactttggagaatttggcgatagctagttaaagccgaagatgtgcatgc

SEQ ID NO: 45032 - DNA, 30 bp, Homo sapiens
  chr17:25680264-25680294
  hypo
atcccagcacgttgccgagctgaggcggga

SEQ ID NO: 45033 - DNA, 105 bp, Homo sapiens
  chr17:25907750-25907855
  hypo
tgtgcaatacaggtgcgtcagtcccttctcacaggctgtaaagaaatacctgaaactggattggttatttatttatttatgagacggcctggagtgcagtggcgc

SEQ ID NO: 45034 - DNA, 116 bp, Homo sapiens
  chr17:25931618-25931734
  hypo
gtctcagatctctcccgggagtccccgctagctgagagcagagcggtgttcctcaaggtctccttgacaaaccttgtttactcttaggctcgatgaccagccgaaagcagatgtgt

SEQ ID NO: 45035 - DNA, 30 bp, Homo sapiens
  chr17:25957285-25957315
  hypo
agaggtgcagactcacgtatggccctgggg

SEQ ID NO: 45036 - DNA, 40 bp, Homo sapiens; identical to SEQ ID NO: 16181
  chr17:26263183-26263223
  hypo

SEQ ID NO: 45037 - DNA, 22 bp, Homo sapiens
  chr17:26927142-26927164
  hypo
actggatttcaaacacgtcgta

SEQ ID NO: 45038 - DNA, 30 bp, Homo sapiens
  chr17:26961906-26961936
  hypo
catccttcatcagctcgtagttatcatgaa

SEQ ID NO: 45039 - DNA, 24 bp, Homo sapiens
  chr17:27056401-27056425
  hypo
ctccctctgtcaccccggctggag

SEQ ID NO: 45040 - DNA, 24 bp, Homo sapiens
  chr17:27056845-27056869
  hypo
gagccaccgcgacaggccagaagt

SEQ ID NO: 45041 - DNA, 30 bp, Homo sapiens; identical to SEQ ID NO: 16185
  chr17:27074858-27074888
  hypo

SEQ ID NO: 45042 - DNA, 22 bp, Homo sapiens
  chr17:27081800-27081822
  hypo
ttttttttcctgagacgggagt

SEQ ID NO: 45043 - DNA, 20 bp, Homo sapiens
  chr17:27170162-27170182
  hypo
tttttttttctgagtcgaag

SEQ ID NO: 45044 - DNA, 30 bp, Homo sapiens; identical to SEQ ID NO: 16187
  chr17:27411663-27411693
  hypo

SEQ ID NO: 45045 - DNA, 30 bp, Homo sapiens
  chr17:27419477-27419507
  hypo
gacacagaccacccccgccccagggagaga

SEQ ID NO: 45046 - DNA, 96 bp, Homo sapiens
  chr17:27716046-27716142
  hypo
catacactgtatacacggattgcttaggtctgatcaacatgctccttccttggagcacagatctactatggccagcctggtctcgaactcctgacc

SEQ ID NO: 45047 - DNA, 120 bp, Homo sapiens
  chr17:27716202-27716322
  hypo
gcccggcccagagttaatttttattcatgaaactcatataacaggtttatttatttcagtcgttttgttggttaaagaaccaagattttttatgactacactttgtgtacacttttaggt

SEQ ID NO: 45048 - DNA, 30 bp, Homo sapiens
  chr17:28715779-28715809
  hypo
tgtctgggccaggggcgacattgccacaag

SEQ ID NO: 45049 - DNA, 17 bp, Homo sapiens
  chr17:28988919-28988936
  hypo
gggtgcggtggctcacg

SEQ ID NO: 45050 - DNA, 23 bp, Homo sapiens
  chr17:29232244-29232267
  hypo
aggtttgtcttaggccgggcgcg

SEQ ID NO: 45051 - DNA, 186 bp, Homo sapiens
  chr17:30243768-30243954
  hypo
acgatgtaactaaaacgccactctacagttaactccctctattccttagatttcattcccggggtcacctctttggcctaggtgcacacaccgcgggctccgctctaggtggggcacaggccttcgcccgccgcatgcaccctgggctgcgcagccccagccagcccgacccgggctcagcgaccc

SEQ ID NO: 45052 - DNA, 30 bp, Homo sapiens
  chr17:30333112-30333142
  hypo
attaacatatgtttacgaaacctttctttt

SEQ ID NO: 45053 - DNA, 44 bp, Homo sapiens
  chr17:30710883-30710927
  hypo
cactccagcctggacaaggagtgggactccgtctcaaaaaacaa

SEQ ID NO: 45054 - DNA, 30 bp, Homo sapiens
  chr17:30822187-30822217
  hypo
atgtggttgaacagacgccaccaggtctct

SEQ ID NO: 45055 - DNA, 50 bp, Homo sapiens
  chr17:30954269-30954319
  hypo
ggattgagggagggccgagggagtgagtaggctagcgcacaccagcacag

SEQ ID NO: 45056 - DNA, 30 bp, Homo sapiens
  chr17:31162054-31162084
  hypo
ccacatttcttcaaccgcttcccattgcct

SEQ ID NO: 45057 - DNA, 155 bp, Homo sapiens
  chr17:31214020-31214175
  hypo
taaagccctggtttacgtccctcctggcacaactcttcccatttccccattccgtgtgaagagtgccatcccatggagccttgattgttacctgccaatttgtatatgttatttgcattaaaacttctgattcacggaggagccaagatggccga

SEQ ID NO: 45058 - DNA, 184 bp, Homo sapiens
  chr17:32237066-32237250
  hypo
aaatgagtgaatacccgtgcagtgctaagagtggtgcttggcatgtagcaagagcccaggaaatgttggctattaatattcaaacagcttttggggatatcgctacatattctgtgcctaagatgcaaagatgaataaggggatatctgtcctcagagcatccatattccggttggatgacaga

SEQ ID NO: 45059 - DNA, 23 bp, Homo sapiens
  chr17:32239704-32239727
  hypo
attatagactagggccgggtgag

SEQ ID NO: 45060 - DNA, 30 bp, Homo sapiens
  chr17:32275435-32275465
  hypo
gagatcacacaatcacgggctcagagagtt

SEQ ID NO: 45061 - DNA, 17 bp, Homo sapiens
  chr17:33877286-33877303
  hypo
aggtgcagtggctcacg

SEQ ID NO: 45062 - DNA, 38 bp, Homo sapiens
  chr17:33917230-33917268
  hypo
ccggctgtaacttctaatgaagacgtcagtttttgcca

SEQ ID NO: 45063 - DNA, 189 bp, Homo sapiens
  chr17:35061647-35061836
  hypo
gaacagtttttatggcggctattcgggggatgcttttatattgatggtatacagcctgaatctgtcttttttgcatcccaccccccttccctgggcagggaggggaagtctgtgtaactatttttcatgcatttaatatattaattatctggtaaatgctccccaggctgtgctcgggacattggagag

SEQ ID NO: 45064 - DNA, 43 bp, Homo sapiens
  chr17:37011090-37011133
  hypo
aatagtatcgcttctcggccttttggccaagatcaagtgtaaa

SEQ ID NO: 45065 - DNA, 29 bp, Homo sapiens
  chr17:37192172-37192201
  hypo
ttagccgccacccccgggcagtaactggc

SEQ ID NO: 45066 - DNA, 30 bp, Homo sapiens; identical to SEQ ID NO: 16197
  chr17:37369159-37369189
  hypo

SEQ ID NO: 45067 - DNA, 23 bp, Homo sapiens
  chr17:37606489-37606512
  hypo
actgctcccggcctcacctttcg

SEQ ID NO: 45068 - DNA, 17 bp, Homo sapiens
  chr17:37887620-37887637
  hypo
cccggtgctgatggcat

SEQ ID NO: 45069 - DNA, 33 bp, Homo sapiens
  chr17:38179589-38179622
  hypo
ctgtctgctgcagcacgtcggcacacatgcgct

SEQ ID NO: 45070 - DNA, 17 bp, Homo sapiens
  chr17:38445245-38445262
  hypo
cccggcccatttcaggt

SEQ ID NO: 45071 - DNA, 146 bp, Homo sapiens; identical to SEQ ID NO: 1618
  chr17:39682499-39682645
  hypo

SEQ ID NO: 45072 - DNA, 124 bp, Homo sapiens
  chr17:39768852-39768976
  hypo
ggctggagccgcccccgatgccgcctccgatgccgcaggagcccttcatggagctggaggaggtgaactggcggctgcaggtggtcatggtgccaaggagggaggtgagcgagtgagcagttgg

SEQ ID NO: 45073 - DNA, 36 bp, Homo sapiens
  chr17:39803800-39803836
  hypo
aactgcaggatgcaccggcagcgatggagaagcctc

SEQ ID NO: 45074 - DNA, 30 bp, Homo sapiens
  chr17:39855665-39855695
  hypo
tatgcttctactgtccgtttttgtgtgctc

SEQ ID NO: 45075 - DNA, 23 bp, Homo sapiens
  chr17:40477866-40477889
  hypo
accgcgcccggccaatcaatttc

SEQ ID NO: 45076 - DNA, 30 bp, Homo sapiens
  chr17:40705998-40706028
  hypo
ctggccctctctgcccggctcacattagct

SEQ ID NO: 45077 - DNA, 24 bp, Homo sapiens
  chr17:40801969-40801993
  hypo
ctccctctccgaaaaaaaaaaaac

SEQ ID NO: 45078 - DNA, 103 bp, Homo sapiens; identical to SEQ ID NO: 16200
  chr17:40975574-40975677
  hypo

SEQ ID NO: 45079 - DNA, 30 bp, Homo sapiens
  chr17:41188525-41188555
  hypo
cccagagcccggcgccgccccagttgggcc

SEQ ID NO: 45080 - DNA, 138 bp, Homo sapiens
  chr17:41278565-41278703
  hypo
ctttttccgtgtctccggacagctaatcgttttagtgacaggatgagagagcccttcgtgttctgagggaccgagtgggcgaaaagcgccggagagttggagagtctgtggttcagaatgcgaggtgacaacgtgcta

SEQ ID NO: 45081 - DNA, 30 bp, Homo sapiens
  chr17:41416844-41416874
  hypo
tcttcggattccttgcgggatctgcagact

SEQ ID NO: 45082 - DNA, 193 bp, Homo sapiens
  chr17:41464759-41464952
  hypo
tcttagccaaaaggacgagaagagatgtcgtcgccttcctccctgccatcaccgtcccactctcatctacattcaagacgcggtgagagccccagcctcgctccttgcctcattcactttgtcttgtccacaccaatattgacgccattacacactcgggctgatttcttattctccacgttttaaaagaaaa

SEQ ID NO: 45083 - DNA, 34 bp, Homo sapiens
  chr17:41957252-41957286
  hypo
aggtagcgcccagcacggacgtcagcctccatct

SEQ ID NO: 45084 - DNA, 294 bp, Homo sapiens
  chr17:42330572-42330866
  hypo
ccatgacagtgagggcgttggcatgggtgacggaacgcacggtggtggcactgagccagggcatcccaaagagggcggccaccccacccatgcctactaccagcagcaggtccaggtggaagccggagcccttgaccatcttgcgctcaggtttgctgacaatcagcctacggtaggggaaggtgaggggtaagcagggttctcccctgcctcctccaccccctccttccttctccatacttggtgtccttgtagctcagttttgtcttctgtgcccctcgctctttgagttcc

SEQ ID NO: 45085 - DNA, 144 bp, Homo sapiens
  chr17:42331627-42331771
  hypo
gccaccgcgcccggccacgttttttttttcttaaaaagagctctccaaattatacaacttctggtcccacaaaacctggaactgcccctggcttttcactattcctgctagtcgggagggccacacacccgcagggactagctt

SEQ ID NO: 45086 - DNA, 30 bp, Homo sapiens
  chr17:42335482-42335512
  hypo
cacgcaccaggcccccgaagagctggcctg

SEQ ID NO: 45087 - DNA, 41 bp, Homo sapiens; identical to SEQ ID NO: 16204
  chr17:42395128-42395169
  hypo

SEQ ID NO: 45088 - DNA, 16 bp, Homo sapiens
  chr17:42401285-42401301
  hypo
gcgtgagccaccgcac

SEQ ID NO: 45089 - DNA, 23 bp, Homo sapiens
  chr17:42587332-42587355
  hypo
gagccagacgccttctcaaaaaa

SEQ ID NO: 45090 - DNA, 82 bp, Homo sapiens
  chr17:42787212-42787294
  hypo
catggcacttccctccgtactgcccctttagttaatatcatctagttggccgggcgcggctgctcacgcctgtaatcccagc

SEQ ID NO: 45091 - DNA, 82 bp, Homo sapiens
  chr17:42787534-42787616
  hypo
cgtctcaaaaaaaagaaaaaaaaaataccgtctacttttacttctggattgttaacagatatgccatcggcttgttgccttt

SEQ ID NO: 45092 - DNA, 30 bp, Homo sapiens
  chr17:43001916-43001946
  hypo
tgtgaagtgaagagccgggctcagacctca

SEQ ID NO: 45093 - DNA, 30 bp, Homo sapiens
  chr17:43318029-43318059
  hypo
ggcccacagggcacacgggccacagggcca

SEQ ID NO: 45094 - DNA, 20 bp, Homo sapiens
  chr17:45268837-45268857
  hypo
tacattttttttttccgaga

SEQ ID NO: 45095 - DNA, 30 bp, Homo sapiens
  chr17:45971018-45971048
  hypo
gaagcatagctaccccgtttttctcccaga

SEQ ID NO: 45096 - DNA, 39 bp, Homo sapiens
  chr17:46177212-46177251
  hypo
taaaatatggccaggcgcagtggctcacgcctataatcc

SEQ ID NO: 45097 - DNA, 116 bp, Homo sapiens
  chr17:46946208-46946324
  hypo
tatgcattgtgaattcgatctcaaattatcatttgggacatgaaggatgtctcaaatacaaacacagagcaagttaaacactgttgaacttggatagattacggtgatgtcagtac

SEQ ID NO: 45098 - DNA, 30 bp, Homo sapiens
  chr17:47170202-47170232
  hypo
ctcactattacacctcgtagactgcttgaa

SEQ ID NO: 45099 - DNA, 95 bp, Homo sapiens
  chr17:47227368-47227463
  hypo
ttgtatttcctcttccgttaattacctgtttatgttctttaccatttaaaaattttggaggtcggggggggtcagccccccacctggccagccgc

SEQ ID NO: 45100 - DNA, 30 bp, Homo sapiens
  chr17:47330524-47330554
  hypo
cagttaggaggccagcgtgaggctgcagtg

SEQ ID NO: 45101 - DNA, 30 bp, Homo sapiens
  chr17:47449030-47449060
  hypo
ggagaggcctatgggcggagctcagaggag

SEQ ID NO: 45102 - DNA, 86 bp, Homo sapiens
  chr17:47657508-47657594
  hypo
agaccggggttctcccggatctggatggcgccgccctctcagcagcgggcacgggtggggcggggccgggccgcagagcatgtgct

SEQ ID NO: 45103 - DNA, 32 bp, Homo sapiens; identical to SEQ ID NO: 16208
  chr17:47851118-47851150
  hypo

SEQ ID NO: 45104 - DNA, 31 bp, Homo sapiens; identical to SEQ ID NO: 16209
  chr17:47851390-47851421
  hypo

SEQ ID NO: 45105 - DNA, 30 bp, Homo sapiens
  chr17:48239531-48239561
  hypo
tccagctctcctgaccgacgccccaactgg

SEQ ID NO: 45106 - DNA, 35 bp, Homo sapiens
  chr17:48611963-48611998
  hypo
cccacagaaggcccacgacccgctggaaggaaaga

SEQ ID NO: 45107 - DNA, 62 bp, Homo sapiens
  chr17:48612246-48612308
  hypo
gatggagggtggagccgaaaggtgtttggtgggtgggggacagttcacgggtgaagtggagg

SEQ ID NO: 45108 - DNA, 440 bp, Homo sapiens
  chr17:48652984-48653424
  hypo
ctgatgcgggagcagcgtgtgcggttcctgtccaacgccagcaccctggctagcttctctgagcccggcagctgctatgaggagctgctcaagtacctggtgtacatccttcgtaaggcagcccgcaggctggctcaggtctctcgggcagcaggtgtgcgggttgggctgctcagcagcccagcacccctcgggggccaggagacccagcccagcagcagctgctctcgctcccaccgccgcctatccgtccaccacctggtgcaccaccaccaccaccatcaccaccactaccacctgggcaatgggacgctcagggccccccgggccagcccggagatccaggacagggatgccaatgggtcccgccggctcatgctgccaccaccctcgacgcctgccctctccggggccccccctggtggcgcagagtctgtgca

SEQ ID NO: 45109 - DNA, 64 bp, Homo sapiens
  chr17:48687158-48687222
  hypo
gagctgaggggaagccgcccctgaggggccctgcccagcgcacctggtccggccagtgaccaat

SEQ ID NO: 45110 - DNA, 25 bp, Homo sapiens
  chr17:48799845-48799870
  hypo
cgcgcccggccggctcctcttatgc

SEQ ID NO: 45111 - DNA, 120 bp, Homo sapiens; identical to SEQ ID NO: 1620
  chr17:49229470-49229590
  hypo

SEQ ID NO: 45112 - DNA, 30 bp, Homo sapiens
  chr17:51321147-51321177
  hypo
ttatgaatatttcctcggtaaaaattaact

SEQ ID NO: 45113 - DNA, 39 bp, Homo sapiens; identical to SEQ ID NO: 16215
  chr17:53479136-53479175
  hypo

SEQ ID NO: 45114 - DNA, 40 bp, Homo sapiens
  chr17:53916938-53916978
  hypo
aactggggtgcaggacgagtgtcctcataagaagtcaaag

SEQ ID NO: 45115 - DNA, 30 bp, Homo sapiens; identical to SEQ ID NO: 16216
  chr17:54473510-54473540
  hypo

SEQ ID NO: 45116 - DNA, 34 bp, Homo sapiens; identical to SEQ ID NO: 5202
  chr17:55037248-55037282
  hypo

SEQ ID NO: 45117 - DNA, 44 bp, Homo sapiens; identical to SEQ ID NO: 16218
  chr17:55184791-55184835
  hypo

SEQ ID NO: 45118 - DNA, 181 bp, Homo sapiens
  chr17:55364048-55364229
  hypo
ggagaatgtatttcccggctcactgtgagcctcgacttaatttgttcctttcctaaggcaaaatgaccttccagtaaacccacaccccctcccccgcttattattatttatttatttttctggtgaacaaacagaattaggaaaggtgtgttcttccaggagagagcgggcagtgtgggag

SEQ ID NO: 45119 - DNA, 70 bp, Homo sapiens
  chr17:56031530-56031600
  hypo
gtggctcaggtgctgcgggatcacccagggaaggctcattcctctcgctacaagacgctgactgcggatc

SEQ ID NO: 45120 - DNA, 102 bp, Homo sapiens
  chr17:57297027-57297129
  hypo
tacaggcgtgggccaccgcgcccggctgaatcaggattttaaatattcactctgcttttctagtcctgtgggagatatggtcttctccgtaaaatttctccc

SEQ ID NO: 45121 - DNA, 30 bp, Homo sapiens
  chr17:57881555-57881585
  hypo
gaaagcaaaattgcacgtaacatatagaac

SEQ ID NO: 45122 - DNA, 21 bp, Homo sapiens
  chr17:58471329-58471350
  hypo
ccaccgcgccccaccaatatt

SEQ ID NO: 45123 - DNA, 110 bp, Homo sapiens
  chr17:60216644-60216754
  hypo
acctggcgctctaggcggttcttggtctcccgtagctcccggcacagtgctttctcccattggtcccgcagggtcttcagggtcttccgcgcgtgcgtgacctccttgct

SEQ ID NO: 45124 - DNA, 41 bp, Homo sapiens
  chr17:60221577-60221618
  hypo
atatagagtaattcaagctaaggacccgcatgctaactagg

SEQ ID NO: 45125 - DNA, 30 bp, Homo sapiens
  chr17:60242060-60242090
  hypo
aatgagactctatttcggaaaaaaaaaaga

SEQ ID NO: 45126 - DNA, 35 bp, Homo sapiens
  chr17:60670444-60670479
  hypo
gcccagttcctaacaaggcacggacctgtactggg

SEQ ID NO: 45127 - DNA, 54 bp, Homo sapiens
  chr17:60744566-60744620
  hypo
acccaggttagaaagcgcggaggaccccgtggtctggggcggagctggagctga

SEQ ID NO: 45128 - DNA, 59 bp, Homo sapiens
  chr17:60766944-60767003
  hypo
ctcaacggcaccttccggctgcttcagaagccgctgcgctggcacgatgccctcctgct

SEQ ID NO: 45129 - DNA, 234 bp, Homo sapiens
  chr17:60856637-60856871
  hypo
cagaaagaagaggcccgacccacaaggaatctgagaatgggcaagcagaaattagagaaaattaaaagcatgattcatggaacacatatgccacatcctaagccgtggctgctttcatgacactgtaaagggtgtcagtgggttgacattgacagattaatgggaggatgtctccccaagagccgtttgaaagtggagaagctgaaggtttcacggacacgataggatgaatca

SEQ ID NO: 45130 - DNA, 80 bp, Homo sapiens
  chr17:61580796-61580876
  hypo
ccgtcctcagcttcacgctcgaataaacctgttaaactggattctgatcttttttattatttcaggttgacagaacactg

SEQ ID NO: 45131 - DNA, 19 bp, Homo sapiens
  chr17:61580936-61580955
  hypo
tgcccgatcatatggtaat

SEQ ID NO: 45132 - DNA, 66 bp, Homo sapiens
  chr17:61607855-61607921
  hypo
cataaggtggtggagcggacacagaacgtcactgagaaggtcacccaggtgcgggcctgcagagca

SEQ ID NO: 45133 - DNA, 30 bp, Homo sapiens
  chr17:61677509-61677539
  hypo
gtgagccaccgcgcccggctgtcctgcttc

SEQ ID NO: 45134 - DNA, 160 bp, Homo sapiens
  chr17:61817857-61818017
  hypo
gcgaaactccatctcaaaaaaattaaaataaaaataaagagagaaaataataaacccagcaaacatttatggcaaacttcctacgtgtcaggcactgtgctaaatgcttcatgagcagctcacaagtattatcatctctgttttacggatcaggaaattc

SEQ ID NO: 45135 - DNA, 30 bp, Homo sapiens
  chr17:61847674-61847704
  hypo
aggcattgcagactgcggaacaggtttggc

SEQ ID NO: 45136 - DNA, 30 bp, Homo sapiens
  chr17:62020148-62020178
  hypo
tcagtgctgccctgccggtccagcccgccc

SEQ ID NO: 45137 - DNA, 16 bp, Homo sapiens
  chr17:62054818-62054834
  hypo
gcgatagagcaagacc

SEQ ID NO: 45138 - DNA, 227 bp, Homo sapiens
  chr17:64672331-64672558
  hypo
tcccagtaacgtgaccgggaaaatgtgagccagaggaaacttgagagctccgtggtgcggctgagctggtggggtgagggttttttccctttttctatctggtccagcccatcggccacttgagatgctcctgaactgagtaaccaagctgttcggagggtactttctcagcaggacaagccctgagctctggaaaaacgcagctagaataacgaggaagcagaggg

SEQ ID NO: 45139 - DNA, 30 bp, Homo sapiens
  chr17:65298508-65298538
  hypo
atctcagtattctatcgatcactaggaaga

SEQ ID NO: 45140 - DNA, 24 bp, Homo sapiens
  chr17:65789887-65789911
  hypo
cccagcactttgggacgttgaggc

SEQ ID NO: 45141 - DNA, 39 bp, Homo sapiens
  chr17:66421027-66421066
  hypo
caaaacaaatcagtacttccatctcgaaatgatttcagg

SEQ ID NO: 45142 - DNA, 20 bp, Homo sapiens
  chr17:66462836-66462856
  hypo
gtcaccgtgcccaaccatgt

SEQ ID NO: 45143 - DNA, 30 bp, Homo sapiens; identical to SEQ ID NO: 16224
  chr17:66643303-66643333
  hypo

SEQ ID NO: 45144 - DNA, 30 bp, Homo sapiens
  chr17:66872616-66872646
  hypo
cctcggggtccatcccggtcgacggctcat

SEQ ID NO: 45145 - DNA, 22 bp, Homo sapiens
  chr17:67410388-67410410
  hypo
tccctctcgggaaaaaaacaac

SEQ ID NO: 45146 - DNA, 24 bp, Homo sapiens
  chr17:68268160-68268184
  hypo
ttaaaaaaatattgtcggccgggc

SEQ ID NO: 45147 - DNA, 38 bp, Homo sapiens; identical to SEQ ID NO: 16227
  chr17:70657503-70657541
  hypo

SEQ ID NO: 45148 - DNA, 30 bp, Homo sapiens; identical to SEQ ID NO: 16228
  chr17:70712704-70712734
  hypo

SEQ ID NO: 45149 - DNA, 30 bp, Homo sapiens
  chr17:71201620-71201650
  hypo
tgaagctgtttattacgctcacataccaag

SEQ ID NO: 45150 - DNA, 30 bp, Homo sapiens
  chr17:71202377-71202407
  hypo
catcgcctggtgcagcgaacttctgtgagt

SEQ ID NO: 45151 - DNA, 30 bp, Homo sapiens
  chr17:71375377-71375407
  hypo
gctgtgtggccgtggcgccgtggacgacca

SEQ ID NO: 45152 - DNA, 30 bp, Homo sapiens; identical to SEQ ID NO: 16229
  chr17:71391476-71391506
  hypo

SEQ ID NO: 45153 - DNA, 30 bp, Homo sapiens
  chr17:71417363-71417393
  hypo
taactgctctccacacgggctgccacctgc

SEQ ID NO: 45154 - DNA, 30 bp, Homo sapiens
  chr17:71427753-71427783
  hypo
tccaggggtgtgaagcgaggcagctgcaca

SEQ ID NO: 45155 - DNA, 30 bp, Homo sapiens
  chr17:71484009-71484039
  hypo
agtctttaacaacctcggctgtggcttcag

SEQ ID NO: 45156 - DNA, 21 bp, Homo sapiens
  chr17:71879558-71879579
  hypo
ctccaaaatccgaaacgctcc

SEQ ID NO: 45157 - DNA, 30 bp, Homo sapiens
  chr17:72233647-72233677
  hypo
ctacaggtgaaggaccggtgggaggcagag

SEQ ID NO: 45158 - DNA, 119 bp, Homo sapiens
  chr17:72356210-72356329
  hypo
gcagcaggcggtgggcgtggaatacccggacctcatcggtgcccgcagcctgcacccgcagaaccacatcgctggcgttgccctgccgcagcagctcctgcaagcgctggagcaccgcc

SEQ ID NO: 45159 - DNA, 30 bp, Homo sapiens; identical to SEQ ID NO: 16232
  chr17:72370768-72370798
  hypo

SEQ ID NO: 45160 - DNA, 30 bp, Homo sapiens
  chr17:72731669-72731699
  hypo
gtctccgggagcccacggcattgagcaaac

SEQ ID NO: 45161 - DNA, 30 bp, Homo sapiens
  chr17:72800435-72800465
  hypo
cagtgtcccagccagcggtgctggccctgc

SEQ ID NO: 45162 - DNA, 30 bp, Homo sapiens
  chr17:72969610-72969640
  hypo
tcatcaaaacaaggccgggtgcggtggcta

SEQ ID NO: 45163 - DNA, 19 bp, Homo sapiens
  chr17:73031621-73031640
  hypo
actccagtctctggccggg

SEQ ID NO: 45164 - DNA, 26 bp, Homo sapiens
  chr17:73083437-73083463
  hypo
agcgagactcccggccaactgagtac

SEQ ID NO: 45165 - DNA, 257 bp, Homo sapiens
  chr17:73089693-73089950
  hypo
cattggcagtgaggccgtggcagcgtcggcagcagaggatgccccaggccctggagcgtgcagatggcagctgggcctgggtggtgctgctggccaccatggtgacccagggcctcaccctgggcttccccacgtgtatcggcatcttcttcactgaattgcaatgggagttccaggccagcaacagcgagacctcttggttcccctccatcctcacggctgtgctccacatggcaggtgagcggcctagggagggg

SEQ ID NO: 45166 - DNA, 105 bp, Homo sapiens
  chr17:73091075-73091180
  hypo
agactgcagagaccccggcctcggaggggcccggtggacagcagcccgagctgatggcccacaggcctctgcaggcgtgtgtctgctggccgcagctgcccatct

SEQ ID NO: 45167 - DNA, 30 bp, Homo sapiens
  chr17:73091437-73091467
  hypo
tccccagctgacttgcggctcaccaccccc

SEQ ID NO: 45168 - DNA, 30 bp, Homo sapiens
  chr17:73124882-73124912
  hypo
tgtctgccatcaccacgctcatgcacctga

SEQ ID NO: 45169 - DNA, 17 bp, Homo sapiens
  chr17:73135904-73135921
  hypo
tccgtctcaaaaataaa

SEQ ID NO: 45170 - DNA, 41 bp, Homo sapiens
  chr17:73179823-73179864
  hypo
ggattacaggcgtgagccaccgcgcccggcctacagtgtct

SEQ ID NO: 45171 - DNA, 463 bp, Homo sapiens
  chr17:73585955-73586418
  hypo
cccgactgcacccgacgggccttccctcgacgagagcggctccagcagtgaggcggagttggagaccctcaatgacgagcccccggtgcgctgggcgcagggctcaggcccccacgagggtcctaggcttggcgccgccgtgctgctaccccgactctccttggagacccgcctgcagcaggagggagacccgggcctccgtgggtccctgagggagctgtgggaacccgaggatgaggacgaggcggtgctggagagggacctggagctgagcctccggccgggcctggaggcgccacccttccccggtgccaagggcaggagcctcggagacggcctggaagacatggaggacctggcgcggttgcggttagcgggcgcggtgccaaagctgccatccccggctcacagctcctcatatccaccctgccctcatctttatgaattgcgtgtagacccttat

SEQ ID NO: 45172 - DNA, 48 bp, Homo sapiens
  chr17:73592635-73592683
  hypo
ggtaagaggattgggcgtggacgtggcaggggccgctcaggcattgcc

SEQ ID NO: 45173 - DNA, 52 bp, Homo sapiens
  chr17:73606380-73606432
  hypo
gctgcctgagctggccgagctggccaaatcccagcagcgttgaccctctcag

SEQ ID NO: 45174 - DNA, 30 bp, Homo sapiens
  chr17:73608306-73608336
  hypo
ttattgaatgggagacgttatttagatcca

SEQ ID NO: 45175 - DNA, 200 bp, Homo sapiens
  chr17:73615929-73616129
  hypo
acctcagttcatgcccgatccctgcgcagctttgcggaggtgctgggtgtggagtgccggggcggctccaccctggagctgtcactgaagagcgagcagctggtgctgcacacagcccgggcaagggccatcgaggcgctggttgagctattcctgaatgagcttaagaaggtaagtgtggggcacgggttgagaggccg

SEQ ID NO: 45176 - DNA, 30 bp, Homo sapiens
  chr17:73635801-73635831
  hypo
ccatgaacctgctctcgggagaacctgctc

SEQ ID NO: 45177 - DNA, 254 bp, Homo sapiens
  chr17:73636137-73636391
  hypo
gacaaacttgttctgcgggctgcggatgggtgcgagggtggaatctcggtgctgcgacgagtgtggggccagccgtggaggctccaggtgttctctctgccccagcagagcccggcaggagccccaacaggaagccagcgcggcatggctgccaccgacttcgtgcaggagatgcgcgccgtgggcgagaggctgctgctcaagctgcagagactgccccaggctgagcccgtggagatcgtggccttctcagt

SEQ ID NO: 45178 - DNA, 37 bp, Homo sapiens; identical to SEQ ID NO: 16241
  chr17:73638388-73638425
  hypo

SEQ ID NO: 45179 - DNA, 39 bp, Homo sapiens
  chr17:73693123-73693162
  hypo
tgggattacaggtgtgagccaccgcgcccggcccctcct

SEQ ID NO: 45180 - DNA, 30 bp, Homo sapiens
  chr17:73931814-73931844
  hypo
tcaaggcttgagactcgccagaaggcgtca

SEQ ID NO: 45181 - DNA, 42 bp, Homo sapiens
  chr17:74005455-74005497
  hypo
agctgagccttcaggcggtcgatctcacgcagcacctcgggg

SEQ ID NO: 45182 - DNA, 30 bp, Homo sapiens
  chr17:74028304-74028334
  hypo
aggttagagatgaaacgatccctggggctg

SEQ ID NO: 45183 - DNA, 30 bp, Homo sapiens
  chr17:74062044-74062074
  hypo
acctatgtgaatgggcgtggctgggttcca

SEQ ID NO: 45184 - DNA, 165 bp, Homo sapiens; identical to SEQ ID NO: 16242
  chr17:74128189-74128354
  hypo

SEQ ID NO: 45185 - DNA, 30 bp, Homo sapiens
  chr17:74362291-74362321
  hypo
tggctggttctgattcgtgttcttttgctg

SEQ ID NO: 45186 - DNA, 30 bp, Homo sapiens; identical to SEQ ID NO: 16243
  chr17:74908784-74908814
  hypo

SEQ ID NO: 45187 - DNA, 30 bp, Homo sapiens
  chr17:74920559-74920589
  hypo
gcctgcagcagctcgcggcctcagccagcc

SEQ ID NO: 45188 - DNA, 178 bp, Homo sapiens
  chr17:75049797-75049975
  hypo
ggcctgtgttcaaatcgactctgctctgacttgtggtgtggacttggccgcgggactgagcgcggggcctgctcaggggccagcgtcacagggaagacagtccgagcaagcatgggtcagggcgctgaggcttcctcctgcgagccaaagggaaactcagccacggggactcagggag

SEQ ID NO: 45189 - DNA, 30 bp, Homo sapiens
  chr17:75207839-75207869
  hypo
tgtagcaggatccagcggttgaatggatgg

SEQ ID NO: 45190 - DNA, 104 bp, Homo sapiens
  chr17:75523080-75523184
  hypo
agtttgagaagatggcggcctgaaccggagtccttcttcccctcctccctctccgctgctgcaatgcccaggccccccgcaacgttcctcgtctgtaatggtgc

SEQ ID NO: 45191 - DNA, 39 bp, Homo sapiens
  chr17:75544134-75544173
  hypo
ctaggactaacaggcgtgagccaccgcacccggccaagc

SEQ ID NO: 45192 - DNA, 56 bp, Homo sapiens
  chr17:75630378-75630434
  hypo
gcaacatgggcaaggcgaaggttggaggctgggagggacatcgattcaaatcattg

SEQ ID NO: 45193 - DNA, 41 bp, Homo sapiens
  chr17:75733967-75734008
  hypo
acagagaataaaagacgcggcccgtacgcagagctgaagtg

SEQ ID NO: 45194 - DNA, 33 bp, Homo sapiens
  chr17:75770731-75770764
  hypo
ccctttttagaacaacgtcggggggtggtctgt

SEQ ID NO: 45195 - DNA, 30 bp, Homo sapiens
  chr17:75840791-75840821
  hypo
ttgtacacttaaaaacggctcattttgagc

SEQ ID NO: 45196 - DNA, 43 bp, Homo sapiens
  chr17:75905178-75905221
  hypo
catagggaatgaacacggatgaccccctcgttttctgagtaag

SEQ ID NO: 45197 - DNA, 79 bp, Homo sapiens
  chr17:76021242-76021321
  hypo
ttgacatgcacagtattgtgtatctgtcatagcagtttccctgccctaaaaatcccctgtgctccgcatagtcatcccc

SEQ ID NO: 45198 - DNA, 41 bp, Homo sapiens
  chr17:76101087-76101128
  hypo
aaacagtgcgggctgcggtgggtcagcgtcacatgctaatg

SEQ ID NO: 45199 - DNA, 92 bp, Homo sapiens
  chr17:76134317-76134409
  hypo
gccttgagctgggctcgcctcctgctcctgctcctgcccccttccctgggtgtcagccccctggggtctgcataactcgctgactcctggtt

SEQ ID NO: 45200 - DNA, 82 bp, Homo sapiens
  chr17:76136106-76136188
  hypo
gagcaaaactccgtctcaaaaaaggaaaaaaggataacatggctgagtgcagtggctcacgccgaggcgtgaagagtgcttg

SEQ ID NO: 45201 - DNA, 292 bp, Homo sapiens; identical to SEQ ID NO: 5208
  chr17:76137898-76138190
  hypo

SEQ ID NO: 45202 - DNA, 38 bp, Homo sapiens
  chr17:76138696-76138734
  hypo
agctctgtgttccatcgagggggcgacaagcctggacc

SEQ ID NO: 45203 - DNA, 19 bp, Homo sapiens
  chr17:76146895-76146914
  hypo
agcctacactccaaacggc

SEQ ID NO: 45204 - DNA, 33 bp, Homo sapiens
  chr17:76211252-76211285
  hypo
tttcggaggctgaggcgggcggatcacctgagg

SEQ ID NO: 45205 - DNA, 93 bp, Homo sapiens
  chr17:76211525-76211618
  hypo
aaagaaagcatatacttcagtgttgttctggatttttttcttcaagatgcctagttaatgacaatgaaattctgtactcggatggtatctgtc

SEQ ID NO: 45206 - DNA, 18 bp, Homo sapiens
  chr17:76212036-76212054
  hypo
atccttacagtgggccgg

SEQ ID NO: 45207 - DNA, 30 bp, Homo sapiens
  chr17:76217104-76217134
  hypo
gggcgatgcattgggcgctgattcttgttc

SEQ ID NO: 45208 - DNA, 125 bp, Homo sapiens
  chr17:76395588-76395713
  hypo
cctcttcgacaacagcgtcatcttgagcgggtgagtgcttcccaccgtcagtgcttttgccctcctgctctgcaggctggagggcagtggaataggaacagtgggaaacccgttcccctcagtct

SEQ ID NO: 45209 - DNA, 44 bp, Homo sapiens
  chr17:76404759-76404803
  hypo
aaggtgctgccaggccgcttcacctgcatcgccttggctttggg

SEQ ID NO: 45210 - DNA, 30 bp, Homo sapiens; identical to SEQ ID NO: 16251
  chr17:76419409-76419439
  hypo

SEQ ID NO: 45211 - DNA, 53 bp, Homo sapiens
  chr17:76498919-76498972
  hypo
cccttatctcagccacgaggcgccgccgagcccccacccgcctcagacctggg

SEQ ID NO: 45212 - DNA, 99 bp, Homo sapiens
  chr17:76501675-76501774
  hypo
aacaaaaggaaccagcgaagactgctctgagtcaggacacagaaaccaggccaggaaccgcagcccttctaagccaaacatccattctggaagatttct

SEQ ID NO: 45213 - DNA, 30 bp, Homo sapiens
  chr17:76526202-76526232
  hypo
aggtgctcggtacaccgggtttggagaagg

SEQ ID NO: 45214 - DNA, 66 bp, Homo sapiens
  chr17:76557445-76557511
  hypo
accgtgaagcctccccggcccctggctgtccaggagacttggccaagtgcacgcaacagtggctca

SEQ ID NO: 45215 - DNA, 78 bp, Homo sapiens
  chr17:76670740-76670818
  hypo
gcctcctcagggctgcgccctgcaccgccctggtccagggtcctgtggaggggcggggcgagacggccagacagccag

SEQ ID NO: 45216 - DNA, 112 bp, Homo sapiens
  chr17:76676225-76676337
  hypo
gagggctgcaccaggcgcgcactgccctttctcagcagtcacttacttaatgcacttaatccactcctccttctcctcgggcgtcggagctgagatccggtaaacagtgtgg

SEQ ID NO: 45217 - DNA, 80 bp, Homo sapiens
  chr17:76897106-76897186
  hypo
gcaggcacagcgccacgtccacgggcaccgcccgttcccaccctgcaggacgccacagcatcagacgagacggcccgtgt

SEQ ID NO: 45218 - DNA, 33 bp, Homo sapiens
  chr17:76958740-76958773
  hypo
tttccacctttggatcgacgctgaccttgtgat

SEQ ID NO: 45219 - DNA, 213 bp, Homo sapiens
  chr17:76974264-76974477
  hypo
agggggcctggtggacggctgcaatggcatccccagagcttgtcggaaatgcagtcatggctggccttgccctagcccctctgcatgggagtctgcatgaacaagcgccctgggagctgggtgcactggctggtgagcagctttgctctgggactcgtgctcgctggcactgtgcagccaccccttgtcggggctccccgggcaccactggag

SEQ ID NO: 45220 - DNA, 49 bp, Homo sapiens
  chr17:76991604-76991653
  hypo
cactctgaaggggcacgtgtgtcccaggggagtgcgggtgctgccctcg

SEQ ID NO: 45221 - DNA, 30 bp, Homo sapiens
  chr17:76997571-76997601
  hypo
ctgctgaataaatggcgaatctgttaatga

SEQ ID NO: 45222 - DNA, 272 bp, Homo sapiens
  chr17:77002640-77002912
  hypo
tgtctatggtgtgggcgcacagcttcagaaccctctacggtttgcagttactgccttgtaaagaggctgtgtctgcttaatttgtatcatcgatgttacacctggaggaattttagccaaaaggcgaccttctcagttgaaaggcacattccaaatggcaccacacatctgggaaggtgtccttttccagagtgtgtgaaaataacgggatgggatcatcgccccatggacctggatcagggctgccttccacaccgcggtggcacctgcac

SEQ ID NO: 45223 - DNA, 32 bp, Homo sapiens
  chr17:77003134-77003166
  hypo
accatcccagaggaacgcggggagcagcgtcc

SEQ ID NO: 45224 - DNA, 30 bp, Homo sapiens
  chr17:77104088-77104118
  hypo
cttccttcgccttcccgcctcaattccatg

SEQ ID NO: 45225 - DNA, 178 bp, Homo sapiens
  chr17:77105020-77105198
  hypo
cagctctgtcccctgcgttgaacagcgaggatgcagcacacaccccacagcgtgggaaccgctgtcccgatgctcacctgggcatgcgctgcaggacctgtctcagcagacgcgccatgtggtatgctgtcccaattccgacaagcatgtgttctgagctgtacgtgttcccaaggtg

SEQ ID NO: 45226 - DNA, 30 bp, Homo sapiens
  chr17:77126850-77126880
  hypo
ccctgtccttcagcccgggcttggtgcggg

SEQ ID NO: 45227 - DNA, 30 bp, Homo sapiens; identical to SEQ ID NO: 16254
  chr17:77127147-77127177
  hypo

SEQ ID NO: 45228 - DNA, 72 bp, Homo sapiens
  chr17:77135878-77135950
  hypo
gcatctctgcactgacgatgccggaggggcagaaccaccgtgtgtgcccggggaggacgtcttgctgacttc

SEQ ID NO: 45229 - DNA, 206 bp, Homo sapiens
  chr17:77143891-77144097
  hypo
gcaagctttgccaagcgccttcgatccagcctctctctcatgctaatgactgtcaacatgaaacagaggctgtgaaggggaagaaaattactccctgaaaaggaattgactgatccccatcatttctcaaggaatcactgacctgtgaatatttcattacccaaaatgctgcaccatccatccagagccgccgctgccgtggggcc

SEQ ID NO: 45230 - DNA, 154 bp, Homo sapiens
  chr17:77145129-77145283
  hypo
agctcccaccactgacgaacagcgcactctaaagcttaagaagcacaaggagatcctccagggcatggaggctcccgcagcacccaggctgggacccccgctgcctgccaggaaaatgcgacgtctgtgctattattgccggggttacaccagg

SEQ ID NO: 45231 - DNA, 45 bp, Homo sapiens
  chr17:77147241-77147286
  hypo
ggcaagcaacaaagccggcatcagaccctgcgtgctgaccacccc

SEQ ID NO: 45232 - DNA, 30 bp, Homo sapiens
  chr17:77174895-77174925
  hypo
agaataaacatcacccgacctcaactactt

SEQ ID NO: 45233 - DNA, 30 bp, Homo sapiens
  chr17:77365458-77365488
  hypo
gaccgtgacccttgccgtgactgctggggg

SEQ ID NO: 45234 - DNA, 34 bp, Homo sapiens
  chr17:77390969-77391003
  hypo
gagacgcaacacaggcgctcggggcgtgtgcagg

SEQ ID NO: 45235 - DNA, 34 bp, Homo sapiens
  chr17:77807459-77807493
  hypo
ctagaactctgaggccgggcgcagagctgccctg

SEQ ID NO: 45236 - DNA, 244 bp, Homo sapiens
  chr17:77807717-77807961
  hypo
cccccgcgggaatggcgcttccccttccgacgccctccggctacaccgtcacgtactccttgaaagtaacggtgaggcagttcgcggtgacgtcggtgataattatattcccaaagaagggcttgaactcgctcagcgactctgcaggttcgtcctgggcctcggctggaggcttctccgccgtcgtggtgggtgccgctgccgccgccaccgccaccgccgccgacgccggtgtctcgggctt

SEQ ID NO: 45237 - DNA, 78 bp, Homo sapiens
  chr17:77808479-77808557
  hypo
ccttcttctcctctgcgcccgccgcctttttaaaagtcctgtcggcaggagggtggcgctcgtcggctgcccgcttct

SEQ ID NO: 45238 - DNA, 217 bp, Homo sapiens
  chr17:77825381-77825598
  hypo
ctgcaagcgtcggggcgtgtccacacccttgtccgacgtgtccctggcatctggcacagtgcccagcacgtacctgtcagatgaatgttgaattaataggatttgtgtgaggaccgagtgagctcacacagccagatgaagctggtccacccgtacgggctggcaagagccgttggccacattctcagacattttgtgaacccgttgttgaacccag

SEQ ID NO: 45239 - DNA, 78 bp, Homo sapiens; identical to SEQ ID NO: 16257
  chr17:77926480-77926558
  hypo

SEQ ID NO: 45240 - DNA, 211 bp, Homo sapiens
  chr17:77948908-77949119
  hypo
acacccggaacaatccgccaggccgcgtcactcctcaccctccagcagggctttggatttttggacagcgagttctgtttcattttgttttgtttttccctttgcatttggtgaactccgtgtcaggaaagctagtctttgggattcaaggaagaacaaaacaaacccgatctcctgtaatctacctggattggaacgcccagctttgtac

SEQ ID NO: 45241 - DNA, 57 bp, Homo sapiens
  chr17:78078914-78078971
  hypo
accgcctccacttcacggtgggcagggcaggggcgggggcggcggccagggcagagg

SEQ ID NO: 45242 - DNA, 40 bp, Homo sapiens
  chr17:78083747-78083787
  hypo
ctgccatcagcagctcgggccctgccgggagctacaggcc

SEQ ID NO: 45243 - DNA, 103 bp, Homo sapiens
  chr17:78122150-78122253
  hypo
gcacctgggaccacaggtgtccacgcgcagccactaaccgctttcttatctgacactttaagtgcttcttcgtacccagctcctctaacgccttttgaagcag

SEQ ID NO: 45244 - DNA, 60 bp, Homo sapiens
  chr17:78151768-78151828
  hypo
ttcagcattcttttgcggggggccacaatcagtgacaccctgactcgcaagcctcaatca

SEQ ID NO: 45245 - DNA, 30 bp, Homo sapiens
  chr17:78152480-78152510
  hypo
tgggacggcttctggcgctgctcctgcaca

SEQ ID NO: 45246 - DNA, 45 bp, Homo sapiens
  chr17:78447074-78447119
  hypo
agcgtaggagaagggcgtgcccacacctggcgtggcgctggactt

SEQ ID NO: 45247 - DNA, 32 bp, Homo sapiens
  chr17:78599596-78599628
  hypo
agtatgcctccctcacgcgctgccacaaaggc

SEQ ID NO: 45248 - DNA, 144 bp, Homo sapiens; identical to SEQ ID NO: 16261
  chr17:78667900-78668044
  hypo

SEQ ID NO: 45249 - DNA, 30 bp, Homo sapiens
  chr17:78820077-78820107
  hypo
tcccttcgtgcaccccgcaggctctccctc

SEQ ID NO: 45250 - DNA, 76 bp, Homo sapiens
  chr17:78872638-78872714
  hypo
ggttcctggggatggcggtccagccacaatgacagcagcgcatgacaggagcccaaagacccgaaacagacgcagg

SEQ ID NO: 45251 - DNA, 101 bp, Homo sapiens
  chr17:78975561-78975662
  hypo
aggctgcagacacttcgctggaaggcacacttgccacggggcaggcagtgtggcagtcagaaatgtgtgggatggaatgggcgcggtggctcacgcctgta

SEQ ID NO: 45252 - DNA, 30 bp, Homo sapiens
  chr17:79001034-79001064
  hypo
ccagcagcatggagacgtctgggtcctccc

SEQ ID NO: 45253 - DNA, 30 bp, Homo sapiens
  chr17:79066768-79066798
  hypo
ccagcctgtgcccaccgctcgggggcaggg

SEQ ID NO: 45254 - DNA, 514 bp, Homo sapiens
  chr17:79093967-79094481
  hypo
gccccgggcagaccccgggtggcggcggcccacctggtcaaagaggtagacggtgacgtcgtcgaagaaggacacggccttcttcttgcgttccaggtcctcgcagaaggtctcggacagcaggctgggcatcttgagcaggctgcgcaggttgcgcgcgctctggctctcagccaccaccacgggcaccgccggcgcctcctcttcgctgtcctcgctaggctcctggacgctgtagcagcggagctcctcgtcagactcgtcgctgtcctcactgtcctcctcctcctcctccggccggccctccaaggccgcagggaggccgggcagagccaggcggagtggggctctgggggtgcctgggccccccatccgcttttgtggggccggccctgacaacagtcctgggggcccctggaactcagagctgttgccttctgatctcagcggaaccggggtcagcaggaaaaactgggagcagctggggctgggcccaggccgcaccttggctggg

SEQ ID NO: 45255 - DNA, 46 bp, Homo sapiens
  chr17:79094742-79094788
  hypo
aagtaggcagagtctcggtagggattcttctcgttgaggccactga

SEQ ID NO: 45256 - DNA, 35 bp, Homo sapiens; identical to SEQ ID NO: 16262
  chr17:79096981-79097016
  hypo

SEQ ID NO: 45257 - DNA, 48 bp, Homo sapiens
  chr17:79098155-79098203
  hypo
cccctctgcctggcacggcccgacctacgctcccgtgaaggcagccaa

SEQ ID NO: 45258 - DNA, 47 bp, Homo sapiens
  chr17:79099761-79099808
  hypo
ggcgtctggggctgacggggccacgtgtccttcgccacttcttccag

SEQ ID NO: 45259 - DNA, 75 bp, Homo sapiens
  chr17:79100184-79100259
  hypo
tggcctagggcttcccggccgctggcccgcgcccgccctcacctgtgcacgaaattgttgcgatgaaggtgcagg

SEQ ID NO: 45260 - DNA, 120 bp, Homo sapiens
  chr17:79104885-79105005
  hypo
gggcaaggagacctccgtgagtggcaggacgtacacgtcgggcccgttctgtgctgccgtggccggggagccctgcgccaggtcggctgcgtactcgtccccctccgcattctcaaactc

SEQ ID NO: 45261 - DNA, 30 bp, Homo sapiens; identical to SEQ ID NO: 16265
  chr17:79107633-79107663
  hypo

SEQ ID NO: 45262 - DNA, 149 bp, Homo sapiens
  chr17:79158112-79158261
  hypo
ctcctgatgcagccacgtggcccccttgcctcctcagccaggcgccaccttgccctggggcctttgcacctccagccctcagcctggcatgctcttccctagacatccggctgcaagacagactctctcttcttcgatgttttctgcaa

SEQ ID NO: 45263 - DNA, 125 bp, Homo sapiens
  chr17:79211706-79211831
  hypo
cgtgactagctccatcgctccccgagaaccgactgatgtcgtgtgttttacgttcgcttagcgcagacgtacttatttgtttcatgcttacttactggcacaaagatgtacggtttatagggatg

SEQ ID NO: 45264 - DNA, 30 bp, Homo sapiens
  chr17:79226304-79226334
  hypo
tgagtcgggcagaggcggcgccatctggcc

SEQ ID NO: 45265 - DNA, 17 bp, Homo sapiens
  chr17:79292579-79292596
  hypo
ggccgggcatggtggcg

SEQ ID NO: 45266 - DNA, 30 bp, Homo sapiens
  chr17:79505417-79505447
  hypo
ggccacaccgtggtccgcaggctccccgag

SEQ ID NO: 45267 - DNA, 30 bp, Homo sapiens
  chr17:79544264-79544294
  hypo
tcactgtgtagtcctcgccagactgcctgt

SEQ ID NO: 45268 - DNA, 48 bp, Homo sapiens; identical to SEQ ID NO: 16267
  chr17:79609256-79609304
  hypo

SEQ ID NO: 45269 - DNA, 161 bp, Homo sapiens
  chr17:79619136-79619297
  hypo
tgagtggacactcctcggtgcgttgatgggagcgcggtgcctgtgtgcgcacacgagtgagtggacactcctcggtgcactgatgggagcgagatgcccgtgtgtgcgcatgtgtgagtggacactcctcggtgcattgtgccatggctgtccctgggtgg

SEQ ID NO: 45270 - DNA, 102 bp, Homo sapiens
  chr17:79626311-79626413
  hypo
acctgggtgacagagcgagacctcaactctgaaatagtaaaataggccaggcatggtggctcatccctgtacttttggaggacgaggtggctggaccacctg

SEQ ID NO: 45271 - DNA, 30 bp, Homo sapiens
  chr17:79643888-79643918
  hypo
gacactgtgtgccagcgaagtggggacctg

SEQ ID NO: 45272 - DNA, 145 bp, Homo sapiens
  chr17:79668589-79668734
  hypo
cgcaggcacaggggccgccggcacagggcagcgaggcccagctcatttcattcgactgacccaggccatgctcacgtccggagtaacactacatacagttcacctgaaacgcctcgtctctaactgccgtcgtcctgcctccctg

SEQ ID NO: 45273 - DNA, 22 bp, Homo sapiens
  chr17:79695451-79695473
  hypo
gagccaccgcacctggccagct

SEQ ID NO: 45274 - DNA, 329 bp, Homo sapiens
  chr17:79769364-79769693
  hypo
gggctgctcaggacccgctacagccagaaaattggcgacgacctcagtgtcagcacctggctcagtgatggagtgagcccccctcggcggccccaggcaggtgggtgggtgggcagccaggcaggtggccacgtagccgcgctcacactgcacctgtaccaggcggtggctggctgccgtgtggccgcggtgttcatgcaatatggcatcgtggccaactactgctggctgctggtggagggcctgtacctgcacaacctgctgggcctggccaccctccccgagaggagcttcttcagcctctacctgggcatcggctggggtgagtg

SEQ ID NO: 45275 - DNA, 30 bp, Homo sapiens; identical to SEQ ID NO: 16269
  chr17:79774960-79774990
  hypo

SEQ ID NO: 45276 - DNA, 30 bp, Homo sapiens; identical to SEQ ID NO: 16270
  chr17:79847763-79847793
  hypo

SEQ ID NO: 45277 - DNA, 86 bp, Homo sapiens
  chr17:79870436-79870522
  hypo
ccttcttcaccagcacgcaggggagtcgccagtgagaaaatgggatcctgccacctgccaaaaagggaaagcggcatcaggcgggc

SEQ ID NO: 45278 - DNA, 173 bp, Homo sapiens; identical to SEQ ID NO: 16272
  chr17:79874854-79875027
  hypo

SEQ ID NO: 45279 - DNA, 195 bp, Homo sapiens
  chr17:79887606-79887801
  hypo
gaccggctttaagtgcggccttgaggcctggctccctgtttggacttctctgcacctccaggagctcacttcccgtcacagctggatgcctcctcccgcaggcacctcccgggcatcctcccgccccaggctgcaccttctgtgggactggcccccgcaggcacctcccgggcaccctcccgccccaggctgcag

SEQ ID NO: 45280 - DNA, 23 bp, Homo sapiens
  chr17:79913143-79913166
  hypo
actgcgcccggcctacaagacct

SEQ ID NO: 45281 - DNA, 30 bp, Homo sapiens
  chr17:80163670-80163700
  hypo
gcccagcatctccagcgctttatccatcac

SEQ ID NO: 45282 - DNA, 30 bp, Homo sapiens
  chr17:80201941-80201971
  hypo
caggcatgtcaattacgggaggagggaggg

SEQ ID NO: 45283 - DNA, 44 bp, Homo sapiens
  chr17:80229940-80229984
  hypo
caaacttgggccaggcgcggtggcttcccagcacttcgggaggc

SEQ ID NO: 45284 - DNA, 82 bp, Homo sapiens
  chr17:80251922-80252004
  hypo
catggggggaatcctcgtaaggcaagaacgtgctgcacattctggggactgggacaggataagcacacgagtagatctaagt

SEQ ID NO: 45285 - DNA, 79 bp, Homo sapiens
  chr17:80254257-80254336
  hypo
ctgcgggacagacccggcattcttcgttatccattcattcgttgacggacacttaggcgagttccgtaccttgattgca

SEQ ID NO: 45286 - DNA, 49 bp, Homo sapiens
  chr17:80281082-80281131
  hypo
gaaggagacccagagcgcaggtgtgtcggggcagcgagggaaacatcta

SEQ ID NO: 45287 - DNA, 187 bp, Homo sapiens
  chr17:80289234-80289421
  hypo
ggcagcaggtgtcagcgactttgggttgctgtgggaatttgctccgtttatcagaagaaaacgcaccctggcaacacaggcccctctcaggtcaccaggcacatctggtcacatctgagtctcagataaacaaccaatgatgtcctggtgaaagcttgtcccgtgggacactcgggacacacttata

SEQ ID NO: 45288 - DNA, 29 bp, Homo sapiens
  chr17:80294426-80294455
  hypo
gctgggattacaggcgtgagccactgtgc

SEQ ID NO: 45289 - DNA, 135 bp, Homo sapiens
  chr17:80300182-80300317
  hypo
acaattttggtggcccgtgtggggaacgttgtgtgctttggggggcccaagcctgcccatctggtttctgttgggcagggcgtaggttcacctgtgagttccagctgctcctggctgctgcgcctgtggctggaa

SEQ ID NO: 45290 - DNA, 151 bp, Homo sapiens
  chr17:80338743-80338894
  hypo
cgtctccaaaaaaaaaagcagcagaaaggttattgaaagattattgaaagtatgacctagacacggtgagaaatgtgatttcaggagtcagaattccgatgcagaaaggacaactcaacaccaaatgcagaaaccgcgcaggatggagccc

SEQ ID NO: 45291 - DNA, 34 bp, Homo sapiens
  chr17:80448159-80448193
  hypo
gggattggattaactcgagcgatggccttcccag

SEQ ID NO: 45292 - DNA, 180 bp, Homo sapiens
  chr17:80479355-80479535
  hypo
ggaatttttaacgctttcggttgttggagatgctggtaagagctgttgcttttcttcttgacttgcgtgttgtgtgtgtgtgcatgcgctgttctgtttcttagcatggaaaggtgcaccagcatattccttaaactttggtagtagcattttaaagaatgttattttcaggccgggcgc

SEQ ID NO: 45293 - DNA, 209 bp, Homo sapiens
  chr17:80518148-80518357
  hypo
cctggaattacaggcatgaaccactgcgcccggcccttctcgctgttatttaagggaagcggtctcactgtgtggcacaggctggtctcaaactatcctcctgtttggcttcccaaagtgctaggattacaggagtgggccaccgtgcccggccctcctcgctgttatttaagggaagcggtctcactgtgtggcgcaggctggctttg

SEQ ID NO: 45294 - DNA, 160 bp, Homo sapiens
  chr17:80654983-80655143
  hypo
cctctgggtgctggtcgtgagcccaagcccatctcagctgctcccccaaactctgcccattcctcaccccgtcccctaagctgaggtgtggccgggcacctgagtcccaccccacgctccacagtctcaggccaccccctccagccgtgccacactccct

SEQ ID NO: 45295 - DNA, 16 bp, Homo sapiens
  chr17:80692834-80692850
  hypo
gcgccactgcactgca

SEQ ID NO: 45296 - DNA, 30 bp, Homo sapiens
  chr17:80747022-80747052
  hypo
agcatttgggtgaaacgaggtaccccaggc

SEQ ID NO: 45297 - DNA, 40 bp, Homo sapiens
  chr17:80772901-80772941
  hypo
tgagtagctgaagcacggtcagctgcgtcaccaggctgtc

SEQ ID NO: 45298 - DNA, 1028 bp, Homo sapiens
  chr17:80797692-80798720
  hypo
aaggcagagcagacacggagcaaacgctgcgttcagctgggtattttagatacgtctgagaagagttttaaaataaaacttgaatttgaaaagaaatagtgagtacttaccagaggtgggcagtgctgggatgtggccggtcttggtgccggtggctggcggtgctcaggaagcagtacctgttctcacgcttgctgggtgaaactggagcctgctgttccagtgggagggatttaagtgtaggagttgagccctcggggcgtagagatgcacctgatattcctcctgcccgcagctacgattcatgtgtttgcacccaccgagctgctgcgggcagcctccccagcactggacccagcaagcaagttatctcgccgactcccagcgctgtctccagactcaactgtctgtgagtgcggcgtcggtgctgcctggacggccatatgtcagagggctttcgatgtgtccgcagttagaatagagattactatattcatcagaatcacacccgatgaatatttggcgtcatgataaagacatgtgagactttcctttagaacttgagcatgtgtacgcaggaggcaaacacttggattgattctcaagcgcgcataccctgggaggcacagtattcatggcgtccttgccatgaggtccagtgaggcctttgaggatctgtggaccttccaccctctaccctgctcctgagagtctctgtccctggtcctcctcaggagctgagccggcagggagggagcttatcccagagcctggctgcagggacctgccggagcttgcccgacaccaggcaccgcaagagctgcggagcagggtgtgtgggtgcgggggagggggccagctgtgcactcccgcaaaccaccctccccccactttaaattgcagaggcacttaacttgggggccagtttttacctccacacccccccaccaaaactgcttgcttgcttaatcggaggccgcaccccagttgtagcgaaggctggcatgtggtgtcggtttgaggactgg

SEQ ID NO: 45299 - DNA, 317 bp, Homo sapiens
  chr17:80832479-80832796
  hypo
gtcaggcttgtccaacgggttcttagagaacctgggccccatccctccttggcccacgcagactccaggcatccggccgggcgggctgtgagtcaggctgcaccaggtgagcgtgtgggatgctgctggtgcgagcctccctgcccaggagccctgcgcacccgggtatcggttggggtgtgcccttccagatctccctcccttggtttgtcataggtgaccacattttaattaccagcttttatgcccgtcaatttgggaacgtgatacaatcttgatttctctaactttcacaagttcttcggtgggtcctgtaa

SEQ ID NO: 45300 - DNA, 30 bp, Homo sapiens
  chr17:80882906-80882936
  hypo
ttccttctgaaaggccggctccagcaggtg

SEQ ID NO: 45301 - DNA, 50 bp, Homo sapiens
  chr17:80972320-80972370
  hypo
agtacttacgctcgacgggtgctgaacggcagcctcgtgttgcagcctca

SEQ ID NO: 45302 - DNA, 267 bp, Homo sapiens
  chr17:81008618-81008885
  hypo
caggtttttagggcacgtgtttggggtaagtgtgctgggcacacaggcaggtgtgtgggcacggaggaggtgtgcaggtaggtgtgtgggatgcgcaggcaggtgtgcacggcaggtgcacgggcaggtatggggcacgggcatgtatgcaggacgcagagcaggtgtgtgaagcaggtgtgcaggcacaagacgtgtgtgtggggcatgggcaagtgtgccgggaatgtgtgacggcagacgtgtggggtgcgaggttgtgtgggg

SEQ ID NO: 45303 - DNA, 166 bp, Homo sapiens
  chr17:81015300-81015466
  hypo
ctcacctccaggggacggccccgcaagccggagctgccctcctgcacactcagcactcaaggtggatttggaggtgacctaagcccacagctctccaagtcttggggaaatctacagtggatggcaggtgcctgcggacgccgagtgggtgcggccccagttatgc

SEQ ID NO: 45304 - DNA, 30 bp, Homo sapiens
  chr17:81015900-81015930
  hypo
cacatctggacagtgcgtgaagccagtcca

SEQ ID NO: 45305 - DNA, 30 bp, Homo sapiens
  chr17:81021226-81021256
  hypo
ggcaggctgcgtgtccgggcagtcccagcc

SEQ ID NO: 45306 - DNA, 30 bp, Homo sapiens
  chr17:81024242-81024272
  hypo
tgaagagctccagatcgcagacaccgtgcc

SEQ ID NO: 45307 - DNA, 30 bp, Homo sapiens
  chr17:81033487-81033517
  hypo
ggcctgggagggaaacgggtggcaaatgac

SEQ ID NO: 45308 - DNA, 98 bp, Homo sapiens
  chr17:81043026-81043124
  hypo
actgctggtaccagacggggacggcaggcccggccgggtgcagtgttttggcctggagcagggcggcctgttcgtggaggccacgccgcagcaggata

SEQ ID NO: 45309 - DNA, 32 bp, Homo sapiens
  chr17:81047925-81047957
  hypo
gcttgcataccctcacgcgcccaggccccggg

SEQ ID NO: 45310 - DNA, 58 bp, Homo sapiens; identical to SEQ ID NO: 16285
  chr17:81048783-81048841
  hypo

SEQ ID NO: 45311 - DNA, 147 bp, Homo sapiens
  chr17:81050193-81050340
  hypo
cctccttttgggtgccgctgccgtcgcgacccagggaagtgggcagcagagctgtggggagtgtctgcccttcgaggaagctgggaaatgagggtggtcccggcgccgtgggccgtggaggtgggttgggggcgactctgggaggtg

SEQ ID NO: 45312 - DNA, 48 bp, Homo sapiens
  chr17:81050936-81050984
  hypo
cgaggtgctcctagccgtctgcaccagcgacttcggtgagtgtctgct

SEQ ID NO: 45313 - DNA, 69 bp, Homo sapiens
  chr17:81062099-81062168
  hypo
gagaggaaaggatcacgcgaccatgggtacgttggccacctgaaggttgagtcccgcagcctagagact

SEQ ID NO: 45314 - DNA, 55 bp, Homo sapiens
  chr17:81065766-81065821
  hypo
tgcacgatccttcctcgctgcaggatccttcctcgctgcacgatcattcctggtt

SEQ ID NO: 45315 - DNA, 30 bp, Homo sapiens
  chr17:81068659-81068689
  hypo
cagggctgacgggcgcgaaactgggagcgt

SEQ ID NO: 45316 - DNA, 82 bp, Homo sapiens
  chr17:81076347-81076429
  hypo
ggcagatcctggagccgggaagggatttgggggagggcccctgacgccctgtgggctgaccgttccccggtgccactcagga

SEQ ID NO: 45317 - DNA, 23 bp, Homo sapiens
  chr17:81081890-81081913
  hypo
gggcgacgctcagggcggccgtg

SEQ ID NO: 45318 - DNA, 38 bp, Homo sapiens
  chr17:81087525-81087563
  hypo
tgttctcctgagggccgcgggtcccgactggctgtttg

SEQ ID NO: 45319 - DNA, 78 bp, Homo sapiens
  chr18:597381-597459
  hypo
aggaggaggtagaggcggggagacacaccatccctgcaaaactactggcaaaaactaagcggagccgggtgtggtggc

SEQ ID NO: 45320 - DNA, 19 bp, Homo sapiens
  chr18:1522199-1522218
  hypo
agaccggagctgttcctat

SEQ ID NO: 45321 - DNA, 41 bp, Homo sapiens; identical to SEQ ID NO: 16292
  chr18:2755837-2755878
  hypo

SEQ ID NO: 45322 - DNA, 122 bp, Homo sapiens
  chr18:3616285-3616407
  hypo
gatgtgtggatcattcgctgtctgacctgactactctatcactgtggcacagccctgggcgatgtgtacatgtacagccttgtttgtgtttgagaggtgagcccattcggtggtctgagggc

SEQ ID NO: 45323 - DNA, 86 bp, Homo sapiens
  chr18:3930506-3930592
  hypo
ttgtgcggatctgagcgtgtcctgcaataggaagggtgccgggtcccagcctgaaggtacatgtactcagtcgctaccctggacgc

SEQ ID NO: 45324 - DNA, 50 bp, Homo sapiens
  chr18:5133182-5133232
  hypo
cagctccaccaccaccgaccacgatggctgcgccccgggccgcgaggaag

SEQ ID NO: 45325 - DNA, 30 bp, Homo sapiens
  chr18:6929750-6929780
  hypo
ccagccacactgtcccggcagacgctctca

SEQ ID NO: 45326 - DNA, 97 bp, Homo sapiens
  chr18:8570976-8571073
  hypo
caatgtatgatttttttaaactcaacaatgtgcaggcattgctttcacatccattccctgcccgtgacggtccatccctgcccgtgatggacactgt

SEQ ID NO: 45327 - DNA, 30 bp, Homo sapiens
  chr18:8612252-8612282
  hypo
cagagaaggcttcctcgtcattggaatgtt

SEQ ID NO: 45328 - DNA, 40 bp, Homo sapiens; identical to SEQ ID NO: 16294
  chr18:8845133-8845173
  hypo

SEQ ID NO: 45329 - DNA, 30 bp, Homo sapiens
  chr18:9333406-9333436
  hypo
ggtggtaggcatttacgatttaccagcata

SEQ ID NO: 45330 - DNA, 143 bp, Homo sapiens
  chr18:9364378-9364521
  hypo
tcccatgagttccgacggtgaaagtctgatccctttgtgataaaggtccccatcagcctttcacctggtgatttcaccccttcttgatgaccattgcctgagtcagctacttcattagaagctgtaaaacagccaggtgtggt

SEQ ID NO: 45331 - DNA, 30 bp, Homo sapiens
  chr18:9547786-9547816
  hypo
ctagtaggttgaggacgctgtgctcatggc

SEQ ID NO: 45332 - DNA, 30 bp, Homo sapiens
  chr18:9737972-9738002
  hypo
aggcagccagccggccggcatttaaatgat

SEQ ID NO: 45333 - DNA, 76 bp, Homo sapiens
  chr18:9797320-9797396
  hypo
aataagtcaattttgcgaatcgctggcttaatgtcagcgatgcttctgcttctcctgctggcggacgttccctgat

SEQ ID NO: 45334 - DNA, 534 bp, Homo sapiens
  chr18:10589046-10589580
  hypo
gtttctcgtgtgctccgggagtgtgagccccagcttctgctttcactgaattctgctgccagccacgtccttgatactttgtgggtgatttatttcattggctcgctattacttggcagcggcggtggctcctcaagccagcgtgggctccaggtggccccgggccgggaggcgatggccccgggccaggaggcgtggccacggccgctcgccggcgtccgtccccaggaacggccagcactggggcagcggaggaggcagcggtggtggtggcaccgggtagaaggcggtggcactgggtagaaggcaccgccgccgcccgccgcgggaggcttccgcggagactcagggctgcagagccagcggaggctgaaggaagagaaaggtaattttcctactcgcatatattaatttcagtaaacagataaaacaattagtaaatcaaacatataaaacagaatttttaaagaaaataatctcccaaaatatataaaagtagaatagttaaaaaaacagaaccgaatattttaatgt

SEQ ID NO: 45335 - DNA, 30 bp, Homo sapiens
  chr18:10664802-10664832
  hypo
ggatgagatcatgtacgtacagcacttagc

SEQ ID NO: 45336 - DNA, 36 bp, Homo sapiens
  chr18:10696324-10696360
  hypo
attcatggcaggaagcgccatcgccatgggtcaggg

SEQ ID NO: 45337 - DNA, 30 bp, Homo sapiens
  chr18:10832633-10832663
  hypo
taatgactgaacaaacgcaggaaagaacta

SEQ ID NO: 45338 - DNA, 25 bp, Homo sapiens
  chr18:10906877-10906902
  hypo
tgtcttttgtcgccttcctgagccc

SEQ ID NO: 45339 - DNA, 86 bp, Homo sapiens
  chr18:11009583-11009669
  hypo
ttctttggtatcatacgaagtaataatatatgtgggcactataaagataaatgtcttgttatgggttaaatcgtgtccccttcata

SEQ ID NO: 45340 - DNA, 17 bp, Homo sapiens
  chr18:11014809-11014826
  hypo
tccggggccccctcatt

SEQ ID NO: 45341 - DNA, 30 bp, Homo sapiens
  chr18:11533320-11533350
  hypo
ggagagggttgggggcgctatccggggctg

SEQ ID NO: 45342 - DNA, 30 bp, Homo sapiens; identical to SEQ ID NO: 16298
  chr18:11979044-11979074
  hypo

SEQ ID NO: 45343 - DNA, 15 bp, Homo sapiens
  chr18:11979861-11979876
  hypo
cggcctctgtcttaa

SEQ ID NO: 45344 - DNA, 30 bp, Homo sapiens
  chr18:11989410-11989440
  hypo
cctacgtgagaaattcgaaaactcaacaac

SEQ ID NO: 45345 - DNA, 30 bp, Homo sapiens
  chr18:12076093-12076123
  hypo
tggaattccaaagaccgtaatgaggaaaga

SEQ ID NO: 45346 - DNA, 120 bp, Homo sapiens
  chr18:12375353-12375473
  hypo
cgccttggccccccgagttgctgggactatagtcataagtcactgagcccaggtaagaaaaaaaaaaaaaaaacaatttgtagaggccaggagctgtggctcaggtctgtaattccaaca

SEQ ID NO: 45347 - DNA, 38 bp, Homo sapiens
  chr18:12376123-12376161
  hypo
cctatctccccttacagtgaagacgttgagctgactac

SEQ ID NO: 45348 - DNA, 30 bp, Homo sapiens; identical to SEQ ID NO: 16300
  chr18:12701811-12701841
  hypo

SEQ ID NO: 45349 - DNA, 26 bp, Homo sapiens
  chr18:12949149-12949175
  hypo
gccaccgcgcccggcctacaagcaga

SEQ ID NO: 45350 - DNA, 88 bp, Homo sapiens
  chr18:13231230-13231318
  hypo
aagaggggtctggaccggttttgcttgagaagaaatggcagtggacacatggctcgtgtgaaaggtgggtgcacgcagacaggccaga

SEQ ID NO: 45351 - DNA, 30 bp, Homo sapiens
  chr18:13295972-13296002
  hypo
gaagacctgaggctgcgaggcggggtgcct

SEQ ID NO: 45352 - DNA, 61 bp, Homo sapiens
  chr18:13319261-13319322
  hypo
acggcgggtatgattcgtcccagttcacgggcgagtaacagaggtgcgcagtggcggggca

SEQ ID NO: 45353 - DNA, 30 bp, Homo sapiens
  chr18:13430352-13430382
  hypo
atgcgaggttagtcccgatgagggtgtatt

SEQ ID NO: 45354 - DNA, 30 bp, Homo sapiens
  chr18:13452326-13452356
  hypo
gcttggaggatgcagcgggtgcagactggg

SEQ ID NO: 45355 - DNA, 111 bp, Homo sapiens
  chr18:13452723-13452834
  hypo
acaattccaccaggtcgcgtgtttactaattgctaagtgctttacttgagtcatctcatttaattgttagaacaaccatatgtgataagaactcatcggacccctccttag

SEQ ID NO: 45356 - DNA, 283 bp, Homo sapiens
  chr18:13461100-13461383
  hypo
ccgtgggaactgaggcgggctggccttgtctccccagcgcctgctcacagaaggtgccccatgatgtctgtcgtgcagatgaatgtgtccacgcgtgctgggctagtacagaagatcggtaggcaggggtcttcgtggccagggcctgaggaggaccgatagccttggggactgcatgggttttgagagtctgggggaaccagggggaagtaggaggacatagtaaacaaaggtcaagaagagcgaggaagacgtggggatggggacacgtacctgactgagg

SEQ ID NO: 45357 - DNA, 32 bp, Homo sapiens
  chr18:13486501-13486533
  hypo
ctccaccagggagaacgcggagcagcagagtc

SEQ ID NO: 45358 - DNA, 30 bp, Homo sapiens
  chr18:13486818-13486848
  hypo
gaactcaagcagccccgcagagcccccttg

SEQ ID NO: 45359 - DNA, 85 bp, Homo sapiens
  chr18:13583740-13583825
  hypo
gcctgcttgagtcaccgagccagggcgctgcggctccccactgctggcggagtcttattgttgtgtctctcgctttgcctttcac

SEQ ID NO: 45360 - DNA, 30 bp, Homo sapiens
  chr18:13603756-13603786
  hypo
cgctgctgggtgccacgccaagtttcacag

SEQ ID NO: 45361 - DNA, 67 bp, Homo sapiens
  chr18:13621659-13621726
  hypo
gtcctggaggtgctgcggggacaaatcacgcgctcatcgtcactaaacgtgccggcagcacatgggt

SEQ ID NO: 45362 - DNA, 237 bp, Homo sapiens
  chr18:13621998-13622235
  hypo
gagcggtgagttcagcgagcgtataaatccttggcttccgtgatgggcagcgaggccgagtctccacagtgtggagccctgcggtatgctgagcacaggagccggtccttacggagcatccctcttcaggaacagggctgtgcagttccggctcccaccctgacttacagagcctgtccagggtatggggtgcagctgtccaggtgggtttcctggggtggccgctggccctgggac

SEQ ID NO: 45363 - DNA, 203 bp, Homo sapiens
  chr18:13826333-13826536
  hypo
catctccatgttcttcgctatgctgttcctcctggtgtctctgtacatacacatgttcctcctggcgcggactcacgtcaagcggatcgcggctctgcccggggccagctctgcgcggcagaggaccagcatgcagggcgcggtcaccgtcaccatgctgctgggcgtgtttaccgtgtgctgggccccgttcttccttcatc

SEQ ID NO: 45364 - DNA, 180 bp, Homo sapiens
  chr18:13836794-13836974
  hypo
agcgggcagactccccgccctgggctctgtcctgcccttcttgtgcctggcctctttctagggagccatggaaacagtgctcctaggatccgccctccagtcctgctctcagtgagaactcagcgcagggctccggacacgggcagacgccgcgctttgtcttcccgtcttcccctcacc

SEQ ID NO: 45365 - DNA, 59 bp, Homo sapiens; identical to SEQ ID NO: 16304
  chr18:13940522-13940581
  hypo

SEQ ID NO: 45366 - DNA, 30 bp, Homo sapiens
  chr18:19243727-19243757
  hypo
agttcagcttcagaacgcagctccagggat

SEQ ID NO: 45367 - DNA, 227 bp, Homo sapiens
  chr18:20911344-20911571
  hypo
gtgaaacctgccccccgccaccacctgtagtacaggagacaccacaaagcaagaggccccagggctctgctcgggaagctgccgggcctgtttttcctcccagtggccaacaaacaggagggcaggttcagcacgttgggctctgctttctgagcgccgcaccattacagcatccacatccgatttttaaaactgaagtataacataaataccgtgtagtgtaggag

SEQ ID NO: 45368 - DNA, 25 bp, Homo sapiens
  chr18:21168944-21168969
  hypo
gctcccagcccgcttttcttttcgg

SEQ ID NO: 45369 - DNA, 40 bp, Homo sapiens
  chr18:23841433-23841473
  hypo
gattacaggcgtgagccactgcgcccggccagcactgtca

SEQ ID NO: 45370 - DNA, 30 bp, Homo sapiens
  chr18:24465773-24465803
  hypo
tgtgtacagcacttgcgatattgagagtaa

SEQ ID NO: 45371 - DNA, 36 bp, Homo sapiens
  chr18:25089977-25090013
  hypo
aggagccaagatggccgaataggaacagctctggtc

SEQ ID NO: 45372 - DNA, 30 bp, Homo sapiens
  chr18:43254053-43254083
  hypo
ttacgtcttctacagcgattcaccttaagc

SEQ ID NO: 45373 - DNA, 45 bp, Homo sapiens
  chr18:44140380-44140425
  hypo
gtgaggtccacctcccgcaccaccaggtgccgcagccacacggtg

SEQ ID NO: 45374 - DNA, 81 bp, Homo sapiens
  chr18:47344091-47344172
  hypo
attgatacattggtacggttctaggccttgcattacttcttccgatttttcccttggggtgggctgtcggcatgctcagtg

SEQ ID NO: 45375 - DNA, 145 bp, Homo sapiens
  chr18:48493743-48493888
  hypo
tgaccacctcaagtacgctgagcacgaaatcagtgcatctggcagtacacaggagcttgaaatactttttttaaaagttgttattcaaactgaaggagtttttccctgtggtctgtaatcgccacgtgcccgttctgtatacagc

SEQ ID NO: 45376 - DNA, 44 bp, Homo sapiens
  chr18:52627111-52627155
  hypo
acattgggccaggtgcggtggctcacgccttggtaatctcagca

SEQ ID NO: 45377 - DNA, 103 bp, Homo sapiens
  chr18:52961793-52961896
  hypo
tccataggtgttgtgcgtggggtgaacttctggccttgtaccaggaagaagatatcatatggagatgacccagatgtgaaaggtatcacgctgcaattccaca

SEQ ID NO: 45378 - DNA, 180 bp, Homo sapiens
  chr18:53074296-53074476
  hypo
aagatggggttggtgcggggggcggggggagattctgaaatatataccagaaacaaatcttgtcaggcatttgattcatttttatacctaaaaggaccaaatgttaaattttgctgctggtgacgatttgccgtgcatgaaatgaatatgacctaatggagtacacgaagggctgaatga

SEQ ID NO: 45379 - DNA, 181 bp, Homo sapiens; identical to SEQ ID NO: 16306
  chr18:53968903-53969084
  hypo

SEQ ID NO: 45380 - DNA, 47 bp, Homo sapiens
  chr18:54483265-54483312
  hypo
agtcacatcagaagccgcgcagactatcaccacggctcctgatgcct

SEQ ID NO: 45381 - DNA, 72 bp, Homo sapiens; identical to SEQ ID NO: 5215
  chr18:55850845-55850917
  hypo

SEQ ID NO: 45382 - DNA, 30 bp, Homo sapiens
  chr18:56483562-56483592
  hypo
aagacaatttttccacggaccaggggtggg

SEQ ID NO: 45383 - DNA, 25 bp, Homo sapiens
  chr18:56483918-56483943
  hypo
aagtttgaaattccccggccgggcg

SEQ ID NO: 45384 - DNA, 23 bp, Homo sapiens
  chr18:56816117-56816140
  hypo
attacaggcgtgagccactgtgc

SEQ ID NO: 45385 - DNA, 170 bp, Homo sapiens
  chr18:57652629-57652799
  hypo
gcgtgattgtgaccacgtaagtcatcatgggcatgttagctattaagatgatttaaaaatgatcacatcttagttcttgcaattttacactgaaattactataagtaagcttctcctcacgtggaagtcattagctttacctgtaaatatgattgcggcatctgcctatg

SEQ ID NO: 45386 - DNA, 30 bp, Homo sapiens
  chr18:59137607-59137637
  hypo
aaaaaggaaaggaaccgataagcctgagct

SEQ ID NO: 45387 - DNA, 30 bp, Homo sapiens
  chr18:60056441-60056471
  hypo
atgctctgctccaagcgccagaggaggctt

SEQ ID NO: 45388 - DNA, 30 bp, Homo sapiens
  chr18:60557827-60557857
  hypo
attttcctcattcagcgtattgctgctttc

SEQ ID NO: 45389 - DNA, 27 bp, Homo sapiens
  chr18:60759984-60760011
  hypo
acagctgccccccatcgctcacatgac

SEQ ID NO: 45390 - DNA, 31 bp, Homo sapiens
  chr18:62165289-62165320
  hypo
atcaccattgaggcccggcgcattggctcac

SEQ ID NO: 45391 - DNA, 35 bp, Homo sapiens
  chr18:68051409-68051444
  hypo
gatgtggggagtctctgggccgatgcatgtaaagc

SEQ ID NO: 45392 - DNA, 19 bp, Homo sapiens
  chr18:68699219-68699238
  hypo
ccaccggccgctcccagtg

SEQ ID NO: 45393 - DNA, 17 bp, Homo sapiens
  chr18:72263664-72263681
  hypo
atgatttttttgagacg

SEQ ID NO: 45394 - DNA, 17 bp, Homo sapiens
  chr18:72263921-72263938
  hypo
ggcgtaagccaccccgc

SEQ ID NO: 45395 - DNA, 30 bp, Homo sapiens
  chr18:72347499-72347529
  hypo
catgaggaattgctgcgggaggtgaataag

SEQ ID NO: 45396 - DNA, 45 bp, Homo sapiens
  chr18:72896219-72896264
  hypo
aggggaggttgaggacgtccctgcactccccgccctgtaagcatc

SEQ ID NO: 45397 - DNA, 41 bp, Homo sapiens
  chr18:74062274-74062315
  hypo
gacagctggggccaccgccttcccggcgcaaggtgggccag

SEQ ID NO: 45398 - DNA, 88 bp, Homo sapiens
  chr18:74107215-74107303
  hypo
cacaaggctgcaccccgtcctaaacgagcatctcccagacaccaagaaagcaaaccttgtttcacagctttatcgccactatctagcg

SEQ ID NO: 45399 - DNA, 38 bp, Homo sapiens
  chr18:74113912-74113950
  hypo
ctgcacatgcatgtgcgtgcctatgtgcatgtgtgtac

SEQ ID NO: 45400 - DNA, 158 bp, Homo sapiens
  chr18:74114010-74114168
  hypo
tggtctctgcatcccacagggaggggagggcttctctgaaaagaaattgtatatgcacaagccttagccccgcgccttctatttgctgaagacatcgcctcggtcaacaccaatgaattcatttactctgtgaatacaaatcccgccagtggccacaa

SEQ ID NO: 45401 - DNA, 37 bp, Homo sapiens
  chr18:74396499-74396536
  hypo
tcaggtgattgactccgtgcagcgatctccacgggtc

SEQ ID NO: 45402 - DNA, 30 bp, Homo sapiens
  chr18:74497491-74497521
  hypo
agatgccactccacacgtatgagagtggct

SEQ ID NO: 45403 - DNA, 76 bp, Homo sapiens
  chr18:74501216-74501292
  hypo
ctctcccgccctacacggagatgagaaaaaggttgatagaataaattacattaggccgggtgaggtggctcacgcc

SEQ ID NO: 45404 - DNA, 30 bp, Homo sapiens
  chr18:74504480-74504510
  hypo
agtcctgggggtgggcgaggagagcacact

SEQ ID NO: 45405 - DNA, 30 bp, Homo sapiens
  chr18:74695927-74695957
  hypo
ggatgaaaatgcaaacgcaggtgcctgggg

SEQ ID NO: 45406 - DNA, 30 bp, Homo sapiens
  chr18:74755472-74755502
  hypo
ctgctgcaggcaccccggggacctgctggt

SEQ ID NO: 45407 - DNA, 32 bp, Homo sapiens
  chr18:74877184-74877216
  hypo
atgccgtgaggattgcgcgagctcatattctg

SEQ ID NO: 45408 - DNA, 143 bp, Homo sapiens; identical to SEQ ID NO: 16311
  chr18:75229713-75229856
  hypo

SEQ ID NO: 45409 - DNA, 176 bp, Homo sapiens
  chr18:75230687-75230863
  hypo
aactgaagtctagctcgtgcttctgaaatgacgcataaataattcaagcttgagagggaagaactggccacactttggaggcgccgagctggggaacctggtgtccgaagccaagctctgctcgggcccaggaggacgcagggacatcgcactgtcccccacgcctggcctgtgct

SEQ ID NO: 45410 - DNA, 46 bp, Homo sapiens
  chr18:75617810-75617856
  hypo
cacaaaccacctgctcgctgctgcccagcgccgcctgggcactcct

SEQ ID NO: 45411 - DNA, 30 bp, Homo sapiens
  chr18:75631688-75631718
  hypo
ttcttgcgcaaactccgtgttcatgtagag

SEQ ID NO: 45412 - DNA, 395 bp, Homo sapiens
  chr18:75998625-75999020
  hypo
cgtggtgtgtgtgtgtgtcgtgtgtcgtgtggcgtgtgccgtgcgtgtgcgcaccgtgggcgggaggcgagaggaagcgcagtgggagccgcgggcaggcggtcgcagaggggcctggggaggcgaagcagcccgggtgggggcgttcgctggaaacggggcccctctgaagggcgtgggcagccggtgcctgcagagcgtggagagctgcggccgcctcacctgacacaattgggcagcgatttctcaggtccaaagagcggaccccgtgggcactttcctgacggaggactcggctcctgggagctccggcaacatcagcgacagtggagcccggtctcaaaagaccgacccggcggcctgagaagaaggaaggaggccgaggcgccgcaggg

SEQ ID NO: 45413 - DNA, 93 bp, Homo sapiens
  chr18:76073259-76073352
  hypo
ccaggctcctggggacggcgtgtgtcctggctccaccctctgctggcggtgagaccatgcacaccgcaaaaccatggacgtcacaagaccacg

SEQ ID NO: 45414 - DNA, 174 bp, Homo sapiens
  chr18:76123720-76123894
  hypo
ggggcgcacaccctccgggatgaagacggcacgcctgctgcgcacggtggctgtgctgtgctttccagagacaccaaagatccagcaagccccggtttgtgtcgagtgtcacgggaatggagatgccttaaggctccggcttggacggcctgttgttcgcgtgctgagtgcact

SEQ ID NO: 45415 - DNA, 172 bp, Homo sapiens
  chr18:76161408-76161580
  hypo
tgttcgcggcgttcccgctaaaaccagaaaaaaaaaaaaaaaggagatgaagaagatggagcctggggcaagggagcttgcttggagaatattttccatggaagccaagggagcatccctctcccttttggaggcacgtcgaggccaattgacttgacgatgatttgctgtt

SEQ ID NO: 45416 - DNA, 49 bp, Homo sapiens
  chr18:76189823-76189872
  hypo
gcgctgggaccccagcgaggcgacccggggccaccgggcaggcccaaga

SEQ ID NO: 45417 - DNA, 141 bp, Homo sapiens
  chr18:76239475-76239616
  hypo
gggttaaccagagtccggagtcagagaaataatttggtgtttcagggtcgcctgctgcagggcaatctccacacctgactgcggggtcacctgctgctgggcaatctccacacctgactgcggggtcgcctgctgcagggc

SEQ ID NO: 45418 - DNA, 43 bp, Homo sapiens
  chr18:76412736-76412779
  hypo
gactttcctgggttgcgcactgaaagtcccagtcccaggaaac

SEQ ID NO: 45419 - DNA, 94 bp, Homo sapiens
  chr18:76415372-76415466
  hypo
gggaaccccctcagtcccaggaaacccctcagtcccaggcaaatggtggagagcagggcaggtgtgttttgggtgccaccgtgggggatggggc

SEQ ID NO: 45420 - DNA, 158 bp, Homo sapiens
  chr18:76477472-76477630
  hypo
tcccaagcccatgaccgataccctgggtctccacctcctgggcccatgaccgacaccgagggtctgcacctccagagcccatgaccgacgctgcgggtctccacctcccgagcccatgaccgacaccgcgggtctgcacctcccgagcctatgactga

SEQ ID NO: 45421 - DNA, 74 bp, Homo sapiens
  chr18:76486799-76486873
  hypo
acgtggagactccctcggagacctctgcgcacatggagacccgcgcgcacgtggagactcgcgcgcaaaaggag

SEQ ID NO: 45422 - DNA, 215 bp, Homo sapiens
  chr18:76501459-76501674
  hypo
agagctcaggaagtgcggctctcagtctatggatccgctggacgacccatccgctgttctcaactcaccgaatgacagtaaaatcaaagccttgtatcatattcagaagattcagcgccaagactcagcatgtggcggtgtcttctttaggacgcagcagtgcgatggagaaggtagagggtaactctggcagggtgcatcggtaaccagcaaga

SEQ ID NO: 45423 - DNA, 36 bp, Homo sapiens
  chr18:76540366-76540402
  hypo
gtccgaggccaggcacggtgtcgggtggccctggcc

SEQ ID NO: 45424 - DNA, 36 bp, Homo sapiens
  chr18:76541554-76541590
  hypo
gtcctctgggtgaggcggagccgctcctgaaggatc

SEQ ID NO: 45425 - DNA, 33 bp, Homo sapiens
  chr18:76564667-76564700
  hypo
ctgcagggggctggccgccggcctgacgaggct

SEQ ID NO: 45426 - DNA, 16 bp, Homo sapiens
  chr18:76571588-76571604
  hypo
ccgctcatctcctgct

SEQ ID NO: 45427 - DNA, 159 bp, Homo sapiens
  chr18:76626246-76626405
  hypo
cataaaggacagccgcggctgaacatgccaagctggctagagggagggtgacagccgcagccgaacctcagagctggctagagggagggtgacagccgcggacaaacctgcagacctggctagagggagggtgacagccgcggccgaacctgcagtgct

SEQ ID NO: 45428 - DNA, 30 bp, Homo sapiens; identical to SEQ ID NO: 16321
  chr18:76686197-76686227
  hypo

SEQ ID NO: 45429 - DNA, 98 bp, Homo sapiens
  chr18:77167756-77167854
  hypo
tattgacattactgttctctctccggtgcaggagactgcgtggctcccgtcctcttgagggcatttctttacgatggggaaggcgggactggggcctg

SEQ ID NO: 45430 - DNA, 53 bp, Homo sapiens
  chr18:77176557-77176610
  hypo
gtgtaaggtggtagccgtggggtcttccccgagcttcccgctgccatcacctc

SEQ ID NO: 45431 - DNA, 157 bp, Homo sapiens
  chr18:77181269-77181426
  hypo
actgttcccagaactcgagggttccctgacaccaagatgacatgtggcacagacctggaatcacgaggaaatgcccgtcctcctcccacgggcagacaggtcgagtgtgtttccagagaccgggccgtccgtggggcagtagcgcctggatgacgtc

SEQ ID NO: 45432 - DNA, 30 bp, Homo sapiens
  chr18:77181779-77181809
  hypo
agctcttggcagtgccgccaccatgggctg

SEQ ID NO: 45433 - DNA, 30 bp, Homo sapiens; identical to SEQ ID NO: 16324
  chr18:77194948-77194978
  hypo

SEQ ID NO: 45434 - DNA, 290 bp, Homo sapiens
  chr18:77201979-77202269
  hypo
cccctgcaccctccacgtcagtgccctggctccgtggccctgtcggtgctctggtgagtctggggttcgtgccgagcgccattgcctccaggtcgaggtgggaagcgcgctggtggggcaaggtggtccctgcatggcacaggttgggagagcagccgggagggcagcgggccgaggcggtgggggagggcaccagttctccacggcaagcacggcctctggggctgctcttccggagagacgtggagacccgcgtgcacgtgtggagactggcacgtgtgaggggccca

SEQ ID NO: 45435 - DNA, 40 bp, Homo sapiens
  chr18:77203641-77203681
  hypo
gcccagcctctgcctcggttcctgccgggcacatggacgc

SEQ ID NO: 45436 - DNA, 167 bp, Homo sapiens
  chr18:77209978-77210145
  hypo
tccctgagtttgcctcgagagctgtaatccaagtttcccgcagacagggcacagtcaggtgcgttccacagccgtagtaaacgtcctggcttcgctggcggctgcgttcaccccaccatgatgtggggcagaaagggtggccgggagacgcccgcagccaggaccgc

SEQ ID NO: 45437 - DNA, 63 bp, Homo sapiens
  chr18:77229435-77229498
  hypo
ggcggcccccaggaccgtggccacagcatgaagccggtggggctgagccgctcctgctacctc

SEQ ID NO: 45438 - DNA, 30 bp, Homo sapiens
  chr18:77230030-77230060
  hypo
tccgtcccgcgtgcccgctgcacttcctgc

SEQ ID NO: 45439 - DNA, 59 bp, Homo sapiens
  chr18:77236179-77236238
  hypo
gcgccctgagcttggcgacgccagccgcgcgcctgggagggatccgcctgtccacgtgc

SEQ ID NO: 45440 - DNA, 135 bp, Homo sapiens
  chr18:77236516-77236651
  hypo
acttgcgcttcccctcgctgccgtgctgtcctggccccgtcgctgccacctgagacccccatcaagtacctgagctctgcgtctgttttcacgcttctgtatgtgtaggaagccccccaccgatgttgctcgggg

SEQ ID NO: 45441 - DNA, 91 bp, Homo sapiens
  chr18:77246511-77246602
  hypo
gtcacctcggactcccgcagccggccggagaggcccccgccgtccaggacgtgcccaggccagtggccacgcaccccggctcgcccgggca

SEQ ID NO: 45442 - DNA, 38 bp, Homo sapiens
  chr18:77247301-77247339
  hypo
accggcctctgcagtcggggcatcgtgggtgccgcctg

SEQ ID NO: 45443 - DNA, 38 bp, Homo sapiens
  chr18:77271051-77271089
  hypo
gccctgggccagccccgctgattcgatttagagctaac

SEQ ID NO: 45444 - DNA, 78 bp, Homo sapiens
  chr18:77272049-77272127
  hypo
atggctccttgtctccggcccaagcgacccctggcatggcggacagagaggcccaggaggagccggcctcagggagga

SEQ ID NO: 45445 - DNA, 39 bp, Homo sapiens
  chr18:77272999-77273038
  hypo
cctggcagagaatttcgctagagacgcagggagttgtat

SEQ ID NO: 45446 - DNA, 244 bp, Homo sapiens
  chr18:77285870-77286114
  hypo
gcaaggctgaaccagcgcagtgggaaaggagttaactggtctcgaattctggggcatccctgtctcgtgccacagatgccaagcacagcagggcacggagctcctgggggccgctgcactcagcagcacagtgggcgggaggccgctgagcaaccagcagcctagggcatttgggtggggacgtgcgacccccacacagaacagagccgtctttctctctgcgttgtgccgaggccccgcagcg

SEQ ID NO: 45447 - DNA, 55 bp, Homo sapiens
  chr18:77288237-77288292
  hypo
tcatagtcgcatgctcgcatctttgtttttaatctggcttcgaacatagcacaag

SEQ ID NO: 45448 - DNA, 30 bp, Homo sapiens
  chr18:77290969-77290999
  hypo
ctggcaagggcatctcgttatatggacagc

SEQ ID NO: 45449 - DNA, 48 bp, Homo sapiens
  chr18:77308327-77308375
  hypo
tgcccggcaggaccacgagacgtccgctgagcacgatgtctacctggc

SEQ ID NO: 45450 - DNA, 84 bp, Homo sapiens
  chr18:77313917-77314001
  hypo
tggctgattgtggcacgcgtgccttccgagcccagatgtcccttcctgacacgccggcagcagccaccgcggattgttggcctc

SEQ ID NO: 45451 - DNA, 188 bp, Homo sapiens
  chr18:77320324-77320512
  hypo
cacgtatgatcatcccgggaccacattctcacagcaaggagagggaagaacacaatattccctgccgagaataagatgcctcttcatgatggcaagcctggtaacttggcaattaatcctcggtgccaggaatcctcatgccgagagggacagatgctcctttgtttggctcccggcactcagtcgac

SEQ ID NO: 45452 - DNA, 290 bp, Homo sapiens
  chr18:77329727-77330017
  hypo
cagtacaacaggacacgctctcaccttcaccatctgggtacagcaagacacgccctcacctttaccgtctcagtacagcaggacacactctcaccttcaccgtctcagcgcagcgggacacgccatcaccttcaccgtctgagtgcagcaggacacgccctcaccttcaccgtctcagtacagcaggacacactctcaccttcactgtctcagtatagcggtccacgccctcaccttcaccgtctcagtacagccaaacacgccctcaccttcaccgtctcagtacagca

SEQ ID NO: 45453 - DNA, 100 bp, Homo sapiens
  chr18:77357908-77358008
  hypo
cagtgaacccagcatcgcctccatggcctgtcatcatcgggactctgccgcaagtgaagacgtgcttgtgtcccagggtacaagccgccaaagccccaga

SEQ ID NO: 45454 - DNA, 261 bp, Homo sapiens
  chr18:77364366-77364627
  hypo
aaactaaggtgcctccgaaggctccaggggaggatccttcctgcgtcttccagtgtccccaggcgttccgggcttgtggctgcgtcattctgccctctgccccctgggcacgcagctgactcccctgtatgggcccatctctccgaattcacatgaccgtccttcggtaaagacaccagcaccagtccctgactccgggccttccctaacccagtgtggcctcatcttaactaaagatgtctgcatcgaccctatttccaa

SEQ ID NO: 45455 - DNA, 77 bp, Homo sapiens
  chr18:77365747-77365824
  hypo
ccagtctgcgttccccgccaggtctacgttccccgccaggtctgcgttccctgccaggtctacgttccctgccaggt

SEQ ID NO: 45456 - DNA, 30 bp, Homo sapiens; identical to SEQ ID NO: 16334
  chr18:77410108-77410138
  hypo

SEQ ID NO: 45457 - DNA, 80 bp, Homo sapiens
  chr18:77509599-77509679
  hypo
tgactgccccctccccgaggtcagcgccatgcactgctctgggggcctgaaacaccgcctctgttcgcaagggtctcctg

SEQ ID NO: 45458 - DNA, 69 bp, Homo sapiens
  chr18:77533378-77533447
  hypo
ctgcaggcgacatcacgtgtaaaacgcattcgtttttggttttgatgaacccttcggctgtccttttcc

SEQ ID NO: 45459 - DNA, 30 bp, Homo sapiens
  chr18:77534970-77535000
  hypo
cgtcgcatgatctcacgcgtggagtcaaca

SEQ ID NO: 45460 - DNA, 46 bp, Homo sapiens
  chr18:77542905-77542951
  hypo
tcccctttcaaaacacgtacagcgaatgactcgggcttcagagcca

SEQ ID NO: 45461 - DNA, 141 bp, Homo sapiens
  chr18:77543230-77543371
  hypo
catccccgtgagctccgcctggccctgctgctcccgcccggaaagctcagacccataacccagcccacttggcagcagcgtgccgcctgatcggcaaggtttactccctttgaaaatctctgttgggtggccgggcgcggt

SEQ ID NO: 45462 - DNA, 60 bp, Homo sapiens
  chr18:77543700-77543760
  hypo
ttgggcacatctaaacgcacccaagcttcctaccgcacgtctctgcgaggagccgggtct

SEQ ID NO: 45463 - DNA, 80 bp, Homo sapiens
  chr18:77544682-77544762
  hypo
ggtgtggatgacagacgcagccctgcccttggctgctgtgcacgccatgcctccctgcgtggtcacgcctgtcacctgtc

SEQ ID NO: 45464 - DNA, 334 bp, Homo sapiens
  chr18:77550096-77550430
  hypo
gttcaccctgggccccggagactagtgatcccgctccccagcagagcaccgccaaaagccccgggtgccggagctgtcctgcaagaatgaacgggcaggagacacaagagcgtggcggggccttccgaggatgcggtgcaagggcgctgttagcacccacgcgaggcggcagcgcatggaggaagcctcccatcgtaagcgcgtttctgcctgaaatgcacgtgtccttataggcagcggtcttgccactcatggacggagaggcagcatatgtttaaaagatgagcacacaaaggactgtgcacctgccgcggagtggcgtcctctgggagaa

SEQ ID NO: 45465 - DNA, 177 bp, Homo sapiens
  chr18:77577013-77577190
  hypo
gccacacggttgtcacgcagctgccacatggatgttacacggctgtcatacagctgtcacacggctgccactcacatgcctgtcacgtttgtcacacggctgccacatggctgtcacgcagctgccacatggatgttacacggctgtcatacagctgtcacacggctgccactcaca

SEQ ID NO: 45466 - DNA, 30 bp, Homo sapiens
  chr18:77609629-77609659
  hypo
agggcccagcgcggacgcttgcctttctct

SEQ ID NO: 45467 - DNA, 40 bp, Homo sapiens
  chr18:77612204-77612244
  hypo
ccagtgaccttgtttcggggaagcgcgctcccatttccca

SEQ ID NO: 45468 - DNA, 30 bp, Homo sapiens
  chr18:77622551-77622581
  hypo
ttctcgggtttttcccggcatgtgcgcagc

SEQ ID NO: 45469 - DNA, 30 bp, Homo sapiens
  chr18:77627798-77627828
  hypo
ggcctccctggactgcgtggagacccctcc

SEQ ID NO: 45470 - DNA, 49 bp, Homo sapiens
  chr18:77628385-77628434
  hypo
tgacccgtgtccaagcgtccggttaagaagcagtcgccctctgcatggg

SEQ ID NO: 45471 - DNA, 30 bp, Homo sapiens
  chr18:77628965-77628995
  hypo
ctgatgggatgtgtgcgggaggctgagtcc

SEQ ID NO: 45472 - DNA, 71 bp, Homo sapiens
  chr18:77631844-77631915
  hypo
ggtgccagtcagcagcgtctgccactgcgacattggcagcaaattcctgccagcaccgagtgaggacccgc

SEQ ID NO: 45473 - DNA, 40 bp, Homo sapiens
  chr18:77636150-77636190
  hypo
ccaggacccatctcccgcctggtgccgctgccatcacagt

SEQ ID NO: 45474 - DNA, 208 bp, Homo sapiens
  chr18:77636591-77636799
  hypo
cagtggtgccctctgcgagcagcttgctcacctgtgtctgtgacgctggtgccctgagggcagggccagccccctctctcggcacagctgggtgaatcatcaacgacacccttggcaccgtgagcacttgcacctgcagaccgcctggtctcgctcttgggcaccagccgtgccaggcccgggccaccaactccgtgtccttcttgca

SEQ ID NO: 45475 - DNA, 36 bp, Homo sapiens
  chr18:77644664-77644700
  hypo
ggtttccaaagagaccggacacgcccaaggcccaca

SEQ ID NO: 45476 - DNA, 30 bp, Homo sapiens
  chr18:77713124-77713154
  hypo
gcccctgctcagccgcgccctagcctgagc

SEQ ID NO: 45477 - DNA, 115 bp, Homo sapiens
  chr19:292109-292224
  hypo
tcggcacccaccttgcgacggcgtagggtgtccaggcgcagccctgtgcccaggcaccgttcctatcagcgcacttgctgtcccatttcacagaagagcacgggggcgccaggag

SEQ ID NO: 45478 - DNA, 26 bp, Homo sapiens
  chr19:349162-349188
  hypo
ataaagcaccacggatgaggtagttt

SEQ ID NO: 45479 - DNA, 118 bp, Homo sapiens
  chr19:400972-401090
  hypo
ccaggctcaccctcacgcttgatgatttgcgaggacgcacggaactcccagcaagctgtcctcgtcacaggtagggtttgtcacagtgccggggtgcaggtgccgtgggctggggaag

SEQ ID NO: 45480 - DNA, 30 bp, Homo sapiens
  chr19:401481-401511
  hypo
gcagcagggctcagccggtgaccaggactg

SEQ ID NO: 45481 - DNA, 442 bp, Homo sapiens
  chr19:403367-403809
  hypo
agacctgaggcagggcgagacaccacgcaggcgcagaatccctggatgacgcccacttggaagtggaggggggagggcatgggcagctgcagctcccagacaccagcacacacaaacgcacacacaagtgcacaccagcagcgacacaggcacacacaagcgcacacagggtcacacatgcatacacggctcacgtgcttacacgtgcacacgccagcacacaggcagctatactcgagtgcctgcaggcgctcacctggcactgtcacatacgcccaacagatgagcacggtaacggcacacgcagtcacactgcacacacatgcggaagcacatggcgacgtgtgtgcacctacctggcacgcacacgcacacacccgtgcagcctagcgatgagtggctggggctgaagaggctacaaggcgcccgtagccctgtcaac

SEQ ID NO: 45482 - DNA, 546 bp, Homo sapiens
  chr19:407124-407670
  hypo
gcagctccttctccccgagcagcgtgtcccgcttgaggctgctgcccttgttcaccaccttgatcctgagggccagtttccggacgctggcgggccccaggccgtcgaagaagaaatcctcgttgaagacggggcggcggctgttcttcacgatggtgctgcgctgcttctgcagcttgcccggcaccaggcacaggcccacgcagcagttgatgctgcgggcgtcgcacaggcggtcgtagaggccctcggcggccagcaggtgcacccgcaggcgggcctggccggcctcgtactcggccagcagccgcacgctgccccgagggcccacgtggaccgtgtgctccccacgcgcctggcccgactcggggccaggttccgggggtgcccggcgggtcaggcggcgccggctcccggggctggcgtccggggtgctgtcgtccgcagacagggagccgtggcggcccacggagtgccggagctggctcaccttggcctggctgtcctgggcgaaacctttgagcagagacacggagcgggacagca

SEQ ID NO: 45483 - DNA, 30 bp, Homo sapiens
  chr19:413211-413241
  hypo
gcaccagctgattcccggggcatcctggcc

SEQ ID NO: 45484 - DNA, 119 bp, Homo sapiens
  chr19:426860-426979
  hypo
tccggggagggaggacgacagtgcgagacgcaggcgggtggaggaatccctggaccctggacccgcgctatgggcacatttgtaggagttcttggccagagaatcgggaagggcatgag

SEQ ID NO: 45485 - DNA, 68 bp, Homo sapiens
  chr19:468719-468787
  hypo
cacggccccacagaccgtctgtgcacacatgctgtacatgtggcagtgagccacgggtgagggaggaa

SEQ ID NO: 45486 - DNA, 272 bp, Homo sapiens
  chr19:470863-471135
  hypo
ggagctgcttcactgcgcccgttctagacaggagcaggcaccatggggcaaggccaccagcctgtggcacagcgagccggtgcaccccatgcctgccctcccgcaggcagccgggaatgtccacagagatacaccacagccctgtgagacgggccaggcccggggagcccccaccttcatggtggagaaactggggctcagggctcagcctcacacccgacagcacacgtttactgagcacttactattttttctttttcttaaatttgttt

SEQ ID NO: 45487 - DNA, 229 bp, Homo sapiens; identical to SEQ ID NO: 16347
  chr19:485165-485394
  hypo

SEQ ID NO: 45488 - DNA, 216 bp, Homo sapiens
  chr19:491311-491527
  hypo
cctttatggtgtttgcgacgtcgtgtaaacaccagctctctagtctcaaacccggcgagggcggttcatagacaatttcagtctctcgacgcgacgccgtgtggcttgtgcccttctagccacctagaccctcgggagaggcctgtgcggctcctggctgggcccccgtcttcaaagcagcttttgagtggccctttgacccgtgagacagggccg

SEQ ID NO: 45489 - DNA, 30 bp, Homo sapiens
  chr19:499792-499822
  hypo
gggccggtgccctggcggtgctcccttcac

SEQ ID NO: 45490 - DNA, 41 bp, Homo sapiens
  chr19:508329-508370
  hypo
cctggaagagcctggcgatgtgcgggcgggttgcagggaag

SEQ ID NO: 45491 - DNA, 176 bp, Homo sapiens
  chr19:524057-524233
  hypo
taaatcctggacacccggacagggacgcagggcacggaggcttccaggagtgaccaatcagaggacaccaaagctggtcccagggtgcacctcacactccgccccggtcccttgaggccaaggccgaccgaagcccacctcccctgccccgcccagctccccggggcctcccctga

SEQ ID NO: 45492 - DNA, 224 bp, Homo sapiens
  chr19:530256-530480
  hypo
tgcagctgtgtgtacccagggcatagcaacaatgccactggcacagtccgagggcagggccacccgtcacgggcacgactcaggggaggctgggctgccccgtcctcaccacggccagttctcccgaccaagcttcacagcaaggagcatgtgggtgtctgggcagccactgagccaggtcagaagtcaggtggggtcacagtgatgcccggaatcagctgggg

SEQ ID NO: 45493 - DNA, 206 bp, Homo sapiens
  chr19:548497-548703
  hypo
cacgccgggccaggccgcagcaccctgattccctctgtccccaggatggcccagctgaggctggtgctggggctccacaccctggacagccccggtctcaccttccacatcaaggcagccatccagcaccctcgctacaagcccgtccctgccctggagaacgacctcgcgctgcttcaggtgtgcagggacgggacagggagaac

SEQ ID NO: 45494 - DNA, 366 bp, Homo sapiens
  chr19:549314-549680
  hypo
cactggcaggggtcccgtttctcaggtgcagaaactgaggctcagacaggtttagcaacctgcgcaagaccacacagccgggaagcggcagagctgtgacttctgctccagccaagacggtccggcgggggaagaaggagcagggttcacagggccagcgggagatggggaggggacacgcgtgggccgggagcagcccctgtgtctccttgagcctggggataacaggcctggccctgctcccctcggcgggccctgctcccctcgtcccctcagcaggtgcagaggctgagctgcggtgtgtcgtccctgcagggtgactcgggcgggcccctggtgtgtggcaaaggccgggtgttggccaga

SEQ ID NO: 45495 - DNA, 111 bp, Homo sapiens; identical to SEQ ID NO: 16352
  chr19:550388-550499
  hypo

SEQ ID NO: 45496 - DNA, 37 bp, Homo sapiens
  chr19:557261-557298
  hypo
caaagcgcagaggcacgatggtcgctgacaaagtggg

SEQ ID NO: 45497 - DNA, 24 bp, Homo sapiens
  chr19:558037-558061
  hypo
gatgccaaggtcaggcgccgtcgc

SEQ ID NO: 45498 - DNA, 30 bp, Homo sapiens
  chr19:559762-559792
  hypo
tccttctgtgtctggcgtctctcactgagt

SEQ ID NO: 45499 - DNA, 218 bp, Homo sapiens
  chr19:593150-593368
  hypo
agtccaccctgctcccgtgctcggaagtggcctctttcacgccccacgtcccagtcccagtatacagcaggtgccacatatttgctgaattttctgaggggcagagcatgggtcctgggctgacgtgggtccagatttcggctctcaggcctgggcggctggcccctttggaagtgcagttggtgccagggtgcagcggctcacgcctgagatcccag

SEQ ID NO: 45500 - DNA, 248 bp, Homo sapiens
  chr19:599192-599440
  hypo
ctcttccttttggaccgtttcctcgggatcatttccccgaagtggagcgtctgggtcaccccgcagacgtggtgttaacagcttttccctcgaggagccgtccagaagcaaggagccgactttcggcggctcctgaaacaaaggtcccggcggccacgccagcgatgagctcccaggtttttctttattggtgttaactttggggagtccctccagtccctcagcatctcctccgaaaggatgtgggg

SEQ ID NO: 45501 - DNA, 46 bp, Homo sapiens
  chr19:601680-601726
  hypo
ttttaaggagccacccgtgtttgctccgagtcgttttgattttcat

SEQ ID NO: 45502 - DNA, 30 bp, Homo sapiens
  chr19:602546-602576
  hypo
ggcgtgagctgagcacggttcatttcccac

SEQ ID NO: 45503 - DNA, 34 bp, Homo sapiens
  chr19:623991-624025
  hypo
tttgagaatcaaagacgcacgtccacataaaagc

SEQ ID NO: 45504 - DNA, 84 bp, Homo sapiens
  chr19:634304-634388
  hypo
gaatgaaataaacctcggagcctagagcctgccctggtctccgcgtgatcctgcctaggaggagcagggcgggagctttagaat

SEQ ID NO: 45505 - DNA, 30 bp, Homo sapiens
  chr19:638382-638412
  hypo
tggggccagtctcaccgctgtgggtcccat

SEQ ID NO: 45506 - DNA, 58 bp, Homo sapiens
  chr19:640949-641007
  hypo
ggggactggctgggccggtccatccatggcgggcatggccaggcggggtggcctcggg

SEQ ID NO: 45507 - DNA, 85 bp, Homo sapiens
  chr19:690838-690923
  hypo
tacaccgtccctggcaaggtgacaggccgctgcggctctgcgctggtgtgcctgatccccgtgtccggggcgctggcatcgtctg

SEQ ID NO: 45508 - DNA, 30 bp, Homo sapiens
  chr19:696867-696897
  hypo
tggcaaagttcaggtcgtaaattgcagctc

SEQ ID NO: 45509 - DNA, 33 bp, Homo sapiens
  chr19:727028-727061
  hypo
gagatcgagaacaagcgccggcagctggaggac

SEQ ID NO: 45510 - DNA, 30 bp, Homo sapiens
  chr19:748479-748509
  hypo
tggggtggtgggaggcgctggaatccccac

SEQ ID NO: 45511 - DNA, 285 bp, Homo sapiens
  chr19:752081-752366
  hypo
cacttgctctgtcatcgctgtgtgacctcagatgagcaggttctcctctctgggtcccagctccctctctcgaaaaccggagtcgaaaacggttccaaggtgttgcaggaagagtctcaggacgccgaggtccttagccaccgccgggccttgcaggggccatcttccgtcctggggctcttcccccgagggcagcgccgctgcccaagaatgccggccatgagagccgccgtggatccaggggtttttttggccgacacagtgaaaccccatctctactaaaaa

SEQ ID NO: 45512 - DNA, 39 bp, Homo sapiens
  chr19:793780-793819
  hypo
taaccagcaaaccaacgtgattctcgcacaaaggcaagg

SEQ ID NO: 45513 - DNA, 87 bp, Homo sapiens
  chr19:814462-814549
  hypo
ggaagccggcatacacgtccacagggtggctgcggtactgcgtgatctgcgtgagcccgcatacgcccgcggcgatggcaaaggcga

SEQ ID NO: 45514 - DNA, 30 bp, Homo sapiens
  chr19:850011-850041
  hypo
taagaactttatgaacgtgaatttatttca

SEQ ID NO: 45515 - DNA, 632 bp, Homo sapiens; identical to SEQ ID NO: 1629
  chr19:883582-884214
  hypo

SEQ ID NO: 45516 - DNA, 30 bp, Homo sapiens
  chr19:885082-885112
  hypo
gggaccctggggccacgcactgctgggcct

SEQ ID NO: 45517 - DNA, 145 bp, Homo sapiens
  chr19:891516-891661
  hypo
acactagctctctcccgaaggaagagcccgcagacaggcaagcggtggggcggctccctgtagccgaggcggggctgagtgacagggaacacctgtggccgaggcggggctgagtgacagggaacacctgtggccgaggcggggg

SEQ ID NO: 45518 - DNA, 41 bp, Homo sapiens
  chr19:893910-893951
  hypo
atgtccaagagtggggaaactgtaagcgaagtcaccgaccc

SEQ ID NO: 45519 - DNA, 228 bp, Homo sapiens
  chr19:900821-901049
  hypo
cccgcacctctcctccggtcctccccacggccagggcccctcctccgcgccttgctcctgccctcatcctccaggtagcgaagaacccgctcctgctcctccccggagcggttcatgaaatcgttccagacctggaagagaggcagggaggcaggcttgccatgaaacactggggctgcgctgacatccccgggcaaatgggcacggtaaggccgccaagcacgtgga

SEQ ID NO: 45520 - DNA, 113 bp, Homo sapiens
  chr19:945999-946112
  hypo
agtgcttggaccctgcggttactccgagcccatttctcagcagggaaaaatgaggctcgcggaggcaggggcccggcgtccaggtgggagcatgagggcgtattgtgggtggg

SEQ ID NO: 45521 - DNA, 833 bp, Homo sapiens
  chr19:955719-956552
  hypo
aggcagggtagaccccgtaataccgggtcagaatctcagaggagaggaccttccgctcgccctggaagggcccaaggtgtgctggcctctacgtgcggttcttagccggggggctgcgtaacgaaggacctcaaaccgcgggcgtaaaacaaacgaaacctgttctccctccgtcctggagcccagagtccaaaatcgaggcgtccgcagggctgcgctccctccaggggctgcaggaggagccttccgcctctcccagctcctgggggctccaggagtcccttgacatgtggccggcctctgtctctgtgcgaccgtctccagtgcccaccggccttcactgtgactttttctcaatttgatcacgtctgcaaaggccctttttccaaataacgtctcgttctgaggttctgggccgatgtgaatttgggtgggggatggcgttcaccccaggacagccccagcggtgaagtcctccccattccagtacctgctgcctcaggcgtttccctggcaagctcgtcctgtccccctctccgccctgtccccctctccgccctgcccggctcacttttgcagctgagaaaatcaaggttcaagtaacgagcatttattaggcaactgctgtgtgctcggctgattccagactctgggaacaaaacagactaaaccccagatacactcctagatccgtgactcggtgatggacggggtctcggaggaagaacgtggaggggagggggcggcagccgggccggggtcagaggacgaggccgggcgtgtggccatgtgtgcgtgcctgtgctcatgggacccaccggcccggccagccg

SEQ ID NO: 45522 - DNA, 230 bp, Homo sapiens
  chr19:957171-957401
  hypo
ctctggaagacgttccggggcctggtgatcttcttcctccccagccaccaccctggcaggcagaggcggtcggtggctcatttcatagctggaggctgagactccaggctccaggtgcggggaagccagcaggagacaggaggaccgggatgggaagcagggcggggctctgggccaagtccccagcagcccccaggctctggtcccgcactcgccgctgtgtctcagtt

SEQ ID NO: 45523 - DNA, 32 bp, Homo sapiens
  chr19:959587-959619
  hypo
tctgggctccgggaccgcgggagaatagattt

SEQ ID NO: 45524 - DNA, 65 bp, Homo sapiens
  chr19:963980-964045
  hypo
tcctcccgagggctgcgctgtccctaagcccaggttactggtggataaaccgaggcagagctgcc

SEQ ID NO: 45525 - DNA, 625 bp, Homo sapiens
  chr19:1003177-1003802
  hypo
tggatgtgctggtggcggtgctgcaggcgcacgcctgggaagacgtcggcctggccctgtgccgcactcaggaccccggcggcctggtggccctctggacaagccgggctggccggcccccacagctggtcctggacctaagccggcgggacacgggagatgcaggactgcgggcacgcctggccccgatggcggcgccagtggggggtgaagcaccggtacccgcggcggtcctcctcggctgtgacatcgcccgtgcccgtcgggtgctggaggccgtacctcccggcccccactggctgttggggacaccactgccgcccaaggccctgcccaccgcggggctgccaccagggctgctggcgctgggcgaggtggcacgacccccgctggaggccgccatccatgacattgtgcaactggtggcccgggcgctgggcagtgcggcccaggtgcagccgaagcgagccctcctccccgccccggtcaactgcggggacctgcagccggccgggcccgagtccccggggcgcttcttggcacggtgagtggggaccctgcttcccttaggagggtgtccaggccactgagtctgcactgctcatggatcacaaaaggcaacgtg

SEQ ID NO: 45526 - DNA, 666 bp, Homo sapiens
  chr19:1004775-1005441
  hypo
ccatttgtgtttgcccgtgatccagacgaagacgggcagtgcccagcggggcagctgtgcctggaccctggcaccaacgactcggccaccctggacgcactgttcgccgcgctggccaacggctcagcgccccgtgccctgcgcaagtgctgctacggctactgcattgacctgctggagcggctggcggaggacacgcccttcgacttcgagctgtacctcgtgggtgacggcaagtacggcgccctgcgggacggccgctggaccggcctggtcggggacctgctggccggccgggcccacatggcggtcaccagcttcagtatcaactccgcccgctcacaggtggtggacttcaccagccccttcttctccaccagcctgggcatcatggtgcgggcacgggacacggcctcacccatcggtgcctttatgtggcccctgcactggtccacgtggctgggcgtctttgcggccctgcacctcaccgcgctcttcctcaccgtgtacgagtggcgtagcccctacggcctcacgccacgtggccgcaaccgcagcaccgtcttctcctactcctcagccctcaacctgtgctacgccatcctcttcagacgcaccgtgtccagcaagacgcccaagtgccccacgggccgcctgctcatgaac

SEQ ID NO: 45527 - DNA, 133 bp, Homo sapiens
  chr19:1030092-1030225
  hypo
cctcagtgctgtctccgcggtcactagtggctggatagggacactcgaggtccccactggtgcacacccactgcccaggagcacacagcccattccccacggcggtgtctcagagcaccgaaggccaagaaag

SEQ ID NO: 45528 - DNA, 56 bp, Homo sapiens
  chr19:1042258-1042314
  hypo
ggtgcctcagaccaacgtccccccagccccatgctcccgtgcgctcctcccccagc

SEQ ID NO: 45529 - DNA, 25 bp, Homo sapiens
  chr19:1047890-1047915
  hypo
agaagctggcacagtcgccgggcgc

SEQ ID NO: 45530 - DNA, 178 bp, Homo sapiens
  chr19:1051366-1051544
  hypo
gggtactgaggtccacgtgggtaggcaaccttgcccaaggctgggtgtgacacactgaggtcccttccccatctctaccaggtgggatgcaacggaagctgtccgtggccattgcctttgtgggcggctcccaagttgttatcctggacgagcctacggctggcgtggatcctgcttc

SEQ ID NO: 45531 - DNA, 32 bp, Homo sapiens
  chr19:1083719-1083751
  hypo
gcgaggtcaattccccgcttcagattttcttt

SEQ ID NO: 45532 - DNA, 118 bp, Homo sapiens
  chr19:1085976-1086094
  hypo
gcagggaaaggcagccggaattcgtgtgagctggggtggggctgggaccacaggtggcttctctcttgcctgctcctgtccctccagcacgtcccctgcaccacggcatagcttaggt

SEQ ID NO: 45533 - DNA, 186 bp, Homo sapiens
  chr19:1105541-1105727
  hypo
cgggtgggtgggggtcggggtgggctccagcctggagagggcctgggagtgtgcagggggcccggactgagggggtgccagcccccgactcactcacacaccttggccgccacaggagccagggagtaacgaagagatcaaagagttcgccgcgggctacaacgtcaaattcgatatgttcagcaa

SEQ ID NO: 45534 - DNA, 158 bp, Homo sapiens
  chr19:1112603-1112761
  hypo
cacccactaggcccccgctccaggtcaccaggacgtcccggggcagcgagaggcctgcggggcgcggacaccacccgccacacggccactcgcgcccgcacctggcacacacacactccagaagtgcgcgggtccacagtccccggggacccttgggc

SEQ ID NO: 45535 - DNA, 25 bp, Homo sapiens
  chr19:1128398-1128423
  hypo
tttttttttttgagacggattctta

SEQ ID NO: 45536 - DNA, 56 bp, Homo sapiens
  chr19:1156227-1156283
  hypo
gacgccccttccaggcggcaaccccaggaggctcaggggaccgggttcttcaaggg

SEQ ID NO: 45537 - DNA, 60 bp, Homo sapiens
  chr19:1156568-1156628
  hypo
ctcacaacagccacccgaggaagcagcccagtgtccacggataggcgagtggaccagcat

SEQ ID NO: 45538 - DNA, 30 bp, Homo sapiens
  chr19:1167293-1167323
  hypo
tgacaacgacacccacgcgccctctctggg

SEQ ID NO: 45539 - DNA, 354 bp, Homo sapiens
  chr19:1171068-1171422
  hypo
cacacaacacaaacacgggtgcacaggcacacacaacacacaaacacggatgcacagacacgcacacaatgtgcacccataaaacacacgcgtatgaaacacacgagcaacacacacatgcacaggagcacacagccacaggcacgcacattcacacacacacaacgcacccacatccgtacaacacacacacagaacgcgcacacgtccgtacgacgcacacacagaatgcacgtgcgtacgtacaatgcacacaaagaatacacacatccatacaacacacaggcacacaacacacatgtgcatgcacatggcgcaacatacagatacacaaagacacgtgtacacacacat

SEQ ID NO: 45540 - DNA, 30 bp, Homo sapiens
  chr19:1208940-1208970
  hypo
gcaggctgtgacatgcggaaaccaggggca

SEQ ID NO: 45541 - DNA, 121 bp, Homo sapiens
  chr19:1220427-1220548
  hypo
acaaggacatcaagccggggaacctgctgctcaccaccggtggcaccctcaaaatctccgacctgggcgtggccgaggtaggcacgtgctagggggggccctggggcgccccctcccgggc

SEQ ID NO: 45542 - DNA, 92 bp, Homo sapiens
  chr19:1227516-1227608
  hypo
atcctcccaggggcccgcgggaggcggagaaccggtgcccaggctgacctcttccgtcttccttccaccctgcagcccgtgtccaggagccc

SEQ ID NO: 45543 - DNA, 30 bp, Homo sapiens
  chr19:1234905-1234935
  hypo
ggtccctgcagcctccgcacccagctcctc

SEQ ID NO: 45544 - DNA, 30 bp, Homo sapiens; identical to SEQ ID NO: 16369
  chr19:1236238-1236268
  hypo

SEQ ID NO: 45545 - DNA, 60 bp, Homo sapiens
  chr19:1236474-1236534
  hypo
ccaaggcggtgcagccggctcgagaaggactccagacgccctgtccgccccatcacgggg

SEQ ID NO: 45546 - DNA, 30 bp, Homo sapiens
  chr19:1257622-1257652
  hypo
ggagagtgaaggagacggagaaacgcgccc

SEQ ID NO: 45547 - DNA, 30 bp, Homo sapiens
  chr19:1274097-1274127
  hypo
tagctccatcccatacgggtagctggctcc

SEQ ID NO: 45548 - DNA, 101 bp, Homo sapiens
  chr19:1274693-1274794
  hypo
ctggagcacgggctgcggtgcgccggcagcttacggggcggccagtccttgcccacaacgatgtggagccctgtgaaagtcggattcgaataaagggccac

SEQ ID NO: 45549 - DNA, 48 bp, Homo sapiens
  chr19:1289247-1289295
  hypo
gtgcgtgcccttgcacgggatgtctgcagtgtccgaggtccctgtgcg

SEQ ID NO: 45550 - DNA, 32 bp, Homo sapiens
  chr19:1301313-1301345
  hypo
gtcggcggggcgggccgcgttgccaggcctgg

SEQ ID NO: 45551 - DNA, 168 bp, Homo sapiens
  chr19:1308177-1308345
  hypo
cacttgagtctggaacgtctcagaccggacccctccctttacagcctgagagagggagagaccctgcccaggcctcccaggggcctgcccacccgacagctcctgactcccccaccctcattggtccagaaatggaaggcttcggcccaggagcgatcaatgcaccct

SEQ ID NO: 45552 - DNA, 80 bp, Homo sapiens
  chr19:1311273-1311353
  hypo
ggcacttttgccagccgctcctgcctttgtcgcaaacccaggggtattttcccacaaggtggactcggtgggtttgaaag

SEQ ID NO: 45553 - DNA, 30 bp, Homo sapiens; identical to SEQ ID NO: 16373
  chr19:1325942-1325972
  hypo

SEQ ID NO: 45554 - DNA, 35 bp, Homo sapiens
  chr19:1329520-1329555
  hypo
atacgattccagtcacgacccggcatgtgtcgggt

SEQ ID NO: 45555 - DNA, 40 bp, Homo sapiens
  chr19:1409921-1409961
  hypo
ggaggcaggagatcccgccggaccccgcttggagggctgg

SEQ ID NO: 45556 - DNA, 39 bp, Homo sapiens
  chr19:1424255-1424294
  hypo
gtcttctccatcctgcgctcctctcgctgtgtgccttgc

SEQ ID NO: 45557 - DNA, 30 bp, Homo sapiens
  chr19:1437261-1437291
  hypo
aagcataagccaccacgcccagccaggtgc

SEQ ID NO: 45558 - DNA, 30 bp, Homo sapiens
  chr19:1440112-1440142
  hypo
aggccaagaaggaggcgccgcccatggaga

SEQ ID NO: 45559 - DNA, 149 bp, Homo sapiens
  chr19:1481985-1482134
  hypo
ctgctgctggtccagcgtggaggatgggggacaggaggtgcagtccctcggggagccgccgcggcaggtgtagcaggaggcatggcagctggagcagaccctcagcgcgggcgccgccgtgtgcccaggcccagcggtcaccagccttg

SEQ ID NO: 45560 - DNA, 198 bp, Homo sapiens
  chr19:1482359-1482557
  hypo
agcccctctgtgtcccgctgcacacacgcgctgctggtcacctgggggcctgtaggccgcgctgtcatgtcctcggccgtcccatagagcagcagcgtgtagcggtacaacgtccctggacaggggtcgcgggtgggcacaggaggaaaaggaggctctcggcagcctggtcctggtagtccccgggctccctcccct

SEQ ID NO: 45561 - DNA, 30 bp, Homo sapiens
  chr19:1495370-1495400
  hypo
accccgcatatgcctcgtgagtgcacggct

SEQ ID NO: 45562 - DNA, 307 bp, Homo sapiens
  chr19:1496387-1496694
  hypo
agacagaatcatgaacgacctcagcgggcgagccctggacgcggcggccggaataaccaggaacggtgggtgctcgcaggcgcctggctgcctcaggccatctcccgggtctggacctgtctctctccaccttgcctccctttctgactttggccgccccctctcactgtccgcctctctctctcacgcttccgggaaccagtcttgcaggtcctggcccgtagccgggcaggcatcaccccggtggctgtggccgggccctccactcccctggaagctgaccgtacgtaaccgctgtggggagata

SEQ ID NO: 45563 - DNA, 210 bp, Homo sapiens
  chr19:1525771-1525981
  hypo
tgtccatctgcacctcgccgctgccccccgtaccatcctgtgtgccctctgctgtccattcgccagcgcttcttacgcctacgtagggccaattgtgtccatcctttactcacctgggcacacccaggctctcttgatccacctgggcccagcttacgctgtgctcatcaggcccgtctcagactcacctgtgaccgcctgggcccatca

SEQ ID NO: 45564 - DNA, 43 bp, Homo sapiens
  chr19:1526480-1526523
  hypo
acagtctttggcccacgtgctgagggcgcggcagatcctgacg

SEQ ID NO: 45565 - DNA, 61 bp, Homo sapiens
  chr19:1527227-1527288
  hypo
acaggcaggtcagggcgtatgtgtacagggatacagcgtgtgtgggcgcagggcaggtgtg

SEQ ID NO: 45566 - DNA, 33 bp, Homo sapiens
  chr19:1528123-1528156
  hypo
cttcacacaggtgggcggcggtcctcggcgtgg

SEQ ID NO: 45567 - DNA, 30 bp, Homo sapiens; identical to SEQ ID NO: 16379
  chr19:1533726-1533756
  hypo

SEQ ID NO: 45568 - DNA, 49 bp, Homo sapiens
  chr19:1654563-1654612
  hypo
gacctcaggcaagttcgtgctactctccgggcctcggtttctccatctg

SEQ ID NO: 45569 - DNA, 46 bp, Homo sapiens
  chr19:1672993-1673039
  hypo
cggggcatgcttatgcgtgttctcgcatgctcgtgtgcattctagc

SEQ ID NO: 45570 - DNA, 46 bp, Homo sapiens
  chr19:1729230-1729276
  hypo
gtgttgtggggtacacgtgtgtatgtgagctcgtgagggtgtgcaa

SEQ ID NO: 45571 - DNA, 48 bp, Homo sapiens; identical to SEQ ID NO: 16380
  chr19:1799852-1799900
  hypo

SEQ ID NO: 45572 - DNA, 64 bp, Homo sapiens
  chr19:1802584-1802648
  hypo
attccaggcaccccacgaagtggtgcatccgactgttaggcgcctcacacgtcactgtgcctgt

SEQ ID NO: 45573 - DNA, 30 bp, Homo sapiens
  chr19:1807179-1807209
  hypo
aggtcccgggtggcacggatgaagaggagg

SEQ ID NO: 45574 - DNA, 320 bp, Homo sapiens
  chr19:1808120-1808440
  hypo
ctgtggggagtgggacgtgaacccacccatcacacagacaaacacatcgatgctgccaggtggctaggggggacttcctggaggaggcaacacgcctcacctgcaggatgatgatgatgaggaagaacaggttggacacgcggtggaactgctcgtacaggttcagcggcaggaacgagtagaagttgtacttggccgtgcggatgacattggtctggaacgagagccgcgggctgcctggcagaggggtgccatccaggccaggggatgggggtgcccgaggccagacctgcctcacttggcctcgcccagcatcctct

SEQ ID NO: 45575 - DNA, 377 bp, Homo sapiens; identical to SEQ ID NO: 16382
  chr19:1809512-1809889
  hypo

SEQ ID NO: 45576 - DNA, 141 bp, Homo sapiens
  chr19:1810575-1810716
  hypo
ataatccctcccacctgcaccgccccctctgcccaggatcagcacctgagttcctgtcctcatcttggagatcttctctctggccgaggctgcccatgctggtggggctgtgggagagaagggccccgggtcacagcagtg

SEQ ID NO: 45577 - DNA, 78 bp, Homo sapiens
  chr19:1896317-1896395
  hypo
gcctggctgtaattgcctcttaaagagaaacaagtcagattggatttgggcgcaccctcaggacgtcatttgaaccta

SEQ ID NO: 45578 - DNA, 51 bp, Homo sapiens
  chr19:1908389-1908440
  hypo
ccccggcggctgaggcgtggaccaggcagtgcatgtcgaggagtagcaccc

SEQ ID NO: 45579 - DNA, 37 bp, Homo sapiens; identical to SEQ ID NO: 16383
  chr19:1912092-1912129
  hypo

SEQ ID NO: 45580 - DNA, 48 bp, Homo sapiens
  chr19:1912374-1912422
  hypo
tttgcctggctgggccggcctcgggcccgcgctcgctggctgagctcc

SEQ ID NO: 45581 - DNA, 150 bp, Homo sapiens
  chr19:1969956-1970106
  hypo
aggtgaggccctgctcggtggtaggtggggtcgggaggctgctggcagggccgccccgagtcaccggagcctctggtggggccgcccggggtcactggagcctctggcggggccgccccatgtcactggcaggtgcgttgaatcatcagt

SEQ ID NO: 45582 - DNA, 99 bp, Homo sapiens
  chr19:1970425-1970524
  hypo
caccatgtaaaaggccgcacctggcccacctggctccgtcccttctgctcacaccaacctctcccgggtcggggtctgattgcccgggcaggcgtgagg

SEQ ID NO: 45583 - DNA, 30 bp, Homo sapiens
  chr19:1970740-1970770
  hypo
gttgctggggttgtccggggaacccaggtg

SEQ ID NO: 45584 - DNA, 649 bp, Homo sapiens
  chr19:1978313-1978962
  hypo
ctatacaaatgaatacgtggctatcaaattggtgagtcggcccctccaccccacccccgctgacgtgccccccagggatttcagggcagcgacccggtcccctggtgactcgctcttgtgcccccaggagccgatcaagtcccgggccccgcagctgcacctggagtaccggttctacaagcagctcagcgccacaggtaccgggcggcccgcgggtggggcgggggctgcgcaggggcagggagggggctgccgccgcacgcccgtgcgtctgtcctccgccgcagagggcgtccctcaggtctactacttcggtccgtgcgggaagtacaacgccatggtgctggagctgctggggcccagcctggaggacctgttcgacctgtgcgaccggaccttcacgctcaagacggtgctgatgatcgccatccagctggtgcgcggcgggcggggcggggcggggctcggagggaagagggtggccctggaggggagcgcgtgggacggggaggggcccggccgacaccgccgtgcccccctgcagatcacgcgcatggagtatgtgcacaccaagagcctaatctaccgggacgtgaagcccgagaacttcctggtgggccgcccggggaccaagcggcagcatgccatc

SEQ ID NO: 45585 - DNA, 385 bp, Homo sapiens
  chr19:1992849-1993234
  hypo
cgtgagcaaccacgcccggcccaaaacacattttactaccaggcaggagcctgctgcctcccgggcccgcccccggccccgcctccgcctccagcctcggtccgccccaccccggccccgcctccagccaggcctggccccgcccccgcctcgtaccggccccgcccacctgcgtgagcagcatgaaggcgttgtcggctcgcaggttcttcttcaggaactccacgcaatgggcctcgagcgctggcaccgcgtacttcttggcggtgtatagcgtggtcatcaccgtctccgggccaatctgcacctcgtccgagtagagaaacctgcagaagcaacgcgggtggccgtgaggtgggaccgccatgcccgcccccaggggaga

SEQ ID NO: 45586 - DNA, 44 bp, Homo sapiens
  chr19:2191591-2191635
  hypo
cccgggccccacccacggctgcagcctgccgcagtccttccctg

SEQ ID NO: 45587 - DNA, 30 bp, Homo sapiens
  chr19:2214092-2214122
  hypo
gggtttgttcccagacgaattgcgccacct

SEQ ID NO: 45588 - DNA, 56 bp, Homo sapiens
  chr19:2243515-2243571
  hypo
ggccctggagaccatcgacatcaacaaggtgggccagccaccgtgcagctgcctgt

SEQ ID NO: 45589 - DNA, 55 bp, Homo sapiens; identical to SEQ ID NO: 16388
  chr19:2274600-2274655
  hypo

SEQ ID NO: 45590 - DNA, 197 bp, Homo sapiens
  chr19:2275743-2275940
  hypo
aacacagccagtcctcgaggctgggagcttccccacctgcggcccgctctgctaggcgcaggaccagcagcccgcggcgcacccgcagccagggcccgagcgctcggagccagggaccaagcggtgctccgcggccgcgcagctcaggcccgggcccccagagcagcgcctgcagcgcgccccgcgtccgggacgcc

SEQ ID NO: 45591 - DNA, 170 bp, Homo sapiens
  chr19:2331273-2331443
  hypo
acagtcacttggaagcggggtttctaagcctagtagtttctgaacctgtgtgcggttgcaaagcgtttgtgctgcaattgtgaaggatttggaggtcgaggcttgggctttgagcctgtccttgtagcctgagctttttctgctcctccaaatttcggtgggcctgtcta

SEQ ID NO: 45592 - DNA, 125 bp, Homo sapiens
  chr19:2331903-2332028
  hypo
acacagaaggtgggccggactgtggattcttggcctctgccgtgacccataacatccctcctggaggaggggttctggggggctgtgttggaaggggcaccctccgggctcggcaccggggccag

SEQ ID NO: 45593 - DNA, 204 bp, Homo sapiens
  chr19:2358959-2359163
  hypo
cgtggcagcgggtggcgcgtcaaaactgaggccacccagtctgaccatgagggagaaaagcaccagacaaacccacttgaggcgtgtcctgcaaaacacctgacctgccttccccaggagcgggcagggtgtcagaaataggaatgtctgggaaactgcgacagcccagagagatccgaggaggcgtgacgcctaaatgccacg

SEQ ID NO: 45594 - DNA, 99 bp, Homo sapiens
  chr19:2360711-2360810
  hypo
cgggggttatgtggacgcaggtgtggcgtgtggatgcggccggggttgtgtggactcaggtgtggtgtgtagatgcacgtagggttgtgtggacgcagc

SEQ ID NO: 45595 - DNA, 127 bp, Homo sapiens
  chr19:2363057-2363184
  hypo
ccctgcagagcctcacgccgcctgcttgtcctgccacgcggaatgggagtccgtgtgtgccccgctgcccacagcgtgtgaacgtgagttggggaccatgtggcccactgcgcgctgggtcccgtcc

SEQ ID NO: 45596 - DNA, 42 bp, Homo sapiens
  chr19:2471261-2471303
  hypo
acttcaaagcccccccgcaacaccgtgcccagcctgcagtac

SEQ ID NO: 45597 - DNA, 29 bp, Homo sapiens
  chr19:2471700-2471729
  hypo
aaatacggtgactcacgcctgtaattcca

SEQ ID NO: 45598 - DNA, 294 bp, Homo sapiens
  chr19:2513200-2513494
  hypo
ccaagcagggatccccgcctcacgggcctgcacggaggacctgggcggccgtccaggaaccctctcggcacgggttcttagacgcctgtctccactggggccggagggacaggactaggctagttttattctactacttgcttctaggccagccccgtggagggggtcggggcggccaggcctcctgcgatcagggctgcgtggggtccatctcaggtgtggccgcaggtgatgccggcaggccctggaagatgtggctgcacctgctcccgtccgtgccgcagaggaggacgc

SEQ ID NO: 45599 - DNA, 60 bp, Homo sapiens
  chr19:2518493-2518553
  hypo
cccggccagcagcagcgtgatggggtctgggagggctcagagctgcgctggagggagact

SEQ ID NO: 45600 - DNA, 124 bp, Homo sapiens
  chr19:2524811-2524935
  hypo
gtgcatgcgtgttggcgtgtgtgtacgtcactgtaggtgcgtggatatgtgcgtgcgtgggtgtgtacatgtgtctgcatgtgtacatgcgtgtgcgtgtgtgtgcgcacgggagtgcatgtgg

SEQ ID NO: 45601 - DNA, 150 bp, Homo sapiens
  chr19:2683891-2684041
  hypo
gctggtggacagcatcggccagaggagctcaaatccgccctcagccccagggggccgagctgcaaaagcgacgtcaaatggacaaaaatcccaccgggcacagaagtgcgaccagcaagtctatgggtttaaaaataaatgatggggccg

SEQ ID NO: 45602 - DNA, 30 bp, Homo sapiens
  chr19:2895788-2895818
  hypo
aaaaaaaaaaagtaccgacgttgacatggg

SEQ ID NO: 45603 - DNA, 22 bp, Homo sapiens
  chr19:2899962-2899984
  hypo
caggaggctgggaaacgtttgg

SEQ ID NO: 45604 - DNA, 22 bp, Homo sapiens
  chr19:3050735-3050757
  hypo
gggcgcggtggctcacgcctgt

SEQ ID NO: 45605 - DNA, 148 bp, Homo sapiens
  chr19:3219506-3219654
  hypo
gctgggattacaggtgtgagtcgccgcgccctgccactcccacgcgctttacttcctcagtaacatccatggcacgggcatcctgcagtgaccgatgcccaccagactgcatccgctaacaagacagggagaccggcctgtggtaccc

SEQ ID NO: 45606 - DNA, 97 bp, Homo sapiens
  chr19:3296598-3296695
  hypo
catgccaatctgcctcgagggggcctcacccgtgtccgcggcgcccgccgaggcccccgagggcctgcttgggagtgtgtgccggtgtgcagttgta

SEQ ID NO: 45607 - DNA, 30 bp, Homo sapiens
  chr19:3308117-3308147
  hypo
atcagcaggtcctgtcgcccctgccctcac

SEQ ID NO: 45608 - DNA, 122 bp, Homo sapiens
  chr19:3344938-3345060
  hypo
cccgtgtggctgcagcggagggaggagagggagagagggaggaggcgagggcagggagggacagggtgggtcaggcagggctttgtagccctcggggaggactctgtcgcctggagggcagt

SEQ ID NO: 45609 - DNA, 32 bp, Homo sapiens
  chr19:3456167-3456199
  hypo
ataattcatgcaccccgcgcggaggcagccct

SEQ ID NO: 45610 - DNA, 360 bp, Homo sapiens
  chr19:3562248-3562608
  hypo
cccagcccttcatgcctcttttacagataaggaaactgagtttcacaaagacgggcatgggcatgggactgtggcgggcatgggactaacaagaggcagatgtgggatttgaactcagctccacgtgacctctttatgtgctggctgcggaatgccacctgagtgtggaggaacaggtgcctcactgtccactgctttttcagcctcctttgtaggtcgagaatcaggcacaatcccgcctccctttggagaagatccagcggaggaggcagggtgtggttaaagcgccaacacatctctgcattcttgtccttttgctgttgtggtggttgttgtttgagactgagtcttgctctgtcg

SEQ ID NO: 45611 - DNA, 32 bp, Homo sapiens
  chr19:3570187-3570219
  hypo
aacaaacaaaaaggccgggcgcagtggcccac

SEQ ID NO: 45612 - DNA, 88 bp, Homo sapiens
  chr19:3571371-3571459
  hypo
gcgcccggcccatggcggataatattctgttgtaaggatatatcccgtcatcgatccatgcatcattagcagacgtttgagttgtttt

SEQ ID NO: 45613 - DNA, 75 bp, Homo sapiens; identical to SEQ ID NO: 16400
  chr19:3578148-3578223
  hypo

SEQ ID NO: 45614 - DNA, 30 bp, Homo sapiens
  chr19:3747990-3748020
  hypo
ccctggcccggtcctcggagcccgtgcagg

SEQ ID NO: 45615 - DNA, 40 bp, Homo sapiens
  chr19:3760214-3760254
  hypo
catggctggaggccccgaaggggatcgggaaattgtgggg

SEQ ID NO: 45616 - DNA, 217 bp, Homo sapiens
  chr19:3778200-3778417
  hypo
gcgaggtggagccgtcggcgtcctgccctgagacggaggctggggcacctgcactgcgtagctcccgggccagcttctcggccagtttgcggaagggtggccggcgggcgggctctgcctcccagcagctgctcatgaggacgtgcacggggcctggacagccctcggggggttccatgcggtaccccttctccacggcctccgacacctctttcag

SEQ ID NO: 45617 - DNA, 432 bp, Homo sapiens
  chr19:3779009-3779441
  hypo
gcgccgtccacttgacgggcagccggcttgagtctagccccttccgctcggctttggccaggccaaagtcgctgaccttggccaccaggtcctctgagaccaggatgttgcgggcggccaggtcgcggtgcacaagcttcttgctctccaggtactccatgccctcggccacgtgcctgggggtagtagggggcagtgggggctcaggtgccaggatgcccacattcagggctcagaaagctcggggtgcctggggccacaagctcacaaagcctccctgccccgtgcctcagtttccccttgatggatcttggaatctgcgccccgacgaccccagtgccgcagcaccctgagagtcccacttacagagaaaactgcaggagctgagcggtgttcacgagggctcgaccccgggtccgcagaaagttcacc

SEQ ID NO: 45618 - DNA, 243 bp, Homo sapiens
  chr19:3821011-3821254
  hypo
agggacaccgggggtcgggggacacaggtcacaaggcacctctgcagccgtgtggtccagcgagttggccggcagtgtccctgcgtctacggaggccctggagcccacgtgtcaggtccgcacgccactgtgcccttgcccgtctgctctggaaccctctcacgctcccacaccaggacgtgcccactgcccgggcacccgtctccccccactgctcgagagctcacacggaggagctccgta

SEQ ID NO: 45619 - DNA, 246 bp, Homo sapiens
  chr19:3855407-3855653
  hypo
aagtgaaagcagtcccgggcgatccggcggcagattcattgagtcattggataaatacttcctgggtgctagtggggaccagctgctgtcatgggcgctgtcacagcagcggggaataaccagaccaaagtcccgtcctccaggagggtgctgcgcgatagtccagggagacacggggtcagcaaaataattcaacgcgatctgatggttctcatgccgccgggaaggacgcggcaagggggtgtg

SEQ ID NO: 45620 - DNA, 120 bp, Homo sapiens
  chr19:3907807-3907927
  hypo
cggcagcgccgccaacgggcgcctgtggcggacagtgatcatcggggagcaagagcaccgtatagacctgcacatgatccggccttacatgaaagtggtcacccacggaggtgagacccg

SEQ ID NO: 45621 - DNA, 105 bp, Homo sapiens
  chr19:3982749-3982854
  hypo
ggctcctgcagatcccgctgcggcaagcccaccacccagctagggagggccgtaccatgatgttgcccatggggccgctctcgccctcgccgtaggtggagatga

SEQ ID NO: 45622 - DNA, 34 bp, Homo sapiens
  chr19:4043284-4043318
  hypo
cgactgaggcggcagcggtcgtaacaggctgcgt

SEQ ID NO: 45623 - DNA, 206 bp, Homo sapiens
  chr19:4053834-4054040
  hypo
gtgtgcacgtgcgtgtatgtgtgcgtctgcgtgcatgtgtgcgtgcggtgcagggagagaggcgggaggggtcgtgagcggcggatgctggggcagagagcaggacggcgcctcccccgcggcgggcagctcacctggtgaagcggaccttgcagatgttgcactcgtagggcttctcgcccgtgtgggtgcggatgtgtcgcggc

SEQ ID NO: 45624 - DNA, 34 bp, Homo sapiens
  chr19:4054641-4054675
  hypo
catccaggtcatcatcggacgccccaaaggcgga

SEQ ID NO: 45625 - DNA, 41 bp, Homo sapiens
  chr19:4096416-4096457
  hypo
cccagggaggtggcccggcctggtcacgtggccaacaggac

SEQ ID NO: 45626 - DNA, 37 bp, Homo sapiens
  chr19:4131483-4131520
  hypo
aagaaaagaaaaaggcgggctgggcgcggtggctcac

SEQ ID NO: 45627 - DNA, 188 bp, Homo sapiens
  chr19:4212361-4212549
  hypo
gttgcacgtggaatgcgtgaatgtgcatggaatggaggctatgaagcaggaggtggggcagggaggcctcttgcccagatccaaacccctgtccctgtttctcccgtcagtccccggaggccagctccctgcacatcctggagagacaggtaggtgggaaggtggggaggagccggtcctcctgctgc

SEQ ID NO: 45628 - DNA, 30 bp, Homo sapiens
  chr19:4290546-4290576
  hypo
ctccactacagttcacgcccactgccggtg

SEQ ID NO: 45629 - DNA, 30 bp, Homo sapiens
  chr19:4305764-4305794
  hypo
ggctcacctgcctgccgtgtgtgtgtgcgc

SEQ ID NO: 45630 - DNA, 131 bp, Homo sapiens
  chr19:4361539-4361670
  hypo
cccagcagggggtgccggccagtgtggacggaggggcggggcggggacacgggtgagtcactgcggcaggggcacaagcacctccacgtagctgagcgggaagaagcccgactggccgtccagcatgccct

SEQ ID NO: 45631 - DNA, 30 bp, Homo sapiens
  chr19:4363376-4363406
  hypo
gcttctccgccagctcgtccaggatctgca

SEQ ID NO: 45632 - DNA, 48 bp, Homo sapiens
  chr19:4512122-4512170
  hypo
ggacggtccctttggcgacattcactgcccccacgagcccagtagtca

SEQ ID NO: 45633 - DNA, 392 bp, Homo sapiens
  chr19:4547998-4548390
  hypo
cttgcttcccgcccacggctggcctggggtggacactcacttcatacaccccgagtactgctggcagcgagccacaggcactcggaccacgcagcgggggaaggcagccagcaggccccccgaagctgcgtccagctccaagctcagcagccgctgccctgtctcgccaccgccgggccgtccacacctggggacaagcagagtggtgaggctgagcgcatctcagcccatctcccctcctgctggcgaccccttcccacctttgcccagacttacctgtccggccggtaggtctcaaactcctccaggaagacactgagcccagacgtccctgaggtgctggcattgggccggacgaggaacttgaggaccgtccccgcctcagaacccag

SEQ ID NO: 45634 - DNA, 114 bp, Homo sapiens
  chr19:4550904-4551018
  hypo
gtgtcaggtcaaaggcgcagacagccgagccagggatgctgaggggttgggatgaaagagtttggtgagcccggtgggaggccccatctcggacaagtgcgtgcaggagcctct

SEQ ID NO: 45635 - DNA, 166 bp, Homo sapiens
  chr19:4554076-4554242
  hypo
gggtgagcaggtagacggatggacaggggatgaaggatggataagtgattgtggctgggtgggtgggtggacaggtgaacagcaacagcaccaggtgtatctgacttccaactcaagtccctcgtcagggctgagtgctccacggctgctccgtagatgtcttcag

SEQ ID NO: 45636 - DNA, 62 bp, Homo sapiens
  chr19:4554999-4555061
  hypo
tggagtcatgtttcacggtgcgcagggtgggcctgtccccgaggctgcggtagatgacagca

SEQ ID NO: 45637 - DNA, 260 bp, Homo sapiens
  chr19:4555896-4556156
  hypo
ctggaggaggtgacacggcctggggaaaagccatggccagcggaggtcgggcgagcagaggcctggaggttggacctggggcgcagggagtctgaagactcacgctgtagttggcgcacaccgggttgaaggcgttggaaccgcacacaaagagcgtggactcgtcccgaaggagcagcacctttacgaagtttcgacactcgccctgaggtggggacaggaggaagcggggagcgcgatgtgggcgtggtcatggtgat

SEQ ID NO: 45638 - DNA, 408 bp, Homo sapiens
  chr19:4556928-4557336
  hypo
cgcaggggccgggaccgagccagggccaactcacctcctgtttgcccttcatccgacacacgtttatgtcgctggggttagatctccaggtcagcttctgcagacagagagagctggtgagggggtaacgggtcccagcagccctgagtgaccccgccgtgctgggccgaatccacccagctccccggcgcagtgccgcgtccccctggccctacccctccactcccacctgcaccccttcctcaccctctggtaccgcagctccgtggacgtggggggctccagctctacgcggtagaggttgtccctgggggaggggcatagttagtgagaactgggggctccgccaccctctcccgttccatccttcccactgccaatgtggtgtgcacacgggggcatgcaggg

SEQ ID NO: 45639 - DNA, 42 bp, Homo sapiens
  chr19:4572555-4572597
  hypo
gggatcacaggcgtgagccaccgcgcccggcctcccctccac

SEQ ID NO: 45640 - DNA, 142 bp, Homo sapiens
  chr19:4670725-4670867
  hypo
aaggtcaccattaggcgaacttctcataatcgttgcagccaagatgtgtgtgcatcgatattcaaaattagcagagggaaagtaggatgagaagcaggatgcttgcttttgtttccctcttgttgcccaggctggagggcag

SEQ ID NO: 45641 - DNA, 50 bp, Homo sapiens
  chr19:4672854-4672904
  hypo
tcaccatgaaggattcgatgcatggccgagctctgcggctaacaaggaat

SEQ ID NO: 45642 - DNA, 40 bp, Homo sapiens
  chr19:4725551-4725591
  hypo
tatgtgtttaccttccgatggagttttgctcctgttgccc

SEQ ID NO: 45643 - DNA, 78 bp, Homo sapiens
  chr19:4789954-4790032
  hypo
gctgggattacaggcgtgagacaccgcgcccggccggcatgagataacaattctgaatgaagacgctgttgaacatct

SEQ ID NO: 45644 - DNA, 194 bp, Homo sapiens
  chr19:4792866-4793060
  hypo
agtacctgcccaaaccggagcccccacagctggtcctggcctatgactattccagggaggtcaacaccaccgaggagctggaggcgctgatcaccgacccggatgagatgcgcatgcaggccctgttgatccgggagcgcatcctcggtccctcgcacccggacacttcctattacatccgttacaggggtgcc

SEQ ID NO: 45645 - DNA, 30 bp, Homo sapiens
  chr19:4794081-4794111
  hypo
aggacagtctttctccgggagcccgctcac

SEQ ID NO: 45646 - DNA, 30 bp, Homo sapiens
  chr19:4795123-4795153
  hypo
aaagtctcaggttcccgtgactcagggtaa

SEQ ID NO: 45647 - DNA, 35 bp, Homo sapiens
  chr19:4798716-4798751
  hypo
tgctgattctccatccgggacgccagacacatgga

SEQ ID NO: 45648 - DNA, 30 bp, Homo sapiens; identical to SEQ ID NO: 16414
  chr19:4800545-4800575
  hypo

SEQ ID NO: 45649 - DNA, 30 bp, Homo sapiens
  chr19:4835700-4835730
  hypo
ttttcctttttaattcgcataggccagagt

SEQ ID NO: 45650 - DNA, 30 bp, Homo sapiens
  chr19:5041081-5041111
  hypo
gctgagggtgggctgcgtagcacccaggcc

SEQ ID NO: 45651 - DNA, 200 bp, Homo sapiens
  chr19:5046161-5046361
  hypo
gagggactctgcagccgcacgcaggctgtgccagcccaggccgacctgccacaggtgccaggggaagcttcagggcttccttgccatgtgtttgccatgcctagcctatgcactagcctacttttacagcgggggaaacagcccacagcagagaagcgacttgctgtggtcccaggatgaatttgcgcccagctcagcct

SEQ ID NO: 45652 - DNA, 236 bp, Homo sapiens
  chr19:5155177-5155413
  hypo
agctggcagaggggccgtggcaggagcaggtggtgcctgcagcgtcctttccattgttctccaaaacgctctaaaacgggaaggctatttgggacaggctgttgctgtctgccgagcagagtaaagatgagtggataggtccccaaaagtgtcaccgtgcggagccgatgaggtctgcactcgggccggggtgggtgccccgatgccgaggtctcgtatctcggggcagtgtgtga

SEQ ID NO: 45653 - DNA, 229 bp, Homo sapiens
  chr19:5587354-5587583
  hypo
cgccacctggcaccacgtggccctgggaatgtccaccttgtgcaaagccgcctcgcctaggaacaaagtcagacaatttttttccccttgaagtgctcagcgttttcatcgtaacatgggttcagtaacggtcccgcagcctttagagcgcttgggttttttttccaggtgagaaaaatcatcatcgcacattgtattccaggtaactcaagagcgttatttgcataaa

SEQ ID NO: 45654 - DNA, 362 bp, Homo sapiens
  chr19:5587840-5588202
  hypo
ggccacagccaccctcgtccctggagccagccccgtaccttgccacctggcgtgctcccggctagccgcgcctgcgtccatggcaccctgccaggcgcgtgcctggtgctcctctagccgctggttgtgctctccccagtcacggccacccctttgccaaaagaaaaagacatgcagccatctaatgagcctccagggttgtgtcggcagcaggcgcacccaccctgacctcagctgcatggtgggtcatgccacacaacaagggctgcatgtcaagtgggcaaatcaagggaagggacatttccccaaagacagatgtgctagtaagcacgtgagaaggtgctcaacgccacccagaaatg

SEQ ID NO: 45655 - DNA, 103 bp, Homo sapiens
  chr19:5676808-5676911
  hypo
gctgcaggacccggccgcctggatggaggggaggggccagaaagcagctgctcactggcctcgtccagtccttcccctctaacagtgacggtaacaggtgtga

SEQ ID NO: 45656 - DNA, 30 bp, Homo sapiens
  chr19:5688079-5688109
  hypo
acagaaaagcaaaaccgagaaaaacgacgg

SEQ ID NO: 45657 - DNA, 39 bp, Homo sapiens
  chr19:5759751-5759790
  hypo
ggtccatccgcacatcgcaatatgactcagacttaagaa

SEQ ID NO: 45658 - DNA, 30 bp, Homo sapiens; identical to SEQ ID NO: 16417
  chr19:5789897-5789927
  hypo

SEQ ID NO: 45659 - DNA, 37 bp, Homo sapiens; identical to SEQ ID NO: 16418
  chr19:5790176-5790213
  hypo

SEQ ID NO: 45660 - DNA, 34 bp, Homo sapiens
  chr19:5825328-5825362
  hypo
acgcacatgtccatgcgtgcgcctgcgcgggcat

SEQ ID NO: 45661 - DNA, 17 bp, Homo sapiens
  chr19:5857648-5857665
  hypo
accgacgtgcgtgacac

SEQ ID NO: 45662 - DNA, 36 bp, Homo sapiens
  chr19:5897722-5897758
  hypo
atgaggagcttgggccggggccgggcccagaactca

SEQ ID NO: 45663 - DNA, 33 bp, Homo sapiens
  chr19:5905436-5905469
  hypo
attatttttttgagacggagtttcgctcttgtc

SEQ ID NO: 45664 - DNA, 29 bp, Homo sapiens
  chr19:5910435-5910464
  hypo
gggcgcggtgtctcacgcctgtaatccca

SEQ ID NO: 45665 - DNA, 164 bp, Homo sapiens
  chr19:5914953-5915117
  hypo
cccatgtcccaggcccgggaggctgtcatcgcagctgcatttgccaagctggaccgcagtggggacggcgtcgtgacggtggacgacctccgcggggtgtacagtggccgtgcccaccccaaggtgcgcagtggggagtggaccgaggacgaggtgctgcgccg

SEQ ID NO: 45666 - DNA, 87 bp, Homo sapiens
  chr19:5915421-5915508
  hypo
agccacaccacagagcggggaggggcaggtgggggaatggaggctgcaggactggctagaccaggtccctgccggtccaccaggcgg

SEQ ID NO: 45667 - DNA, 30 bp, Homo sapiens; identical to SEQ ID NO: 16422
  chr19:5915925-5915955
  hypo

SEQ ID NO: 45668 - DNA, 30 bp, Homo sapiens
  chr19:6333625-6333655
  hypo
tgggccctgatgaggcggggagaggacagc

SEQ ID NO: 45669 - DNA, 45 bp, Homo sapiens
  chr19:6351083-6351128
  hypo
atatgagttataggccgggtgtggtggctcacgcctgtaatctca

SEQ ID NO: 45670 - DNA, 215 bp, Homo sapiens
  chr19:6358251-6358466
  hypo
tctgagcccaaatgccggctttccaccgtgaggccctgcctgccagcgctggctgccatgtgggctttctgctttgcggacctgcaaggtattctcctaactctgtcaccttcaactccctccctctgtcttactcctgattctacaaaactgggagtgtctgtgtccccttctatctccccatcggactgcagtcccctcgaggttacagaggg

SEQ ID NO: 45671 - DNA, 21 bp, Homo sapiens
  chr19:6623980-6624001
  hypo
accctaagggccaggcgtggt

SEQ ID NO: 45672 - DNA, 32 bp, Homo sapiens
  chr19:6779828-6779860
  hypo
aaaataataaaaggccgggcacggtgactcac

SEQ ID NO: 45673 - DNA, 38 bp, Homo sapiens
  chr19:7168432-7168470
  hypo
tttgtcctgacacaacgttgtctcgcatatggacttgt

SEQ ID NO: 45674 - DNA, 38 bp, Homo sapiens
  chr19:7184325-7184363
  hypo
cttgctggaattcatcgtgtacccggagggacactcag

SEQ ID NO: 45675 - DNA, 104 bp, Homo sapiens
  chr19:7542252-7542356
  hypo
gctgagaagtgacagcgcctccgactgcatctgcgcctccatggccctccgcttgccccggggcagcgggctgtggggcagagaggggccgcttacactcacgc

SEQ ID NO: 45676 - DNA, 30 bp, Homo sapiens
  chr19:7543713-7543743
  hypo
cctgcacacacaccccggacattggctgga

SEQ ID NO: 45677 - DNA, 99 bp, Homo sapiens
  chr19:7627750-7627849
  hypo
ccttggctagatgcccgggagtggaattgttgggttacatggagattctgtgttgaattgaagaaacgccaaacttttccatagcggctgcaccatttt

SEQ ID NO: 45678 - DNA, 43 bp, Homo sapiens
  chr19:7706504-7706547
  hypo
aggaggtgcaggtggcggcagcgggaagcggggcaggtgtgca

SEQ ID NO: 45679 - DNA, 127 bp, Homo sapiens
  chr19:7727784-7727911
  hypo
tgacaagggccaactcgtcccgggcaagggcagcatccctctgcttcttagtgtatgcatggtgtttaacacagcatatggaacataatagttgctcaataaatattgcctgcgctttgaacctgtg

SEQ ID NO: 45680 - DNA, 38 bp, Homo sapiens
  chr19:7752437-7752475
  hypo
ccatgagtcaactcacgccctcccggcctcagggtgat

SEQ ID NO: 45681 - DNA, 84 bp, Homo sapiens
  chr19:7914950-7915034
  hypo
caaacccagcatggccgagctcgggctctgcatctatcagttcgagtacatgctgcaggtgagcagggccgcaggagagcaggg

SEQ ID NO: 45682 - DNA, 48 bp, Homo sapiens
  chr19:7970450-7970498
  hypo
gcagagctaggaggccggtggcaggcaggcccccgaggagtcccctcc

SEQ ID NO: 45683 - DNA, 56 bp, Homo sapiens
  chr19:8009581-8009637
  hypo
gaggcagcttggccccggagagcatgcattcctggcttctgcgatggatagacttg

SEQ ID NO: 45684 - DNA, 30 bp, Homo sapiens
  chr19:8091663-8091693
  hypo
agtggtagtggctcccgggccctgggccaa

SEQ ID NO: 45685 - DNA, 30 bp, Homo sapiens
  chr19:8124555-8124585
  hypo
caggactcatggaagcgctctacttgtgtt

SEQ ID NO: 45686 - DNA, 34 bp, Homo sapiens
  chr19:8194085-8194119
  hypo
ggctgcccacacatccgcccgccaggtggcatgc

SEQ ID NO: 45687 - DNA, 16 bp, Homo sapiens
  chr19:8253828-8253844
  hypo
tggcaacgggctggac

SEQ ID NO: 45688 - DNA, 100 bp, Homo sapiens
  chr19:8475425-8475525
  hypo
aaaagaaaatcaccatttggttgctattatggtaataactgactcaggcaagggtcatcaattgatattaagctcttggaaacggcgtgtgttgaggaac

SEQ ID NO: 45689 - DNA, 49 bp, Homo sapiens; identical to SEQ ID NO: 16427
  chr19:8576903-8576952
  hypo

SEQ ID NO: 45690 - DNA, 88 bp, Homo sapiens
  chr19:9129141-9129229
  hypo
ccttgagccgggacccggcctgcattggactaacgtatgacttcgcttctcaccccgaagcctttgcctcggccgttccctgtgccgg

SEQ ID NO: 45691 - DNA, 30 bp, Homo sapiens
  chr19:9261611-9261641
  hypo
acttgagaataattccgggaggttgtgagg

SEQ ID NO: 45692 - DNA, 158 bp, Homo sapiens
  chr19:9937353-9937511
  hypo
aaaacagtaaaaatcccacggccggggaaatcaggaccaaaccagtaaggagcagctctttaggcataagcacgcgcattaaagacaaaaagtatccttaacatgataaggataaccagctcattagcgctcatgcatatggacggcatatcatgaat

SEQ ID NO: 45693 - DNA, 15 bp, Homo sapiens
  chr19:10231227-10231242
  hypo
cgtctcagaaaaata

SEQ ID NO: 45694 - DNA, 30 bp, Homo sapiens; identical to SEQ ID NO: 16430
  chr19:10231504-10231534
  hypo

SEQ ID NO: 45695 - DNA, 31 bp, Homo sapiens
  chr19:10362045-10362076
  hypo
aaacaaatgaaaaaacgccaggcacggtggc

SEQ ID NO: 45696 - DNA, 232 bp, Homo sapiens
  chr19:10370332-10370564
  hypo
cctgacgctgcccaccgtcgccttcctggaggacaagctgctctggcaggactcacgttacagacccctctaccccttcagcctgccctacagcgacttcccccgacccctaccccacgctacccagggcccagcggccaccccgtaccactgttgatgtgaagcacctcttctgagccaggccgagcccctggccgacttgggagcctcaggcccacgcccacccttcgag

SEQ ID NO: 45697 - DNA, 30 bp, Homo sapiens
  chr19:10394324-10394354
  hypo
ctgaggtcacgaccacggtgctggtgagga

SEQ ID NO: 45698 - DNA, 185 bp, Homo sapiens
  chr19:10562119-10562304
  hypo
gcggctataggtctgcgtagccgctggtttattggctacgcatttgcagcgctggggtgttgggaatagattctgaagagtggcacgccagtgtgtacttgtgtaggtgtataggtttgcacgggtaattatgcagggttataggtgtgtggggctgtgccagaggggtgcgcatgtctgcaggg

SEQ ID NO: 45699 - DNA, 30 bp, Homo sapiens; identical to SEQ ID NO: 16433
  chr19:10570365-10570395
  hypo

SEQ ID NO: 45700 - DNA, 139 bp, Homo sapiens
  chr19:10711944-10712083
  hypo
ccggcctgttttcacccattttttccacaataactgtcaaggctgcagggaacaccccttggttactacatcccatgcacacacacctgcagtggtttgtccagggtcagtgccagacaggaatcgcaccaggtgaaca

SEQ ID NO: 45701 - DNA, 30 bp, Homo sapiens
  chr19:10762205-10762235
  hypo
atttcttttttgagacggtctagctgtgcc

SEQ ID NO: 45702 - DNA, 75 bp, Homo sapiens
  chr19:10872535-10872610
  hypo
tgagctctgctatttcgtacgccaccgatgggccaatgggctgccacctctgggttcaggcgtccaatcagctgt

SEQ ID NO: 45703 - DNA, 202 bp, Homo sapiens
  chr19:10875905-10876107
  hypo
ttacaggcgtgagccaccacgcccggcctgttttttcttaatggactctctctgcgccagcacacgagaacaggcatgcagatcggctctgcccagcacagggcctggcgccgagcaggtgctccgcatgcacggccgagtgaacgagctcaaagggctggtgctgtgccccttcttgcctactgggcgggaagtgatgggg

SEQ ID NO: 45704 - DNA, 30 bp, Homo sapiens; identical to SEQ ID NO: 16436
  chr19:10954418-10954448
  hypo

SEQ ID NO: 45705 - DNA, 30 bp, Homo sapiens
  chr19:11002349-11002379
  hypo
agacgccggccctcccgcccccagccttcg

SEQ ID NO: 45706 - DNA, 95 bp, Homo sapiens
  chr19:11002992-11003087
  hypo
tgctggggaagtgcccgttcagggccatggctgcagggctcctggacacccagctccggtgctggagtggggttgggattcgcccagaggccagg

SEQ ID NO: 45707 - DNA, 30 bp, Homo sapiens; identical to SEQ ID NO: 16438
  chr19:11005335-11005365
  hypo

SEQ ID NO: 45708 - DNA, 25 bp, Homo sapiens
  chr19:11008369-11008394
  hypo
atgctagctctgggccgggcacggt

SEQ ID NO: 45709 - DNA, 55 bp, Homo sapiens
  chr19:11030140-11030195
  hypo
tgggaagagcaagctcgttttagctgcacagcctagaagccgtgggcagacctgg

SEQ ID NO: 45710 - DNA, 90 bp, Homo sapiens
  chr19:11052037-11052127
  hypo
agtcaattatgtattcgtctggcgcccagtaaatggtcactttccataagataaagtgaacacagggtaggtacctatggagcttttttt

SEQ ID NO: 45711 - DNA, 36 bp, Homo sapiens
  chr19:11053260-11053296
  hypo
gggattacaggcgtgagccaccgtgcccagccttgc

SEQ ID NO: 45712 - DNA, 42 bp, Homo sapiens
  chr19:11129719-11129761
  hypo
tttcctctcttgctacggaggtgcaggcggtggtgggcagga

SEQ ID NO: 45713 - DNA, 30 bp, Homo sapiens; identical to SEQ ID NO: 16440
  chr19:11252737-11252767
  hypo

SEQ ID NO: 45714 - DNA, 30 bp, Homo sapiens
  chr19:11406534-11406564
  hypo
agttcccccctcccccgcttggatccccca

SEQ ID NO: 45715 - DNA, 104 bp, Homo sapiens
  chr19:11658653-11658757
  hypo
gcagagaagcaggagcggaaattcgagccggggaagctaagagaagggcggaacatcattgggctgcaggtaccgccctgtcctcactgcgcagaggtcataga

SEQ ID NO: 45716 - DNA, 101 bp, Homo sapiens
  chr19:12220383-12220484
  hypo
gcgatagtgctgggattacaggcatgaaccaccacgcctgttcacacaaacgtttttatgtttgataaatatttgcctttttgtcacgatttggcaccctg

SEQ ID NO: 45717 - DNA, 132 bp, Homo sapiens
  chr19:12222626-12222758
  hypo
tctgggaatacataccgtttttctggtttctatcatagacataaaatgcctcatgctggcgggaagttttatggatgtaagaaatgtgggaaagcctttattagtttctgtgcctttcgataccatcaaagg

SEQ ID NO: 45718 - DNA, 40 bp, Homo sapiens
  chr19:12675871-12675911
  hypo
attaccagtcttggccggacgtggtggctcacgcctgtaa

SEQ ID NO: 45719 - DNA, 23 bp, Homo sapiens
  chr19:12846825-12846848
  hypo
tggagctgaagtccccgtctgag

SEQ ID NO: 45720 - DNA, 192 bp, Homo sapiens
  chr19:12863412-12863604
  hypo
gtcacctacacagcccgagtggcgaacgcccgcttcggtggcttctcccagctgctgctactgtggcgtgggagcatctacaaactcctgtggcgagagctgctctgcttccttgggttctacatggcgctgagtgctgcctaccggtgaggctgccctgaggtgctcatgttctagcggagggggggcagc

SEQ ID NO: 45721 - DNA, 45 bp, Homo sapiens
  chr19:12977473-12977518
  hypo
agacaggtatcaccacgtgaactcctatgacgaggatgacacgac

SEQ ID NO: 45722 - DNA, 30 bp, Homo sapiens; identical to SEQ ID NO: 16444
  chr19:13335742-13335772
  hypo

SEQ ID NO: 45723 - DNA, 163 bp, Homo sapiens
  chr19:13781908-13782071
  hypo
caaccaaatttggcccgtgggccataatttgtcaaaccctggtcaaggagtttggacttctttccattggatcattaaagatgttgcaggtgtgaatttcagttcccaatttagagacttaagagatgtaatcttatttttgttttttgtgcatttttttttg

SEQ ID NO: 45724 - DNA, 39 bp, Homo sapiens
  chr19:13943608-13943647
  hypo
agaaagggcacccagcggccgggcgcggtggctcacgtc

SEQ ID NO: 45725 - DNA, 465 bp, Homo sapiens
  chr19:13988295-13988760
  hypo
tttctgcaaacacaacggcgagtcccgggccatctaccagtcccacgtgctgaaggacgaggctggcagggtgctgtgtcccatcctgcgggactacgtgtgtccccagtgcggcgccacacgtgagcgcgcccacacccgacgcttctgcccacttactggccagggctacacctccgtctacagccacaccacccgaaactcggcaggcaagaagctggtccggcctgacaaggcgaagacacaggacacaggccaccgccgaggaggaggaggaggagcaggtgcctgcacaggtggctgggggggacctgtccgagggtagtggctgagcccccctgtgaagtaagattagccccagtacccacctccaagggttaggggaagaccttagagagagcttagaacagcagttgattttatttacgtatttatttatttatcttgagacaggtctctttctgt

SEQ ID NO: 45726 - DNA, 40 bp, Homo sapiens
  chr19:14042824-14042864
  hypo
cccacgtggccgatgcggttgccctcgaggtgcagctcct

SEQ ID NO: 45727 - DNA, 274 bp, Homo sapiens
  chr19:14181305-14181579
  hypo
gtggcaggtgcctcccgccaggagaacggcgccagcgtgatcctccatgacattgtgagagccagagagaacatccagaaatccctggctggaagctcaggccccggggcctccagtggccccagcggagaccacagcgagctcgttgtccggatcgccagtctggaagtggagaaccagagcctgcgtggcgtggtacaggagctgcagcaggccatctccaagctggaggcccagctgaacgtgctggagaagagctcgcctggccaccggg

SEQ ID NO: 45728 - DNA, 79 bp, Homo sapiens
  chr19:14209036-14209115
  hypo
tttatatcatgtccacgcccagacaaaacaaaggcacggtgtttgaagtcagaaaggacaactgcctttggtggggagg

SEQ ID NO: 45729 - DNA, 85 bp, Homo sapiens
  chr19:14244905-14244990
  hypo
gcgctcggccacaaccatttttaaatgcaaggaacacaaacaggctgattgaaacctgatctcctgccgtcggggagctgggaat

SEQ ID NO: 45730 - DNA, 30 bp, Homo sapiens
  chr19:14616913-14616943
  hypo
ccagggcctgccaggcgtcttcccctccac

SEQ ID NO: 45731 - DNA, 36 bp, Homo sapiens; identical to SEQ ID NO: 16449
  chr19:14630627-14630663
  hypo

SEQ ID NO: 45732 - DNA, 44 bp, Homo sapiens
  chr19:14675028-14675072
  hypo
agcgcctgctggagacgctcttcgtgcaccgcttctcccatggc

SEQ ID NO: 45733 - DNA, 40 bp, Homo sapiens
  chr19:14797872-14797912
  hypo
aacaatggaaaacagcgtggcgattcctcaaagacctaaa

SEQ ID NO: 45734 - DNA, 80 bp, Homo sapiens
  chr19:14877987-14878067
  hypo
ccatgtttcctggcacggaagcatctggaaggcaccactgtctgctcccttttcttttctttctttcttttttttttttt

SEQ ID NO: 45735 - DNA, 47 bp, Homo sapiens
  chr19:15220624-15220671
  hypo
agcctgcgaggcccccgggctggcagggagcgcgagagggctgcccc

SEQ ID NO: 45736 - DNA, 123 bp, Homo sapiens
  chr19:15272392-15272515
  hypo
gtctctcctgggctacgtcccgcggcagcctgtccaggtggtcggtgatctcacggttggcaaagtggtccaacagcagcttggcagcctcatagctgccctcgcgggcggccaggaataggg

SEQ ID NO: 45737 - DNA, 256 bp, Homo sapiens
  chr19:15292289-15292545
  hypo
aggactcccccaagtcgttgctgtccccacttcgtcccaggtcccaggccccatcccaagccagagtccctgctctccaagcagaggccccgcccacctggggctgcagtcgggcaggtcctgttcgcagtggaagcctccgtagcctggcgggcaggtgcaggtgaaggaggccacgtggtcggtacaggtgcccgggccgcaggggttgctcaggcactcatccacatcgcgggcgcatcgtgggccggcgaaa

SEQ ID NO: 45738 - DNA, 38 bp, Homo sapiens
  chr19:15488546-15488584
  hypo
gggattacaggcgtgagtcaccgcgccaggcccttcct

SEQ ID NO: 45739 - DNA, 30 bp, Homo sapiens
  chr19:15547714-15547744
  hypo
ggacccccaggctctcggcccagggggctg

SEQ ID NO: 45740 - DNA, 174 bp, Homo sapiens
  chr19:15558347-15558521
  hypo
cataccctggcacaccgaaggtgctcagtatttaatgaatgaataacacgtctggaggtggggagagtgtgagatacctttttgctgggtaaaccaaggggtagccagcatcgctgactacccagcctctccctagccactacagaagctgttttggcccgtggttcaggaaca

SEQ ID NO: 45741 - DNA, 30 bp, Homo sapiens
  chr19:16232444-16232474
  hypo
atcacagtggctgaacggtgagaaagccag

SEQ ID NO: 45742 - DNA, 136 bp, Homo sapiens; identical to SEQ ID NO: 16452
  chr19:16275694-16275830
  hypo

SEQ ID NO: 45743 - DNA, 30 bp, Homo sapiens; identical to SEQ ID NO: 16453
  chr19:16638285-16638315
  hypo

SEQ ID NO: 45744 - DNA, 68 bp, Homo sapiens
  chr19:16638668-16638736
  hypo
caaaccatcaaagctcggggaagggacgtgaagacctgtcacttgacctgtcccggagccacaggaag

SEQ ID NO: 45745 - DNA, 191 bp, Homo sapiens
  chr19:16939668-16939859
  hypo
agcaaaaattcaccacgcaaggccctatattagggcgctgggggctcatacctcatcgtcccgtcaactctataaagcaggggccaacaaactttttccataaaaggccagatcgtaaatacttcagggtctgcagatctgtaggatctttagcaactacctactctgttgtaaggcgaaagcaggcagag

SEQ ID NO: 45746 - DNA, 44 bp, Homo sapiens
  chr19:17049224-17049268
  hypo
ctgtaggtgtacgcccgggggactccttccgcctgaaacaaaga

SEQ ID NO: 45747 - DNA, 42 bp, Homo sapiens
  chr19:17265055-17265097
  hypo
aaaatcactctggcacgccacccttgccggcccaggaatgcc

SEQ ID NO: 45748 - DNA, 62 bp, Homo sapiens
  chr19:17365683-17365745
  hypo
agatctacaggaggtcgaggactttatgacacaaagagggaagtgaccggtgttcctggcag

SEQ ID NO: 45749 - DNA, 23 bp, Homo sapiens
  chr19:17379245-17379268
  hypo
tttttttttttgagacggagttt

SEQ ID NO: 45750 - DNA, 798 bp, Homo sapiens
  chr19:17404613-17405411
  hypo
ccactcagcctcccaagttgcagcgattattggcgtgaaccacctcgccgggctagtatccagggctattctaagtgctaaggatccccagaccctttctaatctgaactcgctaattagagtttctaatctaaagatcccctggtgccggtcttctagaattatataggtcaccggtctcatacaaatcctccgctgtgaggagagccttcttacagcggtggggacagtgcgtaattgctaacacctgtccagggcagccctgctttctagattctacttctgatgctagacctaatgctcctgtttgcctggggtcagaacaagatacagcaactagaggccacgcccacccggcagccacgccccctcgggaagaaagcacgcccaccaagcgctaccacgccccccgcagaggccacgcccctcccgggcagcaccctggggatttgtagctgtggcgccccaggtgcccgcctctacctcggccatgcgctggtcttcctccaccggcacaaacttatcgtgcatgccgtggacaagcaggacgggcacggtgagctcggcgtggtagacctcgtcgccctcgggccagtactggccgctcatcatggcccggagtacgaaggatgacacgttgaaagcgttgccctcctttaacagctgcttctccttggctccttggcgggcgaagccggccctggtggtggtggaggcaccgctagagccccttatgccagcccgactgccgtggggtgcccccgatgccagccctagtcccagcggtacagtcccccc

SEQ ID NO: 45751 - DNA, 438 bp, Homo sapiens
  chr19:17438085-17438523
  hypo
ctcggccacccagcccgggatatcggggatggccacgtggatgaggtacttgaggagcagagcgaagtgctgcaggggtggcagagaggaggctgcaggctgcagacgctggggccgccctctcgcctcccagctgcccccgcccctgtcgccggccccacctcgagcactaccaccgacacgatggctgcctccgggctcagccaggggaagaggcgctgcagctgcccgcactggccgattaagtagcagttgaccacaatcgctaggacacccatggcctccatcaccttctgcagggcggcaggagggctcaggcggggtccagccggcctccccagaccccaggctcctcccagctgcacctgggctccctctgggcctcagctcggatctcttggcttccccccacctgccactggccgatgctttccacgc

SEQ ID NO: 45752 - DNA, 30 bp, Homo sapiens
  chr19:17644708-17644738
  hypo
gtctcccgggggcagcgttgctacgggtga

SEQ ID NO: 45753 - DNA, 66 bp, Homo sapiens
  chr19:17687961-17688027
  hypo
ggctccttaccccagcgactcctcaacgtctgtgccccacagtgaagcacccgcccgcagagccct

SEQ ID NO: 45754 - DNA, 154 bp, Homo sapiens
  chr19:17759263-17759417
  hypo
ggtcctggcacttctcgtggcacttgacaccgcactcggtgcagcgcatgccctgcctcgcgatgccccacagcagcccctcgcactcgtagcagtaggtgggcgtggtggccgtccacacttcgaagttgtgtggcgtcgtgcacgagatggg

SEQ ID NO: 45755 - DNA, 79 bp, Homo sapiens
  chr19:17759753-17759832
  hypo
ggccgaggtgatgcccgctttcctggactggaccagggactggggaggtcacagaagagggagtcgggggggttgacat

SEQ ID NO: 45756 - DNA, 30 bp, Homo sapiens
  chr19:17767185-17767215
  hypo
atagcggctgctacccgtggggctgtgggg

SEQ ID NO: 45757 - DNA, 46 bp, Homo sapiens
  chr19:17836551-17836597
  hypo
ggatgagggtgtcctcgcccagttttcccaccgggctaggtgttgc

SEQ ID NO: 45758 - DNA, 96 bp, Homo sapiens; identical to SEQ ID NO: 16462
  chr19:18041146-18041242
  hypo

SEQ ID NO: 45759 - DNA, 181 bp, Homo sapiens
  chr19:18054301-18054482
  hypo
catgtccacccccagcgtggcggaggaggcggccgaccggcacccagaaagacgcatgcgggcagccttcacagcctttgaggaagcccagctgccgcggctcaaacaagagaaccccaacatgcggctgtcgcagctgaaacagctgctcaagaaggagtggctccgctctcctgacaac

SEQ ID NO: 45760 - DNA, 82 bp, Homo sapiens
  chr19:18054758-18054840
  hypo
gcccaataaaggtggcggcaaggctgcggtgaggcacttgaagcctaagtgagtgggtggggagaggcgggcgaagaatggg

SEQ ID NO: 45761 - DNA, 51 bp, Homo sapiens
  chr19:18084967-18085018
  hypo
caccgcctgggccaccggcgggcgctcttcgagaagcggaagcgcctcagc

SEQ ID NO: 45762 - DNA, 310 bp, Homo sapiens
  chr19:18092490-18092800
  hypo
tggctggttccctcccgccctccacagctgttcatggtggacaacggggctgatgactggcgcatcgccatgacctgcgagcgcgtgttcctcatctcgctagagctggcagtgtgcgccattcacccggtgcccggccactaccgcttcacgtggacggcgcggctggccttcacgtacgcgccctcggtggccgaggccgacgtggacgtgctgctgtccatccccatgttcctgcgcctctacctgctgggccgggtgatgctactgcacagcaaaatcttcacggacgcctcgagccgcagcatcg

SEQ ID NO: 45763 - DNA, 165 bp, Homo sapiens
  chr19:18103700-18103865
  hypo
acctccccagagcaacggcagcccctcggccatctgggaaccccgcgcggggccctagggtggcatccccgggaggtgggcagggttgggtacatgccgaacaactgtgctgaggttaaaattgccttgtgatttttctcctgctctgcccggtcctgccagggc

SEQ ID NO: 45764 - DNA, 79 bp, Homo sapiens
  chr19:18104430-18104509
  hypo
gggctcagctcctgccggaggagggcacaaggacccgctgtgggctgagtgcagtggcgggcggatcgcttgagctcag

SEQ ID NO: 45765 - DNA, 76 bp, Homo sapiens
  chr19:18207919-18207995
  hypo
ggtgagatcctcactcgcctcaccctagaacccgttctgctgtgtgtactgggcacattttttgttgttgttttgt

SEQ ID NO: 45766 - DNA, 18 bp, Homo sapiens
  chr19:18227706-18227724
  hypo
gagcgaaactctgtctca

SEQ ID NO: 45767 - DNA, 105 bp, Homo sapiens
  chr19:18272708-18272813
  hypo
aatcctgtgcacatgcgtgggcggacaggccctacccagccctcaccacactccccttccccctaaggagtgagcccagccctgacttcccggcgctgctggtgg

SEQ ID NO: 45768 - DNA, 18 bp, Homo sapiens
  chr19:18298268-18298286
  hypo
acaggcataagccaccga

SEQ ID NO: 45769 - DNA, 218 bp, Homo sapiens
  chr19:18330991-18331209
  hypo
gtactcctaaaatgtcgtccaggcagtgactcaacaaagctcacccaggaaggtccgggagatgtactcggacacctggttcccggagcggctggtttcggacaggtgggtcaactcccggttcaggatccgcttgaactggggcggagagaaggtgaagaccgtgatgatggggcaccgtgggccgaggcaggtgagctcagcgatctgccccacct

SEQ ID NO: 45770 - DNA, 48 bp, Homo sapiens
  chr19:18383303-18383351
  hypo
aaagtcacaggaccacgttctggatccagggctcgggcaggcttcacc

SEQ ID NO: 45771 - DNA, 30 bp, Homo sapiens
  chr19:18600783-18600813
  hypo
ccacgctgtggagcccgtgctggtccctca

SEQ ID NO: 45772 - DNA, 120 bp, Homo sapiens
  chr19:18681763-18681883
  hypo
aggcgtgagtcaccggacccaggtcccgccctggcactttttaaccacccacaaatctggatcctacactgaaaagagacactgcagtggctcacgtctgtaatcccagcactttgggag

SEQ ID NO: 45773 - DNA, 30 bp, Homo sapiens
  chr19:18707421-18707451
  hypo
gggtgctcaccactgcggggagtggaggcg

SEQ ID NO: 45774 - DNA, 42 bp, Homo sapiens; identical to SEQ ID NO: 16472
  chr19:18788397-18788439
  hypo

SEQ ID NO: 45775 - DNA, 30 bp, Homo sapiens
  chr19:18878375-18878405
  hypo
gtacctggcaatgcccggcccggactccat

SEQ ID NO: 45776 - DNA, 101 bp, Homo sapiens
  chr19:18880013-18880114
  hypo
caagaggcggcagcccgttgggcacagcgcctggggcccagggctgggggctgcagctcagaccattggacttttctgcctagggccggctcaggcagaca

SEQ ID NO: 45777 - DNA, 30 bp, Homo sapiens; identical to SEQ ID NO: 16473
  chr19:18883509-18883539
  hypo

SEQ ID NO: 45778 - DNA, 111 bp, Homo sapiens
  chr19:18883973-18884084
  hypo
atagggacatcagtacggggctctcaggggcagatggttctaggtggagccgagacctgccttccctctgcactgggtctccgaggactcacccatcggtcccacaggccc

SEQ ID NO: 45779 - DNA, 30 bp, Homo sapiens
  chr19:18895773-18895803
  hypo
gcttccacatgaccacgtagaagctggagc

SEQ ID NO: 45780 - DNA, 30 bp, Homo sapiens
  chr19:18975090-18975120
  hypo
cccttgtcctcacaccgggatgctggccgt

SEQ ID NO: 45781 - DNA, 83 bp, Homo sapiens; identical to SEQ ID NO: 16475
  chr19:18988902-18988985
  hypo

SEQ ID NO: 45782 - DNA, 586 bp, Homo sapiens
  chr19:18989695-18990281
  hypo
cactaaaggagggaacgcggggtgcgggcccctccacactcactcggctttgctgggcttcaggctctgggcctcggctgtgtcatactcccgcaggtccttcagctcgtgcacctggcctgtcaacaccttggctgcaaacgccacgatgtactgcgagaggggaggggaggtgccagtgagaagaaagcccccacgccactgccctgctgacagccatgtgctcctgtcccgggccctccacacgggctgtctgccacctaacgtgcccctccccgggactgcctgaggaggggacagggattgggacgaggacgggaccgccactgtggaggagagccggggccgactcaccaggaaccagtagaggttcataagggtgagcagcagcaggagcgcattgaagaagaagtagaaggggatgtcaggcaccgtgcgcagactgcagtgactggtggcatacaggaccttgagcgggaaccagtagaggcggaaccagaacctgcggtgggaggagtcaggaggccgtgggtggagggggacggtgccctacccagtccctgtcctatcccgtcctagacccacc

SEQ ID NO: 45783 - DNA, 567 bp, Homo sapiens
  chr19:18994680-18995247
  hypo
tccctcaggaatctccgggcccacatcccctcctcagccttcctgcctctggtctgtcccctcgtcggacccctgagcactctgaccttggaaccctgagcactccgacctgatgtgatcccctccacggcctcctctgtgccccgccgcaacatcagcctccgcactctgtgtgggctgtgcctcggccccctgccacccgatcctgtccttaccggaaggcgtaggaggagacgatgaggatgagagtgaccacgtggtggagcagcatgaccaccgagtccttgcgccaggtgtccatgtatagcgtagcgtagatggagtggccatagaagcttccctggagcaggtaggcggctgcaatgtcccgtggcactgccatgcccggcgtccagtctggggagagccaaatctcacagtcagggccctgcgaagcctctagacgatcgcctccatgacccggtgacaccctccaagccacacgtgtcctcccagtacccaggtaaccatgcgtgtctgactgctggctttccattcccaattctatttttttttttttttctttga

SEQ ID NO: 45784 - DNA, 57 bp, Homo sapiens
  chr19:19042770-19042827
  hypo
aggggtgccctcacccgctgccgcagccgctcggcctctgcacgctgagcctccagc

SEQ ID NO: 45785 - DNA, 30 bp, Homo sapiens
  chr19:19214217-19214247
  hypo
ataaggacaccaattcgcatttagggccca

SEQ ID NO: 45786 - DNA, 200 bp, Homo sapiens
  chr19:19218598-19218798
  hypo
acacccaggcccagccggcttcgggaggagccgagagcctctgtggctcctccctgtgcctgggaggcctgagtcccacctgctgggctgctctgtcctggcaggtacagcaacatctttcatgtcttcatccgcatctcgagagaagaggggctgaagactctctaccatggatttatgcccaccgtgctgggggtcat

SEQ ID NO: 45787 - DNA, 99 bp, Homo sapiens
  chr19:19334846-19334945
  hypo
cgatcagcccgggaccgctatgcactgaccttcgctgaggcccaggaggcctgccgtctcagctcagccatcattgcagcccctcggcatctacaggct

SEQ ID NO: 45788 - DNA, 50 bp, Homo sapiens
  chr19:19335175-19335225
  hypo
cggagctatgggaggcgcaacccacaggaactctacgatgtgtattgctt

SEQ ID NO: 45789 - DNA, 183 bp, Homo sapiens
  chr19:19391386-19391569
  hypo
gggtcacacagctaacgagtgacagggcaggaatttgcagagccagagacaagagagctgagacggcatgtgggcagcatgcatgggcgcacgcacaaacgggctctcagaaggcagctccgttgctaacagacaccaggtgtaagcgcgcacagattcagagtctggcgtaagactcagctg

SEQ ID NO: 45790 - DNA, 39 bp, Homo sapiens
  chr19:19391907-19391946
  hypo
gccctgttggggagacgcaggagccgaagtctgagcatc

SEQ ID NO: 45791 - DNA, 30 bp, Homo sapiens
  chr19:19737618-19737648
  hypo
gggcagccacccacacgcccacaatgagca

SEQ ID NO: 45792 - DNA, 22 bp, Homo sapiens
  chr19:21265857-21265879
  hypo
tttaagatggagtttcgctctt

SEQ ID NO: 45793 - DNA, 30 bp, Homo sapiens
  chr19:21727297-21727327
  hypo
ataaaaattaggagtcgatttcaccatata

SEQ ID NO: 45794 - DNA, 42 bp, Homo sapiens
  chr19:22017749-22017791
  hypo
aaaaaaaaaatagcccggctcggtggctatttttaagtgctg

SEQ ID NO: 45795 - DNA, 120 bp, Homo sapiens
  chr19:22606112-22606232
  hypo
gccaccgcgcccaactaacctgaggtttttaaaaggacacaatccttctaagtaaaatgtgagccacatgtgaattttaaatttcctactagccaaactttaaaaacaaggaacacacgg

SEQ ID NO: 45796 - DNA, 171 bp, Homo sapiens
  chr19:28402178-28402349
  hypo
gtgcggaaccaccgccgggagccagggactgtgctgtccgcagccctcacccccggggccccagtttctgcaaagagaggctgcactttggagggtgggtgggtgtgagtccgtcagctgaaacctggccccttatcccaagtggccagcataacacggtgacacaactta

SEQ ID NO: 45797 - DNA, 54 bp, Homo sapiens
  chr19:29145984-29146038
  hypo
ccacctcacatctgccgccaccaacaacccctccaggggcggaggtgctgcaca

SEQ ID NO: 45798 - DNA, 85 bp, Homo sapiens
  chr19:29425113-29425198
  hypo
caccgaagacacagacgatgctctcaccaggtccccactgggcttgattgctttattttactcttagaaacagtgtttcctttaa

SEQ ID NO: 45799 - DNA, 103 bp, Homo sapiens
  chr19:29716608-29716711
  hypo
ccagtggaggctgtgcgcaaaatcaggcccagagccatggtttctttggcctgtaaagtgttaaaaaatgagattggtgggggaggagccaagatggacgaat

SEQ ID NO: 45800 - DNA, 30 bp, Homo sapiens
  chr19:29920756-29920786
  hypo
tcccccgccgcccgccgtcaggggttactt

SEQ ID NO: 45801 - DNA, 49 bp, Homo sapiens
  chr19:29930941-29930990
  hypo
cgggaactggggctgcgcggctctcgggggccagcgtgagttccaggtg

SEQ ID NO: 45802 - DNA, 45 bp, Homo sapiens
  chr19:30056272-30056317
  hypo
gcacttgtcctctaacgtgacgactcgcagcgttcacatcagcaa

SEQ ID NO: 45803 - DNA, 30 bp, Homo sapiens
  chr19:30244714-30244744
  hypo
ggctgagcgtgggagcgaggaccccgcttt

SEQ ID NO: 45804 - DNA, 388 bp, Homo sapiens
  chr19:30555329-30555717
  hypo
gcccagcccccaccccgtggcacctgcccacgcggcacctgcccagggcggcccactgtgctcccggcagccctcctgacgtcaacggcagccgcggggacgctgcctcctctgccacacgttgctcacaaagtgtaggcaaaaggcaggcgtccaattgctgcggatgaggaagagaaataatttcgtttctaaatcaggactcagtaccggtggccaggccccggaaggggcatctgtcggctgcacggcagccactcctgcaatggaggagatggtccagttctccatggggacttggggggctccccagctctggccctgggtgccgaaagccctgagaacaagccatctgaaaattaggattctgcgtcgcctgtcaatcccc

SEQ ID NO: 45805 - DNA, 30 bp, Homo sapiens
  chr19:30562726-30562756
  hypo
ggagaagctaatattcgccttttacaaaca

SEQ ID NO: 45806 - DNA, 184 bp, Homo sapiens
  chr19:30579049-30579233
  hypo
gagactaagagggagcgtagacaaggagccacaggaggcgacactcccggtggtggattcctgcctaagttccagggaactcagaatctgggggccacgctggcaacatctgtctcttggcttcccaaagaaagactaacatgccagcaaagccaggaaatgtcaagaccgagagctcatgtgg

SEQ ID NO: 45807 - DNA, 33 bp, Homo sapiens
  chr19:30636005-30636038
  hypo
tctgaggggtgccctcgccgggggtgccaccac

SEQ ID NO: 45808 - DNA, 64 bp, Homo sapiens
  chr19:30637506-30637570
  hypo
cagcgagactcgatgcgaaggcaaggcaagcacgtgacatccagtactacgtgaggtgctgaca

SEQ ID NO: 45809 - DNA, 45 bp, Homo sapiens
  chr19:31017337-31017382
  hypo
aacaggttcaggggccgggcgcggtggctcacgcctgtaatccca

SEQ ID NO: 45810 - DNA, 205 bp, Homo sapiens
  chr19:31587355-31587560
  hypo
acgggagcaaagctccgtattttagtctcagtacaaatttgcttcaatcttatacaactcccatgcagcattgcccacagctgcatgctgtaaacaacaaacaaatctatttccatcagccctgctgatgccaggagaaaagtgcctgagcagaagacatgcacagatgcaaaccctcacctgagcctggcgctgccctccattt

SEQ ID NO: 45811 - DNA, 138 bp, Homo sapiens
  chr19:31780548-31780686
  hypo
cccaggggtggggttcggagccagatgccctgcagcacggttctggctggggcggcacctcagacactggctctcagattggctgccactgtccctgtagcccctagcccccaagctgggccgcgttctcctccaggc

SEQ ID NO: 45812 - DNA, 30 bp, Homo sapiens
  chr19:32026024-32026054
  hypo
tgcattacaagagagcgtgagctaacaaag

SEQ ID NO: 45813 - DNA, 59 bp, Homo sapiens
  chr19:32083683-32083742
  hypo
tgatggctctactgccgtccacccgggaggatggacgtgtgttccgggatatcagagct

SEQ ID NO: 45814 - DNA, 32 bp, Homo sapiens
  chr19:32232273-32232305
  hypo
agaggaaaatgaggccgcgtagccacaatgcc

SEQ ID NO: 45815 - DNA, 181 bp, Homo sapiens
  chr19:32364365-32364546
  hypo
gcagccctatggccccgggcatgcgcttctcttcttcctacatgaaagccctccttacaagccttccttgtaccctatggctccaggatctggccccttcacctccccagagtcagagttaccacggtgcagtggcgcaccagtgggcctccggcaatgctgctcccgcttcccaccttcc

SEQ ID NO: 45816 - DNA, 53 bp, Homo sapiens
  chr19:32516351-32516404
  hypo
aactcccctgcggcccgtccctgcctcaccgcatggcccggctttgcagtgca

SEQ ID NO: 45817 - DNA, 89 bp, Homo sapiens
  chr19:32672320-32672409
  hypo
ctatgacaaattaagcggctggtgagtgcgcttgcacacaaaagaatggtgccgaaaactagggctgagctaggcgctgtgtcaataaa

SEQ ID NO: 45818 - DNA, 81 bp, Homo sapiens
  chr19:32718922-32719003
  hypo
ctgcagcagggaggccgattcaggaggtcactgcacgagctgtgcctggcctggagtggcctggtgcggggaacctggcgg

SEQ ID NO: 45819 - DNA, 89 bp, Homo sapiens
  chr19:32835111-32835200
  hypo
tctcttaccttttatcgaaaaaaaaattactcaacattttattttttcacagctatttggtctaattggcaaaggattctgtggaatag

SEQ ID NO: 45820 - DNA, 30 bp, Homo sapiens
  chr19:32898460-32898490
  hypo
ttacgtgacgcattgcgtggtaactgctat

SEQ ID NO: 45821 - DNA, 16 bp, Homo sapiens
  chr19:33143466-33143482
  hypo
gcgaaactccatcccg

SEQ ID NO: 45822 - DNA, 156 bp, Homo sapiens
  chr19:33415273-33415429
  hypo
ccattagccacaacacgaggtctgtcgctgggccggttttgatgcctaacagtctatgtctgtttcagctcccaacagtctgtgtgtgtgacacttcagctgagcctcctccatcagggcttttccagcttccgtgtcctgcgctgtcctttggtg

SEQ ID NO: 45823 - DNA, 43 bp, Homo sapiens
  chr19:33468025-33468068
  hypo
atggagcccgtgggtcgtcctgccttagcgtctgagttcagct

SEQ ID NO: 45824 - DNA, 75 bp, Homo sapiens
  chr19:33557281-33557356
  hypo
gctgggattacaggcgtgagccaccgcacccggccgtggagcacggttcttaaccacctccgttttctaggctgc

SEQ ID NO: 45825 - DNA, 18 bp, Homo sapiens
  chr19:33557746-33557764
  hypo
aaaaaaaaaaaagtccgg

SEQ ID NO: 45826 - DNA, 30 bp, Homo sapiens
  chr19:33908049-33908079
  hypo
ccaagctatgtgcctcgagcatgggtgggg

SEQ ID NO: 45827 - DNA, 40 bp, Homo sapiens
  chr19:34263232-34263272
  hypo
cgtgtcccgtatcttcgtggaggaccgccaccgcgtgctc

SEQ ID NO: 45828 - DNA, 30 bp, Homo sapiens; identical to SEQ ID NO: 16489
  chr19:34263853-34263883
  hypo

SEQ ID NO: 45829 - DNA, 34 bp, Homo sapiens
  chr19:34558340-34558374
  hypo
aggcatgagtcactgcgcccggcatcctttttat

SEQ ID NO: 45830 - DNA, 39 bp, Homo sapiens
  chr19:34896321-34896360
  hypo
attacaggcatgagccaccgcgcccggcctttcttaagg

SEQ ID NO: 45831 - DNA, 16 bp, Homo sapiens
  chr19:35497210-35497226
  hypo
gcgactctttgtctcc

SEQ ID NO: 45832 - DNA, 33 bp, Homo sapiens
  chr19:35524590-35524623
  hypo
cgagcacaacaccagcgtcgtcaagaagatcca

SEQ ID NO: 45833 - DNA, 30 bp, Homo sapiens
  chr19:35607399-35607429
  hypo
gagccaggagataaacggaagtcccttccc

SEQ ID NO: 45834 - DNA, 30 bp, Homo sapiens
  chr19:35608942-35608972
  hypo
ggaagtgccagctctcgctatcaaaattat

SEQ ID NO: 45835 - DNA, 54 bp, Homo sapiens
  chr19:35615955-35616009
  hypo
ggcttaaggcctagacgtgtggctgatgaacgtggcccacggtcagcagctcac

SEQ ID NO: 45836 - DNA, 221 bp, Homo sapiens
  chr19:35616256-35616477
  hypo
ttgtcaggctcaaggcggaggacctggctgaaggcgaagtcgctgcctaggatggccagctggtccctggcgatgagcagtggctggaagacgtgggcaccgcgcgagggaagttgctgcagcagacgaaacatggagccgtcccagcgcatgacctgtgggggtgtggccagtgagggcctggggtcccgggggtctctgggggccgtggaacagcttgg

SEQ ID NO: 45837 - DNA, 261 bp, Homo sapiens
  chr19:35781223-35781484
  hypo
ccgtgcatggcctcaattccggtttttaagccacccagtttgtgaaactttgttgtaacagccctggaaaactgatacacctgctctctcgtaaaagatcagctgatacggcagcaccggccactggatctgcgggtcagttgtccccttagacagggcacctgcccgccagtcacaggtcctgtcacccagccccttcctctcatgggctccagccgcctcgctcccacaggtctcctggagacccgagttgctgatgtc

SEQ ID NO: 45838 - DNA, 56 bp, Homo sapiens
  chr19:35797909-35797965
  hypo
aaaagatactaagcacgtgcaccggcagggtgtcggcgttccgccgacatccaggt

SEQ ID NO: 45839 - DNA, 156 bp, Homo sapiens
  chr19:35827208-35827364
  hypo
tcctctccaatgacacggtgcagctgaacgtgaagcgtgagtctccccggcatgcctgtgggaagggcaaggtctgtgtcaccttctccccagccccgcagggggcatgcacccagggcagggggaagcctgcacagacggcggcatcctccagcc

SEQ ID NO: 45840 - DNA, 35 bp, Homo sapiens
  chr19:35842975-35843010
  hypo
ggacccggcctctgccggcccggcccgcttcagcc

SEQ ID NO: 45841 - DNA, 30 bp, Homo sapiens
  chr19:35921023-35921053
  hypo
gtggcttgacttattcgccaagtggagatt

SEQ ID NO: 45842 - DNA, 195 bp, Homo sapiens
  chr19:35940942-35941137
  hypo
gggagtggctttccccgtgcagtacaagctctcccgccggcctctgtatggagtgattgcagctctggtggcctgggttatgtcctttggtcactgcaccatcgtgatcatcgttcaatacttgaacacgactgagcaggtcagaagtggcaatgaaattacctgctacgagaacttcaccgataaccagttgga

SEQ ID NO: 45843 - DNA, 30 bp, Homo sapiens
  chr19:36199677-36199707
  hypo
acttaaccagaaagacggaacatctttttt

SEQ ID NO: 45844 - DNA, 417 bp, Homo sapiens
  chr19:36221572-36221989
  hypo
cccaagcatcctaaccgtcttatcccacatgccaggtgctcccgtctgtactggagcacagtggatgctcggaggcgctgctggtatcggtgccgaattctggagtatcggccatgggggccgagggaagagccagctcacctggaggctgcagaggagaaccagaccattgtgcacagccccgccccttcctcaggtgtggctttggctctgtcttcttcctgaataccgctctccctaaacaaacctacagatctctgttccccgctcccttttggaaagtccaggaggcttgcttttgcttcagttgctgtaatgtaacggcagctcgcttactgccatgccttgtgtgccaggggctgtgcccggcttttcatgggaagtgaggtggggagagcggcacgctgcctacttgag

SEQ ID NO: 45845 - DNA, 50 bp, Homo sapiens; identical to SEQ ID NO: 16495
  chr19:36222432-36222482
  hypo

SEQ ID NO: 45846 - DNA, 277 bp, Homo sapiens
  chr19:36249972-36250249
  hypo
gtctggaatgggaaccgcgcgcctgtaacgttgaaaagcccctcctagactggatccagggttgagaaccaccggctgtcagttcctgagttgctccctgttaagactgctccaggggcgggctcccaggactcacccttccactgtcgatatcctgaatgtgcaacggtgcttcatggaaatgacagtccgtctcctccaggaatctatgggaattgtctggttctgccctcctctaatgtccccctccccagggctgcggcgaaaccacgtgctg

SEQ ID NO: 45847 - DNA, 339 bp, Homo sapiens
  chr19:36604439-36604778
  hypo
acagccggccagctacgcttaccgtgagcgccgcgagaagctgcacgtgtgcgaggactgcggcttcaccagctcccggcccgacacctacgcacagcaccgcgccctgcaccgcgcagcctgatacggtgtgccagcgtcctccccacgaggcaaataaacacagaaaactcacgcatggaatctggtgtttattacactcgggggagagaggaggtcactcggtccagcggtggccgcagtgtggggctgtgcacacgtagtaaaggcgcatggcgtcctggcagaaatgatgcatggttaggaaggatttggacccagcagcgccttaccccaaaa

SEQ ID NO: 45848 - DNA, 150 bp, Homo sapiens
  chr19:36640992-36641142
  hypo
tgcacacacccactccgtaacctctcccctgtacctgtgccaagcctagcacttgtgatgcctccatgccccgagggccctctctcagttctgggaggatgactccagtccctgcacgccctggcacacccttcacggttgctacccagg

SEQ ID NO: 45849 - DNA, 196 bp, Homo sapiens
  chr19:36704661-36704857
  hypo
ggcctcccaaagggctgatgtgagccaccacacccggccctacatccactcctgagacacaggacacaatcacagacacctctatacctttccagtcacaatatctttccagtcacaatcacacacccgctaagacacacccagtcacacaatctactctccactgtgatacagttactcccgtatagtcacaagc

SEQ ID NO: 45850 - DNA, 101 bp, Homo sapiens
  chr19:36747803-36747904
  hypo
aatgtggcttggattcgggcgcaggccctgtctcgcaggttttcaggtgcgcttggcttttcctcagctttgttgcggaggtctcccgtggcccccgggcg

SEQ ID NO: 45851 - DNA, 30 bp, Homo sapiens
  chr19:37110908-37110938
  hypo
aggagtgagccactgcgcctggcctgagag

SEQ ID NO: 45852 - DNA, 91 bp, Homo sapiens
  chr19:37702078-37702169
  hypo
cgtgagccaccgcctccggctgttatatttacaatacctaagttaccccttggttacggcacactgcagaaaacaacgatttactaggaga

SEQ ID NO: 45853 - DNA, 98 bp, Homo sapiens
  chr19:38228271-38228369
  hypo
gaagggtagagtttcaagaatttgaggacatatttttaaaacaccacgactggcattctgagtacaaattgcttatatttctacgtcatgcaaaatat

SEQ ID NO: 45854 - DNA, 36 bp, Homo sapiens; identical to SEQ ID NO: 16499
  chr19:38481038-38481074
  hypo

SEQ ID NO: 45855 - DNA, 30 bp, Homo sapiens
  chr19:38782535-38782565
  hypo
atggtctacctgatccgggtggcacggagg

SEQ ID NO: 45856 - DNA, 214 bp, Homo sapiens
  chr19:38828121-38828335
  hypo
actcacccatcgacccgagcgaggtgaggggaccagggtcaagtgaaccagagggattttgaacccgcactccactcatttctggacgtgtggcctaacctctctttgcagaaatacctgggcttcccttactacctgaagatcaactactcctgcgaggaaaaggtgagtgggtgcagcacggataggctcattctatgagccttggttttcc

SEQ ID NO: 45857 - DNA, 230 bp, Homo sapiens
  chr19:38873935-38874165
  hypo
gccagcagcagaagccggaagacaccaccattccctccacagaactggccaaacaggtcatcgagtatgcccggcagctggagatgatcgtctgagccccccgggcactgggtggggcagggcacgagttatttaaaacagttacactgcagggtttcgcccaataaaggtggactgacattccctcttccaggcccttgtctccccagttgggacggcagagagacaag

SEQ ID NO: 45858 - DNA, 184 bp, Homo sapiens
  chr19:38905548-38905732
  hypo
accagctcctgcagccgcaggtagaggttgttcagcttgggtaggtgcaggcggccgtcaggcaacctgtcgggctgtgcctcatgcagggacaccaggtccttgaggtgcacgcccagtacaggcagccggaaacccgcgcagccagcccaggtgcggcggtagcgggcgtagttgttgtggg

SEQ ID NO: 45859 - DNA, 112 bp, Homo sapiens
  chr19:38934459-38934571
  hypo
ggtgtgaaggggccccgcagcagggattcagggggtagaaggtctgcagaacgccaaggcaagcatgagactaccctggggacatgaatgggggcttcgtagcagagagtct

SEQ ID NO: 45860 - DNA, 87 bp, Homo sapiens
  chr19:38956890-38956977
  hypo
gacatcccagcgcgccgaaaccctcggctggtgccctaccgcctgctggatgaagccaccaagcgcagcaaccgggacagcctctgc

SEQ ID NO: 45861 - DNA, 30 bp, Homo sapiens; identical to SEQ ID NO: 16502
  chr19:38974232-38974262
  hypo

SEQ ID NO: 45862 - DNA, 321 bp, Homo sapiens
  chr19:38976340-38976661
  hypo
cgctctgtgcagccacgtagaccaagctcagctgctgcacgccctggaggacgcgcacctgccaggcccactgcgcgcaggctactatgacctcctcatcagcatccacctcgaaagtgcctgccgcagccgccgctccatgctctctgaatacatcgtgcccctcacgcctgagacccgcgccatcacgctcttccctcctggaaggagcacagaaaatggtcacccccggcatggcctgccgggagttggagtcaccacttcgctgaggcccccgcatcatttctcgcccccctgtttcgtggccgctctgccagctgc

SEQ ID NO: 45863 - DNA, 145 bp, Homo sapiens
  chr19:38990607-38990752
  hypo
ctatgccgccttgatcgacctgctcggacgctgtgcaccagagatgcatgtgagaccctgagccagggcaggatgggaagggagggcaggcacagccgctttgaacgcctcatgcaggcactcggtgacacggagtgagctccca

SEQ ID NO: 45864 - DNA, 53 bp, Homo sapiens
  chr19:38991499-38991552
  hypo
tgccggaccacaaggcgtccatggtgctcttcctggaccgtgtgtatggcatc

SEQ ID NO: 45865 - DNA, 30 bp, Homo sapiens
  chr19:38996547-38996577
  hypo
gaaaagaaaaaaacgcggaagatatcacaa

SEQ ID NO: 45866 - DNA, 80 bp, Homo sapiens
  chr19:38998362-38998442
  hypo
acatggaactggactcgtcttccattgaaaagcggtttgcctttggcttcctgcagcagctgctgcgctggatggacatt

SEQ ID NO: 45867 - DNA, 41 bp, Homo sapiens
  chr19:39006715-39006756
  hypo
ccgtcttccaggcttcggccagccctcggggagtgcctggc

SEQ ID NO: 45868 - DNA, 52 bp, Homo sapiens
  chr19:39071019-39071071
  hypo
ccgtgggccttctggcggtggtcgtctacctgtacaccgtggtggccttcaa

SEQ ID NO: 45869 - DNA, 30 bp, Homo sapiens
  chr19:39101480-39101510
  hypo
tcagttccggcaactcggggtatttgggaa

SEQ ID NO: 45870 - DNA, 21 bp, Homo sapiens
  chr19:39135433-39135454
  hypo
acagggcgagactccacctcc

SEQ ID NO: 45871 - DNA, 30 bp, Homo sapiens
  chr19:39151783-39151813
  hypo
tctacattcaacttgcgcctgcaaactcag

SEQ ID NO: 45872 - DNA, 30 bp, Homo sapiens
  chr19:39191735-39191765
  hypo
caagctggtctccatcggggcagaaggtga

SEQ ID NO: 45873 - DNA, 42 bp, Homo sapiens
  chr19:39222079-39222121
  hypo
tgtgtgaagacagaacgctcaggacagcgtctgacacgtgac

SEQ ID NO: 45874 - DNA, 30 bp, Homo sapiens
  chr19:39235148-39235178
  hypo
ggctggggaaggaggcgggtttacctcggt

SEQ ID NO: 45875 - DNA, 30 bp, Homo sapiens
  chr19:39266345-39266375
  hypo
tgagatatgcatcctcgatgggctcttatt

SEQ ID NO: 45876 - DNA, 30 bp, Homo sapiens
  chr19:39329609-39329639
  hypo
ccatctccaccatggcggcccccggcttgc

SEQ ID NO: 45877 - DNA, 30 bp, Homo sapiens
  chr19:39329947-39329977
  hypo
tctgttacacacagacgtgtgtgatctatg

SEQ ID NO: 45878 - DNA, 30 bp, Homo sapiens; identical to SEQ ID NO: 16504
  chr19:39330221-39330251
  hypo

SEQ ID NO: 45879 - DNA, 19 bp, Homo sapiens
  chr19:39393000-39393019
  hypo
cgcccggcctcattttatt

SEQ ID NO: 45880 - DNA, 30 bp, Homo sapiens
  chr19:39524876-39524906
  hypo
tattttatttggcttcgacataacgtgagc

SEQ ID NO: 45881 - DNA, 94 bp, Homo sapiens
  chr19:39646149-39646243
  hypo
aaccaagcagccctccggaggcctcgaggggaacagacagtgttcacaggagaaacagttacacctgcgagctctgcctcgggccagcctttgc

SEQ ID NO: 45882 - DNA, 30 bp, Homo sapiens
  chr19:39672405-39672435
  hypo
ggaatgaatgactctcgacaggtgccggag

SEQ ID NO: 45883 - DNA, 30 bp, Homo sapiens
  chr19:39815860-39815890
  hypo
ccaagggaagtggcacggacaccaacatct

SEQ ID NO: 45884 - DNA, 250 bp, Homo sapiens
  chr19:39816936-39817186
  hypo
ccaagtctagggcaccgactcaaaacttagggagcttggatctgtgggcgtttataggataggttggtggaactagaggaggcggtccccagtttgtactgcctctccagggaatctccccaaacccgaagacacgtcccattgtgctgactcctcattggatagtgcagtctgttctggcctctctgattggtccttccacaatccctagctgtactccctctgcattggactgcgcctgtgagccacc

SEQ ID NO: 45885 - DNA, 19 bp, Homo sapiens
  chr19:39996557-39996576
  hypo
agattaaatgcggcccggc

SEQ ID NO: 45886 - DNA, 189 bp, Homo sapiens; identical to SEQ ID NO: 16507
  chr19:40218707-40218896
  hypo

SEQ ID NO: 45887 - DNA, 77 bp, Homo sapiens
  chr19:40829862-40829939
  hypo
gggaagacaacagctcgcacgcccagaatcgctcccccatccccactcactttactccctgtcgtggtgtctgcctt

SEQ ID NO: 45888 - DNA, 114 bp, Homo sapiens
  chr19:40889727-40889841
  hypo
gccaggggttggcagcgtcagggtgggggttgcgcttgaagaagtggtgggccttgcaggcggcgtgcaacaggtgtggcttgggcaggccctgggtttcgcagatgtagcgca

SEQ ID NO: 45889 - DNA, 30 bp, Homo sapiens
  chr19:40901793-40901823
  hypo
tcgcctggcttgccacgtgatggggactct

SEQ ID NO: 45890 - DNA, 417 bp, Homo sapiens
  chr19:40902278-40902695
  hypo
cgggagctgcacttccgggaggtgcacatcgggcacagccatctcgggcaccttcgggagtttcacctcagggagtttcatctcagggagcttcatctctgggacttttggaagctgcacttctgggaggtgcacatcgggcacggccatctcgggcaccttcgggagttgcacttcagggagtttcatctcaggaagtttcatctcaggcacctttggaagcttcatctcagggactttcatctctggcactttcggcagctgcacctctggaagccgcacctctggcacagccacctctgacacctctgggagtttcatctctgacactttcggcagctgtacctctggaagccgcacctccggcacagccatctctggcacctttgggagtttcatctccgacactttcagcag

SEQ ID NO: 45891 - DNA, 16 bp, Homo sapiens
  chr19:40908674-40908690
  hypo
ccgtctcaaaaaaaaa

SEQ ID NO: 45892 - DNA, 31 bp, Homo sapiens; identical to SEQ ID NO: 16508
  chr19:40951175-40951206
  hypo

SEQ ID NO: 45893 - DNA, 49 bp, Homo sapiens; identical to SEQ ID NO: 16509
  chr19:41062945-41062994
  hypo

SEQ ID NO: 45894 - DNA, 47 bp, Homo sapiens
  chr19:41198165-41198212
  hypo
atgaggtcctgtatgcggcgggccgtttcccccgacccaaagtcata

SEQ ID NO: 45895 - DNA, 30 bp, Homo sapiens
  chr19:41615907-41615937
  hypo
tggcacatctatatgcggtgacatgctact

SEQ ID NO: 45896 - DNA, 120 bp, Homo sapiens
  chr19:41881467-41881587
  hypo
ccactgcgcccggcccgtgagcccgtttctttatctgcaaaacagggattaaaaacaagccaacaccccttcagcactcctccgcaaaaaaacaccccaaaacaaaataggccaggcgcg

SEQ ID NO: 45897 - DNA, 40 bp, Homo sapiens
  chr19:41956303-41956343
  hypo
agaaacacgtgtaggcgctcaccaaagacacctactagaa

SEQ ID NO: 45898 - DNA, 31 bp, Homo sapiens; identical to SEQ ID NO: 16511
  chr19:42202366-42202397
  hypo

SEQ ID NO: 45899 - DNA, 127 bp, Homo sapiens; identical to SEQ ID NO: 16512
  chr19:42349306-42349433
  hypo

SEQ ID NO: 45900 - DNA, 154 bp, Homo sapiens
  chr19:42373753-42373907
  hypo
cttccctccccacagcggccgcaaactgacacctcagggacaaagagatctggacagaatcgccggacaggtaaggcctgcgtttggggtggggctgggtcccttagtcgctgcccaagcatttccaaagcccatacttcgtcaggtagactta

SEQ ID NO: 45901 - DNA, 491 bp, Homo sapiens
  chr19:42408203-42408694
  hypo
gaagaaattggtccacgagggcccactgacgtggcgggtgactaaggacaaggcagtgggtgagtgccagagcagctgcctagtgcagggtgttggggcagtgagccaagggcggggagggggtcgcgcgggggcacgccgtgtgagcactgctcgccccgtagaggtgcatgtgctgctgctggacgacctgctgctgctgctccagcgccaggacgagcggctgctgctcaagtcccatagccggacactgacgcccacgcccgatggcaagaccatgctgcggcccgtgctgcggctcacctccgccatgacccgcgaggtggccaccggtgagtgcagccactgcatggcccagggcagagggtgtcttttttgggcagagctgcctgtggagtggggagcagaaccctctagagagccagggagccagcattctagcaaagaggttgagaagtaggtggaggtgggcagggcggggccaggcctag

SEQ ID NO: 45902 - DNA, 30 bp, Homo sapiens
  chr19:42507833-42507863
  hypo
gcctgggcaggcacacgaggggctggacca

SEQ ID NO: 45903 - DNA, 34 bp, Homo sapiens
  chr19:42579050-42579084
  hypo
tttcagatggagtctcgctctgtcgcccaggcgg

SEQ ID NO: 45904 - DNA, 43 bp, Homo sapiens
  chr19:42697082-42697125
  hypo
cctgcaaaagccaggcgcggtggctcacgcctgtaatcccagc

SEQ ID NO: 45905 - DNA, 71 bp, Homo sapiens
  chr19:42722668-42722739
  hypo
aggctgtggtgtatgcgtgtccccttaccgcggggccttgggtgtgacggtcgccacgccccccacttagg

SEQ ID NO: 45906 - DNA, 41 bp, Homo sapiens
  chr19:42907251-42907292
  hypo
catgggaagggcagtcgcctgtggagcgctgtgaaaggctg

SEQ ID NO: 45907 - DNA, 23 bp, Homo sapiens
  chr19:44599783-44599806
  hypo
acaaaatgggcctggcgcggtgg

SEQ ID NO: 45908 - DNA, 38 bp, Homo sapiens
  chr19:45003229-45003267
  hypo
cagcgtgggggttctcgagcctacgatacagcagctca

SEQ ID NO: 45909 - DNA, 30 bp, Homo sapiens
  chr19:45279887-45279917
  hypo
tgaacgccatcctcccgcctggcttcttcg

SEQ ID NO: 45910 - DNA, 33 bp, Homo sapiens; identical to SEQ ID NO: 16517
  chr19:45381918-45381951
  hypo

SEQ ID NO: 45911 - DNA, 107 bp, Homo sapiens
  chr19:45570386-45570493
  hypo
tgagtgtatctagagcgccatctctgtagccggagggaggccggaatgccgctctgggacattttggagggagagtagcaggagaggagagtcgagcctgtcaccct

SEQ ID NO: 45912 - DNA, 235 bp, Homo sapiens
  chr19:45574465-45574700
  hypo
gtggacatagggtgtcggcccagcatgtcccacatgggcccctttgcccagggcctctggcgacaggtccgggcctctccccgccctcgcctcagcccctgccctggcctcgcccgcactaggaactgggagcgcagctttctgtgccagtcctgctgcgccccaggcactgggggctggccgttccctcaccccctcactccaaaccggtctgtccagccgtccaccccacgga

SEQ ID NO: 45913 - DNA, 38 bp, Homo sapiens
  chr19:45575118-45575156
  hypo
actcacagctgcccccgggcccgcggctcttgccccct

SEQ ID NO: 45914 - DNA, 30 bp, Homo sapiens
  chr19:45601584-45601614
  hypo
gaatgacctgaggctcggctggtctcctca

SEQ ID NO: 45915 - DNA, 30 bp, Homo sapiens
  chr19:45616778-45616808
  hypo
agcccctgccctgcacgatggtagcagagc

SEQ ID NO: 45916 - DNA, 30 bp, Homo sapiens; identical to SEQ ID NO: 16518
  chr19:45626698-45626728
  hypo

SEQ ID NO: 45917 - DNA, 30 bp, Homo sapiens
  chr19:45627017-45627047
  hypo
tttagaattttagaacgtgtttcactacat

SEQ ID NO: 45918 - DNA, 30 bp, Homo sapiens; identical to SEQ ID NO: 16519
  chr19:45709152-45709182
  hypo

SEQ ID NO: 45919 - DNA, 30 bp, Homo sapiens
  chr19:45751388-45751418
  hypo
ttttcaaacagagtccggtaggttttagta

SEQ ID NO: 45920 - DNA, 233 bp, Homo sapiens
  chr19:45810003-45810236
  hypo
gcgcctacttctgggcggggatcatgtcgtcaatggactggcctttctccaacttcttctccatttccaccatgagcttcacaccatccaccaccagctgcacctgttctacttcggacgagcccagccgatcagcgttggacacgtcaaatactgagcccacggcagctgtgtccacgccacctgtgggagcaagggacaggggcgtgaagaggcagcgaaggtgcagaggg

SEQ ID NO: 45921 - DNA, 92 bp, Homo sapiens
  chr19:45810770-45810862
  hypo
gtgcttgctcaggtgcgccagcttcacatgcacgcctccacgcagcccagtgcccaggttggatgggcaggtgagcacgtagcccaggtgct

SEQ ID NO: 45922 - DNA, 26 bp, Homo sapiens
  chr19:45835234-45835260
  hypo
ggtcaacagagcgagactacgtctca

SEQ ID NO: 45923 - DNA, 201 bp, Homo sapiens
  chr19:45851193-45851394
  hypo
cctaggtcctgaggccgcaggagcagcagctgctcagcagggtggctatgagatccctgcccgccttcggaccctgcataacctcgtgatccagtacgcggggcagggccgctatgaggtggcggtgcctctgtgccgccaggccttggaggacctggagcgcagctcgggccactgccaccctgacgtggccaccatgct

SEQ ID NO: 45924 - DNA, 235 bp, Homo sapiens
  chr19:45997416-45997651
  hypo
tgcttacctagaaggcgtggctccaccgtgaattctaattggtccgtgctatcgaggcactgtccccttactggctctcgctccagtggcccccactgcttttcttcctcttccagcaatggctcttcgggcccagagttcgaatctcgcgatcgggatggggacggagtaccggcctggggtgtcccagagcccggactgagctggggagtcaagacctcgggcgatgagggct

SEQ ID NO: 45925 - DNA, 17 bp, Homo sapiens
  chr19:46144063-46144080
  hypo
tccgcctcccaaactgc

SEQ ID NO: 45926 - DNA, 160 bp, Homo sapiens
  chr19:46234839-46234999
  hypo
tgggattacaggcgtgagccaccgcgcccggcccgtcccctcctttcttacctcctgatttacaaatgagaaaattaagccttaggaggaaggaaagtcccatacattaggagttagtccacatcatagaatagcagctccacatcgctcgagcccagga

SEQ ID NO: 45927 - DNA, 30 bp, Homo sapiens
  chr19:46269160-46269190
  hypo
agggctgggggccaccgggaggcctccctc

SEQ ID NO: 45928 - DNA, 64 bp, Homo sapiens
  chr19:46321335-46321399
  hypo
gctgctgcatcaccacggccagcacctctgacgtgtacacgttccgctccgcaaagcacaggtt

SEQ ID NO: 45929 - DNA, 121 bp, Homo sapiens
  chr19:46327091-46327212
  hypo
cagcaggagcagctccggggagttcatgcccattcctcggatctagaggcagagacagggatgaccagacccagggtgagagcttaggggagggtcaggtgttgcccggcagggtggcttg

SEQ ID NO: 45930 - DNA, 30 bp, Homo sapiens
  chr19:46346873-46346903
  hypo
gctcggggtccaccacggagctacatttct

SEQ ID NO: 45931 - DNA, 95 bp, Homo sapiens
  chr19:46356540-46356635
  hypo
ccaagtgtcccatgtcgtcttctgcctttgcacacacttctgtgccctcagcttgacatgctctccctctcttggctgggcacggtggctcgtgc

SEQ ID NO: 45932 - DNA, 125 bp, Homo sapiens
  chr19:46404522-46404647
  hypo
agacactcacctgcacgtcggtcctcccggcggtcttccgacaacacgtagcgctgagggcaggcgcttgggggcggcggctgtgaagagggggccgcagggggctcctccgccccagcacctgc

SEQ ID NO: 45933 - DNA, 39 bp, Homo sapiens
  chr19:46811882-46811921
  hypo
tgcctgtgacctccccgctgcccccgggcctccccagcc

SEQ ID NO: 45934 - DNA, 30 bp, Homo sapiens
  chr19:47116936-47116966
  hypo
atggactgattaaaacgcagcacccgctca

SEQ ID NO: 45935 - DNA, 66 bp, Homo sapiens
  chr19:47200499-47200565
  hypo
atgtttgaagagtcacgtgaaccgccagactttcctgcccagtccctatcccgtggagctgcttgg

SEQ ID NO: 45936 - DNA, 37 bp, Homo sapiens
  chr19:47284561-47284598
  hypo
gaggactcccaagtccgggcgcggtggctcacgcctg

SEQ ID NO: 45937 - DNA, 44 bp, Homo sapiens; identical to SEQ ID NO: 16528
  chr19:47429440-47429484
  hypo

SEQ ID NO: 45938 - DNA, 30 bp, Homo sapiens
  chr19:47593170-47593200
  hypo
tggcccgggtggctccgatgccccagagga

SEQ ID NO: 45939 - DNA, 30 bp, Homo sapiens
  chr19:47633375-47633405
  hypo
ttcctgttttcttaacgctcctctctccca

SEQ ID NO: 45940 - DNA, 30 bp, Homo sapiens
  chr19:47783598-47783628
  hypo
ggtgaggagggtgtgcgctgattcagatct

SEQ ID NO: 45941 - DNA, 30 bp, Homo sapiens
  chr19:47847634-47847664
  hypo
tgatacctgtgtctgcggtcattactccag

SEQ ID NO: 45942 - DNA, 23 bp, Homo sapiens
  chr19:47864411-47864434
  hypo
atgacaatggcaggccgtcccgg

SEQ ID NO: 45943 - DNA, 47 bp, Homo sapiens
  chr19:47986518-47986565
  hypo
ctctctccctcctcccgtccacgcctcactcacgggcaatagagtca

SEQ ID NO: 45944 - DNA, 42 bp, Homo sapiens; identical to SEQ ID NO: 16529
  chr19:48003498-48003540
  hypo

SEQ ID NO: 45945 - DNA, 32 bp, Homo sapiens
  chr19:48003977-48004009
  hypo
tgcagcctggcagaacgcgtttccagcagctg

SEQ ID NO: 45946 - DNA, 41 bp, Homo sapiens
  chr19:48106984-48107025
  hypo
tagggttacgggcgtgagccactgcacggggccagggctgg

SEQ ID NO: 45947 - DNA, 30 bp, Homo sapiens
  chr19:48137321-48137351
  hypo
gcatactgcacacaccgtttggcatctccc

SEQ ID NO: 45948 - DNA, 89 bp, Homo sapiens
  chr19:48151322-48151411
  hypo
cgtctgccttctctccgtctccctgttttcctgttaccgtctccccgtccctctctctgtctctctgaactgctcgttccctccttgcc

SEQ ID NO: 45949 - DNA, 34 bp, Homo sapiens
  chr19:48237374-48237408
  hypo
ggcaagagaggatgacgctcgaatggacatggtg

SEQ ID NO: 45950 - DNA, 25 bp, Homo sapiens
  chr19:48293267-48293292
  hypo
tcactgtgcccggccacacaggcgt

SEQ ID NO: 45951 - DNA, 30 bp, Homo sapiens
  chr19:48586347-48586377
  hypo
aggcgtgagccaccgcgcctggccctggct

SEQ ID NO: 45952 - DNA, 22 bp, Homo sapiens
  chr19:48614830-48614852
  hypo
aagcccagcactaagcgtcatc

SEQ ID NO: 45953 - DNA, 54 bp, Homo sapiens
  chr19:48775999-48776053
  hypo
ctgggcagggccagacgtgcaggatgcactggtttcttacgagaaagagctttt

SEQ ID NO: 45954 - DNA, 240 bp, Homo sapiens
  chr19:48800603-48800843
  hypo
ggctcaaaatggacccggggatggcatgggggtgcctggtgggcaccaggacggtactggagccggccctctgggtgctggccaggtccacgctcagggtgccgtccagcttcgcggcggcggcggccaggtccttctggcgctgcgcctccgcctgctcctggagctccacctgcagggaaggtgaactgggccccgacacacactgaggcctggccccacccccgcaggccccactct

SEQ ID NO: 45955 - DNA, 39 bp, Homo sapiens
  chr19:48806604-48806643
  hypo
atggggagatgcaggcggggagaacggtagatatgggta

SEQ ID NO: 45956 - DNA, 16 bp, Homo sapiens
  chr19:48834248-48834264
  hypo
tggagtgcagtggtac

SEQ ID NO: 45957 - DNA, 30 bp, Homo sapiens
  chr19:48844484-48844514
  hypo
cctcgagacaggacacgcattttggcaagc

SEQ ID NO: 45958 - DNA, 40 bp, Homo sapiens
  chr19:48902532-48902572
  hypo
aggaatgggcctgggcgcggtggctcacgcctgtaatccc

SEQ ID NO: 45959 - DNA, 30 bp, Homo sapiens
  chr19:48902848-48902878
  hypo
tcagaaagaaaggggcgaagtctagtggag

SEQ ID NO: 45960 - DNA, 374 bp, Homo sapiens
  chr19:49119027-49119401
  hypo
tggggctggctggtacgagggataggagaagcagcccaagtgtggccaggcctggccctgcaggctgagtctggggagagggcagggctgggggcctgatactcacttggtgtggctgtgcggggttcctggggccttgccgaaatgccggtacacctctcggcccttgcgaggacctagggaaggggaaggagaaccgggtgagacagggatctggcgcccagcttctggcctcccagatccaggagggtgaaggctgccagtagccacacagctcagtccaaacccgtcgaccacgtatcactcaccggagagcaggacagtgccacagcccttaggggagtccagggccagctggtcgaaagtgaggatct

SEQ ID NO: 45961 - DNA, 23 bp, Homo sapiens
  chr19:49266813-49266836
  hypo
cgagactccgtctatttaaaaaa

SEQ ID NO: 45962 - DNA, 76 bp, Homo sapiens
  chr19:49328490-49328566
  hypo
tcgcaaaaaaaaaaaaaaaaaaaattgtatgatctgggtggtggtggggggcaggagtcaacgggtagagcaagtt

SEQ ID NO: 45963 - DNA, 44 bp, Homo sapiens
  chr19:49402394-49402438
  hypo
aaaaaaaaaaaaaaaagagagagagagagcgggagaccagagac

SEQ ID NO: 45964 - DNA, 38 bp, Homo sapiens
  chr19:49463885-49463923
  hypo
ctgggattacaggcatgagccgccgcacctggccatgt

SEQ ID NO: 45965 - DNA, 30 bp, Homo sapiens
  chr19:49482126-49482156
  hypo
tgtgagcagggaagccgtgccctggggcct

SEQ ID NO: 45966 - DNA, 45 bp, Homo sapiens
  chr19:49541866-49541911
  hypo
acacccagtgccccccggtccacaccccggcggcaggtcctccac

SEQ ID NO: 45967 - DNA, 30 bp, Homo sapiens
  chr19:49553727-49553757
  hypo
cagctgcaggcacctcgcccaacacctcca

SEQ ID NO: 45968 - DNA, 30 bp, Homo sapiens
  chr19:49703569-49703599
  hypo
ttgtaccacctgggccgcactgtcctctgc

SEQ ID NO: 45969 - DNA, 21 bp, Homo sapiens
  chr19:49890887-49890908
  hypo
aaaggacaggccaggcgctgt

SEQ ID NO: 45970 - DNA, 41 bp, Homo sapiens
  chr19:49971866-49971907
  hypo
ggcagcagaaaaaggcgccccaaagtcggcaggagcttgtc

SEQ ID NO: 45971 - DNA, 18 bp, Homo sapiens
  chr19:49997380-49997398
  hypo
gcccggccaatttttttt

SEQ ID NO: 45972 - DNA, 31 bp, Homo sapiens; identical to SEQ ID NO: 16534
  chr19:50049718-50049749
  hypo

SEQ ID NO: 45973 - DNA, 21 bp, Homo sapiens
  chr19:50050812-50050833
  hypo
tttttttttggaagacgaatc

SEQ ID NO: 45974 - DNA, 20 bp, Homo sapiens
  chr19:50053089-50053109
  hypo
atccacactgtagcccgtgt

SEQ ID NO: 45975 - DNA, 205 bp, Homo sapiens
  chr19:50166617-50166822
  hypo
agattttatgtgggtcgtgagggtccttgctccggtcctctgctaaacgcaacccttctttgcggttgagggcagagcggaaattcctcttccaggttggcaggtctggcttatccctcccgggaacatatgcaccagtggcctcggcccaggcctggggcaacagtggtgtcaggatggtgggggaggacgacttagatcctgc

SEQ ID NO: 45976 - DNA, 130 bp, Homo sapiens
  chr19:50216075-50216205
  hypo
ctatgtttcctcaggcggtggattcgggcctgtgagtggagctgggcgcgctggcccccagaggaaagagggggctggggggcctgcactcctgcatagtgggggtggaggggaccggagctattttctt

SEQ ID NO: 45977 - DNA, 174 bp, Homo sapiens
  chr19:50216693-50216867
  hypo
gcagcacattgaggacgcactgctggatgtggcctccctgttccaggcgggacagcattttaagcgccggttcagagggtcagggaaggagaactccaggcacaggtgtggatttctctcccgccagactggggcctccaaggcctcaatgacatccaccgacttctgactcct

SEQ ID NO: 45978 - DNA, 30 bp, Homo sapiens
  chr19:50292243-50292273
  hypo
tccagctgcagcacacgagggttcccagca

SEQ ID NO: 45979 - DNA, 30 bp, Homo sapiens
  chr19:50306672-50306702
  hypo
gtcggccttcctcaccgtggggaagccggc

SEQ ID NO: 45980 - DNA, 120 bp, Homo sapiens
  chr19:50319641-50319761
  hypo
tgagccatctcgcccggccgaagattatgttttaaaatatttactggccattcaaaattttgtgtgtgtgtttgtgtgaaactagtcaggtttctttttatttatttatttttatttttt

SEQ ID NO: 45981 - DNA, 45 bp, Homo sapiens
  chr19:50331949-50331994
  hypo
tgtgtccttgggggacgcctggccagtgcccggtctcagcatccc

SEQ ID NO: 45982 - DNA, 426 bp, Homo sapiens
  chr19:50353152-50353578
  hypo
aacactgatgactcccgaatttctctctccaggctatgacatcaatatctatctacattgtttagtcaacatccgaaacagaagtagggactccgtctctaacctcctacagctgtgtctatttctcctctctaccttcactcgactccgcccacactggctcccttttattccttctactttcaggatttgtctttgctgttctgtcctctttgcacacttttccagccatctggaatggcaggttgctcacaggtcgttttcttgacttcccttgcttgctaactttacctcgctatggtcatatcccatcgccctgtggatgtgcgctagttaacacttagcacagcctgtgattatgtctctccccagtggaccgtggggcctgtgagggacgtggtctgattcggtcgtcgccgagcacag

SEQ ID NO: 45983 - DNA, 30 bp, Homo sapiens
  chr19:50362485-50362515
  hypo
gtccacgaagctgttcgtgggtgggggggg

SEQ ID NO: 45984 - DNA, 254 bp, Homo sapiens
  chr19:50364908-50365162
  hypo
agcagcggcaggggacgcccgcggctcgggcacactggacgtacctgtgggggaaggagctggatgtgcaggccccgcccaccccgccgcaggccacctacggccccgcggtcacgctacctggcgcggctcgcggcgtctgggtttgtgttgtcgatggcgacccgtttcccttgcttcagggctgtctcacacgtggtcacacagcgctgccaggagcctagcgtgtcctggggacacgagaggtcacaaac

SEQ ID NO: 45985 - DNA, 45 bp, Homo sapiens
  chr19:50395086-50395131
  hypo
ggagagggtcccaggcgtgctgtgtcctcccgggggctcagtgat

SEQ ID NO: 45986 - DNA, 51 bp, Homo sapiens
  chr19:50481531-50481582
  hypo
ggttccagccaactccgatgagagaaatgactactccggggagagaaaagg

SEQ ID NO: 45987 - DNA, 212 bp, Homo sapiens
  chr19:50919863-50920075
  hypo
cagggggggaccacacgcgctgcaagacggtgctcacgggcaaggtgggcggcctcctggccttcgccaaacgccgcaactgctgcattggctgccgcacagtgctcagccaccagggtgagcggccctggccactgggcccccactggccctcaacctgctctgccgtcaccccagatcctagacacccaccccatcggctggcactgcca

SEQ ID NO: 45988 - DNA, 95 bp, Homo sapiens
  chr19:50926491-50926586
  hypo
aaaactcaagctcagtcatttggttgaggtttgctgggtgccgggcactgcattgagactgcacatagtaagccctgcagcggcctcccaggtta

SEQ ID NO: 45989 - DNA, 115 bp, Homo sapiens
  chr19:50938597-50938712
  hypo
ccttgaatctgtccccgcacagccccagggctgacccacgcctcccgtgctcccagccctcccggggctccctggcacccgcaggcagagcccagcccctcggctggcatcggct

SEQ ID NO: 45990 - DNA, 44 bp, Homo sapiens
  chr19:50947800-50947844
  hypo
tggtgtactcttctacgtatcagagatataatggggagaaaaaa

SEQ ID NO: 45991 - DNA, 74 bp, Homo sapiens
  chr19:50967770-50967844
  hypo
tgcaagctggaggtccgaggtgagggcgtggccatccccaacactggctgacccttgctcgggccctgtgccag

SEQ ID NO: 45992 - DNA, 35 bp, Homo sapiens
  chr19:51022774-51022809
  hypo
cgtgctgtgctgtgacggtacgacctatattgcaa

SEQ ID NO: 45993 - DNA, 58 bp, Homo sapiens
  chr19:51046474-51046532
  hypo
tcatgcaggtggcagcgcggcgggggacagatgacaaccaaggcggcaggtcacacgg

SEQ ID NO: 45994 - DNA, 33 bp, Homo sapiens
  chr19:51128766-51128799
  hypo
ttccgcttcttcagacgccgcccctcgctgatc

SEQ ID NO: 45995 - DNA, 82 bp, Homo sapiens
  chr19:51203231-51203313
  hypo
tggaggattggagggatcggggcattggagggttggaaggctcggggcattggaggattggagggctcggggcattggaggg

SEQ ID NO: 45996 - DNA, 30 bp, Homo sapiens
  chr19:51304561-51304591
  hypo
tcagaaggcgggaagcgctagtgccccggg

SEQ ID NO: 45997 - DNA, 48 bp, Homo sapiens
  chr19:51340799-51340847
  hypo
tgattcagatgtagccgctggagccaggtggcccgggtttgagttctg

SEQ ID NO: 45998 - DNA, 30 bp, Homo sapiens
  chr19:51684708-51684738
  hypo
caggccgtgggggcgcgttacctgattgtc

SEQ ID NO: 45999 - DNA, 30 bp, Homo sapiens
  chr19:51715131-51715161
  hypo
cctgtgagcaggggacgccccccatcttct

SEQ ID NO: 46000 - DNA, 40 bp, Homo sapiens
  chr19:51754542-51754582
  hypo
tgggcttccagtcagcgtcagtcagcggatccttgggccg

SEQ ID NO: 46001 - DNA, 41 bp, Homo sapiens
  chr19:52086376-52086417
  hypo
agattacaggcgtgagccaccgtgcccggctatgggcatct

SEQ ID NO: 46002 - DNA, 30 bp, Homo sapiens
  chr19:52091303-52091333
  hypo
ttcaaagagcatcagcgaattcacacgggt

SEQ ID NO: 46003 - DNA, 82 bp, Homo sapiens
  chr19:52248361-52248443
  hypo
tactgagttgttgaccgataaaggctgaggactttatataaagtatcttctttttttttttttctgagccggagtctctctc

SEQ ID NO: 46004 - DNA, 23 bp, Homo sapiens
  chr19:52512149-52512172
  hypo
ggttgggaaagaggccgggcgcg

SEQ ID NO: 46005 - DNA, 137 bp, Homo sapiens
  chr19:52780320-52780457
  hypo
gtgaggtcttccctgcgtgtgtggttgtggcacaggaagaaagtatgttgattctaaaccctaaacagcatatttttgacattcaggattgacttctaaagagtcatgttggccgggcgcgggggctcatacctgta

SEQ ID NO: 46006 - DNA, 149 bp, Homo sapiens
  chr19:52893581-52893730
  hypo
cagtcccagggaggccgtgaactcttcctggtcctgggatcctgcagaccctgcccctctcctgactttctcctgcctttttcctccttgatcgggggcccttctgctccccaggcctccccttctcctgatatcgagtgtggggacgt

SEQ ID NO: 46007 - DNA, 25 bp, Homo sapiens
  chr19:52983447-52983472
  hypo
cgtgcccagtcgattatgaatctta

SEQ ID NO: 46008 - DNA, 26 bp, Homo sapiens
  chr19:53028928-53028954
  hypo
ttatttatttagagacggaatctctt

SEQ ID NO: 46009 - DNA, 39 bp, Homo sapiens
  chr19:53105829-53105868
  hypo
tatgtacagatttagcgagggaagcacagtaatgaagac

SEQ ID NO: 46010 - DNA, 76 bp, Homo sapiens
  chr19:53148247-53148323
  hypo
agcaaaactccatcttaaaaaaaaaaaaaaaaaaaaagggggtgcttttggcacagcgttccgtgccaatccaacc

SEQ ID NO: 46011 - DNA, 30 bp, Homo sapiens
  chr19:53225425-53225455
  hypo
gaaacatactgaaaccgtttctacaaaaaa

SEQ ID NO: 46012 - DNA, 30 bp, Homo sapiens
  chr19:53299504-53299534
  hypo
ctcaggaggtcctgacgatgtgtgcccaag

SEQ ID NO: 46013 - DNA, 30 bp, Homo sapiens
  chr19:53387507-53387537
  hypo
cttcagatcgagtcacgctcttatcaccca

SEQ ID NO: 46014 - DNA, 30 bp, Homo sapiens
  chr19:53412458-53412488
  hypo
tccatgtggaacaggcgctttgtaactttt

SEQ ID NO: 46015 - DNA, 24 bp, Homo sapiens
  chr19:53429320-53429344
  hypo
ataagaagggacaatcggccaggt

SEQ ID NO: 46016 - DNA, 41 bp, Homo sapiens
  chr19:53702028-53702069
  hypo
tatacagcaggtcctcgaataacgttgttttgttcaatgtc

SEQ ID NO: 46017 - DNA, 23 bp, Homo sapiens
  chr19:53728478-53728501
  hypo
ttacccatgtggggccgggtgcg

SEQ ID NO: 46018 - DNA, 38 bp, Homo sapiens
  chr19:53965321-53965359
  hypo
cttacagctcatgcacgagtcaccgtcataagatgttt

SEQ ID NO: 46019 - DNA, 114 bp, Homo sapiens
  chr19:54033275-54033389
  hypo
aaggaagcatggtatcgacatctggcatccacttggcttctagggaggcctcaggagcttttactccactttacttggaaggtgaagtgggagcaggcacgtcacatggcaaaa

SEQ ID NO: 46020 - DNA, 21 bp, Homo sapiens
  chr19:54039855-54039876
  hypo
tttaaaaattattctcgactg

SEQ ID NO: 46021 - DNA, 30 bp, Homo sapiens
  chr19:54046025-54046055
  hypo
ggttaatattgattacgcagacagcgggtt

SEQ ID NO: 46022 - DNA, 39 bp, Homo sapiens
  chr19:54314338-54314377
  hypo
tagcctggtgtcccacggtcctcgcgtgtccccggcctg

SEQ ID NO: 46023 - DNA, 126 bp, Homo sapiens
  chr19:54403466-54403592
  hypo
gcccatgcacttctccgcaggaccgcctgtatttcgtgatggagtacgtcaccgggggagacttgatgtaccacattcaacagctgggcaagtttaaggagccccatgcagcgtgagtctcggcca

SEQ ID NO: 46024 - DNA, 44 bp, Homo sapiens
  chr19:55645710-55645754
  hypo
cactttctccacatccgagctggagctctcgcatttcccaaggg

SEQ ID NO: 46025 - DNA, 16 bp, Homo sapiens
  chr19:55727832-55727848
  hypo
gcgattagatcattga

SEQ ID NO: 46026 - DNA, 30 bp, Homo sapiens
  chr19:55798634-55798664
  hypo
gctccacgacgtctacgagaacaagaaata

SEQ ID NO: 46027 - DNA, 58 bp, Homo sapiens
  chr19:55853009-55853067
  hypo
ggggatctgtgtctgcgctgcggagcaagagcaagagctaaggcgatggctgacatgg

SEQ ID NO: 46028 - DNA, 30 bp, Homo sapiens
  chr19:55912333-55912363
  hypo
ccactgccacaccaacgtggccattattct

SEQ ID NO: 46029 - DNA, 30 bp, Homo sapiens
  chr19:55927698-55927728
  hypo
gcaccagatatacaccgggcactgttctgg

SEQ ID NO: 46030 - DNA, 54 bp, Homo sapiens
  chr19:55976843-55976897
  hypo
agccaggatgtttcccgaaattgatgtaacaaatgaccacggctcagtacctag

SEQ ID NO: 46031 - DNA, 30 bp, Homo sapiens
  chr19:55982821-55982851
  hypo
ccggaaacactgtcacggacacacccagaa

SEQ ID NO: 46032 - DNA, 39 bp, Homo sapiens
  chr19:56179648-56179687
  hypo
ttgggagacatggtgcgttctccccgaggagcctctgtg

SEQ ID NO: 46033 - DNA, 79 bp, Homo sapiens
  chr19:56181818-56181897
  hypo
tgcaccctgctgtcccgtgcaccctgctgtccgtgcaccctgctgtccgtgcaccctgctgtcccgtgcaccctgctgt

SEQ ID NO: 46034 - DNA, 100 bp, Homo sapiens
  chr19:56200496-56200596
  hypo
gcctcatcctcaccccgccgtccctctgcgtgtcactctctgcctgtccctcactggttcagggacccccagccctctctttcttcggctctatctgacc

SEQ ID NO: 46035 - DNA, 51 bp, Homo sapiens
  chr19:56205745-56205796
  hypo
aggcacctgtgaacacgcccccgctgccttcccccgcgggcctatagaccc

SEQ ID NO: 46036 - DNA, 34 bp, Homo sapiens
  chr19:56354394-56354428
  hypo
gattacaggcgtcagccaccgtgcctggccttat

SEQ ID NO: 46037 - DNA, 84 bp, Homo sapiens
  chr19:56539038-56539122
  hypo
cctgcagctgcaggacgtggtgggggagagcgtcgcccccttcaaccaaacgctcacaggcctgcacgccgcttttgtgtttca

SEQ ID NO: 46038 - DNA, 30 bp, Homo sapiens
  chr19:56543855-56543885
  hypo
ggcctctaaagccaccgtggtctcacctcg

SEQ ID NO: 46039 - DNA, 30 bp, Homo sapiens
  chr19:56603841-56603871
  hypo
caggtttcccctccacgggagataaatgtt

SEQ ID NO: 46040 - DNA, 52 bp, Homo sapiens
  chr19:56617216-56617268
  hypo
aagcccgcgcgcccacggcagtcaccgcgcattcccccggccgcgcccacgg

SEQ ID NO: 46041 - DNA, 40 bp, Homo sapiens
  chr19:56686390-56686430
  hypo
aaagatgtctccagccgggcgcggtggctcacgcctgtaa

SEQ ID NO: 46042 - DNA, 35 bp, Homo sapiens
  chr19:56688387-56688422
  hypo
aatgcacctggcccccgcttcggaaaatgactggc

SEQ ID NO: 46043 - DNA, 30 bp, Homo sapiens
  chr19:56727704-56727734
  hypo
tccccgccctccgctcgttatcgtgttgag

SEQ ID NO: 46044 - DNA, 35 bp, Homo sapiens
  chr19:56987547-56987582
  hypo
gtcaacaccagacagcggggcgccacagtccatgc

SEQ ID NO: 46045 - DNA, 30 bp, Homo sapiens
  chr19:57334846-57334876
  hypo
accactcggggatggcgggtcatcttcatg

SEQ ID NO: 46046 - DNA, 30 bp, Homo sapiens
  chr19:57399477-57399507
  hypo
gtgcctggcccaacccgtccttcttagaag

SEQ ID NO: 46047 - DNA, 30 bp, Homo sapiens
  chr19:57477131-57477161
  hypo
agaggcgtgagctaccgcacccggccggat

SEQ ID NO: 46048 - DNA, 49 bp, Homo sapiens
  chr19:57491242-57491291
  hypo
tggatgggccaccctcgggggaggttctgtggtacggggtggtgcccag

SEQ ID NO: 46049 - DNA, 18 bp, Homo sapiens
  chr19:58032743-58032761
  hypo
ctccgtctcaaaaaaaaa

SEQ ID NO: 46050 - DNA, 130 bp, Homo sapiens
  chr19:58046095-58046225
  hypo
gttgcatttagcaagcgctgcctggatcccttgagcagagtggcatgtggagaagccaggtgaagtacctgtgtcatggatgctgagggcagtggagttcaaggtgtagcagtcacgatctggagatgtg

SEQ ID NO: 46051 - DNA, 179 bp, Homo sapiens
  chr19:58101908-58102087
  hypo
tgtgggaaagccttccgtggcaagtactcacttgttcagcaccagagagtccatactggagaaaggccttgggagtgcaatgaatgtggaaaattctttagccaaacctcccacctgaatgatcatcggagaatccacaccggagaaaggccttatgagtgcagcgaatgtggaaaatt

SEQ ID NO: 46052 - DNA, 30 bp, Homo sapiens
  chr19:58233563-58233593
  hypo
aaggacagatagaaacgctgtgtggccact

SEQ ID NO: 46053 - DNA, 30 bp, Homo sapiens
  chr19:58438364-58438394
  hypo
tctctagtgtgaactcgatgatgttcagtt

SEQ ID NO: 46054 - DNA, 30 bp, Homo sapiens
  chr19:58447467-58447497
  hypo
gtgcaaaagtaattgcggtttttgccatga

SEQ ID NO: 46055 - DNA, 30 bp, Homo sapiens
  chr19:58448066-58448096
  hypo
cgtatgttaaattatcgagcttgttatctt

SEQ ID NO: 46056 - DNA, 190 bp, Homo sapiens
  chr19:58457382-58457572
  hypo
cctgagtgtcctatgcgtttgcatccatctcatgtccattcttctcttgggagccgtggccactgccaaactacactgtcttttacataccttgccttcatgaccacttactctatcatcatcctcccagtcttggcccactaacagctttacaaccaaaacctggagcttgccccgcctaactgtgacc

SEQ ID NO: 46057 - DNA, 30 bp, Homo sapiens
  chr19:58512170-58512200
  hypo
aagaggaggctgactcgctaatgggcacta

SEQ ID NO: 46058 - DNA, 75 bp, Homo sapiens
  chr19:58517427-58517502
  hypo
gactaagacaacccccgagataggaaggggtaaggtaaatgcaatgagagttggggttttcgatcttagtccagt

SEQ ID NO: 46059 - DNA, 41 bp, Homo sapiens
  chr19:58536175-58536216
  hypo
gtcaggaggccccagcggggcggggccgtgtggaggctggc

SEQ ID NO: 46060 - DNA, 157 bp, Homo sapiens
  chr19:58836900-58837057
  hypo
ccaacctctatgtatcgggccccaagccagagtctcctgctcaatgtctcttacacatacacacacacacagagaagatacattctcacacacagtccaggcatcgactgaatcacacaatcacactaccattcacagtcaccgtaacaacatcaca

SEQ ID NO: 46061 - DNA, 120 bp, Homo sapiens
  chr19:58874839-58874959
  hypo
aaaaaaaaaaaaaaaattgagtcgggatctcagaagctaagcagggtcgggcctggttagtacttgggagaccgtctgggaacaccgagtgctgttggctaaaataaataaataaaccgg

SEQ ID NO: 46062 - DNA, 75 bp, Homo sapiens
  chr19:58891154-58891229
  hypo
catggaggttgcacacggcacaatgaggtcttatttgcccaagagaatgtgcagggaagtcgccaggcacggtgg

SEQ ID NO: 46063 - DNA, 38 bp, Homo sapiens
  chr19:58964230-58964268
  hypo
gtgggaaagaaattgcgggagcgctgagatcgagacca

SEQ ID NO: 46064 - DNA, 20 bp, Homo sapiens
  chr20:277026-277046
  hypo
gctaccggccgggcgcggtg

SEQ ID NO: 46065 - DNA, 186 bp, Homo sapiens
  chr20:399939-400125
  hypo
gtggaccaagtgggccgcgtggaaccaccaccctttaaccctcctccacagatctgggcttcaaggacctcacgctgcagccgcggggccctctggagccaggccccccaaagcccggggtcccccaggaacccggacgggggcagccagatgcagtgcctgagcccccaccggtaagctgtcctt

SEQ ID NO: 46066 - DNA, 1122 bp, Homo sapiens
  chr20:401049-402171
  hypo
ccccactcctgttcccgtctcagctcctcggcttcgtcacttccccacccctgacgttgagtggctccaccagccctggcccgggccctgccctgctacctgactcaccactcagaccccggcccccttccttaccttgctgccattgctgtctcacctggcgccttccgtggctacctggccggcctcccctcccttggcttccccacctccacctggcctcactcccagccccgcccctcccaacctgcctgctcctgcccatcccccaccccccaccccccatcccccagccccacccccatcccccacccccgtcccccatcccccatccctactggctcccagctttgcctgtggctggtctgacccagccctgaccacgccccctggcccttcccccttcggggtctgacccgcccccgaggccctgacccgccccgtggccccgccccgtgtgcccagcggaagcagcagcagcaggaggggaactacctgcagcacgtccagctggaccagaggagcctggtgctgaacacggagcccgccgagtgccccgtgtgctactcggtgctggcgcccggcgaggccgtggtgctgcgtgagtgtctgcacaccttctgcaggtgcggcccccagtcccacccccggcaatgcagcttaatcaaagccgccaattacgcagggctggacgtgggtggggccctgtgctctgatacctcattggacgcccgcgaaaacctacgaggtaggctccgtctccccatgttgcggacgaggaacctgagggaaagagaggcccagcgccttaccccaggcccacggctcatgagagaagcagcctagacgtgagcgcaggcgtggggggagactcccttcccctctacctttcgccgcccgggctcctgcagccacgctgctctcagcctcgctgtgggcatctgccagtttctgagtctcctgtcatggcccccccacccctgaatgtggggaacacagacccgctcaccacagcggacccttgtggagccgcccctgggtgacaggctccgtgcctgcctcctgcagcttacattccagcagagaggctgatgagaatcggataatcgctggttgatgtct

SEQ ID NO: 46067 - DNA, 143 bp, Homo sapiens
  chr20:741900-742043
  hypo
agaggtgcagagtcacggggcttgcggggcgagcgccggagcaaagaactctcacagggctcaggggaacccacggaatactctctaggtgcgaggagcgccttctgggagtgagcctgcggggccgacgggtcccatgagtt

SEQ ID NO: 46068 - DNA, 45 bp, Homo sapiens
  chr20:799104-799149
  hypo
gagtgaggggtggggcgtagtttcagattttttttttttttttga

SEQ ID NO: 46069 - DNA, 44 bp, Homo sapiens
  chr20:799689-799733
  hypo
gccgggatcacaggcgtgagccaccgcgccgggcccagcttctg

SEQ ID NO: 46070 - DNA, 41 bp, Homo sapiens; identical to SEQ ID NO: 16556
  chr20:1323452-1323493
  hypo

SEQ ID NO: 46071 - DNA, 30 bp, Homo sapiens; identical to SEQ ID NO: 16557
  chr20:1692274-1692304
  hypo

SEQ ID NO: 46072 - DNA, 30 bp, Homo sapiens
  chr20:2058766-2058796
  hypo
gtgagccaccgcgcccggcctgtgtacaca

SEQ ID NO: 46073 - DNA, 147 bp, Homo sapiens; identical to SEQ ID NO: 5237
  chr20:2113428-2113575
  hypo

SEQ ID NO: 46074 - DNA, 41 bp, Homo sapiens
  chr20:2444391-2444432
  hypo
cctgttgggatggcccgccaaccccacggactggcccagca

SEQ ID NO: 46075 - DNA, 32 bp, Homo sapiens; identical to SEQ ID NO: 16560
  chr20:2645508-2645540
  hypo

SEQ ID NO: 46076 - DNA, 30 bp, Homo sapiens
  chr20:3001373-3001403
  hypo
ttgatcctagggtatcgggtgtcatgatca

SEQ ID NO: 46077 - DNA, 43 bp, Homo sapiens; identical to SEQ ID NO: 1636
  chr20:3027758-3027801
  hypo

SEQ ID NO: 46078 - DNA, 30 bp, Homo sapiens
  chr20:3202086-3202116
  hypo
catctggcttgtccacggagttcagggtac

SEQ ID NO: 46079 - DNA, 91 bp, Homo sapiens; identical to SEQ ID NO: 16562
  chr20:3202418-3202509
  hypo

SEQ ID NO: 46080 - DNA, 95 bp, Homo sapiens
  chr20:3204880-3204975
  hypo
gtcctcgaccccactcggcgtgatcgccacagttcagcctgcgggctgcaggcccctcgggaggccctgcttatgccacacgcccttactctgtg

SEQ ID NO: 46081 - DNA, 30 bp, Homo sapiens
  chr20:3729991-3730021
  hypo
atccttggcccctaccgggcaccatatact

SEQ ID NO: 46082 - DNA, 30 bp, Homo sapiens; identical to SEQ ID NO: 16564
  chr20:3763473-3763503
  hypo

SEQ ID NO: 46083 - DNA, 34 bp, Homo sapiens
  chr20:3764967-3765001
  hypo
gggagaggcactctccggccgggaacctccaggg

SEQ ID NO: 46084 - DNA, 105 bp, Homo sapiens; identical to SEQ ID NO: 16565
  chr20:3820924-3821029
  hypo

SEQ ID NO: 46085 - DNA, 17 bp, Homo sapiens
  chr20:4657798-4657815
  hypo
tccgtctaaaaaaaaaa

SEQ ID NO: 46086 - DNA, 30 bp, Homo sapiens
  chr20:4677123-4677153
  hypo
aaccttgcactctagcgttggttctcatgt

SEQ ID NO: 46087 - DNA, 76 bp, Homo sapiens
  chr20:4690696-4690772
  hypo
ttcatgatcaaccaacgtggtttagtttggctcagacctaggaagatctaaaactttacgccggatcatgttcctc

SEQ ID NO: 46088 - DNA, 30 bp, Homo sapiens
  chr20:4749380-4749410
  hypo
cagggtagggagtgccgtggtgaagagtct

SEQ ID NO: 46089 - DNA, 48 bp, Homo sapiens
  chr20:5762556-5762604
  hypo
tttcaacaaccggcacgactgtacaggtgcacacgagctgaatagagg

SEQ ID NO: 46090 - DNA, 30 bp, Homo sapiens
  chr20:10641102-10641132
  hypo
cttcataaaagggatcggttaaacacacta

SEQ ID NO: 46091 - DNA, 207 bp, Homo sapiens
  chr20:13243380-13243587
  hypo
ctccattttgtcagccggccccaagaaccttcaatgaggagagatacacagggatgggtggcccctccacctcaaagccagctccctacccaaatgcaaagagttgcccattcttcatttcttctaaagcctgagataataaacgaggtcactgccaagccctaaagtaaacatcgttatgatacattctgccgccataactaggga

SEQ ID NO: 46092 - DNA, 142 bp, Homo sapiens
  chr20:16554594-16554736
  hypo
tgttttaaatgtgtgcgggaatgtcattatattggctagaatcaaaccttatttagacttgttttgcacttttgtacactttagtaatttttagttttaatcataagggagttaaaggcgaacacaactggtattttttttt

SEQ ID NO: 46093 - DNA, 142 bp, Homo sapiens
  chr20:16555036-16555178
  hypo
cttaaggcttagggcctctggtagaagtgagctccacctcccttcctgtgtagaaggtaaatgcattcattcattcagtgaatcgagcatgcatgaaatcgtttgcgcacacccagaagcccacctgcgagccacaggagca

SEQ ID NO: 46094 - DNA, 179 bp, Homo sapiens
  chr20:17482564-17482743
  hypo
cgggtctgaggctgccgctctggagtggcgagctttcatgtgcatggcaaagttgagaaaggtaattatttggagaggaaaagaaatgaagccgaaaggcaaagacaaacagaaattagggagccatggcaagagaaggaagagatggaaaaggagacggagagcggctgcctcagctc

SEQ ID NO: 46095 - DNA, 30 bp, Homo sapiens
  chr20:17702368-17702398
  hypo
aagcaaattctggaccgctgttcacacaga

SEQ ID NO: 46096 - DNA, 154 bp, Homo sapiens
  chr20:18233341-18233495
  hypo
ccaggttttgttttccgagtcttggcgtccccagccaaagttcctgggtactggctgccacccatgggagaggggaacacccaccagctccaccccataggacattgctagggccttagtcacctagaaaagccctccacgtatttgcctggtt

SEQ ID NO: 46097 - DNA, 208 bp, Homo sapiens
  chr20:18489646-18489854
  hypo
gagccaccgcgcccggccgccagtgccttttaataaagaacgttttgagagagagacggttatttaatgaaatctgctgacatacttgctgagagttgtgatagaacttgctttcattccgactttagttatccctttgcttcccatgaagctccagagtgcttcctgtgcacacagtgcttcaggttcttgccgttgccagaaataa

SEQ ID NO: 46098 - DNA, 197 bp, Homo sapiens
  chr20:19080645-19080842
  hypo
agtccttgctcctgccgcccccatggtgggctgaagtttacatgttggggtttttgccaggcaactccctggacagcctatcactaagccctcacctaaaaccactgacagtggttcttattttgcttactggacaaaaaaagaaaccgagtttccgatggatttgttttttgggatgacaccgggtaatctcccat

SEQ ID NO: 46099 - DNA, 40 bp, Homo sapiens
  chr20:19674013-19674053
  hypo
cgtttgcttcctccacgctgtggatcgcagccttctccta

SEQ ID NO: 46100 - DNA, 30 bp, Homo sapiens
  chr20:19928306-19928336
  hypo
agtctaggagattcccggaaaccttcaggg

SEQ ID NO: 46101 - DNA, 30 bp, Homo sapiens
  chr20:19961658-19961688
  hypo
ctggtaatcactcctcgtgggcggccctgt

SEQ ID NO: 46102 - DNA, 30 bp, Homo sapiens
  chr20:20376922-20376952
  hypo
ctccattaaggctggcggtcaaaggccggc

SEQ ID NO: 46103 - DNA, 30 bp, Homo sapiens
  chr20:20377191-20377221
  hypo
tgtgggcagggcccccggggaggggaaggc

SEQ ID NO: 46104 - DNA, 30 bp, Homo sapiens
  chr20:20421168-20421198
  hypo
ttgcgcagacagcatcggagctttgtcagc

SEQ ID NO: 46105 - DNA, 32 bp, Homo sapiens
  chr20:20914015-20914047
  hypo
gataggaaaggcggacgcgcaaatccaccaac

SEQ ID NO: 46106 - DNA, 30 bp, Homo sapiens
  chr20:23117794-23117824
  hypo
cagcagaggggcctacggctgggactgtgg

SEQ ID NO: 46107 - DNA, 37 bp, Homo sapiens
  chr20:23138450-23138487
  hypo
tacacgcgtgagccaccgcgcccggcctcctagtgtc

SEQ ID NO: 46108 - DNA, 94 bp, Homo sapiens
  chr20:24467593-24467687
  hypo
agagtgtgcatttctaacaagtgccagtgatgacagtgctgctagcccgcaggacacactttgagcagccggggaatcacgggccaaggttggg

SEQ ID NO: 46109 - DNA, 174 bp, Homo sapiens
  chr20:24523871-24524045
  hypo
cagtaccagagccaccgggtgggggccagcacagtgccggccagcctggacagcagcaggagtgagccgatgcagcagctgctggaccccaacaccctgcagcagtcagtggagtcccgctaccggcccaacatcatcctctattcagagggcgtgctgcgctcctggggggac

SEQ ID NO: 46110 - DNA, 134 bp, Homo sapiens
  chr20:24571035-24571169
  hypo
tgggataagaagcctcgggggtttgagcggaggagaagcccctgtggccacatgctcccgggagccttcagagaacagggcggagggggaggcgcagggcgacgacggcagtggtcaaacgcagaaccgtggag

SEQ ID NO: 46111 - DNA, 77 bp, Homo sapiens
  chr20:24571472-24571549
  hypo
cgtgggagcattgaccgctgatgagcagcttcaggcatgcagggagggacagcaccgaggagcggactccagagcaa

SEQ ID NO: 46112 - DNA, 46 bp, Homo sapiens
  chr20:24872951-24872997
  hypo
cccacccttgctgcacggacacccccagccccgcagatgccctgca

SEQ ID NO: 46113 - DNA, 246 bp, Homo sapiens
  chr20:25028280-25028526
  hypo
tgagcttcaggcaaacggggtttgcatggagaaccaaggtgctgcaccaacacagcagcccctacaggaagcagcttggggaaggccagtgcagaccgcccaaagcacacagcatctgaagcatgcttggcacatagaatctgcttaaggaatcagagactaaaaagatcagcttaaaaacaaaacaactctactaaagatgattttatttattgtcccatcctcacaaggcgctgagagtgtggc

SEQ ID NO: 46114 - DNA, 152 bp, Homo sapiens
  chr20:25230352-25230504
  hypo
acatagaagtggcaacgaatggccaaaacaggttataacaagggcttgggatgactttgccaggaaaagcagccaagaagcagtggctcccccagaattccctgctgttgggagagttctgatgcacagcaccattttttttttttttttaa

SEQ ID NO: 46115 - DNA, 211 bp, Homo sapiens
  chr20:25230744-25230955
  hypo
aaagtgcaggagttacaggcgtgagccaacgcacccgacccgcaacatcatttttattgtctaagtggcggatggcaaggacatagctctgccttcacattcaagggcatttccttggagctggaccaggactcagctctacaccttagggtgcccattggagtatttatgtataatcacatcctggagaggccagcgatgggctcaggga

SEQ ID NO: 46116 - DNA, 97 bp, Homo sapiens
  chr20:25251463-25251560
  hypo
gtttttctttcaagacgttttgattggaacaagggctggatttaatgacacgtgctatagcgccttggggcccctggtactgcggtgtttgcacagg

SEQ ID NO: 46117 - DNA, 30 bp, Homo sapiens
  chr20:25603036-25603066
  hypo
gaagatataaggctccgagtggttaattcc

SEQ ID NO: 46118 - DNA, 30 bp, Homo sapiens
  chr20:30022593-30022623
  hypo
gagagagagaaggcacggtgactcacgcct

SEQ ID NO: 46119 - DNA, 30 bp, Homo sapiens; identical to SEQ ID NO: 16575
  chr20:30101713-30101743
  hypo

SEQ ID NO: 46120 - DNA, 28 bp, Homo sapiens
  chr20:30134312-30134340
  hypo
ggaggctgaggcaggcggatgacttgag

SEQ ID NO: 46121 - DNA, 47 bp, Homo sapiens
  chr20:30153940-30153987
  hypo
ttggggtgctgggcacggccctgaggcagtgccgtgcccagcatggc

SEQ ID NO: 46122 - DNA, 20 bp, Homo sapiens
  chr20:30181151-30181171
  hypo
cacatcgttgcttttgcatc

SEQ ID NO: 46123 - DNA, 30 bp, Homo sapiens
  chr20:30464460-30464490
  hypo
gggcctataagatatcgtctagtagtggaa

SEQ ID NO: 46124 - DNA, 33 bp, Homo sapiens
  chr20:30468280-30468313
  hypo
tctccgcaccccaaccgactttttttttttttt

SEQ ID NO: 46125 - DNA, 51 bp, Homo sapiens
  chr20:30585053-30585104
  hypo
gtggcccgcaccttgcggacagaggggcctgtcatccggattgacttgcct

SEQ ID NO: 46126 - DNA, 30 bp, Homo sapiens
  chr20:30671697-30671727
  hypo
aagctactctttgtccgtgcgagactacga

SEQ ID NO: 46127 - DNA, 30 bp, Homo sapiens
  chr20:30770464-30770494
  hypo
gtagagagttcctatcgctagagatacaaa

SEQ ID NO: 46128 - DNA, 153 bp, Homo sapiens; identical to SEQ ID NO: 5243
  chr20:30864866-30865019
  hypo

SEQ ID NO: 46129 - DNA, 48 bp, Homo sapiens
  chr20:31108565-31108613
  hypo
ctcttagatggcccccgccctagccctccagcacgccacccctgctac

SEQ ID NO: 46130 - DNA, 213 bp, Homo sapiens
  chr20:31115617-31115830
  hypo
gctctccacatgcatcgagtagatgatgtcaaagaaatcttccaccacagcgacccgcttcagagagatgccctctggctccgacaggccatctgccccctgcgacagggtggacaagctgtgttagtgtcaggaatgatggcggggtgagaactgggccctgaggccggggcaaggggtcaggacgggcaatgcctccgacagtgggtcttg

SEQ ID NO: 46131 - DNA, 30 bp, Homo sapiens
  chr20:31147343-31147373
  hypo
gtaggaatgttattacgttcattttgcaga

SEQ ID NO: 46132 - DNA, 30 bp, Homo sapiens
  chr20:31151622-31151652
  hypo
cattgcctggtctcccggccaaggtggcag

SEQ ID NO: 46133 - DNA, 159 bp, Homo sapiens
  chr20:31226664-31226823
  hypo
cgctcccggcaatgtcggcctgactcacctggtgataccaagtgtatattctgtgtcaggagctgcggtgtgcaactcaagatgctctgacttacttaattcttacacccaacaagttccaacagggaaacagagttcaggcagcgaggtagctgccca

SEQ ID NO: 46134 - DNA, 30 bp, Homo sapiens
  chr20:31553994-31554024
  hypo
cttgagcgggataagcgagatgctcctcac

SEQ ID NO: 46135 - DNA, 30 bp, Homo sapiens
  chr20:31940171-31940201
  hypo
actgcatggggtccacgggcagccggagct

SEQ ID NO: 46136 - DNA, 223 bp, Homo sapiens
  chr20:32242529-32242752
  hypo
tttacagggaatggacggggtgggagccaggtaaagaagttgctgcagtcttccacgccagagaggacggtggccctgacttgggggctggggcgaggcacaatggtggggatggcaggctacagatgaggtgggctcgtgagatcgacagacaaggcagaggcttgagggcttcctccaggtccccacagccccagcccagctcagacgtctgttctgtggc

SEQ ID NO: 46137 - DNA, 69 bp, Homo sapiens
  chr20:32301884-32301953
  hypo
tgcatggaatggcagcgagttctgtgtgccaagggcacgccagggtggacacaacgggggtcagctgag

SEQ ID NO: 46138 - DNA, 30 bp, Homo sapiens
  chr20:32414088-32414118
  hypo
aggaccattcgaggccgaggagactgtggg

SEQ ID NO: 46139 - DNA, 153 bp, Homo sapiens
  chr20:32450390-32450543
  hypo
gtgtttatttaaggaatggaagcgttcactcaagccagacttcaggggcaaatgtacattgggaatctccaagggacatctcccaaactacctgaccagggtgtgggttccgccgaatatcttttgggaaacgctgtgcgggggtccctagag

SEQ ID NO: 46140 - DNA, 38 bp, Homo sapiens
  chr20:32459722-32459760
  hypo
atcaggtgctcatcacgtgttttcgaaggcagttgatt

SEQ ID NO: 46141 - DNA, 30 bp, Homo sapiens; identical to SEQ ID NO: 16581
  chr20:32524318-32524348
  hypo

SEQ ID NO: 46142 - DNA, 30 bp, Homo sapiens
  chr20:32950057-32950087
  hypo
cagctcttagaataccggacaggccacgtt

SEQ ID NO: 46143 - DNA, 123 bp, Homo sapiens
  chr20:33134858-33134981
  hypo
agcatagccagggagcggcccagatggcagggcaaggtctctgtggagtgagggcagcagggaaggtgcctcgcaggagaggagagaaaacatacacttccctggggacgcgggcggggagtt

SEQ ID NO: 46144 - DNA, 30 bp, Homo sapiens
  chr20:33137930-33137960
  hypo
gcccgtgtgccaggccggccaaggccagtt

SEQ ID NO: 46145 - DNA, 29 bp, Homo sapiens
  chr20:33290324-33290353
  hypo
ttatcactagagtgccgggcacggtggct

SEQ ID NO: 46146 - DNA, 30 bp, Homo sapiens; identical to SEQ ID NO: 16583
  chr20:33547626-33547656
  hypo

SEQ ID NO: 46147 - DNA, 30 bp, Homo sapiens
  chr20:33574865-33574895
  hypo
ctgcatgaatggtcccggggcagtgcctgg

SEQ ID NO: 46148 - DNA, 45 bp, Homo sapiens
  chr20:33834734-33834779
  hypo
tatgcagcagttttacgggatcccggtcaccggtgtgttggatca

SEQ ID NO: 46149 - DNA, 41 bp, Homo sapiens
  chr20:33855099-33855140
  hypo
cagcccaggccccctcggccgcccctcggggaccggccatc

SEQ ID NO: 46150 - DNA, 30 bp, Homo sapiens; identical to SEQ ID NO: 16584
  chr20:33866905-33866935
  hypo

SEQ ID NO: 46151 - DNA, 244 bp, Homo sapiens
  chr20:33879984-33880228
  hypo
gtgccgcagcaccagcggtgagctctcccgccaccacggcagcttcagctcttccacccggccccgcaggggtcccgccatgccctgggctcccaggaccccaggccccgggcctccgaacatgcctgccacgcggctgcctcacccgccggcagggcccatggcccgcacgctgggctggctgcagcaggaagaggagaccagcagaaccgccttctgcccgcccgctcgctgtgtgtgtggc

SEQ ID NO: 46152 - DNA, 31 bp, Homo sapiens
  chr20:34041981-34042012
  hypo
atttatacacaaggccgggcgcggtggctca

SEQ ID NO: 46153 - DNA, 30 bp, Homo sapiens
  chr20:34147200-34147230
  hypo
agcctgagcctcctgcgcctcccgctccac

SEQ ID NO: 46154 - DNA, 276 bp, Homo sapiens
  chr20:34147978-34148254
  hypo
aagggtccagacctgcgccagacgctcacctcccgctccgtgggcaggtagtcaaagcggaacacaaagcgccaattgaagttcccctccccagtcagggagttgaagtgaacgtctgtctcctgcttgtcatgctccaaccccttcacccagctggggccggggtgggtgagcgtcagggctggagctacatggagaacccactcctcaccccgctctcagcaccacggagggcctggggtcggggctctggactcagcccgagggcccacaccc

SEQ ID NO: 46155 - DNA, 63 bp, Homo sapiens
  chr20:34710619-34710682
  hypo
ggaaggcagaagccacgcagacttctagtcctggttccactgcttactcggtatgtggccctt

SEQ ID NO: 46156 - DNA, 131 bp, Homo sapiens
  chr20:35089026-35089157
  hypo
gacctaccacaggtgcggcctggagagatgaggcccacaaggcagcgacaggacctggattcagtgaggagaggggactcgcggggtagaagccaggaactgggaaggcgaggaggcgtgaaggcaccacc

SEQ ID NO: 46157 - DNA, 256 bp, Homo sapiens
  chr20:35924156-35924412
  hypo
ctgtaaagtgctgttcgcaacacctggccgttcatttgccgactgctgctgctgctggaacaatggccagggaacaaaacctgtcacagccagtcgaaggggtgtctcctagttgagatctgcaggatgaataggacttgtttgactttggtcatcaggaaaggaaagcccagaaatactggcaggagggctgggaagtaaagcacagaggtgcagagagaactagatgagagccgtacggcgcacagtgtgtgta

SEQ ID NO: 46158 - DNA, 33 bp, Homo sapiens
  chr20:36049828-36049861
  hypo
accccactctgcagacgccgggccacactgtgt

SEQ ID NO: 46159 - DNA, 39 bp, Homo sapiens; identical to SEQ ID NO: 16588
  chr20:36151122-36151161
  hypo

SEQ ID NO: 46160 - DNA, 35 bp, Homo sapiens
  chr20:36526859-36526894
  hypo
ccaagcctggagttccgcaccggtttcataccctc

SEQ ID NO: 46161 - DNA, 96 bp, Homo sapiens
  chr20:36571234-36571330
  hypo
gtcaaagtacaaagacgaatataacaaacatccttgctccccccaagtggagtgaatagttattagcatcctgatatatttgtcgtcagcctttat

SEQ ID NO: 46162 - DNA, 30 bp, Homo sapiens
  chr20:36767887-36767917
  hypo
ccaacgatcagggaacggttgatggatttg

SEQ ID NO: 46163 - DNA, 63 bp, Homo sapiens
  chr20:36775268-36775331
  hypo
gcacaccctggtcatcgttgcagttgacctgcaaccagtggggcagcacggggactgagcctg

SEQ ID NO: 46164 - DNA, 40 bp, Homo sapiens
  chr20:39687444-39687484
  hypo
ctataattatatgaccgctcgaaaacgccaagacaattta

SEQ ID NO: 46165 - DNA, 30 bp, Homo sapiens
  chr20:40715181-40715211
  hypo
tttttcttttcaccacgcaaatcatcacaa

SEQ ID NO: 46166 - DNA, 107 bp, Homo sapiens
  chr20:42088631-42088738
  hypo
atgttttaagatttccgagtctgaccaatcttgtctttcaggattttatgcgacaagcaggtgaagtaacctatgcggatgcccacaaggaacgaacaaatgagggt

SEQ ID NO: 46167 - DNA, 143 bp, Homo sapiens
  chr20:42199155-42199298
  hypo
gagagggagtgagctcgcagccgcacagggcggggagcaggtgcaccctagccctacagcagccacccaataactcctgtcacactcctcctcccctccagctcttcttccacctgcagcgggagcgccggttcctggagccc

SEQ ID NO: 46168 - DNA, 102 bp, Homo sapiens; identical to SEQ ID NO: 1637
  chr20:42218592-42218694
  hypo

SEQ ID NO: 46169 - DNA, 30 bp, Homo sapiens
  chr20:42853157-42853187
  hypo
agtctattaaaggtacgagcttagctggac

SEQ ID NO: 46170 - DNA, 128 bp, Homo sapiens; identical to SEQ ID NO: 16591
  chr20:43065628-43065756
  hypo

SEQ ID NO: 46171 - DNA, 113 bp, Homo sapiens
  chr20:43276908-43277021
  hypo
tatgggaggcacacccgacagggcaaacttgacttgggcatcccctgacgatgaccctgcatggcaggcacacttgaatgggtgttcagagttctgagcgaaggaatccaaga

SEQ ID NO: 46172 - DNA, 37 bp, Homo sapiens
  chr20:43385586-43385623
  hypo
atacagtgggtccagcgacttgcgagcgactttggtc

SEQ ID NO: 46173 - DNA, 31 bp, Homo sapiens
  chr20:43952328-43952359
  hypo
ccgtgttagccaggatcgtctcaatctcctg

SEQ ID NO: 46174 - DNA, 40 bp, Homo sapiens
  chr20:44477901-44477941
  hypo
aggctatttattcagcgcttgttcttttttttgtttgttt

SEQ ID NO: 46175 - DNA, 30 bp, Homo sapiens
  chr20:44562147-44562177
  hypo
cctttatgaggtaggcggatttattatctt

SEQ ID NO: 46176 - DNA, 40 bp, Homo sapiens
  chr20:44601506-44601546
  hypo
taatagagctgaggccgggcgctgtgagtcacgcctgtaa

SEQ ID NO: 46177 - DNA, 300 bp, Homo sapiens
  chr20:44601786-44602086
  hypo
gcgacagagcgagaccctctttcaaaaaataaataaatacaagtcaactacctatcctttaaaagtggagaaagaaaaaaaattttaattaaaagtcagctgcccttaaggtatgtccttcctccggaaatgtcaccttctgttttaagacttttagcagtttgcagtggaagagcacaagagggagtaaggcgctctggtttttgtccctaagtctctgtagttccataggctattttccttaattgaaagatacaaattttgggggaaaaaaatctcaaaaaaactcctaagcaggct

SEQ ID NO: 46178 - DNA, 120 bp, Homo sapiens
  chr20:44602326-44602446
  hypo
ccttccagcctggggaacaacagcggaaactcttgtctcaaacaaacaaacaaaaagtcctaaggagaagacctattaataaggagaaaaggtccgggctcggtgggtcacacctgtaat

SEQ ID NO: 46179 - DNA, 47 bp, Homo sapiens
  chr20:44756555-44756602
  hypo
ccagtttaaaaatgtcggcaaatatttccaaacgttaagaaaatgtt

SEQ ID NO: 46180 - DNA, 30 bp, Homo sapiens
  chr20:44845534-44845564
  hypo
gccacccagctgacccgccatgtctgtggc

SEQ ID NO: 46181 - DNA, 416 bp, Homo sapiens
  chr20:45337605-45338021
  hypo
tgcctaacccaccaccgtagtttaactttctgcctagtctttatcactagctgatatttctcaggatcctttagttacttctttttcgtcttcccctcctagaatgtaaactcttcccctcctagaaggtaaacaaaagacctgttctgttttgttcttcggcccatcccaagcctagcgtagtgcctggtatgtggtggtgtccaaacccaagcgtggagtgaatgagggatgaatccatgagagagtgagcggctccagtgggtatgcgcgagtgtctcactcggtgtagatgtgtgtgttgtgtgtgttgtgtgtgtgcgcacgctggggaggccagacaagtgtggaccagtgattggggcacctcttccctgcaaagaggccaggggaagacagtgcgtgtggggtcttct

SEQ ID NO: 46182 - DNA, 30 bp, Homo sapiens
  chr20:45834171-45834201
  hypo
tcaggttctactgaacggtgagcccctcag

SEQ ID NO: 46183 - DNA, 32 bp, Homo sapiens
  chr20:45949151-45949183
  hypo
cctggccagccaccacgtaaagatgctgcggc

SEQ ID NO: 46184 - DNA, 30 bp, Homo sapiens
  chr20:45951653-45951683
  hypo
cttggcattggccaacgtcaacacagcatt

SEQ ID NO: 46185 - DNA, 146 bp, Homo sapiens
  chr20:46013515-46013661
  hypo
taaagtgctgggatcacaggtatgagccagcgcgcccggcggaggaattttcagtactaaagctatagtgttgtgatgagagtccggcgtgctccctgaatgccggtgcccgattcataacctagtgcattcgttcacacattatt

SEQ ID NO: 46186 - DNA, 30 bp, Homo sapiens
  chr20:46175625-46175655
  hypo
ttcttgatccagtaccgttcttcatccagt

SEQ ID NO: 46187 - DNA, 30 bp, Homo sapiens
  chr20:46315525-46315555
  hypo
aggctcccctggactcggctttctcagccc

SEQ ID NO: 46188 - DNA, 36 bp, Homo sapiens
  chr20:46365599-46365635
  hypo
acatgggtgtggtcacgaaggcgttgatgaagtgcg

SEQ ID NO: 46189 - DNA, 30 bp, Homo sapiens
  chr20:46582135-46582165
  hypo
attcttcctatgtgccgagtatatacactc

SEQ ID NO: 46190 - DNA, 30 bp, Homo sapiens
  chr20:46823521-46823551
  hypo
ggcgaatgagctggacgagggccagccctg

SEQ ID NO: 46191 - DNA, 30 bp, Homo sapiens
  chr20:47128746-47128776
  hypo
ctagatcagcagcaccggctcctccctggg

SEQ ID NO: 46192 - DNA, 68 bp, Homo sapiens; identical to SEQ ID NO: 16599
  chr20:47247201-47247269
  hypo

SEQ ID NO: 46193 - DNA, 36 bp, Homo sapiens
  chr20:47252955-47252991
  hypo
cagtgggtgggccagcggggccgccctcccgcccca

SEQ ID NO: 46194 - DNA, 36 bp, Homo sapiens
  chr20:47260725-47260761
  hypo
gatgtttgtttctttcgctgccgcattcccagtgcc

SEQ ID NO: 46195 - DNA, 182 bp, Homo sapiens
  chr20:47274120-47274302
  hypo
caaggtcaacctagccgctccggccatgggtatgtcgctccttgcagcccaaagcattcctaattgccacaggggcaagctgggctccagccagcacggcaggtgcatctcccccacccacctgcacacgccccaggcaaagccggaaggccccagggctgaatcctcggccagccacaccc

SEQ ID NO: 46196 - DNA, 30 bp, Homo sapiens
  chr20:47274646-47274676
  hypo
ccctgccagctcccccgagggcctcacctc

SEQ ID NO: 46197 - DNA, 255 bp, Homo sapiens
  chr20:47296109-47296364
  hypo
aggcctgctctgaggcgaacccagggtggaggtgaacgaggccagctgagtcagagtcacaggggcggagggcccctaccttggacatgatgtcctccagctcacttcgggccttgtaggtgccatcgtcgtagcggaagcgatacatcacctgctcattcttgaactggtgcttgtcggaaactggagagacaggaggacctgtgacgctgggcacgccccctcagcccctcccagccacgccccccagcattg

SEQ ID NO: 46198 - DNA, 184 bp, Homo sapiens; identical to SEQ ID NO: 16602
  chr20:47428537-47428721
  hypo

SEQ ID NO: 46199 - DNA, 118 bp, Homo sapiens
  chr20:47837088-47837206
  hypo
agactcctcaggcagcgtctgggtcccgtacactgtcgccatttccccgatgtcccctgtgggcgcgggcggccacccaggcctgctggctgcggccccctctcggacaggccttggc

SEQ ID NO: 46200 - DNA, 253 bp, Homo sapiens
  chr20:47905350-47905603
  hypo
taaacattttgccaacgcaggtacaatatgggattcaataaaagtacagaattaaagttgtcttattagagattgggaagtttcccagctccgtttatcggtacttggccgtaccgataaaggggatggacttggagtgaccaggtcttagtcacatgtattttcataccctaaacaagaagcggtatagaccagaatggagcactgattgtaatccaccttctttcttagaaactggcgatggaatatgaga

SEQ ID NO: 46201 - DNA, 33 bp, Homo sapiens
  chr20:48252895-48252928
  hypo
tgtttttatacaaggcgtcgtatgtgatgtttg

SEQ ID NO: 46202 - DNA, 30 bp, Homo sapiens; identical to SEQ ID NO: 16604
  chr20:48477511-48477541
  hypo

SEQ ID NO: 46203 - DNA, 88 bp, Homo sapiens
  chr20:48673896-48673984
  hypo
tcccttgacttgccccgcacagtgaggcctggcattttcttcccgctccccatgctggcacgtgacacagccccgggcacatgggagg

SEQ ID NO: 46204 - DNA, 21 bp, Homo sapiens
  chr20:48720805-48720826
  hypo
agactccgtctcaaaaaaaaa

SEQ ID NO: 46205 - DNA, 154 bp, Homo sapiens
  chr20:48767027-48767181
  hypo
cttcaggcctcacttcgaatgtcacctgctcagggaagccttcactgccccctccctaaaatgtcattcctgtccccaacatttcagatccccctctcctgctatgtatttgctccacagcgcttgccaccactgggcacgtgagacagttatt

SEQ ID NO: 46206 - DNA, 25 bp, Homo sapiens
  chr20:48771341-48771366
  hypo
ttccatacaggcagccgggcgcggt

SEQ ID NO: 46207 - DNA, 180 bp, Homo sapiens
  chr20:48863456-48863636
  hypo
agggggacctgtgggcggcctctgcctctccccgcgcagcgtcaggacacaggcccacattccctcctggcttctccctgaagggagagagaataatagttggttcaaatgtcaggcctgctccgtgctggtggggagactggttgagcaggtccgcaggagggacggagggaggaaatt

SEQ ID NO: 46208 - DNA, 142 bp, Homo sapiens
  chr20:49047022-49047164
  hypo
ctcggtaccctacagcgcacaacacggcccttgccagaaagaatcaacagggctgtgggcgaggagccctggtctcacgagaggttgcccacccctcacctggtgccccaggaggtgggaggcttcgcgggctccaggtctt

SEQ ID NO: 46209 - DNA, 30 bp, Homo sapiens
  chr20:49194287-49194317
  hypo
catccacctcctcatcggaaaatggatggg

SEQ ID NO: 46210 - DNA, 111 bp, Homo sapiens
  chr20:49200439-49200550
  hypo
tcttcttgagcagaccgtgatttggaagagaggcacctgctggaaaccacacttcttgaaacagcctgggtgacggtcctttaggcagcctgccgccgtctctgtcccggt

SEQ ID NO: 46211 - DNA, 270 bp, Homo sapiens
  chr20:49204179-49204449
  hypo
acaaagggtggaggtcggctctgtgccagggctgctaacggtgcccatcccaggtgccccagagttgttctgcctgctgggagagctgggtgtggcctctcgcagattctaagggccccaggcaccccgctgcgctgcacagtttgtgccactttttaccgaacgacagtgtggtttcccgggctgccgcccgcacggcctccaggtcagactggcacaggctggcagtctggtcgatgctttcaatgccctgttcgagattaggagaaa

SEQ ID NO: 46212 - DNA, 99 bp, Homo sapiens
  chr20:49218709-49218808
  hypo
gcccctcgagggccacgccaggcccgtcctctctgtccccggttgccccttcctcgtggccgttctggctactcgaggctgtgccgctgtggaacaggg

SEQ ID NO: 46213 - DNA, 26 bp, Homo sapiens
  chr20:49250786-49250812
  hypo
aggattatagccgtgagccaccgcgc

SEQ ID NO: 46214 - DNA, 79 bp, Homo sapiens
  chr20:49252062-49252141
  hypo
cacctgtagtcgagctactgcggcaggctgaggtgggaggatcattagagacctcccagcaagtcgaggctgcagtgag

SEQ ID NO: 46215 - DNA, 387 bp, Homo sapiens
  chr20:49261761-49262148
  hypo
gagcccaggcagggacggccaaaagctcgctacccctgcccaggaaggcaggagcaccgttgtgtcccgttcctatccctcaaaaataaatcacagccagctcatgtcataggacagagcctgttcgcaatccatcctgtgtctgcggattctcccaggtctgtaaggcagcagggagatgcggcctctcccactccacccaacacgtagccagggcgaggtggggccgggggagaggctgacattcaaaggcatctgagtggtaagaggtgagcgagtgaggtgaatggggactacgttagaaggaccctacgttagaagggtgaggcgctagggccatagcctaagggcactgggaaccctgtgggcatgcgcagttcaagccca

SEQ ID NO: 46216 - DNA, 114 bp, Homo sapiens
  chr20:49286780-49286894
  hypo
agttttacctactgccggtttcggccaaaatgccagaaagccaagcagcaatcttgggcatcggacttggctagaaatccctctcctcctgggaagtctcgtcatcaacaccca

SEQ ID NO: 46217 - DNA, 20 bp, Homo sapiens
  chr20:49324105-49324125
  hypo
cagagcgagactccaccaaa

SEQ ID NO: 46218 - DNA, 56 bp, Homo sapiens
  chr20:49345671-49345727
  hypo
ggagagaggatgtgacgacacctccaggaatgcagggcccacgcaggtgcactggc

SEQ ID NO: 46219 - DNA, 295 bp, Homo sapiens
  chr20:49346464-49346759
  hypo
aaaaaatgagcttctcgcctttgaacccaagtggggcaaagagcctgcagaagggacaccctcagtggcagcacccagcaaagacccatctgagtacccgctgggagtcgggttctgtgccactcaatgccagcaaagcacaagccgtccctgcgccttcgggagctttcattctaggctggtggcagattactcacaaaactcagatgcacacaaaaatgggaaacctgtaacttgtaacaagtgctgggcaacaggggtacaagtgttaggaggcctccgaggtgggcaggga

SEQ ID NO: 46220 - DNA, 26 bp, Homo sapiens
  chr20:49350870-49350896
  hypo
aactaggtagtgtgccggtccttttt

SEQ ID NO: 46221 - DNA, 32 bp, Homo sapiens
  chr20:49358364-49358396
  hypo
gagccaccgcgcccggccgcactctgtctttt

SEQ ID NO: 46222 - DNA, 158 bp, Homo sapiens
  chr20:49377913-49378071
  hypo
ctcctggccgagaatcccccttcctaaattggtaaaatctgattcatcagaattgcaattttgatcaaagccagtaactcctcacacaaatccttctatgtgtgcagaaagtgagcgtctgaaaactccaggcggagtttttgcgctaggttatctac

SEQ ID NO: 46223 - DNA, 30 bp, Homo sapiens; identical to SEQ ID NO: 16619
  chr20:49380822-49380852
  hypo

SEQ ID NO: 46224 - DNA, 30 bp, Homo sapiens
  chr20:49502935-49502965
  hypo
aggattggggttggacggttttgaggactc

SEQ ID NO: 46225 - DNA, 20 bp, Homo sapiens
  chr20:52275978-52275998
  hypo
tttttttttttgagacggag

SEQ ID NO: 46226 - DNA, 76 bp, Homo sapiens
  chr20:52341635-52341711
  hypo
gatctcctctccgaccctgccctccggcctccgtggtggccttccctggacggtattcacacgttcccctactcta

SEQ ID NO: 46227 - DNA, 30 bp, Homo sapiens
  chr20:52484713-52484743
  hypo
tgttggtggctgtcccgggcagtgtagggt

SEQ ID NO: 46228 - DNA, 40 bp, Homo sapiens
  chr20:52693155-52693195
  hypo
tttttttttttgagacggagtcttgctctgtcaccaagct

SEQ ID NO: 46229 - DNA, 99 bp, Homo sapiens
  chr20:52693375-52693474
  hypo
gacctcggggcacccttcttttattgcgaaaattgtgtcttatttatatttgtaacctaagtgcctacctgaatgccagcccaacgtcaatgttgcctc

SEQ ID NO: 46230 - DNA, 30 bp, Homo sapiens
  chr20:52773951-52773981
  hypo
agctctgctaatcggcgaccaatgcacatt

SEQ ID NO: 46231 - DNA, 198 bp, Homo sapiens
  chr20:52867324-52867522
  hypo
gggctgaccccccacctcgagagggaatcttttgatgaacttgccactcatcaagattacacaactagtaagaggtggagctaagagttgaactcagacaatatgaacctaaaaaccagtgttactaaatgagtcactccaatgaagaactttaactggaaatttggtgtcctacggagaggccgtagcatgcaaaga

SEQ ID NO: 46232 - DNA, 79 bp, Homo sapiens
  chr20:53051998-53052077
  hypo
gatttagcctgctatcgtttgccaacccctcttatgggtcataggtaatttgcttgcatttaaatagctgttaaggccg

SEQ ID NO: 46233 - DNA, 24 bp, Homo sapiens
  chr20:53209356-53209380
  hypo
caccacgcccggccagataaattt

SEQ ID NO: 46234 - DNA, 23 bp, Homo sapiens
  chr20:53535735-53535758
  hypo
aaaaccaggaggggccgggcgcg

SEQ ID NO: 46235 - DNA, 30 bp, Homo sapiens
  chr20:53866697-53866727
  hypo
acaaaaacaattccacgatccctgcattta

SEQ ID NO: 46236 - DNA, 18 bp, Homo sapiens
  chr20:54585945-54585963
  hypo
tttgaggtgcagtctcgc

SEQ ID NO: 46237 - DNA, 101 bp, Homo sapiens
  chr20:55378966-55379067
  hypo
tttctccacactcatcgtcccaggtgttgatttgttgatttttataaaccaatcataaccagttcagccttttttttttttttttttttttgagacggagt

SEQ ID NO: 46238 - DNA, 38 bp, Homo sapiens
  chr20:55379439-55379477
  hypo
ttcagccttcttctccctccacacgccatccggggggt

SEQ ID NO: 46239 - DNA, 284 bp, Homo sapiens
  chr20:55693381-55693665
  hypo
accccacctaagcaccgctcaccccactacacccgcagcactgcccgcctcacagagcagggccccacctgcctcagagtaagaaaccagcagctccaccacccctggaggctgccttggcgcagcactggaaacattcataagaacacagctgccttttccgagattcagaggttgctctggtgcctgtcacctgcccaggaatcctgctttccagcaaaggtgcctgtaattctaacttttaaagaatgtctcagggccgggcgcggtggctcacacctgta

SEQ ID NO: 46240 - DNA, 30 bp, Homo sapiens; identical to SEQ ID NO: 16624
  chr20:55925381-55925411
  hypo

SEQ ID NO: 46241 - DNA, 215 bp, Homo sapiens
  chr20:55958990-55959205
  hypo
gcttaaaatgtaaatcggctcccgaaaaagaactgacctgcattcttaatcttttattctttttccctcctgactgtggtgcagaggaggcagtatgggaggagacaaagctcaaagaaggcactgacaatccccagcatcctacgggcccgaatccacactgcggattccgtcagctcactggcggcagcactctctggtgtcttttttttttt

SEQ ID NO: 46242 - DNA, 94 bp, Homo sapiens
  chr20:55959325-55959419
  hypo
tagctgggattacaggagtgaaccactgcacctggccttctcttgtgtcttttgtctttcatttctcttcttcactacccgtcagcatgatagg

SEQ ID NO: 46243 - DNA, 117 bp, Homo sapiens
  chr20:55969858-55969975
  hypo
ggggcatggactgggcgggagcagctgcccagaggtgagggtgtgtgcctccagtgcctgcagctcttttctgcttacagtgggataaggccttcccacgtgcgtctgggctcgctc

SEQ ID NO: 46244 - DNA, 35 bp, Homo sapiens
  chr20:55989687-55989722
  hypo
tgctagcagggtaagcgaagcgatggagggtgggt

SEQ ID NO: 46245 - DNA, 30 bp, Homo sapiens
  chr20:56041897-56041927
  hypo
tccacatcctagtcccggcacgttttgagt

SEQ ID NO: 46246 - DNA, 23 bp, Homo sapiens
  chr20:56053945-56053968
  hypo
gttatccaaattagccgggcacg

SEQ ID NO: 46247 - DNA, 30 bp, Homo sapiens
  chr20:56065208-56065238
  hypo
gattcattggttgggcgtggtggctcacgc

SEQ ID NO: 46248 - DNA, 30 bp, Homo sapiens
  chr20:56265981-56266011
  hypo
gatgcctctacaccccgaggcctggggatc

SEQ ID NO: 46249 - DNA, 180 bp, Homo sapiens
  chr20:56271495-56271675
  hypo
tcaaatcctgctctgcggtgtgctgggcaatccctggcaggtgacttagctccacctcctccatgcgatggggttgccatgaggattagtgagacagggtgtgcaaagagctcagtgagcacctgccactgtcagtaggaattgctagggttcaaaaagccgcgacgtcaccggcaagaa

SEQ ID NO: 46250 - DNA, 30 bp, Homo sapiens
  chr20:56385780-56385810
  hypo
tcggttgggagcattcggctgctggtaata

SEQ ID NO: 46251 - DNA, 90 bp, Homo sapiens
  chr20:56766160-56766250
  hypo
cccccaacacatgcacgtgccaagaaccagtctggtcagttagaatcctccatcctggccgggcgcggtggctcacgcctgtaatcccag

SEQ ID NO: 46252 - DNA, 30 bp, Homo sapiens
  chr20:56771631-56771661
  hypo
gggtgtctacttctccgaggacccagacac

SEQ ID NO: 46253 - DNA, 305 bp, Homo sapiens
  chr20:56771994-56772299
  hypo
cctttgtgctgcctccggagtgtcccactggcctgaagcttagcacaaccacactgagctggtcaccttcacctctagccccgctggcccatccatcttaccaccaccccgtcaccggggccacctctcctgggcctcctcctctcccactccaccccgtcaccggggccacctctcctgggcctcctcctctcccactctgccccgtcaccggggccacctcttctggccctcctctcccactccgccccgtcaccggggccacctctcctggccctccgcctctccctcgcttcttttctcct

SEQ ID NO: 46254 - DNA, 30 bp, Homo sapiens
  chr20:56780688-56780718
  hypo
cactccccacatctgcgcccacacctgaag

SEQ ID NO: 46255 - DNA, 40 bp, Homo sapiens
  chr20:56781064-56781104
  hypo
caccccacatccccgcgtctgtgcccgcacctgaagacgc

SEQ ID NO: 46256 - DNA, 30 bp, Homo sapiens
  chr20:56839640-56839670
  hypo
tcatcctggcagtagcgttccaagtcaact

SEQ ID NO: 46257 - DNA, 30 bp, Homo sapiens; identical to SEQ ID NO: 16627
  chr20:57198958-57198988
  hypo

SEQ ID NO: 46258 - DNA, 32 bp, Homo sapiens
  chr20:57268913-57268945
  hypo
ccgcccacttcatcacgcggctggtgcggacc

SEQ ID NO: 46259 - DNA, 38 bp, Homo sapiens
  chr20:57392369-57392407
  hypo
gagcgggggctttcccgaggaggcgtcagtgagggtgg

SEQ ID NO: 46260 - DNA, 30 bp, Homo sapiens
  chr20:57398016-57398046
  hypo
tggccccagcacctgcgctcttgcctgccc

SEQ ID NO: 46261 - DNA, 76 bp, Homo sapiens
  chr20:57622769-57622845
  hypo
caatttccctagggacgatattccccaggggacattggcactgtctggagacatgctcggttgtcccaactggtgg

SEQ ID NO: 46262 - DNA, 76 bp, Homo sapiens
  chr20:57622905-57622981
  hypo
cacaagttggcaactgactccctgccccaacaaagagggatctggccccaaatgttgacaacgtcagtgttgaaac

SEQ ID NO: 46263 - DNA, 51 bp, Homo sapiens
  chr20:57699771-57699822
  hypo
acctcagatctctctcgtgtaaggggctggccccttcgagaggctcagtgt

SEQ ID NO: 46264 - DNA, 197 bp, Homo sapiens
  chr20:58283870-58284067
  hypo
gataactgcagtaaacgttcagaaaagggacgatgaactgtcaaatgatcgctaccctgaagttctcccatgcaaatacagtgacattcccttctctgggggaaagagagttccttcattgagctggtttggctccatgggactaccttccagtcttcattggccttcttcattggctttagcgccacctttctgaa

SEQ ID NO: 46265 - DNA, 159 bp, Homo sapiens
  chr20:58311576-58311735
  hypo
gctcacccgcccacccgtgtaggtgcacacccacccatgcccatgcatgctggctctgcagttgctcacccacccaccctcagagatacacacctacccactctgtgcacacctgcccaccagcatccgcaggccacaccgtgccgtggatgaccacac

SEQ ID NO: 46266 - DNA, 68 bp, Homo sapiens
  chr20:58348402-58348470
  hypo
cacccacggggtctccgcatctcaccacggtccaccggcctcttcccccaagccgcgtcattgaggag

SEQ ID NO: 46267 - DNA, 317 bp, Homo sapiens
  chr20:58507720-58508037
  hypo
tccgtctcgggaaaaaaaacaacaaaaaaaaaccacgctgccgtattcgcagatgctcggccagcctggagcccggtccagaaaaggccgcacgtggagccacgtgtcgcgcattgagccgccgcgggacgcatcaggcccagctgcgcggaggggctggcggcctcaaccgcaaggagaggccgcaggtggggacggcgggagggagagaagggactgaaggcgccgagcaggaggaaggttttgcgcgcactcccttcttccctaagtggaaccggcagtggcaacaacgaggccgaaggcgaagtccctgctcc

SEQ ID NO: 46268 - DNA, 303 bp, Homo sapiens
  chr20:58514097-58514400
  hypo
ggatccagctctcttcgcactccccgcgaggcatgtgcagcgcgtggttgcgacatgtgaggctgtagtctcggtggtcgttgttgtcccagtactcggcacccgccacttggtagcgcaccgcgaagtgcacgcgggagccgagctccagcaggaagggcggtactggaaagccgaaggtgaaaacgtcctccgtgccctcggggcctgcgggcccgcgccaccgcgccaccgcctcgtgggtactgcgccagcccgagaaagtgtagcgcacagccacctgcttctcgaaggccacgttgc

SEQ ID NO: 46269 - DNA, 30 bp, Homo sapiens
  chr20:58671797-58671827
  hypo
tttttttttcacgcacgtgtccctttgcca

SEQ ID NO: 46270 - DNA, 99 bp, Homo sapiens
  chr20:59005702-59005801
  hypo
agaatcccattctcacggcggcttgcaggaccccatgtgatctcctaaccccctatatctcccctccacactcttccctcctgccgctctcacccctgc

SEQ ID NO: 46271 - DNA, 31 bp, Homo sapiens
  chr20:59185805-59185836
  hypo
agccaccacgcccggccgagtaaaagtttct

SEQ ID NO: 46272 - DNA, 185 bp, Homo sapiens
  chr20:59232938-59233123
  hypo
tccatgtgccagctccggacctgtttttaactcatcggcaacatttttaaaaataaggtatttcacataaaagtcagtatgtccaggttttggggggaatgataagattcagtatcaaggggctcctgttcccagatggaaggaaacgggcagggccgcccttcacacagcgttgctccgtccag

SEQ ID NO: 46273 - DNA, 30 bp, Homo sapiens
  chr20:59598638-59598668
  hypo
tgcaggctcctagttcgaagctgtgatgtt

SEQ ID NO: 46274 - DNA, 185 bp, Homo sapiens
  chr20:59708146-59708331
  hypo
agctcagctggcccacgcaagttccacactgacacagggcaagggaggaagccaaccagggaggccgtgccgaggaagaaaagcacaaaagtattgctaaaaatgtacaggagaaaagagaggatgagaaggatcaggatgtgaggcagaatatgcttagctgccaacagcgcatggcagtatcc

SEQ ID NO: 46275 - DNA, 94 bp, Homo sapiens
  chr20:59821803-59821897
  hypo
ccttgccgggggtcccgcaggcctctctgagcagaagcctgtgtgccgagcagccatcagccatcagggcatctggggccgaatgttccaaatg

SEQ ID NO: 46276 - DNA, 30 bp, Homo sapiens
  chr20:59855416-59855446
  hypo
ccaatccctctctggcgcctcccaaggcgg

SEQ ID NO: 46277 - DNA, 30 bp, Homo sapiens; identical to SEQ ID NO: 16632
  chr20:59910323-59910353
  hypo

SEQ ID NO: 46278 - DNA, 30 bp, Homo sapiens
  chr20:59967982-59968012
  hypo
tgcagatactcaccccgatacccaccaagg

SEQ ID NO: 46279 - DNA, 70 bp, Homo sapiens
  chr20:59973035-59973105
  hypo
aggctgaccgcatgccgagctgcgtgcctgggaaccacatggcaagcttcacctgcgtgtcctgaaccag

SEQ ID NO: 46280 - DNA, 158 bp, Homo sapiens
  chr20:60120725-60120883
  hypo
tttggcaactggtgccgctcatgcttggcgccagcgggcaggaggcagctttgtcctgcacaccgagacagtgtgcttgtgtatgtgagtgtgtgggggtggggtgtgtgtgcatgtgtttggggggtatgtgggatacggtgcgtgttcacatgtgt

SEQ ID NO: 46281 - DNA, 30 bp, Homo sapiens
  chr20:60121193-60121223
  hypo
gtatttgttcacattcgtgagggtgtgtgc

SEQ ID NO: 46282 - DNA, 30 bp, Homo sapiens
  chr20:60122026-60122056
  hypo
gacagcagtgatgggcggtgcctcttagga

SEQ ID NO: 46283 - DNA, 36 bp, Homo sapiens
  chr20:60162590-60162626
  hypo
ggcagggttccaggccgagcgcggggaggttagggc

SEQ ID NO: 46284 - DNA, 30 bp, Homo sapiens
  chr20:60174306-60174336
  hypo
gtgccctctttcacccggctgagcgggcag

SEQ ID NO: 46285 - DNA, 159 bp, Homo sapiens
  chr20:60175455-60175614
  hypo
cctggcagggtccttcggggtcctggctctggggccttgagggagtcactctagtggctgagcctgagccatctctgcaacgggagccatagtggtgctcaggtggcgggacagcggtgagaatctaattcagaaatgaatgcccgcaactcaccctgc

SEQ ID NO: 46286 - DNA, 30 bp, Homo sapiens
  chr20:60176588-60176618
  hypo
cggccctgctcttcccggggcctgttcaga

SEQ ID NO: 46287 - DNA, 30 bp, Homo sapiens; identical to SEQ ID NO: 16634
  chr20:60202364-60202394
  hypo

SEQ ID NO: 46288 - DNA, 30 bp, Homo sapiens; identical to SEQ ID NO: 16635
  chr20:60202615-60202645
  hypo

SEQ ID NO: 46289 - DNA, 30 bp, Homo sapiens
  chr20:60210184-60210214
  hypo
gcttcctgttccttacgatgtctgctgaga

SEQ ID NO: 46290 - DNA, 164 bp, Homo sapiens
  chr20:60225027-60225191
  hypo
gccttctgcctgcgccggagccctgagtctccccaggttgtgccagcagctccactctcctgggcacatttcctaaatgggcagtcagcggctatcccagtcttacctgcctctccttcttgcctcttccagtgtattctcctccatgccgctgcccggcccat

SEQ ID NO: 46291 - DNA, 182 bp, Homo sapiens
  chr20:60227182-60227364
  hypo
cgcttttaatgtcaccgtctctttattaaagtacataatatacactcatgataggaagagctgaaaatactggaaagaaaataaaaatcctacagaaccccagtatccacgtgaaactatggtgacaccttcgaacagttccttccaccctcttactcctttgtatacgcagctatgtatgt

SEQ ID NO: 46292 - DNA, 33 bp, Homo sapiens
  chr20:60235486-60235519
  hypo
atcgaaggcaggtgacgccgggactcgcttgca

SEQ ID NO: 46293 - DNA, 158 bp, Homo sapiens
  chr20:60237356-60237514
  hypo
cctttctggagccatcgctggcttcctggagccgcacagcgcaacctctgtcagggcaagtgtagcaccaggttgtgctgtccaattaatgatgaaacaacctgtcctcaacgttctcagctccgtgcgcggcttcaccattccgagcttgggaggac

SEQ ID NO: 46294 - DNA, 148 bp, Homo sapiens
  chr20:60238291-60238439
  hypo
cagaggagctttcatcgagggcttggcgcccacgacaaatgagtccacgcaggaaaggagtggcacccgcaggaggcctgtgctgcggagctcctgggagggtgacgctggggcaggggctgctgcggacaagcgttgggaggcctct

SEQ ID NO: 46295 - DNA, 199 bp, Homo sapiens
  chr20:60238848-60239047
  hypo
gggcaccactgaacacggggtaaaccaatcaccagtcactcccacgctgggtcttccagctccctcgaggccgccctggccctccacactcccaccgctggcgccagcatctgtgcccgcggcagtttagagtgacactgtcctctgtccagcaccggtccacgttgaggtgtctgtgtgccaccgggacccttccgta

SEQ ID NO: 46296 - DNA, 169 bp, Homo sapiens
  chr20:60243965-60244134
  hypo
ttctcatcagagcaccgtccgccagcccctctctccagtctgtccttgggacaaccctgggaagccagtgggacaggtgttccaggaggacccctgtccagcgaagctcagggctgcggcaggccggcggcaggtcaggtccttccttcaccctcggggatggtgcctg

SEQ ID NO: 46297 - DNA, 54 bp, Homo sapiens
  chr20:60281411-60281465
  hypo
caccacccgaggcaccgacaactgacagaaaactgcagccggcctcatttgccg

SEQ ID NO: 46298 - DNA, 71 bp, Homo sapiens
  chr20:60281806-60281877
  hypo
ggttgggaatctcaccggaactggctcgggcaggacgttcatggtgaggttccaaccggaatgagtcatgt

SEQ ID NO: 46299 - DNA, 183 bp, Homo sapiens
  chr20:60304145-60304328
  hypo
agccctgttgctctgcgagcgctgactgcagcgtgttttgacaagaggccctggcatctcacaagcccaggagtcctcggtgcatggcgcattggtggctggatttgccactattattctctgctcactcctgtgttggcgtgagtgggaggacttcattagcgacatcgcccacatcaagag

SEQ ID NO: 46300 - DNA, 82 bp, Homo sapiens
  chr20:60329634-60329716
  hypo
tgcaggcacactgcccggaacaccacacacacggtgcacggcacacacaccacacacacacgccccacacaccacacgcaca

SEQ ID NO: 46301 - DNA, 56 bp, Homo sapiens
  chr20:60355322-60355378
  hypo
cctggagggttttcccggtgcacccaacactcccctcagcccggctactccctacc

SEQ ID NO: 46302 - DNA, 130 bp, Homo sapiens
  chr20:60359749-60359879
  hypo
gtaatcccagttcctcgggacagttctcaaggccctccgatatcctgtgcccccaggagaatgtaagcccagttcctcggaacagttctccaggccctcagatgtcctgtgcccccggggcctcatcaga

SEQ ID NO: 46303 - DNA, 411 bp, Homo sapiens
  chr20:60374909-60375320
  hypo
agcctcataacaccacggtccctgcggggcctcgagtggggcctctgcagtggctctgccccgctccccatctctcatgcaacctccctgagagcccagggccatctccgcttgtcttcatggcccgtcccttcccatgacccgctcggctgcagcggccctcggtgggcacagtcaccgggccggcttccccgcctgtgcttcctctgaggggttccccagcccacagcatggtccagggccgggtggggccagcatcctctactccctccttgaagcctgtgcagggctgcatcttctttgtgtgcaagcaagcgagcggcctgcagccccaagggccctttgtgagtgctgcaaagccccgaagaccagaccgcactccctcgagtgcacacacggtgcttctgggaa

SEQ ID NO: 46304 - DNA, 164 bp, Homo sapiens
  chr20:60385207-60385371
  hypo
gacctgttctcaagacggagacagagatgggtgagggaggccgggccagccacactaacatcccactggcagaccccgggaaaggccatggccacccacatggatgtgtgggtatggccacatgtggctatccaccgggccagtcggggcggctgtgccaggct

SEQ ID NO: 46305 - DNA, 243 bp, Homo sapiens
  chr20:60415719-60415962
  hypo
ctattcacggcccatcgtgggcttctgcggtgtttgtctcatttgccagacacaaatcaagtggaaaactgttctcccctgatctggtggattcactcgcacagtatttcttcttaatatggtaaactgtgggagaattcagagcattttgagagctgatgctcagagcccgtggatgcacatcacccgcagccacccgctgcccgccatatttcagaggcggccaaacgggcctggagaata

SEQ ID NO: 46306 - DNA, 72 bp, Homo sapiens
  chr20:60428149-60428221
  hypo
accacaggtgagaagcgattgcagccacagcagggccaacgggctgggaagaaaacccgggcactgggagtc

SEQ ID NO: 46307 - DNA, 30 bp, Homo sapiens
  chr20:60439765-60439795
  hypo
gtggccccagcttcccgggcagacccttat

SEQ ID NO: 46308 - DNA, 30 bp, Homo sapiens
  chr20:60447479-60447509
  hypo
ccaaggctggtgtggcgagagtccttcatc

SEQ ID NO: 46309 - DNA, 241 bp, Homo sapiens
  chr20:60448710-60448951
  hypo
ctgcccaggtgtgtgcgggggtggcagcctgtgtggcaggccatccccatctgagctgctgtctccgttccaggcacctacgtgatgaccgtcacggccaacgatgctgacgacagcaccacggccaacgggatggtgcggtaccggatcgtgacccagaccccacagagcccgtcccagaatatgttcaccatcaacagcgagactggagatatcgtcacagtggcggctggcctggacc

SEQ ID NO: 46310 - DNA, 30 bp, Homo sapiens
  chr20:60449466-60449496
  hypo
gtgctgggttccatgcgctcccacctcctg

SEQ ID NO: 46311 - DNA, 152 bp, Homo sapiens
  chr20:60452936-60453088
  hypo
tccattgtgtgacaacgcgtctttggctgggaggacccccaggcaggggatgaggtgtaacccaaatgaggcccggccccaagcagactgtgacagggtcatcaccaggaaccacgggggccccagagggaggacttcgtggacacagacgg

SEQ ID NO: 46312 - DNA, 166 bp, Homo sapiens
  chr20:60453925-60454091
  hypo
gtgccgaggccagggcgcccctcgccagggctctgctttcagtgtgggtctgtgcttaatgttcagagctgccctgctcttccttcgcccacctcctggggaaattgaatgatggtttataattataaccgcttctgcagcagaggatgcacgttgtcggattttc

SEQ ID NO: 46313 - DNA, 136 bp, Homo sapiens
  chr20:60454749-60454885
  hypo
taatgaggaggtgaacgtgccgcccgagccccgtcctgaaggtgagagtgggctctgcagacgcaggcgctgttccgattgttgggcagtgaaattagcaccgggccagcattgttctcagcgtcccttccaggct

SEQ ID NO: 46314 - DNA, 30 bp, Homo sapiens
  chr20:60457286-60457316
  hypo
ggctgaccatttgcacgtgggcggtgccac

SEQ ID NO: 46315 - DNA, 231 bp, Homo sapiens
  chr20:60477306-60477537
  hypo
cagaaaaggtcaagccggggcctctgaaaccaggacccccggggcctccattccaggagaagcagcctcactctgcccttcaccagccacggagacccggggtctatgggcagtgccctaaatgccagccatgccctggggcacgcggtcaccaccccgcagaaccgctcccgtgctcgttgcaggagtgcaagggcagatccacagaggagcgtgcggggccccaccttc

SEQ ID NO: 46316 - DNA, 30 bp, Homo sapiens
  chr20:60492778-60492808
  hypo
atggccacgtgtgggcggcagccatgctga

SEQ ID NO: 46317 - DNA, 30 bp, Homo sapiens
  chr20:60495131-60495161
  hypo
gtgtcacggtgattgcgtggaagcatgttg

SEQ ID NO: 46318 - DNA, 111 bp, Homo sapiens
  chr20:60502200-60502311
  hypo
catttttacatggttcgcctgcctcagtcaaaacacgtggttgttaacgtcaggtcaggagctgccatcaggagcaaagctacagtcagaacatgccgccaccaccgccgc

SEQ ID NO: 46319 - DNA, 40 bp, Homo sapiens
  chr20:60502586-60502626
  hypo
gcagcagttcttccacgcgatcatgcgtctgggctcaggg

SEQ ID NO: 46320 - DNA, 228 bp, Homo sapiens
  chr20:60502832-60503060
  hypo
ggctgtgagtttccacgtgaatgccacaccccgctgtgtgcgtgtgtgcaggtgtgggtgtggccgtgtgctctgccgtgtctgttgaggtgccgtgcgcagtggctgtgtgcgtgtgtgcagctgcgggtgtgggtgtggccgtgtgctttgccgtgtctgttgaggtgccgtacgcagtggtgtggctgcccatggcgtgtggcagggtgtcggtcaggagccatg

SEQ ID NO: 46321 - DNA, 179 bp, Homo sapiens
  chr20:60515823-60516002
  hypo
cgctgtcctaggctgcgggaaaacagaaagaacaaagccaggcccgctcctcacacctgtgggcccacatgccatctgtctcaatgttttaaagggtttagaaggtatccatgaaactaacaagcaaaatcacattcccctcctaccttggcatatacacctcccggactccatggaat

SEQ ID NO: 46322 - DNA, 107 bp, Homo sapiens
  chr20:60552230-60552337
  hypo
ccacacacacgacaccgcccagcggggcgcgcgccacacacacacaacaccgcccagcggggcgcgcaccacacacacacgacaccgcccagcggggcacgtgccac

SEQ ID NO: 46323 - DNA, 46 bp, Homo sapiens
  chr20:60578805-60578851
  hypo
ctggatctgctgaggcgtggtgagcatgatccggttgtgaggctgc

SEQ ID NO: 46324 - DNA, 740 bp, Homo sapiens
  chr20:60772977-60773717
  hypo
gagtaaaaactgcttcgggcgcagtggcgccgtcctctacatccgggtgagccgagactgccggacctggccctgtccccgttgttctggatcatccagctcctgggggccaccgtgtgacccacggggcccctgtggcttgatgcccacagctaggaaacagcacaatggaaacggaggctggcagacagcgggaaagcagccccacccctcaaagcaaacccagacgggcatttgtaccagggtctcacaccatgtgcatgtctagtgaaaaagtcatgaaacgattctcttttaaaaagagggagcccacggcacggacgcttcctccgtctctgaccccatgagccgacctctgactgagggaggccactggcacccagcgggcctgcgtctccttcgcgagctgaattcactcgtctcttagatgttttttctggtgcttcagttcacactaacgttttagaaacactatttgaaaaagccctttgtgcagtcagaagggtgtgtacgcagccccgtgaaagccctggagcactgggaccttttccttgtgctccggagctgttggcagaggtgagtggggcgggcagctgcccggggcacagtccgctcttgtcttctttccttagcgcttgcttcaggaatgggttaaggcctcctttcctcactgctggtagagctcagctgatgagtgcctgctgttccccaggtccccgtgggcacgctggtgaaggagg

SEQ ID NO: 46325 - DNA, 179 bp, Homo sapiens
  chr20:60781327-60781506
  hypo
acatgctgaggcaaccggagcgtctcatcagtgaacacacgtgccggggacctgtcctggtgccgctaaagaggctgcagagccgcggggtgcggcagtgcttggcgggggcggggtgcagctctgcgtgcatggcgtccacctggggaccgcaggtgtcaagccggggagagccagtg

SEQ ID NO: 46326 - DNA, 211 bp, Homo sapiens
  chr20:60789965-60790176
  hypo
tctctcctcaaagcacgaaggctctgagcaccccacaaagtcctcaggaatcagcaccaataaaaaaatacactttattgtgacctcacggtttgcagggcagcgcagcgggcacaggcagaggagcatgcagagcgcgtggcacgggtgcacagcacatggcgaagcggcccctgcccgggcacctcctctggaccgcccctgcacgcct

SEQ ID NO: 46327 - DNA, 34 bp, Homo sapiens
  chr20:60803825-60803859
  hypo
ctatgtgtgtgtgcacgtgcgtctgtgggtctgc

SEQ ID NO: 46328 - DNA, 27 bp, Homo sapiens
  chr20:60816241-60816268
  hypo
tttgagatggagtctcgctctgtcgcc

SEQ ID NO: 46329 - DNA, 66 bp, Homo sapiens
  chr20:60921238-60921304
  hypo
tgccatccgtgaagtcggactcgcagttgcagcctgggcaggggcaggagccgggtaagcctggag

SEQ ID NO: 46330 - DNA, 41 bp, Homo sapiens
  chr20:60921597-60921638
  hypo
gagagcggtagaagccgggcaggcagcgctcacagttgacg

SEQ ID NO: 46331 - DNA, 61 bp, Homo sapiens
  chr20:60921962-60922023
  hypo
actcacactggcactcgttggcactgttggcagtcgcaggcttccacggctgctgattgaa

SEQ ID NO: 46332 - DNA, 260 bp, Homo sapiens
  chr20:60925281-60925541
  hypo
cactccctgctgtcacgagctgcgtccccacttggcacttaatttcccaggacaagttagctctgctggagctcagcacctgaagctgtgctggcagcaacaagtgcctgggtgggtccccagggcccacagctcctggcaaacagcccaagtcctccggctcaggtgactgtgccactcctcccctcagacccaccagccacatccgaaggggcccagggctcccgcctctgctcggcactggccgtgagaatgggagt

SEQ ID NO: 46333 - DNA, 110 bp, Homo sapiens
  chr20:60925847-60925957
  hypo
cccagctgcctcccccggaacaggtgctcctgaggccgggctggggtcccaccctgtgttcccattcccaggaaaacggcccagcgtgtgttaggcgctcaacatacagc

SEQ ID NO: 46334 - DNA, 228 bp, Homo sapiens
  chr20:60953312-60953540
  hypo
caagacaagcctgggcgactcacctggggcaggaatgtggattccatcactccgcagaggctttcaagcaaaacacagcctcgtctctgggcctgtttctgccgtgcgggcacgtccagcccgacgctctcagaagcagctgggatgggctcggggaggtgggggtggagcaggagtcccagccgccttcctctggggcccatcccaggctcccggctgggcgccagc

SEQ ID NO: 46335 - DNA, 50 bp, Homo sapiens; identical to SEQ ID NO: 16653
  chr20:60970933-60970983
  hypo

SEQ ID NO: 46336 - DNA, 271 bp, Homo sapiens
  chr20:60983859-60984130
  hypo
gagaacagaaaggggcgagtgagggtggagggcaggacgcaggaggcaggaggcagctgtccgtgctggctgcagcgccgggtcctggggatcggctgtgcagtaggggggcccctagccagttcttctttgctggcgctaagctagactttgagggacaaggaggaatgctgaggaaggaacggggtctcttcctgggtctggtgaacccccttgctaggctcccgctgccagtcttctcccctccccagggtgtcgatgggtggccaaa

SEQ ID NO: 46337 - DNA, 30 bp, Homo sapiens; identical to SEQ ID NO: 16655
  chr20:60984485-60984515
  hypo

SEQ ID NO: 46338 - DNA, 518 bp, Homo sapiens
  chr20:61288016-61288534
  hypo
gggacccatgaggtgcggtacgtctcggccgggcagagcgtggcgtgcggctggtgggccttcgcaccgccgtgcctgcaggtcctcaacacgcccaagggcatcctgttcttcctgtgtgcggccgcattcctgcaggggatgactgtgaatggcttcatcaacacagtcatcacctccctggagcgccgctatgacctgcacagctaccagagcgggctcatcgccagctcctacgacattgccgcctgcctctgcctcaccttcgtcagctacttcgggggctcagggcacaagccgcgctggctgggctggggcgtgctgcttatgggcacggggtcgctggtgttcgcgctgccccacttcacggctggccgctatgaggtggagttggacgcgggtgtcaggacgtgccctgccaaccccggcgcggtgtgtgcggacagcacctcgggcctgtcccgctaccagctggtcttcatgctgggccagttcctgcatggcgtgggtgccacacc

SEQ ID NO: 46339 - DNA, 319 bp, Homo sapiens
  chr20:61291131-61291450
  hypo
ggccttttgccctcccgccgctgcctcactgtgaagacacatccccgaaagcccagagcttgtcctcactgtgaagacgcgtccctggatgcccagagcttggatgggcttctaccactccacggccgcctcagcccatggttattttccactcgccttttcgtttgaaagcacttatgtgcaaattgccacgtgcacaacagtcccttcgtggggagctctcagtgagctccagctgagccctctggcgtccctgggaaccccatctgtcatcctctgcactgtggggagggatgcctcctcccgctgttgcctggag

SEQ ID NO: 46340 - DNA, 295 bp, Homo sapiens
  chr20:61294577-61294872
  hypo
taactagggctgcaccgtctgttcctgattcttcagaatccatttacatttggccacctcctcaaacaagagcatttgaatgttccaggcattcagagttgcgttcatcggaaccaggctctaggtgtggccgagaggaaagagccgccctcctgcaggtgggggtgatgtgaggccgacagtctgctctggtgagaggctggaaagtgtaggtttacaggatgtcactaagctgcagacgcaggggttcaagtcagcgacactgcggtgtgagcagaggcgacatggacatgtc

SEQ ID NO: 46341 - DNA, 84 bp, Homo sapiens
  chr20:61305619-61305703
  hypo
gtggcactgagcatccgtgtggaggtgtccatggggccctcggggagactcatgggagctgtcagcctgcgggctgagctgaga

SEQ ID NO: 46342 - DNA, 30 bp, Homo sapiens
  chr20:61305919-61305949
  hypo
ctgactcacagatgacgattccaagggtct

SEQ ID NO: 46343 - DNA, 50 bp, Homo sapiens
  chr20:61312710-61312760
  hypo
ctgcttatactcactcgtgtgcgtgtgtattaagccgtgtcacttgtgtg

SEQ ID NO: 46344 - DNA, 34 bp, Homo sapiens
  chr20:61314672-61314706
  hypo
tcctgcagagccagccgctcgctgctggccatgc

SEQ ID NO: 46345 - DNA, 30 bp, Homo sapiens
  chr20:61318633-61318663
  hypo
atgaagttgaccaaacgccacacagccacg

SEQ ID NO: 46346 - DNA, 115 bp, Homo sapiens
  chr20:61321299-61321414
  hypo
ccccaggggctgagtcgacgcctgcagccagcgcctgcactcctgttcacatgggcttccctggcctctgtgcctgctttgcgcctgcgcggcaggtgaacgaccccagccccct

SEQ ID NO: 46347 - DNA, 160 bp, Homo sapiens
  chr20:61329188-61329348
  hypo
ggggctgggctgctgcgggatgaatgcctggccagtggtggggacatgtcttacaggcagcacagaacacacctgagaggataaaagctcatgtggtctcagcacctgccgatggagtcggggggtgagagagaataagaacacccgaaaaaatcaggga

SEQ ID NO: 46348 - DNA, 131 bp, Homo sapiens
  chr20:61330920-61331051
  hypo
ggctcccaagtggaccgggaaaggctcccgagtggaccgggacaggctcccgagtggaccgggacaggctccctctctcttgctgctgggatgtctccccgggagcttgcgtctctcgccaccctcacctc

SEQ ID NO: 46349 - DNA, 30 bp, Homo sapiens
  chr20:61368079-61368109
  hypo
catgcacacacctggcgtaggagttacttc

SEQ ID NO: 46350 - DNA, 136 bp, Homo sapiens
  chr20:61374450-61374586
  hypo
gctgggaggggagcacggagccgcccctgctggacacgtatcccggccatctcaggcccacccattgcctcattgctccctgcccccggtccagtcagctgagtgccccgtggtgtgggtgcgtcatgccatggcg

SEQ ID NO: 46351 - DNA, 215 bp, Homo sapiens
  chr20:61393835-61394050
  hypo
tatctgtgcacttaccgtaggtagggacacgtgtccacgcaccacagacacacccacgacacctgatctcgtatcactagcttgcggccaggtcatgatgtggccccggaagctggccctgcgtgccatgagtgcgtcggtcatggagtccggagcccctgagccggcccctggtgacggcacagccctcacagctcaaacgcccacccccactc

SEQ ID NO: 46352 - DNA, 22 bp, Homo sapiens
  chr20:61411096-61411118
  hypo
agttagaaagctcttcgttgtg

SEQ ID NO: 46353 - DNA, 156 bp, Homo sapiens
  chr20:61412187-61412343
  hypo
gagcccaggtgccaccgagggaatgcaacgtgccacaccccaagacatgacacttgtgagaacagtgtggcccagcccccactccgggcacagcctcggacaccctgcccgcctccgcccatggaggtgcggcctgcaaagcgtacctgccgccgc

SEQ ID NO: 46354 - DNA, 30 bp, Homo sapiens
  chr20:61424994-61425024
  hypo
taacggtgagggtcccgtctcccgagcgta

SEQ ID NO: 46355 - DNA, 58 bp, Homo sapiens
  chr20:61472103-61472161
  hypo
agtgacaaggacgcccgaagcacagtggacggtcatgaaggagcgggggtgtggcagg

SEQ ID NO: 46356 - DNA, 685 bp, Homo sapiens
  chr20:61505851-61506536
  hypo
cagggagaagcccaccgaccctgtggggctggtccctacaggggcatgtgggaagatcccagtgaagctgaggaccacgagccctgcaagtccattgggatctgccggtgaactccgcaggtcgtctttgaaggcacatgtggctcttctgccactgcctggggagctgagacccctttgcccaaagaccctcaagtgccttccctagggagctgccctgtaaggtgccgccgtcctgcccgggactcaccaccacctctgtgttccttctagacctagatccagactggagttccagcaggccccaaaagagaaagtgtgaggtgtggcctacaaatatgtttccctacgaaaacctgcggaaaatgtgtggaaatcgatgttgagagtgcgggatctgggtgggaggaatataagcttgcgtaagtggacagggactcagatacgagattctggatttgatgcgttggagggaacggctgggagtgacccaccccccacccccattttcttcatcagtcaccgaaactttcgccccacaggtagctgaccctaaattcagtgaaatccagaactttcctggcacactggagaggacggcagaacgctgggatggatttatcgtgcaagaccagcttgatgtccttagggcttggaggtcaccccttcacgaggattgtgagga

SEQ ID NO: 46357 - DNA, 30 bp, Homo sapiens
  chr20:61541112-61541142
  hypo
ttatcccttggtcttcgctagacttctgct

SEQ ID NO: 46358 - DNA, 76 bp, Homo sapiens
  chr20:61567431-61567507
  hypo
ctcaagctttctgctcgtgcatccccttgcacactttctccttgacgttcaggctgggcatggtggctgacgcctg

SEQ ID NO: 46359 - DNA, 331 bp, Homo sapiens
  chr20:61570543-61570874
  hypo
ttttgcagttgacaacgaaagatgggtgttcgtgtgtgacagcgactcctggtttctcctccactttacctgccgctccacatcaagttttcttctgctggtgccactttctctgctttaccttcaaggttggcatcctccaagtaatggcgattctcattccctatctacgctcttcctatggtctttgctgaattcttggctttaaatatccctgtgccccagcaccgccccccccgccccttatttcactaattcatgttttcagctctgagctcaggatctgtaattcagacacctgcttgatttctccagacgcatgtctaatagt

SEQ ID NO: 46360 - DNA, 30 bp, Homo sapiens
  chr20:61571213-61571243
  hypo
aagtagtatgtgtaacgtatgtatcagtgg

SEQ ID NO: 46361 - DNA, 30 bp, Homo sapiens
  chr20:61618995-61619025
  hypo
ggtgaacacggagctcgggggacacgacca

SEQ ID NO: 46362 - DNA, 39 bp, Homo sapiens
  chr20:61655625-61655664
  hypo
agttatgtgaacagccgccaccctcgtgcgggcaaaagc

SEQ ID NO: 46363 - DNA, 30 bp, Homo sapiens
  chr20:61666827-61666857
  hypo
ctgcaggggactgaacggggctctgaaacc

SEQ ID NO: 46364 - DNA, 105 bp, Homo sapiens
  chr20:61695646-61695751
  hypo
ctgacctgcatgggccgaggtcctgcaagagaacgggctccatttgcgtctgagggccaggatgcctgcactggggatcacgctgtgcttcggatggagcctcca

SEQ ID NO: 46365 - DNA, 189 bp, Homo sapiens
  chr20:61714761-61714950
  hypo
tcagggggttccagccgaggctttgtgaaccggatcctgggtcactgagtaaccagactggtctcaggaggttccagctgaggctttgtgaaccagatcctgggtcactgagtgcccggaccaggggttcaggaggttccggccgaggctttatgaaccggatcctcctctttgcgtttcaaacagcgg

SEQ ID NO: 46366 - DNA, 136 bp, Homo sapiens; identical to SEQ ID NO: 16663
  chr20:61725275-61725411
  hypo

SEQ ID NO: 46367 - DNA, 34 bp, Homo sapiens
  chr20:61749778-61749812
  hypo
gtgtctactgcacgccgctcgctgcattgctggg

SEQ ID NO: 46368 - DNA, 71 bp, Homo sapiens
  chr20:61763598-61763669
  hypo
catgaagcttcccaccgggtaggcactcactatgtctgttacgccgggcgccggcccgagtcctaaagata

SEQ ID NO: 46369 - DNA, 30 bp, Homo sapiens
  chr20:61765333-61765363
  hypo
ccctggggctgggttcggccccagacgacc

SEQ ID NO: 46370 - DNA, 30 bp, Homo sapiens
  chr20:61799802-61799832
  hypo
ctggctcagggaaggcgctccccaagatgg

SEQ ID NO: 46371 - DNA, 30 bp, Homo sapiens
  chr20:61820146-61820176
  hypo
cccacttccctgctccgccaggctgctcca

SEQ ID NO: 46372 - DNA, 35 bp, Homo sapiens
  chr20:61823119-61823154
  hypo
aggagcctggtggctcgaggagcctctgaaccggg

SEQ ID NO: 46373 - DNA, 18 bp, Homo sapiens
  chr20:61838526-61838544
  hypo
cagctgcattaaccccgg

SEQ ID NO: 46374 - DNA, 102 bp, Homo sapiens
  chr20:61883273-61883375
  hypo
ggatgtctgccctgccggagccccggggggaaggtaagcgagccccccaaggggagcagttcttgccctggcccactttgcctacgccgggcacagttctgt

SEQ ID NO: 46375 - DNA, 33 bp, Homo sapiens
  chr20:61941734-61941767
  hypo
ggtggtggagggacccgccgcctccacggagct

SEQ ID NO: 46376 - DNA, 30 bp, Homo sapiens
  chr20:61965232-61965262
  hypo
ccagggcagtggggacgggagagctgggac

SEQ ID NO: 46377 - DNA, 563 bp, Homo sapiens
  chr20:61973846-61974409
  hypo
cctgagaggaggtaacgtcgatgcaaccacgttggcaaacccttcgtcagcagctcattgagccgaccacgcacccttccttcccacggcagagcgggagctcctgggtcagcctccctgccaaagtctgttcacagcagccccgagctggcgacgggtaaataagatggtggagccacgcggcggagcccgcagcacagtggccgcgcagcgagcaatgacccgggatcgggagccgacagaagggcacgcctggcgcggccacgcacagaacccagggccaggcaacgcggggcagaggtgttgggtgacctcgggcgggtcgtggccggccgggctgggcaggggattcctgggtgccggctctatgcgaatattcttcagtctgtgaaagaaaatgccttgtcatgccgctgaggattcatacgcacgctgtgtaccttaccccgcgaggcaggcaaatgccaagaaatgccagctcggattagcgcagcgggagcgcctgtctgcagacagggagtgtaaacggcacagtcacgtggaagacacgttggcattatctc

SEQ ID NO: 46378 - DNA, 626 bp, Homo sapiens
  chr20:61980710-61981336
  hypo
cctgtggcccctcaccgtgccgtccgccgaggcccactgtgtcccaaagccagagacggcaccgggatccaccctgtgccagccactcggggccccctgccccgctcagcctgggacctgcggccacatagcaggcttgggaagaggctgctgcagcaggggccacgccctgcaccccaaagcgaagcagcctgaggcctgggcccggctcctggattacacaccaggaagaaagggcgtccgccggttccgtctgggtcagaggcgcccaacacagccatgggcgggacttaccgagaagtctgtgtcttcggccttcaggtggtctgcaatgtactggacgccctccaccgcccgggtcagggccggcgacaggggcaggtgcgggggcggcgctttggtgctgcgggtcttgaccgtggcgctcggggacaccgaagagggctccttcttgcatgtgcatttgcacggagagggctggtctgggggtgggagctcagccgagtgggtgttgcgagaggccagggcgccggcagcctggccatctgcctcgggggcggcatcgtctcggggaacacagtactggatgctccgagaccggcaccggacgccgccttccaccgctt

SEQ ID NO: 46379 - DNA, 98 bp, Homo sapiens
  chr20:61982236-61982334
  hypo
tgcagttctgctggtcgaaggggaagaaggtgacgtcgatgctgcaggagctcttgtaaatggccgggggagtccactgcacccgcccgtcatggaac

SEQ ID NO: 46380 - DNA, 36 bp, Homo sapiens
  chr20:61982611-61982647
  hypo
ccacacacagaggcattctcacgtcacaggagcaca

SEQ ID NO: 46381 - DNA, 30 bp, Homo sapiens
  chr20:61986659-61986689
  hypo
caggcacagaaaacccgtttccatgaccag

SEQ ID NO: 46382 - DNA, 183 bp, Homo sapiens
  chr20:61990886-61991069
  hypo
cgccctcacctaccacgtcaatgagctgagcgatggacaggccgaagcggacgaggaccacgtccgagatgttggccacgggtcgggaccacttgttgtaaccggagaagagtttcttcaggagccgctcctcggcgtgggcccgggtctccacatggctgctggctgcggggagaggcaggc

SEQ ID NO: 46383 - DNA, 89 bp, Homo sapiens
  chr20:62011874-62011963
  hypo
tggaagccacttgtggtctgcctggtccagcgccagcctcacagggagccggcatgtggagctgtcctccctgccgcagccggcatgcc

SEQ ID NO: 46384 - DNA, 116 bp, Homo sapiens
  chr20:62031637-62031753
  hypo
ccccagaaccttccacggccatcgcggccgcaggaccccacacccgaagtcccccgcaaacccgcactggcgcattcttacggctctggcatcaacctgtccgtgtgagtaagtta

SEQ ID NO: 46385 - DNA, 392 bp, Homo sapiens
  chr20:62031973-62032365
  hypo
gacagccagaggcaacggcgcaaatggggaagctgcagccaccgtcacggccagaggatggcagactgcaatggcgtggggcgcgggcatggcgggcacacgtgggccgtgtggatcccgggcagagggatggcgtccagcgggaccaccagctctgggcgcctcagtgcgagacccctccgtgagacccctcctgccctgcgcgtgtctctggagcccgtcccttgggcccctcgcccgccccacctgttcgcagggtccagggcgtccgtacctggcacagccagggggcatggggcgacctcagggagttcctgtccacatgcattaaggcaacgactttgtaaaacccaggcggagttggcgtgtggcgatggcgatgtgcacgtgcc

SEQ ID NO: 46386 - DNA, 159 bp, Homo sapiens
  chr20:62033495-62033654
  hypo
ccaagtctcgtgagccgttcctctcacaccacgtctgctgggcaccctccacagcaggtccaagcctcgtgagccgtccctctcacgccacgtctgccgggcaccctccacggcaggtccgagctttgtgaaccgtccctctcacgtctgctttgaggg

SEQ ID NO: 46387 - DNA, 209 bp, Homo sapiens
  chr20:62037523-62037732
  hypo
gcccggaaaccccaccgggacccaaggccgcaggtcctcaccaaacaggcccgccctttgcgcaggtcctcagggaacaggcctgccctttgtgcctcccctgggctcggctgagacaaccccccgcctgttgccacgctggcaacaccccgtcatcactcccgcccctcctcacaccgggctgatgtcggccgcggccctgagcagag

SEQ ID NO: 46388 - DNA, 86 bp, Homo sapiens
  chr20:62038039-62038125
  hypo
tcgccggtggccgagcgtggcgggggcccgcacggggtacagaggtcggagtcggtgtctgactctccctccgcaatgtagggcct

SEQ ID NO: 46389 - DNA, 183 bp, Homo sapiens
  chr20:62038491-62038674
  hypo
gggcgcggccgggggcgccgagaagttcttctggcccgtggagctgctggagcgcacgatcttgacaatgcagccgtgcctgtcgacatgctcccggctgtcttccgggctgtggtacggcggcgccggctccggctctttggccccaaagtaggcctcggtctctgtcggggggatgcccat

SEQ ID NO: 46390 - DNA, 381 bp, Homo sapiens
  chr20:62046201-62046582
  hypo
caccacatccatccccggagaggatggaccaggagaggatgcggccacacccaccttctgagttctgccgtgacgcggcacccttgatgcggaaagcctggcgtgcccggctgcggtccccgaagctccagctcttgggcaccttgctggggctgtcctcgaggctctggtcggcgctgggtgaccgcctcacagtctgggcctgcggggaccccttccccttggcagccacgcctcgggggctggagaagacacgatctttcaaactgaccttctggctgctcccacgggaaccgacagacagacagaaaaacagggagagaagtcactctgcaaagaacacaggccgtgtctgctcatggccgacgccgcccatgcgcc

SEQ ID NO: 46391 - DNA, 54 bp, Homo sapiens
  chr20:62050926-62050980
  hypo
gagccgtgcagcagccgtcagtccgtgcggcgtgttccgcggtacctagagcgt

SEQ ID NO: 46392 - DNA, 30 bp, Homo sapiens
  chr20:62052467-62052497
  hypo
aaggaggcagggtcccgcttccccaaacct

SEQ ID NO: 46393 - DNA, 122 bp, Homo sapiens
  chr20:62053217-62053339
  hypo
gcctggctccccacccgaccccaacgtagacgcttcctctgactccagcacagccccagtggtccctacgggaaccgagcccccgccagccgggtcgcctgccaccacgtgcctgtgttctg

SEQ ID NO: 46394 - DNA, 38 bp, Homo sapiens; identical to SEQ ID NO: 16678
  chr20:62054264-62054302
  hypo

SEQ ID NO: 46395 - DNA, 42 bp, Homo sapiens
  chr20:62058718-62058760
  hypo
ttctgatgtcacacccgcgcttgtaggcgtttgccacagccg

SEQ ID NO: 46396 - DNA, 30 bp, Homo sapiens
  chr20:62090117-62090147
  hypo
caagttgaacctgctcgagagcccaggctg

SEQ ID NO: 46397 - DNA, 222 bp, Homo sapiens
  chr20:62090414-62090636
  hypo
tgaggtccgtccgtgcggccacaggaaggacgaggcagcggcccccagacacggagaggatgaaggagtaccctaaacacgaaggaacctgagggcaggctcggcaaggaaagccaggcacaaaacggcaccacgatgacaactccacttacacgaaacatccgaagcaaacaggccaggcccggcggccacgcctgtactcccagagcttggcgaggccga

SEQ ID NO: 46398 - DNA, 39 bp, Homo sapiens; identical to SEQ ID NO: 16681
  chr20:62097848-62097887
  hypo

SEQ ID NO: 46399 - DNA, 163 bp, Homo sapiens
  chr20:62115182-62115345
  hypo
ggcgacagagcgagactcaaaaaaaaaaaaaaaaattattcaccaacccaagtagggtggagctccttccgccacccatgccctccctgacttcaggacctgctctggggcctcagcggccccaggactgaccctgagtcccagtggccgccagtcagagcca

SEQ ID NO: 46400 - DNA, 413 bp, Homo sapiens
  chr20:62126061-62126474
  hypo
ggccctcgacctccccgtgccacctgccggtgcctcgctctgggccagggggtccagccagctcccgtggcccgccccgccctagccgccactcacgttgggggagggctccagcatgttgtcaccgtgccagccggagatgggcacaaagggcacggtggccgggttgtagccgatcttcttgatgtaggcgctgacttccttgacgatctcgtcgtagcgcttctcgctgtaggccggctctgtggagtccattttgttcacgcccacgatgagctgcttcacacccagcgtgtaggccagcagggcatgctcccgcgtctgcccattcttggagatgcccgcctcgaactcgcccacgcccgccgccacgatcagcactgcgcagtccgcctgcccggcaggggacacag

SEQ ID NO: 46401 - DNA, 30 bp, Homo sapiens
  chr20:62132074-62132104
  hypo
tcgagtggcccaggccggggtcccggggat

SEQ ID NO: 46402 - DNA, 96 bp, Homo sapiens
  chr20:62153366-62153462
  hypo
cagcaagcagaccttcgcatcaacacagcagacaccaaaaaccagtgagagccccgctctctaccgcccggccccagcactcgctagctttcctga

SEQ ID NO: 46403 - DNA, 257 bp, Homo sapiens
  chr20:62165598-62165855
  hypo
tcgttcaggtgcagccggcccccggcacgccgccagatcttgtagtgccgcacagcctgcgtgtcccgcactgggagggagagcgtgagctgtgtggccaccccaactccgacgcctccctgcgtccccagccctgctggccacacctgcgcagagtttctgggtccccacagttgctgttggtgcttcctcagtaccacccctgcctcccctccctcagaacggctccctcctgccctgcacgctctggccaagct

SEQ ID NO: 46404 - DNA, 30 bp, Homo sapiens; identical to SEQ ID NO: 16686
  chr20:62167765-62167795
  hypo

SEQ ID NO: 46405 - DNA, 237 bp, Homo sapiens
  chr20:62168240-62168477
  hypo
ctgggcactcctgggcgccagcgcatggggcctgcagggaggatcaagcgggatgcccagcctggactttggggtgcaggaagatggaaccggggtccccaccttcttgggcctccctgagcagcccagagccctgtccctcccctgtgcctagagggtggcctgtgccaaagctcccagcagcctaggacacgcacggttccgactccaccgtctccctctcggccaggtagttgt

SEQ ID NO: 46406 - DNA, 46 bp, Homo sapiens
  chr20:62170163-62170209
  hypo
atgtccaggaagcctcgagtatccctgagttcggacgtgcaggact

SEQ ID NO: 46407 - DNA, 252 bp, Homo sapiens
  chr20:62172062-62172314
  hypo
cagccagaggctcctcggtccggcagaccggcatcccttcgagttggcgctctgcagggaggaggggctggcctggctggagcccagagcgttgggtcacgtgaggactcaggggtggcatctgtggatggcgtgcagcttctcccgcagcgtggcgaaggagggccgttcctcggggctgctcctccagcactccagcatgagcacgtagacctccgccgggcaggcagccgggcgcggcagccggtaccc

SEQ ID NO: 46408 - DNA, 366 bp, Homo sapiens
  chr20:62172667-62173033
  hypo
cttggagctgctgctcggggagtagatgtcgtcctgggggcgagggaaggcccctggtagggcaggtggaccggggtcccctcacccaccccctctgggtcaggggcccagagcctccgctgaccttgagcagccgggccaggccgaagtcagccaccttgcaggccaggccgtcgtccacgagcacgttccgggcggccaagtcccggtgcacaacgcgctgctcctccaggtagctcatgccctcagccacctggcaggcaaagcccaggagtggcggcagacgcagggcccggccctcgggggctgcaggagacagcgcggggtcttttagggcacggggccaacggccggtgaggccagcgt

SEQ ID NO: 46409 - DNA, 83 bp, Homo sapiens
  chr20:62204292-62204375
  hypo
gggccagcaggatctcgcgggagcagtcatgctccaccctacggaggacgtaggtgctttcattgagccgctgggtgcagcgg

SEQ ID NO: 46410 - DNA, 56 bp, Homo sapiens
  chr20:62221347-62221403
  hypo
cccgagccagccctgcggcctctgcccgctccctgctgccgcggctgagagacagc

SEQ ID NO: 46411 - DNA, 35 bp, Homo sapiens
  chr20:62274577-62274612
  hypo
ctccttccaggtggccgcctcggaacccttcctcc

SEQ ID NO: 46412 - DNA, 87 bp, Homo sapiens
  chr20:62281540-62281627
  hypo
tcccttctttctcaccgccccctccccaccatccttccccttcactgacttcagggagttaaaaacaattctcgcagtgagctgggc

SEQ ID NO: 46413 - DNA, 30 bp, Homo sapiens
  chr20:62310644-62310674
  hypo
agccactgtcctcagcgtaatgctcaaggc

SEQ ID NO: 46414 - DNA, 30 bp, Homo sapiens
  chr20:62311251-62311281
  hypo
gctgcatcctggactcgctggaccagatca

SEQ ID NO: 46415 - DNA, 958 bp, Homo sapiens
  chr20:62320923-62321881
  hypo
ccacgcatggacccccgggttgtcctcaagatgcagttcctggatgagatgaagggccagggtggggctgggggccaggtgagttacagcagggtggggctggggtaaggcggtctggtgactgagcccccgccccgtggccaagggagcccccgtgaccgagccgcctcgccccacagttcctctctgggcaggagtggtaccggcagcaggcgtccagggctgtgaaccaggccatcgggcgagtgatccggcaccgccaggactacggagctgtcttcctctgtgaccacaggtgcgtgcagtccggtggcaggcgcggcgccaggggacacgcccacaccccactgggcccctggactctccttccccacatgaggccccgtctcctccagagcctctccggctactcggggtcagcgtggggcccctgcagcagatgagggtcttcacttcggtgaactgaacccttgaagcggctgtgggcagggcagcagggctatggccaccccccaggttcgcctttgccgacgcaagagcccaactgccctcctgggtgcgtccccacgtcagggtgtatgacaactttggccatgtcatccgagacgtggcccagttcttccgtgttgccgagcgaactgtgagttcctgcccagggaggggatgagggtgttgtccccagaggagccagaaatgggtccacccacccccatggttctgcagatgccagcgccggccccccgggctacagcacccagtgtgcgtggagaagatgctgtcagcgaggccaagtcgcctggccccttcttctccaccaggaaagctaagagtctggacctgcatgtccccagcctgaagcagaggtcctcaggtgcggacgggcagcgctgggtgggcggtgtgggggtggcggagcgggcggcgtggggcgggcagcaccaggcgcccagggcggagg

SEQ ID NO: 46416 - DNA, 30 bp, Homo sapiens; identical to SEQ ID NO: 16693
  chr20:62329526-62329556
  hypo

SEQ ID NO: 46417 - DNA, 30 bp, Homo sapiens
  chr20:62331916-62331946
  hypo
ggtccccaaagcccccgcaggtgcagcccc

SEQ ID NO: 46418 - DNA, 45 bp, Homo sapiens
  chr20:62340242-62340287
  hypo
ttcctaaagcagaggcggggccagaatctgcggcaggtgggcagg

SEQ ID NO: 46419 - DNA, 579 bp, Homo sapiens
  chr20:62383137-62383716
  hypo
atgaagccccgcccccggtgggtctccccatgaagccccgccccccggtgggtctcccatgaagccccgccccccggtgggtctcccggtggagctcggctcctgcaggtccgctccggaacctgctgactctcctgcgattcctaaactggcagcgatgctccagagcctcttccgccccgacagcagccccacctctgcccggagcccggggcgcctccactgcctctcctcacacagctgcccgccgcgagctccccctgcaccctgcgcctcggggtgggcgttccaggactccccgaacccttggggccgccccgctctgggctgcctgtgccccacccgcctcactggttgatctcacccacttgagatgccctcgccaggccttttttggcaaatctgcctccctgttcccaggctgcctttttctattatttcctccccaagcaaatccatccactccacacctgctacctgacaacgacctgccagtgctgagctccagggtgggcgcggtgggtgcagacaggtcggcaggcacaaggacagggttctccctcccgaggcagggcgggg

SEQ ID NO: 46420 - DNA, 266 bp, Homo sapiens
  chr20:62383922-62384188
  hypo
tgtgcagagtggacccggtgtggggtccggggcggtctgcgccctcatcaggacccgcctgcccggacatcgtggccacgcgcagcgcgcggcacgcggaccctccccgcactcaccagcgtgtggcgcttcatgtgctcgcgccgcgtgaacttcttcccgcagatctcgcaggggtagggccgctctcccgtgtgcgagcgcatgtgtcgcttgaggatgcactggtgcatggccgagaagctgcagtacggacacttgaactt

SEQ ID NO: 46421 - DNA, 30 bp, Homo sapiens
  chr20:62398516-62398546
  hypo
caccgccaaggacgccgtggcaggctttgt

SEQ ID NO: 46422 - DNA, 98 bp, Homo sapiens
  chr20:62400802-62400900
  hypo
ttccagaagcactgacgatcttcccggcatgcggtgtgagcccggtgatgccccaagggtctcgctggaggcaggtgtttgaacgctttgatcagctg

SEQ ID NO: 46423 - DNA, 212 bp, Homo sapiens
  chr20:62481430-62481642
  hypo
ttttgggattcaccccgtagcggcggccttgtcttcccaccgtagggatgagccactgttcgcttatccactcgccagctgatggatacttggttttctcagctttgcgaacgctgctgctacaaaggtttgaggcgagtcttcctgcggacgtgtttcatctcttctgggtaaatacctgggcgcgggatgctgagtcacgctacgtctcc

SEQ ID NO: 46424 - DNA, 222 bp, Homo sapiens
  chr20:62488224-62488446
  hypo
aaaaaaagaaaagaaaagaagaaaagaaaagcccctagaggccagggtccttgaacaaaagtgcgcgatgccctgtgtctgcagcggggagaggtctggagcccgtgtgtccgacagcagaagtggacacagtggtgccagggcaggaaccctgggggcatttgcaggcctgtgctgcgagactgcagtggcgctcaggacacacctcggagaagagcaagc

SEQ ID NO: 46425 - DNA, 36 bp, Homo sapiens
  chr20:62662189-62662225
  hypo
gtttggcaactgagacgaacccgaacagctgcccgg

SEQ ID NO: 46426 - DNA, 171 bp, Homo sapiens
  chr20:62722776-62722947
  hypo
acacctctgaggcttcgtgctctcagcagtggccgggtatggtgggggtgactgagctccaggagcacacagcaggtgctgggccagtgccgtgtcctggacccaagcatcttacccgcttgtttacgacgaagctttgatctgtcgagagctggccgggtgggggcattt

SEQ ID NO: 46427 - DNA, 30 bp, Homo sapiens
  chr20:62737760-62737790
  hypo
ggtccacgctcatcacggctaggaagtaga

SEQ ID NO: 46428 - DNA, 36 bp, Homo sapiens; identical to SEQ ID NO: 16700
  chr20:62762699-62762735
  hypo

SEQ ID NO: 46429 - DNA, 100 bp, Homo sapiens
  chr20:62766351-62766451
  hypo
tccctcagttttgtgcgtcacacacacgctccctcagttttgtgcgccacaaacacgcgcactccctcagttatgtgcgtcacaaacacagacgctccct

SEQ ID NO: 46430 - DNA, 45 bp, Homo sapiens
  chr20:62871836-62871881
  hypo
accgtttacctccctcgccctgccccgcaccgtggggatgcccaa

SEQ ID NO: 46431 - DNA, 30 bp, Homo sapiens
  chr20:62873290-62873320
  hypo
cttttgtttcaggcacggataacagcaaat

SEQ ID NO: 46432 - DNA, 33 bp, Homo sapiens
  chr21:15442571-15442604
  hypo
ccttgtcgggacaagcgacgctgttagtgacat

SEQ ID NO: 46433 - DNA, 30 bp, Homo sapiens
  chr21:15444814-15444844
  hypo
gaaggcactgtcctccgtgggaggaacccg

SEQ ID NO: 46434 - DNA, 60 bp, Homo sapiens
  chr21:15446528-15446588
  hypo
cggaggacttcttgccgctttggggtgtcccccatggacgtgacacgcaccctgggtgca

SEQ ID NO: 46435 - DNA, 85 bp, Homo sapiens
  chr21:15694247-15694332
  hypo
acgcccagcctaggctaattcttacacaagctaattatactgatgatagcttgtatgtcgtggatagtaacgatctcaatatatt

SEQ ID NO: 46436 - DNA, 30 bp, Homo sapiens
  chr21:15762808-15762838
  hypo
tagacactgggaactcgaaagggtgagagg

SEQ ID NO: 46437 - DNA, 19 bp, Homo sapiens
  chr21:15869848-15869867
  hypo
gtcgcggtgagccgagatc

SEQ ID NO: 46438 - DNA, 81 bp, Homo sapiens
  chr21:19274379-19274460
  hypo
atgtttttccaagtgcggcatttctaggatacagcatctggacagggaaaatgtttctgagcagtggagtagttaattttt

SEQ ID NO: 46439 - DNA, 172 bp, Homo sapiens
  chr21:20359980-20360152
  hypo
attcctgcacccactcgcctgcgcgctccctcagtggaggggtggaatgcagcaggtccaagttaatggagtttgatgccgctggtgctgaggcagctggctgcttccactgctggtttactccggttcccgcacttgtttgctagcaagcttcctccggggagctgttgag

SEQ ID NO: 46440 - DNA, 33 bp, Homo sapiens
  chr21:23970030-23970063
  hypo
aaaagcacttcagtccgccgctgcatgatggga

SEQ ID NO: 46441 - DNA, 41 bp, Homo sapiens
  chr21:25338183-25338224
  hypo
cacttgagtgcatgacgggcacttctcgcaggcctcccaaa

SEQ ID NO: 46442 - DNA, 23 bp, Homo sapiens
  chr21:26737215-26737238
  hypo
actgcgcccggccgagggatttt

SEQ ID NO: 46443 - DNA, 1300 bp, Homo sapiens; identical to SEQ ID NO: 38320
  chr21:28216633-28217933
  hypo

SEQ ID NO: 46444 - DNA, 17 bp, Homo sapiens
  chr21:30266890-30266907
  hypo
tccgtctcaaaaaaaaa

SEQ ID NO: 46445 - DNA, 38 bp, Homo sapiens
  chr21:31057101-31057139
  hypo
ttataggcgtgagccaccacacccggctgcaaaaacgc

SEQ ID NO: 46446 - DNA, 139 bp, Homo sapiens
  chr21:31059342-31059481
  hypo
agagacgaggcgagacgaaactttgctcctcctaagagttctccagagtctttcgacattttatcttctagaggacagaattctgcttgctagtatttagcgaattgaattttgtccttagagacgtgcacactgctcc

SEQ ID NO: 46447 - DNA, 30 bp, Homo sapiens
  chr21:32592616-32592646
  hypo
caaggataaaactgacggatgccaggcact

SEQ ID NO: 46448 - DNA, 30 bp, Homo sapiens
  chr21:33630406-33630436
  hypo
ctgccacctctcagccggcaactccaaact

SEQ ID NO: 46449 - DNA, 30 bp, Homo sapiens
  chr21:33694588-33694618
  hypo
ttttaaggtttgaggcgccatgtagaagtg

SEQ ID NO: 46450 - DNA, 30 bp, Homo sapiens
  chr21:33721794-33721824
  hypo
gtgaggacaagagcacgagcctcagcaggg

SEQ ID NO: 46451 - DNA, 278 bp, Homo sapiens
  chr21:33954157-33954435
  hypo
catagagagtaagaccgtaaagctccgtacctagcccatgtaaagtccacagtaagggtttgctgctgttgtcctgagacatcatgagatgtcttagaattctggacttgagacacacggcctgggggcggcaatgcttctgtctgctggagtgccaggtgagaggcctgatgtatccagttcttattaatcattacttacgggaaatggagttgatggaaagatagcaacccctcccaccacccggagcgtgagtgataccgcgtcattcagcaata

SEQ ID NO: 46452 - DNA, 84 bp, Homo sapiens
  chr21:33983236-33983320
  hypo
caggaagtatcatcccgtcaagttcaaaaactatgctgtctaatgcggcagctactcgctccacttggcgatttaaatttattt

SEQ ID NO: 46453 - DNA, 30 bp, Homo sapiens
  chr21:34127723-34127753
  hypo
gttccatactatttccggatttctgaaaaa

SEQ ID NO: 46454 - DNA, 95 bp, Homo sapiens; identical to SEQ ID NO: 16704
  chr21:34459377-34459472
  hypo

SEQ ID NO: 46455 - DNA, 30 bp, Homo sapiens
  chr21:34466163-34466193
  hypo
agccttctgatgagacgctaccagattaga

SEQ ID NO: 46456 - DNA, 62 bp, Homo sapiens
  chr21:34471025-34471087
  hypo
caaattgcccgtctacgttcttagaagactgaggaggatgtatgagacgaagatttaaaaaa

SEQ ID NO: 46457 - DNA, 222 bp, Homo sapiens
  chr21:34508376-34508598
  hypo
agcaggtggatggttcgtttccaagaagctgagctgggctgaagcacgcagcgtgtccgttgctgctccactgaacctccagctggatttccatgtggtggtgcaggcgaggggccgtgccgattcattatgacaaaatgacatatcaaaaaggttttgctggcctgcgaaagatgcccaacagcagatatgcattatcttataagttaagaatgctgtctt

SEQ ID NO: 46458 - DNA, 94 bp, Homo sapiens
  chr21:37527928-37528022
  hypo
acaagtggcccacttcgggttggctggagccacagctgggtggggacagggcctgtgctcaggtgagcactgcctaccgcgcaccctccaggtg

SEQ ID NO: 46459 - DNA, 19 bp, Homo sapiens
  chr21:37699121-37699140
  hypo
ttttttttttgagaccgag

SEQ ID NO: 46460 - DNA, 133 bp, Homo sapiens
  chr21:37750031-37750164
  hypo
aggtccagttggtgacgctgcctgtgatctcagacgcttgattcttgctgtcacatgagacgtcttaaacttgggtcatacatcattgaggaatcatttaagttctcacctctggctgcgtagtagaattact

SEQ ID NO: 46461 - DNA, 108 bp, Homo sapiens; identical to SEQ ID NO: 16706
  chr21:37758492-37758600
  hypo

SEQ ID NO: 46462 - DNA, 106 bp, Homo sapiens
  chr21:37775052-37775158
  hypo
caggcaagaagctaccggatgtttcacgacgacagcatgaagtctttcttccgtagactgagtttcactcccgacggatctttgcttctcacgccaggtgtgtttc

SEQ ID NO: 46463 - DNA, 30 bp, Homo sapiens
  chr21:37781662-37781692
  hypo
atccattaggcccatcgctcatcttccatg

SEQ ID NO: 46464 - DNA, 189 bp, Homo sapiens
  chr21:38092100-38092289
  hypo
gacccttcccttccacggcaggtggagctcacgggcaacagtatttatgaatacatccatccttctgaccacgatgagatgaccgctgtcctcacggcccaccagccgctgcaccaccacctgctccaaggtattccatccagagggaaaaaaaaaaacagactaaaagcaaggcgacattcttaaatg

SEQ ID NO: 46465 - DNA, 40 bp, Homo sapiens
  chr21:38363098-38363138
  hypo
gtaaagaacacaactcggtaacagccgagtgcaagagatg

SEQ ID NO: 46466 - DNA, 37 bp, Homo sapiens
  chr21:38638489-38638526
  hypo
aatacaagcgtgagccaccgcgcgggccagatttttc

SEQ ID NO: 46467 - DNA, 30 bp, Homo sapiens
  chr21:38823635-38823665
  hypo
atctctcttcctctccgtccctccatccct

SEQ ID NO: 46468 - DNA, 72 bp, Homo sapiens
  chr21:38918489-38918561
  hypo
ggtgggcagctctttcggggttggtacccatcaggtgctgtggccagaactcagattcggagtctaaattca

SEQ ID NO: 46469 - DNA, 142 bp, Homo sapiens
  chr21:38935380-38935522
  hypo
ggagaccatttttcacgcctggccggctctgtgcttaagtggccccatcgcagccagagtagcctcattacagctgaagtccctggtaggtctcctccttcctctgagcccagcgcagtgccaaggccggggactctggctg

SEQ ID NO: 46470 - DNA, 30 bp, Homo sapiens
  chr21:38987670-38987700
  hypo
cctgcctcagcctcccgagtacccagcatt

SEQ ID NO: 46471 - DNA, 30 bp, Homo sapiens
  chr21:40510674-40510704
  hypo
ctataaagagaagttcgggccgggcgcagt

SEQ ID NO: 46472 - DNA, 39 bp, Homo sapiens
  chr21:42448116-42448155
  hypo
agccacagcctcacacggagccagcgctgtgccagcacc

SEQ ID NO: 46473 - DNA, 30 bp, Homo sapiens; identical to SEQ ID NO: 16710
  chr21:42613756-42613786
  hypo

SEQ ID NO: 46474 - DNA, 30 bp, Homo sapiens
  chr21:42953643-42953673
  hypo
tataagggacctcagcgcaggggctggatg

SEQ ID NO: 46475 - DNA, 30 bp, Homo sapiens
  chr21:43033404-43033434
  hypo
acaggccccaggaaacgcagatctcatggg

SEQ ID NO: 46476 - DNA, 382 bp, Homo sapiens
  chr21:43248539-43248921
  hypo
ggtggtccagcatgacgtccttgcggtagaacatcttgctgcagacctcacaggcaaacttcttgtcgccgtgcttcttcttgtgcttggagaggttgctgttggtggagaagaatctgaaacacatctcacattggaacgtcttgtcatctgtccagagagcaaacaaacacacaacgattttgaggtaaataacatctcacgcaggcacgcacgtgtggcctgaacgtcaataaagcgcgggtgacgggcatgagagtcacggggatgcgtggccaggaagaaaacagcacctgtgtgtcatacactgtctaccccaggaactcacgatgcagagacgggaaccccggtgcttgaaaagcagacacggagctcacctttc

SEQ ID NO: 46477 - DNA, 42 bp, Homo sapiens
  chr21:43255693-43255735
  hypo
ccccgacgtgctgcccgggcgactccacgcctgtgtctgtta

SEQ ID NO: 46478 - DNA, 30 bp, Homo sapiens
  chr21:43376373-43376403
  hypo
tgcagtcagataattcgagtcctgctggtc

SEQ ID NO: 46479 - DNA, 38 bp, Homo sapiens
  chr21:43493035-43493073
  hypo
aggcttgggatggcacgtgacctcggataaaatgttaa

SEQ ID NO: 46480 - DNA, 70 bp, Homo sapiens
  chr21:43725826-43725896
  hypo
gaaaaggctgggcaccgcccacactccatgcagctctctttccctggctcggaatcgctgcaggcgccac

SEQ ID NO: 46481 - DNA, 245 bp, Homo sapiens
  chr21:43786496-43786741
  hypo
gagcaggaagaagcacgccttacctgtctgggcctcggccagggtgccgagggccagcatggacaccaggaccagggcgcagatcaccttgttctccatggtggccattgcctcctctctgctccaaaggcgaccccgagtcagggatgagaggccgcccgagccccggattttatagggcaggctctgtttgcttaaagagcgttagataacatttgcctaaggaggcccggggatcctctgag

SEQ ID NO: 46482 - DNA, 45 bp, Homo sapiens
  chr21:43864728-43864773
  hypo
ggattttgcccaactcgtgagaaaggtacgcgcccactcttggct

SEQ ID NO: 46483 - DNA, 30 bp, Homo sapiens
  chr21:43991300-43991330
  hypo
agccaagtcccttcccgaaggaggtgcccg

SEQ ID NO: 46484 - DNA, 30 bp, Homo sapiens
  chr21:44093215-44093245
  hypo
taacattcctgtgggcgaggtaggatttgt

SEQ ID NO: 46485 - DNA, 30 bp, Homo sapiens
  chr21:44283686-44283716
  hypo
tacacctccttgccacggtcctagaaggcc

SEQ ID NO: 46486 - DNA, 378 bp, Homo sapiens
  chr21:44338174-44338552
  hypo
ttaggcggaggtatgcggcataagggttagtggtgttcgtacagtaccaggccttttttgacaagacacaattgaggtagcttaagttagaaggagaccaggctccagggggtaaccttggccaccactcagctatggaggcattgactgttagggtttggtgacgggttttcacctacggcgcgatgggttttatcagtccacttgcgggatatgcacaccgtccctcatactgggttggtaagtgtccaggactgcgggcattcctgaggagtgaaagtgagtctggggttttgggatgcctgtaagtaagggggaatgtctatcccgtcccacagccactgttcactcataaagctcccccgcatacccaacaat

SEQ ID NO: 46487 - DNA, 46 bp, Homo sapiens
  chr21:44480679-44480725
  hypo
acgcgccagggtgagcgtgcgtgggtgcacacgtatgcatgaattg

SEQ ID NO: 46488 - DNA, 30 bp, Homo sapiens
  chr21:44482657-44482687
  hypo
tttccagttccaacacgttttgcagacagc

SEQ ID NO: 46489 - DNA, 34 bp, Homo sapiens
  chr21:44482920-44482954
  hypo
cagcttctcaccatgcgtgcggggcttgcccttc

SEQ ID NO: 46490 - DNA, 303 bp, Homo sapiens
  chr21:44836846-44837149
  hypo
cagcagcgggagccccgacgtgaggagggtgctggggagcggggcagccccagggccatcacagggggcgatcacaaacggggcaggggccggctggggggcctgggagcagccgggtgcagcggccgggtggtgctgtaactggagcagcctgtgggaacagaggacaggtggtcactgcgccggctcgcagggttctcgggtttccgagtgcccgtgtggcagggcccgcccgaggagctgccagccgcggctgccgagggcaggtgcgtggctgatccctgaccgcgccccacctttcat

SEQ ID NO: 46491 - DNA, 43 bp, Homo sapiens
  chr21:44837378-44837421
  hypo
tgccgtgtgcccacccggggtcccagggcgggggcaggcccta

SEQ ID NO: 46492 - DNA, 351 bp, Homo sapiens
  chr21:44866552-44866903
  hypo
tactggcacttgggccggtgtgaagccacccccctgccatgaaaaatggctcttccctgccacagccggcccagcgggagccaggtcagggcctggagacacagcgccccccaccggagccactgcccggcccagcagcacctgcggagaatcccaccagctcccacgcctcccgccgcgccaccgccccggctttctgcaaatccaccttatggaagccggataaggtgaagtccacatataactaaaagcgagttactgagggttactttctttgcagagtggttcccctaaaggattcctttaaacatgatccggtcagccagtgctcacttacgttcaccaagtcac

SEQ ID NO: 46493 - DNA, 30 bp, Homo sapiens
  chr21:44871839-44871869
  hypo
tgcctgctgaagccacgcagccagtgcctc

SEQ ID NO: 46494 - DNA, 58 bp, Homo sapiens
  chr21:45140870-45140928
  hypo
cctcaggtggagcctcgaaaggatggcgctgctgttcctacctcgggtctccccagtg

SEQ ID NO: 46495 - DNA, 57 bp, Homo sapiens; identical to SEQ ID NO: 16716
  chr21:45170351-45170408
  hypo

SEQ ID NO: 46496 - DNA, 152 bp, Homo sapiens
  chr21:45195176-45195328
  hypo
accatgacagcgaggcgggcctggcctgtgctccaccggagggggcttcttgcacagatgacctgctcatttcagcccctccagaatcttctggcaggcgcagagcaacaggacgtccattttacagacgaggaaaccgagacacagggaag

SEQ ID NO: 46497 - DNA, 36 bp, Homo sapiens
  chr21:45201243-45201279
  hypo
gggattataggtgtgagccaccgtgcctgacaatta

SEQ ID NO: 46498 - DNA, 30 bp, Homo sapiens; identical to SEQ ID NO: 16718
  chr21:45232947-45232977
  hypo

SEQ ID NO: 46499 - DNA, 30 bp, Homo sapiens; identical to SEQ ID NO: 16719
  chr21:45247147-45247177
  hypo

SEQ ID NO: 46500 - DNA, 30 bp, Homo sapiens
  chr21:45268919-45268949
  hypo
ggcttgttcacagggcgggataacagggtt

SEQ ID NO: 46501 - DNA, 30 bp, Homo sapiens
  chr21:45273343-45273373
  hypo
tgttccaattatttacgaggggttgagcaa

SEQ ID NO: 46502 - DNA, 334 bp, Homo sapiens
  chr21:45273579-45273913
  hypo
ggtgatcctatgaaccgccccagagaaacactcctgcatctcacagcgttctccctcgtgctcttgtcttctctttcctaccagattccaaattctcttcccaagaggtggcatgaacctgtgagtcccagctgcaaccaacagagaagcaagcgagccgtgaacctcatcgatccggccagtcagcacctccgtctctccacgcaggccaggtggctccagatgcgggacttgctcctggcagcttggcagctttgcagctttgcatctgtaaggcgtatattaccgtagagtgcttttcagcgttacataagtcattcgtatgtattgcaga

SEQ ID NO: 46503 - DNA, 99 bp, Homo sapiens
  chr21:45276620-45276719
  hypo
agtgaaatattttataatcatgatctatgtctatgcctaaatcgccctgcctaagacactgaatagcctgagaaaactccctttcgtgctaactcactg

SEQ ID NO: 46504 - DNA, 30 bp, Homo sapiens
  chr21:45299990-45300020
  hypo
tgtggacttgagcttcgacatcagttggca

SEQ ID NO: 46505 - DNA, 30 bp, Homo sapiens
  chr21:45352946-45352976
  hypo
aacacctgttacattcgtctttttgataat

SEQ ID NO: 46506 - DNA, 97 bp, Homo sapiens
  chr21:45365737-45365834
  hypo
atgcttgcacaggagcgtggctttgtcagaactcatccccaggcagccctgtgggcacctggtgggggctggacaggggtcacgaggagaagccagc

SEQ ID NO: 46507 - DNA, 34 bp, Homo sapiens
  chr21:45411880-45411914
  hypo
gctggtggagctcctcgggcgcttggagccaggg

SEQ ID NO: 46508 - DNA, 65 bp, Homo sapiens
  chr21:45516505-45516570
  hypo
cagattccagctggccgtcagtgctcgcgtgtctctctgaagaggctctgcggttctggtccctg

SEQ ID NO: 46509 - DNA, 88 bp, Homo sapiens
  chr21:45583747-45583835
  hypo
atgaggctggacaagcgcctccgccagaagcagcacaggcctgacacaggcaaacctcccggagaccaccccacggaccccagcccct

SEQ ID NO: 46510 - DNA, 30 bp, Homo sapiens
  chr21:45657028-45657058
  hypo
ttccttcagggcaagcgcagctgagctcca

SEQ ID NO: 46511 - DNA, 131 bp, Homo sapiens
  chr21:45681620-45681751
  hypo
acagggctgctgccacggctccgggtacagccagctggtgggttcaaggttccagtggtccggggcttccaggctcagggtccccggggaggactgggccatggaacgagggacggcgcaggcaaagaatg

SEQ ID NO: 46512 - DNA, 79 bp, Homo sapiens
  chr21:45682528-45682607
  hypo
tgagggtgggcactccggggcagggctcagtggcgggggtcggggctcagggcaagggtagagacggggtgaaagtagg

SEQ ID NO: 46513 - DNA, 30 bp, Homo sapiens
  chr21:45710106-45710136
  hypo
tttttcctgataatacgcaatggtaatagt

SEQ ID NO: 46514 - DNA, 30 bp, Homo sapiens
  chr21:45713048-45713078
  hypo
gggtcagcaggtgagcggggagtgggggtc

SEQ ID NO: 46515 - DNA, 34 bp, Homo sapiens
  chr21:45713421-45713455
  hypo
agcaggagagaggtgcgggcgccaggcttgcagg

SEQ ID NO: 46516 - DNA, 30 bp, Homo sapiens
  chr21:45727181-45727211
  hypo
gggagatttggggctcgccctccgtcctgg

SEQ ID NO: 46517 - DNA, 30 bp, Homo sapiens
  chr21:45749126-45749156
  hypo
tcacgcatcaccgctcggcggaggatggga

SEQ ID NO: 46518 - DNA, 106 bp, Homo sapiens
  chr21:45750020-45750126
  hypo
gggggctggggaagacgctggggtccccgtggaggctggagcggcgttcaggtcctgcggtcactcggcgtgctcctgcacctcttccccacgcagggcctgcagc

SEQ ID NO: 46519 - DNA, 30 bp, Homo sapiens
  chr21:45753810-45753840
  hypo
ggcgcctcagaagggcggtcaccaggcccc

SEQ ID NO: 46520 - DNA, 66 bp, Homo sapiens
  chr21:45791088-45791154
  hypo
tccagtcgctgcctccgtgtcccatggccgcctccctccagtctctgcctccgtgtcccgtggccg

SEQ ID NO: 46521 - DNA, 30 bp, Homo sapiens
  chr21:45824465-45824495
  hypo
ttcggatttgctgaccgtgatgatagtgat

SEQ ID NO: 46522 - DNA, 68 bp, Homo sapiens
  chr21:45844751-45844819
  hypo
agccctgcactggatcgtgaggacgctgcgggccagcggcttcagctcggaggcggacgtccccactc

SEQ ID NO: 46523 - DNA, 196 bp, Homo sapiens
  chr21:45929175-45929371
  hypo
cttgcatctccacatcgtagctgtgactgtttgccacagcgaggaagatcctctccccgatctggaagacctcccagtctgcagcaccgaacgtctaggaccaaaggagagcaggtgcagaggtgtgggggagcgggcgcagaggtgtgggggagcgggcgcagaggtgtgggggagcgggcgcagaggtgtgggg

SEQ ID NO: 46524 - DNA, 30 bp, Homo sapiens
  chr21:45939784-45939814
  hypo
tcagccagtgtgagccgctaccaccaccta

SEQ ID NO: 46525 - DNA, 135 bp, Homo sapiens
  chr21:45959906-45960041
  hypo
ggcagggggccggggcgcagcagctgagggcgcagcagtggggctcacagcagctctctgggcaggcatccacctgccaggagtcggagcaagcgctggagcagacggacatggtggacgcggccatgctggggt

SEQ ID NO: 46526 - DNA, 30 bp, Homo sapiens; identical to SEQ ID NO: 16724
  chr21:46015435-46015465
  hypo

SEQ ID NO: 46527 - DNA, 38 bp, Homo sapiens
  chr21:46035197-46035235
  hypo
tgcgctcacccgacccgcacacacgcaggagcgcgagt

SEQ ID NO: 46528 - DNA, 255 bp, Homo sapiens
  chr21:46036572-46036827
  hypo
ggtcagcacccaattcgagagctctgctcagcagtgagaatgagacaccgtgacaatgcggctgcgcaccggacacctggctcagcgcaggcagcgcacggacagagtctgcggtgtgaccacaccaagcagccctaaggcagcacgtgcccgcacaagcctcagcctctgctccggtcacgcctgcccacttgggtgtattttttgtctgacttttgcttctggggccgaacaacccagcgaattcaacacagc

SEQ ID NO: 46529 - DNA, 58 bp, Homo sapiens
  chr21:46068645-46068703
  hypo
cctcccgatggctcccgaggggaaaggcagggacagccatggccgagcacagcttgtg

SEQ ID NO: 46530 - DNA, 30 bp, Homo sapiens
  chr21:46169786-46169816
  hypo
cgcactgtgcccacccgccactggtgagga

SEQ ID NO: 46531 - DNA, 33 bp, Homo sapiens
  chr21:46184045-46184078
  hypo
ggcatccagcacacccggggcatctacacactc

SEQ ID NO: 46532 - DNA, 102 bp, Homo sapiens
  chr21:46184437-46184539
  hypo
acacccagcacatgccgccccaggcccatggaactcgtgctctgatctgaaagttctcttcagactcagactggaatgttgaggatccgagatggtggccgc

SEQ ID NO: 46533 - DNA, 30 bp, Homo sapiens
  chr21:46206196-46206226
  hypo
atacaagtatacagccgcacagtccactaa

SEQ ID NO: 46534 - DNA, 202 bp, Homo sapiens
  chr21:46238872-46239074
  hypo
tccctcaggagtgcccgggtggtgccagccggggcgtggcggaggtctcatctgatggtgagcccggccgaaggcgggggaggccgcacttcaggctcagctgggaaatggcagggcctggatttgaacctaagcgtctgagccgtttctgtcctgcctgggaaaggctcagccaactgagcaacgtcgcaaagccatggag

SEQ ID NO: 46535 - DNA, 399 bp, Homo sapiens
  chr21:46256917-46257316
  hypo
agtcacgcgaggctccgaggcagcaggtttcaggggcacctccgtgcagtccccggcacccagggtgcagcccccagcacctccgtgtagcccccgacacccagggtgcagcccccggcacctccgtgtagcccccggcacccaggcagtccccggcacctccgtgtagctcccggcacccagggtgcagctcctggcccggcctctgctttgccggttgcttccagtcctagcagcaaagatcgcagagcctctgtcctcttggggtgcggggcagagcacgggcaccatctcctcagggctgggcccccgttcttgccctacgactctgcagagacaatcgtgtgactcgcagctcatgaattagcctggtagacaggaggccggagaagcccggat

SEQ ID NO: 46536 - DNA, 175 bp, Homo sapiens
  chr21:46257708-46257883
  hypo
ctgggaacctgcctgcggtgcaggcgtctgcccttcctagaggaggcgctgggtgagaccctccagggtgtttggggccaagctgtgcgcacctctgatgccagctgttctcggtttggaaagcgctcactgtgcatgtggcgctgggggctgagctgcacgttccaggcccccc

SEQ ID NO: 46537 - DNA, 78 bp, Homo sapiens
  chr21:46273062-46273140
  hypo
gctgggcagtgtgtgcgtgtgtgcgcgtgtgcgtgtgtgtgtatccaccttgtcttttatttacattaacattagtct

SEQ ID NO: 46538 - DNA, 353 bp, Homo sapiens
  chr21:46308526-46308879
  hypo
cttccgcaccaccctcgcctctgcggagaccccgcagccggagctctggagccggtccccgctgcaccccagcggcctcacctcggctctcatccacatagatgaggtagcggtccatcccgtcctgctgctccagcgtgtaggccacccagcagccctctgagtccctctccttgcaggtcctgcccttcacggggttgttcgacagctgcaggcccggacacgccgcgctgcagttcttcccaaaggggcccttttcgaacttcaggcactcggcgcaggagctgcggggagccaggtgtgagcatcggtgccagggtgtgcgggggctccggcaacgggggctcgggctt

SEQ ID NO: 46539 - DNA, 40 bp, Homo sapiens
  chr21:46309364-46309404
  hypo
aagcccgggtggcagcggcacttcccgcagaagcagagcc

SEQ ID NO: 46540 - DNA, 355 bp, Homo sapiens
  chr21:46310428-46310783
  hypo
cctgtgctgcgataccggtgctctgtgagtggctggtgtctgctcctgcgtgccccacatggtggccagtggggactcggcactgcctcctgccacagccccgccctccctcctgcgttcgtgcactgacaggccaggttgtgggagaatgcagggacaaggggtttttacagatgtggaagctggcatcaagccgctggcaggcaggagccacacacaccctgaggcatcctcagagacggcactgccacgggctctcctgctccccagaggaggaagctgcaggaccgagtgtctgagtacctgtggcagggcaccccccgacacctgccaagtgttccgactgagtcacccc

SEQ ID NO: 46541 - DNA, 122 bp, Homo sapiens
  chr21:46311753-46311875
  hypo
ccatggcagaggctgcggtctctgctctggtcccggcaccggcactcacactggggaagaacctgcacggtcactatgtccgtgaagcccagcgcccggatgacaaacgactgctcctggat

SEQ ID NO: 46542 - DNA, 58 bp, Homo sapiens
  chr21:46317030-46317088
  hypo
ccatcccgtgtctcccgcagggtcctgctcccactccagagcccggggaacctatggc

SEQ ID NO: 46543 - DNA, 37 bp, Homo sapiens
  chr21:46318286-46318323
  hypo
tgtatcctcccacctcgggcagcggctggcacccagg

SEQ ID NO: 46544 - DNA, 54 bp, Homo sapiens
  chr21:46318785-46318839
  hypo
ctatcgacacgcaggcgtcctgtccccgacgggaagcctcgggctcctcaccta

SEQ ID NO: 46545 - DNA, 362 bp, Homo sapiens
  chr21:46319143-46319505
  hypo
gtctgccccgctcagcgtcagccctgcccgtgcttcgaaccctctctggggaaggctggagaggcagaggctgccacgcaggagtgcagggcagagagctgccacgccctctgggcaatgtgtgcatagactcgggctttcagagtccaggcatgagcagcatttgaggcgtctcaccgtgggactggggatgtccacgggggcagaatcccagccttccccacacggtggacctgctttcgcactgagggacactcagtttcggtagaggccatgagtgtcaggtgcggctctccctacccgagttccgggacccgagggccgtccctcccgtctgtggctcccggcggaggacctgagtc

SEQ ID NO: 46546 - DNA, 38 bp, Homo sapiens
  chr21:46321598-46321636
  hypo
gtgcgtgttcacgaacggcagcacggtcttgtccacga

SEQ ID NO: 46547 - DNA, 201 bp, Homo sapiens
  chr21:46359164-46359365
  hypo
gatgagcagggctcccgttcccagcacgggacccagcccgttacctcgctgctatgtttcccacgtaaacggagcaatacccaattctaaagaactgttctgaggactaaatggaatagtgtaaaaaataaattgacatgaagtgaaggtcaattaaaatgcactagcttggccaggcgcagtgtggctcatgcctgtaat

SEQ ID NO: 46548 - DNA, 33 bp, Homo sapiens
  chr21:46424460-46424493
  hypo
caccatccccacagccggcgctcctgtgccccc

SEQ ID NO: 46549 - DNA, 65 bp, Homo sapiens
  chr21:46431841-46431906
  hypo
gccccacagaagcttcgagcccacacctgggttctggcccattgtgttcacgccccccacacccc

SEQ ID NO: 46550 - DNA, 46 bp, Homo sapiens
  chr21:46439310-46439356
  hypo
gggccctggagggagcggctcggaggggcgccggtgcctgggcagg

SEQ ID NO: 46551 - DNA, 259 bp, Homo sapiens; identical to SEQ ID NO: 16734
  chr21:46452280-46452539
  hypo

SEQ ID NO: 46552 - DNA, 34 bp, Homo sapiens
  chr21:46549475-46549509
  hypo
atggcagggaccaggcgctcgcttggcagctctc

SEQ ID NO: 46553 - DNA, 85 bp, Homo sapiens
  chr21:46677808-46677893
  hypo
gtcctcgtgggaaaccgcgggggcacgtggggcggctgcagggtccgcaaagccggctgtttgcgaagggcgcagctccacctgg

SEQ ID NO: 46554 - DNA, 30 bp, Homo sapiens
  chr21:46839039-46839069
  hypo
ctgggccctgacacacgatgccgtgtgtag

SEQ ID NO: 46555 - DNA, 62 bp, Homo sapiens
  chr21:46844701-46844763
  hypo
ggaccctgggaggcccgtggcgcagccccttcccgcctcctgcccgtcggtttccattgctc

SEQ ID NO: 46556 - DNA, 30 bp, Homo sapiens
  chr21:46848585-46848615
  hypo
atcggcggttctggacgttcatgcaggtgg

SEQ ID NO: 46557 - DNA, 30 bp, Homo sapiens
  chr21:46853427-46853457
  hypo
tgatccaacagatgccggcccagggcctgc

SEQ ID NO: 46558 - DNA, 83 bp, Homo sapiens
  chr21:46863752-46863835
  hypo
atgatcccctagatgcgtccgagggacactggacatctggtggccctccagactcctaggaaggggaccgtcctcccagtggc

SEQ ID NO: 46559 - DNA, 305 bp, Homo sapiens
  chr21:46864146-46864451
  hypo
gcatcttcagtgctgcgagcaggctgggcttgcagcaggagcacgggtgtgcgtgtggagtgaatgaagggccgtgtgcccgagtaggtggcgtgcaggggtgtagtgaggtgcgtgcaggggtgtagtgaggtgtgggatgtgcagagtgaatgaaggacgttgtgctcgtgtgggtgatgtgcggggttgtggtgaggcgtagggctggggtcagctggtcgtccggacttttggttttctggctgtaaaatgcacatgccaggatagttgtgaggtgcacgctcactcgtgcatggagggtg

SEQ ID NO: 46560 - DNA, 79 bp, Homo sapiens
  chr21:46894771-46894850
  hypo
tttgcccaataagcccgttgtttttgcctggaacatgccagaagacgccagatcgttcacatggcggccatgacaaggc

SEQ ID NO: 46561 - DNA, 30 bp, Homo sapiens
  chr21:46895400-46895430
  hypo
ctctggcagcgggctcggggacgcccggga

SEQ ID NO: 46562 - DNA, 106 bp, Homo sapiens
  chr21:46908905-46909011
  hypo
cctttcaccccgctgcgtgctcatcaaagcgtcctctgctgcgtgcggggccaagggcgcacggggcccaccctggggctgcactctcacgcgtcaccagcccctg

SEQ ID NO: 46563 - DNA, 30 bp, Homo sapiens
  chr21:46909213-46909243
  hypo
gccagcctgggcccacggggtccctgcaca

SEQ ID NO: 46564 - DNA, 35 bp, Homo sapiens
  chr21:46909499-46909534
  hypo
ctgcggagatcagctcggggcggccttccccgctc

SEQ ID NO: 46565 - DNA, 388 bp, Homo sapiens
  chr21:46912094-46912482
  hypo
aggccacagggacctcggcgtgacggtcaagacatcagaacatcagaaaagcctcccgtaggccgagccacctccgccggcaagcaagggagcgtctagcagaggcaggagcattttaaaacaaaatggaagtaaaaaccatggcccttagggcgtctggagtctgcatccagctgctctgagctgaggggcgtctgtgctgcaggagggatgccccaggcccaggaagactggaaagcaacattttccttgaatttcctggtttggtgttttgttgatctgtaagtcgctcgagtccagttgaattttaaacgcggctctttgtttccgatttttccttttgctcgtggacagggatccgtcctgagcgtgccgggacctgaggtat

SEQ ID NO: 46566 - DNA, 163 bp, Homo sapiens
  chr21:46921470-46921633
  hypo
ctgggagcttaggtgcgtccagggcatcctcagccctcacactgcagccgcaggggccttgccctgcacaatccccggtctcccaggtggtggggcctccacagccggtcacctccctctgcagaaggacccccaggggctccacagccggtcacctccctct

SEQ ID NO: 46567 - DNA, 84 bp, Homo sapiens
  chr21:46925361-46925445
  hypo
ccggctgggcacctgcgtcccgtgccctggctggttctgcagcccctgcccctcagagacactctcccacggaccccacaggga

SEQ ID NO: 46568 - DNA, 146 bp, Homo sapiens
  chr21:46925754-46925900
  hypo
aggctctgggctacacgccaggccatgctgggccaggtgcacgaggttcccgagggctggctcatcttcgtggccgagcaggaggagctctacgtccgcgtgcagaacgggttccggaaggtccaggtgagcgctctgtgtgacgg

SEQ ID NO: 46569 - DNA, 145 bp, Homo sapiens
  chr21:46926439-46926584
  hypo
ggtggcaggagtggccgctctgatccaggtgggtgcggccatgcttgcagggccccgggaaggtttaccttcgtgtggcaaaggtgaggacgggtagaagccccatgccgccgaaacggcctgtgacatccgtgggagcctccat

SEQ ID NO: 46570 - DNA, 89 bp, Homo sapiens
  chr21:46934071-46934160
  hypo
gggcctccccagtgacgctctagcccatggcacaggcccagcccacctccacccatcacatcctgctagatctacgagcccaggaaatg

SEQ ID NO: 46571 - DNA, 141 bp, Homo sapiens
  chr21:46935829-46935970
  hypo
gtcttctggggaaagcggcgggctctgggctggctgcaggcctccgaggcccttgtcctgcacgctcagtgcctgtgctgccttctcctccgcggcactcctcaggccctgggccgggggctgccgcgggtggtggccccg

SEQ ID NO: 46572 - DNA, 30 bp, Homo sapiens
  chr21:46978498-46978528
  hypo
tgtgtgagaggactgcgtttggtttgagcg

SEQ ID NO: 46573 - DNA, 54 bp, Homo sapiens
  chr21:46999805-46999859
  hypo
gggacgcgggtgccccgggatgcgggtgcccctgagatgcgggtgcacctggga

SEQ ID NO: 46574 - DNA, 77 bp, Homo sapiens
  chr21:47013235-47013312
  hypo
atcaccccatggccccgtcatttcagcactggcggctgctctgccctgggatgcgcctgtcacgtgcagtgatttaa

SEQ ID NO: 46575 - DNA, 49 bp, Homo sapiens
  chr21:47019157-47019206
  hypo
ccccagctggctgcacgctgggcctccgggaagccggcaagcccacctg

SEQ ID NO: 46576 - DNA, 39 bp, Homo sapiens
  chr21:47026381-47026420
  hypo
cagtgcagtcacacgctgcacgggcgtctggctacacaa

SEQ ID NO: 46577 - DNA, 67 bp, Homo sapiens
  chr21:47026666-47026733
  hypo
cagtcacactctgcacgggcgtttagctacacaaatgccatggcgtcacagtcgcctgcagtattca

SEQ ID NO: 46578 - DNA, 30 bp, Homo sapiens
  chr21:47036096-47036126
  hypo
actcctgcactgtcccgaaatgaggacaat

SEQ ID NO: 46579 - DNA, 120 bp, Homo sapiens
  chr21:47213460-47213580
  hypo
tccccgagcacagagcgcatcacaggactgaccagtattgagtgggcgcggggaaaacatggctgccaggacctgtgaggaccgagtttcagatactgtggacagcggagactccacagg

SEQ ID NO: 46580 - DNA, 69 bp, Homo sapiens
  chr21:47287081-47287150
  hypo
cctaggcagagcaggcgtggaagggaaggcggcggacggaacaaaacgcgggcacgcaacggctgctgc

SEQ ID NO: 46581 - DNA, 32 bp, Homo sapiens
  chr21:47287393-47287425
  hypo
cccgcattcaccgcacgcggagggtgcgggcc

SEQ ID NO: 46582 - DNA, 30 bp, Homo sapiens
  chr21:47328429-47328459
  hypo
cctgttgccctgaatcgtaactcaggcata

SEQ ID NO: 46583 - DNA, 30 bp, Homo sapiens
  chr21:47365874-47365904
  hypo
cggtcatttgatacacggctgcaaaagtaa

SEQ ID NO: 46584 - DNA, 162 bp, Homo sapiens
  chr21:47404017-47404179
  hypo
gccttccaggagggccggcctcagggccacagggcaagtccagctgtgtgtcagccacggccagggtggggcagcctgtccatctgggtgacgtcgcgccctgggacgggtagcgatggcgccaggggccgcccgcctcacgcccgccgtgcctgttcctgg

SEQ ID NO: 46585 - DNA, 35 bp, Homo sapiens
  chr21:47417760-47417795
  hypo
cctggggtccctgaccgggccgggagtgcccgcag

SEQ ID NO: 46586 - DNA, 30 bp, Homo sapiens
  chr21:47418458-47418488
  hypo
gtacacaggcacccacggctgccccactgt

SEQ ID NO: 46587 - DNA, 30 bp, Homo sapiens
  chr21:47420466-47420496
  hypo
tgagagtccccggtgcggtgcagagctgcc

SEQ ID NO: 46588 - DNA, 34 bp, Homo sapiens
  chr21:47421299-47421333
  hypo
ggtgaggcctcgccccgcccggctttctcaagcc

SEQ ID NO: 46589 - DNA, 92 bp, Homo sapiens
  chr21:47422662-47422754
  hypo
aggtgcgcgcggggccgcccgggcagtcccagatctgcgtaggtgcacgcggggccgcccgggcagtcccagatctgcgtaggtgcacgcgg

SEQ ID NO: 46590 - DNA, 142 bp, Homo sapiens
  chr21:47425521-47425663
  hypo
ggctgttctgggggccgctaggggactaagaggatcggccgagggctgggctggaggagggcagcagggatgggcggcgagggtgagggtggggcttcctgaaggccttcacctgcggggaccccggcgagcccctcaggtg

SEQ ID NO: 46591 - DNA, 53 bp, Homo sapiens
  chr21:47457442-47457495
  hypo
agtggctctctgtgccggggacgtcgcgtgctgggtcccggtctgaatgcttc

SEQ ID NO: 46592 - DNA, 35 bp, Homo sapiens
  chr21:47459822-47459857
  hypo
gctggaatcagcactcgcgacgaatcccaggtgct

SEQ ID NO: 46593 - DNA, 65 bp, Homo sapiens
  chr21:47471074-47471139
  hypo
ctgcagatccctcaccggtagcccccactccaggccagactgaaacaccgcggtgggctcctgga

SEQ ID NO: 46594 - DNA, 67 bp, Homo sapiens
  chr21:47475296-47475363
  hypo
tggtgagctgggaggcgaggccctgggacgggacaagtagcagacgtctcagcgcacacaggctcct

SEQ ID NO: 46595 - DNA, 30 bp, Homo sapiens
  chr21:47487782-47487812
  hypo
tccctccctccattccgaatccccccaccc

SEQ ID NO: 46596 - DNA, 78 bp, Homo sapiens
  chr21:47489936-47490014
  hypo
gccgagctgagggggcggccagaggcgcttggcctgcagggagccgtggaggctggcggagcacggcaccctgggaaa

SEQ ID NO: 46597 - DNA, 30 bp, Homo sapiens; identical to SEQ ID NO: 16747
  chr21:47501864-47501894
  hypo

SEQ ID NO: 46598 - DNA, 34 bp, Homo sapiens; identical to SEQ ID NO: 16748
  chr21:47503061-47503095
  hypo

SEQ ID NO: 46599 - DNA, 30 bp, Homo sapiens
  chr21:47504861-47504891
  hypo
tcctcacgggcagctcgcccgacccaggtg

SEQ ID NO: 46600 - DNA, 93 bp, Homo sapiens
  chr21:47531922-47532015
  hypo
tcgtgctggacacctcggagagcgtcaccatgcagtcccccacggacatcctgctcttccacatgaagcagttcgtgccgcagttcatcagcc

SEQ ID NO: 46601 - DNA, 30 bp, Homo sapiens
  chr21:47539603-47539633
  hypo
gtagagaaggagcatcggccccggcacagc

SEQ ID NO: 46602 - DNA, 30 bp, Homo sapiens
  chr21:47546044-47546074
  hypo
ctactccatcgcctgcgacaagccacagca

SEQ ID NO: 46603 - DNA, 43 bp, Homo sapiens
  chr21:47565176-47565219
  hypo
tcaaggtccagacagcggccagtggtgacgccctcaggcccct

SEQ ID NO: 46604 - DNA, 62 bp, Homo sapiens
  chr21:47570296-47570358
  hypo
ctcacctgtgcttctcggcaggtctcctcgtagaccgtgtgcagtgccgtgacctcaaagtc

SEQ ID NO: 46605 - DNA, 30 bp, Homo sapiens
  chr21:47689638-47689668
  hypo
gcagcagagtgtgtgcgaggtgaggtggcg

SEQ ID NO: 46606 - DNA, 37 bp, Homo sapiens; identical to SEQ ID NO: 16750
  chr21:47737928-47737965
  hypo

SEQ ID NO: 46607 - DNA, 236 bp, Homo sapiens
  chr21:47746178-47746414
  hypo
gactgggtcagccctcgggcctcatggtccccaccagtctgttgactttgtggttctgttatttttttctcacttacctttgcctttactacttatctacatttttgcgcagcttgctcacttccgacagagaaaaacaaaaggtgacagttcgcattcggagaaaaagacggcgaagaggaagggctcggctgtcgatgcgtctgtccaggaggagagtccggtaaccaaggagg

SEQ ID NO: 46608 - DNA, 30 bp, Homo sapiens
  chr21:47771781-47771811
  hypo
agtgctgtccaagtgcgggctcacctggtg

SEQ ID NO: 46609 - DNA, 30 bp, Homo sapiens
  chr21:47772056-47772086
  hypo
gagggtgagccactgcgtgtctcctggcat

SEQ ID NO: 46610 - DNA, 44 bp, Homo sapiens
  chr21:47799181-47799225
  hypo
ctgcgtgtcgtgagccgcgcccgtcttcccgggccgcgtgtcgt

SEQ ID NO: 46611 - DNA, 37 bp, Homo sapiens
  chr22:17330739-17330776
  hypo
caaaaaaaaaaaaaaaaagtgtcggggtttggtatga

SEQ ID NO: 46612 - DNA, 120 bp, Homo sapiens
  chr22:18009965-18010085
  hypo
ggctggagtgcagtggtgccgcgcccggcacatgactgcatactttcaaggagaggactcagagcttttatttatttaaagaaacttgaaaggaggaaagtggattaagaaaaaaaaaat

SEQ ID NO: 46613 - DNA, 97 bp, Homo sapiens
  chr22:18110592-18110689
  hypo
aaaaaagaaaaaaagaaaaaaacacagttcataaagtgaacgaccttgtcaaaacactggttggaagcaggtctcttccctccgcactgtttcctat

SEQ ID NO: 46614 - DNA, 30 bp, Homo sapiens
  chr22:18265801-18265831
  hypo
gtgctgatggagaagcggggggggggggcc

SEQ ID NO: 46615 - DNA, 64 bp, Homo sapiens
  chr22:18328093-18328157
  hypo
gggtaacgtggggaacgcatactgtctggcaagaattctactaggaccacgggaaacaaagcag

SEQ ID NO: 46616 - DNA, 30 bp, Homo sapiens
  chr22:18355680-18355710
  hypo
taaattaagaagacacggggaaaaaaagaa

SEQ ID NO: 46617 - DNA, 30 bp, Homo sapiens; identical to SEQ ID NO: 16753
  chr22:18553893-18553923
  hypo

SEQ ID NO: 46618 - DNA, 53 bp, Homo sapiens
  chr22:18634479-18634532
  hypo
caaagtgttgtaatccgtgtgttctaacccgcatattacgattactcaagaaa

SEQ ID NO: 46619 - DNA, 139 bp, Homo sapiens
  chr22:19117537-19117676
  hypo
catgcactgcagccccgacccacccatacacaggcccttgctcgctggagcagcagcgactcacctgcccggctctctaccctgaggggcctgccgcctctgctcccaaacacagagctgctttcgtctaccaggcttg

SEQ ID NO: 46620 - DNA, 30 bp, Homo sapiens
  chr22:19444363-19444393
  hypo
gataacacttactgtcgactcctcatgctg

SEQ ID NO: 46621 - DNA, 43 bp, Homo sapiens
  chr22:19771799-19771842
  hypo
gagacacgcacagcacgtcaacatggagcgcccagcagcggcg

SEQ ID NO: 46622 - DNA, 78 bp, Homo sapiens
  chr22:19965000-19965078
  hypo
cactgcccaggggcccgggctcggcctcctggtacctgtcggccccgggcacctccttgtgcacgtggtaggacaggt

SEQ ID NO: 46623 - DNA, 151 bp, Homo sapiens
  chr22:20166058-20166209
  hypo
tggcccaggggtgagcggagaggggacctgagcaggcaacacgggcctggagaggagctttgtctctctaggagaaggcagcctgtcctgccagacctggtatcacgccaccccaaggcaggccccgcagagccctcgggagctccactcg

SEQ ID NO: 46624 - DNA, 33 bp, Homo sapiens
  chr22:20308760-20308793
  hypo
ccagagctggtcatgcgccgggcaccctggcct

SEQ ID NO: 46625 - DNA, 39 bp, Homo sapiens
  chr22:20749338-20749377
  hypo
ggcctcctgcttctttcttccccgcgcccaatcatttgt

SEQ ID NO: 46626 - DNA, 22 bp, Homo sapiens
  chr22:20765425-20765447
  hypo
ccgtgcccggccaaaaaggact

SEQ ID NO: 46627 - DNA, 20 bp, Homo sapiens
  chr22:20851286-20851306
  hypo
gggcttggtggctggcgcct

SEQ ID NO: 46628 - DNA, 34 bp, Homo sapiens
  chr22:21024902-21024936
  hypo
ggtccaccgcgttgccgtgcgagaagaagaccgt

SEQ ID NO: 46629 - DNA, 88 bp, Homo sapiens
  chr22:21105305-21105393
  hypo
ctttggcagctaaaccgagaacacagctgagtcaacatggctgaggtgggggagctgggcttggaagacagagcgacctgggggcagc

SEQ ID NO: 46630 - DNA, 30 bp, Homo sapiens
  chr22:21150528-21150558
  hypo
catccaccaggtgctcgtcttggatgttgg

SEQ ID NO: 46631 - DNA, 30 bp, Homo sapiens
  chr22:21153993-21154023
  hypo
caggctggccaagaacgcctccacaatcac

SEQ ID NO: 46632 - DNA, 91 bp, Homo sapiens
  chr22:21214252-21214343
  hypo
tagacaaatagtgtgcgggttaagagtttgttgctccaactcatcttcatcagttcttcccatccttagatttcagagagtagtaccttca

SEQ ID NO: 46633 - DNA, 34 bp, Homo sapiens
  chr22:21380309-21380343
  hypo
tcgggctcatccccacggccgtcacactgggcac

SEQ ID NO: 46634 - DNA, 58 bp, Homo sapiens
  chr22:21982983-21983041
  hypo
gtaccttccaggacccgcgccagggccccggacacgcggtgagcggacatgtgccggc

SEQ ID NO: 46635 - DNA, 87 bp, Homo sapiens
  chr22:21986707-21986794
  hypo
caaccaaggaggacacgaggaaggtgcttgtgccaccggtggaagacgtggctttggcttttaggctcccctcggggcaggagcaga

SEQ ID NO: 46636 - DNA, 30 bp, Homo sapiens
  chr22:22058379-22058409
  hypo
tggctgattctgctgcgtcaacattctgca

SEQ ID NO: 46637 - DNA, 30 bp, Homo sapiens
  chr22:22344036-22344066
  hypo
tccacccctcagcagcgggccccactccct

SEQ ID NO: 46638 - DNA, 321 bp, Homo sapiens
  chr22:22899633-22899954
  hypo
cgccactgcctgggccgtccccaacccccagcaccttcagaggggccgagtcccagagcatccaccgcattacaaatgcgcacccaccctggagagctccaaccacgagcaccgccgcctcggttcaaggcatccttacagccacaactcctcaactggggccaattttccggggcaggcggcccggggtgacccaagtggcgcacattattttctttggtcttcaacccatttccagagagaaaacagggacccgggacaggggtggtgccgggggcacaagcccaaggtcaccctgcggggaagcggaggaatcagggc

SEQ ID NO: 46639 - DNA, 330 bp, Homo sapiens
  chr22:22901123-22901453
  hypo
ggtgttctgggatcacggagacgtccaagtctggactctgtcctgggtctgtgcttctggcgacctcccttttcttcagtgggatgcggggtgcaggggccggttccaggtcccctgagctcaagtctcgccccaccccgccccgcaagtctagaaaagatgcccctgcccttggctgggtaatctctggatttacctactgtctgtaaccccccgggctgaagagaccaccccccgggagtcaattaacttactctctggagcgcgcgttcctccctgctcccaggagtcggtttcccaaaactttctgaggcccgcgcatgctcccct

SEQ ID NO: 46640 - DNA, 153 bp, Homo sapiens
  chr22:23453131-23453284
  hypo
tccacttggggtcagcgacgattccatctaggtgctgggtgaaccaagcacaggggtgctgcctcagagccacttcgaatgagggggtaggatagcactgggattccagcaggcgatcatcatttgctggggggcctgcgcgccttccctgtg

SEQ ID NO: 46641 - DNA, 30 bp, Homo sapiens
  chr22:23791417-23791447
  hypo
cgctcctgctgccctcggggccagtccctg

SEQ ID NO: 46642 - DNA, 82 bp, Homo sapiens
  chr22:23915601-23915683
  hypo
gcgtggtcatctccacgccctgggtgatgggggtaccatctgccttccaggtcaccgtcaagattcccggataaaagtcatt

SEQ ID NO: 46643 - DNA, 42 bp, Homo sapiens; identical to SEQ ID NO: 16758
  chr22:24374229-24374271
  hypo

SEQ ID NO: 46644 - DNA, 34 bp, Homo sapiens
  chr22:24560385-24560419
  hypo
gtggacgagattgaccggccgggcagctttgcct

SEQ ID NO: 46645 - DNA, 42 bp, Homo sapiens
  chr22:24646515-24646557
  hypo
gacagaggatggacccgaaggccgaagaaaatgcctcaaggg

SEQ ID NO: 46646 - DNA, 30 bp, Homo sapiens
  chr22:25091239-25091269
  hypo
tcacaccacctgggccgcaggtgacaggca

SEQ ID NO: 46647 - DNA, 21 bp, Homo sapiens
  chr22:25171155-25171176
  hypo
tcctcacgtggaagagtggaa

SEQ ID NO: 46648 - DNA, 30 bp, Homo sapiens
  chr22:26763231-26763261
  hypo
gccctagacagctctcgccttgccctagtc

SEQ ID NO: 46649 - DNA, 38 bp, Homo sapiens
  chr22:26932483-26932521
  hypo
ggcagacccagatggcgcctgagcggattccctgctca

SEQ ID NO: 46650 - DNA, 19 bp, Homo sapiens
  chr22:26965186-26965205
  hypo
accccgttccagtaacagt

SEQ ID NO: 46651 - DNA, 21 bp, Homo sapiens
  chr22:26991250-26991271
  hypo
gcctgtgaggccaggcgcagt

SEQ ID NO: 46652 - DNA, 20 bp, Homo sapiens
  chr22:27010657-27010677
  hypo
taaaaacaagtaaatcggcc

SEQ ID NO: 46653 - DNA, 71 bp, Homo sapiens
  chr22:27045927-27045998
  hypo
catgtcgggtgtgtccgacagtctcccagaagacctcagcaggactgagttctagtcgctaacaacttgct

SEQ ID NO: 46654 - DNA, 64 bp, Homo sapiens
  chr22:28007163-28007227
  hypo
ccgcactgcgtctcgcgcgagattaacccgtcccgcactgcgtctcacgcgagattaacccgtc

SEQ ID NO: 46655 - DNA, 75 bp, Homo sapiens
  chr22:28371649-28371724
  hypo
ctggaccctgaaaggcgttattttgtattttcatatatagtggcataaaatcgtttgtagcgttttcttattctt

SEQ ID NO: 46656 - DNA, 30 bp, Homo sapiens
  chr22:29167679-29167709
  hypo
agacatgcactaccacggtgggctaattgt

SEQ ID NO: 46657 - DNA, 30 bp, Homo sapiens
  chr22:29168256-29168286
  hypo
ataactgataatgagcgtgtattgtatgtc

SEQ ID NO: 46658 - DNA, 733 bp, Homo sapiens
  chr22:29445592-29446325
  hypo
agggcctcagctacccggagcaggaggggcagtccccacctagcctcgcaccccggggcccggcccgtgcctttcctccgagcggcagtggcagcctgctcttccccaccgtggtgcacgtggccccgccctcccacctggagagcggcagcacgtccagcttcagctgctatcacggccaccgctcggtgtgcagtggctacctggccgactgcccaggcagcgacagcagcagcagcagcagctccggccagtgccactgttcctccagtgactctgtggtagactgcactgaggtcagcaaccagggcgtgtacgggagctgctccaccttccgcagctccctcagcagcgactatgaccccttcatctaccgcagccggagcccctgtcgtgccagtgaggcggggggctcgggcagctcgggccggggacctgccctgtgcttcgagggctccccgcctcccgaggagctcccggcggtgcacagtcatggtgctgggcggggcgagccttggccgggccctgcctctccctcgggggatcaggtgtccacctgcagcctggagatgaactacagcagcaactcctccctggagcacagggggcccaatagctctacctcagaagtggggctcgaggcttctcctggggccgcccctgacctcaggaggacctggaaggggggccacgagttgccgtcgtgtgcctgctgctgcgagccccagccctc

SEQ ID NO: 46659 - DNA, 20 bp, Homo sapiens
  chr22:29701033-29701053
  hypo
ccggccgggaatgttaagac

SEQ ID NO: 46660 - DNA, 30 bp, Homo sapiens
  chr22:29736031-29736061
  hypo
cccccgtgctgccaccgtgcggacctgagc

SEQ ID NO: 46661 - DNA, 120 bp, Homo sapiens
  chr22:29977639-29977759
  hypo
catgcccagcctaccaagggttcttaacaaggctgtccgggatgtgcagcagagggtcagtgtaaccaccccatgggttcattttgcccgtttcccagacagcggatttatcaagacaga

SEQ ID NO: 46662 - DNA, 24 bp, Homo sapiens
  chr22:29977939-29977963
  hypo
agtggaagccgtcctcttgtgctg

SEQ ID NO: 46663 - DNA, 34 bp, Homo sapiens
  chr22:29997189-29997223
  hypo
cctttttttttgagacggagtctcgcactctcgc

SEQ ID NO: 46664 - DNA, 36 bp, Homo sapiens
  chr22:29998650-29998686
  hypo
aataataattctaggcggggcgtggtggctcacgcc

SEQ ID NO: 46665 - DNA, 30 bp, Homo sapiens
  chr22:30091110-30091140
  hypo
agagctgacctccaccgcccagcctgggaa

SEQ ID NO: 46666 - DNA, 33 bp, Homo sapiens
  chr22:30158330-30158363
  hypo
ccaacccccaggccccggaacggtacgggtcca

SEQ ID NO: 46667 - DNA, 29 bp, Homo sapiens
  chr22:30233129-30233158
  hypo
gtaggcagggctgggcgcgatggctcacg

SEQ ID NO: 46668 - DNA, 30 bp, Homo sapiens
  chr22:30768004-30768034
  hypo
tctgaggtagtacagcgctcccctgcccta

SEQ ID NO: 46669 - DNA, 102 bp, Homo sapiens
  chr22:30783894-30783996
  hypo
gggggcaaggcaaaacgaagcaggcagggactcagtgcctcagtgggaccgagaggctgggtcacttccctcatctgtgaaatgggcaccataggccgggcg

SEQ ID NO: 46670 - DNA, 319 bp, Homo sapiens
  chr22:30857340-30857659
  hypo
atgtgggcgttatagcgctggctgggtagaacatctgtcatctcccctgcccgctgtcgctcccccatcttggtcttcaggaaaactccgaagccgatgtccgcaccatcagatgagaactgccacctgtcagggggagggggaggagacaggttgctgctcagcctgatgggtctctgaggggttagggcctgcccctacctgagaacgcagcctggaaataggatctcgtattccacttggtgtgatgagccgcggttgatctgcaccgagtgctcgtactgagtcttcacctggtcccgcacgtacatggacttgg

SEQ ID NO: 46671 - DNA, 30 bp, Homo sapiens
  chr22:30924831-30924861
  hypo
ctcctaacctcaaatcgggatctctaccca

SEQ ID NO: 46672 - DNA, 30 bp, Homo sapiens
  chr22:30940902-30940932
  hypo
ttaaaacaacaacaacgtgaaaaaaagaaa

SEQ ID NO: 46673 - DNA, 30 bp, Homo sapiens
  chr22:31460423-31460453
  hypo
ggagaagatagcatccgaaagaattaaata

SEQ ID NO: 46674 - DNA, 35 bp, Homo sapiens; identical to SEQ ID NO: 16768
  chr22:32014233-32014268
  hypo

SEQ ID NO: 46675 - DNA, 29 bp, Homo sapiens
  chr22:32356777-32356806
  hypo
aaaaactccgtccccgccccccccccccc

SEQ ID NO: 46676 - DNA, 80 bp, Homo sapiens
  chr22:32701637-32701717
  hypo
atcaactgtgttcagcgtgagggacacacggtcccagtgtgagggacggtggcttttcaggagcacggtgctcattaaag

SEQ ID NO: 46677 - DNA, 30 bp, Homo sapiens
  chr22:32748880-32748910
  hypo
tttagtctccatggccgccaccaaccacag

SEQ ID NO: 46678 - DNA, 24 bp, Homo sapiens
  chr22:33170623-33170647
  hypo
gctggagtgcaatggcgcacgatc

SEQ ID NO: 46679 - DNA, 149 bp, Homo sapiens
  chr22:33255195-33255344
  hypo
tgtgacttccaagaacgagtgtctctggaccgacatgctctccaatttcggttaccctggctaccagtccaaacactacgcctgcatccggcagaagggcggctactgcagctggtaccgaggatgggcccccccggataaaagcatca

SEQ ID NO: 46680 - DNA, 35 bp, Homo sapiens
  chr22:35079349-35079384
  hypo
agactggagctgttcctattcggccatcttggctc

SEQ ID NO: 46681 - DNA, 30 bp, Homo sapiens; identical to SEQ ID NO: 5266
  chr22:35768487-35768517
  hypo

SEQ ID NO: 46682 - DNA, 96 bp, Homo sapiens
  chr22:35822686-35822782
  hypo
agctgggcctggccccggggaggtgctcccaggaagggctgggtgcctgtggttttccctgcctcacagcctctgccatctcggatttcacctttt

SEQ ID NO: 46683 - DNA, 64 bp, Homo sapiens
  chr22:35848324-35848388
  hypo
gtcacaccctggaaccgtgtggtgtttctgttgtctgcctacagtaggacgtaggctccacgcc

SEQ ID NO: 46684 - DNA, 30 bp, Homo sapiens
  chr22:35964914-35964944
  hypo
tggcacttactgacccgtaggggaggcaga

SEQ ID NO: 46685 - DNA, 25 bp, Homo sapiens
  chr22:36246202-36246227
  hypo
ccgtgtgcacgcatgcgcattctct

SEQ ID NO: 46686 - DNA, 25 bp, Homo sapiens
  chr22:36246287-36246312
  hypo
tcactgtctccggcagagacaggtg

SEQ ID NO: 46687 - DNA, 70 bp, Homo sapiens
  chr22:36585930-36586000
  hypo
ccataaactttacctcgccctctttattcccctaaaaaatgtctgcgttttgtcccggcctgtgtctggc

SEQ ID NO: 46688 - DNA, 150 bp, Homo sapiens
  chr22:36684196-36684346
  hypo
accctgccaggttcccgccctgggccgagccctggcaccttcatatgtagttggctcagtcgggtgccgcccaccctcacctgggccccgcccacccttacctgcagcttccgcagctgtttgatggcttcgtcccggttcttgttggcc

SEQ ID NO: 46689 - DNA, 30 bp, Homo sapiens; identical to SEQ ID NO: 16776
  chr22:36878964-36878994
  hypo

SEQ ID NO: 46690 - DNA, 126 bp, Homo sapiens
  chr22:36902430-36902556
  hypo
cgggggaccccacaacggggccgcagcggagaggcccatcctgcagcagatcagaggggtaaggcctcgcacccggcccggcggctgggagacacgaggcccagaaagaggcggggcctgcgggaa

SEQ ID NO: 46691 - DNA, 41 bp, Homo sapiens
  chr22:36906156-36906197
  hypo
tagtttacatagcctcggctgggtgcggtggctcacgcctg

SEQ ID NO: 46692 - DNA, 117 bp, Homo sapiens
  chr22:37321872-37321989
  hypo
ccaggatggcagctccgtgggcaggatttttgtgtgttttatcactgctggcccctgattctgaacagagccaggcatgtggtgagcactcgaggaacctttcgtgagtcagtgata

SEQ ID NO: 46693 - DNA, 82 bp, Homo sapiens
  chr22:37328816-37328898
  hypo
ccctccatccctcaacgtgaccaaggatggagacagctacagcctgcgctgggaaacaatgaaaatgcgatacgaacacata

SEQ ID NO: 46694 - DNA, 30 bp, Homo sapiens
  chr22:37334157-37334187
  hypo
cctccaattgagggccggtcccccaggtca

SEQ ID NO: 46695 - DNA, 50 bp, Homo sapiens
  chr22:37335158-37335208
  hypo
catggtattgggggtcgggggggcggtgcaagggacgcacatgagagact

SEQ ID NO: 46696 - DNA, 30 bp, Homo sapiens
  chr22:37348896-37348926
  hypo
aggcagaggggacaccgtagcccctacccg

SEQ ID NO: 46697 - DNA, 30 bp, Homo sapiens
  chr22:37367531-37367561
  hypo
caagcgtttgcacatcgttataaattatgt

SEQ ID NO: 46698 - DNA, 30 bp, Homo sapiens
  chr22:37367799-37367829
  hypo
aggctgagcaggttgcgcaccataaataca

SEQ ID NO: 46699 - DNA, 30 bp, Homo sapiens
  chr22:37395982-37396012
  hypo
cccttttctggccctcgaagacttcatcaa

SEQ ID NO: 46700 - DNA, 30 bp, Homo sapiens
  chr22:37770782-37770812
  hypo
gtcggtggagtagggcgtggggtggctcac

SEQ ID NO: 46701 - DNA, 30 bp, Homo sapiens
  chr22:38085235-38085265
  hypo
agccccactgctgagcggctgaggagcttg

SEQ ID NO: 46702 - DNA, 313 bp, Homo sapiens
  chr22:38199680-38199993
  hypo
gaccataccgggatgcgttcatcattttgaccagcaacaaactcccactcccagggtattgtttaagtgaacagtgaccggcctctatgcttagggaataaaagcggggttgtgggagaggggcccagggagcaaacgtcgcagaatctcagcccagggccgctgccaagcggacccggcacgtgagtaggaggtcggccgcagacaaggggtcctagggtctctgaggtctctcctgctggcctctgggcccctaaagcccctcgagcttcagaactccctacagacagtggcgccccgtgtccgcctcgtc

SEQ ID NO: 46703 - DNA, 30 bp, Homo sapiens; identical to SEQ ID NO: 16779
  chr22:38520276-38520306
  hypo

SEQ ID NO: 46704 - DNA, 84 bp, Homo sapiens
  chr22:38578330-38578414
  hypo
caatacatttttttccgatagaacagaaattgattatagcttttttatttttcacaactaaggccaaattccctaggggaatta

SEQ ID NO: 46705 - DNA, 24 bp, Homo sapiens
  chr22:38578714-38578738
  hypo
gcccggctccgaaatttttaacat

SEQ ID NO: 46706 - DNA, 136 bp, Homo sapiens
  chr22:38679362-38679498
  hypo
aagttaattacactacgtgctttcaagatgctgggatgaaagtccttgggaggcataattacttgagaagacattcttcaagggccgtggaggagcccaggttactatctgtaggcatcctttgccccaggtgggc

SEQ ID NO: 46707 - DNA, 89 bp, Homo sapiens
  chr22:38694504-38694593
  hypo
acccatgccctgctgcgggcacccaggagggaccccaggtgaagccagatcctccttgttccgacgggagacagcgccctgcctggccc

SEQ ID NO: 46708 - DNA, 30 bp, Homo sapiens
  chr22:38841845-38841875
  hypo
tgaaatgggatccggcgtgtgtcttgaagc

SEQ ID NO: 46709 - DNA, 30 bp, Homo sapiens
  chr22:39228205-39228235
  hypo
gtgtgagtccctccccgtcccagtgtctga

SEQ ID NO: 46710 - DNA, 32 bp, Homo sapiens
  chr22:39530973-39531005
  hypo
gccccacagagcactcgcgtcccagcgtttac

SEQ ID NO: 46711 - DNA, 182 bp, Homo sapiens
  chr22:39756856-39757038
  hypo
ctggcagagcagagacgaggctgtcgcccctgctggggtgtacgcttggagggcgagaactgcatctgtcatagccccaggactagattgcttccaggcatctccttagggccccaactatggatggacgtggcgggaactgcactgatcggtcgtccttctagccacggttcttcaggtgt

SEQ ID NO: 46712 - DNA, 79 bp, Homo sapiens
  chr22:39770483-39770562
  hypo
tggacgtgtacttcccgcagatcagcagcgtcaaggaccgcaagaaagccgtcctgtccgacatcggtgtctcgggtga

SEQ ID NO: 46713 - DNA, 135 bp, Homo sapiens
  chr22:39877264-39877399
  hypo
ctcacgtcgcctcctcggtgagcctgccctgcccactccattcatcactggacataatgacgcactcgctcctgcccgttacccgctttgtctttctccagagcacagcctctttgggcgcgcagttttctgagc

SEQ ID NO: 46714 - DNA, 30 bp, Homo sapiens
  chr22:39932533-39932563
  hypo
tcttgtgctcacacacggttaggttggagg

SEQ ID NO: 46715 - DNA, 206 bp, Homo sapiens
  chr22:40018133-40018339
  hypo
ccaaaaggtggcctccgtacactcagcacccagaactctgcctggcggacagaaggcgcgccaaagacacgtgtgaaatggacacagcaggtgtactgagctgtgtactgtgccaggaccacagagctatacatgctcctgtgccgggcatgaggaggcagggagaatggggctgggggtcgggaggcctccgggagaaggggatg

SEQ ID NO: 46716 - DNA, 50 bp, Homo sapiens
  chr22:40037034-40037084
  hypo
gactttggggcggggcgccaggacctcaatgccagcggcctctgtgtcaa

SEQ ID NO: 46717 - DNA, 270 bp, Homo sapiens; identical to SEQ ID NO: 16784
  chr22:40042590-40042860
  hypo

SEQ ID NO: 46718 - DNA, 41 bp, Homo sapiens
  chr22:40055020-40055061
  hypo
ttcatgcctgccctgcggcgccagctcgtggtgctcatgaa

SEQ ID NO: 46719 - DNA, 30 bp, Homo sapiens
  chr22:40055554-40055584
  hypo
ggtgagtggccgctgcgtgttcatgtttgc

SEQ ID NO: 46720 - DNA, 97 bp, Homo sapiens
  chr22:40073967-40074064
  hypo
ggctgacctcctccccgcttccagtctgcaacgacgagaacccgtgcgagggcatgagccggcatgccaccttcgagaacttcggcatggccttcct

SEQ ID NO: 46721 - DNA, 37 bp, Homo sapiens
  chr22:40095526-40095563
  hypo
atttggctgagcaaccgggcaccgtagcccagccagc

SEQ ID NO: 46722 - DNA, 30 bp, Homo sapiens
  chr22:40113507-40113537
  hypo
agttataggataggccggtcagattaacca

SEQ ID NO: 46723 - DNA, 26 bp, Homo sapiens
  chr22:40548285-40548311
  hypo
cctcaaaattttggacggaaaagttt

SEQ ID NO: 46724 - DNA, 20 bp, Homo sapiens
  chr22:40991418-40991438
  hypo
ccggccgagaaatgcctttt

SEQ ID NO: 46725 - DNA, 150 bp, Homo sapiens
  chr22:41048813-41048963
  hypo
aaccttcctgccttccgggtgctcagagtctagtctggagacaataagaaaaatggttaatcaccatggaatgtgctagcgccttagcccgaagcaggggtctggttattgaggtttgttgaaggaagatgcctgtaagggctgggtgcg

SEQ ID NO: 46726 - DNA, 81 bp, Homo sapiens
  chr22:41578499-41578580
  hypo
aatagtgttatggaggtagaagatacggattaatccagagtcagcaatataataagatgatttcaacgtttgtagtttttt

SEQ ID NO: 46727 - DNA, 444 bp, Homo sapiens
  chr22:41634411-41634855
  hypo
gcagagcctggagctcgttgtggtgtaggctgagccgtctcagggcgggcaggccagccagggcctcgggggccagcacgctgagcgcgttgtgcgacagccgcagccagcggacgcgcagtagcccctggaaggccatggcgggcaggtaaaccagggcgttgtgggccaggtttagcgtggccagcgcacccagtgccccgaacgtccccggccgcagctcctccagtgcgttcccctccagctccagccgccgcaacgagcccagcccgtccagcgcctcctggggcagctcacgcaggtggttggaggccaggttgagcaggagcaggcggcccaggccacggaaggcgccctcggccaccagctccacctcgcagtggcgcaggtccaggtgtgtgaggtgaggcacgccctggaaggcggctgcggggatcaccttca

SEQ ID NO: 46728 - DNA, 30 bp, Homo sapiens; identical to SEQ ID NO: 16787
  chr22:41637166-41637196
  hypo

SEQ ID NO: 46729 - DNA, 101 bp, Homo sapiens
  chr22:41657315-41657416
  hypo
ggcttggagagggcacgtgacgccccaggtctcttggttgagtgccagccctgggattagcatccagaactgtcagcctactatgccgagtgcacctcaag

SEQ ID NO: 46730 - DNA, 30 bp, Homo sapiens
  chr22:41668138-41668168
  hypo
cttgatcccatgtgccgaaagcaagctcag

SEQ ID NO: 46731 - DNA, 44 bp, Homo sapiens
  chr22:41776124-41776168
  hypo
ttttcctccttaccccgccgcaaaattatttttatttatttatt

SEQ ID NO: 46732 - DNA, 81 bp, Homo sapiens
  chr22:41839301-41839382
  hypo
ctctaatgtcagaagcgaaggaagatttttttccccccctcgagacagtcttgctctgtagcccagagctggagtgcaatg

SEQ ID NO: 46733 - DNA, 21 bp, Homo sapiens
  chr22:41839922-41839943
  hypo
cccggccggaaggtttttcag

SEQ ID NO: 46734 - DNA, 18 bp, Homo sapiens
  chr22:41939343-41939361
  hypo
tgcattgacccgaggcga

SEQ ID NO: 46735 - DNA, 42 bp, Homo sapiens
  chr22:42109080-42109122
  hypo
gggattacatgcgtgagccaccgcgcccggctgggcattaga

SEQ ID NO: 46736 - DNA, 127 bp, Homo sapiens
  chr22:42395163-42395290
  hypo
ggcggggagggggtgcgagacgcgtgtgtccttcgaagagaggccggagctgaccggcggttgtgagcagccgggggccttcggtggcagcgtggctgcccttgggtgcctgcgactttgttggatg

SEQ ID NO: 46737 - DNA, 51 bp, Homo sapiens
  chr22:42667191-42667242
  hypo
gtccctggcagcccccgcccatgggttccaggtgtccgtggaggaacgact

SEQ ID NO: 46738 - DNA, 30 bp, Homo sapiens
  chr22:42675831-42675861
  hypo
ggcctccgtggcaatcgggctcacaaagcc

SEQ ID NO: 46739 - DNA, 30 bp, Homo sapiens
  chr22:42829925-42829955
  hypo
gcattggaaaagcatcggtctgtgcctcta

SEQ ID NO: 46740 - DNA, 47 bp, Homo sapiens
  chr22:42963266-42963313
  hypo
gtctgggaatgttaacgtgtttgtctttgatccgtgtgggatttgtt

SEQ ID NO: 46741 - DNA, 30 bp, Homo sapiens; identical to SEQ ID NO: 16790
  chr22:42995705-42995735
  hypo

SEQ ID NO: 46742 - DNA, 21 bp, Homo sapiens
  chr22:43012543-43012564
  hypo
agtgtagggcagatgcggagg

SEQ ID NO: 46743 - DNA, 30 bp, Homo sapiens; identical to SEQ ID NO: 16792
  chr22:43083005-43083035
  hypo

SEQ ID NO: 46744 - DNA, 57 bp, Homo sapiens
  chr22:43434441-43434498
  hypo
gcatgggaacaaccacgctcgcgcagcctgtcccgcagccatcgctcctcccacagc

SEQ ID NO: 46745 - DNA, 194 bp, Homo sapiens
  chr22:43524923-43525117
  hypo
cccatggtgtccactcggcaccgcccaccacaagggcagctgactgccctcacctgtgcccaccgggtgtctttgcctgtgtcccgcagactggcaggcccaggccacgctggcctctctggccacgtcctcagggccactttccccctctcctgaactccttccttctctggtcccctcgagctccttcccag

SEQ ID NO: 46746 - DNA, 30 bp, Homo sapiens
  chr22:43570284-43570314
  hypo
gccagggtgggccctcggggccacctgccc

SEQ ID NO: 46747 - DNA, 30 bp, Homo sapiens; identical to SEQ ID NO: 16795
  chr22:43581330-43581360
  hypo

SEQ ID NO: 46748 - DNA, 262 bp, Homo sapiens
  chr22:43601093-43601355
  hypo
ctggtccctggacctcgggaacatcgctttgctgctctgactttcattcttccctgcacagagaggtcacgatgcctcttcccggggctgcgaggaaaatgatctgcactggcgtgagcagagaacctctcctcagcggtgctcagtacaggtttgctgcagggatctaggcagcaaacggggctgtcctccggagcagtctctggagggcagatgcagtccccgccctctctgagccccagtgtctcgtctctctagtggg

SEQ ID NO: 46749 - DNA, 202 bp, Homo sapiens
  chr22:43603869-43604071
  hypo
gcagaggccactaaccgctgtcttgcctgtaccacccggtaccaccctcagcctgtctggctctggcccctgacagtgttcgttctgcttccaggtctgtacctgccaggtcgcagctccctgagggcggggacgtgcgactcatctctgtgtctccagggccccgcctgagccgtgcacagtgggccgtgaagacagtgga

SEQ ID NO: 46750 - DNA, 30 bp, Homo sapiens
  chr22:43665130-43665160
  hypo
aggttgggacagcgtcggggaagacgtgcc

SEQ ID NO: 46751 - DNA, 119 bp, Homo sapiens
  chr22:43677877-43677996
  hypo
tgtccctctgagttccgccagctttgggcctggcttcaggctcctgggcccattgtctcccataggtaaccacagctgctgggacgaggactcctctggccaaccggaacaagctggaa

SEQ ID NO: 46752 - DNA, 30 bp, Homo sapiens
  chr22:43689691-43689721
  hypo
ccctgggactcagttcggacccctctcatg

SEQ ID NO: 46753 - DNA, 30 bp, Homo sapiens
  chr22:43735330-43735360
  hypo
tgcccgtccattgatcggtgggctcattgg

SEQ ID NO: 46754 - DNA, 154 bp, Homo sapiens
  chr22:44455600-44455754
  hypo
aataaagaaagatgccgtacacattttcctttaaaaagtctcacttggcttgtttgacaggcacagaagatgtgttattaaacacttgcaaagcctgctgtcatttggttttaaacagcactcgtcgtctttggcggggcgtgtttgctcagca

SEQ ID NO: 46755 - DNA, 30 bp, Homo sapiens
  chr22:44484781-44484811
  hypo
gtatgttctgtaatccgaggttgtgtgccc

SEQ ID NO: 46756 - DNA, 36 bp, Homo sapiens
  chr22:44527455-44527491
  hypo
gtacatgacctgctgcggccccgaggctgggcgctc

SEQ ID NO: 46757 - DNA, 39 bp, Homo sapiens; identical to SEQ ID NO: 16798
  chr22:44538737-44538776
  hypo

SEQ ID NO: 46758 - DNA, 60 bp, Homo sapiens
  chr22:44564136-44564196
  hypo
tggggtttttggtcccggtaagtgtcattagccatgtcccccaaccggttcttagacatg

SEQ ID NO: 46759 - DNA, 63 bp, Homo sapiens
  chr22:44564434-44564497
  hypo
gacaggaggatggcacgcctctgaagtttctctgtttccttctgcagacgtggttaacttgga

SEQ ID NO: 46760 - DNA, 62 bp, Homo sapiens
  chr22:44580537-44580599
  hypo
gtaggtgttatggagcgagaactccagtgccaacagggtccctggcacggcagatgagaccc

SEQ ID NO: 46761 - DNA, 180 bp, Homo sapiens
  chr22:44664413-44664593
  hypo
agtggaacgaggtgccgggactcccagcccagggttctgctctgcaccagcaccccccagaagactcagtccagtggaaacaggccacggagctctctgactgtgctgcaagtgggcagcagggagagggtgttttagaggatggggagaggcctcgggaaggagcgtgacctcagcgac

SEQ ID NO: 46762 - DNA, 30 bp, Homo sapiens
  chr22:44671280-44671310
  hypo
agcgaggctgagtttcgggaagctcctggg

SEQ ID NO: 46763 - DNA, 93 bp, Homo sapiens
  chr22:44681409-44681502
  hypo
tgcggctgtggggcccgctgacccggccgaggggcccgagcggggttcccccaccgccgggggtcctgtttcatccatcgtccttggatgccc

SEQ ID NO: 46764 - DNA, 70 bp, Homo sapiens
  chr22:44698506-44698576
  hypo
gccctggggtgggtgcggtgaggaggcagcaggggcaaaggccctggggtgggtgcggtgaggaggcagc

SEQ ID NO: 46765 - DNA, 133 bp, Homo sapiens
  chr22:45020626-45020759
  hypo
tggcctccagaactgcgatcgaataaatgtctgttgttttaagtcccccaggctgtggtcatctgtgagtccgcagaactgacttggggaccttgggtggcagcagctcccctgcacacggtcccacgggtcc

SEQ ID NO: 46766 - DNA, 163 bp, Homo sapiens
  chr22:45075725-45075888
  hypo
gcccggaaaagatgccggcgcagcctgagggcttgtacaggtgccactgtgccgaagggtggctacgagggaggcaggtgtatgggtgagggtgagtgcagtgtggctggaggcttagggaaaggtgagtaggacggcgagagacccacggggaatgagggct

SEQ ID NO: 46767 - DNA, 73 bp, Homo sapiens; identical to SEQ ID NO: 16800
  chr22:45088693-45088766
  hypo

SEQ ID NO: 46768 - DNA, 41 bp, Homo sapiens
  chr22:45093092-45093133
  hypo
cctggtgcttggtgccggagtcaccgcgagtaccctgggct

SEQ ID NO: 46769 - DNA, 104 bp, Homo sapiens
  chr22:45137806-45137910
  hypo
gccagccaggaaacaccacatactggatgattccattccgagatgttcagaataggcaaatccacggggacagaaagtagagtggtggtcgccagaccctgcgg

SEQ ID NO: 46770 - DNA, 191 bp, Homo sapiens
  chr22:45277292-45277483
  hypo
tgaagacatggacatcgcaagccacgcggtaatgcatacttggcacagagtagccaatatagaagacgtgtgcctcacacggttcactttgttcatcaataaaagaatataaaaatcttgttcacccagtggtaagtgtattaaaatagatctgtatcatacagcacagtttctcccggagtcgtgagaat

SEQ ID NO: 46771 - DNA, 49 bp, Homo sapiens; identical to SEQ ID NO: 16801
  chr22:45593666-45593715
  hypo

SEQ ID NO: 46772 - DNA, 30 bp, Homo sapiens
  chr22:45604343-45604373
  hypo
aacaggcagaaccaccgactccacacgcac

SEQ ID NO: 46773 - DNA, 106 bp, Homo sapiens
  chr22:45931289-45931395
  hypo
tagaatctgcggggccgcatggtatacagaacaggggttggcaaactttttgtgtaaagggctggacagcaaatagagcaaatactttagccgttgtgggccatat

SEQ ID NO: 46774 - DNA, 30 bp, Homo sapiens
  chr22:45981309-45981339
  hypo
gtggagagtttggcccgggatcagtacaca

SEQ ID NO: 46775 - DNA, 36 bp, Homo sapiens
  chr22:46438085-46438121
  hypo
aaaatcagctgggcacgttggctcacgcctgtaatc

SEQ ID NO: 46776 - DNA, 86 bp, Homo sapiens
  chr22:46521906-46521992
  hypo
ctggtggctgtgagccgggccggctggctcattcagcccaggccccacccgccctgggatgatctggaccccggccctgctctcag

SEQ ID NO: 46777 - DNA, 38 bp, Homo sapiens
  chr22:46719152-46719190
  hypo
ttggcaggtgagtgacgttggtccgcttcctctcttta

SEQ ID NO: 46778 - DNA, 120 bp, Homo sapiens
  chr22:46805005-46805125
  hypo
ggtcactccaggacacgacgctctcaccgctgaagagctgggggtgaggcatggctgcggacacaggcccagggacctcaggtgtctcccgaaatcacacggccgcggacttggctgcag

SEQ ID NO: 46779 - DNA, 148 bp, Homo sapiens
  chr22:46929253-46929401
  hypo
gaaggcgctgatccccggtcttgaacttgggagaaccgcaggcctgctcccaggaaaatgctgacggaagcggcgcggtgcctctccccctcgctgggcctaggccgggcgcccacccccagcatccaaccggcggcaacaaatcctt

SEQ ID NO: 46780 - DNA, 57 bp, Homo sapiens
  chr22:46929652-46929709
  hypo
tgaggctgtctgacacgtcggggtcatgggccgggatgcagccgatcacgccggtgg

SEQ ID NO: 46781 - DNA, 252 bp, Homo sapiens
  chr22:46931788-46932040
  hypo
ccaggagctggtactcggccgcctcctcccggtccagcaccgcccgtgtgctcaccacgccagagctctcgttgagctggaagacgtcccacgcgccccccaacacgcggtaacgcaagttggcgttgatgggcgagtcgcggtcgctggcgcggatggtcagcacctcgtagcccacctccaggttctcccgcacgcgctcgcggtactccgactgctcgaagaccgggctgtggtcgttggtgtctttga

SEQ ID NO: 46782 - DNA, 173 bp, Homo sapiens
  chr22:47005073-47005246
  hypo
cccagagacatacatcgcagaccgctgagtggcgctggttgctgtctgggccggcttggcctcaggcgatcctgttgccctccgcgcaggagcctgggtccaccttctcctggctgtgtgcttccttaaacacggaaggtgttccgcagcctgctgtgcggggtagccctgtg

SEQ ID NO: 46783 - DNA, 57 bp, Homo sapiens
  chr22:47005505-47005562
  hypo
tctttggtgccaggccgtgtgctgggccccagggacacggcacgctgatggtcagag

SEQ ID NO: 46784 - DNA, 77 bp, Homo sapiens
  chr22:47054535-47054612
  hypo
tcatggctctgatcccggcctgctggtgaccccattctgtacatccacccagtgccccaccccgggggccagcccgg

SEQ ID NO: 46785 - DNA, 36 bp, Homo sapiens
  chr22:47193335-47193371
  hypo
tgcagaaagtgccagcgatgccgcccctctgcagag

SEQ ID NO: 46786 - DNA, 36 bp, Homo sapiens
  chr22:47428866-47428902
  hypo
ttcctctggggctgtcgctgtcgtcctggctgctct

SEQ ID NO: 46787 - DNA, 219 bp, Homo sapiens
  chr22:47525705-47525924
  hypo
gtggggctgtgtcagcgtcactgccgctgagtcaccacgtgcactgtgcctgtcatccctttctgggacagcatgtcactttccttggtgtcaccaatcatctcccttaggagtctgtgaaccacccactccctccctccccaccagacaggttaccggagcgggcgtgtctggaggagcaggcagagcaggtgctgtacacctcgtgtcctctgggac

SEQ ID NO: 46788 - DNA, 30 bp, Homo sapiens
  chr22:47840461-47840491
  hypo
ctctccctgcttccccgtgtgcgcctcact

SEQ ID NO: 46789 - DNA, 68 bp, Homo sapiens
  chr22:48027676-48027744
  hypo
ggaggagtgtgtgtgcgcttgatgacgatgatggagcccagtgagccaccgtccgtggagtgtcagag

SEQ ID NO: 46790 - DNA, 34 bp, Homo sapiens
  chr22:48553477-48553511
  hypo
gagcctcagtttccacgtgcgcaccatggtgtca

SEQ ID NO: 46791 - DNA, 30 bp, Homo sapiens
  chr22:48661129-48661159
  hypo
gtcacaggtggaagccggggccactccttt

SEQ ID NO: 46792 - DNA, 30 bp, Homo sapiens
  chr22:48728717-48728747
  hypo
ggctggggttgtcctcgttgtaccaagggt

SEQ ID NO: 46793 - DNA, 30 bp, Homo sapiens
  chr22:48793754-48793784
  hypo
acacacctgcaccctcgcagcacacacaca

SEQ ID NO: 46794 - DNA, 119 bp, Homo sapiens
  chr22:48917425-48917544
  hypo
tacaaatgtgagtttcggggagccatcccagccagccgcacgggagacggaggatgcgtggccacagatggacccgatccgttaggtgtaaaaggtaaatacggcgagaagtttccatc

SEQ ID NO: 46795 - DNA, 241 bp, Homo sapiens
  chr22:48931827-48932068
  hypo
ccccccaggagtgcccgtgttgtcgagcccccgccacagagctgcaccgccgcttggtgccgcatgcagcgagttcccgcatgggttggttttcgtctcctgaaactaatttggcagaagcaagtgtccatatgtaggtgtgggtctctgtcttcatgcgtcccccatgccccgacacacacacacgtttccattaattagcagggacttggaaacctaccgtccccggctcaaggcaaat

SEQ ID NO: 46796 - DNA, 106 bp, Homo sapiens
  chr22:48976157-48976263
  hypo
ccaatgcagagtgttcgtctatctgttagatggatcagtttattttttaagaaatggatagagaacttcttaggagacacagcacagttcccggccctaagactcc

SEQ ID NO: 46797 - DNA, 144 bp, Homo sapiens
  chr22:48987212-48987356
  hypo
ctctcctcccacccccgtgcgtctgacccccagggcttgcgatgcctcagttgcctgcagccatggccttgccctggatggagagcacagacagaggcagctgggagtttctgggagtttctgaggcctcgcattggacagagt

SEQ ID NO: 46798 - DNA, 80 bp, Homo sapiens
  chr22:49048024-49048104
  hypo
acctgctctattgtacgcaagagactgggagtgcgccaaggtccctaagatgcggtgtctgtggccgagtcagcctgcat

SEQ ID NO: 46799 - DNA, 177 bp, Homo sapiens
  chr22:49115640-49115817
  hypo
aaaaacgtatatggccggcgccacatcagctagtattgtaagcagtgacactcttcattttctcagcagaaatgagcccagaaacaaaaaaaaattggtttgaccaaacccacattatttctgtctgcactttgggccacttttgtaatgggagacgtgacacgctgggcgccattt

SEQ ID NO: 46800 - DNA, 30 bp, Homo sapiens; identical to SEQ ID NO: 16811
  chr22:49117093-49117123
  hypo

SEQ ID NO: 46801 - DNA, 30 bp, Homo sapiens
  chr22:49138471-49138501
  hypo
ggcaacgtggtagaccgggcagtgtgatgg

SEQ ID NO: 46802 - DNA, 30 bp, Homo sapiens
  chr22:49145839-49145869
  hypo
ccgacccgaggaggccggactcagacacat

SEQ ID NO: 46803 - DNA, 30 bp, Homo sapiens
  chr22:49147007-49147037
  hypo
atttcctgcccctttcgccactcacggacc

SEQ ID NO: 46804 - DNA, 30 bp, Homo sapiens
  chr22:49247250-49247280
  hypo
atctcgcgtggccaccgtgaagtatggaca

SEQ ID NO: 46805 - DNA, 30 bp, Homo sapiens
  chr22:49277436-49277466
  hypo
cctcctcctgcctcacgcaccacacaaccc

SEQ ID NO: 46806 - DNA, 40 bp, Homo sapiens
  chr22:49387651-49387691
  hypo
tctttctgatcatctcggttccaatcgaggtgagatggtg

SEQ ID NO: 46807 - DNA, 39 bp, Homo sapiens
  chr22:49447333-49447372
  hypo
ttaggtcgtaaagaccgtctccatcgcttcttccgttcg

SEQ ID NO: 46808 - DNA, 36 bp, Homo sapiens
  chr22:49491699-49491735
  hypo
acactcacacagacgcgtgaacgcactcacatacac

SEQ ID NO: 46809 - DNA, 100 bp, Homo sapiens
  chr22:49508009-49508109
  hypo
gactatacccggccacgggaggaggatggcgagtcgcgcttgcaaatgtttgctcacccggcacgtgtcacgagtgtgcgctccgcgcccatcacctttc

SEQ ID NO: 46810 - DNA, 30 bp, Homo sapiens
  chr22:49510169-49510199
  hypo
cagcttctaggataacgtggtgaggaaaaa

SEQ ID NO: 46811 - DNA, 253 bp, Homo sapiens
  chr22:49637528-49637781
  hypo
tcactgagcttcacacgacgctagctctgtccaagtcggggtccctgtgcccctaggtttccggtcaccgggagagctgtctgtcgcgccataagctggaggtgcgcaggaggatagaaatagaaactcctcatccagccgggccagggcactgacagccacagcgatgtccacggtgtaatggtcacggactccgtccccaaattagcccattttttacaaagacgataatggggggcggttctctgtgaaa

SEQ ID NO: 46812 - DNA, 30 bp, Homo sapiens
  chr22:49694859-49694889
  hypo
agcttctccaccgcccgcagcagcttctcc

SEQ ID NO: 46813 - DNA, 39 bp, Homo sapiens
  chr22:49785322-49785361
  hypo
tagccagggtttgcccgcggacgccgcccagccctccct

SEQ ID NO: 46814 - DNA, 30 bp, Homo sapiens
  chr22:49814696-49814726
  hypo
gcttgccaggtggagcgcacatctgttcag

SEQ ID NO: 46815 - DNA, 32 bp, Homo sapiens
  chr22:49831409-49831441
  hypo
cacggtcttctcgtacgcgtgaggagccagtg

SEQ ID NO: 46816 - DNA, 40 bp, Homo sapiens
  chr22:49831947-49831987
  hypo
tctggaatttggagccggtgacatacgctgaagtctctct

SEQ ID NO: 46817 - DNA, 30 bp, Homo sapiens
  chr22:49851741-49851771
  hypo
ccacccacggctgtgcgtcccttaacaaag

SEQ ID NO: 46818 - DNA, 30 bp, Homo sapiens
  chr22:49852487-49852517
  hypo
acggaccaacccgggcgctgacatcactct

SEQ ID NO: 46819 - DNA, 149 bp, Homo sapiens
  chr22:49864707-49864856
  hypo
aaggtgtgactgcagcgtgactggtggaaacatatgtttgcgttaccactcccctgccagccacaaatacacacaaaagagactgggatggtggcaccaaagagcttcagagggcacgggcgtcatttccacatcgctttccaaaatgc

SEQ ID NO: 46820 - DNA, 43 bp, Homo sapiens
  chr22:49868142-49868185
  hypo
gaaagagtgactccacgaagcaagcgtacgaatacaagctcac

SEQ ID NO: 46821 - DNA, 39 bp, Homo sapiens
  chr22:49888284-49888323
  hypo
ccaggggtctccaggcggtgggagcgcaccccagcaggc

SEQ ID NO: 46822 - DNA, 58 bp, Homo sapiens
  chr22:49911506-49911564
  hypo
tctctgtataaccttcgcggccactgcccccgtgcctgcagagcgggtttgcaggaga

SEQ ID NO: 46823 - DNA, 99 bp, Homo sapiens
  chr22:49934854-49934953
  hypo
gggtgactggggcagcggagaaagcggagacagagacagggtgtgcccagggcgcgggcaccgggaggtccagcctgcgaggcacgtggcctgcccagc

SEQ ID NO: 46824 - DNA, 30 bp, Homo sapiens
  chr22:49937851-49937881
  hypo
ttttgtttaatcccacgtgagcaaaatcac

SEQ ID NO: 46825 - DNA, 39 bp, Homo sapiens
  chr22:49941794-49941833
  hypo
ccagacaagtcccgccgctgtcagcgcacctctgcattg

SEQ ID NO: 46826 - DNA, 51 bp, Homo sapiens
  chr22:49943168-49943219
  hypo
tgcctgatgcagagtcgggggcggcttcctgcagaccgggcttccttggcc

SEQ ID NO: 46827 - DNA, 30 bp, Homo sapiens
  chr22:49948590-49948620
  hypo
ccccgggtgcacccacggtgatcagggacc

SEQ ID NO: 46828 - DNA, 30 bp, Homo sapiens
  chr22:49959175-49959205
  hypo
ctcttcactgcttctcggagtgggatccat

SEQ ID NO: 46829 - DNA, 30 bp, Homo sapiens
  chr22:49963888-49963918
  hypo
ctcgtgcagcctctccgagcacccctgact

SEQ ID NO: 46830 - DNA, 175 bp, Homo sapiens
  chr22:49967997-49968172
  hypo
gagcctcggggcctgcggggggccaggcagcagctgccctcacagttgcacggtacagtttgcagaacacaccctcctgccctgtggaagcttccaggctcccgggcaggtcgctgaaggatcctcttcctggcccctggagtccacaggtgcgacatcccgtcccgacatgggt

SEQ ID NO: 46831 - DNA, 74 bp, Homo sapiens
  chr22:49970518-49970592
  hypo
accagctgatgacaacgtgtttccccctgtggctgcagccactcctgtcccatgggcagcgcagagctgtcctc

SEQ ID NO: 46832 - DNA, 30 bp, Homo sapiens
  chr22:49977657-49977687
  hypo
ggctccgggcagctgcgtcagggccccaca

SEQ ID NO: 46833 - DNA, 40 bp, Homo sapiens; identical to SEQ ID NO: 16815
  chr22:49979613-49979653
  hypo

SEQ ID NO: 46834 - DNA, 187 bp, Homo sapiens
  chr22:49980189-49980376
  hypo
tctgtgtgacatcagcgtgtttagtgcatgacatcagcatgtttagcacagagtcactgggagacagtgtgagtctgtgtgacatcagcgtgcttagtgtatgacatcagcgtgtttagtgcatgacatcagcgtgcttggcacagagtcactggaaggtggcatgagtctgcgtgacgtcagcatg

SEQ ID NO: 46835 - DNA, 30 bp, Homo sapiens
  chr22:49980591-49980621
  hypo
tgcacccactgctctcgtgggccccaggtt

SEQ ID NO: 46836 - DNA, 189 bp, Homo sapiens
  chr22:49983668-49983857
  hypo
cggcagtgctggggccgggaattctccctgtgggctctgccctccggcgtgaccagtgcatgtgtctgtgctggaggtcggggcccttgagatgagacactgaatgctccctgctctgcccggctcccggcggcaggtggagcgtccagcgcacacagggtctgcacagccaggcgtttcttccccacc

SEQ ID NO: 46837 - DNA, 33 bp, Homo sapiens
  chr22:49992716-49992749
  hypo
cagcatgagtaatgacgacggcccctccacggc

SEQ ID NO: 46838 - DNA, 35 bp, Homo sapiens
  chr22:49994264-49994299
  hypo
cacaggccctggggccgcagcgtccacagccccgc

SEQ ID NO: 46839 - DNA, 30 bp, Homo sapiens
  chr22:49996899-49996929
  hypo
taccccaggccctggcgaggccactctggt

SEQ ID NO: 46840 - DNA, 30 bp, Homo sapiens
  chr22:50000658-50000688
  hypo
aagtatacaggagaacgtggaattcatctg

SEQ ID NO: 46841 - DNA, 169 bp, Homo sapiens
  chr22:50001661-50001830
  hypo
taccatgattaatgtcgtgcgcaggcctctcctgggtgccggggattcagctgcgatgaacaggacaaagtccagatctcatgggaccggcatgggggtgatctcagggaggacaacagagaaaatggaagccaagaaccgggaacagggattccgacagatctgggtt

SEQ ID NO: 46842 - DNA, 233 bp, Homo sapiens
  chr22:50002568-50002801
  hypo
agctggagacattctcgtgttcacggtcacagctctgctcctttgagaaataagcggcacgatgtttttctagtgggtttgcctttttctcagtgatggtaaaagtgctgtgtatgttaaggtgagtgactcaggaccaaggtgagtcttgactcctcttggctttgcgctgagagcacctgggagagtcaagggagcacacaggacagtccctgcttcggctccccaggaac

SEQ ID NO: 46843 - DNA, 78 bp, Homo sapiens; identical to SEQ ID NO: 16818
  chr22:50003204-50003282
  hypo

SEQ ID NO: 46844 - DNA, 176 bp, Homo sapiens
  chr22:50007867-50008043
  hypo
acacctggatccccacgaaactgcagaaactgtgactcagacccggcagctccttaccaagcccctccctggagccgcctcacctcccaaagggctcctctctcttgctcttcaaaagttagccccaacgacctgcggcacacggcacacgagactggcttcgcattttgcgttaa

SEQ ID NO: 46845 - DNA, 38 bp, Homo sapiens
  chr22:50008747-50008785
  hypo
gatgcaggccccctccggcgctgcgctccacaatttga

SEQ ID NO: 46846 - DNA, 280 bp, Homo sapiens
  chr22:50010113-50010393
  hypo
ggcttcagagctcctcgcagcctgcgccagcgcagagcaggacgggaaacagccccgggagcagaaggtcccagcagcggaattcccctccacttggaccaggcctgcgggagatccgggcactgacaggcggggacattttagaatcttttcaagaaaagataaagaaagaaacaagagtaacaggaggccagaagcaagggcatctactgcagacagcggtgccgcggggctggagctgaagctacccaaggagccccaggctcgggagcctccaggc

SEQ ID NO: 46847 - DNA, 30 bp, Homo sapiens; identical to SEQ ID NO: 16820
  chr22:50010606-50010636
  hypo

SEQ ID NO: 46848 - DNA, 46 bp, Homo sapiens
  chr22:50013222-50013268
  hypo
gaaggatcaaggcagcgagctcctcacggggcgggggcaggctcca

SEQ ID NO: 46849 - DNA, 158 bp, Homo sapiens
  chr22:50015975-50016133
  hypo
gccctgagaagtgaccgtgctggtaggcgtggtgtaaggctggacactgccggctgacctgctcccgggggcccaggagaccctgcactggccactgggaagagtgggcagcagcagcctccctggaagctggggtggccgggcggtgtgggcagggc

SEQ ID NO: 46850 - DNA, 30 bp, Homo sapiens; identical to SEQ ID NO: 16821
  chr22:50024083-50024113
  hypo

SEQ ID NO: 46851 - DNA, 30 bp, Homo sapiens
  chr22:50025118-50025148
  hypo
tgtttcagggcacaccgggtgcaggtgttt

SEQ ID NO: 46852 - DNA, 30 bp, Homo sapiens
  chr22:50025649-50025679
  hypo
cgggtgcaggtgtttcggggcacacgtgtt

SEQ ID NO: 46853 - DNA, 100 bp, Homo sapiens
  chr22:50031154-50031254
  hypo
gaggccaggcctggacgccttctcgctgcaggccctcggagatgtttcccagcactgacggtgctgaggacagaacgctggaggccgggccacactcagg

SEQ ID NO: 46854 - DNA, 30 bp, Homo sapiens
  chr22:50031691-50031721
  hypo
gaacaagccccaggtcgcacaagaaatgca

SEQ ID NO: 46855 - DNA, 46 bp, Homo sapiens
  chr22:50032443-50032489
  hypo
cgcatctcccgagcacggctcttcgggcggacggagcccccagcag

SEQ ID NO: 46856 - DNA, 30 bp, Homo sapiens
  chr22:50041973-50042003
  hypo
ttaccgtggccgagccgcagcctggatgca

SEQ ID NO: 46857 - DNA, 34 bp, Homo sapiens
  chr22:50054601-50054635
  hypo
tgcagctccccatgacgatcgctcctcctctgag

SEQ ID NO: 46858 - DNA, 60 bp, Homo sapiens
  chr22:50119416-50119476
  hypo
ataacacctgaaaaccggaacccgggtcctggggtcacacgcagccgaagggatgggctg

SEQ ID NO: 46859 - DNA, 171 bp, Homo sapiens
  chr22:50149299-50149470
  hypo
ccctttccatggcaacgccccataaggtgccacccctttccatggcaacgacccataaggtgccacccctttccatggcaacgccccatacggtgccacccctttccatggcaacgccccatacggtgccacccctttacatggcaacgccccatacggtgccatcccttt

SEQ ID NO: 46860 - DNA, 152 bp, Homo sapiens
  chr22:50170583-50170735
  hypo
ccatgctccctgagccggagtccagtccccagcagtcgagccctaagacgctaaccaggaggtgtggagagccatggaggcaggtccgggcgactcaccggctgcgatcctggccgccttggcgtagttcccattctcgatgcaggagatca

SEQ ID NO: 46861 - DNA, 65 bp, Homo sapiens
  chr22:50251106-50251171
  hypo
tgctctggaaggtgccgtttccaagacgcccttacctgggttcctgagcacgtctgacagagcag

SEQ ID NO: 46862 - DNA, 30 bp, Homo sapiens
  chr22:50439060-50439090
  hypo
actgcccaccccacccggccagctccactt

SEQ ID NO: 46863 - DNA, 155 bp, Homo sapiens
  chr22:50466890-50467045
  hypo
ctgcaggaggaacttcgcctcccgtggggcaagaggcatctccgtgagtgggtcccagcccctgaatcgcagtgggaatcagggaggcggcaacacctgcgtgccgtcataaagacccccaccatgccctcgtaaagacccccatcacaccgtcc

SEQ ID NO: 46864 - DNA, 30 bp, Homo sapiens
  chr22:50470583-50470613
  hypo
gagggcacccaaggccggtcctcccagccg

SEQ ID NO: 46865 - DNA, 92 bp, Homo sapiens
  chr22:50507025-50507117
  hypo
gggagcccaggacagcgggcgtggccagggctgggggggcgggcatggccgggcactcatgggcatagtcccaagctggttccctgcatgac

SEQ ID NO: 46866 - DNA, 30 bp, Homo sapiens
  chr22:50509901-50509931
  hypo
tgggtccctgttaatcggggagtccctcag

SEQ ID NO: 46867 - DNA, 57 bp, Homo sapiens
  chr22:50512688-50512745
  hypo
aaactgagtcatccacgttcagggcaatgatccccccgaggacggcagagatgcctg

SEQ ID NO: 46868 - DNA, 30 bp, Homo sapiens
  chr22:50526328-50526358
  hypo
tctgtgggcatctgccgggtctactgagtc

SEQ ID NO: 46869 - DNA, 75 bp, Homo sapiens
  chr22:50529523-50529598
  hypo
tcctgctgcaggcagcgtgttcagggcctctggatccacgagggccgatgcccggggggccggctgtgttacctg

SEQ ID NO: 46870 - DNA, 45 bp, Homo sapiens
  chr22:50582635-50582680
  hypo
catggtccgggtgaacgccacctgcaggttcgaggaggtgagccc

SEQ ID NO: 46871 - DNA, 287 bp, Homo sapiens
  chr22:50686625-50686912
  hypo
ctgcagcctagcacccggccacactgaccttgctgctggaggctcttccagtgcggggcctgggcagcacgggcactctggatggactctagggcactgtgagggagacacaacagtcgtgacacctggtctcacaccccggccctgcccgccctacctcccctcgcacctctgacatggcgccattggccctgacaggggtggggccgggtcacccagcagcgtctgtactgtcatgcacactgactccgccagtgactccaggtggtagccgccctgggaggagg

SEQ ID NO: 46872 - DNA, 158 bp, Homo sapiens
  chr22:50695362-50695520
  hypo
ctctgtggatgatgccggcagcgtggatatactgcggggggcagaggatttggcaggcttcagcgcaccctctcagagccacagggccctcctctgcccagccccgaggccctgcctgcctccctgcagcctcccccggggcccgtaccctcagcccc

SEQ ID NO: 46873 - DNA, 30 bp, Homo sapiens
  chr22:50764712-50764742
  hypo
aggtgaacaaggaggcgctgcagggtttta

SEQ ID NO: 46874 - DNA, 439 bp, Homo sapiens
  chr22:50899269-50899708
  hypo
tgtatctgtgtcacacgaaggcaagcgcttgtgtaaactcgaaatctcagtggctgtgagctgaggcctgggtttgcaaggcacacccaagacacggacttgagggccggcgccccaaggaaaggacaaggacccaaagaccgcacatcaaacagtggacatcaactcaagagccacagtgagggccccagacatgcaagcgtaacaacagggccactgctggagactggcctaaaaatggttcatacaagaaagaccggtttgcaggagaaagaccagggcgggggatgagagccccacccgcgcaccgcgccccacctggaatgtgcaggagcgcagctggagcccgtcctgcaggagctggtccacaggggtctggacgctgatgcgcttctccttggtcagcgcagccaccgggaaggagcggaccaccacctgc

SEQ ID NO: 46875 - DNA, 50 bp, Homo sapiens
  chr22:50922613-50922663
  hypo
ggattgccgagtccacgtaactgacctgtactccacgaggccctgtggga

SEQ ID NO: 46876 - DNA, 110 bp, Homo sapiens
  chr22:50943215-50943325
  hypo
cctgggagggctcaccgtccagtggtggccgtcgtaactgccctccagcaccacctcaggccgtccaccaagcccagtcatgcggcggaagaggccgtaggagttggcca

SEQ ID NO: 46877 - DNA, 96 bp, Homo sapiens
  chr22:50944404-50944500
  hypo
agcagcgctgaaggccgagccctgtctgcctctctctgacagctgcggccctcacccacctgcgagtagaaagcagccaagcgcaggcgtcgaatg

SEQ ID NO: 46878 - DNA, 69 bp, Homo sapiens
  chr22:50954977-50955046
  hypo
gtgggccctgcttgacgctggtcttggcattttggtggccagtgggaccacagtcggctctccttctgg

SEQ ID NO: 46879 - DNA, 41 bp, Homo sapiens
  chr22:50977129-50977170
  hypo
tgctgaactgagaggcgtgcacaagccgtgggaatggatgg

SEQ ID NO: 46880 - DNA, 143 bp, Homo sapiens
  chrX:2836217-2836360
  hypo
ggtggcagtgatccccgcgggatgcacaattcacaccctggtgccattttcctaaaagaaacgcaaatgttcaacagagacccgctttgaagcagccctgtctgctgcaaagaacctcggaatcattccgcgtcggcaggaaa

SEQ ID NO: 46881 - DNA, 128 bp, Homo sapiens
  chrX:2931204-2931332
  hypo
gactcataggtatggcgccggaactctgcccgtggaaacgtgatcctgcagcctctctgtcatcgtgtctaaggtgtttccggggatgttggctttgtgcgcgccagtttgaccgacttctctttgag

SEQ ID NO: 46882 - DNA, 20 bp, Homo sapiens
  chrX:3478216-3478236
  hypo
agtaacgcagttccccctcc

SEQ ID NO: 46883 - DNA, 47 bp, Homo sapiens
  chrX:3746571-3746618
  hypo
ctcaccaagcaggagcgggcccctccctcacgcggagccgctggcac

SEQ ID NO: 46884 - DNA, 30 bp, Homo sapiens
  chrX:5757324-5757354
  hypo
gtgagacaccgtgcccggcaaagattgggc

SEQ ID NO: 46885 - DNA, 30 bp, Homo sapiens
  chrX:11773720-11773750
  hypo
atgcccgaatacagacgaaactactgtcca

SEQ ID NO: 46886 - DNA, 31 bp, Homo sapiens
  chrX:19435201-19435232
  hypo
acgaacaactccagtcgacagcccccagcat

SEQ ID NO: 46887 - DNA, 43 bp, Homo sapiens
  chrX:20160928-20160971
  hypo
cataacgcagtcctttcactcgcccagccgggttgggagcctg

SEQ ID NO: 46888 - DNA, 16 bp, Homo sapiens
  chrX:23714117-23714133
  hypo
cacaactcagctgggc

SEQ ID NO: 46889 - DNA, 54 bp, Homo sapiens
  chrX:41331697-41331751
  hypo
aggccgcggaggtaacgatcccgaagggcggctcgggcccgctgcttctgggat

SEQ ID NO: 46890 - DNA, 22 bp, Homo sapiens
  chrX:44136212-44136234
  hypo
acttacagctgaggccgggcac

SEQ ID NO: 46891 - DNA, 21 bp, Homo sapiens
  chrX:44755607-44755628
  hypo
tcaccgcgcccggccaaaaat

SEQ ID NO: 46892 - DNA, 52 bp, Homo sapiens
  chrX:44922962-44923014
  hypo
ttacctgcagcgaaacgcactcactctacctcataaccgcacaaacctgacc

SEQ ID NO: 46893 - DNA, 40 bp, Homo sapiens
  chrX:58297213-58297253
  hypo
aaagccgtgaccccccggggcctggcgcagaggctgctgg

SEQ ID NO: 46894 - DNA, 30 bp, Homo sapiens
  chrX:58304829-58304859
  hypo
gagacagggaatccacgacacccccggttc

SEQ ID NO: 46895 - DNA, 32 bp, Homo sapiens
  chrX:78711051-78711083
  hypo
tcgtgatccgcccgcctcggccttacaaccat

SEQ ID NO: 46896 - DNA, 30 bp, Homo sapiens
  chrX:97101386-97101416
  hypo
caaggaggacttaggcgcccagggccccat

SEQ ID NO: 46897 - DNA, 128 bp, Homo sapiens
  chrX:97285068-97285196
  hypo
tgcgggggtggggggcggctaacttcccgctttgctggagttgcaactacttttggtcggatgcctggaaagccagagtatctaaagctcctgagtctctgcgtgcacctgagcggctgctctgccaa

SEQ ID NO: 46898 - DNA, 35 bp, Homo sapiens
  chrX:122924429-122924464
  hypo
ggattacaggtgtgagtcaccgcacctggccaaga

SEQ ID NO: 46899 - DNA, 30 bp, Homo sapiens
  chrY:14621298-14621328
  hypo
tcatttgcatatggacgcaaaaggaaaggc

SEQ ID NO: 46900 - DNA, 35 bp, Homo sapiens
  chrY:22918547-22918582
  hypo
ctgtcctttctcctccgatccggtattacccgtta

SEQ ID NO: 46901 - DNA, 30 bp, Homo sapiens
  chrY:23111758-23111788
  hypo
ctggtgggagtgatccgattttccatgtgc

SEQ ID NO: 46902 - DNA, 45 bp, Homo sapiens
  AC225595.1_16282-19523:1184-1229
  hypo
gcagaaggatagtctcggaagacatctgcccggccagatccaagc

SEQ ID NO: 46903 - DNA, 30 bp, Homo sapiens
  AC239873.3_5604-11530:5296-5326
  hypo
gaggcagagggagagcgcccgcctgaaacc

SEQ ID NO: 46904 - DNA, 30 bp, Homo sapiens; identical to SEQ ID NO: 16832
  AEKP01139090.1_11256-14570:719-749
  hypo

SEQ ID NO: 46905 - DNA, 41 bp, Homo sapiens
  AEKP01149800.1_88-7643:5268-5309
  hypo
gtggagggttgtgagcggctgtcagactgggtgtgagtggg

SEQ ID NO: 46906 - DNA, 86 bp, Homo sapiens; identical to SEQ ID NO: 16833
  AEKP01153556.1_1-5252:404-490
  hypo

SEQ ID NO: 46907 - DNA, 30 bp, Homo sapiens
  AEKP01166227.1_44013-111583:24167-24197
  hypo
acctagactgttgaccgaggacctgaaaga

SEQ ID NO: 46908 - DNA, 58 bp, Homo sapiens
  AEKP01188815.1_1-4777:2612-2670
  hypo
tgcgggtgcggaaggcgcctgcagaagaggcgcttcttgtttccgctccgtcctccca

SEQ ID NO: 46909 - DNA, 151 bp, Homo sapiens
  AEKP01196136.1_22995-25251:459-610
  hypo
tgctggaagagtcaacggcgtttttaaagaggcagggcaacgcgcactacagtgagggatcttacaggcctgtttttgagggaaaatggtaagtgagctacagcgagcacacgtgtgtagatcccagttacaggtccgtcaagatggctag

SEQ ID NO: 46910 - DNA, 30 bp, Homo sapiens
  AEKP01229474.1_1-1021:874-904
  hypo
tgctgcgtcagctggcgtgacctctcattc

SEQ ID NO: 46911 - DNA, 22 bp, Homo sapiens
  CR936360.14_69981-85448:11336-11358
  hypo
ctagtttgagccagccggccgc

SEQ ID NO: 46912 - DNA, 30 bp, Homo sapiens
  FP565324.3_2001-29640:15187-15217
  hypo
aggtggccagtggcacggacacaggtgttt

SEQ ID NO: 46913 - DNA, 47 bp, Homo sapiens
  FP565324.3_2001-29640:19686-19733
  hypo
cggcaagtaggtggccggatcgccctccgtcccgcctcctgtgcccc

SEQ ID NO: 46914 - DNA, 18 bp, Homo sapiens
  JH636052.4:2022610-2022628
  hypo
aacaataaaacaggccgg

SEQ ID NO: 46915 - DNA, 61 bp, Homo sapiens
  NW_001838014.1_249000-295694:3702-3763
  hypo
cgaagcgggcagcgccgccaagcatccctgtgtgtacggccgcccgcgcttcccttcccca

SEQ ID NO: 46916 - DNA, 42 bp, Homo sapiens
  NW_001838014.1_249000-295694:4094-4136
  hypo
agccagagccagagccgtgcggagacacggagccggccgaag

SEQ ID NO: 46917 - DNA, 60 bp, Homo sapiens
  NW_001838014.1_249000-295694:7207-7267
  hypo
atgctcccgcacgcacgaggttccccagcgctctgggtctcaggccgccggagaggagta

SEQ ID NO: 46918 - DNA, 311 bp, Homo sapiens
  NW_001838014.1_249000-295694:13512-13823
  hypo
ggcccctcggcagtgcggcccctcagcagtggggccaaagcgccattgccggcagccggtcgggaggagggtgaaagagaaatcctggctgcacacagaaggcaccaactgtttgctcatcgcagagcagggcagtggtgcccaggagggcggggcatcggatactgaaacacgagcaggtttccggcatcgagactggggctggagacttcaggaaacctcattttcttccccaaacatccacccttttctttaaagtaggccaaaggcctccgtttcacgctgtgtgagccaggcgtgtcaagccacag

SEQ ID NO: 46919 - DNA, 84 bp, Homo sapiens
  NW_001838056.1_145425-224902:42711-42795
  hypo
ccacactgctttccccggactgtctgctgtttctgcatcctggtagcccctccgtgtagcatagtgtcccgaatctgttttgtc

SEQ ID NO: 46920 - DNA, 30 bp, Homo sapiens
  NW_001839407.1_42766-49957:1184-1214
  hypo
ccaccatcgccggcccgctggtgcctctgc

SEQ ID NO: 46921 - DNA, 23 bp, Homo sapiens
  NW_001839609.1_1-3470:1139-1162
  hypo
caaagcgaggcactgcgagcctg

SEQ ID NO: 46922 - DNA, 90 bp, Homo sapiens
  NW_001839760.1_243903-260476:6752-6842
  hypo
ttgaatcatattaaccggaaaggaatgtactggaatagaatggactcgaatgtaatggataaaaaagtaattgatttgaatgccttggaa

SEQ ID NO: 46923 - DNA, 22 bp, Homo sapiens
  NW_001840754.1_117-3691:2515-2537
  hypo
gggctaccgcagggagggtgcc

SEQ ID NO: 46924 - DNA, 30 bp, Homo sapiens
  NW_001840841.1_1-4205:1669-1699
  hypo
ccgtgaaattccagccgggactccctgagt

SEQ ID NO: 46925 - DNA, 43 bp, Homo sapiens
  NW_001841011.1_96346-168555:37241-37284
  hypo
tgcacatgtgtgaggcgcgagcggcttctcccgtcccagtgct

SEQ ID NO: 46926 - DNA, 140 bp, Homo sapiens
  NW_001841051.1_40144-46142:4777-4917
  hypo
gcttgctgcgtctcccgggtcagggctgagattcacgctggagttgcctcagctggtgtgacctctcattctgaaacgaaatctgtacccttggctacggaatgccaaaggcctgggcgagccgttctctggtggtgatg

SEQ ID NO: 46927 - DNA, 46 bp, Homo sapiens
  NW_001841110.1_111-11841:9069-9115
  hypo
agggaacggctgacacgggccattgtcattccggagagcagagtcc

SEQ ID NO: 46928 - DNA, 55 bp, Homo sapiens
  NW_001841145.1_177495-186900:5222-5277
  hypo
atcaacctgctccctcgtgggtcgactttgcccacaccggcgcctggggaacagt

SEQ ID NO: 46929 - DNA, 69 bp, Homo sapiens
  NW_001842432.1_1-179261:101291-101360
  hypo
tcaggacaagatgaccgagctagagtactcgccccaggaaatgcaggtccagagcgggtcacctcctta

SEQ ID NO: 46930 - DNA, 282 bp, Homo sapiens; identical to SEQ ID NO: 25985
  chr1:840722-841004
  hyper

SEQ ID NO: 46931 - DNA, 49 bp, Homo sapiens; identical to SEQ ID NO: 25986
  chr1:975817-975866
  hyper

SEQ ID NO: 46932 - DNA, 30 bp, Homo sapiens; identical to SEQ ID NO: 25987
  chr1:1355593-1355623
  hyper

SEQ ID NO: 46933 - DNA, 19 bp, Homo sapiens
  chr1:1475537-1475556
  hyper
ggccggggaggggagcgca

SEQ ID NO: 46934 - DNA, 187 bp, Homo sapiens; identical to SEQ ID NO: 25990
  chr1:1535001-1535188
  hyper

SEQ ID NO: 46935 - DNA, 135 bp, Homo sapiens; identical to SEQ ID NO: 25991
  chr1:1535782-1535917
  hyper

SEQ ID NO: 46936 - DNA, 39 bp, Homo sapiens; identical to SEQ ID NO: 25992
  chr1:1567286-1567325
  hyper

SEQ ID NO: 46937 - DNA, 132 bp, Homo sapiens; identical to SEQ ID NO: 25993
  chr1:1567781-1567913
  hyper

SEQ ID NO: 46938 - DNA, 95 bp, Homo sapiens
  chr1:1935459-1935554
  hyper
agacagccaggcctggcccagggccaaggcttggaggtgacagacagacttggggggcctggaggagctcagcaccggcgcgttggcccagagga

SEQ ID NO: 46939 - DNA, 779 bp, Homo sapiens; identical to SEQ ID NO: 25995
  chr1:1950582-1951361
  hyper

SEQ ID NO: 46940 - DNA, 44 bp, Homo sapiens; identical to SEQ ID NO: 25996
  chr1:2136044-2136088
  hyper

SEQ ID NO: 46941 - DNA, 146 bp, Homo sapiens; identical to SEQ ID NO: 25997
  chr1:2136893-2137039
  hyper

SEQ ID NO: 46942 - DNA, 198 bp, Homo sapiens
  chr1:2374950-2375148
  hyper
gggaggtgtggggagcggaaggccgcaggagcatctttgcggagaaagtactttggctgcggcgggcgcagggcgggccggctagccccgcgccccacctgttctgtgcgtcgcgctcgcccggttgcgcccgatctgcctccagcccggtgcccgccgcggagcccgcgcccccggccccctcccggcgcggggcgg

SEQ ID NO: 46943 - DNA, 82 bp, Homo sapiens
  chr1:2375543-2375625
  hyper
cggtggcacgggcaggggtgcgggcgcgggactgtgggcgggacgggcggagcggtcttgagctctccggatggcctcaggt

SEQ ID NO: 46944 - DNA, 482 bp, Homo sapiens; identical to SEQ ID NO: 26000
  chr1:2560443-2560925
  hyper

SEQ ID NO: 46945 - DNA, 40 bp, Homo sapiens
  chr1:2984749-2984789
  hyper
ggcccagctcgggcgctcgcgcagccgggtactcaccttg

SEQ ID NO: 46946 - DNA, 288 bp, Homo sapiens; identical to SEQ ID NO: 26003
  chr1:2985115-2985403
  hyper

SEQ ID NO: 46947 - DNA, 82 bp, Homo sapiens; identical to SEQ ID NO: 26004
  chr1:2986416-2986498
  hyper

SEQ ID NO: 46948 - DNA, 165 bp, Homo sapiens; identical to SEQ ID NO: 26005
  chr1:2987055-2987220
  hyper

SEQ ID NO: 46949 - DNA, 44 bp, Homo sapiens; identical to SEQ ID NO: 26006
  chr1:2987457-2987501
  hyper

SEQ ID NO: 46950 - DNA, 102 bp, Homo sapiens; identical to SEQ ID NO: 26007
  chr1:3087621-3087723
  hyper

SEQ ID NO: 46951 - DNA, 192 bp, Homo sapiens; identical to SEQ ID NO: 26008
  chr1:3310353-3310545
  hyper

SEQ ID NO: 46952 - DNA, 232 bp, Homo sapiens
  chr1:3568226-3568458
  hyper
caagcgcaccgacgcccgcgagctccttccaaacaccgaacgggatccagagcccgagcccacaggcggcggccgggggagggagcagggtgctggccgccgcccgggagtgttcgcgtcctgggtgacccctggaaggacgtggggcccaaactccggctggggttgggagagcagcccccagaggctctccgcgggatcctctgccgggcgggaccgtggctccacagga

SEQ ID NO: 46953 - DNA, 45 bp, Homo sapiens; identical to SEQ ID NO: 26012
  chr1:3663242-3663287
  hyper

SEQ ID NO: 46954 - DNA, 288 bp, Homo sapiens
  chr1:3663586-3663874
  hyper
ggctgggggccaggacgatcccacccggagaagcctcgcgggcgagaagagggtcccttcctgcgggggcagatggaggcgcgggagccttccccgggaggtgaccgaggccagtcagcggccccggggacccaaggccggggactctcggcggccggtggacgggcagggccggcccgcctgggcaggcggcggggtgaaggtgtccagggcctgaggcggcaaagtgccgccgccgtcagccccgactgccacccaccaggcacccggcccatccccggctcccat

SEQ ID NO: 46955 - DNA, 54 bp, Homo sapiens
  chr1:3663921-3663975
  hyper
gagatcccgcaacaacccggatccggaagcgcggggtcgcggctgggcgagggc

SEQ ID NO: 46956 - DNA, 152 bp, Homo sapiens; identical to SEQ ID NO: 5289
  chr1:4712671-4712823
  hyper

SEQ ID NO: 46957 - DNA, 184 bp, Homo sapiens; identical to SEQ ID NO: 26020
  chr1:6208628-6208812
  hyper

SEQ ID NO: 46958 - DNA, 30 bp, Homo sapiens; identical to SEQ ID NO: 26021
  chr1:6221982-6222012
  hyper

SEQ ID NO: 46959 - DNA, 507 bp, Homo sapiens; identical to SEQ ID NO: 26022
  chr1:6239505-6240012
  hyper

SEQ ID NO: 46960 - DNA, 427 bp, Homo sapiens; identical to SEQ ID NO: 26023
  chr1:6240281-6240708
  hyper

SEQ ID NO: 46961 - DNA, 280 bp, Homo sapiens; identical to SEQ ID NO: 26024
  chr1:6240931-6241211
  hyper

SEQ ID NO: 46962 - DNA, 30 bp, Homo sapiens; identical to SEQ ID NO: 26025
  chr1:6266556-6266586
  hyper

SEQ ID NO: 46963 - DNA, 262 bp, Homo sapiens; identical to SEQ ID NO: 26026
  chr1:6301710-6301972
  hyper

SEQ ID NO: 46964 - DNA, 83 bp, Homo sapiens; identical to SEQ ID NO: 16857
  chr1:6304118-6304201
  hyper

SEQ ID NO: 46965 - DNA, 68 bp, Homo sapiens; identical to SEQ ID NO: 16858
  chr1:6304242-6304310
  hyper

SEQ ID NO: 46966 - DNA, 71 bp, Homo sapiens; identical to SEQ ID NO: 26028
  chr1:6304595-6304666
  hyper

SEQ ID NO: 46967 - DNA, 775 bp, Homo sapiens; identical to SEQ ID NO: 26029
  chr1:6309246-6310021
  hyper

SEQ ID NO: 46968 - DNA, 189 bp, Homo sapiens
  chr1:6480325-6480514
  hyper
caggctcgggttcagcgtcttctctgagccccgccctgggccgcagcaggggacccagcggttacgggagctcccatgagggacagcagcgggagggacttgcacccccagctgctttatcgggtgaagggctgagctggacgggaaatccgagttccggagaaaggtcgtgacttgctccagtcctcg

SEQ ID NO: 46969 - DNA, 120 bp, Homo sapiens
  chr1:6480831-6480951
  hyper
gctgcggcaaactggctggcgtcccccgcccatctgctccgggctcccctcccccgaccggctggcggggcaacggccacgcccgcgaaccacactgcgaactgccgggcagagagatga

SEQ ID NO: 46970 - DNA, 16 bp, Homo sapiens
  chr1:6484964-6484980
  hyper
gcgtcctggggaaggc

SEQ ID NO: 46971 - DNA, 288 bp, Homo sapiens; identical to SEQ ID NO: 26032
  chr1:6484981-6485269
  hyper

SEQ ID NO: 46972 - DNA, 48 bp, Homo sapiens; identical to SEQ ID NO: 26033
  chr1:6500940-6500988
  hyper

SEQ ID NO: 46973 - DNA, 73 bp, Homo sapiens; identical to SEQ ID NO: 26035
  chr1:6507490-6507563
  hyper

SEQ ID NO: 46974 - DNA, 987 bp, Homo sapiens
  chr1:6508126-6509113
  hyper
ctgccgcccccacagccaggtgcacagcgggggccaccagcaccgtggcaggtaggagcagcccccggacgggcaaccggggtccgtggcaagccggagcctccgagagcacaggctctggagggggctccctccggccccggacccccgaaagacagggctccgcggagccctggggacccgcagtccttctgacagccgagagcggagtgcggccgagggcctagtgagggctaagctgggaggtgccccttcgccagctccccctggcgtcggggctgggccaccccgcccctgggcccgcctcttctggcctcagtgggggcccctgtgccccttggccggtgcccagaacccctccctgtaaggcgggcggagcctgcccttccaccgaggcccccatgaccctcgcccgctgcccactgtgagaaccagggggtctaggaagtcagctgctgcacccctcgacggccgctggccgcgagtccccaggaggtgaagagctgggtggggaggcgtggggggcgcctaccgggcaggtgcccgagccccaccggtcactgtcttcccgcagctgagctcctgtgacggccacgacgggctgcggaggcaggactccagccgcaagccccgcgccttcagcaagcagcccagcacgggggactactaccggcagctgggccgctgccccggcgagacgctggccgcacgcccgggcatggcgcacagcgaggaggtgcgtgcccgccagcccgcgcgcgccggctgcccgcgcctcggccctgccgcccgcggctcactcgaaggcccctccgctcccccgcaggcggcgctgcttcctgggaaccatgttcctaacggctgcgccgcggaccccaaggcgtccagggagctgccaccgccgcccccaccgccgccgccgcccctgccggaggccgcgagttcgccaccgccggccccgcctctgcccctcgagagcgctggccc

SEQ ID NO: 46975 - DNA, 46 bp, Homo sapiens; identical to SEQ ID NO: 26037
  chr1:6545397-6545443
  hyper

SEQ ID NO: 46976 - DNA, 171 bp, Homo sapiens; identical to SEQ ID NO: 26038
  chr1:6663729-6663900
  hyper

SEQ ID NO: 46977 - DNA, 80 bp, Homo sapiens; identical to SEQ ID NO: 26039
  chr1:7023766-7023846
  hyper

SEQ ID NO: 46978 - DNA, 30 bp, Homo sapiens; identical to SEQ ID NO: 26040
  chr1:7130249-7130279
  hyper

SEQ ID NO: 46979 - DNA, 52 bp, Homo sapiens; identical to SEQ ID NO: 26041
  chr1:7764556-7764608
  hyper

SEQ ID NO: 46980 - DNA, 85 bp, Homo sapiens; identical to SEQ ID NO: 26042
  chr1:7765187-7765272
  hyper

SEQ ID NO: 46981 - DNA, 329 bp, Homo sapiens; identical to SEQ ID NO: 26043
  chr1:8002422-8002751
  hyper

SEQ ID NO: 46982 - DNA, 30 bp, Homo sapiens; identical to SEQ ID NO: 9
  chr1:8277113-8277143
  hyper

SEQ ID NO: 46983 - DNA, 60 bp, Homo sapiens; identical to SEQ ID NO: 26045
  chr1:8277775-8277835
  hyper

SEQ ID NO: 46984 - DNA, 94 bp, Homo sapiens; identical to SEQ ID NO: 26046
  chr1:9243226-9243320
  hyper

SEQ ID NO: 46985 - DNA, 426 bp, Homo sapiens
  chr1:9712135-9712561
  hyper
ccggcgcctgcactgcgcgccttgcccgcctggcccggcagcggggtttcagctgcgctcacagcggcggtgcggcctccggtgcgccggctgaggcgcgaggatactggaagcgctcagcgcgtgcgcccgctccgagcgctgactagaggaccaggggcctcctctgtacggcagcggggtccacagagagcgcgctggtgatgtcgcccgagtgccctggcgcggagagagggctgcgcacagttcgccggcgcccgggtcctgtgcgcccttcccagcctgggcaagtggggagcggggctgcagaggggccggggtggaagttttcggggcttcctcccggctcgtggacccgcgccccgcctcccagtcccgggcctcccgcgttgctcgccgcgtttgctgcagcggcgcaggcgagat

SEQ ID NO: 46986 - DNA, 201 bp, Homo sapiens; identical to SEQ ID NO: 26048
  chr1:10057409-10057610
  hyper

SEQ ID NO: 46987 - DNA, 23 bp, Homo sapiens
  chr1:10948529-10948552
  hyper
cccgggtctcccaggcgagaggg

SEQ ID NO: 46988 - DNA, 38 bp, Homo sapiens; identical to SEQ ID NO: 16870
  chr1:10948582-10948620
  hyper

SEQ ID NO: 46989 - DNA, 30 bp, Homo sapiens; identical to SEQ ID NO: 26050
  chr1:10948841-10948871
  hyper

SEQ ID NO: 46990 - DNA, 235 bp, Homo sapiens
  chr1:11538940-11539175
  hyper
gccgggctgaaccaccgcgcggatcggcagggggagcggcggcgaagacagcgccagacagcgggtcccagagaccgcagcgcgcggcgtggcgcagggtctcgccggccactgattcaaggcgcggcggcgcggagcccgagaggcgccagggattgggcggcagcgcggctccggagcctggctcggacacccccgcgacccgtggtaggagcccggacccaaacaaaggcgg

SEQ ID NO: 46991 - DNA, 205 bp, Homo sapiens
  chr1:11539205-11539410
  hyper
gtgctcgggttgcgagctgaggactgggattcgcgcgcagcttcccgcggtctgcttgccctggagcggagggggagccccagcctcctgcggctccgagaagcttccccctgcgacttccgcgaggagacgagtctgcgcagcgtggtggccgccgccccccgaccctctgcgcactctctcccgcgccggcggctcagcctag

SEQ ID NO: 46992 - DNA, 556 bp, Homo sapiens
  chr1:11539440-11539996
  hyper
gccgcggggcgccatccgggcttggtctcggggctgggggatgcattgctaggaggagggggaagtcctccgcgccgtccgcaccccgacctgcttggcgccgcgcgcgaagttctctcgctctccagccagcccgggatgcgggcctcggagccccccgggaaagacggtcaggggtggacagaacccaagcttgccctctacgaccgggccccagctccgcaccatctccccgcgggactgcagcattcttggtcggccaaggggagttggatgttggatgtccaggaacggcaaggcttccgacctctggcccctgcttgtcccctctgagggatatctgggtccataaaagttgagcgtcagtctgaagccgcccttggatcgggctctcgcccatgctagagcggagggaggggacagagtaaggctaatgaccccctccacccactccctacctagcgtactcgtgctctcggagggacatttccccgattaacctggctgcaggtccggccggggagggcgcgtgggggcttggggcgggccgggccag

SEQ ID NO: 46993 - DNA, 90 bp, Homo sapiens
  chr1:11540039-11540129
  hyper
cgcgaacgagggtggaggtggagtgggcagccgggcagtggcggcgctgagggtcgggaaagattcccagcgcaaggggcgccaagtccc

SEQ ID NO: 46994 - DNA, 30 bp, Homo sapiens; identical to SEQ ID NO: 26053
  chr1:11611023-11611053
  hyper

SEQ ID NO: 46995 - DNA, 61 bp, Homo sapiens; identical to SEQ ID NO: 26054
  chr1:11751330-11751391
  hyper

SEQ ID NO: 46996 - DNA, 12 bp, Homo sapiens
  chr1:11752464-11752476
  hyper
gcccggaaccag

SEQ ID NO: 46997 - DNA, 125 bp, Homo sapiens
  chr1:11752511-11752636
  hyper
caggaaggtactcagcctggctcccccgacggcgctggtctttcgcctgtggtctcccgctctgtccctcctgctccccaccgccggcttttggcttttctccgtccgctcgtcaagggtctcag

SEQ ID NO: 46998 - DNA, 109 bp, Homo sapiens; identical to SEQ ID NO: 26056
  chr1:11919143-11919252
  hyper

SEQ ID NO: 46999 - DNA, 19 bp, Homo sapiens
  chr1:11959074-11959093
  hyper
ggacccacctggatccgag

SEQ ID NO: 47000 - DNA, 42 bp, Homo sapiens; identical to SEQ ID NO: 16874
  chr1:11959196-11959238
  hyper

SEQ ID NO: 47001 - DNA, 121 bp, Homo sapiens
  chr1:12123122-12123243
  hyper
ctactcacatttcaccgtttcttggggcaggagtggaggtgggggcattggaacccccttggggcctcctaatatcctgtgagtccccacctccagggccagaagctgcctgcctccgctc

SEQ ID NO: 47002 - DNA, 145 bp, Homo sapiens; identical to SEQ ID NO: 26059
  chr1:12123787-12123932
  hyper

SEQ ID NO: 47003 - DNA, 309 bp, Homo sapiens; identical to SEQ ID NO: 26060
  chr1:13839460-13839769
  hyper

SEQ ID NO: 47004 - DNA, 177 bp, Homo sapiens; identical to SEQ ID NO: 26061
  chr1:13840521-13840698
  hyper

SEQ ID NO: 47005 - DNA, 106 bp, Homo sapiens; identical to SEQ ID NO: 16877
  chr1:13910330-13910436
  hyper

SEQ ID NO: 47006 - DNA, 88 bp, Homo sapiens; identical to SEQ ID NO: 26065
  chr1:14027035-14027123
  hyper

SEQ ID NO: 47007 - DNA, 30 bp, Homo sapiens; identical to SEQ ID NO: 26066
  chr1:14219099-14219129
  hyper

SEQ ID NO: 47008 - DNA, 339 bp, Homo sapiens; identical to SEQ ID NO: 26067
  chr1:14219335-14219674
  hyper

SEQ ID NO: 47009 - DNA, 679 bp, Homo sapiens; identical to SEQ ID NO: 26068
  chr1:14924519-14925198
  hyper

SEQ ID NO: 47010 - DNA, 302 bp, Homo sapiens; identical to SEQ ID NO: 16881
  chr1:14925199-14925501
  hyper

SEQ ID NO: 47011 - DNA, 18 bp, Homo sapiens
  chr1:14926050-14926068
  hyper
tgccggggccttttcccc

SEQ ID NO: 47012 - DNA, 35 bp, Homo sapiens; identical to SEQ ID NO: 26070
  chr1:15251220-15251255
  hyper

SEQ ID NO: 47013 - DNA, 81 bp, Homo sapiens; identical to SEQ ID NO: 26071
  chr1:15251499-15251580
  hyper

SEQ ID NO: 47014 - DNA, 48 bp, Homo sapiens; identical to SEQ ID NO: 26072
  chr1:15479729-15479777
  hyper

SEQ ID NO: 47015 - DNA, 156 bp, Homo sapiens; identical to SEQ ID NO: 26073
  chr1:15573605-15573761
  hyper

SEQ ID NO: 47016 - DNA, 336 bp, Homo sapiens; identical to SEQ ID NO: 26074
  chr1:15930022-15930358
  hyper

SEQ ID NO: 47017 - DNA, 30 bp, Homo sapiens; identical to SEQ ID NO: 26075
  chr1:16375412-16375442
  hyper

SEQ ID NO: 47018 - DNA, 34 bp, Homo sapiens; identical to SEQ ID NO: 26076
  chr1:16533298-16533332
  hyper

SEQ ID NO: 47019 - DNA, 51 bp, Homo sapiens; identical to SEQ ID NO: 26077
  chr1:16542965-16543016
  hyper

SEQ ID NO: 47020 - DNA, 88 bp, Homo sapiens; identical to SEQ ID NO: 26078
  chr1:16553585-16553673
  hyper

SEQ ID NO: 47021 - DNA, 54 bp, Homo sapiens
  chr1:16861468-16861522
  hyper
tctccggggtggcgacgggaaagaaggtgggcttattgggtgcagctccacggg

SEQ ID NO: 47022 - DNA, 190 bp, Homo sapiens
  chr1:16861552-16861742
  hyper
tgagcgagaagctcagtcgctctctaaagctgctcccgcggatgacggacacggagacaaataggaacggtgtgtcgtgagaggtggtccacaagcacttgccctccttcgcccggctttaaccccgctgcggagactgttctgcttctggcccttggagcaggccggctgacagcgtagtgaaggaaga

SEQ ID NO: 47023 - DNA, 30 bp, Homo sapiens; identical to SEQ ID NO: 26080
  chr1:17033955-17033985
  hyper

SEQ ID NO: 47024 - DNA, 138 bp, Homo sapiens; identical to SEQ ID NO: 26081
  chr1:18152717-18152855
  hyper

SEQ ID NO: 47025 - DNA, 65 bp, Homo sapiens; identical to SEQ ID NO: 26082
  chr1:18434751-18434816
  hyper

SEQ ID NO: 47026 - DNA, 33 bp, Homo sapiens; identical to SEQ ID NO: 26083
  chr1:18435496-18435529
  hyper

SEQ ID NO: 47027 - DNA, 507 bp, Homo sapiens; identical to SEQ ID NO: 26084
  chr1:18436492-18436999
  hyper

SEQ ID NO: 47028 - DNA, 388 bp, Homo sapiens; identical to SEQ ID NO: 26085
  chr1:18437043-18437431
  hyper

SEQ ID NO: 47029 - DNA, 25 bp, Homo sapiens
  chr1:18437432-18437457
  hyper
ggggtctccgggattgcgcgggcgg

SEQ ID NO: 47030 - DNA, 291 bp, Homo sapiens
  chr1:18437526-18437817
  hyper
atgggatggaggggctgtctccgctaggccgccgcaaccgcaacgccgagactgcgggggctgtgcgcgcgcgagcgggtgtgacgactttatatatttatcctcccttcacacgcccccttcccactgggcggggcctctggcgcggcagggtttcttctccagccccaactgggggagttaagggccctaatcccttgcaggctgcctcgcccatgcccctccagcgtggccccgcccctagccataaactccacccctcttccaccccataaccgctctgcaaatggg

SEQ ID NO: 47031 - DNA, 104 bp, Homo sapiens
  chr1:18956470-18956574
  hyper
tgtatcaagtcttgacgggctccctccctcccatttcccacctctttgggcccccagatcctcacaccagcaccaactccctgtaaacccaactacctgctgga

SEQ ID NO: 47032 - DNA, 118 bp, Homo sapiens
  chr1:18956738-18956856
  hyper
cggcaggaaggtagagtaagaaccggacaccggggctctgacattacacagaaaaggtcagaattcctcccttcaagtcaccctaggccggttcccggggagcctcactggaggaatt

SEQ ID NO: 47033 - DNA, 261 bp, Homo sapiens
  chr1:18957246-18957507
  hyper
ccctcctcatgaataaaagaaaagtccgaacctatcagatcgcgctcactgcctcctcctcctcctcctcctcctcctcctcgtacttcggtgaacacttttgcacaacttacccagctgatcactcgcgccccctcgcttttccatttctctttccccaaccccgtcaccccctgtctcctccgtccagccctgaaacccgaggaggctccttcttccgtctgtccccgggtctcctaggggacggggctgtgaaagctg

SEQ ID NO: 47034 - DNA, 48 bp, Homo sapiens; identical to SEQ ID NO: 16891
  chr1:18957985-18958033
  hyper

SEQ ID NO: 47035 - DNA, 38 bp, Homo sapiens
  chr1:18958381-18958419
  hyper
ccggcggccttcgtttcgcaggtcgctagctgccggtc

SEQ ID NO: 47036 - DNA, 58 bp, Homo sapiens; identical to SEQ ID NO: 5338
  chr1:18958829-18958887
  hyper

SEQ ID NO: 47037 - DNA, 48 bp, Homo sapiens; identical to SEQ ID NO: 26093
  chr1:18959220-18959268
  hyper

SEQ ID NO: 47038 - DNA, 121 bp, Homo sapiens; identical to SEQ ID NO: 26094
  chr1:18959269-18959390
  hyper

SEQ ID NO: 47039 - DNA, 355 bp, Homo sapiens
  chr1:18959550-18959905
  hyper
ccgccacggagaccgagtgactccgactttgcgacgcacgatttctgattaaatccgagagtggcttcagacaccgacttttacaaagagaggtggggggaccgggagagcgagggagggggcggtaggaacggcccagcagcggagcctcttctcgcctcctccctttcaattacagtcagctccctccactcccgcggctgtgaaatcgttctaatcttccagatctccgcagccgctgagtccccaaattggggggatcgaggccggattagtgcgctgggtgtccccccaatcttctgtgaggaaattgtgtagactttgcattaaggcaaccaggcgttctcccctcccc

SEQ ID NO: 47040 - DNA, 14 bp, Homo sapiens
  chr1:18960990-18961004
  hyper
gggtccatccggcc

SEQ ID NO: 47041 - DNA, 139 bp, Homo sapiens
  chr1:18963135-18963274
  hyper
gcggggctgcgcgcctggtctaccccaatactgcggggagtgcgtcctcccgggctggcgttttggctgctactctcggcgtcgatcaattatttataggaaacttgggcaagggggcgggggacgggagggagggaga

SEQ ID NO: 47042 - DNA, 182 bp, Homo sapiens; identical to SEQ ID NO: 26098
  chr1:18963662-18963844
  hyper

SEQ ID NO: 47043 - DNA, 129 bp, Homo sapiens; identical to SEQ ID NO: 26099
  chr1:18964285-18964414
  hyper

SEQ ID NO: 47044 - DNA, 41 bp, Homo sapiens; identical to SEQ ID NO: 26100
  chr1:18966656-18966697
  hyper

SEQ ID NO: 47045 - DNA, 129 bp, Homo sapiens; identical to SEQ ID NO: 26101
  chr1:18968003-18968132
  hyper

SEQ ID NO: 47046 - DNA, 132 bp, Homo sapiens
  chr1:18969493-18969625
  hyper
gcgaagggagggggtcggctgcacttggaacttcaacctcctgggagaggaaaagcgtctgcgggtcgctacagcctcgggaggggtgaagggaagttgtgtgcgccccaagtccagctcaaaagaggcccc

SEQ ID NO: 47047 - DNA, 982 bp, Homo sapiens
  chr1:18969819-18970801
  hyper
ggtgcgctgggcccgagctccggtggagaccaagggaggggtggggagaggcagcggagacagagagccacagaggaggagagagctagaaaattcagagtgagaaagtctgagcgcagcagaagagaatcttgcgcacagtttgaggacgctggaaaatgcggaggcgccgagggaggcgccgagcagcaggaagaaagacaaagagatgcagaatcaccgagagactggccctgggacaggcggatcaggagagccagcgggacctagagacagcccgcgggagagcacgggccgagagggcgagtgctcaaagccgggcagcggctaggggaagataggaggcgggcgagccgcggccgcccttttgatccttcgtggcttcgccttatcagaagcgctttcggtgacatccgcacaaaggcagttcatcatattacagcacgtcccggcggctcgctgcgatcctgccgcttaattagaggcgagcgagctgggccggcagggcgggagggaggccgaccccgaggcgggaggccgggttctgcgctccaacccggggcgctgggcaggggccagcccgcgtgcctggcggtgttgggacgtggagagagggagaggccgggaactgcattcagagcgttgctaaattaacaggccggcccgggcttcactgcccggagagtgaagctcgccgccttccaatttagccgccgccccttctaagttcttgggaagggatggcgctccggccactttcccctcttccaggctgcgaacgctgcggactggagggcgagtaatggggaggcaacccagggcgagctgaaggcttagtgcaactccgggtccaggtcgcacccaccagccccccgcggctgtgttccatcccctcctccgaccgccttgctctccatccgaacccaggtgtgccaggctggagcaatctgagaggggcaaagtgcatcgtggtcgaggttct

SEQ ID NO: 47048 - DNA, 113 bp, Homo sapiens
  chr1:18971739-18971852
  hyper
ggctgggccttgcttcgccacgggttcgagggagaggcggagggaggagcggctgggctgcggagcctcttgccttcactgcactctttgtctgacaccacgaaaagaccgaa

SEQ ID NO: 47049 - DNA, 38 bp, Homo sapiens; identical to SEQ ID NO: 26104
  chr1:18972986-18973024
  hyper

SEQ ID NO: 47050 - DNA, 73 bp, Homo sapiens; identical to SEQ ID NO: 26105
  chr1:18973661-18973734
  hyper

SEQ ID NO: 47051 - DNA, 13 bp, Homo sapiens
  chr1:19043054-19043067
  hyper
tcttttctccctt

SEQ ID NO: 47052 - DNA, 29 bp, Homo sapiens
  chr1:19043114-19043143
  hyper
cgtctccctgatcgcgtcataaccctgag

SEQ ID NO: 47053 - DNA, 211 bp, Homo sapiens
  chr1:19043352-19043563
  hyper
cctctcccccacccccgtgtcccctttccgaattcctccgctgctggtgggctccgaggcagggaccgggcgcgggctcccgaggccgggcggacccaagtccagggcgggggttggggcggcggccggagcggggatcgggtctggggggatccgcgcggccgcccctccccgcgctccgccgccgccgccgtcgccgccgcgcctttga

SEQ ID NO: 47054 - DNA, 65 bp, Homo sapiens; identical to SEQ ID NO: 16905
  chr1:19043678-19043743
  hyper

SEQ ID NO: 47055 - DNA, 151 bp, Homo sapiens; identical to SEQ ID NO: 5351
  chr1:19043756-19043907
  hyper

SEQ ID NO: 47056 - DNA, 74 bp, Homo sapiens; identical to SEQ ID NO: 26110
  chr1:20512379-20512453
  hyper

SEQ ID NO: 47057 - DNA, 189 bp, Homo sapiens
  chr1:20618140-20618329
  hyper
gcagggtgcccaccccggcagccgggctcatgcctgctgcccttcggatgccccgcagcttgtgaccatccccagagccaccggccaagggcacaccctttcctgagccccgtgtctcctgcaaggtaagaggggaaggagaaaaggtcctcgggcagaaggaggcggctagtggagaggaactcagca

SEQ ID NO: 47058 - DNA, 184 bp, Homo sapiens
  chr1:20618369-20618553
  hyper
ctggaagttccaccataacgtctgcggcagccccaacagttccaccccatgctcccgccgccggcaccacagcagcagaaggaggcctgtggggcgggggccagaacctttccctcctcccttctgaagagcaacaggcgtcacaccatcctgcctctcccactaaccccgttccttcttttgc

SEQ ID NO: 47059 - DNA, 150 bp, Homo sapiens; identical to SEQ ID NO: 26112
  chr1:20669698-20669848
  hyper

SEQ ID NO: 47060 - DNA, 38 bp, Homo sapiens; identical to SEQ ID NO: 26113
  chr1:20669896-20669934
  hyper

SEQ ID NO: 47061 - DNA, 40 bp, Homo sapiens; identical to SEQ ID NO: 5354
  chr1:20692819-20692859
  hyper

SEQ ID NO: 47062 - DNA, 203 bp, Homo sapiens; identical to SEQ ID NO: 26115
  chr1:20810635-20810838
  hyper

SEQ ID NO: 47063 - DNA, 47 bp, Homo sapiens; identical to SEQ ID NO: 26116
  chr1:20810864-20810911
  hyper

SEQ ID NO: 47064 - DNA, 148 bp, Homo sapiens; identical to SEQ ID NO: 26117
  chr1:20878512-20878660
  hyper

SEQ ID NO: 47065 - DNA, 124 bp, Homo sapiens; identical to SEQ ID NO: 5357
  chr1:20878905-20879029
  hyper

SEQ ID NO: 47066 - DNA, 5 bp, Homo sapiens
  chr1:20879030-20879035
  hyper
acgcc

SEQ ID NO: 47067 - DNA, 148 bp, Homo sapiens; identical to SEQ ID NO: 16915
  chr1:20879289-20879437
  hyper

SEQ ID NO: 47068 - DNA, 100 bp, Homo sapiens; identical to SEQ ID NO: 16916
  chr1:20879462-20879562
  hyper

SEQ ID NO: 47069 - DNA, 205 bp, Homo sapiens
  chr1:20879640-20879845
  hyper
cggcgccagaaagtggagctcaacaaggaggacccgacctacaccgtgtggtacctgggcaacgccgtcaccctgcacgccaagggcgacggctgcaccgacgacgccgtgggcaagatctgggctcgctgcgggcctggcgggggcactaagatgaagctgacgctggggccgcacggcatccgcatgcagccgtgcgagcgca

SEQ ID NO: 47070 - DNA, 225 bp, Homo sapiens; identical to SEQ ID NO: 16917
  chr1:20879957-20880182
  hyper

SEQ ID NO: 47071 - DNA, 57 bp, Homo sapiens; identical to SEQ ID NO: 26122
  chr1:20916163-20916220
  hyper

SEQ ID NO: 47072 - DNA, 44 bp, Homo sapiens
  chr1:21044081-21044125
  hyper
ggatgcagcactgggcgcgcgcgcagtccacagtcaccacgggc

SEQ ID NO: 47073 - DNA, 60 bp, Homo sapiens
  chr1:21044161-21044221
  hyper
cggcagcgcacgacaaccttcaccgcctcggaggccatggcgccgcgcccaggaccaacg

SEQ ID NO: 47074 - DNA, 66 bp, Homo sapiens; identical to SEQ ID NO: 26124
  chr1:21058309-21058375
  hyper

SEQ ID NO: 47075 - DNA, 127 bp, Homo sapiens; identical to SEQ ID NO: 26125
  chr1:21754473-21754600
  hyper

SEQ ID NO: 47076 - DNA, 174 bp, Homo sapiens; identical to SEQ ID NO: 26126
  chr1:21835408-21835582
  hyper

SEQ ID NO: 47077 - DNA, 317 bp, Homo sapiens; identical to SEQ ID NO: 26127
  chr1:21836071-21836388
  hyper

SEQ ID NO: 47078 - DNA, 90 bp, Homo sapiens
  chr1:22140663-22140753
  hyper
cgcatcttagggtttcgaataagggattgtagatttgaattaaattaaattaaatcatttaatccttacaatcattctgagattgattaa

SEQ ID NO: 47079 - DNA, 124 bp, Homo sapiens
  chr1:22141184-22141308
  hyper
ggtccccactgtgcggcctgaacatcccggtgcctgtggcatcctccggaccctttctaggcctgcgcctggtcacgagaggccgccagccccgcgtggacttcgtgggcgaagtcacctcttt

SEQ ID NO: 47080 - DNA, 140 bp, Homo sapiens; identical to SEQ ID NO: 26130
  chr1:22889622-22889762
  hyper

SEQ ID NO: 47081 - DNA, 30 bp, Homo sapiens; identical to SEQ ID NO: 26131
  chr1:22890079-22890109
  hyper

SEQ ID NO: 47082 - DNA, 48 bp, Homo sapiens; identical to SEQ ID NO: 26132
  chr1:22933907-22933955
  hyper

SEQ ID NO: 47083 - DNA, 73 bp, Homo sapiens; identical to SEQ ID NO: 26133
  chr1:23038177-23038250
  hyper

SEQ ID NO: 47084 - DNA, 120 bp, Homo sapiens; identical to SEQ ID NO: 16925
  chr1:23748862-23748982
  hyper

SEQ ID NO: 47085 - DNA, 79 bp, Homo sapiens
  chr1:23749070-23749149
  hyper
tcccagagcaggccccacctttctcggccagacgcccagagctccatgcccacccagacactgccgagagcccaggcgc

SEQ ID NO: 47086 - DNA, 69 bp, Homo sapiens; identical to SEQ ID NO: 26135
  chr1:23884932-23885001
  hyper

SEQ ID NO: 47087 - DNA, 80 bp, Homo sapiens; identical to SEQ ID NO: 26136
  chr1:24648262-24648342
  hyper

SEQ ID NO: 47088 - DNA, 342 bp, Homo sapiens; identical to SEQ ID NO: 16927
  chr1:25256012-25256354
  hyper

SEQ ID NO: 47089 - DNA, 441 bp, Homo sapiens; identical to SEQ ID NO: 16928
  chr1:25256383-25256824
  hyper

SEQ ID NO: 47090 - DNA, 137 bp, Homo sapiens
  chr1:25257205-25257342
  hyper
ccggtgacgccgcactgggagccgccccaaagaggttactcacctccctcgtcccgcacattattctgacccaagagcctccaccccacacgggattttgcgcgtcgtccacgcccggccggcggcctttgctgctc

SEQ ID NO: 47091 - DNA, 117 bp, Homo sapiens; identical to SEQ ID NO: 26139
  chr1:25259018-25259135
  hyper

SEQ ID NO: 47092 - DNA, 103 bp, Homo sapiens; identical to SEQ ID NO: 26140
  chr1:26249061-26249164
  hyper

SEQ ID NO: 47093 - DNA, 196 bp, Homo sapiens; identical to SEQ ID NO: 26141
  chr1:26249400-26249596
  hyper

SEQ ID NO: 47094 - DNA, 113 bp, Homo sapiens; identical to SEQ ID NO: 26142
  chr1:26372988-26373101
  hyper

SEQ ID NO: 47095 - DNA, 290 bp, Homo sapiens
  chr1:26551796-26552086
  hyper
cttgcctgcaaagcagttcctgccgggcaggctgggtagccggactcccagctgcgccgtcttcacggaagcggtgctgatgcgggacctgggggactgcggtgctggggactggccagtcctaccgggggcggggcttgtggaagactgggcgggattttgaagacctaggtcttgtggatggtgaactcacttggggcggggagggaggtggggctaccctggggtcttgggcaaagtcctcgcctggccggcttcgctacccttgtgcttgcgttgcccacaagctt

SEQ ID NO: 47096 - DNA, 77 bp, Homo sapiens
  chr1:26552130-26552207
  hyper
cgaacgcgggagggcctggagcgcggcggcagctggatagcattcgggcccatccgaataagcggtaaatggatcat

SEQ ID NO: 47097 - DNA, 121 bp, Homo sapiens; identical to SEQ ID NO: 26144
  chr1:26735162-26735283
  hyper

SEQ ID NO: 47098 - DNA, 309 bp, Homo sapiens; identical to SEQ ID NO: 5374
  chr1:26735645-26735954
  hyper

SEQ ID NO: 47099 - DNA, 402 bp, Homo sapiens
  chr1:26737181-26737583
  hyper
ggggagggggctgcccgcggggggttgggtcattgtcttttagaatttgggagcctttgaaaagccgtgggccctcccaccgctattgtgcgggggaagatgtagcagcttcttctccgaaccaaccctttgccttcggacttctccggggccagcagccgcccgaccaggggcccggggccacgggctcagccgacgaccatgggctccgtgtccaaccagcagtttgcaggttcgagctcgggacttagcggggacactttaggattcaggggcggccaggagccacgtagaagggaggtggggaactgagtcctaggctgcccaaaggaccccaagacggtgcggccttctgcttcatagggccgtctctggggccaggaaccttggtgtcccagtggc

SEQ ID NO: 47100 - DNA, 270 bp, Homo sapiens
  chr1:26737613-26737883
  hyper
aggagaggcttgtcccgccgtgagtctctgggaaacgcgttgtgggaagaggagcaaaactttcggggcactactgtcccggtgtacgctaggggaacgcgggaggcgaccgggataggtttcttctcttctgttgcttggtagctgccccctcctggctgtccacttgtggggctggatactcgggtctccctgcctggggcccgagacggccctccgattccgtgccccccagctaagtgcccggccctccctctctccaggtggctg

SEQ ID NO: 47101 - DNA, 39 bp, Homo sapiens
  chr1:26737907-26737946
  hyper
cgaggaggcgccggaggacgcggcccgggcggcggacga

SEQ ID NO: 47102 - DNA, 142 bp, Homo sapiens
  chr1:26738182-26738324
  hyper
tgcatccctgtctttgcttcggcaccccaattctgagtccctgttaactatctcgtgggggagtagtgggaggcagcaccaattatcagcacccccgcccccttccgggaacccctccggcttaccacgtgtctattacctc

SEQ ID NO: 47103 - DNA, 442 bp, Homo sapiens; identical to SEQ ID NO: 26148
  chr1:27960654-27961096
  hyper

SEQ ID NO: 47104 - DNA, 328 bp, Homo sapiens; identical to SEQ ID NO: 26149
  chr1:28199304-28199632
  hyper

SEQ ID NO: 47105 - DNA, 405 bp, Homo sapiens; identical to SEQ ID NO: 26150
  chr1:29138552-29138957
  hyper

SEQ ID NO: 47106 - DNA, 237 bp, Homo sapiens; identical to SEQ ID NO: 26151
  chr1:29448530-29448767
  hyper

SEQ ID NO: 47107 - DNA, 112 bp, Homo sapiens; identical to SEQ ID NO: 26152
  chr1:29449783-29449895
  hyper

SEQ ID NO: 47108 - DNA, 30 bp, Homo sapiens
  chr1:29586042-29586072
  hyper
cagagcggccgaggccgaacgcttcctctt

SEQ ID NO: 47109 - DNA, 184 bp, Homo sapiens
  chr1:29586674-29586858
  hyper
ggggcgctatctgaagatgggcctgtggaaatggcagtggcccagccgggatgagatctgatctaggggtcggggctggcttcgagggggacggacagggtcaaggtgagagcctaaagaggggtggggttctggctgtgtgacttctgtgttgatcctagctggcctgcggtccgctccagga

SEQ ID NO: 47110 - DNA, 31 bp, Homo sapiens
  chr1:29805094-29805125
  hyper
gacccctggcttcccgcgctgccctgcccgg

SEQ ID NO: 47111 - DNA, 30 bp, Homo sapiens; identical to SEQ ID NO: 26155
  chr1:29805353-29805383
  hyper

SEQ ID NO: 47112 - DNA, 166 bp, Homo sapiens; identical to SEQ ID NO: 26156
  chr1:30559014-30559180
  hyper

SEQ ID NO: 47113 - DNA, 264 bp, Homo sapiens
  chr1:30815578-30815842
  hyper
ctctccagggtcctgggacgagaccagccccgggcagggcagcgcggggagccaggggtcccacacccaggagggcccctcaccgcaagggacgggcttaggcggataaatgtccggctcccctcgaggggcagagtcagcaccccccacacggtccctgagatggccctgggaccgagccgccgcccccgacttgtgattcagcctcttcctgcctggctttcccctccccactgtgcctcctgggatcgcctcccaaatcag

SEQ ID NO: 47114 - DNA, 223 bp, Homo sapiens; identical to SEQ ID NO: 26158
  chr1:31157994-31158217
  hyper

SEQ ID NO: 47115 - DNA, 34 bp, Homo sapiens; identical to SEQ ID NO: 26159
  chr1:31712624-31712658
  hyper

SEQ ID NO: 47116 - DNA, 287 bp, Homo sapiens; identical to SEQ ID NO: 26160
  chr1:31846347-31846634
  hyper

SEQ ID NO: 47117 - DNA, 213 bp, Homo sapiens; identical to SEQ ID NO: 16940
  chr1:32180184-32180397
  hyper

SEQ ID NO: 47118 - DNA, 133 bp, Homo sapiens; identical to SEQ ID NO: 26162
  chr1:32180688-32180821
  hyper

SEQ ID NO: 47119 - DNA, 228 bp, Homo sapiens; identical to SEQ ID NO: 5385
  chr1:32180905-32181133
  hyper

SEQ ID NO: 47120 - DNA, 99 bp, Homo sapiens; identical to SEQ ID NO: 26164
  chr1:32181358-32181457
  hyper

SEQ ID NO: 47121 - DNA, 20 bp, Homo sapiens
  chr1:32226308-32226328
  hyper
ccgacctgcccaggccgcca

SEQ ID NO: 47122 - DNA, 25 bp, Homo sapiens
  chr1:32237521-32237546
  hyper
cacaaagggccccaccgccggaagc

SEQ ID NO: 47123 - DNA, 167 bp, Homo sapiens
  chr1:32238507-32238674
  hyper
agggaccccgggcccgccgccagccctgggcacacccgccccttcctccagcggccccgctcgctgacccacgggcactcgatgggcactcgggaggcaatggccggagaggatgggcagttagcgggagggactgagtggcgccggcttcacgctcattctgctga

SEQ ID NO: 47124 - DNA, 42 bp, Homo sapiens; identical to SEQ ID NO: 16944
  chr1:32410234-32410276
  hyper

SEQ ID NO: 47125 - DNA, 58 bp, Homo sapiens; identical to SEQ ID NO: 16945
  chr1:32410306-32410364
  hyper

SEQ ID NO: 47126 - DNA, 84 bp, Homo sapiens; identical to SEQ ID NO: 26169
  chr1:32827740-32827824
  hyper

SEQ ID NO: 47127 - DNA, 408 bp, Homo sapiens; identical to SEQ ID NO: 26170
  chr1:32930619-32931027
  hyper

SEQ ID NO: 47128 - DNA, 35 bp, Homo sapiens; identical to SEQ ID NO: 5391
  chr1:33351678-33351713
  hyper

SEQ ID NO: 47129 - DNA, 98 bp, Homo sapiens; identical to SEQ ID NO: 26172
  chr1:33358896-33358994
  hyper

SEQ ID NO: 47130 - DNA, 75 bp, Homo sapiens; identical to SEQ ID NO: 26173
  chr1:33390730-33390805
  hyper

SEQ ID NO: 47131 - DNA, 71 bp, Homo sapiens; identical to SEQ ID NO: 26174
  chr1:33438729-33438800
  hyper

SEQ ID NO: 47132 - DNA, 140 bp, Homo sapiens; identical to SEQ ID NO: 26175
  chr1:33772445-33772585
  hyper

SEQ ID NO: 47133 - DNA, 33 bp, Homo sapiens; identical to SEQ ID NO: 26176
  chr1:33772904-33772937
  hyper

SEQ ID NO: 47134 - DNA, 358 bp, Homo sapiens
  chr1:34628590-34628948
  hyper
ctgagcaaggagctgcgagcaaatggatctctatagggcaggattccagcaccgctgagcggtgcaagcgccggtgagtcggcctttttctctcccctaggggcaggatatgcccaaggggcagggacaaatctagccagaaaaacaattcagtccgatgccgagacattctccaatcagctaagccagagaccggcctcgcctcaacgtacgtccgggaggcctggcgggaggtagcagcgattcccccaccgcccatgtggcaagtctgggtgaccagcagcgtcggtatgcacagcctcccagtgggtgtgggtgtgcgagaggccagagctcccaggcgcgcgcaccgcgggcg

SEQ ID NO: 47135 - DNA, 491 bp, Homo sapiens; identical to SEQ ID NO: 16951
  chr1:34628978-34629469
  hyper

SEQ ID NO: 47136 - DNA, 185 bp, Homo sapiens
  chr1:34629728-34629913
  hyper
tggcgcggagtgagcaccgaggggaatgtggcagcgcgaagcctggcggcggcactccctcccccgcctcgggctacaacccccaccccctccttcccatccctcaacaccctccagcccccacctgcaccctcctgcaaggaatgcgcgggacccccaccgtgggcacgcgtccacctgaaccc

SEQ ID NO: 47137 - DNA, 333 bp, Homo sapiens
  chr1:34630215-34630548
  hyper
ccccgcaaccccgggcggggatgtctgtctcccaggcccccacaccggccgcatccgtccaagttgcggctggggttggggcagcagtgagggtgagggtggaggtgaggacgtggctgagggtggggtgggagacggaggcagggatgagaatgagagtaggcaactgggagggtgggagattcaggcagggatagaggcggggggagggactgggaccgggtcgaggatgggtgggctcggggctcgggtggggcgcgcggcggccgctggctcctcggcgcggctggactcacccgcggcggccgagacgctgagcaacccacagcccag

SEQ ID NO: 47138 - DNA, 224 bp, Homo sapiens; identical to SEQ ID NO: 16954
  chr1:34630635-34630859
  hyper

SEQ ID NO: 47139 - DNA, 62 bp, Homo sapiens
  chr1:34630978-34631040
  hyper
ccaaatgctgggggtggaggcgcagctaaggataaaatattggggggcgggggttcctcttc

SEQ ID NO: 47140 - DNA, 64 bp, Homo sapiens
  chr1:34631516-34631580
  hyper
gggaggggggggaaccggttcatttgacccagtgcggtcccactcctaccctaagacaaaaatc

SEQ ID NO: 47141 - DNA, 147 bp, Homo sapiens
  chr1:34631662-34631809
  hyper
tagtacaatttatccccaaatttaaataatcggatcctacttcttcttctccccttcctcctcccagccaaggccccaaaccaagagagttcttcccaaggacgtgagctgctccccacctctccccagtagcggctgcctctaggc

SEQ ID NO: 47142 - DNA, 361 bp, Homo sapiens; identical to SEQ ID NO: 26180
  chr1:34632140-34632501
  hyper

SEQ ID NO: 47143 - DNA, 276 bp, Homo sapiens; identical to SEQ ID NO: 26182
  chr1:34642862-34643138
  hyper

SEQ ID NO: 47144 - DNA, 77 bp, Homo sapiens; identical to SEQ ID NO: 26183
  chr1:35247068-35247145
  hyper

SEQ ID NO: 47145 - DNA, 76 bp, Homo sapiens
  chr1:35258561-35258637
  hyper
ctgcgctatttaaggcgcccccgccgctcgtgcggtccagcagggctcccgcgggcgtcactccggccatcgtccc

SEQ ID NO: 47146 - DNA, 90 bp, Homo sapiens
  chr1:35258714-35258804
  hyper
ggaggccgggaggagtcttgggtcctccgatgccgggacgggggttgctgcggaacgcccgccgcgacagagccgcgctcacccaggtgg

SEQ ID NO: 47147 - DNA, 39 bp, Homo sapiens; identical to SEQ ID NO: 16960
  chr1:35351039-35351078
  hyper

SEQ ID NO: 47148 - DNA, 197 bp, Homo sapiens
  chr1:35351659-35351856
  hyper
aaggtgtactcacaggagccgggcctccctgagacagcggcaggggtagcgaggaggggcaggcagtcgtcgtcttgagagcagccggcctggatggcccggaggtagctgtggctccgcatgcggaaacagccgggcaggtccagggcgtccacggcctgggactccagctccccaaacaccgacccgcacacggc

SEQ ID NO: 47149 - DNA, 60 bp, Homo sapiens; identical to SEQ ID NO: 5400
  chr1:35390613-35390673
  hyper

SEQ ID NO: 47150 - DNA, 151 bp, Homo sapiens
  chr1:35395375-35395526
  hyper
cgagctccccgcccccgcgcggacccaggagggccgaggtcgccgcccgcgggcggccgccggggtcccggaggagcgcccacctcgctgagcgacggtgctgggggcgcccagcgtaggggcaggaatgagatccccctccccggggacc

SEQ ID NO: 47151 - DNA, 198 bp, Homo sapiens
  chr1:35395851-35396049
  hyper
gtccgcacagccgaggcatccccagtgtggagggagagccccgctgtacctgccgcctgtgctgggcccccgcccgtgcccactgtgcccgcccgcctctgggccctgagcctgggattgtgccatggcggggtcggggtggggggaaagggactgtccgaagcacagctggaggctgcggagcccggacacaggctg

SEQ ID NO: 47152 - DNA, 24 bp, Homo sapiens
  chr1:35396107-35396131
  hyper
cgcccagagcgatgctgtaatggg

SEQ ID NO: 47153 - DNA, 130 bp, Homo sapiens; identical to SEQ ID NO: 16965
  chr1:36042549-36042679
  hyper

SEQ ID NO: 47154 - DNA, 30 bp, Homo sapiens; identical to SEQ ID NO: 5405
  chr1:36549840-36549870
  hyper

SEQ ID NO: 47155 - DNA, 164 bp, Homo sapiens; identical to SEQ ID NO: 26192
  chr1:37498362-37498526
  hyper

SEQ ID NO: 47156 - DNA, 39 bp, Homo sapiens; identical to SEQ ID NO: 16967
  chr1:37498753-37498792
  hyper

SEQ ID NO: 47157 - DNA, 279 bp, Homo sapiens
  chr1:37499181-37499460
  hyper
gagtgaggtgggcagaggagagaagttggcgccttccccagggtccccactctgcggagaagcccgatcgcagaactcggtcggctgcggttcatgctggcagtcaccgcgaaatgcgccctcgactcgggatcgcactggaaaccttcgccacactgtgccaggtctgacctcccaggagcgcgccaagggcccctcgcccactgcggcccggcggcctcctccccaataagtaaggcccgtgaccccgactctggaactttgtcctcacagggagga

SEQ ID NO: 47158 - DNA, 288 bp, Homo sapiens
  chr1:37500153-37500441
  hyper
cctcccagccccctcccctgcgccctgcctcccgcctcccgcgccgcccgccgcccgcgctccctccgcgcactcccccgcgcacacacacttcacactcacacttgccgaggcgcacactcgcgcgctcacacctgcgcggggggcggggaaggggaccctggccccattgtagggggacgcccggagaacgaggactctcctcgcttcccagacgtccccacccgccccgccggccccagtcccttctactgcgagggcacggagcccgggagccaggcgtggagc

SEQ ID NO: 47159 - DNA, 26 bp, Homo sapiens
  chr1:37500442-37500468
  hyper
cgagagctggcaccgcgagctgggag

SEQ ID NO: 47160 - DNA, 168 bp, Homo sapiens
  chr1:37500806-37500974
  hyper
gctgcggaggaggaagaccgctcacgccttagatgtaggggggcgtgggcgccgggcccgctccctctcagccctctcccgtaactgtgcaggaagggctggtgccccctccctcattctcctgagaaagaataaagagaaactgtaatttgtcgtgggatggagtag

SEQ ID NO: 47161 - DNA, 33 bp, Homo sapiens; identical to SEQ ID NO: 26198
  chr1:38100650-38100683
  hyper

SEQ ID NO: 47162 - DNA, 189 bp, Homo sapiens
  chr1:38219523-38219712
  hyper
tggcagcatggggaccgaaccgatggtgcgaaggtcgggagcccccctttcggctggagggtaggcagggtgaggagagggcagcggaggggcgctctcctcagtgatctgccaggcatcctaaccccatcctccgtctggactctcgcagttgtcctggttcttctcatcaaaggccccggcccccag

SEQ ID NO: 47163 - DNA, 163 bp, Homo sapiens
  chr1:38219795-38219958
  hyper
accctgccctcaccaccacctggatcaggccttccttcttggccactcccaccccccaccctccgcagtgcagcctggaggggggactcacgggtgcaggaagccgagggcgggtcggtgggtgagcgcgcatagctgtcctggcacacgcagaaggtggagg

SEQ ID NO: 47164 - DNA, 36 bp, Homo sapiens
  chr1:38230006-38230042
  hyper
ctggattcaactgagcgtatagctcccctaaatgca

SEQ ID NO: 47165 - DNA, 156 bp, Homo sapiens; identical to SEQ ID NO: 16970
  chr1:38230623-38230779
  hyper

SEQ ID NO: 47166 - DNA, 91 bp, Homo sapiens; identical to SEQ ID NO: 16971
  chr1:38510087-38510178
  hyper

SEQ ID NO: 47167 - DNA, 33 bp, Homo sapiens
  chr1:38510217-38510250
  hyper
ggctcggatgaaacgaaacgaaaaatgaacact

SEQ ID NO: 47168 - DNA, 253 bp, Homo sapiens
  chr1:38510310-38510563
  hyper
tagggaaatataaggggaaaaataaattaggctagattaaagctttggctatttcctgcttttatacacagacgcggctctcgcgacctcccctccggggccccgataaatacagtatactgcgatttaaattaagggcgcgggcggagttagaaggaccccaggagccgagaggctccacgaataaataaaaaccgtaaaaaaccaagcccggagaaaggggaaagcggggtggggcgcatccttataggag

SEQ ID NO: 47169 - DNA, 110 bp, Homo sapiens; identical to SEQ ID NO: 16974
  chr1:38510624-38510734
  hyper

SEQ ID NO: 47170 - DNA, 81 bp, Homo sapiens; identical to SEQ ID NO: 16975
  chr1:38510773-38510854
  hyper

SEQ ID NO: 47171 - DNA, 218 bp, Homo sapiens; identical to SEQ ID NO: 16976
  chr1:38511119-38511337
  hyper

SEQ ID NO: 47172 - DNA, 290 bp, Homo sapiens
  chr1:38511824-38512114
  hyper
ctcgtggccatcctcgtgcagcgcgtggtgcaggcccggccccgcgccgccaccgcccgccgccagcatcccggccaggccgccgccgccgccccccgggtaggccgcctgcgcgtacagcccgagcggctggggctggtggcccccgctggccccgggcgagggcgacatggccgggcccaagtggtgcgctgtgctgccctgcgcccatgccgcgcccgcgtgggccgccccctggtgcaccaggcgcgcgtggaaacctccgccgccgccgccgtcgtcggctcggc

SEQ ID NO: 47173 - DNA, 27 bp, Homo sapiens
  chr1:38512126-38512153
  hyper
cgcctgccttgccgtgttctaggtgcg

SEQ ID NO: 47174 - DNA, 39 bp, Homo sapiens; identical to SEQ ID NO: 26209
  chr1:38513064-38513103
  hyper

SEQ ID NO: 47175 - DNA, 32 bp, Homo sapiens; identical to SEQ ID NO: 26210
  chr1:38599724-38599756
  hyper

SEQ ID NO: 47176 - DNA, 20 bp, Homo sapiens
  chr1:39025499-39025519
  hyper
cggggcggggcggggggcga

SEQ ID NO: 47177 - DNA, 74 bp, Homo sapiens; identical to SEQ ID NO: 26212
  chr1:39044122-39044196
  hyper

SEQ ID NO: 47178 - DNA, 109 bp, Homo sapiens; identical to SEQ ID NO: 26213
  chr1:39044197-39044306
  hyper

SEQ ID NO: 47179 - DNA, 98 bp, Homo sapiens; identical to SEQ ID NO: 16979
  chr1:39269643-39269741
  hyper

SEQ ID NO: 47180 - DNA, 42 bp, Homo sapiens
  chr1:39270121-39270163
  hyper
tttagaaagagctgcgggctgcgggcccggctgtccccgaga

SEQ ID NO: 47181 - DNA, 33 bp, Homo sapiens; identical to SEQ ID NO: 26215
  chr1:39284513-39284546
  hyper

SEQ ID NO: 47182 - DNA, 614 bp, Homo sapiens; identical to SEQ ID NO: 26216
  chr1:40105079-40105693
  hyper

SEQ ID NO: 47183 - DNA, 26 bp, Homo sapiens
  chr1:40137581-40137607
  hyper
gggtttcttcttgggcgcgaggttgt

SEQ ID NO: 47184 - DNA, 83 bp, Homo sapiens; identical to SEQ ID NO: 26218
  chr1:40137646-40137729
  hyper

SEQ ID NO: 47185 - DNA, 169 bp, Homo sapiens; identical to SEQ ID NO: 26219
  chr1:40157762-40157931
  hyper

SEQ ID NO: 47186 - DNA, 30 bp, Homo sapiens; identical to SEQ ID NO: 26220
  chr1:40204397-40204427
  hyper

SEQ ID NO: 47187 - DNA, 82 bp, Homo sapiens
  chr1:40237059-40237141
  hyper
gctctaggctaggcccgcgacccgcaacagggagggggccggctccgccctgggctgggggcccccgagtcagtcctccgtg

SEQ ID NO: 47188 - DNA, 488 bp, Homo sapiens; identical to SEQ ID NO: 26222
  chr1:40781403-40781891
  hyper

SEQ ID NO: 47189 - DNA, 150 bp, Homo sapiens; identical to SEQ ID NO: 26223
  chr1:40782758-40782908
  hyper

SEQ ID NO: 47190 - DNA, 142 bp, Homo sapiens; identical to SEQ ID NO: 26224
  chr1:41267904-41268046
  hyper

SEQ ID NO: 47191 - DNA, 190 bp, Homo sapiens
  chr1:41284463-41284653
  hyper
tgtggcctgcgggggttggagccctagcaggaggcgaggtctaagcgggtggggcgaagtggattctgaattaggtaggggcgggcctaggagtccggaccggatcagggggcggggccggagaggcggggcttgagggtttcccctggatgcttctgggtttgaagggaccactcgtaccacaaagtgg

SEQ ID NO: 47192 - DNA, 73 bp, Homo sapiens; identical to SEQ ID NO: 26226
  chr1:41327007-41327080
  hyper

SEQ ID NO: 47193 - DNA, 39 bp, Homo sapiens; identical to SEQ ID NO: 26227
  chr1:41350136-41350175
  hyper

SEQ ID NO: 47194 - DNA, 92 bp, Homo sapiens; identical to SEQ ID NO: 26228
  chr1:41444864-41444956
  hyper

SEQ ID NO: 47195 - DNA, 287 bp, Homo sapiens
  chr1:41847296-41847583
  hyper
cggcacaacctgtcgctgcacacccgtttcatccgcgtgcagaacgagggcaccggcaagagttcgtggtggatgctgaaccccgagggcggaaagacagggaagaccccgcggcgcagggccgtgtccatggacaacggggccaagttcctgcgcatcaagggcaaggcgagcaagaagaagcagctgcaggcgcccgagcgaagcccggacgacagctccccgagtgcgcccgccccggggccggtgcctgccgcagccaagtgggccgccagccccgcctcgca

SEQ ID NO: 47196 - DNA, 251 bp, Homo sapiens
  chr1:41847702-41847953
  hyper
tcatgtacccaagccccgccagcgcgctgtcgccggcgctgggctcgcgctgtccgggtgagctgccccgcctggccgagctgggaggcccgctgggcctgcacggcggcggcggcgcggggctgcccgagggcctgctggacggcgcgcaggacgcgtacgggccgcgggcccgcgcccaggcccggcccggtgctgggtgcgccgggggagctggcgctggcgggcgcagccgccgcctaccccggcaa

SEQ ID NO: 47197 - DNA, 56 bp, Homo sapiens; identical to SEQ ID NO: 26230
  chr1:41848262-41848318
  hyper

SEQ ID NO: 47198 - DNA, 33 bp, Homo sapiens; identical to SEQ ID NO: 26231
  chr1:41848943-41848976
  hyper

SEQ ID NO: 47199 - DNA, 57 bp, Homo sapiens; identical to SEQ ID NO: 26232
  chr1:42128290-42128347
  hyper

SEQ ID NO: 47200 - DNA, 11 bp, Homo sapiens
  chr1:43533901-43533912
  hyper
ggtgtgcgccc

SEQ ID NO: 47201 - DNA, 131 bp, Homo sapiens; identical to SEQ ID NO: 26234
  chr1:43534114-43534245
  hyper

SEQ ID NO: 47202 - DNA, 124 bp, Homo sapiens; identical to SEQ ID NO: 26235
  chr1:43613496-43613620
  hyper

SEQ ID NO: 47203 - DNA, 156 bp, Homo sapiens; identical to SEQ ID NO: 26236
  chr1:44402104-44402260
  hyper

SEQ ID NO: 47204 - DNA, 118 bp, Homo sapiens
  chr1:44873706-44873824
  hyper
cccagagtattctatatacaaaggcaaccgagagccggagggagaggtcgggccaaagagtagtgggctcggctccgcgttgggcccaagtttatgtaggtttcgccttcacctcttc

SEQ ID NO: 47205 - DNA, 52 bp, Homo sapiens
  chr1:44883069-44883121
  hyper
tggggccaggctggacgggagcagtccctgatggctgcagagccatctggcc

SEQ ID NO: 47206 - DNA, 154 bp, Homo sapiens; identical to SEQ ID NO: 26243
  chr1:45250008-45250162
  hyper

SEQ ID NO: 47207 - DNA, 173 bp, Homo sapiens; identical to SEQ ID NO: 26244
  chr1:45250192-45250365
  hyper

SEQ ID NO: 47208 - DNA, 330 bp, Homo sapiens; identical to SEQ ID NO: 26245
  chr1:45251926-45252256
  hyper

SEQ ID NO: 47209 - DNA, 155 bp, Homo sapiens
  chr1:46632721-46632876
  hyper
cgcgactacctgcttcgctcccacccgcgcgcccaggaccctagctgcgggactctagcggggaaggcacccccaattctgggccctggcgaccttgggtcagggccaggaaaggcacttccagccaagcgctggcgccgggtgcgcctcgcttt

SEQ ID NO: 47210 - DNA, 49 bp, Homo sapiens
  chr1:46632923-46632972
  hyper
gcagccgcgagaaggctagctgctgccaaagctccgaagctctggatgt

SEQ ID NO: 47211 - DNA, 42 bp, Homo sapiens; identical to SEQ ID NO: 26247
  chr1:46859934-46859976
  hyper

SEQ ID NO: 47212 - DNA, 51 bp, Homo sapiens
  chr1:46913786-46913837
  hyper
cgcccgcattcagttcgaaggaccagccagtaggccctgcgccgcccaggg

SEQ ID NO: 47213 - DNA, 148 bp, Homo sapiens; identical to SEQ ID NO: 26250
  chr1:46914285-46914433
  hyper

SEQ ID NO: 47214 - DNA, 21 bp, Homo sapiens
  chr1:46951186-46951207
  hyper
gtgaaggggagtagccgtcgg

SEQ ID NO: 47215 - DNA, 23 bp, Homo sapiens
  chr1:46951739-46951762
  hyper
agggcggccgcatggggcattcg

SEQ ID NO: 47216 - DNA, 194 bp, Homo sapiens
  chr1:46956260-46956454
  hyper
aaccccgcagtgctccgggcattgcccgggtctggctttggtctcgcccgcgcagatcccgttcaaactcagctgccaccaagtgcgccttttctctctggattgcgattctgcacgaattttccagttgagggtggttcggcgctcagccagcctctgccctcgaagacgcggccttggtctaggaaccttca

SEQ ID NO: 47217 - DNA, 13 bp, Homo sapiens
  chr1:46956603-46956616
  hyper
agtcaaagggttg

SEQ ID NO: 47218 - DNA, 139 bp, Homo sapiens; identical to SEQ ID NO: 17001
  chr1:46956684-46956823
  hyper

SEQ ID NO: 47219 - DNA, 437 bp, Homo sapiens; identical to SEQ ID NO: 26256
  chr1:47009449-47009886
  hyper

SEQ ID NO: 47220 - DNA, 19 bp, Homo sapiens
  chr1:47009910-47009929
  hyper
cgcctcccgccacccggaa

SEQ ID NO: 47221 - DNA, 28 bp, Homo sapiens
  chr1:47010104-47010132
  hyper
cgtccgcactttccgagagccaggcacg

SEQ ID NO: 47222 - DNA, 35 bp, Homo sapiens; identical to SEQ ID NO: 26259
  chr1:47691684-47691719
  hyper

SEQ ID NO: 47223 - DNA, 101 bp, Homo sapiens; identical to SEQ ID NO: 26260
  chr1:47694827-47694928
  hyper

SEQ ID NO: 47224 - DNA, 143 bp, Homo sapiens
  chr1:47694979-47695122
  hyper
cgctgagaggcctgcagttacgctgcggtgtggtcctgggcgatctgccgcgcccaaagcgagtttccaggaaagataggggtggagagaaagaggcagggcaagagggagggagagagagaaatgggggtcaatggctggga

SEQ ID NO: 47225 - DNA, 164 bp, Homo sapiens
  chr1:47695422-47695586
  hyper
cgcgaagggatagtcccgggcctggatgggcggaggtccgtgttgggaaaggcgaatagtcttcagactctggtcggtgggacagaaccttgaagtcccccccacctcattctctctctgacccccatccacccacctccagcccaaagcgaaaccagaaccca

SEQ ID NO: 47226 - DNA, 399 bp, Homo sapiens
  chr1:47695896-47696295
  hyper
aggtaaaaacaaacccgacactactttcaaggatgtagcaggattgagcttgcttttattttttcctagtggattttgtttaatttgttttgcctaaatcgtcaggcttatgatcacacatcgaagtcttggattaactgcgaaggcctccttctatttgccgcggctttggtggacatataggaataattcttccctggattgcaatacaatgcggaagattttctttctcctcttctaatccaaaagaggggaggggaggaaagaagaggggaatccatccattcccggcgtgttcgcggggggttaatgttgcgtgttcgctgggggttaatgtttgccttatgaccaagtctctgtgtccgtgcctctctccattttctcttcctacctcaaacc

SEQ ID NO: 47227 - DNA, 201 bp, Homo sapiens; identical to SEQ ID NO: 17006
  chr1:47696620-47696821
  hyper

SEQ ID NO: 47228 - DNA, 15 bp, Homo sapiens
  chr1:47697341-47697356
  hyper
tgctgagaacaccaa

SEQ ID NO: 47229 - DNA, 222 bp, Homo sapiens; identical to SEQ ID NO: 17008
  chr1:47697510-47697732
  hyper

SEQ ID NO: 47230 - DNA, 30 bp, Homo sapiens
  chr1:47882033-47882063
  hyper
tccctgccctgccagcggtcgcgccgtcgg

SEQ ID NO: 47231 - DNA, 16 bp, Homo sapiens
  chr1:47882322-47882338
  hyper
gcgcaagtggcagaac

SEQ ID NO: 47232 - DNA, 10 bp, Homo sapiens
  chr1:47882759-47882769
  hyper
ccccgccact

SEQ ID NO: 47233 - DNA, 32 bp, Homo sapiens
  chr1:47882803-47882835
  hyper
gcgacgcgccccggccccggcccgctgcccgc

SEQ ID NO: 47234 - DNA, 55 bp, Homo sapiens; identical to SEQ ID NO: 26270
  chr1:47904617-47904672
  hyper

SEQ ID NO: 47235 - DNA, 183 bp, Homo sapiens
  chr1:47909535-47909718
  hyper
gagttgaggtgggggcggacacttcccctccatatccaatttgctcttgccacagcgggcgcgtcttcgtggttacaaagcgctttttccctgatgacttttttccccttttcaaaaacacttctttctccccccttcaactagcaaccctccccaggcccacccctcctccctctccgctcc

SEQ ID NO: 47236 - DNA, 15 bp, Homo sapiens
  chr1:47910508-47910523
  hyper
cgcctccttccgtag

SEQ ID NO: 47237 - DNA, 132 bp, Homo sapiens
  chr1:48058946-48059078
  hyper
cgccgccgccagcccggggctgacctctcagagcagggcggaggattttcacagcacagcttcccgagagagcgggattaagggggaactgctcgggtgggccagagccaggggctagggggaggccgggcg

SEQ ID NO: 47238 - DNA, 63 bp, Homo sapiens
  chr1:48059243-48059306
  hyper
ggtggggctcagtctgtctctcgttttctctccctgtttctaagatctcgtggaatcaaagac

SEQ ID NO: 47239 - DNA, 188 bp, Homo sapiens; identical to SEQ ID NO: 26275
  chr1:48190874-48191062
  hyper

SEQ ID NO: 47240 - DNA, 310 bp, Homo sapiens; identical to SEQ ID NO: 26276
  chr1:48462159-48462469
  hyper

SEQ ID NO: 47241 - DNA, 10 bp, Homo sapiens
  chr1:49242334-49242344
  hyper
cgcgcggggg

SEQ ID NO: 47242 - DNA, 64 bp, Homo sapiens; identical to SEQ ID NO: 5472
  chr1:49242884-49242948
  hyper

SEQ ID NO: 47243 - DNA, 60 bp, Homo sapiens; identical to SEQ ID NO: 26281
  chr1:50489576-50489636
  hyper

SEQ ID NO: 47244 - DNA, 457 bp, Homo sapiens
  chr1:50513745-50514202
  hyper
gagcggtgagactctgcggacgtcttcccgcccgccgcgctccgccccacccagcctccgcagcctcgggccggatcgcccggcggggaagatgcgcctcaagaaccaggtagaagcgcctcggcgcaggccccgcacccccgactctgcccgccctctgttacggacacccgctgggccacgtggtcgcgactggcttctcccagcggccagcctggccaccccgactcccagggagggggagagggcccttgcaagaggatcctgcccccgcgctgcccagacctgagggctcctggcgaccccacccgcagcccatctggcggctctggccccgcaggtcagggtcacacccctgccggcctcctgagacttcccggccccaggggagagagctgaaacttgggttgacgcgcgccccctccccagcgacaggcgaccccgcagcagccccgcg

SEQ ID NO: 47245 - DNA, 626 bp, Homo sapiens; identical to SEQ ID NO: 17019
  chr1:50798652-50799278
  hyper

SEQ ID NO: 47246 - DNA, 214 bp, Homo sapiens
  chr1:50799400-50799614
  hyper
agccgcggctgccccctactggcggaaggaagagtcgccgctccggggcccttggcggccgccgctcttcgcgcctccttggcctggctgccacccttccaccctcgggggagaccccgcgctctgtgctcactcggggaagagaggctcaatcacggcctggaccagcactagggacctaaacgctcttctcagtgtgcgtgaagccaggtcc

SEQ ID NO: 47247 - DNA, 15 bp, Homo sapiens
  chr1:50881302-50881317
  hyper
cattgcaggtctctg

SEQ ID NO: 47248 - DNA, 23 bp, Homo sapiens
  chr1:50882529-50882552
  hyper
gcggggagcgggagggactggag

SEQ ID NO: 47249 - DNA, 42 bp, Homo sapiens
  chr1:50882766-50882808
  hyper
gccaccctgcccagccgtcgccttcgttgcctgtggttccaa

SEQ ID NO: 47250 - DNA, 271 bp, Homo sapiens
  chr1:50883611-50883882
  hyper
attacaattaataacttagaattccattttataacattatacactggcttgtatatatatatgtatagattatatatagatttatacatatataaaaacacactgcaccaaggaaacccatgcttatcggcataagcaacaaagagagcgacaaataccgcaacgaggaaagtgcaccttaaaacttgtttcctttttttttttttacaattgtatcgatatatatgtgtgtcccaaagactcagtgccaagagatttatacatcctaaat

SEQ ID NO: 47251 - DNA, 88 bp, Homo sapiens
  chr1:50885248-50885336
  hyper
cgagcctgagccgggccgcacctctggggacgacgtcccgggccccgagtctgcgccgtcgggtgataagggcttcaccggcggcggc

SEQ ID NO: 47252 - DNA, 76 bp, Homo sapiens
  chr1:50885366-50885442
  hyper
agcgtcttaggaaacaggtcaaacttctgcaacttggcctctgggaggggagaaaacgtgtcgtgaggagcggtta

SEQ ID NO: 47253 - DNA, 133 bp, Homo sapiens
  chr1:50886055-50886188
  hyper
gcaggcagtaggaagcgaagaggaaaagacataggaaagcagacctgagaaaccagggagggtgcggaagaaactagaaggagggagggcgcagcaagcggttgtccagagggcgttaggaacgcgagaaggg

SEQ ID NO: 47254 - DNA, 30 bp, Homo sapiens; identical to SEQ ID NO: 26294
  chr1:50887723-50887753
  hyper

SEQ ID NO: 47255 - DNA, 478 bp, Homo sapiens
  chr1:50888231-50888709
  hyper
gagtagtagtcggggcggaagacgtatcctgcgaaaagttaggcatttcgggagggggatctttctcgaagaccacctcacactgccctcccctcccctccgggtttagggacagagtcgtcagacacgccctccccgtcttggggtcccaggggacccctctcgagcgcaggctcctgcgttctgatctcagagttggggtcctaggacacggatggcccagcaggccgcaccaagccaggggagtcgccttcgcaactggccataaacggacaccagagtccctcccacgccgcagccccataaggcccaagcaggcccagctccccgcttctgccgcggtctcctctgcttcccgcgttccccgtccctgccagagcccgcgacagagtccttgtgtctccgtccgagagtcccagacctcctctctatgagcgttgcctcctctcccagacccttcgggcgtccctaaggccca

SEQ ID NO: 47256 - DNA, 310 bp, Homo sapiens; identical to SEQ ID NO: 17024
  chr1:50889510-50889820
  hyper

SEQ ID NO: 47257 - DNA, 20 bp, Homo sapiens
  chr1:50890629-50890649
  hyper
cgcgcagactcggcccgggt

SEQ ID NO: 47258 - DNA, 256 bp, Homo sapiens; identical to SEQ ID NO: 17025
  chr1:50892351-50892607
  hyper

SEQ ID NO: 47259 - DNA, 113 bp, Homo sapiens; identical to SEQ ID NO: 26304
  chr1:50896073-50896186
  hyper

SEQ ID NO: 47260 - DNA, 30 bp, Homo sapiens; identical to SEQ ID NO: 26305
  chr1:51442776-51442806
  hyper

SEQ ID NO: 47261 - DNA, 46 bp, Homo sapiens; identical to SEQ ID NO: 26306
  chr1:52456259-52456305
  hyper

SEQ ID NO: 47262 - DNA, 288 bp, Homo sapiens
  chr1:53067878-53068166
  hyper
tccggggcaggggtgcgctgcctcaggacagacggtgaaactgaggtccagagccggacatccaccgcctgcggagggaacgagaacgcggcgcgtcctgccttgcgggccgagcggcgccagagccgcctcctcccgccccccgcgctagatccccccgccccgtctttgccctcgcgacgccgccacctccggaacaagccatggtggcggcgacggtggcagcggcgtggctgctcctgtgggctgcggcctgcgcgcagcaggagcaggacttctacgacttca

SEQ ID NO: 47263 - DNA, 99 bp, Homo sapiens
  chr1:53068546-53068645
  hyper
agcctttgccattcacgggtgaaaaaagtaaccgtagcatcgtgcggcctttccctctcccgtcctcattttctgcatctggaacggggagtggctgat

SEQ ID NO: 47264 - DNA, 159 bp, Homo sapiens
  chr1:53098683-53098842
  hyper
cgagactcccggcgccggctcggtgcaggtaaggcgcccgcgccctggcctcgaattcccgccccgccactctggccgcgtcgtgctgtcgttgcgcacccagcgccctcgtgcaggcagggggagcgcagtggggagggggcaggaagcgcaggcaga

SEQ ID NO: 47265 - DNA, 299 bp, Homo sapiens; identical to SEQ ID NO: 17027
  chr1:53099067-53099366
  hyper

SEQ ID NO: 47266 - DNA, 352 bp, Homo sapiens; identical to SEQ ID NO: 26311
  chr1:53168843-53169195
  hyper

SEQ ID NO: 47267 - DNA, 236 bp, Homo sapiens
  chr1:53308332-53308568
  hyper
ggctaggaggccgcccggggggtggggtctgcggcgggccggcccccgcgtgcgcgtcgcctcgccgggcatttcaaaagctcgccggcagggcgcggcgctagctccgtgtgcctcgcaggcgtggtgggcgcgtcctggcagccgcccgcttggttctcgcgggatccgggctccggctcgacgccggctctctttttgacgccccgccgccggggttgccatggttcatttct

SEQ ID NO: 47268 - DNA, 27 bp, Homo sapiens
  chr1:53309248-53309275
  hyper
cccagcctttgccgaatgcctgttact

SEQ ID NO: 47269 - DNA, 49 bp, Homo sapiens; identical to SEQ ID NO: 26314
  chr1:53527557-53527606
  hyper

SEQ ID NO: 47270 - DNA, 92 bp, Homo sapiens; identical to SEQ ID NO: 5507
  chr1:53527939-53528031
  hyper

SEQ ID NO: 47271 - DNA, 119 bp, Homo sapiens; identical to SEQ ID NO: 17033
  chr1:53528255-53528374
  hyper

SEQ ID NO: 47272 - DNA, 30 bp, Homo sapiens; identical to SEQ ID NO: 26317
  chr1:53528728-53528758
  hyper

SEQ ID NO: 47273 - DNA, 267 bp, Homo sapiens
  chr1:54204399-54204666
  hyper
cctatgcgcagcggaggaatcgagcccgtcgcgcgcgcaaaccggcacagtgggcaatgcccacgcggccgccgccacacacccgcacacccgccgaggcacgcccggggacggacacgccacccacactgccgctggtcagacgctcagcagcgcacaaccacacagtcccacgctctcgccacacgcgcgtgcgatgggggccgcgacagagcctccctcagcccttccatcaggggcccccaaactctccgttcccctccgcgc

SEQ ID NO: 47274 - DNA, 168 bp, Homo sapiens; identical to SEQ ID NO: 26319
  chr1:54940331-54940499
  hyper

SEQ ID NO: 47275 - DNA, 224 bp, Homo sapiens
  chr1:55462703-55462927
  hyper
cgccgactcagccgagggagaccttggccagcccctgccactccgcaggctcggtttcctcgcctgtgaaatgcgggcgatgactcccctccccgccgcgactgctcatcaccgggtccgagcccagccgctgaccccgggggaagcgccttgctcagcgccgggcggcccacgaggccctgcaggaccgcggctgcggagaccgttcccgccacccgcctggg

SEQ ID NO: 47276 - DNA, 89 bp, Homo sapiens; identical to SEQ ID NO: 26321
  chr1:55505073-55505162
  hyper

SEQ ID NO: 47277 - DNA, 30 bp, Homo sapiens; identical to SEQ ID NO: 26322
  chr1:55505516-55505546
  hyper

SEQ ID NO: 47278 - DNA, 522 bp, Homo sapiens; identical to SEQ ID NO: 26323
  chr1:57110923-57111445
  hyper

SEQ ID NO: 47279 - DNA, 36 bp, Homo sapiens; identical to SEQ ID NO: 26324
  chr1:57888031-57888067
  hyper

SEQ ID NO: 47280 - DNA, 40 bp, Homo sapiens; identical to SEQ ID NO: 17036
  chr1:57888327-57888367
  hyper

SEQ ID NO: 47281 - DNA, 207 bp, Homo sapiens; identical to SEQ ID NO: 17037
  chr1:57888780-57888987
  hyper

SEQ ID NO: 47282 - DNA, 315 bp, Homo sapiens
  chr1:57889087-57889402
  hyper
tcgaagccgaatctcagcgctacggaggagtagggaagtgagaacggggttcggccgaatgaggaaaagggtctggccaccagcgagggagggagggagtttcgggagcccaggacagcgggagaaggcaggctcgaggtccgatatagccaggaccgcaggaggaaagagggcgcagggggtcttggagagagacgcgtgtcaggggtggacaagtctggagacaggatcgcgcgtggtcggaagtagggagacaggggcgcggggatggggggcaggacagagaaagagaagtcgcccttttcctcccagcaa

SEQ ID NO: 47283 - DNA, 378 bp, Homo sapiens
  chr1:57889654-57890032
  hyper
tccccatgcccggcgggcggcggcactcaggcgcgctctgcagcccggggaagcccgggcgagcgccgagctgggtccatcctccccgggagccaccggccccgcgtcagagtagggggaggagaccgccacccgcgcggacccgcctcctcccgcggccccccgccccgccgccccccgcgcccgcccggcgccccgcggcaccgctcacctgctagctccccggccgccgccgccgggccgtgagcccctcgccccggcctcgcggctccctccggggcgctctctgcgcagccggagcgcgctccgagagcttagccgagtggcggtggcgacgaggaggtggaagaacgagcgagcgagcgagcgagcgagcgg

SEQ ID NO: 47284 - DNA, 173 bp, Homo sapiens
  chr1:57890258-57890431
  hyper
cttttatccaagcctcgaaaacatatgcatacccaaatatatggagtgccaggaagggcgaaaccacgaggggagtctccgcgagggcatgttgcccccacgccccttggcaggagggggcgctcgctcccagccgccagtgcaggttcggcggctcctgttttgactgaggt

SEQ ID NO: 47285 - DNA, 133 bp, Homo sapiens
  chr1:58715194-58715327
  hyper
tacagtctttgggtaagacccctggccagcttgcctggtttctagatacataagtggacagaaaagaaatgaagagaacgcggactgagcgaggaaatgctcaagaccacaggactgaaccccccggaagtct

SEQ ID NO: 47286 - DNA, 116 bp, Homo sapiens
  chr1:58715359-58715475
  hyper
cgacgcggatgaagttgtttccccgggacaggaagggttaaatggctgcgcgtcaactcggcctcgactggggtgtcagggagcaagagccgcttgtctcgggggattccgcttgg

SEQ ID NO: 47287 - DNA, 253 bp, Homo sapiens
  chr1:58715993-58716246
  hyper
tttgttccctggggctggcaggtccgtgtggggccagggcgcgcgggagacgccgcggagctgggtatcccggagaggggatgctcactcctagcggctccgctggcagcagtagtggcggtggcagcagaggcagcggtagcaacagcagcagtagcagcagcagcagcagtagagatagtgccggctctctgcaggccacatctttcataccttatacatcactaccgcattcccccgaataggggagccc

SEQ ID NO: 47288 - DNA, 430 bp, Homo sapiens; identical to SEQ ID NO: 26334
  chr1:59042065-59042495
  hyper

SEQ ID NO: 47289 - DNA, 271 bp, Homo sapiens; identical to SEQ ID NO: 26335
  chr1:59612368-59612639
  hyper

SEQ ID NO: 47290 - DNA, 259 bp, Homo sapiens; identical to SEQ ID NO: 26336
  chr1:61508695-61508954
  hyper

SEQ ID NO: 47291 - DNA, 44 bp, Homo sapiens; identical to SEQ ID NO: 26337
  chr1:61519551-61519595
  hyper

SEQ ID NO: 47292 - DNA, 102 bp, Homo sapiens; identical to SEQ ID NO: 26338
  chr1:61549208-61549310
  hyper

SEQ ID NO: 47293 - DNA, 248 bp, Homo sapiens; identical to SEQ ID NO: 26339
  chr1:62784355-62784603
  hyper

SEQ ID NO: 47294 - DNA, 276 bp, Homo sapiens; identical to SEQ ID NO: 26340
  chr1:62784870-62785146
  hyper

SEQ ID NO: 47295 - DNA, 94 bp, Homo sapiens
  chr1:63539887-63539981
  hyper
gagatctctgctgctctctggaggtgagaaaccgcgcatctgaatgccgagggaagaggcgctgagcagccagggcaaacggagcaacaatctg

SEQ ID NO: 47296 - DNA, 168 bp, Homo sapiens; identical to SEQ ID NO: 26342
  chr1:63784272-63784440
  hyper

SEQ ID NO: 47297 - DNA, 50 bp, Homo sapiens; identical to SEQ ID NO: 26343
  chr1:63784732-63784782
  hyper

SEQ ID NO: 47298 - DNA, 306 bp, Homo sapiens; identical to SEQ ID NO: 56
  chr1:63784987-63785293
  hyper

SEQ ID NO: 47299 - DNA, 375 bp, Homo sapiens
  chr1:63786656-63787031
  hyper
gcaccactgtccatccggaattaaatccacatcccagcatcttctgcaaatatttcactaattatttcctctcggaactcctcccctcgtgctccttcctctggtgaggccggcgctcccctcccaggccgcagcggacagacagggattgggttccgtgtgcctgccacaccaggcaggctcttgcggctcccaactaggcggcctaaatgagggaggaaagaggaggcgcatcgctgattcaccgcgtcaagagcactgactttccttggaggtgtgaggtccacgcaccccagccacgcacttgggggtcggtttgcggtgcctccccctccagtcccagtgaaatccccacagtttttcctactatcactg

SEQ ID NO: 47300 - DNA, 186 bp, Homo sapiens
  chr1:63787063-63787249
  hyper
catcctcgcctcctccacccgctccgccgccggttttcttggaagttaaatcttggaggatttgtccacaccttaagagaagaaaatccacgttagctggcagcaacggagatcccagcatgctggcatgcccaagtctgcccaggttcccccaaggccatgcccgccgcccgggaagtcactgcc

SEQ ID NO: 47301 - DNA, 20 bp, Homo sapiens
  chr1:63787282-63787302
  hyper
cgctgcgtctaacctgaaga

SEQ ID NO: 47302 - DNA, 42 bp, Homo sapiens; identical to SEQ ID NO: 17047
  chr1:63787568-63787610
  hyper

SEQ ID NO: 47303 - DNA, 290 bp, Homo sapiens
  chr1:63788133-63788423
  hyper
caacttgagtttggccggctcggccgcggccctgacgtcacgcacggtcacgtggccccgcctcccgctggatctttaagtagaaagtaatctatcaggccagtccttaaaacgggactttcgactaccggggcttcggcgtccctgacacccagccccctgcccccccgctactgtccctgcccgcgccctcccgagctgctcggcgcccggcgtcccgcgcccgcctggaccgctcctgcgccccacgccagggccagaggccgaggaaggcgggctaagtgaggggg

SEQ ID NO: 47304 - DNA, 210 bp, Homo sapiens
  chr1:63788557-63788767
  hyper
gagtgtgagctgagcccagcgggccccaagccacctgcggccccctcccctctccctgccccccatctttcgggggcactcaaaccctcttcccctgagctccgtggcagcccccgaacaccctcatcgcccgctgccccctccccgccgccgctaccaaccccgaggagggatgaccctctccggcggcggcagcgccagcgacatgtc

SEQ ID NO: 47305 - DNA, 12 bp, Homo sapiens
  chr1:63792549-63792561
  hyper
acttataaaatt

SEQ ID NO: 47306 - DNA, 156 bp, Homo sapiens; identical to SEQ ID NO: 26356
  chr1:63793435-63793591
  hyper

SEQ ID NO: 47307 - DNA, 221 bp, Homo sapiens
  chr1:63796277-63796498
  hyper
acagggagctctcttgtcagccccagaacaaccctaaactccaaatgttctgtttgctctcgaggtacccctgggatgcagcgtctcctccgcgaagccttcctgagcctccctgcccagaccagttgctccttcttgaagctcaccgtgccaattaatgagccattgtcattagtgttgccctctgagttcctggtgagttcctgaccgtctagcattgc

SEQ ID NO: 47308 - DNA, 28 bp, Homo sapiens
  chr1:64240118-64240146
  hyper
ccgccgctcctggcgctgctggccgcgc

SEQ ID NO: 47309 - DNA, 26 bp, Homo sapiens
  chr1:64240532-64240558
  hyper
cgcgccccagccggtgttcaggcaag

SEQ ID NO: 47310 - DNA, 30 bp, Homo sapiens; identical to SEQ ID NO: 26361
  chr1:65468348-65468378
  hyper

SEQ ID NO: 47311 - DNA, 41 bp, Homo sapiens; identical to SEQ ID NO: 26362
  chr1:65468581-65468622
  hyper

SEQ ID NO: 47312 - DNA, 106 bp, Homo sapiens; identical to SEQ ID NO: 17050
  chr1:65731231-65731337
  hyper

SEQ ID NO: 47313 - DNA, 60 bp, Homo sapiens; identical to SEQ ID NO: 17051
  chr1:65731446-65731506
  hyper

SEQ ID NO: 47314 - DNA, 14 bp, Homo sapiens
  chr1:65731781-65731795
  hyper
ggagctaagttctt

SEQ ID NO: 47315 - DNA, 327 bp, Homo sapiens
  chr1:65991119-65991446
  hyper
cgccgggtctctcctcccgcaggcccgcggccacccgcagcggcattccccgccgccgcccccgccacctgcgcgaccgccctagccgctcgagtccgctcctcccgctcaggggcggctgcggagggcgcggggcgcacgcgggcggccacccgactcttccctcccttctccccaccccagcctgctcctgctcagccccacctccccacgcactcggctgccctcctcctctcctgagagttgccccgcaccttgggcgaggagttcggagcggccccatcgcagagcccacggccagccgagcgcgcgcgacgcaggtgcccg

SEQ ID NO: 47316 - DNA, 58 bp, Homo sapiens
  chr1:66258774-66258832
  hyper
ctttcgtcccccacccccgggagcgcggaaggctcactcgcagcgcatggtctacccg

SEQ ID NO: 47317 - DNA, 20 bp, Homo sapiens
  chr1:66259117-66259137
  hyper
cggcccctagcctttcgccc

SEQ ID NO: 47318 - DNA, 257 bp, Homo sapiens
  chr1:66259174-66259431
  hyper
tgacaagtcactggggaggagaggatggagagaggctaagggagaatggagagaggcagaaggattcagggcttggaagccctggagtaggtgacggatgggcgcgcggtgcccagtgattgactgcaggcagcgggcgcggaagggaacctgaactacccaagagtttgctgggctgaggctccaggatgctcctgcgtgccctggtggctggggcaccaaggaggggcgcactcaagcctcggcatcaccaaggc

SEQ ID NO: 47319 - DNA, 81 bp, Homo sapiens
  chr1:66999332-66999413
  hyper
ctgacatttggaattccttcagggtaaaaggacaccggaatgggagcttagaagtgtgttgctaagatttccggctgcacg

SEQ ID NO: 47320 - DNA, 142 bp, Homo sapiens; identical to SEQ ID NO: 26373
  chr1:66999473-66999615
  hyper

SEQ ID NO: 47321 - DNA, 99 bp, Homo sapiens; identical to SEQ ID NO: 17055
  chr1:67217965-67218064
  hyper

SEQ ID NO: 47322 - DNA, 25 bp, Homo sapiens
  chr1:67773134-67773159
  hyper
cacacgattttatcgcgcctatcat

SEQ ID NO: 47323 - DNA, 30 bp, Homo sapiens; identical to SEQ ID NO: 26376
  chr1:68696775-68696805
  hyper

SEQ ID NO: 47324 - DNA, 128 bp, Homo sapiens; identical to SEQ ID NO: 26377
  chr1:70032971-70033099
  hyper

SEQ ID NO: 47325 - DNA, 106 bp, Homo sapiens
  chr1:70033503-70033609
  hyper
agctgcagctggtgtcgtcggaaaagggggtgggaaaaaagagagggggcggggagagcggtgagacacagccaagagccatgagcggcgcctcctcgcctgccaa

SEQ ID NO: 47326 - DNA, 511 bp, Homo sapiens
  chr1:70033948-70034459
  hyper
ctgcgcctccgccaccgccgccgccgccgccgctgctgctgcggtcgctagcgcggcgcgctgggcaggctgaggctggggagtggacgcgctcctgcctcccccgccggcgcttcgggcttcccctcagccgcttcccgcgggaacctctccagccgtccacctgaagggcactggcatcatggtctaacgtggcaccttcctggattcccctctatctcctgttcttcctaccttctactccttccctcctcttctcctccgaagaccctggcgcccactccactgcggacccctgaacacttaaggaataacccttggcagctgcacgactacgctctccgaaacctcatgggcagtttctcccgccggcgatgtgagtaaggcacgctcgctccgtggcggagggtgctgcgggggcccggccgcggcgaccgtaggcgcgcgaggtgtgggaccccagaggccggccgggggcgggggtggcagggcgggaggcttcggcgctcgc

SEQ ID NO: 47327 - DNA, 701 bp, Homo sapiens; identical to SEQ ID NO: 26383
  chr1:71513046-71513747
  hyper

SEQ ID NO: 47328 - DNA, 76 bp, Homo sapiens; identical to SEQ ID NO: 5555
  chr1:72747951-72748027
  hyper

SEQ ID NO: 47329 - DNA, 67 bp, Homo sapiens; identical to SEQ ID NO: 26385
  chr1:72749731-72749798
  hyper

SEQ ID NO: 47330 - DNA, 481 bp, Homo sapiens; identical to SEQ ID NO: 26386
  chr1:72750097-72750578
  hyper

SEQ ID NO: 47331 - DNA, 15 bp, Homo sapiens
  chr1:75594000-75594015
  hyper
cgtggccgttttatt

SEQ ID NO: 47332 - DNA, 127 bp, Homo sapiens; identical to SEQ ID NO: 26388
  chr1:75595334-75595461
  hyper

SEQ ID NO: 47333 - DNA, 205 bp, Homo sapiens
  chr1:75598179-75598384
  hyper
cccaagcccagaaacctctaaaaatgaatcattttctccacttatgcagagatagacgctcttagatcaaggttagtattttgaaaacctgactgagagccgcctgattaggcgagggtgggtggaaagaccgcataaatgcccgcacccccgccctgcttccctaacacagctccagctctctctggatctccaaatgacccgc

SEQ ID NO: 47334 - DNA, 303 bp, Homo sapiens
  chr1:75598414-75598717
  hyper
agtaccccagattcactttaaaccctaacacacacacacacacacacacacacacacactgtaattaaatatccaaaccggacctttatgtttaattccactttcaacgaaatcctgctctatacacgacctgatggcgccaatgttctgcacgactctgactttccattcggaagagcggtctccacaacgatgctatttcatggaaaatgcattatgtgaatttctccaccacccccaataccgatttctgcatttgatgaaaaacacaagtctttctggttcccacgcacaagttagctt

SEQ ID NO: 47335 - DNA, 40 bp, Homo sapiens
  chr1:75599387-75599427
  hyper
cctccgccgcttccccgccccgcagtcagaacttgaggca

SEQ ID NO: 47336 - DNA, 51 bp, Homo sapiens
  chr1:75599621-75599672
  hyper
gtcagctcccaggctgccaggagcggtggcattcctcggctacaccggaca

SEQ ID NO: 47337 - DNA, 22 bp, Homo sapiens
  chr1:75600203-75600225
  hyper
cttttattagtggatcggggcg

SEQ ID NO: 47338 - DNA, 77 bp, Homo sapiens; identical to SEQ ID NO: 17064
  chr1:75600848-75600925
  hyper

SEQ ID NO: 47339 - DNA, 54 bp, Homo sapiens
  chr1:75601929-75601983
  hyper
ctccgctatgattgacgtctggaaagaaagagctttgtgaggggatgattgtta

SEQ ID NO: 47340 - DNA, 107 bp, Homo sapiens; identical to SEQ ID NO: 17065
  chr1:75603052-75603159
  hyper

SEQ ID NO: 47341 - DNA, 206 bp, Homo sapiens; identical to SEQ ID NO: 17066
  chr1:76080278-76080484
  hyper

SEQ ID NO: 47342 - DNA, 285 bp, Homo sapiens
  chr1:76080768-76081053
  hyper
aagctcttccttgtcctccccgccatcgcttctctccgcgaactttccaactttggaagcccgggttccaaaggagcaacagggagactgcttagccggagccactgcccgtctcgacaggttggggagcaggaagtagcctgcagggactcggccggtagcaagtccccttgaccgcagggaaaaggagaggcagccagctccaatctcctcctgaggatggaggttggggaaatggatgcagaacttgtcaccctagggacgaaggggcggagggagggggga

SEQ ID NO: 47343 - DNA, 59 bp, Homo sapiens; identical to SEQ ID NO: 26403
  chr1:76081342-76081401
  hyper

SEQ ID NO: 47344 - DNA, 70 bp, Homo sapiens; identical to SEQ ID NO: 26404
  chr1:76081756-76081826
  hyper

SEQ ID NO: 47345 - DNA, 169 bp, Homo sapiens; identical to SEQ ID NO: 17068
  chr1:76082209-76082378
  hyper

SEQ ID NO: 47346 - DNA, 40 bp, Homo sapiens; identical to SEQ ID NO: 26406
  chr1:76540210-76540250
  hyper

SEQ ID NO: 47347 - DNA, 55 bp, Homo sapiens
  chr1:77333003-77333058
  hyper
gtgggtacactggctcggttaactctctctccccagaaatttcactactgaaaag

SEQ ID NO: 47348 - DNA, 79 bp, Homo sapiens
  chr1:77333305-77333384
  hyper
aaaagtggccccggacgcgcgagcctgaggattctgcacaaaagaggtgcccaaaatgaagaccctgatggtgagtcag

SEQ ID NO: 47349 - DNA, 43 bp, Homo sapiens; identical to SEQ ID NO: 26411
  chr1:77333881-77333924
  hyper

SEQ ID NO: 47350 - DNA, 103 bp, Homo sapiens; identical to SEQ ID NO: 26414
  chr1:77334811-77334914
  hyper

SEQ ID NO: 47351 - DNA, 67 bp, Homo sapiens
  chr1:77747299-77747366
  hyper
ttcctgggagttcctcggagacccggaggtaaccgtgtatgtgcgtgcgagtgtgtctgtgtgcgta

SEQ ID NO: 47352 - DNA, 486 bp, Homo sapiens
  chr1:77747453-77747939
  hyper
tgggcggcgcacgcagtgaagcgtcgcgctctggcgccggtgccgcaccgaggggtatgactacgaccccttgcgcgtgcccgcccccacctccgcacctcgcgccagcccgcgcagcgtgaccggcagccgccgcagacccggctcggggaggcgcggagcgcggcgcgctgaaccggagaggcgggccggctgctgccttgcgttcgccacgctgtcctccctcctccgctccctgcgccccacccctggcggccgcgctgcctggcagcccgggaagccgcggcacagctgctcggcgcctgcagctccggctcgggggctggaaccgaagcgggggcggcgggagcgcggagaccacagcccccggggagaggcggagggggtccctggcctgggcggagaggctgagctgagtgcgcgtgagaaagagggctgcaccgctgctcggcgcggactctgccagccccagcttcagccccggct

SEQ ID NO: 47353 - DNA, 423 bp, Homo sapiens; identical to SEQ ID NO: 26417
  chr1:77748403-77748826
  hyper

SEQ ID NO: 47354 - DNA, 380 bp, Homo sapiens; identical to SEQ ID NO: 26418
  chr1:78354582-78354962
  hyper

SEQ ID NO: 47355 - DNA, 16 bp, Homo sapiens
  chr1:78511450-78511466
  hyper
cgtattgttctgtagc

SEQ ID NO: 47356 - DNA, 30 bp, Homo sapiens
  chr1:78512354-78512384
  hyper
agactcgagatctggcggggcagattaata

SEQ ID NO: 47357 - DNA, 74 bp, Homo sapiens
  chr1:78957218-78957292
  hyper
ttcctcacccgggcacgtcctcactccccgtgcccgggatgagggagaaaacagccctttggcgtttgagcaat

SEQ ID NO: 47358 - DNA, 31 bp, Homo sapiens
  chr1:78957522-78957553
  hyper
ctcagagaagagtggccgtggccttgtgtat

SEQ ID NO: 47359 - DNA, 35 bp, Homo sapiens; identical to SEQ ID NO: 26422
  chr1:82266147-82266182
  hyper

SEQ ID NO: 47360 - DNA, 86 bp, Homo sapiens; identical to SEQ ID NO: 26423
  chr1:82266769-82266855
  hyper

SEQ ID NO: 47361 - DNA, 30 bp, Homo sapiens; identical to SEQ ID NO: 5588
  chr1:82267630-82267660
  hyper

SEQ ID NO: 47362 - DNA, 49 bp, Homo sapiens; identical to SEQ ID NO: 5589
  chr1:82267942-82267991
  hyper

SEQ ID NO: 47363 - DNA, 83 bp, Homo sapiens; identical to SEQ ID NO: 26426
  chr1:82268226-82268309
  hyper

SEQ ID NO: 47364 - DNA, 69 bp, Homo sapiens
  chr1:82268815-82268884
  hyper
tgggatgggggtgccactggggagtggcgacgagagaaaggcgtgggaggagcgcgagggaaggggaga

SEQ ID NO: 47365 - DNA, 30 bp, Homo sapiens; identical to SEQ ID NO: 26428
  chr1:84158496-84158526
  hyper

SEQ ID NO: 47366 - DNA, 33 bp, Homo sapiens; identical to SEQ ID NO: 26429
  chr1:84544390-84544423
  hyper

SEQ ID NO: 47367 - DNA, 132 bp, Homo sapiens; identical to SEQ ID NO: 5591
  chr1:85358461-85358593
  hyper

SEQ ID NO: 47368 - DNA, 147 bp, Homo sapiens
  chr1:85358822-85358969
  hyper
gaggacgcggcgggcgggcggagcgcctcctctccagcgacccctgcgacgcgtccagagccaaaggaaagtttggcggtgcgagggagggacctagggacagcggcccctccctgccccgccccgccccgccgggtgcgttcgacg

SEQ ID NO: 47369 - DNA, 122 bp, Homo sapiens; identical to SEQ ID NO: 26432
  chr1:85359218-85359340
  hyper

SEQ ID NO: 47370 - DNA, 22 bp, Homo sapiens
  chr1:85463327-85463349
  hyper
tgtctgccggagaagcgcctta

SEQ ID NO: 47371 - DNA, 70 bp, Homo sapiens
  chr1:85463378-85463448
  hyper
caaagtggcccacgcaccctccacaccgctcccgggcggccgcacctggcactcccggccctctggggtt

SEQ ID NO: 47372 - DNA, 69 bp, Homo sapiens; identical to SEQ ID NO: 5594
  chr1:85463878-85463947
  hyper

SEQ ID NO: 47373 - DNA, 30 bp, Homo sapiens; identical to SEQ ID NO: 26435
  chr1:85527927-85527957
  hyper

SEQ ID NO: 47374 - DNA, 44 bp, Homo sapiens; identical to SEQ ID NO: 26436
  chr1:85774021-85774065
  hyper

SEQ ID NO: 47375 - DNA, 325 bp, Homo sapiens
  chr1:86621335-86621660
  hyper
cccctccccagtccccgccgcgagtgccacttccccagtgacagggcaatgatcagggcgcagcctcggctcggatgggcaacgtttgttggccttctaaccagaggggattgcctctgagcccgtgggtaaaacaaccccccgacgcccgaggttctgcagccacccccttccccccgctggcgacccttcctcacgcctgagtccagtggtccaggctgcgcacactgaccctgggggacctctagcgtcacagcaatcgccaggctggacgccctgagaagcacctcggggaagcaggacctcgacagggccctgcgggagg

SEQ ID NO: 47376 - DNA, 31 bp, Homo sapiens
  chr1:87617807-87617838
  hyper
tctcgggaggggaaggcggctgtgtacagaa

SEQ ID NO: 47377 - DNA, 168 bp, Homo sapiens; identical to SEQ ID NO: 26440
  chr1:88928334-88928502
  hyper

SEQ ID NO: 47378 - DNA, 35 bp, Homo sapiens
  chr1:91172677-91172712
  hyper
tgtgccagttagaagggttccgccggccacctcgt

SEQ ID NO: 47379 - DNA, 85 bp, Homo sapiens; identical to SEQ ID NO: 26442
  chr1:91172959-91173044
  hyper

SEQ ID NO: 47380 - DNA, 198 bp, Homo sapiens; identical to SEQ ID NO: 26443
  chr1:91176399-91176597
  hyper

SEQ ID NO: 47381 - DNA, 262 bp, Homo sapiens; identical to SEQ ID NO: 26444
  chr1:91176691-91176953
  hyper

SEQ ID NO: 47382 - DNA, 101 bp, Homo sapiens; identical to SEQ ID NO: 26445
  chr1:91177391-91177492
  hyper

SEQ ID NO: 47383 - DNA, 101 bp, Homo sapiens; identical to SEQ ID NO: 17088
  chr1:91177840-91177941
  hyper

SEQ ID NO: 47384 - DNA, 50 bp, Homo sapiens; identical to SEQ ID NO: 17089
  chr1:91178207-91178257
  hyper

SEQ ID NO: 47385 - DNA, 34 bp, Homo sapiens; identical to SEQ ID NO: 26447
  chr1:91178960-91178994
  hyper

SEQ ID NO: 47386 - DNA, 125 bp, Homo sapiens; identical to SEQ ID NO: 17090
  chr1:91181807-91181932
  hyper

SEQ ID NO: 47387 - DNA, 206 bp, Homo sapiens
  chr1:91182132-91182338
  hyper
catttgatgtcgctctgggaatcctcccgcttgtcgagtttggtcttgctgtcctcctgctcgagctttggcctgaagctctcgtgcactgcgttgctctcctgcttcggggtgtggtggggagaggatacgctggtgctgtagggtgcacatgccgccagaggtttgctgtcgcccaagatgtccttaattaaaaaagaagacgt

SEQ ID NO: 47388 - DNA, 176 bp, Homo sapiens
  chr1:91183775-91183951
  hyper
cgagtccagtggtcccggtgtccacaatcacgagtgcgaggcaaagggagagggaggaagagatcagagggagaccagagaaagggaaccaaaggggagaaagaaaaaaaaaagtagcaaggattcgcccgttttcttaagtcagaagagagagagaagaggacgggaagggactt

SEQ ID NO: 47389 - DNA, 139 bp, Homo sapiens; identical to SEQ ID NO: 1759
  chr1:91184274-91184413
  hyper

SEQ ID NO: 47390 - DNA, 9 bp, Homo sapiens
  chr1:91184414-91184423
  hyper
cccctgccg

SEQ ID NO: 47391 - DNA, 129 bp, Homo sapiens; identical to SEQ ID NO: 26455
  chr1:91184791-91184920
  hyper

SEQ ID NO: 47392 - DNA, 35 bp, Homo sapiens; identical to SEQ ID NO: 26458
  chr1:91185961-91185996
  hyper

SEQ ID NO: 47393 - DNA, 305 bp, Homo sapiens
  chr1:91189383-91189688
  hyper
agagctcccgcaaagcggggggatgtgacctgtgggcccccagcaggggtaggaggcagttcagcccgagagggggcgctctagggcctggatcctgcatccctatttcctggaacacacccaacgcctcattctgaaaaccctgcttaggccctggccctggtgccgctcagcaaccaggaaagagctggacctgccttcaggcagcaagaacaggactgccagcctcctgtggctctgtctcccgaggctccatgagaaggggatgggggtgcaagaagggaagagtgaggtggtgtgctggg

SEQ ID NO: 47394 - DNA, 47 bp, Homo sapiens
  chr1:91190380-91190427
  hyper
cacattaaaaccgtagtgtgtccctaatggtgcgtaatgtgctcaca

SEQ ID NO: 47395 - DNA, 240 bp, Homo sapiens
  chr1:91190629-91190869
  hyper
cctgcagcctcctcccgcgacacggcgctttgaactcggcggattgattttgcttcccttcccccttttgtgtgtgtttgcgttcaattggttaggtttttaagatttgggagggctggtgtgaaagaattaaaatactcttaactggagcccctccgccgagaactggaggtcccgcctcctagttcggcgctttcaggaccctcttcccagagggaatttctttcagaaattccaggg

SEQ ID NO: 47396 - DNA, 228 bp, Homo sapiens; identical to SEQ ID NO: 17098
  chr1:91191310-91191538
  hyper

SEQ ID NO: 47397 - DNA, 34 bp, Homo sapiens; identical to SEQ ID NO: 26464
  chr1:91191752-91191786
  hyper

SEQ ID NO: 47398 - DNA, 136 bp, Homo sapiens; identical to SEQ ID NO: 26466
  chr1:91192681-91192817
  hyper

SEQ ID NO: 47399 - DNA, 251 bp, Homo sapiens
  chr1:91194569-91194820
  hyper
atgcgtccgggttgatgtgatatgaccgtatcagggaaacaaagctaagtgcagtcaggatctgttagtacagtggcttttgatggaacagctgaggcacacatcgcccgtggcatggactccggggccgaacgctcacgaccaagacttttgcccttttgaaatgaaatagaaataggggagctgcaggaaaaccgaatcgcgcttagggtcaggagcaagacaggagctttcagcgaagatctgaacat

SEQ ID NO: 47400 - DNA, 15 bp, Homo sapiens
  chr1:91195390-91195405
  hyper
cggtctctgcctttt

SEQ ID NO: 47401 - DNA, 15 bp, Homo sapiens
  chr1:91196502-91196517
  hyper
cggcggcaggactga

SEQ ID NO: 47402 - DNA, 20 bp, Homo sapiens
  chr1:91316241-91316261
  hyper
ctaagaaccgccgtgcgatg

SEQ ID NO: 47403 - DNA, 314 bp, Homo sapiens
  chr1:91316313-91316627
  hyper
tcctcgggctttagttcaggaagaaaatgaaagctggaggtctcgtgggcgggactggaggcggccagataggcaagaacccgcaacaggagtagggacattttttcttcaaattccaatcccatccagcgatagacaggcgcgtgggtctccctcctccacgaccaccacacaatggcacacacttttgctggaaactgaaatcgaagtctctgaggcaggctggggcccaggccggcagcggggaggggcagggtccagccacctcggcgtggccttggcgagcgctccggggtcagaggccgtcgttctcg

SEQ ID NO: 47404 - DNA, 680 bp, Homo sapiens
  chr1:91316682-91317362
  hyper
tcgcctggctgcgccgtcccggcgggccggccctctccacgccctctcctggggtttgcggtgggcacagctccctccagactgggtctctccactagcctcctccccaactgcaacgtgggaaccagagctatccgagtcacgagccccaagtgcacacaaagcccccaacggggccacggcgcctccacgcctcgctacctccagctccaggagcgcagaacgcagcgccctgggtcaccgcgtctgccctgcggagcagccccactgaggggaagcctcgggcaggaggtgagaccccgcgcacgcaagcacccccgccccaagcagggccctctgcccgagggagactctcacctcaaataaacgggcgctgccgcctccagggggaggacagcgggcggagaatactcacgctgggcccagccgcgcggggacttcgctgggaaccacgcgcgggctcccgccggggagcggagccccagcctgcagtcctgcgcccgccccagcaccgcctcctcggaagggaggcctctaccgtccggcggcggacctgcagccgccgcgggagacgctgccccgccccccggccccgcccttcggcccatccccgccccgctggcctccttttcccctgccccctccctccgctcctcaacgcccgccgggtgcaatctgct

SEQ ID NO: 47405 - DNA, 281 bp, Homo sapiens; identical to SEQ ID NO: 26472
  chr1:91870046-91870327
  hyper

SEQ ID NO: 47406 - DNA, 128 bp, Homo sapiens; identical to SEQ ID NO: 26473
  chr1:92495704-92495832
  hyper

SEQ ID NO: 47407 - DNA, 244 bp, Homo sapiens
  chr1:92948597-92948841
  hyper
tgctgtctgcaaagaggaggcaggtgaggggctcaggctgggaccggttgagtctgagggtgctgaaggctcccccaatcccccgaccagggcagccgagcgtcttcccctctccacccagaccccggccgggaaccctctcggatccgagggcaggcgcagagaggccatggcacctaggagacaaacccggaggaaccaggacagtaggaaacaaaaacagcagcaaaagggacgttggggc

SEQ ID NO: 47408 - DNA, 280 bp, Homo sapiens; identical to SEQ ID NO: 17105
  chr1:92948976-92949256
  hyper

SEQ ID NO: 47409 - DNA, 394 bp, Homo sapiens; identical to SEQ ID NO: 26475
  chr1:92949786-92950180
  hyper

SEQ ID NO: 47410 - DNA, 1509 bp, Homo sapiens
  chr1:92950636-92952145
  hyper
ttgtgtccccttctccggaggaatgggaatagacctgggagaaaagacgcctgggacgtgtcgcggggctcccgcgaagtttcccgctacccaagcgccagaatgcccctaggggtgagagtgccatccgcctccctccggggtggctcctagggctagagctttgtcgcttcctgcacttctcgtccgtacaattagacgccacaaaccccaaacccaattctttaaacagccacgaaactcggaagaaaagaaaaacggagtggcgttgtcccgagggtcccgctgcagcttggacccacgttggctgggagcgggacagatgggggcggggtaactgtcagcgccggagctgggtctgggctggcgccaccagagaccaggcggacgcggaggccgcctccccacccgggctgtaagcccacgcctctctcgcaccccggcccgctttgctggttcctgtggggagcgacagagtttggaggagataggggccccggggcctgggccgagcgcgtgggaaggcaaccccgcgctgcagctggcgcgggaggtggggcggcccctccgcgcgctcaggcctctcctcaccgtccgggcccaggaaggagggagccgagggcgctaagggggcgtcctcccgagcgcagctgccgccgcctccccaccagatgtttccttccctggtggatttggctcccctgccgaaccaccagaccgcctgctgcgcgcccccagctccagatttccagtcacactgcgcgggtcgcgccctaacccagctgccggagctctctgggctcccgcacggcggtccgcagcaggtgggaaaccgcccgcgccctctgatcgcccccgcagtgccagtgctctgcgagtccccgcggccgcccccaccagggcaggaggcgcagaacaggctcggcggacctacctgcggagtcacggcgcgggcaccgcgctaggagagttttcaaacggaatcttgctttcgggagagaccgctctatctctctgacttaaaaaaaaaaaaaattctccttccgagctcagcccccaaaaccacaagcttcacttcctgagcgttactgagtcgctcgcatagccctcccagacctgctcccaacccccgtcgggcggccgggcgcgctcctttgcgcaagtggccaggcggtggggggcctggcctttccagcccgtcccgcgcgccccttagtagtcctcccagttctctccctgtgggtcggcaggggatgggggaaattggaggtccggacacttaggcactagaaatgacttgaaagaaaatgaactattcttggctccagggagacttccgcagcgagagaagccacagattgaggacacagattgactggcgagagaggggtggggggcgccccgctccgaggaccctccccgcccctcaggcctcggtcacccgccccccccacccccgaccccgccgcctcctagggctgcaccacccccgggtcgggaccgtgaatc

SEQ ID NO: 47411 - DNA, 88 bp, Homo sapiens; identical to SEQ ID NO: 26477
  chr1:95392536-95392624
  hyper

SEQ ID NO: 47412 - DNA, 39 bp, Homo sapiens; identical to SEQ ID NO: 26478
  chr1:95393028-95393067
  hyper

SEQ ID NO: 47413 - DNA, 30 bp, Homo sapiens; identical to SEQ ID NO: 26479
  chr1:95428544-95428574
  hyper

SEQ ID NO: 47414 - DNA, 59 bp, Homo sapiens
  chr1:98510732-98510791
  hyper
tctctcttgctcccacgccttcgcagctgacctgagaggggggacgtgccttgcgtttg

SEQ ID NO: 47415 - DNA, 293 bp, Homo sapiens
  chr1:98511335-98511628
  hyper
ccgcaccccaccgtggagaggagaggagcggactgggaacgccgaaccgccccgcaggctcggggaaacggacccccttccgctccccgcccatccccttcacctcgccccccgccccctgcgcgaacccattttccagtcctggtcaccagaggcgcagcgcacagcctttccggtggaaccagtgcgaaaacacccgaggaaatgaaaagaacaagaaagtgctaccttggcaaccacgggcgtttagtggccagctggtgggctggggagggcggccgctgcccccctgc

SEQ ID NO: 47416 - DNA, 285 bp, Homo sapiens
  chr1:98513940-98514225
  hyper
gcttcagcacctggacgaatggacagctcaacccgggccgactgccggcagcactcgcagcagaactgacgctctgagctctaaccaaagctctctcgtgcttgagcggggcagcctgacttacgagaacaccatttcctacgagaccactgccgctgggtgcatattcaattcaagcctccttaagctgtcggatttcccccacccatccaccctcccccccttctccaccctccacacaaaaacaaaaaagggaaaaagcccaataccatcagggcgtttgtt

SEQ ID NO: 47417 - DNA, 19 bp, Homo sapiens
  chr1:98515068-98515087
  hyper
cttgggaagggacctcggc

SEQ ID NO: 47418 - DNA, 54 bp, Homo sapiens; identical to SEQ ID NO: 17113
  chr1:98515088-98515142
  hyper

SEQ ID NO: 47419 - DNA, 179 bp, Homo sapiens; identical to SEQ ID NO: 26487
  chr1:98519817-98519996
  hyper

SEQ ID NO: 47420 - DNA, 118 bp, Homo sapiens
  chr1:99469564-99469682
  hyper
cccctctctcctcgccggcccgcccgccgctgctcttcttccaggcacaatcgaagaggaggcagtgagcgagtcaaggccacagagtggatggaatcaaggttcacccccaaagctc

SEQ ID NO: 47421 - DNA, 186 bp, Homo sapiens
  chr1:99469788-99469974
  hyper
tgacgtgtgggaagagctgggggcttccttcgcacccaccctcacgcgccctagaatgtcctctggggaaggggctgcccataacttggaggaacttagaaggcaaaacctactgcgccccaacccttagaggggcctcaaccccgaaggcgaggggcgagatcagggactcggcgacgagggcga

SEQ ID NO: 47422 - DNA, 315 bp, Homo sapiens; identical to SEQ ID NO: 26490
  chr1:99470215-99470530
  hyper

SEQ ID NO: 47423 - DNA, 36 bp, Homo sapiens; identical to SEQ ID NO: 5642
  chr1:99470582-99470618
  hyper

SEQ ID NO: 47424 - DNA, 166 bp, Homo sapiens; identical to SEQ ID NO: 5643
  chr1:99470619-99470785
  hyper

SEQ ID NO: 47425 - DNA, 80 bp, Homo sapiens; identical to SEQ ID NO: 17119
  chr1:101004737-101004817
  hyper

SEQ ID NO: 47426 - DNA, 92 bp, Homo sapiens; identical to SEQ ID NO: 26494
  chr1:101004842-101004934
  hyper

SEQ ID NO: 47427 - DNA, 136 bp, Homo sapiens
  chr1:101004935-101005071
  hyper
ctacctgctcatcacccgggcgcccgccacctaccaggcgctgtaccagaggcgccacacggcgggcatgctggcgctgtcctgggcgctcgccctgggcctcgtgctgctgctcccgccctgggcaccgcggccc

SEQ ID NO: 47428 - DNA, 216 bp, Homo sapiens; identical to SEQ ID NO: 17120
  chr1:101005144-101005360
  hyper

SEQ ID NO: 47429 - DNA, 110 bp, Homo sapiens
  chr1:101005675-101005785
  hyper
aacctagccggggcccgagggaagcggagatccccggcttccgacgtccttgggcaccgtcgcctccttccctcctagggcatcccctgcctgaacgaagacttccgccg

SEQ ID NO: 47430 - DNA, 180 bp, Homo sapiens
  chr1:101702616-101702796
  hyper
ccgggctctccgaacgcaacttcgccctgcttgagcgaggtagggggcggcgaatggcgggggtcgcgggcgcggggagcccggttgtggtagggcttaggtgtcagaaacgaatttttaagtcgaacgaggcaaacaaaaacttagaaaacatgcatctccgggcgctgaaaatttgca

SEQ ID NO: 47431 - DNA, 30 bp, Homo sapiens; identical to SEQ ID NO: 5648
  chr1:101703188-101703218
  hyper

SEQ ID NO: 47432 - DNA, 46 bp, Homo sapiens
  chr1:101703566-101703612
  hyper
gggcgcggggggaggcggggagaataagaagaagaaagaaaaggca

SEQ ID NO: 47433 - DNA, 394 bp, Homo sapiens; identical to SEQ ID NO: 26500
  chr1:101775094-101775488
  hyper

SEQ ID NO: 47434 - DNA, 88 bp, Homo sapiens; identical to SEQ ID NO: 26501
  chr1:103572677-103572765
  hyper

SEQ ID NO: 47435 - DNA, 145 bp, Homo sapiens; identical to SEQ ID NO: 26502
  chr1:103573555-103573700
  hyper

SEQ ID NO: 47436 - DNA, 467 bp, Homo sapiens; identical to SEQ ID NO: 26503
  chr1:103573701-103574168
  hyper

SEQ ID NO: 47437 - DNA, 114 bp, Homo sapiens
  chr1:107682621-107682735
  hyper
gaagtgggaggtacacgaggagttactggaaacggcgcttctgtggaggagccgggggggatggggagtagagggagggggccctgttgcctcagcgccccgaggtcgtggagc

SEQ ID NO: 47438 - DNA, 462 bp, Homo sapiens
  chr1:107682977-107683439
  hyper
tggcactggcccctaagtttgccaggagctcgctgcccgctcggagcagggtcccggccgggagccgctggtgggggcggggagtccgggagccgcaatccagaagcgtcgtgggccatgtatatttcatcaaacggactttgggtgcgtcgcgtctcactgccatcagtgctatgtgcagtgacatttctgacttgagtggaggaatgcgcgaaggaaacccgggcgaaattggtattagaggatcttcttggcgccaatgctaattgtcctgatttatgccccttctgactaagctcaacgtcttcatctgaaataaaatgaaagcggtgccaagcggcatagaaccgcctggccgctggttctgatccccgggaaccagaaaatcgtcctgcggcttgaaaaaaaaaaaaagaggaaaaaaaaaagaaatagaaatagaaaaaagaaaaaatatccctc

SEQ ID NO: 47439 - DNA, 258 bp, Homo sapiens; identical to SEQ ID NO: 17130
  chr1:107683517-107683775
  hyper

SEQ ID NO: 47440 - DNA, 464 bp, Homo sapiens
  chr1:107683776-107684240
  hyper
gggagtggcgggccggcgctgggttctcggtcctcggggtcctctcccgccggcggccgggcgcgatcggaatccccgggctgcggcggtggcggcggctcgggtcctcacgcccacccctcccgctccgcccgctcccgcctggggaggaggctccgcgggagctgccgccctccgcccgtacgccgcccgcgggctccgctgctgcggccgccgcccgaggcggaccaggctggctgcgcagggccgccgccccgcgccgtcggctcggctcccgcccggcgcaagggcaaacgagccacacggtaagtgcctgcggctcgcctctcctactgcgacccgagcctctcgcccgtgcccctctcccccgggtttccccaccccccgccgccccccgccccacccgctgcgatgcacaggcgggagggaaggctccgggtgggcgaggaactttgtaaagcgcc

SEQ ID NO: 47441 - DNA, 56 bp, Homo sapiens
  chr1:107684439-107684495
  hyper
acacatcgctcaggcggcttgtcgttattttttctttctttcgccaattatatttg

SEQ ID NO: 47442 - DNA, 436 bp, Homo sapiens; identical to SEQ ID NO: 17132
  chr1:108506627-108507063
  hyper

SEQ ID NO: 47443 - DNA, 172 bp, Homo sapiens; identical to SEQ ID NO: 17133
  chr1:108507148-108507320
  hyper

SEQ ID NO: 47444 - DNA, 110 bp, Homo sapiens; identical to SEQ ID NO: 17134
  chr1:108507497-108507607
  hyper

SEQ ID NO: 47445 - DNA, 60 bp, Homo sapiens; identical to SEQ ID NO: 17135
  chr1:108507657-108507717
  hyper

SEQ ID NO: 47446 - DNA, 242 bp, Homo sapiens; identical to SEQ ID NO: 17136
  chr1:108507810-108508052
  hyper

SEQ ID NO: 47447 - DNA, 15 bp, Homo sapiens
  chr1:109203594-109203609
  hyper
gcttctgtctttgta

SEQ ID NO: 47448 - DNA, 537 bp, Homo sapiens; identical to SEQ ID NO: 17137
  chr1:109203672-109204209
  hyper

SEQ ID NO: 47449 - DNA, 71 bp, Homo sapiens; identical to SEQ ID NO: 26513
  chr1:109656220-109656291
  hyper

SEQ ID NO: 47450 - DNA, 179 bp, Homo sapiens; identical to SEQ ID NO: 26514
  chr1:109656891-109657070
  hyper

SEQ ID NO: 47451 - DNA, 235 bp, Homo sapiens; identical to SEQ ID NO: 26515
  chr1:110009583-110009818
  hyper

SEQ ID NO: 47452 - DNA, 137 bp, Homo sapiens; identical to SEQ ID NO: 26516
  chr1:110282667-110282804
  hyper

SEQ ID NO: 47453 - DNA, 174 bp, Homo sapiens; identical to SEQ ID NO: 26517
  chr1:110283065-110283239
  hyper

SEQ ID NO: 47454 - DNA, 51 bp, Homo sapiens
  chr1:110610535-110610586
  hyper
atcggccgggtcatccggctcagggcctcagcggcagcgggcaaaactcta

SEQ ID NO: 47455 - DNA, 97 bp, Homo sapiens; identical to SEQ ID NO: 26522
  chr1:110612445-110612542
  hyper

SEQ ID NO: 47456 - DNA, 21 bp, Homo sapiens
  chr1:110613458-110613479
  hyper
ggagcccgggaaccccctccc

SEQ ID NO: 47457 - DNA, 52 bp, Homo sapiens
  chr1:110627578-110627630
  hyper
ttctaacaccgcgtgatcaccgacaacttttgcaggacgggatgaaactcct

SEQ ID NO: 47458 - DNA, 56 bp, Homo sapiens
  chr1:110672833-110672889
  hyper
ctgtattttcagcctcggtttgacgtcaggctctcacggtcccaaaggatgggctt

SEQ ID NO: 47459 - DNA, 119 bp, Homo sapiens
  chr1:110673233-110673352
  hyper
ggcctaaaatgagggaagatgaggaaatgggggtggggacgatggagaggatggaaggggcggcgggggggtgcggtggtctgcgcggtacagcagcgtccctgcgggttcccctcatt

SEQ ID NO: 47460 - DNA, 89 bp, Homo sapiens
  chr1:110692884-110692973
  hyper
ggccccattcctctccgagggcagaagccctggcgagggctccagggtctgcatcccctgaccaggggcctcaagaagctaagccccct

SEQ ID NO: 47461 - DNA, 145 bp, Homo sapiens
  chr1:110694117-110694262
  hyper
aggggacgtgcgtgtggtgcccatctggagggggcgccgtcctggcgggtcgagaggcctctgctgcatttatgcctgtgtgcgccgtgctctgaagcgatgctggatgctcgcagtactatgggtgggccgctccccaggggcg

SEQ ID NO: 47462 - DNA, 160 bp, Homo sapiens
  chr1:110754149-110754309
  hyper
accgcgggcgcaagtcggggaacaagcctccgtccaaaacatgtctgaaggaggagatggccaagggcgaggcgtcggagaagatcatcatcaacgtgggcggcacgcgacatgagacctaccgcagcaccctgcgcaccctaccgggaacccgcctcgc

SEQ ID NO: 47463 - DNA, 110 bp, Homo sapiens
  chr1:111097796-111097906
  hyper
aggaatcagcattcccgttgtagagatcggtggaccgatgctctcagaggcttccacaagcgtttgtattgtttggggcggtcggaactcagcgctgcggaagccggtgt

SEQ ID NO: 47464 - DNA, 260 bp, Homo sapiens
  chr1:111097936-111098196
  hyper
ctgcagccctgtagaaataaacctgggtcctcgctccctggcctggggaaggaggtctgcaggggtctgtgggggccctggaggcgccttcccagctgcacaggctcagtcggaccagcagaggtcactgcgtgggaaagagtggggcgccaacccgcgcagagcccagccggcgaccgcccccgcgtccccgcggagctccctgccttctgccgcagtcctccgagggctgggcttctggggcaggtcatggctattgc

SEQ ID NO: 47465 - DNA, 102 bp, Homo sapiens
  chr1:111098316-111098418
  hyper
atgccctttcctggtcacggactccgccggcagccggggcgggacggaccagaggctaccaactgggggcttctgctgcctgggacacggggatccacattg

SEQ ID NO: 47466 - DNA, 290 bp, Homo sapiens; identical to SEQ ID NO: 26531
  chr1:111149588-111149878
  hyper

SEQ ID NO: 47467 - DNA, 123 bp, Homo sapiens; identical to SEQ ID NO: 26532
  chr1:111150355-111150478
  hyper

SEQ ID NO: 47468 - DNA, 56 bp, Homo sapiens
  chr1:111216707-111216763
  hyper
gcacggacacgatggcgatgccccgggccggcccggagctctcggggtactcgaag

SEQ ID NO: 47469 - DNA, 86 bp, Homo sapiens
  chr1:111217982-111218068
  hyper
cacacccctaggtacagcccggggagggcaggcgggcccagtgtccagggagggagtgcaggccaggcgggcgccctgggccagag

SEQ ID NO: 47470 - DNA, 76 bp, Homo sapiens
  chr1:111505931-111506007
  hyper
tgagtcacataagagcgtcggccatcttggttttcatctcccgtggagatctactcggtccgcctattaaacttga

SEQ ID NO: 47471 - DNA, 240 bp, Homo sapiens
  chr1:111506212-111506452
  hyper
ccgtggggaggattcgaaaccggtacttaccaacgcgaggcgttgcctgaattttcctctgcgggtttcaggaagaccctccgtaggttatttgacattttagtggggagaaaggggacacctcatccagaaaagtgggaagcgtggggccgagtttcccaatggggcgagaaccagagcgagggaatgttgggctggagttgcccacagcaactgtgaggggttcgaccttaacggagg

SEQ ID NO: 47472 - DNA, 264 bp, Homo sapiens; identical to SEQ ID NO: 26540
  chr1:112283059-112283323
  hyper

SEQ ID NO: 47473 - DNA, 256 bp, Homo sapiens; identical to SEQ ID NO: 26541
  chr1:112531573-112531829
  hyper

SEQ ID NO: 47474 - DNA, 43 bp, Homo sapiens; identical to SEQ ID NO: 26542
  chr1:112533373-112533416
  hyper

SEQ ID NO: 47475 - DNA, 67 bp, Homo sapiens; identical to SEQ ID NO: 26543
  chr1:113051618-113051685
  hyper

SEQ ID NO: 47476 - DNA, 32 bp, Homo sapiens; identical to SEQ ID NO: 26544
  chr1:113392524-113392556
  hyper

SEQ ID NO: 47477 - DNA, 135 bp, Homo sapiens; identical to SEQ ID NO: 26545
  chr1:113497971-113498106
  hyper

SEQ ID NO: 47478 - DNA, 41 bp, Homo sapiens; identical to SEQ ID NO: 26546
  chr1:113498107-113498148
  hyper

SEQ ID NO: 47479 - DNA, 127 bp, Homo sapiens
  chr1:114695312-114695439
  hyper
cctgccgcgactccccggagacgccgcagctgcgcgccagggtccagcccggcggggatcgggctcgggactcacccgctccggcgagctcgactcagctcgggctcccgcctcggctaggcagccg

SEQ ID NO: 47480 - DNA, 166 bp, Homo sapiens; identical to SEQ ID NO: 17154
  chr1:114695943-114696109
  hyper

SEQ ID NO: 47481 - DNA, 67 bp, Homo sapiens
  chr1:114696712-114696779
  hyper
cattcactgcctggtgtgaccttgggcgtctctgagcctcaattttcctctccgtaaaggaggtgta

SEQ ID NO: 47482 - DNA, 65 bp, Homo sapiens; identical to SEQ ID NO: 26552
  chr1:114697062-114697127
  hyper

SEQ ID NO: 47483 - DNA, 30 bp, Homo sapiens; identical to SEQ ID NO: 26553
  chr1:114697835-114697865
  hyper

SEQ ID NO: 47484 - DNA, 26 bp, Homo sapiens
  chr1:115632012-115632038
  hyper
aggtacttgatgcaccgcaggccccc

SEQ ID NO: 47485 - DNA, 250 bp, Homo sapiens; identical to SEQ ID NO: 26555
  chr1:115632104-115632354
  hyper

SEQ ID NO: 47486 - DNA, 82 bp, Homo sapiens
  chr1:115632555-115632637
  hyper
agtgtccagggctgcggctccgcggcgcggagcaagcacacaagcagcttctaggggaccctccctccggcccctcccccct

SEQ ID NO: 47487 - DNA, 132 bp, Homo sapiens
  chr1:115880052-115880184
  hyper
cgccctaaccttccacgcccgcttctcccacacctggcagcagacagctggagatgaagcgtgtgacccaagtggcagggctgaaccttggcgacctctacctgaggttgtccaacgcggctccgtggaggg

SEQ ID NO: 47488 - DNA, 7 bp, Homo sapiens
  chr1:115880395-115880402
  hyper
ccgcggt

SEQ ID NO: 47489 - DNA, 117 bp, Homo sapiens; identical to SEQ ID NO: 5695
  chr1:115880678-115880795
  hyper

SEQ ID NO: 47490 - DNA, 103 bp, Homo sapiens
  chr1:116371036-116371139
  hyper
cgcccactggtgtggcgtcctgagagtgcgtgcgtgagcgagcgagcggcttatcctagactgaagacccagggaaacagatctgtgtggaggatgtttctgt

SEQ ID NO: 47491 - DNA, 328 bp, Homo sapiens
  chr1:116371201-116371529
  hyper
tggaaaacacttccagtgtgaggcgttcgccggcgccccttagacgcggccgggtctgaggcgcctgccgagcgaggtggcgcggcccgggagctgtggtcgaagcccctgggcctggcgtgtaggctgcgcgggcggcggcgggctgggggcggggctctccgccctccgcgcgggtccgcctggcccctcccccgcccaccccgcgcccgtcccgcctcccccaccttctcccagaggaggtgacagacgggcctgtaatttggttccattcgctcgactggagcaacacctgcccccctcccctgggacgcgagggtctcatccc

SEQ ID NO: 47492 - DNA, 128 bp, Homo sapiens; identical to SEQ ID NO: 26563
  chr1:116380300-116380428
  hyper

SEQ ID NO: 47493 - DNA, 410 bp, Homo sapiens; identical to SEQ ID NO: 26565
  chr1:116381534-116381944
  hyper

SEQ ID NO: 47494 - DNA, 20 bp, Homo sapiens
  chr1:116382478-116382498
  hyper
ctctacggcaaaataaaaac

SEQ ID NO: 47495 - DNA, 33 bp, Homo sapiens; identical to SEQ ID NO: 26567
  chr1:116710587-116710620
  hyper

SEQ ID NO: 47496 - DNA, 281 bp, Homo sapiens; identical to SEQ ID NO: 26568
  chr1:116711011-116711292
  hyper

SEQ ID NO: 47497 - DNA, 160 bp, Homo sapiens; identical to SEQ ID NO: 26569
  chr1:118727930-118728090
  hyper

SEQ ID NO: 47498 - DNA, 15 bp, Homo sapiens
  chr1:119521978-119521993
  hyper
cgtcacgatcccaca

SEQ ID NO: 47499 - DNA, 274 bp, Homo sapiens
  chr1:119522565-119522839
  hyper
cgttccggccccgcggcgcctccaaggccgggccgaggggccgaggggccgagggcgggcagacgcggccacggcctaattctgacttctgaaggtcaccgaaactgcgctgtttttccagagatgggttgaagagaagagatgcaatcccagttccttctgcggcgaaacgggatctgaaattcttggagagggggaagaattggacgttttcatcgtgcgtggaggaaaattgggggaggggaagtgagtggcaagtaagggggttaactgc

SEQ ID NO: 47500 - DNA, 159 bp, Homo sapiens; identical to SEQ ID NO: 26574
  chr1:119526773-119526932
  hyper

SEQ ID NO: 47501 - DNA, 232 bp, Homo sapiens
  chr1:119527391-119527623
  hyper
cggtggaatttttgaaacgctttcgaaatacatagtttcctctgtggagtgagtgcctacaacgcgcaggccggactgatcccccgttgctgcaggttggtgccccaagctgcgggtgctcgggcgccaactaaagccagctctgtccagacgcggaaagaaaaatgggctgtgaaaaagcaaaaggcctcgtctttgaatgaaagttaaacattaaaatctgaccctagag

SEQ ID NO: 47502 - DNA, 140 bp, Homo sapiens; identical to SEQ ID NO: 26576
  chr1:119528015-119528155
  hyper

SEQ ID NO: 47503 - DNA, 219 bp, Homo sapiens
  chr1:119529118-119529337
  hyper
tgaactgtcactgcctaaagagaaaatgtaagcgacagctgtccctcctctgagttggacagctttgtggctgagatccccaagctcctgagccccagaccgtctctatcccagtgcaggccgctgccccctccccgggcttgtcagcgtgtgaagcggggtctactccccagctctggctgttcagcaggagcaccttccagcatggttttagaagtc

SEQ ID NO: 47504 - DNA, 51 bp, Homo sapiens; identical to SEQ ID NO: 26578
  chr1:119529378-119529429
  hyper

SEQ ID NO: 47505 - DNA, 73 bp, Homo sapiens
  chr1:119529839-119529912
  hyper
gttctcagaagcgagtcctagatctcggctcccgccgttgccttcggcccgcgcccctcccaatcccagggac

SEQ ID NO: 47506 - DNA, 95 bp, Homo sapiens; identical to SEQ ID NO: 17168
  chr1:119530005-119530100
  hyper

SEQ ID NO: 47507 - DNA, 31 bp, Homo sapiens
  chr1:119530998-119531029
  hyper
gcccccaaccaatagcgaggagggaacaaga

SEQ ID NO: 47508 - DNA, 132 bp, Homo sapiens; identical to SEQ ID NO: 26585
  chr1:119531865-119531997
  hyper

SEQ ID NO: 47509 - DNA, 37 bp, Homo sapiens; identical to SEQ ID NO: 26586
  chr1:119535303-119535340
  hyper

SEQ ID NO: 47510 - DNA, 148 bp, Homo sapiens; identical to SEQ ID NO: 26587
  chr1:119535573-119535721
  hyper

SEQ ID NO: 47511 - DNA, 30 bp, Homo sapiens; identical to SEQ ID NO: 26588
  chr1:119536719-119536749
  hyper

SEQ ID NO: 47512 - DNA, 3 bp, Homo sapiens
  chr1:119542991-119542994
  hyper
acc

SEQ ID NO: 47513 - DNA, 124 bp, Homo sapiens
  chr1:119543408-119543532
  hyper
cgcggctgtctttcccggaaagacccaagtgcgcgatgtcagcccgcctgcacttcatctgagttgtccttatgtggccatttctgtttcaaatttcagatttttctactaaaaaaggatgggt

SEQ ID NO: 47514 - DNA, 304 bp, Homo sapiens
  chr1:119544182-119544486
  hyper
tctagtgtggccctgtgccccggagcctgcctgccataaagtgtgaccggaagcccccccccccccgcccactgtcagaaccactgaggagagaagagcgcggcgccttagtgccgccctgcgtcgtggtcgggaagccgagcaagcggtgtggacgccccaggagcagggggatccaggcctaaactcatgggttccgaatgggcaagggagcagaatcaagcatcggtgggcgcttatagaaagcgcgtctgtcttggaacacccttaccagggtacccaaccccagcgccaggtttcctgg

SEQ ID NO: 47515 - DNA, 226 bp, Homo sapiens
  chr1:119549929-119550155
  hyper
gggtattaccctcttttccgtcttctagaaggggaaaaccatgctgttttgaattcaacatatttagattctgaaaatcgacggcccttcccttctttcctaggaaggcctgccccgtaggcacaaccttcggagaaacgggcggcgcgtgagttccctggagccgcctcctgggcatccaggctcctgtcgcacggctggtgcggcgcccactgggcgtggggac

SEQ ID NO: 47516 - DNA, 28 bp, Homo sapiens
  chr1:119550278-119550306
  hyper
tcttgttctttgacggggtggccctgtg

SEQ ID NO: 47517 - DNA, 29 bp, Homo sapiens
  chr1:119550692-119550721
  hyper
acgcgcctagcagcccggcggccccggcc

SEQ ID NO: 47518 - DNA, 48 bp, Homo sapiens
  chr1:119551269-119551317
  hyper
aaggaaaacttctgcgacttcaagaacgtcctgcgcattcacatgggg

SEQ ID NO: 47519 - DNA, 43 bp, Homo sapiens; identical to SEQ ID NO: 26596
  chr1:119869950-119869993
  hyper

SEQ ID NO: 47520 - DNA, 30 bp, Homo sapiens; identical to SEQ ID NO: 26597
  chr1:119870224-119870254
  hyper

SEQ ID NO: 47521 - DNA, 43 bp, Homo sapiens; identical to SEQ ID NO: 26598
  chr1:120190546-120190589
  hyper

SEQ ID NO: 47522 - DNA, 30 bp, Homo sapiens; identical to SEQ ID NO: 26599
  chr1:120254554-120254584
  hyper

SEQ ID NO: 47523 - DNA, 51 bp, Homo sapiens; identical to SEQ ID NO: 26600
  chr1:147775362-147775413
  hyper

SEQ ID NO: 47524 - DNA, 87 bp, Homo sapiens; identical to SEQ ID NO: 26601
  chr1:147775510-147775597
  hyper

SEQ ID NO: 47525 - DNA, 121 bp, Homo sapiens; identical to SEQ ID NO: 26602
  chr1:150185824-150185945
  hyper

SEQ ID NO: 47526 - DNA, 78 bp, Homo sapiens; identical to SEQ ID NO: 26603
  chr1:151118621-151118699
  hyper

SEQ ID NO: 47527 - DNA, 40 bp, Homo sapiens; identical to SEQ ID NO: 26604
  chr1:151445937-151445977
  hyper

SEQ ID NO: 47528 - DNA, 30 bp, Homo sapiens; identical to SEQ ID NO: 5725
  chr1:151689335-151689365
  hyper

SEQ ID NO: 47529 - DNA, 55 bp, Homo sapiens; identical to SEQ ID NO: 17177
  chr1:151694351-151694406
  hyper

SEQ ID NO: 47530 - DNA, 60 bp, Homo sapiens; identical to SEQ ID NO: 26607
  chr1:152083305-152083365
  hyper

SEQ ID NO: 47531 - DNA, 119 bp, Homo sapiens; identical to SEQ ID NO: 26608
  chr1:152083590-152083709
  hyper

SEQ ID NO: 47532 - DNA, 435 bp, Homo sapiens; identical to SEQ ID NO: 26609
  chr1:152083710-152084145
  hyper

SEQ ID NO: 47533 - DNA, 834 bp, Homo sapiens
  chr1:152084564-152085398
  hyper
ctgctgctcgcgcctctcctcctcctgctcgcgcctcagctgctgctcgcgcctctcctcctcctgctcgcgcctcagctgctgctcgcgcctctcctcctgctcgcgcctcagctgctgctcgcgcctctcctcctgctgctcgcgcctctcctgctgctcgcgcctctcctcctgctgctcgcgcctctcctcctcctgcttgcgccttagttgctgctcgcgcctcagcctttgctgctgctgctcttcctcctggcgctccctcctcagctcttgccgctccagcttccgtagctgctcttcttcctcctggagctctctttgccgctgcggctcctcttcctgcaacttctcttcttccttccggagcactgtctcgcgcttcctccactctttctcttcttcctcctggaacactctgtcttgccgctctcgcctttgctgctgtttctcctcgcggcccttcctcctcagctccagcagctcccgccttcgcagttgctcttcgtctggaaactcctcagtttcgtgacctttgcaactctgcagctgctcttcctctgcacggcgctcttcccgttcttgccattcttgcctttgccgccacagctcctcgtcgcggcgctgcctgtcgcgctgttcaagtcgctcttgtttctcactttgctcctctccctcagctagctccctctcctgttcctgcctcttctgcctgcgtcgttgcccaggttcttcttccagttgtctgtcccggggctcgaatctcctttggtcttcttcttgcctgcgatcttgtaacaggctctcctttccgtcacaccgggctcgctt

SEQ ID NO: 47534 - DNA, 44 bp, Homo sapiens
  chr1:152085504-152085548
  hyper
agatccagaagttccaggatcagatctaccgtcttagggtcatg

SEQ ID NO: 47535 - DNA, 168 bp, Homo sapiens; identical to SEQ ID NO: 26611
  chr1:152487789-152487957
  hyper

SEQ ID NO: 47536 - DNA, 151 bp, Homo sapiens
  chr1:152487999-152488150
  hyper
cggcgactcaggctgctgcggctccagctccaccagttgctgctgcttcccaaggagacgccgccgacagcggagtagtggttgctgctgctgcgggggcggcagccagaggtcccagcgctccaacaaccggagctcaggatgctgctcc

SEQ ID NO: 47537 - DNA, 27 bp, Homo sapiens
  chr1:152488197-152488224
  hyper
cccagcccagagcgggcccgccccgct

SEQ ID NO: 47538 - DNA, 79 bp, Homo sapiens; identical to SEQ ID NO: 26613
  chr1:153438376-153438455
  hyper

SEQ ID NO: 47539 - DNA, 167 bp, Homo sapiens
  chr1:153651798-153651965
  hyper
tgctgccgggctggacggtccgcacggtgctgggcagcagcgaaaacgcgctgggcgtctgctccgacaccgcagcgcccctggccgcggtggacctcaagtgggagcacaaccccgctgtgttcctgggccccggctgcgtgtacgccgccgccccagtggggcgc

SEQ ID NO: 47540 - DNA, 9 bp, Homo sapiens
  chr1:153652379-153652388
  hyper
tttctctct

SEQ ID NO: 47541 - DNA, 8 bp, Homo sapiens
  chr1:154298145-154298153
  hyper
cgccgggg

SEQ ID NO: 47542 - DNA, 67 bp, Homo sapiens
  chr1:154298253-154298320
  hyper
cgcggggctggaggggccggggagcgggtgtagactggggagcaccgggggccaagatttgggagct

SEQ ID NO: 47543 - DNA, 15 bp, Homo sapiens
  chr1:154474763-154474778
  hyper
tgctctttcctcctg

SEQ ID NO: 47544 - DNA, 81 bp, Homo sapiens; identical to SEQ ID NO: 95
  chr1:154474987-154475068
  hyper

SEQ ID NO: 47545 - DNA, 13 bp, Homo sapiens
  chr1:154475531-154475544
  hyper
ggatgccaggcga

SEQ ID NO: 47546 - DNA, 68 bp, Homo sapiens; identical to SEQ ID NO: 26620
  chr1:154540186-154540254
  hyper

SEQ ID NO: 47547 - DNA, 47 bp, Homo sapiens; identical to SEQ ID NO: 26621
  chr1:154733207-154733254
  hyper

SEQ ID NO: 47548 - DNA, 25 bp, Homo sapiens
  chr1:155043657-155043682
  hyper
ccacgggagccgggctggggaggtt

SEQ ID NO: 47549 - DNA, 15 bp, Homo sapiens
  chr1:155147247-155147262
  hyper
ccgctgaccgggttg

SEQ ID NO: 47550 - DNA, 248 bp, Homo sapiens; identical to SEQ ID NO: 17188
  chr1:156215359-156215607
  hyper

SEQ ID NO: 47551 - DNA, 80 bp, Homo sapiens; identical to SEQ ID NO: 26625
  chr1:156339180-156339260
  hyper

SEQ ID NO: 47552 - DNA, 138 bp, Homo sapiens
  chr1:156357855-156357993
  hyper
tgagggaaggttctccggaagcagccgctgttctggcttggcgcaagtgcgtgtggacgacagcaggatttcctgcccagggacatctggataagaggcccaaggtccccaggagcccccaggtgcttctgccctgtg

SEQ ID NO: 47553 - DNA, 68 bp, Homo sapiens
  chr1:156358508-156358576
  hyper
gaggcggccactgcatagggatgagctgttgtcccggagcgcccgggacagagcgccattgtctgtgc

SEQ ID NO: 47554 - DNA, 27 bp, Homo sapiens
  chr1:156390108-156390135
  hyper
ccccgggcccctctgcgcagtgtatgg

SEQ ID NO: 47555 - DNA, 518 bp, Homo sapiens
  chr1:156390698-156391216
  hyper
tgccttcggcggagcccgagcctggcgcgggatggaaatggggagccgcggtgccggcccggccacgtcgccaactcagaaaggcgttggaagcgaagcggagcccttgtgggggaaagagccggattcaagaggccgactaaaaggggaaatgggcagccaaaccccggaggtaaaaaccccagagatgtcctaataggaagcagggaaatcccggcgacccaaagagagaggaaaggctgtggggggcgggtgggggcgacccagagactcccaagcgagtctctcaaggagagaaggaaacagcagagaccccacccgggaagagatccgggagagtacccatgagaggggcggaggggaggaaagcagagggcgacagggcaggtgaccagagtcccaggccctgcagagccccggataaacggctttgttcaaagaggaccagagatcacccagggttgtgaaaatggccgggggttcgaggcgagcggtgctctaggggtgggaaaggggtg

SEQ ID NO: 47556 - DNA, 286 bp, Homo sapiens; identical to SEQ ID NO: 26628
  chr1:156391242-156391528
  hyper

SEQ ID NO: 47557 - DNA, 48 bp, Homo sapiens; identical to SEQ ID NO: 1821
  chr1:156405367-156405415
  hyper

SEQ ID NO: 47558 - DNA, 166 bp, Homo sapiens
  chr1:156406431-156406597
  hyper
gccagggaaagggaagatgagacagagagacatagagagacagggacagagggagacagagagggggctaagagcgacgcgggcgagagaggaagaaaggctggggagaaggaaaaatgagataaataaaggaaaaaagagaagcgaagggcggtgggagaggcag

SEQ ID NO: 47559 - DNA, 30 bp, Homo sapiens; identical to SEQ ID NO: 5745
  chr1:156468873-156468903
  hyper

SEQ ID NO: 47560 - DNA, 51 bp, Homo sapiens; identical to SEQ ID NO: 26633
  chr1:156474407-156474458
  hyper

SEQ ID NO: 47561 - DNA, 212 bp, Homo sapiens; identical to SEQ ID NO: 26634
  chr1:156594433-156594645
  hyper

SEQ ID NO: 47562 - DNA, 124 bp, Homo sapiens
  chr1:156594850-156594974
  hyper
cgcccaccctgccctcggtcggtgacccgctgtggtccccaggccaagtgttcttcgtgcccgggcggctgacgctgtctgaagcccacgcggcgtgccggcgacgcggcgccgtggtggccaa

SEQ ID NO: 47563 - DNA, 32 bp, Homo sapiens; identical to SEQ ID NO: 17198
  chr1:156595021-156595053
  hyper

SEQ ID NO: 47564 - DNA, 104 bp, Homo sapiens; identical to SEQ ID NO: 5748
  chr1:156595080-156595184
  hyper

SEQ ID NO: 47565 - DNA, 44 bp, Homo sapiens; identical to SEQ ID NO: 26637
  chr1:156595221-156595265
  hyper

SEQ ID NO: 47566 - DNA, 114 bp, Homo sapiens; identical to SEQ ID NO: 17200
  chr1:156611775-156611889
  hyper

SEQ ID NO: 47567 - DNA, 114 bp, Homo sapiens
  chr1:156626475-156626589
  hyper
gatggagacccaggccggaactccatccctcaccctggttcctgtctcttagaaaaggcaccagcgcccctgcccaagagcccctccaggctcctgctaccccctcattctcta

SEQ ID NO: 47568 - DNA, 233 bp, Homo sapiens
  chr1:156626658-156626891
  hyper
accagccccttccaggggacctggccctctgggttttggggccctaagatgcccgcccttatgtgccgcaggcctccgcttctgcaaccccggctgggacgccttccagggcgcctgctacaagcacttttccacacgaaggagctgggaggaggcagagacccagtgccggatgtacggcgcgcatctggccagcatcagcacacccgaggaacaggacttcatcaacagtg

SEQ ID NO: 47569 - DNA, 153 bp, Homo sapiens
  chr1:156646647-156646800
  hyper
gctcgcgctccagctctgccacctggctactcagccaggcccgggcgcatttctctgcctcgacggcgcgccggttgcgggctacctcctccgtcgtccgctcccgggccagccgcagctgctggcatcggcctgccacgccctccagctctt

SEQ ID NO: 47570 - DNA, 179 bp, Homo sapiens
  chr1:156814754-156814933
  hyper
gaggggcaagcaaagcgaggctctggggttagcgagaagtcaaaccccaaacctttgcacagggtccttggggtcggtgatgggggtagaaggtgtgtgtgtggatcacctactgtggggcatggtgcgcgcaaagacgaaggtggcggcgctgcagcccacggtgtgcgccgcgtggt

SEQ ID NO: 47571 - DNA, 94 bp, Homo sapiens; identical to SEQ ID NO: 17204
  chr1:156815146-156815240
  hyper

SEQ ID NO: 47572 - DNA, 172 bp, Homo sapiens
  chr1:156815273-156815445
  hyper
cgcctccaaaagcacccacaacccgggacccgcccacacaagcaaggccccacccacaaaccccacccctcccgcaagacccgcccctcacaggccccactcatcagaccctcccaggccgcgcgcgctcttcgcacatggggatggtgatcgcgttgtgtagaaagttttc

SEQ ID NO: 47573 - DNA, 8 bp, Homo sapiens
  chr1:156815745-156815753
  hyper
cggtggca

SEQ ID NO: 47574 - DNA, 467 bp, Homo sapiens; identical to SEQ ID NO: 26645
  chr1:156818562-156819029
  hyper

SEQ ID NO: 47575 - DNA, 54 bp, Homo sapiens; identical to SEQ ID NO: 26646
  chr1:156829171-156829225
  hyper

SEQ ID NO: 47576 - DNA, 30 bp, Homo sapiens; identical to SEQ ID NO: 26647
  chr1:156829545-156829575
  hyper

SEQ ID NO: 47577 - DNA, 4 bp, Homo sapiens
  chr1:156830265-156830269
  hyper
cgcg

SEQ ID NO: 47578 - DNA, 96 bp, Homo sapiens; identical to SEQ ID NO: 26649
  chr1:156830979-156831075
  hyper

SEQ ID NO: 47579 - DNA, 46 bp, Homo sapiens; identical to SEQ ID NO: 17206
  chr1:156863061-156863107
  hyper

SEQ ID NO: 47580 - DNA, 155 bp, Homo sapiens; identical to SEQ ID NO: 17207
  chr1:156863331-156863486
  hyper

SEQ ID NO: 47581 - DNA, 22 bp, Homo sapiens
  chr1:156863640-156863662
  hyper
cgcgccccctggcaggggaggc

SEQ ID NO: 47582 - DNA, 30 bp, Homo sapiens; identical to SEQ ID NO: 26652
  chr1:156890393-156890423
  hyper

SEQ ID NO: 47583 - DNA, 85 bp, Homo sapiens; identical to SEQ ID NO: 26653
  chr1:156890711-156890796
  hyper

SEQ ID NO: 47584 - DNA, 142 bp, Homo sapiens; identical to SEQ ID NO: 26654
  chr1:156893837-156893979
  hyper

SEQ ID NO: 47585 - DNA, 40 bp, Homo sapiens; identical to SEQ ID NO: 5761
  chr1:156894252-156894292
  hyper

SEQ ID NO: 47586 - DNA, 41 bp, Homo sapiens; identical to SEQ ID NO: 26656
  chr1:157963385-157963426
  hyper

SEQ ID NO: 47587 - DNA, 52 bp, Homo sapiens; identical to SEQ ID NO: 26657
  chr1:157963443-157963495
  hyper

SEQ ID NO: 47588 - DNA, 154 bp, Homo sapiens; identical to SEQ ID NO: 26658
  chr1:157963737-157963891
  hyper

SEQ ID NO: 47589 - DNA, 401 bp, Homo sapiens; identical to SEQ ID NO: 5763
  chr1:158083182-158083583
  hyper

SEQ ID NO: 47590 - DNA, 44 bp, Homo sapiens; identical to SEQ ID NO: 1828
  chr1:158150605-158150649
  hyper

SEQ ID NO: 47591 - DNA, 147 bp, Homo sapiens; identical to SEQ ID NO: 1829
  chr1:158150650-158150797
  hyper

SEQ ID NO: 47592 - DNA, 161 bp, Homo sapiens; identical to SEQ ID NO: 26662
  chr1:158150798-158150959
  hyper

SEQ ID NO: 47593 - DNA, 110 bp, Homo sapiens; identical to SEQ ID NO: 26663
  chr1:159141434-159141544
  hyper

SEQ ID NO: 47594 - DNA, 132 bp, Homo sapiens; identical to SEQ ID NO: 26664
  chr1:159141599-159141731
  hyper

SEQ ID NO: 47595 - DNA, 43 bp, Homo sapiens
  chr1:159158305-159158348
  hyper
cagctggctctgagtcgcgctgggacgactggcgaagttcacc

SEQ ID NO: 47596 - DNA, 76 bp, Homo sapiens; identical to SEQ ID NO: 26667
  chr1:159750570-159750646
  hyper

SEQ ID NO: 47597 - DNA, 52 bp, Homo sapiens; identical to SEQ ID NO: 26668
  chr1:159750677-159750729
  hyper

SEQ ID NO: 47598 - DNA, 114 bp, Homo sapiens; identical to SEQ ID NO: 26669
  chr1:159751133-159751247
  hyper

SEQ ID NO: 47599 - DNA, 30 bp, Homo sapiens; identical to SEQ ID NO: 26670
  chr1:160039721-160039751
  hyper

SEQ ID NO: 47600 - DNA, 129 bp, Homo sapiens; identical to SEQ ID NO: 26671
  chr1:160040345-160040474
  hyper

SEQ ID NO: 47601 - DNA, 158 bp, Homo sapiens; identical to SEQ ID NO: 26672
  chr1:160370097-160370255
  hyper

SEQ ID NO: 47602 - DNA, 30 bp, Homo sapiens; identical to SEQ ID NO: 26673
  chr1:160370599-160370629
  hyper

SEQ ID NO: 47603 - DNA, 114 bp, Homo sapiens; identical to SEQ ID NO: 26674
  chr1:161068047-161068161
  hyper

SEQ ID NO: 47604 - DNA, 179 bp, Homo sapiens; identical to SEQ ID NO: 26675
  chr1:161068380-161068559
  hyper

SEQ ID NO: 47605 - DNA, 97 bp, Homo sapiens
  chr1:161276026-161276123
  hyper
cttccccttggccctcccacccactggagtagtctccgcccagatgggggatagtggggagagggggaggggagctaggctccgccccttacctgag

SEQ ID NO: 47606 - DNA, 97 bp, Homo sapiens; identical to SEQ ID NO: 26678
  chr1:161409851-161409948
  hyper

SEQ ID NO: 47607 - DNA, 171 bp, Homo sapiens; identical to SEQ ID NO: 26679
  chr1:161494827-161494998
  hyper

SEQ ID NO: 47608 - DNA, 94 bp, Homo sapiens; identical to SEQ ID NO: 26680
  chr1:161509954-161510048
  hyper

SEQ ID NO: 47609 - DNA, 154 bp, Homo sapiens; identical to SEQ ID NO: 26681
  chr1:161510108-161510262
  hyper

SEQ ID NO: 47610 - DNA, 128 bp, Homo sapiens; identical to SEQ ID NO: 26682
  chr1:161581762-161581890
  hyper

SEQ ID NO: 47611 - DNA, 168 bp, Homo sapiens; identical to SEQ ID NO: 26683
  chr1:161582427-161582595
  hyper

SEQ ID NO: 47612 - DNA, 30 bp, Homo sapiens; identical to SEQ ID NO: 26684
  chr1:161591283-161591313
  hyper

SEQ ID NO: 47613 - DNA, 112 bp, Homo sapiens; identical to SEQ ID NO: 26685
  chr1:161591628-161591740
  hyper

SEQ ID NO: 47614 - DNA, 180 bp, Homo sapiens; identical to SEQ ID NO: 26686
  chr1:161695643-161695823
  hyper

SEQ ID NO: 47615 - DNA, 185 bp, Homo sapiens; identical to SEQ ID NO: 26687
  chr1:161697126-161697311
  hyper

SEQ ID NO: 47616 - DNA, 230 bp, Homo sapiens
  chr1:162792076-162792306
  hyper
gcatttaaaatgaggcgaaagaacaaatggaataattatagaaaattttagcctctagcaaaacactgtgaagcagctccagcctgtggtggaagatgtgcgaaagggatgggggaacgctgtggaccggtgtggagtctaggacgacaggtggtgggctctgtccccacgcgcctcgcggccagcagaggccccctcactgcggccgccgggcgggactggcgcgggcg

SEQ ID NO: 47617 - DNA, 20 bp, Homo sapiens
  chr1:162792533-162792553
  hyper
cccaccggactgggtgggga

SEQ ID NO: 47618 - DNA, 91 bp, Homo sapiens
  chr1:164290524-164290615
  hyper
cccctctgttgtgtgcgccgcgtccggggagcctgggccgtgcctccctggcgtatgcaggtcgccggcgcagccgccagctccgggggcc

SEQ ID NO: 47619 - DNA, 28 bp, Homo sapiens
  chr1:165086960-165086988
  hyper
taattggctgtgacacgcgggccagctg

SEQ ID NO: 47620 - DNA, 189 bp, Homo sapiens; identical to SEQ ID NO: 26691
  chr1:165204385-165204574
  hyper

SEQ ID NO: 47621 - DNA, 69 bp, Homo sapiens; identical to SEQ ID NO: 26692
  chr1:165204838-165204907
  hyper

SEQ ID NO: 47622 - DNA, 45 bp, Homo sapiens; identical to SEQ ID NO: 26693
  chr1:165205298-165205343
  hyper

SEQ ID NO: 47623 - DNA, 86 bp, Homo sapiens
  chr1:165321661-165321747
  hyper
aaaagcccctgcatccgagggttctgcagaaaaccaggaaggcgacagtgaaagggcgaacgggctgtgcgcttagctccgaatgg

SEQ ID NO: 47624 - DNA, 30 bp, Homo sapiens; identical to SEQ ID NO: 26695
  chr1:165323752-165323782
  hyper

SEQ ID NO: 47625 - DNA, 18 bp, Homo sapiens
  chr1:165324178-165324196
  hyper
tccagttaattaacgcgg

SEQ ID NO: 47626 - DNA, 56 bp, Homo sapiens
  chr1:165324249-165324305
  hyper
cagaaaagtctctctcggccttgcccatggctgaaattggggctggagttggtggg

SEQ ID NO: 47627 - DNA, 131 bp, Homo sapiens
  chr1:165324357-165324488
  hyper
attgcctctaggccgcgagaagagggcggcatttatgagacgtcgatcagctccgagattaaaaatccagccctgggtatttttaatcacttgccactcagacgcctacgaacaagctcgcccgcccctcg

SEQ ID NO: 47628 - DNA, 440 bp, Homo sapiens
  chr1:165324668-165325108
  hyper
cagcgccaagcggaaagagagtgcgcccaggacgcacggcctgaacactcacccagcagcgaggagaaggaggccgaggtgtcgatcgcgctttggaagttctcctccatctttaggccgtccagcatgttcgggccgggccgggaggacctgtagaggagaagaaacgatgcgtctgacgtccgtgcccgctgggactcggcgccagcagccaccgcactcctgggaaagaactgagggagtgtccagggcgaccagaatcagccaggaggatagggtccagccaagagaatgtagggtgggaggagagatcagtcacagcgaactgctctggctgatctgatttcacttgaagtcaacacgttatgtacttaggcctccgccccccaactgcgtttctccttctcctgcccccctcacccccacctacatcccttgcc

SEQ ID NO: 47629 - DNA, 250 bp, Homo sapiens
  chr1:165325646-165325896
  hyper
ctggaagcttctgcccgggaaggcgtcgcccccgagactgcagccggaggagccgccctcggcttcggagcgccggggagggagccggagcgaacgccggccgctggctctgctcctcggcgcgcccaggctgggccgggacgtggtcgcgagctgccggccttcccgggacgtcctaccagcccgcgtcgctcctcagcgggaggagagggccagttgcttctccaaggctaggagggaaggcagaggc

SEQ ID NO: 47630 - DNA, 254 bp, Homo sapiens; identical to SEQ ID NO: 17228
  chr1:165325950-165326204
  hyper

SEQ ID NO: 47631 - DNA, 209 bp, Homo sapiens; identical to SEQ ID NO: 26700
  chr1:165345473-165345682
  hyper

SEQ ID NO: 47632 - DNA, 132 bp, Homo sapiens; identical to SEQ ID NO: 26701
  chr1:165414298-165414430
  hyper

SEQ ID NO: 47633 - DNA, 44 bp, Homo sapiens
  chr1:166134203-166134247
  hyper
agttctgaaaggaggcgggtgcggagttatgaaaatttggtaaa

SEQ ID NO: 47634 - DNA, 422 bp, Homo sapiens
  chr1:166134306-166134728
  hyper
ggcgatccttggtcttcaccgcagcagccaagcccggcgcgcaccaaccggcgctgctgaaagttggagagctcccagctcgccgatagaattcggcggtgggcgccaggggaatcccttccagtgccgcaattaggaaagttttaaaaagtaaggaccctagacagacaagagatccatcctttcctttagcataagaaacaccccgcgccgcgccagccgaacgctgctcgcacaaggctatccgcccttcttggccgggacgcactcggtgccttccagctccccaccagaactggtccagggggcgcggaaacagagaggcaactgtgtccggcttgtggttccagacggaaacgcctccgggctccctggcccgggggacaagggttcgaaacttcaacagtcgcgagggcaaggac

SEQ ID NO: 47635 - DNA, 95 bp, Homo sapiens; identical to SEQ ID NO: 17233
  chr1:166134796-166134891
  hyper

SEQ ID NO: 47636 - DNA, 260 bp, Homo sapiens; identical to SEQ ID NO: 17234
  chr1:166134933-166135193
  hyper

SEQ ID NO: 47637 - DNA, 305 bp, Homo sapiens
  chr1:166135281-166135586
  hyper
caccacccaggtctcgtggcgggggatggggggcatgaccacgcgggcggaggctttgaagtagggggtcttgtagcgcaggacgatgggcgaggtctcctcgatgcgcgtggggcactggtcgatggtggcgcacacatcgtacaccacgatgttctcgcgccggatccgcgccttgcaggtgatgctttggatacagcccatcctgcagcccggtgccggcacggcgcggcgtggggcagcgcgggggcccgcgcgggcagccgggggcgcccgtcacgccggcatggcgacgcgccgctcgc

SEQ ID NO: 47638 - DNA, 57 bp, Homo sapiens; identical to SEQ ID NO: 26705
  chr1:166853653-166853710
  hyper

SEQ ID NO: 47639 - DNA, 16 bp, Homo sapiens
  chr1:166916850-166916866
  hyper
gctgagccaatttctc

SEQ ID NO: 47640 - DNA, 196 bp, Homo sapiens; identical to SEQ ID NO: 26708
  chr1:166945272-166945468
  hyper

SEQ ID NO: 47641 - DNA, 286 bp, Homo sapiens; identical to SEQ ID NO: 17236
  chr1:167599330-167599616
  hyper

SEQ ID NO: 47642 - DNA, 8 bp, Homo sapiens
  chr1:167599844-167599852
  hyper
ggtcccac

SEQ ID NO: 47643 - DNA, 90 bp, Homo sapiens
  chr1:169396286-169396376
  hyper
taagctactctcagacgagtatccttcatacatagtgaagaaaggtgttaccagacttccccaccagtgccagactcggtggacctcgga

SEQ ID NO: 47644 - DNA, 91 bp, Homo sapiens
  chr1:170630365-170630456
  hyper
tgaggatagagagtgcgaaaggagggagaggcgaggagctgctctatttctagggaggttttggggagactgatcagctccaaggacagac

SEQ ID NO: 47645 - DNA, 162 bp, Homo sapiens
  chr1:170631315-170631477
  hyper
gtcaggttagggctccgcagacggacgacagaggattatccgtagacttagatgggggttcctccgcccctctctgtcctcctgccaccacagccaggctggacgcagaaccgcacggaagcctccccaactcctgcctctgggagtgctcctgcctgcttc

SEQ ID NO: 47646 - DNA, 20 bp, Homo sapiens
  chr1:170631559-170631579
  hyper
attggcgggggtagggagaa

SEQ ID NO: 47647 - DNA, 33 bp, Homo sapiens; identical to SEQ ID NO: 26717
  chr1:170633073-170633106
  hyper

SEQ ID NO: 47648 - DNA, 46 bp, Homo sapiens; identical to SEQ ID NO: 26718
  chr1:170633432-170633478
  hyper

SEQ ID NO: 47649 - DNA, 381 bp, Homo sapiens; identical to SEQ ID NO: 26719
  chr1:170633902-170634283
  hyper

SEQ ID NO: 47650 - DNA, 14 bp, Homo sapiens
  chr1:170637796-170637810
  hyper
gccagagaaacgcc

SEQ ID NO: 47651 - DNA, 190 bp, Homo sapiens; identical to SEQ ID NO: 26721
  chr1:170640121-170640311
  hyper

SEQ ID NO: 47652 - DNA, 315 bp, Homo sapiens
  chr1:171810972-171811287
  hyper
gcggagtaaggatgcggcagtggggcgaccccgctgcgggccgttggaacgtggacgggcagcgggagccagagggtggatggaccaggcgctgcggtggaatggggggcagagtggaatggggggcagagtggcggtgtccgtggggcgggcggggtcctccagctctgggcatcctccgtcccctgccaccccccgcctggtggccctcctgcctgcctttcatcgtgcgatacaaagccatttcctccctgtcctccagtcggggagtcgggggaggggtccgccccgggctcgacccccaccccctcggtg

SEQ ID NO: 47653 - DNA, 238 bp, Homo sapiens; identical to SEQ ID NO: 26725
  chr1:171811320-171811558
  hyper

SEQ ID NO: 47654 - DNA, 142 bp, Homo sapiens; identical to SEQ ID NO: 26727
  chr1:177133445-177133587
  hyper

SEQ ID NO: 47655 - DNA, 32 bp, Homo sapiens
  chr1:177133689-177133721
  hyper
cgtgatgcttttgagcttgcactccagctcct

SEQ ID NO: 47656 - DNA, 247 bp, Homo sapiens
  chr1:177133814-177134061
  hyper
tgagccccggccgccttcctcctagcgctgcgatggtgggggaggaagcgagcggggagggagcgagggagcgagcgcgggaggcgggggaggttagggaggggatggagagccgggagagccctggaccccggaatgagatgccgcttgcagagtcctgggtttaagctctgatgtctggagagccccggattctttgtttcccggagctgcttatctggagaagggaaagcgggggaggggggag

SEQ ID NO: 47657 - DNA, 451 bp, Homo sapiens
  chr1:177150803-177151254
  hyper
tatcatcaatacgtcgttaggcaggagcaggggcaggtggctgacgggtgtgccggcggctggcggggtcttgggaggcgccctgcacacgcctcttctttctgaaatctccgacctttcggatttgagccgcgagggaccgcggagcaagggcagcctcctccggaagcctcgggtcactagagacccctagaggcgaaaagctgtgttacaagcccccggccgcagaggcgcaggcgggattcttgccccggaggttgccgaggagtggccggtacctttcctaaaacccttatctgtaagtacactccggcaagctcgaaagggacagcaggggagccatgtgtgcgtgcgcgtgtgcggagaaggaatggggagggacagttgcatttgcagaagcaatcctgtctggaactaagctgattagtcctggtgccgtccctccctccct

SEQ ID NO: 47658 - DNA, 30 bp, Homo sapiens; identical to SEQ ID NO: 26733
  chr1:178063661-178063691
  hyper

SEQ ID NO: 47659 - DNA, 182 bp, Homo sapiens
  chr1:179544785-179544967
  hyper
ctcggacctcatccacgtccaccaccgtggcggcgggcgctcggggctcccccggggtccccgcccgtccggagcccgacggctcgggcccagcctcctggcgcccgcggcctccgccgctcctctcggcctttgccctcttgttctccttgtgcggagtcctgccgcctcgcccgcgggac

SEQ ID NO: 47660 - DNA, 82 bp, Homo sapiens
  chr1:179545098-179545180
  hyper
ggggaccctaaagaccgtcgggtgggggctgagggcgaggggcgggacaccggggccgcgggcggggcgcacccggaacccc

SEQ ID NO: 47661 - DNA, 222 bp, Homo sapiens
  chr1:179711942-179712164
  hyper
gatcccgccctgccacgaggcccgggtacccctcagcggcggggacatccaggtgtccctggatttccagggcacagtgcgggccggaaataggaacacagaggagcccttcgggaggctctcgaggcagtctctttccagtggatagcgacacaccctggtccctaagattctcatgctctccgaattttccgtcctggacccgatctgtagggcgcaaag

SEQ ID NO: 47662 - DNA, 247 bp, Homo sapiens; identical to SEQ ID NO: 17249
  chr1:180198209-180198456
  hyper

SEQ ID NO: 47663 - DNA, 158 bp, Homo sapiens; identical to SEQ ID NO: 5816
  chr1:180202237-180202395
  hyper

SEQ ID NO: 47664 - DNA, 278 bp, Homo sapiens
  chr1:180203016-180203294
  hyper
aaggtattttattttgtgtttggtagggtcggggtaaaggttttccctgggacttcctctcctggggctcctccggggtgcgtggggtaatgtcccagcgcaggtcgagttgcagatccgagtccccggggttgttgactgtccttcttgcaggacatttcttaagggggtgagatggattcactgtccaagacaggagttcactcaaacgctggtgctgttcgctcttctttccattcctgccttgtctcctagtgcgagaaacagacacacacaac

SEQ ID NO: 47665 - DNA, 59 bp, Homo sapiens
  chr1:180203354-180203413
  hyper
taatagattgagattctatcatattccgaacattccgatatagcagctgtaggcaccat

SEQ ID NO: 47666 - DNA, 447 bp, Homo sapiens
  chr1:180204924-180205371
  hyper
caccgggtgcactcaccgcacgagaggccgcggctggactgggaccgagcgcatccctgtgtctcagggggtttgctttgtgcaggatgggaccttattatttttagacagtggggcaaacgtgtcttttaaagagatccgaagggtgaaactaatgaaaaaggaaatgaattactagaaaagccgtgaagggataaaaccgggagcagcaggaagttgaaggaaggacgaccgaagctaggtgtatctgcacctgcctcttgacacgccaaaaacaaaggggggttaaggcaagaatgtagactaaatgctgtgaggattagggtaacgcgagccctcaagacgtctcggagaccgcctacagggctgcaaataccagggtccatttttaaaaatcgagtgctcctagaggtggggtgggggtgggagagccgggaaaccagcaaa

SEQ ID NO: 47667 - DNA, 60 bp, Homo sapiens; identical to SEQ ID NO: 26748
  chr1:180206312-180206372
  hyper

SEQ ID NO: 47668 - DNA, 118 bp, Homo sapiens; identical to SEQ ID NO: 5824
  chr1:180881433-180881551
  hyper

SEQ ID NO: 47669 - DNA, 428 bp, Homo sapiens; identical to SEQ ID NO: 26750
  chr1:180882004-180882432
  hyper

SEQ ID NO: 47670 - DNA, 30 bp, Homo sapiens; identical to SEQ ID NO: 26751
  chr1:181286935-181286965
  hyper

SEQ ID NO: 47671 - DNA, 348 bp, Homo sapiens
  chr1:181287331-181287679
  hyper
tgcactccccggcggcgccacgggtctggcccccgcgcttctacgtgttggggggatgcatggaccttggagatccgtagttggccctaaccttctcggaatctcctctgcacgcgctgcctgttcctcctctgcacgctctgtccgttcctttgcaacttctgtgggaattgtcctggcgtgggaaacgcccccgcgctctttggcacttagggtgtgagtgttgcgccccttgccgcagcgctcagggcagcatcccgctcgaggatgcagggttctcaccaagcagtgagggggactcacgcgccgccggggagcggagccaggctccgagaagggagcaggctc

SEQ ID NO: 47672 - DNA, 257 bp, Homo sapiens
  chr1:181287757-181288014
  hyper
ccggcttcgggaagttttgtgcgcggatcgctggtggggagggcgcgcgggccagtggctgagcttgcagcgaagtttccgtgaaggaaactgcatgtgcctttggaggcgactcgggactgctgtagggtggactgggtgtctatggagttgcgggtcagagcgagtagggtgggtcctttcctgggacaggactgggaattggggctcgaagtaggggaggaaagagcacagaggaagccaggctgcatagggtg

SEQ ID NO: 47673 - DNA, 14 bp, Homo sapiens
  chr1:181288188-181288202
  hyper
gcagaggactgagg

SEQ ID NO: 47674 - DNA, 87 bp, Homo sapiens
  chr1:181451320-181451407
  hyper
ggagcctgggaggtgcggaggagcggcgacgcggccatggcgctaggcgcgcaaaggccccgacaccttactagggcggcggcgggc

SEQ ID NO: 47675 - DNA, 239 bp, Homo sapiens; identical to SEQ ID NO: 17260
  chr1:181452120-181452359
  hyper

SEQ ID NO: 47676 - DNA, 180 bp, Homo sapiens; identical to SEQ ID NO: 17261
  chr1:181452691-181452871
  hyper

SEQ ID NO: 47677 - DNA, 19 bp, Homo sapiens
  chr1:181452967-181452986
  hyper
gtgccggcctcggggcagg

SEQ ID NO: 47678 - DNA, 60 bp, Homo sapiens; identical to SEQ ID NO: 26755
  chr1:181453050-181453110
  hyper

SEQ ID NO: 47679 - DNA, 169 bp, Homo sapiens
  chr1:181454704-181454873
  hyper
attgcctgagttgaacgtatctagctagggtggaggtttcgggcgggggaggggtcgggtccctgcagtcacgcctgccggtgcgctgcacaaagcggacagatctcattgtgttgtgtgctgcggctgcaaatattcctctaggcagtctacggatttcccagctggg

SEQ ID NO: 47680 - DNA, 271 bp, Homo sapiens
  chr1:181454912-181455183
  hyper
tcccatccaccaggtgctgccttgctgtgcccctctcttaggggcgtgtttattcagacaggcgccctcccgtttctttgcggtagacaaagccgcccaaccgccccgcgggtggcaaagtgtgccagcagccatcgttggcacctcggacagcgccgctgaaactcccggcggcccggggctccccagttacccgggttcagcacctcgggtacttctggccgggcccagccttggagctgagaaaccaggcacgtttcctacaccacgt

SEQ ID NO: 47681 - DNA, 86 bp, Homo sapiens
  chr1:181455263-181455349
  hyper
tgtgagtcttactcctccctttccttgtctttggccaaaaatggaccaaagagagtcaaacgggagactctcgagggagttgattt

SEQ ID NO: 47682 - DNA, 165 bp, Homo sapiens
  chr1:183385985-183386150
  hyper
ctccctaggagggctcgcgcagtcctcaggctccggataaacacgtgtgcccgcatccagctccggcgcgccctgcatttcagcaccgccgcctctggagagcgccttgctggcgggccaggtcagggcctcccacacgctctctcatccatcccagcccactcg

SEQ ID NO: 47683 - DNA, 31 bp, Homo sapiens
  chr1:183386288-183386319
  hyper
cgagcagctgcgaagccgcgtggcttcccac

SEQ ID NO: 47684 - DNA, 201 bp, Homo sapiens
  chr1:183386626-183386827
  hyper
agcctccgcccggccccctccccgtcctaggcagcgggtccctgaggccgaacctaggcggaaaagggccccctccctattcactcagcatccacctcgcgcgggcaatacacggcccacaattcccaaacactggtccctgggccgcccagaatcaccagccaaatccgaaattaatcttgaagccccagcccctgtcac

SEQ ID NO: 47685 - DNA, 302 bp, Homo sapiens
  chr1:183386964-183387266
  hyper
ccccatcccggtcttcgccagcctggtagccgaaccaccgcaccgccacactccagttctggtatctcgaacccctgcccagccccaaatgatactcatctctagtcccctcccatcccccacctttggccccctgcgagccgggtctggccccggcaagtgacgcctcggaaacgcagtctgcgtaccctcccctgagtccaaaatgaaggggccgacctccaccagctggatgagccggcccacccctccgaaggggcacacgccttcccgttcgatcgccctggaaaacacaggtgcct

SEQ ID NO: 47686 - DNA, 304 bp, Homo sapiens
  chr1:183387319-183387623
  hyper
aacatctgaatgtgccctttggtgatgggattgaagctgccgcaggcgagcaagataacgtgggtcttggtggtctcggtcatggtgcagatgggtccttcgcggtggtctaggggttgcctctctttttgtgtctcgttgtgtctgcagagggagaaaggaaggcgaggctccggcggtggatgctgtggactccaaggagccgctccagacgcaaaccgcgtcactctccgcctccccttaacgcttgcagctccggctagatccgaggctgcttttgtattgctctgctctcttctctcct

SEQ ID NO: 47687 - DNA, 6 bp, Homo sapiens
  chr1:183387662-183387668
  hyper
cgcctg

SEQ ID NO: 47688 - DNA, 146 bp, Homo sapiens
  chr1:183774098-183774244
  hyper
tcagaactggagaaacgctttcatgctgactttatccatgggactgaagaaagggagagtgtgctcacaagcacaaacaggaaagccttacatcacggagtggcgtggggaggagtctgctcctcgcttgctcgctcgctcgccgc

SEQ ID NO: 47689 - DNA, 66 bp, Homo sapiens; identical to SEQ ID NO: 17269
  chr1:183774363-183774429
  hyper

SEQ ID NO: 47690 - DNA, 224 bp, Homo sapiens
  chr1:184005477-184005701
  hyper
caagcttctttcctccggggacaaaacttggctgtttatctttcccagggcatcttcgtctctccccgggacgtggaaccccgatgcaccggcagggacagcccggagcgctcgcaggagaccaggcccacggtggtgccatggttgggcacactccgcgggctccgcccaatctccacccctaggtccaggtccccctaggagagctaggagcacatttccag

SEQ ID NO: 47691 - DNA, 824 bp, Homo sapiens
  chr1:184005814-184006638
  hyper
atacggcgacaggcaccctatcccctcacgtcagggctagcagtatgaggtggggaaagaggaaacctcgagagttaaaagcgagggaactgaaagtccccttgaggggtgtcccccatgccccttgtgggacaaagccccaattcgcaggctaccctccagagctccagcggtccggttctccccatcagcaccctctgcgcacactgacccgcgcgtccctccgcagcctgaccgcccgatccgccagccaccggcgcgggcagcgagggggtgtgtgcgccagattttccgcgtgcccccccgcccctccagcggctccctcgccctgcagctgctgctccgggcgctgtccgcgctgggcaggccgcccccgcgtcccgccgcggcggcccggggcccgtgcgcgctcaccagatggccatcctgctcttggggtagtccagccgctccaggcagccgaggaagtgcggcagcgtgtgcgccgcgttgcgggcgaggaccgccacgagcaccgtggggctctgcaggggcgactccgggaaaaccaccggctcctctccgtcgtcctccgagtcccgctcggcgacgaagcgcgctcggcagccttcgcggagcagggctgaggagaggagcagtagcgaccaggcgagggtggcagcagggcgcgcagccatgttccgggccgaggcgggcggcggggaagtcctggcgcgagcgcccggctgggctgcctgagggcggcggcggctgccggggagcaaggggctgcgaggggcggccgggggatgcggcttgccgcggccggccggctcacacactgg

SEQ ID NO: 47692 - DNA, 34 bp, Homo sapiens; identical to SEQ ID NO: 26765
  chr1:184633316-184633350
  hyper

SEQ ID NO: 47693 - DNA, 71 bp, Homo sapiens; identical to SEQ ID NO: 26766
  chr1:186649956-186650027
  hyper

SEQ ID NO: 47694 - DNA, 429 bp, Homo sapiens; identical to SEQ ID NO: 26767
  chr1:190444251-190444680
  hyper

SEQ ID NO: 47695 - DNA, 20 bp, Homo sapiens
  chr1:190445161-190445181
  hyper
gggcgccaagtggtgcggac

SEQ ID NO: 47696 - DNA, 378 bp, Homo sapiens
  chr1:190445276-190445654
  hyper
acttttatgtctgggagctaaaagggcttttgaatttaaaaaaacattgcttgggttgtcgcgtcagccatcaatgacgacaagaatagttatttcccagaaattaaaaaaaaaaaaaaggaaaagaaaagcgtgaacaataggttcttacctccatgtatcccaagaaaaggaaatgttgtagagaccaggaacttgtccttaatttgagggcggggggcggatgttcagagaaaaccctcagtgggtgttaaaaattaccgatacatgcaggtttggcatttaatgaatatcgtgctttcctcattatgtgtcaattgtgaagtaaaagtaaagattaaaatgtttctcaacacaactatacggaagaggaggtga

SEQ ID NO: 47697 - DNA, 5 bp, Homo sapiens
  chr1:190447285-190447290
  hyper
cgacc

SEQ ID NO: 47698 - DNA, 9 bp, Homo sapiens
  chr1:190447291-190447300
  hyper
gtcacatta

SEQ ID NO: 47699 - DNA, 195 bp, Homo sapiens; identical to SEQ ID NO: 17274
  chr1:190447519-190447714
  hyper

SEQ ID NO: 47700 - DNA, 64 bp, Homo sapiens; identical to SEQ ID NO: 26773
  chr1:196577371-196577435
  hyper

SEQ ID NO: 47701 - DNA, 243 bp, Homo sapiens
  chr1:196577858-196578101
  hyper
cactttccttaaaggcagttgccagatcctcccagagggcagcctcccggctactgttccctcgggcgggcttgcatccggcacagccctgagctggcgggaatcgggggcggtgggtttcggccccagacgcggccaacccggctctccccgcaatctccctgtggagatggagctggaggcccagccaatgagactccccctcattagcatagcacagtgacggcacgggggtgccttggg

SEQ ID NO: 47702 - DNA, 210 bp, Homo sapiens
  chr1:196578150-196578360
  hyper
ttctctgggaggaggggggccagggtgcttggagtgttccactatgccacgagctccctcgctttgattgccttcagtccaggtgggcgggatgaaaaaattgcacgtttctggaaagggaatccccactctcagccccaggaaaatcccatttttttctcacattctgaaagaagggaggtgtttccctgaactcggggaaaaagaagg

SEQ ID NO: 47703 - DNA, 915 bp, Homo sapiens
  chr1:197880156-197881071
  hyper
cgggcgtccccccacaccccccccccactgcgccctggacccacgccacgcaccgccaaggagtagctatggtggcacgtggaggaggggcgggtaggcagggcggcaccatcaccgggaccagcatcttggaacggtcaatctcactgctcatactctcctccctaccggcgcgggagccttgctgtaatcccctgccaccccatctccgactgtgaggggcgcaccgggtgggggaatgggtaaataactggcccaaggcccagcttccaggtcctccctccactttcccgcggcctgactgcgccccgggcaacacagccccttgggaacctgcgaccaggtaatgtggcctccgccccgtcccgggtctggctgcatcccctctaacccctgcctgcccgggtccaagtgagggttttctcccggaaggttaatcaccacccccatcccctagccgggtcccgggaggaagagatgccccggctctctcgttgacccggcctcgaacgccgacctcgagcgcagaatactcccgagtgctgggttcctgatacccagcccgggagcgaggggagtgaaggagggaccgggacaggaaggcggggacgcggtgggtgaacaatcaatggcttagcctagtttccccgcaggagctaccgcccattcaccgtctatgcaagcaccagctggcggcagcatcttttaggtacaagctgcagggaggcaaaagctggctggggggccgggagcccagggcacgccgcgggactccagtccccctgctgcgccccagcctcaagacgctctgggctttatgaggttcagttaccgccgagtcctccattaacacctcctctgattattgagaggctggaagggctgaacgcaacctcagagcgtttctctgggcac

SEQ ID NO: 47704 - DNA, 192 bp, Homo sapiens; identical to SEQ ID NO: 26777
  chr1:197881412-197881604
  hyper

SEQ ID NO: 47705 - DNA, 7 bp, Homo sapiens
  chr1:197882201-197882208
  hyper
ctccctt

SEQ ID NO: 47706 - DNA, 26 bp, Homo sapiens
  chr1:197882427-197882453
  hyper
ttggccgggaagtaccgcccagcgaa

SEQ ID NO: 47707 - DNA, 60 bp, Homo sapiens; identical to SEQ ID NO: 5850
  chr1:197885234-197885294
  hyper

SEQ ID NO: 47708 - DNA, 201 bp, Homo sapiens
  chr1:197886851-197887052
  hyper
ctttccctccatcctcgagcgtctctgcgctcctacagggcagccctctctggtcccttgcctccttcactcggatgagctgaaagccccgggcgtgtgtatatggaaatagtggggtgccgagcagaagacaactcgtgtcctttccgccccccagccatgctctttcacgggatctccggaggccacatccaaggcatc

SEQ ID NO: 47709 - DNA, 311 bp, Homo sapiens; identical to SEQ ID NO: 17282
  chr1:197887741-197888052
  hyper

SEQ ID NO: 47710 - DNA, 344 bp, Homo sapiens
  chr1:197889286-197889630
  hyper
caaggaggattactacaggtactcccctacacccccacttcctacgcccgagtacacctggaggggccatctgcctgagcccggaatcccctctccgtcccctaccttttgccccattccgggtgctgttatcatttcggagaccaggcaaacccactgcatatgccttcaagctgtaatctccctgaccgacggtgagggtgggtgggagggacattaaaaatctagagctttatcagcgaataccacgcactcccatcacttctcagcttggctggcggaacttggggaaatctggggaagagtaaatggacgtggtctccgtctaccgagacttgattggg

SEQ ID NO: 47711 - DNA, 71 bp, Homo sapiens; identical to SEQ ID NO: 26786
  chr1:197890716-197890787
  hyper

SEQ ID NO: 47712 - DNA, 240 bp, Homo sapiens; identical to SEQ ID NO: 26787
  chr1:199998199-199998439
  hyper

SEQ ID NO: 47713 - DNA, 30 bp, Homo sapiens; identical to SEQ ID NO: 5860
  chr1:199998758-199998788
  hyper

SEQ ID NO: 47714 - DNA, 50 bp, Homo sapiens; identical to SEQ ID NO: 26789
  chr1:200008515-200008565
  hyper

SEQ ID NO: 47715 - DNA, 37 bp, Homo sapiens
  chr1:200010114-200010151
  hyper
gggtctggctgctatgggaacccggttggtccaaaga

SEQ ID NO: 47716 - DNA, 266 bp, Homo sapiens; identical to SEQ ID NO: 26793
  chr1:201252527-201252793
  hyper

SEQ ID NO: 47717 - DNA, 42 bp, Homo sapiens; identical to SEQ ID NO: 26794
  chr1:201437622-201437664
  hyper

SEQ ID NO: 47718 - DNA, 105 bp, Homo sapiens; identical to SEQ ID NO: 5866
  chr1:201437682-201437787
  hyper

SEQ ID NO: 47719 - DNA, 73 bp, Homo sapiens; identical to SEQ ID NO: 26796
  chr1:201438552-201438625
  hyper

SEQ ID NO: 47720 - DNA, 218 bp, Homo sapiens; identical to SEQ ID NO: 26797
  chr1:202183428-202183646
  hyper

SEQ ID NO: 47721 - DNA, 234 bp, Homo sapiens; identical to SEQ ID NO: 26798
  chr1:202611761-202611995
  hyper

SEQ ID NO: 47722 - DNA, 127 bp, Homo sapiens; identical to SEQ ID NO: 26799
  chr1:202613418-202613545
  hyper

SEQ ID NO: 47723 - DNA, 133 bp, Homo sapiens; identical to SEQ ID NO: 26800
  chr1:202678970-202679103
  hyper

SEQ ID NO: 47724 - DNA, 190 bp, Homo sapiens
  chr1:202679518-202679708
  hyper
accgctgccccaactcggctccgaagtgcctttgccgcaagacttgctgagcttagcagtctgcgccgaggcggcagagggagggggcctgatcgatgggcgcgcgcggcgagcgctgcagtgaggggaggagaccaagcggcgtgggagggcggggaccgaggcggaggaggcccggaggaggcggagg

SEQ ID NO: 47725 - DNA, 23 bp, Homo sapiens
  chr1:202936931-202936954
  hyper
atcgcgcccggccccaagatctt

SEQ ID NO: 47726 - DNA, 136 bp, Homo sapiens; identical to SEQ ID NO: 5870
  chr1:202996095-202996231
  hyper

SEQ ID NO: 47727 - DNA, 15 bp, Homo sapiens
  chr1:202996304-202996319
  hyper
cggtggggtggaagg

SEQ ID NO: 47728 - DNA, 179 bp, Homo sapiens; identical to SEQ ID NO: 26805
  chr1:203087019-203087198
  hyper

SEQ ID NO: 47729 - DNA, 135 bp, Homo sapiens; identical to SEQ ID NO: 26806
  chr1:203096868-203097003
  hyper

SEQ ID NO: 47730 - DNA, 161 bp, Homo sapiens; identical to SEQ ID NO: 26807
  chr1:203097280-203097441
  hyper

SEQ ID NO: 47731 - DNA, 95 bp, Homo sapiens
  chr1:204653466-204653561
  hyper
aacagatgggagctgcggcagcctgaggaacagagcacaaagcccagctgacattttccttcctgttcgtttgggtgggggaggaagggtaggga

SEQ ID NO: 47732 - DNA, 212 bp, Homo sapiens; identical to SEQ ID NO: 17293
  chr1:204653807-204654019
  hyper

SEQ ID NO: 47733 - DNA, 83 bp, Homo sapiens; identical to SEQ ID NO: 26810
  chr1:204654686-204654769
  hyper

SEQ ID NO: 47734 - DNA, 145 bp, Homo sapiens; identical to SEQ ID NO: 26811
  chr1:204797791-204797936
  hyper

SEQ ID NO: 47735 - DNA, 129 bp, Homo sapiens; identical to SEQ ID NO: 26812
  chr1:204798148-204798277
  hyper

SEQ ID NO: 47736 - DNA, 89 bp, Homo sapiens
  chr1:205312507-205312596
  hyper
ggtgacggccacccccgcccgggctgtgggcagccggggcaaggcggtccactggtcggcctccggggagtagacctcgaagcagtcca

SEQ ID NO: 47737 - DNA, 45 bp, Homo sapiens; identical to SEQ ID NO: 26814
  chr1:205312961-205313006
  hyper

SEQ ID NO: 47738 - DNA, 453 bp, Homo sapiens; identical to SEQ ID NO: 26815
  chr1:205399652-205400105
  hyper

SEQ ID NO: 47739 - DNA, 64 bp, Homo sapiens
  chr1:205424957-205425021
  hyper
ccctcagccgcactcgggcccccaacccggccaaggggtcgccaactcgcggcactttctgcct

SEQ ID NO: 47740 - DNA, 535 bp, Homo sapiens; identical to SEQ ID NO: 26817
  chr1:205425423-205425958
  hyper

SEQ ID NO: 47741 - DNA, 493 bp, Homo sapiens; identical to SEQ ID NO: 26818
  chr1:207627640-207628133
  hyper

SEQ ID NO: 47742 - DNA, 175 bp, Homo sapiens
  chr1:207669321-207669496
  hyper
cgcgggatccatcggaagcccgagcattgtcaagctctgctgctgcacctgggtcagcaaggtgggctctgccagcgaaactcgttagaaacaatgcaaatggggagtaaacatgacctcgcccatgaaggggaagctgtggtcaaaagcattttgtcccggaaccccgcagccc

SEQ ID NO: 47743 - DNA, 15 bp, Homo sapiens
  chr1:208083989-208084004
  hyper
tcctccccagtctcc

SEQ ID NO: 47744 - DNA, 258 bp, Homo sapiens
  chr1:208084031-208084289
  hyper
cgcctctggcaaccagaagagaccctggcatctccaaagcgctttatctcagtccattggaaccagtcgtgctgaccgattcacacctcggctaacgcacactcgcgggggtgatggccttcccttcccctcccacccccgtcagctcccaggtgaggcgctggccccggggggaagcagctgtgggcggcagtgcgtgggttgggcaggggtcccttccctccgtgagactctgctctgctgttcagcctcccagaa

SEQ ID NO: 47745 - DNA, 195 bp, Homo sapiens
  chr1:208084488-208084683
  hyper
gcgctcttcccgccccctccgcccgggagaggggtgggggattcttgcttttttcctctcttctcccctccctttttagtcttggcaaggcagcgcctctccttggctgctactaacttgagctcccctggttggtcccaaaggcggagggcgttaggagggaggctgggttgccgccgtcgaggccaaaaaagg

SEQ ID NO: 47746 - DNA, 64 bp, Homo sapiens; identical to SEQ ID NO: 26823
  chr1:209381523-209381587
  hyper

SEQ ID NO: 47747 - DNA, 105 bp, Homo sapiens
  chr1:210111283-210111388
  hyper
cgtggctctccgggccgggcacctgtttcgaatcgaggcgcgaggcgcggtggggcggtggggtggggtggggtaggttggggtgggggcggggtggcgtcacgt

SEQ ID NO: 47748 - DNA, 30 bp, Homo sapiens; identical to SEQ ID NO: 26827
  chr1:210405727-210405757
  hyper

SEQ ID NO: 47749 - DNA, 48 bp, Homo sapiens; identical to SEQ ID NO: 26828
  chr1:211306737-211306785
  hyper

SEQ ID NO: 47750 - DNA, 267 bp, Homo sapiens; identical to SEQ ID NO: 26829
  chr1:211307126-211307393
  hyper

SEQ ID NO: 47751 - DNA, 86 bp, Homo sapiens; identical to SEQ ID NO: 26830
  chr1:212874013-212874099
  hyper

SEQ ID NO: 47752 - DNA, 282 bp, Homo sapiens
  chr1:213123589-213123871
  hyper
cgcggggtcacttctcgggtggttttgtttctcctctgcttccacagttgcaaaccctcgaagtgccacgacccctggggaaactcgatcttaagtcccatggccaaacgctccagcccgcggggctctcaggacaccacagcgatcggatttcgcgtggccgccaggctccccctactcctgtcccctcccgccagagaacccctggagccaatcagagcgtcgcggagcccggggttgtagagtcccgagcccgggacccgcccctctttgttgcggtgg

SEQ ID NO: 47753 - DNA, 644 bp, Homo sapiens
  chr1:213123979-213124623
  hyper
ccagcagccccagccccagccccaggcccagcagcagcagcagcagcccctgctctcccgccgcccggagaggctctgcagccatgaagccaaccgtcccgaggtaggatcttggagctgccgcgcgcccttcctgcgcgccgcccgcctgcagccagtccctcccggtgataggcgctggaactcggggaaaagggggcggatggagctctttccactagatccccgccggggtccgggagggcttcctggaagaaagcgggccgccttgcaagccaaggctgctgcagcgccctcgcgccagctctgggcgctcacatgccagcacgttcgtggctcccctcctctcttggccacatctgaggacccaggaatgtgtggagccttgcgggaacctcctgttccttcatgctacacaagctgtctttcttctccccacatcttgcgctccgcatcccccaagctccttgtgcccctccatccccaaccccccgggtttaggtgtgtgtgaagcttcgtggcacattttgagctgcctttctaggtaatcgcagggctggaagcccgtcatcgattctcagggaggctgtcagcgtgcaggggggagcggggagtgtcgtggagacactccgggacccctcact

SEQ ID NO: 47754 - DNA, 123 bp, Homo sapiens
  chr1:213124910-213125033
  hyper
ccgctgcccccaccccaaaggcgccaaaggcacccggtcccggagcagccacgcgcggcccgtgagcctcgccaccagcgggggctcagaggaggaggacaaagacggcggggtgctgttcca

SEQ ID NO: 47755 - DNA, 30 bp, Homo sapiens; identical to SEQ ID NO: 26833
  chr1:214155741-214155771
  hyper

SEQ ID NO: 47756 - DNA, 98 bp, Homo sapiens; identical to SEQ ID NO: 26834
  chr1:214155985-214156083
  hyper

SEQ ID NO: 47757 - DNA, 60 bp, Homo sapiens; identical to SEQ ID NO: 26835
  chr1:214156134-214156194
  hyper

SEQ ID NO: 47758 - DNA, 2 bp, Homo sapiens
  chr1:214156417-214156419
  hyper
gg

SEQ ID NO: 47759 - DNA, 22 bp, Homo sapiens
  chr1:214156928-214156950
  hyper
acttaagcgacagcaaaagata

SEQ ID NO: 47760 - DNA, 36 bp, Homo sapiens
  chr1:214158802-214158838
  hyper
atctcgctcgcctagcgtggcgcgcgctcctatttc

SEQ ID NO: 47761 - DNA, 110 bp, Homo sapiens; identical to SEQ ID NO: 26839
  chr1:214159571-214159681
  hyper

SEQ ID NO: 47762 - DNA, 134 bp, Homo sapiens
  chr1:214160184-214160318
  hyper
cttgcaaagcccaaggagatctttaagagccacattatctaaagaaattttgctggttatttttcaagcaagaaatgtcaaaccaaagtaaattttctagggctttattttagagcctgcgatttatgcgtttg

SEQ ID NO: 47763 - DNA, 353 bp, Homo sapiens; identical to SEQ ID NO: 26841
  chr1:214162457-214162810
  hyper

SEQ ID NO: 47764 - DNA, 167 bp, Homo sapiens
  chr1:214360508-214360675
  hyper
aacacactctggaaacgctgtggttgtttttcacaggaacccagggagctatcaaagtcggagaacgtgcctctgtttgcaggagaggtgggcaggcagcgagatccccgcgcaccgctcgctcgggctgcgggcaggcagcaatcagctaattgcctaatcggagt

SEQ ID NO: 47765 - DNA, 72 bp, Homo sapiens
  chr1:214360968-214361040
  hyper
gctcagaacacaccgagatcctttagaaataaatgtaatcgagactaatctggaaatcgtccctgcagccaa

SEQ ID NO: 47766 - DNA, 128 bp, Homo sapiens; identical to SEQ ID NO: 26845
  chr1:214387629-214387757
  hyper

SEQ ID NO: 47767 - DNA, 126 bp, Homo sapiens; identical to SEQ ID NO: 26846
  chr1:214725407-214725533
  hyper

SEQ ID NO: 47768 - DNA, 34 bp, Homo sapiens; identical to SEQ ID NO: 17314
  chr1:215255060-215255094
  hyper

SEQ ID NO: 47769 - DNA, 195 bp, Homo sapiens
  chr1:215255799-215255994
  hyper
agataggatgcagcgcagtgtgatgtggatgccagacagcgagagtgaggattttgcggggtggggatgggggttagtggaaggggctgagaggggaggaggcagcaggtgagccaaggggttgtgcccccaggaagagggaagagaggatctttagaagggagcatcttgcaggggcgacgcaggcaagggtag

SEQ ID NO: 47770 - DNA, 606 bp, Homo sapiens; identical to SEQ ID NO: 26848
  chr1:215256219-215256825
  hyper

SEQ ID NO: 47771 - DNA, 100 bp, Homo sapiens; identical to SEQ ID NO: 26849
  chr1:216896454-216896554
  hyper

SEQ ID NO: 47772 - DNA, 87 bp, Homo sapiens; identical to SEQ ID NO: 5901
  chr1:216896887-216896974
  hyper

SEQ ID NO: 47773 - DNA, 145 bp, Homo sapiens; identical to SEQ ID NO: 26851
  chr1:217262983-217263128
  hyper

SEQ ID NO: 47774 - DNA, 423 bp, Homo sapiens
  chr1:217308274-217308697
  hyper
ccgcagcgcccagtttacctggaattcagggacctgaccctgactctatttccggctagtcccagcctctccttcctctcctttccccgctttccgcccagggcggttctgagattttgattaagagagatctgtccccgcaccgcagagggatggtgccaaatggccaggcttcctgggcactgcgtcctcattcccaggtcagagctactgcgaaaggaaaggtctccatctggacgcacctcgtcccctcccccagcgcgcggggcagccctctagggccagctcgggcacgcgcttttccccctcctcaccccctgctccgcccagccccgtacagttttattctttatgaaacacacacgcccaccccgcctcccacgtaaaggccagtcttgactcattttgcgcccagatgcaaac

SEQ ID NO: 47775 - DNA, 59 bp, Homo sapiens
  chr1:217308948-217309007
  hyper
cgaagcggggtcaggcgcggacccacattcaccgactgcagaactgttttctttgccac

SEQ ID NO: 47776 - DNA, 201 bp, Homo sapiens
  chr1:217309105-217309306
  hyper
tcgggccgctgggcgcctccgggatcgctctcactttgcactcggaagcgggcgcggggattcgggctgccgcgtgtagcctataaatagcaaactttttgaccgaagcaactaacaaataagaggagcaggcgtgcattttgctcaagatccccccttttctggggacgaccttactcccacccccgccccctttgcagt

SEQ ID NO: 47777 - DNA, 30 bp, Homo sapiens; identical to SEQ ID NO: 26854
  chr1:217309653-217309683
  hyper

SEQ ID NO: 47778 - DNA, 39 bp, Homo sapiens; identical to SEQ ID NO: 26855
  chr1:217310204-217310243
  hyper

SEQ ID NO: 47779 - DNA, 394 bp, Homo sapiens
  chr1:217310871-217311265
  hyper
gggcctgggaggctgcggtaccgcctgtcggtcccggtcccgagcgcgcttgcttaagagttctcaaagacggggttggaagcagtacagacgtccccggttatcgctgccgggcttgtgcgccccacgccacctacctgtccggccttcccgctccaattgctgacccgtttagggagcccggcctggagcccgccgcctccagaggagcccgccctcgccctcccccgcgcgcctccgctctctgggacgcctggccaaatgcggggcggtctctcgcgggccattggcttgggccaccgttccgagtcagctcctaggatttccccaggctttgcggcccctttgtgggtctaggccagcgcctcaccttgcaccctattccacctccagt

SEQ ID NO: 47780 - DNA, 66 bp, Homo sapiens; identical to SEQ ID NO: 5907
  chr1:217311944-217312010
  hyper

SEQ ID NO: 47781 - DNA, 17 bp, Homo sapiens
  chr1:217313025-217313042
  hyper
cccctctgcaattgccg

SEQ ID NO: 47782 - DNA, 30 bp, Homo sapiens; identical to SEQ ID NO: 5910
  chr1:218337322-218337352
  hyper

SEQ ID NO: 47783 - DNA, 547 bp, Homo sapiens; identical to SEQ ID NO: 26861
  chr1:218337623-218338170
  hyper

SEQ ID NO: 47784 - DNA, 278 bp, Homo sapiens; identical to SEQ ID NO: 26862
  chr1:218338508-218338786
  hyper

SEQ ID NO: 47785 - DNA, 156 bp, Homo sapiens; identical to SEQ ID NO: 26863
  chr1:218339178-218339334
  hyper

SEQ ID NO: 47786 - DNA, 83 bp, Homo sapiens
  chr1:218520399-218520482
  hyper
attttgacttccatcccctgaggtttagctctgcccggagctctcaaaaccgcagcagctcccgggatcgcccttccctctcg

SEQ ID NO: 47787 - DNA, 45 bp, Homo sapiens; identical to SEQ ID NO: 26866
  chr1:219347215-219347260
  hyper

SEQ ID NO: 47788 - DNA, 96 bp, Homo sapiens
  chr1:220101049-220101145
  hyper
agaagaaaaagagggcgtggggtgagaagaaagggaccgggtgggaggaggaaggaagggccaagcggtccaaaggatgcaaccgaaaggcacctg

SEQ ID NO: 47789 - DNA, 228 bp, Homo sapiens
  chr1:220101385-220101613
  hyper
tgagcagccccaccacgttgaccaacagccccaggacgccgacgatgagcaccagctcggggtcatcgatgcgctcgggccgggccaggcgcagcacggcctccacgaagatggtgaagcagagcgcggtgaggaagaccgcgttgctcagcgcgcccaccacctcggcgcgggcgtagccgtaggtggcgctgaagccccgggtggggcgccgggcgatgtagccgg

SEQ ID NO: 47790 - DNA, 30 bp, Homo sapiens; identical to SEQ ID NO: 26869
  chr1:220101929-220101959
  hyper

SEQ ID NO: 47791 - DNA, 35 bp, Homo sapiens
  chr1:220700897-220700932
  hyper
acttgtactgagtctccagccgcctccctaggctg

SEQ ID NO: 47792 - DNA, 303 bp, Homo sapiens; identical to SEQ ID NO: 26871
  chr1:220702162-220702465
  hyper

SEQ ID NO: 47793 - DNA, 90 bp, Homo sapiens; identical to SEQ ID NO: 26872
  chr1:220864103-220864193
  hyper

SEQ ID NO: 47794 - DNA, 436 bp, Homo sapiens; identical to SEQ ID NO: 26873
  chr1:220921624-220922060
  hyper

SEQ ID NO: 47795 - DNA, 243 bp, Homo sapiens; identical to SEQ ID NO: 26874
  chr1:220960315-220960558
  hyper

SEQ ID NO: 47796 - DNA, 31 bp, Homo sapiens
  chr1:221052007-221052038
  hyper
tagcctctgaggctccggggaaaggtttggc

SEQ ID NO: 47797 - DNA, 718 bp, Homo sapiens
  chr1:221052492-221053210
  hyper
tagaagagagtcagagccctccggagcggctgcctggcccctacgcagagtagcaagaagcactgcgatgtgcgctactaagcccacgcggccgcagcaaaaactttggcgtggccggggcgtggctagggtccggccaggcccccttgttcctaattcccctccactccccgctcccattggtcacgaggatgaccaatgagcgctcggatcgaggtcctaccccgggcctgactcgaaagctcctgccaaaactttgggagtttttagagacgagtttttttttttttctattacttttccccccccctaactaacggactattattgttgttgttttaaatttagctcttagggcttagctatttgggttttcttgcggtgtccggctcccgtctccctggctcccccgcccgccctgcggccccagcgcccctcgctctcatccagcccgcgaggagtgcgggcgccgcgccgcctttaaagcgaggccagggagcgaggcggtgaccggccgagatccggccctcgcctcctccctcggtggcgctagggctcccggcctctcttcctcagtgcgggcggagaagcgaaagcggatcgtcctcggctgccgccgccttctccgggactcgcgcgcccctccccgcgcgcccacccacccagtccggctggactgcggcagccgcgcggctcaccccggcaggatgttcgcagc

SEQ ID NO: 47798 - DNA, 355 bp, Homo sapiens
  chr1:221053255-221053610
  hyper
cgcttactgctcctcggccggcccaggcggctgctccttccccttggaccccgccgccgtcaaaaagccctccttctgcatcgcagacattctgcacgccggcgtgggggatctgggggcggccccggagggcctggcaggggcctcggccgccgccctcaccgcgcacttgggctcggttcacccgcacgcctctttccaagcggcggccagatccccgcttcgacccaccccagtggtggcgccctccgaagtcccggctggcttcccgcagcggctgtctccgctctcagccgcctaccaccaccatcacccgcaacaacaacagcagcagcaacagccgcagcagcaacag

SEQ ID NO: 47799 - DNA, 40 bp, Homo sapiens
  chr1:221067466-221067506
  hyper
ccgcaggctgctccccgagtcccaacgctactagggtgct

SEQ ID NO: 47800 - DNA, 129 bp, Homo sapiens
  chr1:221067688-221067817
  hyper
ctgtgtacactttctggctccagagccccgcgcaccagaaggatggggccctgcgagcgcgccccaggccgcgagctggggccgcaggcgccacggccatgtatagtgcccacccgactctgttctgca

SEQ ID NO: 47801 - DNA, 211 bp, Homo sapiens; identical to SEQ ID NO: 26878
  chr1:221914261-221914472
  hyper

SEQ ID NO: 47802 - DNA, 48 bp, Homo sapiens; identical to SEQ ID NO: 17333
  chr1:223302777-223302825
  hyper

SEQ ID NO: 47803 - DNA, 28 bp, Homo sapiens
  chr1:223302890-223302918
  hyper
cagcacccagcagcgccactgggagagg

SEQ ID NO: 47804 - DNA, 186 bp, Homo sapiens
  chr1:223538158-223538344
  hyper
agtctcttaatttcccgcgttaacccctccccgctcccatctccgccgaagctctgcgcgtccccagggagcccgaaggaccatctgaggcggctgagagacactctccccctcccccacacccttggtattttccctctgccagccgcaggtgttgcgagtgaggacccctgtccggtcttggag

SEQ ID NO: 47805 - DNA, 7 bp, Homo sapiens
  chr1:223936626-223936633
  hyper
gccgctg

SEQ ID NO: 47806 - DNA, 153 bp, Homo sapiens
  chr1:223937057-223937210
  hyper
ttttacttgttttagatgttaccctgttttacagttacaaccttactattttgataagctaaaaataataaaacaatgcatcttcatagtgttttatactctataaggtgctttctcttttgatctcgtaaaagtattcgtgcccatgttcaa

SEQ ID NO: 47807 - DNA, 202 bp, Homo sapiens
  chr1:224528612-224528814
  hyper
ggggctccaggtcctcgctgggcacctctctgcccaaccctctgcacccagccggcttctcccccaccgacggggagccccgcctggccccatcgcagagacccccagagcggcgggcttttgttggggggttcccgcttgtccctggctcctgccgtctctgtggagcgcggcaccgccttggatccagctccacctcctc

SEQ ID NO: 47808 - DNA, 24 bp, Homo sapiens
  chr1:224528844-224528868
  hyper
ggtcctgcccggctgcgcaagggt

SEQ ID NO: 47809 - DNA, 55 bp, Homo sapiens; identical to SEQ ID NO: 26884
  chr1:224803348-224803403
  hyper

SEQ ID NO: 47810 - DNA, 287 bp, Homo sapiens
  chr1:224803810-224804097
  hyper
gcttcaagtttcctccgagaggcgggcgtgcacagctgcagtggcggcggcagcggccaccaagcgcccggcggcgcttcgccacccacctttcctcagcccccggcgctgcagtctccgcccgccggggagggcgcgctcagcggaacaggagtcgagggtggggcgccgagaggagggaatcccgggtcgcaccgctacagttctcgcagtggcaaaggcggcggcggcggcggcggcagcggcagcagcaggtggagcgagctacagcgtttggcctgaaaccc

SEQ ID NO: 47811 - DNA, 206 bp, Homo sapiens; identical to SEQ ID NO: 17339
  chr1:224804910-224805116
  hyper

SEQ ID NO: 47812 - DNA, 18 bp, Homo sapiens
  chr1:224805848-224805866
  hyper
cgccggtcctctcaaaga

SEQ ID NO: 47813 - DNA, 395 bp, Homo sapiens; identical to SEQ ID NO: 26890
  chr1:225117226-225117621
  hyper

SEQ ID NO: 47814 - DNA, 62 bp, Homo sapiens; identical to SEQ ID NO: 26891
  chr1:225632491-225632553
  hyper

SEQ ID NO: 47815 - DNA, 30 bp, Homo sapiens; identical to SEQ ID NO: 26892
  chr1:226069474-226069504
  hyper

SEQ ID NO: 47816 - DNA, 43 bp, Homo sapiens; identical to SEQ ID NO: 26893
  chr1:226150283-226150326
  hyper

SEQ ID NO: 47817 - DNA, 207 bp, Homo sapiens; identical to SEQ ID NO: 26894
  chr1:226411017-226411224
  hyper

SEQ ID NO: 47818 - DNA, 427 bp, Homo sapiens
  chr1:226411273-226411700
  hyper
tctccccgagcccacctttgatcgcaccgccccgccttcccagcccctggcccgggagggtataagtgcggcccgcgcccctccgagcggcgcgctgggttccggagcgatggccacagccgagtcccgtgcgctccagtttgccgagggcgccgcgtttccagcgtaccgggccccccacgccggcggggcgctcctgccgcccccgagccctgcggcagccctgctccctgcgccgcccgcgggccccggcccagcgacctttgcgggcttcctcggccgggaccccgggccggccccgccgccccccgccagcctgggctcgcctgcgccccccaaaggcgcggccgccccgtcggcgtcgcagcgccgcaagcgcacgtctttcagcgccgaacagctgcagctgctggagctcgtcttccgc

SEQ ID NO: 47819 - DNA, 172 bp, Homo sapiens
  chr1:226411832-226412004
  hyper
gtctggactgcgggctcctgaggccacacccgggacgttgcaggcacggtgcttcccctgaggctctgcgtactagactgaaatagggggtgatatcggcacctgctgcatagggtggttgcgaggcctgtgtgaaataatttaggcctgcactgaacgatttctctcatta

SEQ ID NO: 47820 - DNA, 83 bp, Homo sapiens; identical to SEQ ID NO: 26896
  chr1:226736126-226736209
  hyper

SEQ ID NO: 47821 - DNA, 692 bp, Homo sapiens; identical to SEQ ID NO: 26897
  chr1:226736861-226737553
  hyper

SEQ ID NO: 47822 - DNA, 15 bp, Homo sapiens
  chr1:226924815-226924830
  hyper
gccaccacctgctgc

SEQ ID NO: 47823 - DNA, 167 bp, Homo sapiens; identical to SEQ ID NO: 17346
  chr1:226924900-226925067
  hyper

SEQ ID NO: 47824 - DNA, 419 bp, Homo sapiens
  chr1:226925195-226925614
  hyper
cgctcctgctccgccgccggcgcctcctcctcccggcgctcccggctcagccccggaggcccggcagccgcggctccgcgcgcagatggggcggcatggcctgggcagcgggctgggggcacgaccgcgggctcagcccccgcccaaagctccataaacaaccgtgcggctgtggagatacaaggagaaaagtcaggaccctggagggcgcgcggggggagttgggggtcgcctgcagaacccagagagagccccgggaacacaatctatccgggacccagcgccaccggacatctcacctatggggacggcgaggctcggcgagggcatgccccggctgcctcggtcgccagcgcggtttcgggtgtgcttccccgccccccacctcgccccaggctgcgatgcgctttatgaggtcc

SEQ ID NO: 47825 - DNA, 132 bp, Homo sapiens; identical to SEQ ID NO: 26900
  chr1:227505711-227505843
  hyper

SEQ ID NO: 47826 - DNA, 37 bp, Homo sapiens
  chr1:227730075-227730112
  hyper
cagcagcccggacagccgcttccgcccctgcgccgcc

SEQ ID NO: 47827 - DNA, 273 bp, Homo sapiens; identical to SEQ ID NO: 26902
  chr1:227730322-227730595
  hyper

SEQ ID NO: 47828 - DNA, 30 bp, Homo sapiens; identical to SEQ ID NO: 26903
  chr1:227975163-227975193
  hyper

SEQ ID NO: 47829 - DNA, 89 bp, Homo sapiens; identical to SEQ ID NO: 26904
  chr1:228074787-228074876
  hyper

SEQ ID NO: 47830 - DNA, 169 bp, Homo sapiens; identical to SEQ ID NO: 26905
  chr1:228134702-228134871
  hyper

SEQ ID NO: 47831 - DNA, 3 bp, Homo sapiens
  chr1:228135301-228135304
  hyper
acc

SEQ ID NO: 47832 - DNA, 328 bp, Homo sapiens; identical to SEQ ID NO: 26907
  chr1:228135362-228135690
  hyper

SEQ ID NO: 47833 - DNA, 161 bp, Homo sapiens; identical to SEQ ID NO: 26908
  chr1:228194250-228194411
  hyper

SEQ ID NO: 47834 - DNA, 650 bp, Homo sapiens
  chr1:228194727-228195377
  hyper
agggcccagcgacgccgccgcgccagctcccagggcccggccccccccggcgctcacgctctcggggcggactcccggccctccgcgccctctcgcgcggcgatggccccactcggatacttcttactcctctgcagcctgaagcaggctctgggcagctacccgatctggtggtgagtgagcctcctcgcgttcgcccctgcccctgtgcgccgcgcccgcagcagacggtcccctcgggcagggaccccgcggtggcccgagcccgcgcccttctgctccagccccgcgtgcgggccgcgggcggttggttttccttgacggccactttggacctgttcaggccgctgggacgcgtgggtggcggagtttccggagacattgattcccgagcgggggagtaggggaggttgcggaggtcctagctgcccctggcgtcggacagggcgagcagtgggctggggagaggctgaaagaaggtcggcacgcacggtcaccgaggggacaggcagctcgaggccaggggacaggcgagggaagagggccagcgagagagaattcgccggagactttcctcaaaaaccgtatcttacacacaaacacacacacacgttttaaaacaaagtcgatgagacaagactgaacagctc

SEQ ID NO: 47835 - DNA, 176 bp, Homo sapiens
  chr1:228196349-228196525
  hyper
agggagccaggggcagcgcgtccgtccgagagagccccgagggctgccggcttacgcaccaggcttctaattagaacccgccgccgcgttcctgagcgcaaaaggaagctccttcgccccgcgcccttcccataaatgtcgccagcctcctggcaaccccgcgccctaggatcttt

SEQ ID NO: 47836 - DNA, 109 bp, Homo sapiens; identical to SEQ ID NO: 26910
  chr1:228225753-228225862
  hyper

SEQ ID NO: 47837 - DNA, 16 bp, Homo sapiens
  chr1:228248332-228248348
  hyper
ccgtctctgctctgct

SEQ ID NO: 47838 - DNA, 124 bp, Homo sapiens; identical to SEQ ID NO: 26912
  chr1:228248612-228248736
  hyper

SEQ ID NO: 47839 - DNA, 106 bp, Homo sapiens
  chr1:228463205-228463311
  hyper
agctggaggtgggagcggggcttaaggaagcttcctggtttcctcgcttaaagtcgcacccgggagggtgcgcagctgcggcccgcgtgtggccagggccgcgctg

SEQ ID NO: 47840 - DNA, 117 bp, Homo sapiens
  chr1:228463706-228463823
  hyper
aggccaaactcaccgtggagagtgagccgcgggcgggaagggcggggcatcgaggaggagtgaggagggaggcggggcattgaggattagtgaggacgtaggcggggtgctgagggg

SEQ ID NO: 47841 - DNA, 45 bp, Homo sapiens; identical to SEQ ID NO: 26914
  chr1:228566475-228566520
  hyper

SEQ ID NO: 47842 - DNA, 61 bp, Homo sapiens; identical to SEQ ID NO: 26915
  chr1:228566903-228566964
  hyper

SEQ ID NO: 47843 - DNA, 233 bp, Homo sapiens; identical to SEQ ID NO: 26916
  chr1:228603691-228603924
  hyper

SEQ ID NO: 47844 - DNA, 355 bp, Homo sapiens
  chr1:228604254-228604609
  hyper
cccgcacagcgcctagtgcacctggccgagcgctcgctgccgggaaaggctgggtctgcccccacgaagcccaggaggctgcggcccggcccggggcgtggggacctggggtcgggaggcctagggactttgtggcgtcagcgggggctggggggcggcgggggaggggaatgctgggcgagggagtgttcggcggccgggactggggcggcgcctcttaggagaggttgggggtggcttggggaaggaaggcggcagggggtggaaggctctggacgagccggggacaggcgcagcgggtgctgactgggcggtggggaggatgtggtccacagcccagcgaagggaggagtct

SEQ ID NO: 47845 - DNA, 339 bp, Homo sapiens; identical to SEQ ID NO: 26918
  chr1:228633581-228633920
  hyper

SEQ ID NO: 47846 - DNA, 29 bp, Homo sapiens
  chr1:228633921-228633950
  hyper
gcttctctgcagctgtacaccctgcactg

SEQ ID NO: 47847 - DNA, 7 bp, Homo sapiens
  chr1:228633983-228633990
  hyper
cgcaggt

SEQ ID NO: 47848 - DNA, 172 bp, Homo sapiens
  chr1:228644968-228645140
  hyper
tccccatggccactgcgctcattcatgagcctagggtgatcaggcctccggcctataaagaactgcaggatcagtgcggctcttttctcgagatagtaggtggctctgaaaagagcctttatgtccatcaaaggggccccgggggcggcgggcggcctcacttgcccttggc

SEQ ID NO: 47849 - DNA, 175 bp, Homo sapiens
  chr1:228645734-228645909
  hyper
gaagtgagcaaatcctgagccttcatttgaatacaaaacgtacaaatagagttactccgagcgccgcgcgtttctgtttggagagactcagccatcatgccagacccgtccaaatcggctcctgcgcccaagaagggttctaaaaaggctgtcaccaaggcacagaagaaggacg

SEQ ID NO: 47850 - DNA, 3 bp, Homo sapiens
  chr1:228646029-228646032
  hyper
tca

SEQ ID NO: 47851 - DNA, 91 bp, Homo sapiens
  chr1:228646238-228646329
  hyper
ggctcttttcagagccacccacacgatcaagaaagggtttcgaacacggtgaagggttatgtaacctaatgtgtctccatgcaccctagcg

SEQ ID NO: 47852 - DNA, 82 bp, Homo sapiens; identical to SEQ ID NO: 26925
  chr1:228646859-228646941
  hyper

SEQ ID NO: 47853 - DNA, 100 bp, Homo sapiens; identical to SEQ ID NO: 26926
  chr1:228647217-228647317
  hyper

SEQ ID NO: 47854 - DNA, 178 bp, Homo sapiens
  chr1:228651254-228651432
  hyper
tttgggggtaaaatacgagaatcccttaattggggaaattttagctgagtgataaggagatctgtgagcctgctgttttgatgtttcaagcaggaaggcgtggcataaagagctgcttaggcgcaacgctgctgaaatggttttggctagaagctcacagtgtctagttgtggctaag

SEQ ID NO: 47855 - DNA, 253 bp, Homo sapiens; identical to SEQ ID NO: 17365
  chr1:228651626-228651879
  hyper

SEQ ID NO: 47856 - DNA, 30 bp, Homo sapiens; identical to SEQ ID NO: 26930
  chr1:228871287-228871317
  hyper

SEQ ID NO: 47857 - DNA, 25 bp, Homo sapiens
  chr1:229542813-229542838
  hyper
catgctgaggttggtcgcttgtttc

SEQ ID NO: 47858 - DNA, 312 bp, Homo sapiens; identical to SEQ ID NO: 26932
  chr1:229543220-229543532
  hyper

SEQ ID NO: 47859 - DNA, 150 bp, Homo sapiens
  chr1:229566603-229566753
  hyper
ggggaacaccataggcggagctgagacgccctctgagaaacagctctccagccccagcaccatggtcagcgcccgctgcctgaggggacccagggccaccagcggaggccgccccggcagtgctggcaacactcgggagcgctgcgcaga

SEQ ID NO: 47860 - DNA, 146 bp, Homo sapiens; identical to SEQ ID NO: 17369
  chr1:229568204-229568350
  hyper

SEQ ID NO: 47861 - DNA, 352 bp, Homo sapiens
  chr1:229569458-229569810
  hyper
agggaactgccttggcgacaactaaagcaaaaccgtttatctccctaggcacatcctacatgccaggtaaaggagcccaaaggggctagagaaaaatttggagaagtctaatttccagaggctgactgtcttgcctcctttttaaagcgcgtgtggctccggagacgaggcacagcgctcagggcgcaggcctggggctgaccaggtgaaccgactgggttctgccccggagtccttcaggttcccctcggtagtgccctgtccccctgtcccctcccaactcctgccctacctgggcgggtagctacaactgctactctcggctcgggccctggtcgccgcggaggggaag

SEQ ID NO: 47862 - DNA, 734 bp, Homo sapiens
  chr1:229569852-229570586
  hyper
cctctgctcaggttttatatagcccgcgggcattccctccgcgccaccccgcaggaatgtcgctgcccttctcgagccatatttgggtgttgggcactagagccccctccctcggccggttcgcggcctgggcccccgcccgggtcccctgcgttgaccaaagaaggagcgggttggcccggtcccaggtaacgcgggccgggccgtatatggagtgtctccctagcgggtttgcccctcctgacccgacccagttgcccgccggaggggatggggtggggcgagggtcaccgcgttcgccggtgggtgcatgtgtgcgcctgcgctccgggaaccgcacctgtcccaaaggcctccccaaccatgtccactctgagcgccctgggcgctcgggaaggtgcctgactgctgacttccaatatttcaactcctcttcgggttctttgctcagatccccaaactcccacttgcgactaccgggaagagggagtcgtgtggagtggtgggcttgggaggattggagaagcagtcactcctgagtctcaggaagggaaggaaggcgaactccctctcctttacgcccctggaactccatttctctcttcccacccccgagctccctgaatccaaaaagctgagccacgtcgaccccttcccccaccgcacagagggccaccggcggccggagggcgcgcagctgtcgcaggatagacaactggcggggggaggcgagg

SEQ ID NO: 47863 - DNA, 30 bp, Homo sapiens; identical to SEQ ID NO: 26938
  chr1:230240615-230240645
  hyper

SEQ ID NO: 47864 - DNA, 120 bp, Homo sapiens; identical to SEQ ID NO: 26939
  chr1:230561556-230561676
  hyper

SEQ ID NO: 47865 - DNA, 37 bp, Homo sapiens; identical to SEQ ID NO: 26940
  chr1:231296747-231296784
  hyper

SEQ ID NO: 47866 - DNA, 286 bp, Homo sapiens; identical to SEQ ID NO: 26941
  chr1:231296817-231297103
  hyper

SEQ ID NO: 47867 - DNA, 88 bp, Homo sapiens
  chr1:231297221-231297309
  hyper
tctgggggcgctgggttcccaggggtctacccgggcgcgctctcgcctttctcaggaaaccccattttgtgagcggcaccgcgtgtcc

SEQ ID NO: 47868 - DNA, 30 bp, Homo sapiens; identical to SEQ ID NO: 26943
  chr1:231297520-231297550
  hyper

SEQ ID NO: 47869 - DNA, 798 bp, Homo sapiens
  chr1:231297797-231298595
  hyper
gaaattacaactcctcggcgcgccgcgcggggaggcagcggcagcggcgggagggaggcggggaggggattcccgagccagccggacgctcgccctccgcccgccggctgcagcgtcgcgcggcccaaggtcagaggcgccgcaggagcagcagctgggaaccagggaagcgggtcaatcccggccgcagggagaaagccccagggcgcagtcagccggcgtccacagccgcccaggagtagggtgagcggctgtctccgggccggtcgggtcccgccgaggtggccgcggccccagcgacccggcgggtggcggcccaggggtcggcgagcaggcagctggagccccaccttcggctcccgggcgctgtccgccgcctcgtggtgctgatcccagccccacggctgagcggccttcgcacctgcctgtctcacctcgctatcaccccgataaggagttgggccggggcagaaggggggcctcggggtagccgcccaccggagccaggggctgaagcagcgagcgcacagcagcccggccgctggtcctggggtggagaggaggcgcgcgctgcagccggcggcggcgctggtgctgattcatcacctaaagctcctcgcaggccaccgcgagggcagccgaccggctccggaatctggccgcaggttgaagccgctggtgcgggaccctcgggcaggaggtgaggaccccctcccttctctcgcccctcaatcatcttagggcggtggctacaggacagagagaggggcgtgcccctcggctgtgaagtgggcatgc

SEQ ID NO: 47870 - DNA, 155 bp, Homo sapiens; identical to SEQ ID NO: 26945
  chr1:231298924-231299079
  hyper

SEQ ID NO: 47871 - DNA, 25 bp, Homo sapiens
  chr1:231299434-231299459
  hyper
atcccggggacccttcgccaagcat

SEQ ID NO: 47872 - DNA, 163 bp, Homo sapiens; identical to SEQ ID NO: 26947
  chr1:231299478-231299641
  hyper

SEQ ID NO: 47873 - DNA, 38 bp, Homo sapiens; identical to SEQ ID NO: 26948
  chr1:232765315-232765353
  hyper

SEQ ID NO: 47874 - DNA, 162 bp, Homo sapiens
  chr1:234040319-234040481
  hyper
tccaggcggagcgcgggcgcgaggtgcgggctccggggcggagcgcacgcccgggaggcgggaagtgggcagcagcgcccccgcctggcccctgtgcgccccgacccgacgcctccccgcccgaccaggtgcctcgagagcgcacagctgggagggctctcc

SEQ ID NO: 47875 - DNA, 213 bp, Homo sapiens; identical to SEQ ID NO: 1897
  chr1:234041148-234041361
  hyper

SEQ ID NO: 47876 - DNA, 119 bp, Homo sapiens
  chr1:234349869-234349988
  hyper
cagggatgagggctgcggggctgggcgtcccggggaggagggcggagcaggtgagctgcggggtgggagcagggagtgcacttgtacgtgacgttggagtttgcagcaacctccaagta

SEQ ID NO: 47877 - DNA, 208 bp, Homo sapiens
  chr1:234350100-234350308
  hyper
gaggccgggactgagaggggcgagccgctggtgctccccggcggcagagggccgcgtcggccacgggcccgggagagacgcgctccagccggccccaggatgtaggcgatcggcggcagcgctcctgcaggcggccggctcatcatgaagaagcactcggcccgggtggccccgctcagcgcctgcaacagtccggtcctgaccctta

SEQ ID NO: 47878 - DNA, 279 bp, Homo sapiens; identical to SEQ ID NO: 5978
  chr1:235812015-235812294
  hyper

SEQ ID NO: 47879 - DNA, 444 bp, Homo sapiens; identical to SEQ ID NO: 26957
  chr1:235812717-235813161
  hyper

SEQ ID NO: 47880 - DNA, 145 bp, Homo sapiens
  chr1:235813636-235813781
  hyper
cggaggggtctggggcggggccggggttgctggaggggtctggggacggggccgcggtcagcgcgggctccccgaagcctcaggtaccgccctcgctcggggtgagctccagcgcctgggccgttggggcgcgggccgcttccca

SEQ ID NO: 47881 - DNA, 112 bp, Homo sapiens; identical to SEQ ID NO: 17383
  chr1:236228096-236228208
  hyper

SEQ ID NO: 47882 - DNA, 19 bp, Homo sapiens
  chr1:236228563-236228582
  hyper
gcagcccaatggccgcgag

SEQ ID NO: 47883 - DNA, 62 bp, Homo sapiens
  chr1:236228789-236228851
  hyper
cgctcggccgcgtccggggtccaattcgcttgaccctggtaggaagacggggtgggagctgg

SEQ ID NO: 47884 - DNA, 31 bp, Homo sapiens; identical to SEQ ID NO: 5986
  chr1:236558486-236558517
  hyper

SEQ ID NO: 47885 - DNA, 629 bp, Homo sapiens
  chr1:236558547-236559176
  hyper
cgcccagggggacgtgggtaccgggcaggacgcgcgctctgggcgctggggacgcccgggacactcggggccccgccttgcgtcccagccccgggtcgcggcaccccggctcccgccccgcgcctctggagggaggtaccgagggacgcgcagcgaaggggctttgctaattgccaaagcaggaagtgagctcgtggaagaagcgaaggaggagaagaagaagggaggggaaggcggaggagggcaggggcgcgcagagccacggtttgctccaggcgcgtcggaaccgcaggacttttcatccccgtggtcccacggtcctcccgcgccccggaggcctgccagccccgctcggacgctcgtttgcccctaacccgccgccatggcttcaccggacgaccctctgcgcgcaggtaaagggacacagcgccgcgcccgctcctggagcgagcaccgcggggcgggagctcgggaggcgctcgcagcagccgcagggctatcgaggccgggcctcggcgacccccgagggaggcccgggaaccacccccgacccaggcgccagacccggagtcgcacggggctcccagtccagccccgcgagcggctgctgaccgcccctcccgcgctcg

SEQ ID NO: 47886 - DNA, 97 bp, Homo sapiens; identical to SEQ ID NO: 17388
  chr1:236559271-236559368
  hyper

SEQ ID NO: 47887 - DNA, 15 bp, Homo sapiens
  chr1:236850197-236850212
  hyper
cgctttgtggaggtg

SEQ ID NO: 47888 - DNA, 210 bp, Homo sapiens; identical to SEQ ID NO: 26972
  chr1:239549605-239549815
  hyper

SEQ ID NO: 47889 - DNA, 89 bp, Homo sapiens; identical to SEQ ID NO: 26973
  chr1:239550034-239550123
  hyper

SEQ ID NO: 47890 - DNA, 134 bp, Homo sapiens; identical to SEQ ID NO: 26975
  chr1:240160952-240161086
  hyper

SEQ ID NO: 47891 - DNA, 125 bp, Homo sapiens
  chr1:240254819-240254944
  hyper
tatgtggctgtgacccgatggcacctctaaactggaattgggcttcagtttttctccgtgtaaaaatttcttcttttttatttaacttttctcttggcaggtccagcagctttgaagatcagagt

SEQ ID NO: 47892 - DNA, 350 bp, Homo sapiens; identical to SEQ ID NO: 17391
  chr1:240255011-240255361
  hyper

SEQ ID NO: 47893 - DNA, 319 bp, Homo sapiens; identical to SEQ ID NO: 17392
  chr1:240255500-240255819
  hyper

SEQ ID NO: 47894 - DNA, 39 bp, Homo sapiens
  chr1:240256624-240256663
  hyper
cgctgtttcaagccctacccgctcatcaccccctgctac

SEQ ID NO: 47895 - DNA, 238 bp, Homo sapiens; identical to SEQ ID NO: 26980
  chr1:240775075-240775313
  hyper

SEQ ID NO: 47896 - DNA, 47 bp, Homo sapiens; identical to SEQ ID NO: 17394
  chr1:240775378-240775425
  hyper

SEQ ID NO: 47897 - DNA, 197 bp, Homo sapiens
  chr1:241520099-241520296
  hyper
cggacgctcccgctgcgcagagcgagggctgggtgcgggccgggggccgggagggctctgggtggcgctgcctcctccccgcccgccttccctatttacctcctccgccaaggtcacggccccgcggcgtctcccctcccgggcgggctgggtgcaggcggtgtcagctggcggcaagcggagcagcgaggcagggt

SEQ ID NO: 47898 - DNA, 188 bp, Homo sapiens
  chr1:241520345-241520533
  hyper
agctgctcaggcgaccgccaccctcgcctcgccgccgcccgtgcacaggcggctccggcagccgccactcgcgcccgctcccctgggccgcctcgctggctctctccctcctccgcttcttctcccggggactgggaccagccgagcgcgcgcgggagtcgagacgcccggcccgtgcgcgcgactgg

SEQ ID NO: 47899 - DNA, 138 bp, Homo sapiens
  chr1:241587113-241587251
  hyper
gtcctgagcggccgctgccatcgcgccggctgcagcggaaaggtacaagcggtggcggcaggagccgctgtgggagcagcagtggcggcagtgggagccctgtgccacgcgtcccctgtgcgccgtgtccccaaggca

SEQ ID NO: 47900 - DNA, 116 bp, Homo sapiens
  chr1:241587471-241587587
  hyper
gggtagcagggcagtcgagcacggagggaggggcgggcctccaggggacttcagcgggagccgggcctggggcggtgccgcacttgcacacggagtgtggggggccaggcctggga

SEQ ID NO: 47901 - DNA, 81 bp, Homo sapiens; identical to SEQ ID NO: 17398
  chr1:241587797-241587878
  hyper

SEQ ID NO: 47902 - DNA, 40 bp, Homo sapiens; identical to SEQ ID NO: 26986
  chr1:242161790-242161830
  hyper

SEQ ID NO: 47903 - DNA, 111 bp, Homo sapiens
  chr1:242687688-242687799
  hyper
agactgagctggaggagctggaggagcgagcgggcgcggggagcgcggggtgctgagcgccagctgggagcgcggccgggcgggagggggcgatcgcgggaggcgcggggc

SEQ ID NO: 47904 - DNA, 27 bp, Homo sapiens
  chr1:242688007-242688034
  hyper
ggccggctcccggggcggcggcggcgg

SEQ ID NO: 47905 - DNA, 104 bp, Homo sapiens
  chr1:242688080-242688184
  hyper
cgcgcctgcaggttggtgcagtgaggagccgccgccgcccctcccgccgcgcccaggcccgggcggccgcgctcccgctccgcacccgcctttcccgagcaggc

SEQ ID NO: 47906 - DNA, 200 bp, Homo sapiens
  chr1:242688277-242688477
  hyper
cgcggggatggctccggagggagacactcaggaaaccacctccgcccttcccccatctctatccagcggcgccccctcaccctgcccccggctcgcttgggctgcgccttcccccattctgaaagttcactaacttcccaccccaagggacttagagcagagggtgcccagcattcccccctgaaaatagccgagagaca

SEQ ID NO: 47907 - DNA, 92 bp, Homo sapiens; identical to SEQ ID NO: 26991
  chr1:243053773-243053865
  hyper

SEQ ID NO: 47908 - DNA, 167 bp, Homo sapiens; identical to SEQ ID NO: 26992
  chr1:243053866-243054033
  hyper

SEQ ID NO: 47909 - DNA, 125 bp, Homo sapiens
  chr1:243646485-243646610
  hyper
ggcggctgcggagcccggggaggaggcggcgggcgcccgggtcttcctcggagcgcgccccctgggctgggcggcgtgtccctgcctcccgccggcgccctcgtccccgcagcagcgtccccgcc

SEQ ID NO: 47910 - DNA, 75 bp, Homo sapiens
  chr1:243646673-243646748
  hyper
aggctgctgagcacgagcgccctccgcgacccgcccctgctcccgcctccactcttgcctcggggggagggtctc

SEQ ID NO: 47911 - DNA, 248 bp, Homo sapiens; identical to SEQ ID NO: 26994
  chr1:244014423-244014671
  hyper

SEQ ID NO: 47912 - DNA, 202 bp, Homo sapiens; identical to SEQ ID NO: 17403
  chr1:244080470-244080672
  hyper

SEQ ID NO: 47913 - DNA, 93 bp, Homo sapiens; identical to SEQ ID NO: 17404
  chr1:244080702-244080795
  hyper

SEQ ID NO: 47914 - DNA, 786 bp, Homo sapiens; identical to SEQ ID NO: 26996
  chr1:244893526-244894312
  hyper

SEQ ID NO: 47915 - DNA, 176 bp, Homo sapiens; identical to SEQ ID NO: 26997
  chr1:247171005-247171181
  hyper

SEQ ID NO: 47916 - DNA, 166 bp, Homo sapiens; identical to SEQ ID NO: 26998
  chr1:247171251-247171417
  hyper

SEQ ID NO: 47917 - DNA, 120 bp, Homo sapiens; identical to SEQ ID NO: 26999
  chr1:247274343-247274463
  hyper

SEQ ID NO: 47918 - DNA, 77 bp, Homo sapiens; identical to SEQ ID NO: 27000
  chr1:247274523-247274600
  hyper

SEQ ID NO: 47919 - DNA, 111 bp, Homo sapiens; identical to SEQ ID NO: 27001
  chr1:247274826-247274937
  hyper

SEQ ID NO: 47920 - DNA, 29 bp, Homo sapiens
  chr1:248020420-248020449
  hyper
ttgaactgaagccagcggacaccacccgt

SEQ ID NO: 47921 - DNA, 80 bp, Homo sapiens
  chr2:287500-287580
  hyper
tgtctctttttgaaacgtgtttctcaaagacaattctatttcccagcagccccggccctcgggcgcgctcggccccactc

SEQ ID NO: 47922 - DNA, 50 bp, Homo sapiens
  chr2:287641-287691
  hyper
tcccgcccgaggagctgcaggcccttgtgctccgccgagtggtgcttccg

SEQ ID NO: 47923 - DNA, 42 bp, Homo sapiens; identical to SEQ ID NO: 27006
  chr2:288009-288051
  hyper

SEQ ID NO: 47924 - DNA, 135 bp, Homo sapiens
  chr2:288269-288404
  hyper
ggacctcggaggggccgcgctcccgcgcctaccgctctccaagaaggcggcgccgcgcgccgggcccggcggccgcgctcaagtttccagcgtcgcctttgcgcggtggtcgccggcgagcgccgagtccccgaa

SEQ ID NO: 47925 - DNA, 372 bp, Homo sapiens
  chr2:288470-288842
  hyper
tccacctcccggccatggcgccctcccgcacctgcccggcgccacccgggagccacctgcgcgtcgtggccgggccggttacctggagccgccggagtcgtcgccgtctgtgcgcacgtctgtccccgcgccccgagctgcgccactactccatgcccggcgggcggagcgcacgggacgcggggactcggccgctccgagcgctggacccacggccgacctggggtgcgccggctccgagtcccgcctcagacctcggggagcttcttatccccgcgcccgccgacgtcaggcgggtccccaagggctccgagcggggctttaattagaagccgctgaagtgttagtacccccatgcggatcttcgtcagt

SEQ ID NO: 47926 - DNA, 123 bp, Homo sapiens; identical to SEQ ID NO: 27008
  chr2:289223-289346
  hyper

SEQ ID NO: 47927 - DNA, 740 bp, Homo sapiens; identical to SEQ ID NO: 27009
  chr2:289672-290412
  hyper

SEQ ID NO: 47928 - DNA, 119 bp, Homo sapiens; identical to SEQ ID NO: 27010
  chr2:468115-468234
  hyper

SEQ ID NO: 47929 - DNA, 31 bp, Homo sapiens
  chr2:468672-468703
  hyper
cctcaacacattggctcggaaatgtacagtc

SEQ ID NO: 47930 - DNA, 101 bp, Homo sapiens
  chr2:945812-945913
  hyper
ggagactccgcggaccggaggagggataggacccccgagctttgggggcgggaagggagggtggaaggaggaggggagcggggttggggaaagttggagct

SEQ ID NO: 47931 - DNA, 10 bp, Homo sapiens
  chr2:946000-946010
  hyper
ggacgcggcc

SEQ ID NO: 47932 - DNA, 197 bp, Homo sapiens; identical to SEQ ID NO: 17416
  chr2:946011-946208
  hyper

SEQ ID NO: 47933 - DNA, 115 bp, Homo sapiens; identical to SEQ ID NO: 1922
  chr2:946289-946404
  hyper

SEQ ID NO: 47934 - DNA, 94 bp, Homo sapiens
  chr2:946432-946526
  hyper
cgctcgccgccctccccgcgggtgcgcgcccggcccctccctcgcccggggcgggtctgcgtgggcggtgctccgggtcggcgggcggagctcc

SEQ ID NO: 47935 - DNA, 22 bp, Homo sapiens
  chr2:947159-947181
  hyper
cttcgggcgcccaggccaggtc

SEQ ID NO: 47936 - DNA, 97 bp, Homo sapiens
  chr2:1746517-1746614
  hyper
tgggctgaccattcacgggctctggaaagaaagccttggtctctctgcggaggaggagaggaactcgggcccccgccccgccccagggcctccagga

SEQ ID NO: 47937 - DNA, 20 bp, Homo sapiens
  chr2:1747650-1747670
  hyper
ggggaagcgggaggccggcg

SEQ ID NO: 47938 - DNA, 42 bp, Homo sapiens; identical to SEQ ID NO: 27021
  chr2:5813681-5813723
  hyper

SEQ ID NO: 47939 - DNA, 199 bp, Homo sapiens
  chr2:5830979-5831178
  hyper
tttcccagtcctacacggctgatttctctggtgaagggatccgggcagtgtcttaggaactgctcaaagttcccagatacccagtgctggggggtgtggagaaggcgagggtggcgacagaccatacctatgaagcggtgattttctttaattgcccccagaatatccgtagaggtagtagggactcaataaagaaaca

SEQ ID NO: 47940 - DNA, 77 bp, Homo sapiens
  chr2:5831324-5831401
  hyper
ttctctttggtttatgagtgacccagaaggcttctagctcacaatcgcacgatttcaggacgaggctgccggagaag

SEQ ID NO: 47941 - DNA, 86 bp, Homo sapiens; identical to SEQ ID NO: 27024
  chr2:5831467-5831553
  hyper

SEQ ID NO: 47942 - DNA, 229 bp, Homo sapiens; identical to SEQ ID NO: 17421
  chr2:5831819-5832048
  hyper

SEQ ID NO: 47943 - DNA, 5 bp, Homo sapiens
  chr2:5832283-5832288
  hyper
cgcat

SEQ ID NO: 47944 - DNA, 116 bp, Homo sapiens; identical to SEQ ID NO: 1925
  chr2:5832731-5832847
  hyper

SEQ ID NO: 47945 - DNA, 72 bp, Homo sapiens
  chr2:5834028-5834100
  hyper
gtcgctggtggataaggatttggattcgttcagcgagggcagcctgggctcccacttcgagttccccgacta

SEQ ID NO: 47946 - DNA, 295 bp, Homo sapiens
  chr2:5836253-5836548
  hyper
cccgcctctcaaagggtggggacagccgtttccagatttgaattttttctgttctttatttttaacgctgcatcttcgcgtgtgctcagaggtggttgttggcggagaacgccgccgcagtgtttgacctctagcggtgaagggggaaggggaagaggaaaggagagaagtggtcggtgtctgtttccttctgtcccccggggccgtggagctgtcggagggaaggaggacggtgcggggccgcagggggcgcggggcgcggcgggacccaggctacgagcgggagggaggcggg

SEQ ID NO: 47947 - DNA, 54 bp, Homo sapiens; identical to SEQ ID NO: 17424
  chr2:5837414-5837468
  hyper

SEQ ID NO: 47948 - DNA, 24 bp, Homo sapiens
  chr2:5866074-5866098
  hyper
ctgggggcagcagagcgacgtgcc

SEQ ID NO: 47949 - DNA, 228 bp, Homo sapiens; identical to SEQ ID NO: 27036
  chr2:6121893-6122121
  hyper

SEQ ID NO: 47950 - DNA, 30 bp, Homo sapiens; identical to SEQ ID NO: 27037
  chr2:7057304-7057334
  hyper

SEQ ID NO: 47951 - DNA, 235 bp, Homo sapiens; identical to SEQ ID NO: 27038
  chr2:7058143-7058378
  hyper

SEQ ID NO: 47952 - DNA, 33 bp, Homo sapiens; identical to SEQ ID NO: 27039
  chr2:7571090-7571123
  hyper

SEQ ID NO: 47953 - DNA, 320 bp, Homo sapiens; identical to SEQ ID NO: 27040
  chr2:7571157-7571477
  hyper

SEQ ID NO: 47954 - DNA, 80 bp, Homo sapiens; identical to SEQ ID NO: 27042
  chr2:9143213-9143293
  hyper

SEQ ID NO: 47955 - DNA, 47 bp, Homo sapiens
  chr2:10182780-10182827
  hyper
aaccacaccaagagacgcgagcaaccgaaatatagggagaaaaaaaa

SEQ ID NO: 47956 - DNA, 216 bp, Homo sapiens
  chr2:10182904-10183120
  hyper
tgggaagaatgggcgggtttcagcgggcgccttctgggtgactgcccgtttcggcttcccctgaccccgtaacagagcggaagaggcccagagacgccagaggaggggcgtcagcgggacactcaggccaataagctctgactcccgctgtctgcaaaaatgaccggatgcaggaatgtcacctagaaccggccagctttccgacctctccggtca

SEQ ID NO: 47957 - DNA, 155 bp, Homo sapiens; identical to SEQ ID NO: 27044
  chr2:10220786-10220941
  hyper

SEQ ID NO: 47958 - DNA, 49 bp, Homo sapiens; identical to SEQ ID NO: 27045
  chr2:10220958-10221007
  hyper

SEQ ID NO: 47959 - DNA, 143 bp, Homo sapiens; identical to SEQ ID NO: 27046
  chr2:10444448-10444591
  hyper

SEQ ID NO: 47960 - DNA, 30 bp, Homo sapiens; identical to SEQ ID NO: 27047
  chr2:10589172-10589202
  hyper

SEQ ID NO: 47961 - DNA, 52 bp, Homo sapiens
  chr2:10688822-10688874
  hyper
tgcttgcagcctggccgcgtgtgcgcctctgctgggatgacccggtcctgtt

SEQ ID NO: 47962 - DNA, 44 bp, Homo sapiens; identical to SEQ ID NO: 27049
  chr2:10861191-10861235
  hyper

SEQ ID NO: 47963 - DNA, 30 bp, Homo sapiens; identical to SEQ ID NO: 27050
  chr2:11052102-11052132
  hyper

SEQ ID NO: 47964 - DNA, 156 bp, Homo sapiens
  chr2:11052361-11052517
  hyper
ggtgcatgcctcccccgcggcgcgcccccgcaggctgctgcccgctgtgaccgcccttccccgcaggcgggcgccggccaggctctccccgagatcagcgcacgggtggcacccgccggacccccagcggcagcggcggcggcggctgcagggggc

SEQ ID NO: 47965 - DNA, 134 bp, Homo sapiens
  chr2:11052559-11052693
  hyper
ggtccggggagcgcagcctcccggagccgggcagccagagctccgctgccagcgacgacatagagatagtcgtcaacgtggggggcgtgcggcaggtgctgtacggggacctcctcagtcagtaccctgagacc

SEQ ID NO: 47966 - DNA, 556 bp, Homo sapiens; identical to SEQ ID NO: 27052
  chr2:11622808-11623364
  hyper

SEQ ID NO: 47967 - DNA, 135 bp, Homo sapiens; identical to SEQ ID NO: 27053
  chr2:11623424-11623559
  hyper

SEQ ID NO: 47968 - DNA, 111 bp, Homo sapiens
  chr2:12858341-12858452
  hyper
tcagtggcaccgaggcgcctgcagccgcactcgccagcgactcatctctccagcgggtttttttttgtttgtcgtgtgcgatcctcacactcatgaacatacacaggtcta

SEQ ID NO: 47969 - DNA, 12 bp, Homo sapiens
  chr2:12858618-12858630
  hyper
gaaatacttatt

SEQ ID NO: 47970 - DNA, 30 bp, Homo sapiens; identical to SEQ ID NO: 27055
  chr2:14773043-14773073
  hyper

SEQ ID NO: 47971 - DNA, 71 bp, Homo sapiens; identical to SEQ ID NO: 27056
  chr2:14773957-14774028
  hyper

SEQ ID NO: 47972 - DNA, 50 bp, Homo sapiens; identical to SEQ ID NO: 27057
  chr2:14774593-14774643
  hyper

SEQ ID NO: 47973 - DNA, 319 bp, Homo sapiens; identical to SEQ ID NO: 27058
  chr2:14774939-14775258
  hyper

SEQ ID NO: 47974 - DNA, 83 bp, Homo sapiens; identical to SEQ ID NO: 27059
  chr2:14775608-14775691
  hyper

SEQ ID NO: 47975 - DNA, 46 bp, Homo sapiens; identical to SEQ ID NO: 27060
  chr2:16080930-16080976
  hyper

SEQ ID NO: 47976 - DNA, 989 bp, Homo sapiens; identical to SEQ ID NO: 27061
  chr2:16082016-16083005
  hyper

SEQ ID NO: 47977 - DNA, 43 bp, Homo sapiens; identical to SEQ ID NO: 27062
  chr2:17699420-17699463
  hyper

SEQ ID NO: 47978 - DNA, 11 bp, Homo sapiens
  chr2:17719677-17719688
  hyper
taaacattaca

SEQ ID NO: 47979 - DNA, 290 bp, Homo sapiens; identical to SEQ ID NO: 27064
  chr2:17720027-17720317
  hyper

SEQ ID NO: 47980 - DNA, 157 bp, Homo sapiens; identical to SEQ ID NO: 27065
  chr2:17721522-17721679
  hyper

SEQ ID NO: 47981 - DNA, 117 bp, Homo sapiens; identical to SEQ ID NO: 27066
  chr2:17721750-17721867
  hyper

SEQ ID NO: 47982 - DNA, 151 bp, Homo sapiens; identical to SEQ ID NO: 27067
  chr2:18011883-18012034
  hyper

SEQ ID NO: 47983 - DNA, 86 bp, Homo sapiens; identical to SEQ ID NO: 17442
  chr2:18058949-18059035
  hyper

SEQ ID NO: 47984 - DNA, 696 bp, Homo sapiens
  chr2:18059085-18059781
  hyper
cctggctgttaactgagcgctctcgctcagtgcagcgaggccagcgatgccttctggaccacacgctgtcctcgccgaggtcctggtttgttcctcaacgtcggctgaaggcatcgtcccctgacttcctcttccattcgtccttccgaaaggggacccgactggttcctcttctacatatgaggcgcatctgcttggtgcaaatgtccaagcacctcttctgactcggtgagtggaggaataagacaaagcatcttgttctgcactgtgcctgagtcttcaggcagcgggaccgatggcaaacattggcaggaactggagctatatgtactctccttcgcactttgttttaaaacaagtttgggcctcgcgatttcctgaggaaatccaggcaaattagcaaagtgtcgcttgggccgcgactttagaaaggcggttgccccagccgccggggccgcgggggaggtcatctttttcccgcagggccacggcgcttccggcccaggagggcgcgcaggtgggaggcgcggggcgcgctcctggtcccacccggacagcgcctgccgctccggggtgactctgcacttgggcctgggcgggggcgcgcggccggcagggcagcatctaggtctatgggtctgtccgcctgtctggcggtcggagccccgcagtcctcagccgcccgcgccctcggcc

SEQ ID NO: 47985 - DNA, 300 bp, Homo sapiens
  chr2:18059841-18060141
  hyper
cggccgagcggcgggccccgccccgtcccgtccggccccgccccgcccgcagctcccgggagcctcgctctagcggggcgggaccgacggacagaccggccgacgcgggccaccccgctctcctcgccgccgcggcggcaggcgcggggccgcgccgcgaggcctgatccctgcagcgcgggcaggcggcgtcgcagagcggagctagctggatgcgtccggactcctgcaggtacctggctggcgtccccacctccctgcgcgctccggagacttctccgggcgaccctgcaactttac

SEQ ID NO: 47986 - DNA, 30 bp, Homo sapiens; identical to SEQ ID NO: 27069
  chr2:18060643-18060673
  hyper

SEQ ID NO: 47987 - DNA, 67 bp, Homo sapiens; identical to SEQ ID NO: 27070
  chr2:19551382-19551449
  hyper

SEQ ID NO: 47988 - DNA, 157 bp, Homo sapiens; identical to SEQ ID NO: 27071
  chr2:19551499-19551656
  hyper

SEQ ID NO: 47989 - DNA, 88 bp, Homo sapiens
  chr2:19556980-19557068
  hyper
cgccgccggtcgctgctagtcccctccagcgcttctcttccctagggggttgtgaacctgggacacctagccttgcacgtggttttgt

SEQ ID NO: 47990 - DNA, 33 bp, Homo sapiens; identical to SEQ ID NO: 27074
  chr2:19558008-19558041
  hyper

SEQ ID NO: 47991 - DNA, 30 bp, Homo sapiens; identical to SEQ ID NO: 27075
  chr2:19558491-19558521
  hyper

SEQ ID NO: 47992 - DNA, 99 bp, Homo sapiens
  chr2:19558733-19558832
  hyper
tcctaggacacagcccgtgctctttgggaggagggagggaggggcagtagctctgtgcaccgggatccccacaccgcggcttgggtttcaacgcacttt

SEQ ID NO: 47993 - DNA, 91 bp, Homo sapiens
  chr2:19558893-19558984
  hyper
gtggagcagctcctggctatccaagcgtgctcggggccagggtgttaacccaggcagcgctggttaattcctggtgcgggagggccagggt

SEQ ID NO: 47994 - DNA, 157 bp, Homo sapiens
  chr2:19561316-19561473
  hyper
ccagccggcgcgaactccgccgcgactctttctggctctctcgctcactgccttcggggcggaaccgcgggcgccggagtggtcccagactcggctgggaccgggcagcctagaagaagggtcccctcagtagagaccaggcctccagctctccgtc

SEQ ID NO: 47995 - DNA, 22 bp, Homo sapiens
  chr2:19561685-19561707
  hyper
ggtaaagcgccccagcctgtct

SEQ ID NO: 47996 - DNA, 20 bp, Homo sapiens
  chr2:19563338-19563358
  hyper
ccctcccggcacacccggag

SEQ ID NO: 47997 - DNA, 73 bp, Homo sapiens
  chr2:20068725-20068798
  hyper
tgggatgcaagtgcccgccaagccccccgtttcccacgtggagttcccacagggcagcagggaggggccgcgc

SEQ ID NO: 47998 - DNA, 35 bp, Homo sapiens
  chr2:20068885-20068920
  hyper
agacaacaaagccttctacgcggaagttactggtg

SEQ ID NO: 47999 - DNA, 67 bp, Homo sapiens; identical to SEQ ID NO: 27081
  chr2:20212718-20212785
  hyper

SEQ ID NO: 48000 - DNA, 329 bp, Homo sapiens
  chr2:20865927-20866256
  hyper
gcttcgccgctgccgggcgtcccctccatccacctcgggacccgcgccatcaccgcggcggggtaagaagctcggaggcgccatcccggggctctgcgccgtccgctctcccggctcctggccgctcacgcacacagccggtagctggttttcgttagccgctgccctcgcccagaaggcgggtggaaggtcgccagttggacgcacagccaaactcttagcgcactcccgcgcgagatcccccatcacccggggctgccgtcctcatttcgagctctttctagagcttggctcccgctgaagcgcaacttccgcgcccaaaccttgct

SEQ ID NO: 48001 - DNA, 65 bp, Homo sapiens; identical to SEQ ID NO: 27084
  chr2:20867171-20867236
  hyper

SEQ ID NO: 48002 - DNA, 349 bp, Homo sapiens; identical to SEQ ID NO: 27085
  chr2:21022707-21023056
  hyper

SEQ ID NO: 48003 - DNA, 131 bp, Homo sapiens; identical to SEQ ID NO: 27086
  chr2:23608959-23609090
  hyper

SEQ ID NO: 48004 - DNA, 120 bp, Homo sapiens; identical to SEQ ID NO: 27087
  chr2:23609527-23609647
  hyper

SEQ ID NO: 48005 - DNA, 174 bp, Homo sapiens; identical to SEQ ID NO: 27088
  chr2:23609896-23610070
  hyper

SEQ ID NO: 48006 - DNA, 16 bp, Homo sapiens
  chr2:24232773-24232789
  hyper
gtcctgagggcctgcc

SEQ ID NO: 48007 - DNA, 114 bp, Homo sapiens; identical to SEQ ID NO: 27090
  chr2:24233349-24233463
  hyper

SEQ ID NO: 48008 - DNA, 199 bp, Homo sapiens; identical to SEQ ID NO: 27091
  chr2:24273048-24273247
  hyper

SEQ ID NO: 48009 - DNA, 209 bp, Homo sapiens; identical to SEQ ID NO: 27092
  chr2:25354748-25354957
  hyper

SEQ ID NO: 48010 - DNA, 472 bp, Homo sapiens; identical to SEQ ID NO: 17455
  chr2:25391212-25391684
  hyper

SEQ ID NO: 48011 - DNA, 9 bp, Homo sapiens
  chr2:25391725-25391734
  hyper
ggaggctta

SEQ ID NO: 48012 - DNA, 46 bp, Homo sapiens
  chr2:26395401-26395447
  hyper
gcagaattcagaacccgagctttgggcggcggagcaggacagggcg

SEQ ID NO: 48013 - DNA, 282 bp, Homo sapiens; identical to SEQ ID NO: 27098
  chr2:26396681-26396963
  hyper

SEQ ID NO: 48014 - DNA, 46 bp, Homo sapiens; identical to SEQ ID NO: 27099
  chr2:26397014-26397060
  hyper

SEQ ID NO: 48015 - DNA, 328 bp, Homo sapiens
  chr2:26401702-26402030
  hyper
ccagccccatcttttcgcggggctgcttctgtccgcccgcacgggggaggggaggaggaggcggaggcggaggcagaggcccctaggagggcgaaggccggcgggttaacgaggaggcgctgagtgcacggctgggctccacgctgatttctcctaatgaattaataatggcgctcgggcgggcgggggtggccggctgcggaccgcggagagagccgaggggaaggccgtggagggaggaggacggcgactcgcgccgggtggggctgaaggcactgcggggtgactcggtctccaggctgcggcgctctgctccgggagtcaggga

SEQ ID NO: 48016 - DNA, 166 bp, Homo sapiens
  chr2:26402060-26402226
  hyper
cccagcccccgcccctggccctgcgggaggggccaggcgtcttccctgagcatggtgccacttccccagtgttggccttgtttcctgctcagcatttggcagatgcgcctctggcccaactaggatgtttccattttacagacgggaaatccgaagcccagagaga

SEQ ID NO: 48017 - DNA, 86 bp, Homo sapiens
  chr2:26915677-26915763
  hyper
agcggcggccggggccgaggcgcgggccgggggcgccggggggccggcggcggcccgggcgggacgatgaagcggcagaacgtgcg

SEQ ID NO: 48018 - DNA, 130 bp, Homo sapiens
  chr2:26916259-26916389
  hyper
ttggccctgccatgttgcataggcccccagggactccgaagtgtgtgagaggggcagggacgaccggcggaggctcgggcaggaggggtgtggccgggccaggccctgaacagggcgctgagagtgagcg

SEQ ID NO: 48019 - DNA, 30 bp, Homo sapiens; identical to SEQ ID NO: 27105
  chr2:27069901-27069931
  hyper

SEQ ID NO: 48020 - DNA, 826 bp, Homo sapiens
  chr2:27070414-27071240
  hyper
tgagaacagttttcctataacgcccacccggccctttgcatcccgcaatcccgcgggcgtcggagcgggtcttggcgcgaaccaggcggcctcggcggggtcctgcggcggagggcagcgcggccgcagcccgggagaggcggccgcggcattgtttcagcccctggggtgggatccagctgggggaggggaggcggggtgtcctccggaaccgcccccggccctccctggggacccgtgcctcagcgcgtccaggctttgtggtgtcctgagtcgccatggaaacccgagggaacgcggagccgggtgctaggggggtcggtgagttctccggccgcgccctccgtccgctctcggaccccggccctgcagcagggcctgccgggagttgtagtccccaggcggcggcggcgcgcggcgccaaggatgcgggacgccgcctgtccccgcctccccttaacctgctagctgaggtggggagcggcgggaggagccggccgcgcggtgattggcggaggccgctcccagcccccgacacgcgcccctcccccgctccccactctggactcccgcgctgggcgcgctgaggcggcccccgagcgagcgcgcgtgcagccgccgccgccccgagcacccgcagctccggcgccgcggcgagacggagacggaccgagccacgggcccccgcggccgcagcatctcggaggagtgggtgatggcaggggggtcggtgggcttacccctcccgggctaggacatcctcctctcccccttctgtttctgcgtgaggcgcacaaaagggcggggagccgggtgagcctggggc

SEQ ID NO: 48021 - DNA, 161 bp, Homo sapiens; identical to SEQ ID NO: 27107
  chr2:27071758-27071919
  hyper

SEQ ID NO: 48022 - DNA, 30 bp, Homo sapiens; identical to SEQ ID NO: 27108
  chr2:27072330-27072360
  hyper

SEQ ID NO: 48023 - DNA, 150 bp, Homo sapiens
  chr2:27072672-27072822
  hyper
ccacgccgggaatcccgtgtgggaggcgctcccccggcctgggggcctgcagacagccacccccccactccggctcgggtgccttctggtgcagcgccgccgcccgccccgcgctgtccacccgctgccgagacgcggcgtggttagcgg

SEQ ID NO: 48024 - DNA, 42 bp, Homo sapiens
  chr2:27072989-27073031
  hyper
ttgcggagaagcgggtggaaatgatcccgcaagggtgaggct

SEQ ID NO: 48025 - DNA, 302 bp, Homo sapiens; identical to SEQ ID NO: 27110
  chr2:27341792-27342094
  hyper

SEQ ID NO: 48026 - DNA, 168 bp, Homo sapiens; identical to SEQ ID NO: 27111
  chr2:27473190-27473358
  hyper

SEQ ID NO: 48027 - DNA, 482 bp, Homo sapiens; identical to SEQ ID NO: 27112
  chr2:27484899-27485381
  hyper

SEQ ID NO: 48028 - DNA, 30 bp, Homo sapiens; identical to SEQ ID NO: 27113
  chr2:27485609-27485639
  hyper

SEQ ID NO: 48029 - DNA, 32 bp, Homo sapiens; identical to SEQ ID NO: 27114
  chr2:27486442-27486474
  hyper

SEQ ID NO: 48030 - DNA, 181 bp, Homo sapiens; identical to SEQ ID NO: 27115
  chr2:27486854-27487035
  hyper

SEQ ID NO: 48031 - DNA, 200 bp, Homo sapiens; identical to SEQ ID NO: 27116
  chr2:27717830-27718030
  hyper

SEQ ID NO: 48032 - DNA, 296 bp, Homo sapiens; identical to SEQ ID NO: 27117
  chr2:27938325-27938621
  hyper

SEQ ID NO: 48033 - DNA, 136 bp, Homo sapiens
  chr2:29338969-29339105
  hyper
cagtgggtcttcaaagctaaaccaaatggctgtccttgcagtccttggctacctgagatcccttaattctgaaccatccgcacctgggaggggaagttgaaaggagcgctggagctgagcccgcatccttaaggat

SEQ ID NO: 48034 - DNA, 32 bp, Homo sapiens; identical to SEQ ID NO: 27121
  chr2:30142892-30142924
  hyper

SEQ ID NO: 48035 - DNA, 28 bp, Homo sapiens
  chr2:30143276-30143304
  hyper
gccagccttcagctccgaggaggatggt

SEQ ID NO: 48036 - DNA, 220 bp, Homo sapiens
  chr2:30143492-30143712
  hyper
cggcaggagccacaggagcccgatggctcccatcccgccggaggaggccgtttacactgctctccgggcccagcctcacccttcgctctccccgagatgggaagaggctctgaacagtccttggtacccagcggctccttccacctgatctccagaggactgtgcgtgcgcgcaagtctcttgctttcccccaactgcacggaggcgagcaggagtctaa

SEQ ID NO: 48037 - DNA, 83 bp, Homo sapiens
  chr2:30143958-30144041
  hyper
ttttaaggctgagaacggcggctcccagctgctgcacgctgtcctggccgccttttgcgttccttttggctcctccaagctct

SEQ ID NO: 48038 - DNA, 168 bp, Homo sapiens; identical to SEQ ID NO: 17468
  chr2:30144411-30144579
  hyper

SEQ ID NO: 48039 - DNA, 113 bp, Homo sapiens; identical to SEQ ID NO: 27126
  chr2:30144580-30144693
  hyper

SEQ ID NO: 48040 - DNA, 29 bp, Homo sapiens
  chr2:30453625-30453654
  hyper
cacaccttctgcccccgctgcagaccggg

SEQ ID NO: 48041 - DNA, 288 bp, Homo sapiens
  chr2:30453941-30454229
  hyper
acagccagtggatgggaaggagggcgctggcgccgggcggctggggtggaggagtggcgggtgccctaccccggcgcagagcagccgccgagctgtcatgtcccgagcggcccccgcgccctccttgcgcccacctccgccgcgctggagttcggggtgtgcgtggagggggctgtgagcgggaagcggcgcggacgcggagtccgggccggtgcgagtgagcgcgtgtgcgcgtgggagagcggcgggagggggccgggctcgcagccgcagcgaaccacggccccg

SEQ ID NO: 48042 - DNA, 133 bp, Homo sapiens; identical to SEQ ID NO: 27129
  chr2:30454460-30454593
  hyper

SEQ ID NO: 48043 - DNA, 247 bp, Homo sapiens; identical to SEQ ID NO: 27130
  chr2:30455560-30455807
  hyper

SEQ ID NO: 48044 - DNA, 111 bp, Homo sapiens
  chr2:31360195-31360306
  hyper
atttcctcaactccccgccaataccaaggcgtctgtttttacaggctctttcgtggtgttctgggcacattcaacttccaatgcagctgagagggtcgggaacagttagag

SEQ ID NO: 48045 - DNA, 148 bp, Homo sapiens; identical to SEQ ID NO: 17471
  chr2:31360831-31360979
  hyper

SEQ ID NO: 48046 - DNA, 60 bp, Homo sapiens
  chr2:31361296-31361356
  hyper
atagggaaactgactcgagcagcgagagggaggaatccgaggctgtgccaagcaccccgg

SEQ ID NO: 48047 - DNA, 305 bp, Homo sapiens
  chr2:31361385-31361690
  hyper
gggagggcgggcccgacagacaggccgactcggagcgagcccaggtgggagtgagcggggctctgagagggggcgctaccgccgcccgccgaccgaaacgctcggtgctgttgcggggccgccagcgccaagccctgggcgcagctcccagaccatcgtgggttggggcaaggcggggcggggcgggagcggtgcactcgggatgcccgccacccccagctgccagctgggacccaagggccggccctcgccaggcggcgctgtgcctgggaggactttcccgctcatcgcgggggctgcacgtg

SEQ ID NO: 48048 - DNA, 150 bp, Homo sapiens
  chr2:31457039-31457189
  hyper
ccgcgggctgggcagcgtcgccgtctcccctgagccgcctcggtccggcaggagcggagccgaagcatcccttgctgcacgcagggcagagcaggcgagggctgggggccgatcggggaccccggcttgggaccccggcatctggcagtt

SEQ ID NO: 48049 - DNA, 128 bp, Homo sapiens; identical to SEQ ID NO: 27137
  chr2:32852511-32852639
  hyper

SEQ ID NO: 48050 - DNA, 110 bp, Homo sapiens; identical to SEQ ID NO: 27138
  chr2:37571787-37571897
  hyper

SEQ ID NO: 48051 - DNA, 24 bp, Homo sapiens
  chr2:38301261-38301285
  hyper
gacaagataggagaccggaggggt

SEQ ID NO: 48052 - DNA, 99 bp, Homo sapiens; identical to SEQ ID NO: 6102
  chr2:38301762-38301861
  hyper

SEQ ID NO: 48053 - DNA, 25 bp, Homo sapiens
  chr2:38302876-38302901
  hyper
tccatctgaagaggtcgccgggcag

SEQ ID NO: 48054 - DNA, 746 bp, Homo sapiens; identical to SEQ ID NO: 27142
  chr2:38302948-38303694
  hyper

SEQ ID NO: 48055 - DNA, 79 bp, Homo sapiens; identical to SEQ ID NO: 27143
  chr2:38755384-38755463
  hyper

SEQ ID NO: 48056 - DNA, 37 bp, Homo sapiens
  chr2:39187181-39187218
  hyper
acttcgagtcctctccggcggagccgctgggcaacgt

SEQ ID NO: 48057 - DNA, 72 bp, Homo sapiens
  chr2:39893018-39893090
  hyper
ggaagagggagggagcgggcggagagctggggccaagtgcattgtgtctggcggcggcgcgcgagcccaccg

SEQ ID NO: 48058 - DNA, 471 bp, Homo sapiens
  chr2:39893501-39893972
  hyper
ctcatcctgaaaggtgagcggcgggcgcaccccgcgtccccggcgcccgcgcgtggagcgcagcccgcggcttcccaggggcgcgccggtccccgcagccccctcccagccgcggccccgcgcctgggcattcttgcatccttcccgccgcctccagtctttatctcttccctttctttccccactgcctcccttcttctccctctccttgactctcttctttcgtccacatcctgcgcgtcctttcaagtccgtgccgcacctcccgcctctgtctccttctttcctgccttcgcctcccattccccggttctctctctctccccgtccttctctgcctttgtacacctgcctgacatgtgtgtcttttcttgacgctgctccccgtgagggggactaaccgtcaaagactcgacttttctcacccgggctccttccttcaagttgtgctccttttggaaataccgtttg

SEQ ID NO: 48059 - DNA, 141 bp, Homo sapiens
  chr2:40678462-40678603
  hyper
cctacatttcttcctcgtctgtctctgccccgccacacctccctcctctccgcagtccgtggtgaatgagcacccaacgcccgctggaaaacagggggctcggaaatgtggccttggggaaagaccccagggattaccgga

SEQ ID NO: 48060 - DNA, 130 bp, Homo sapiens; identical to SEQ ID NO: 27152
  chr2:42275776-42275906
  hyper

SEQ ID NO: 48061 - DNA, 95 bp, Homo sapiens
  chr2:42329336-42329431
  hyper
aagtgcagatgggttcgcaaacgtggactctctagttttgggtctgcagatggggccggccaccacgtgctctctgagttctctttccaagtaca

SEQ ID NO: 48062 - DNA, 86 bp, Homo sapiens; identical to SEQ ID NO: 6114
  chr2:42329751-42329837
  hyper

SEQ ID NO: 48063 - DNA, 2 bp, Homo sapiens
  chr2:42719904-42719906
  hyper
ga

SEQ ID NO: 48064 - DNA, 440 bp, Homo sapiens; identical to SEQ ID NO: 27158
  chr2:42720772-42721212
  hyper

SEQ ID NO: 48065 - DNA, 1 bp, Homo sapiens
  chr2:43019598-43019599
  hyper
g

SEQ ID NO: 48066 - DNA, 457 bp, Homo sapiens
  chr2:43019868-43020325
  hyper
cactccaggccctggcgagcgcggcggcggcagcgctggggaacggcgtcccgcgccctctgcttctccgcggggcaggggctcggtccccgccaccgtctccggggcgccccacacactggcgcctgcggtggggcctgctcccggcggaggacaaagaatccagacccttcctggacgcttgtccccagacgttccttccctctacgccccgaggggaatcccagggaaggttcccagaaatactacagtgaggagatcgcgggttggaagtcccagcacctgagaacacggtgctggcgctgggctcaagatttggctttcccatctggaaaaggggaatgactgccccgccactcagggctgcggcgctcacccagcgggaagccgcacggcggtccccgcaggtcccgattcaaggtgagccccagacctgctgcgtgcggccggcagactc

SEQ ID NO: 48067 - DNA, 203 bp, Homo sapiens; identical to SEQ ID NO: 27160
  chr2:43037974-43038177
  hyper

SEQ ID NO: 48068 - DNA, 51 bp, Homo sapiens; identical to SEQ ID NO: 27161
  chr2:43448422-43448473
  hyper

SEQ ID NO: 48069 - DNA, 318 bp, Homo sapiens; identical to SEQ ID NO: 27162
  chr2:43451091-43451409
  hyper

SEQ ID NO: 48070 - DNA, 152 bp, Homo sapiens; identical to SEQ ID NO: 27163
  chr2:43451694-43451846
  hyper

SEQ ID NO: 48071 - DNA, 18 bp, Homo sapiens
  chr2:43451891-43451909
  hyper
cgcacggggcccccggcg

SEQ ID NO: 48072 - DNA, 116 bp, Homo sapiens
  chr2:43452327-43452443
  hyper
gaagccgatggtatgaaaggtgcggcacagctcggtcttgtacttcggatggcgagtcaggctgcgcagctcgtggaagccatgcgcgaactggcacttttcgccgtacttgcacg

SEQ ID NO: 48073 - DNA, 61 bp, Homo sapiens; identical to SEQ ID NO: 27165
  chr2:43864669-43864730
  hyper

SEQ ID NO: 48074 - DNA, 48 bp, Homo sapiens; identical to SEQ ID NO: 17486
  chr2:45028940-45028988
  hyper

SEQ ID NO: 48075 - DNA, 118 bp, Homo sapiens; identical to SEQ ID NO: 27168
  chr2:45029987-45030105
  hyper

SEQ ID NO: 48076 - DNA, 37 bp, Homo sapiens; identical to SEQ ID NO: 27169
  chr2:45154244-45154281
  hyper

SEQ ID NO: 48077 - DNA, 468 bp, Homo sapiens
  chr2:45159488-45159956
  hyper
gttggggtcactcctcgcaggcactgtggcttttgtctgcatctggacaacagggtgtgcacccgtgtattcaaataattatgcctgtgggcacttctttattcctcaaattcctgttagtgttcctttaattctcccgtagtgttcctttaattctcccatgtgtattcggtacgattgcctgtacgttccaggcatagtcaggtgactcagcttgagtctgagctcaaacgtgcgcgaccccctgggtctgcatggggagaaggaggtgtgcacgtgcaaacgcgggactttgggtggagtgtgaggttgatagggctttcggccccagggccctctaggcctcttttaaataccttcatctgcccaatttcttaacctttcaggacaaggagggagaccctccgcgatcctgcgccttgccaccctttgggaaggataggaccatcatctagggcgtctctcggt

SEQ ID NO: 48078 - DNA, 58 bp, Homo sapiens
  chr2:45160538-45160596
  hyper
gtagatgtgttttctcgtgagaatgatgcagacttactgctgacttaaggtcagtttg

SEQ ID NO: 48079 - DNA, 380 bp, Homo sapiens
  chr2:45160634-45161014
  hyper
gtgtctctcctgagcattcgtacaaagtgaagccacctcccctccgccatgcagtctcccagaccgggtcaaaggacccaggctccaggtcgctgaggcctggagggctgaggcccttgctgtgcgccctggtgctctgatcccaaggcccaagctgccccggtacccacttagggtcagggtggaaagcctacgtgggaaagggggacctggaggactacccccacgcccatggcagggtggagtcccgaccttggcatattggacctactcacttggcatctccctgccccgaccccgtctgggatccgtattggcagcgacgaggaagggaggaatggtaagggagttgggtcggtacaggacggaagtgaagatgg

SEQ ID NO: 48080 - DNA, 112 bp, Homo sapiens; identical to SEQ ID NO: 27177
  chr2:45161221-45161333
  hyper

SEQ ID NO: 48081 - DNA, 207 bp, Homo sapiens; identical to SEQ ID NO: 27178
  chr2:45161334-45161541
  hyper

SEQ ID NO: 48082 - DNA, 66 bp, Homo sapiens
  chr2:45161597-45161663
  hyper
cgttggtgggggtgggagggcggctctactctgcgttcactttgggtgcccaggcatgcgaccctg

SEQ ID NO: 48083 - DNA, 123 bp, Homo sapiens
  chr2:45162112-45162235
  hyper
tgctgcgcgttctttctccctccccctctcagggcgccagggcccagaccaaggagctaagagtgatcgggacttgggggtaccgggtggaactccttgggggccgcccgccaggcttcctgg

SEQ ID NO: 48084 - DNA, 270 bp, Homo sapiens
  chr2:45162481-45162751
  hyper
caaaaccaaaagccggagttgggaaaagaaaattctttctctgaccatgccagacgcggccggtcaggctcgcagctccgcgctaggatcgggcggctgtacaaccaagatcgactttgccctgtcccccaacgcccccctcatcccacggctccacggctgggaggctccggactcagagctcgcggactcggcgctcagggtcagcaccagcagctcggcttaagccggggcaggctctctaagccctgctcagaagtcaagagcagc

SEQ ID NO: 48085 - DNA, 158 bp, Homo sapiens
  chr2:45162913-45163071
  hyper
tcctgccagccgtgtggctcttaaagagctgcacccctcctccgccctgcgcgatcccccgacccccgcctcccctcccctctcctccggatctagccccccacgccgacgcctgaggtccctgctgccccgaccgatgcctgcggactcccagcccc

SEQ ID NO: 48086 - DNA, 322 bp, Homo sapiens; identical to SEQ ID NO: 27182
  chr2:45164822-45165144
  hyper

SEQ ID NO: 48087 - DNA, 64 bp, Homo sapiens
  chr2:45165500-45165564
  hyper
ccaagtcccagatcccgcaatcagagcggccagagagcagagaagagacctagaggatctgcaa

SEQ ID NO: 48088 - DNA, 192 bp, Homo sapiens
  chr2:45165594-45165786
  hyper
tgagcgaccccagggtgcaggcgccctccacgcgccacctcctctagcggtcccccagggtcccttcccagtcctcgcactgccctagggcttgcttggttcccagaccagcgtggaaggccgctgggccccggaacccaaggtccctctgcttctgctccactccccagtgcccagcgcctgggaatttgg

SEQ ID NO: 48089 - DNA, 73 bp, Homo sapiens; identical to SEQ ID NO: 27184
  chr2:45166113-45166186
  hyper

SEQ ID NO: 48090 - DNA, 30 bp, Homo sapiens; identical to SEQ ID NO: 27185
  chr2:45166483-45166513
  hyper

SEQ ID NO: 48091 - DNA, 93 bp, Homo sapiens; identical to SEQ ID NO: 27186
  chr2:45168959-45169052
  hyper

SEQ ID NO: 48092 - DNA, 130 bp, Homo sapiens
  chr2:45169316-45169446
  hyper
gctccatacttctggcgagtagcggcggcgggaacggtgcgggaggcggcggcggcgcgggaggcggcagcggcggcgggaacggtgcgggaggcggcggtgctggcggagcaggcggcggcggcggcgg

SEQ ID NO: 48093 - DNA, 94 bp, Homo sapiens; identical to SEQ ID NO: 17495
  chr2:45170029-45170123
  hyper

SEQ ID NO: 48094 - DNA, 45 bp, Homo sapiens; identical to SEQ ID NO: 27189
  chr2:45170168-45170213
  hyper

SEQ ID NO: 48095 - DNA, 139 bp, Homo sapiens
  chr2:45171246-45171385
  hyper
tccccacttttccaccgccagctttcctattttctctaccctcggtcctgcgctctgcgctggcatccagagagcaaagtatgcagttctacccggagactggccgggcggtggggaacccgcagctcccggtgtgtgt

SEQ ID NO: 48096 - DNA, 62 bp, Homo sapiens
  chr2:45171862-45171924
  hyper
ctcggtaacctccagcgactcggaatgtgatgtatgatagccaaggccgccctcctccctct

SEQ ID NO: 48097 - DNA, 264 bp, Homo sapiens; identical to SEQ ID NO: 27192
  chr2:45172185-45172449
  hyper

SEQ ID NO: 48098 - DNA, 8 bp, Homo sapiens
  chr2:45176593-45176601
  hyper
gcctgaga

SEQ ID NO: 48099 - DNA, 361 bp, Homo sapiens
  chr2:45176768-45177129
  hyper
attcccaggcctgtggcgcactggatgcactcggcgtcttggagcagtctcttctccctctcttcttcctctgcctccgtggccctgtcagtcccgcctaagcctttgtgtggccgtcacctggagcaccggctgtgcctcagggactttcccgggccttccccttgtcctctctgtcccccagcgctggagctgagatgcccggcccgcgggacgctcgaccccctggtacgcgcgctgaggcccccacggcttcccaccgctccggccctttccggccccagctgagctgaagctccctggccccagtgtgcgggccccggtggccgtctggcccgagggagggcgggggcaggcgaga

SEQ ID NO: 48100 - DNA, 324 bp, Homo sapiens
  chr2:45179296-45179620
  hyper
aaggcagggtccagacgtgagggggagcgcggcggggcgtgggggacgcggcccccggggcaggggtccgggatctgcggacgtggcccggtggggagcgcgccccttggtccccgctccgccctccggccttcgcggcgctctctcgctgggcctttgtccccacctctcaggctcggactccgtctttcttctttcaggccgctgggaggcgctgtggccgaagccccggcctctcccagcctgatgccctggtcctgcagccgcgccgtctttctccgcacccggttcccgcggggctgggctgcctcaggcgatggcccg

SEQ ID NO: 48101 - DNA, 289 bp, Homo sapiens; identical to SEQ ID NO: 17500
  chr2:45179650-45179939
  hyper

SEQ ID NO: 48102 - DNA, 215 bp, Homo sapiens
  chr2:45181672-45181887
  hyper
ggtctgtcggtggacgccgcgaaccaatcaaacccttgcactttgttccaaaacccattccctaccagaatgggagtcctgtagggccaggtctcctcccatacccacccatttcggcctttgttctactgcacaataacagctggcactggggtgcgggaggacggtgaaagctcgagtcccaggctccaaatcctccaggagtaactggggtg

SEQ ID NO: 48103 - DNA, 232 bp, Homo sapiens
  chr2:45182001-45182233
  hyper
tcgcaggctctgcgaaacttcagtgcgcgcagcctcctgcacaccgttttcgcgcgacctccttgcctcggtctccaggggtcaagccaacccagcgcgggaatgttccatttgcccttttgggacattcagagaggcttttccgggctgccgcggcgcttccacgcagaggaggcgtcggcttccaggcagcttggcgatcttgttattggacacgcgagagtttagagac

SEQ ID NO: 48104 - DNA, 15 bp, Homo sapiens
  chr2:45231136-45231151
  hyper
attctgattttatcc

SEQ ID NO: 48105 - DNA, 76 bp, Homo sapiens; identical to SEQ ID NO: 6149
  chr2:45231244-45231320
  hyper

SEQ ID NO: 48106 - DNA, 62 bp, Homo sapiens
  chr2:45232131-45232193
  hyper
aggaaaagggagggagctgtttcaggaatttcagtgccttcacctagcgactgacacaagtc

SEQ ID NO: 48107 - DNA, 30 bp, Homo sapiens; identical to SEQ ID NO: 27199
  chr2:45232401-45232431
  hyper

SEQ ID NO: 48108 - DNA, 183 bp, Homo sapiens
  chr2:45233586-45233769
  hyper
ggttgtggctgttagaattggagttctcgttgttctccctgcaagtgcgggagcaaagcagcggggtcagcagggacatcgagaccacccagcgccatctcagtcacagtcagagccagccaccagcctcgggagacagatcccgggcttgtggcctgcgggtgttttcggtttctaccattt

SEQ ID NO: 48109 - DNA, 119 bp, Homo sapiens
  chr2:45235475-45235594
  hyper
ctgaattgctctgcccgctttagacaaatccctgctcgccgggtctccggcatagaaaggcctaagcatcgtccaagtcaggccgggctgccgctgggctgtggccgggcctgggggcc

SEQ ID NO: 48110 - DNA, 960 bp, Homo sapiens
  chr2:45235926-45236886
  hyper
ttgcccacggcgcccaggggtcggccgcgcagcttctccgcctcgatgtagtgtgccttgagccacagctgctgcagcttggcgtggttgtgcggcgagaactggtggctctccaggatcttgtagagctcgcggaagttgccgcggtggaaggccaccacggccttggccttgagcacgctttcattcttgtgaaggtgctcgcaggcgggcagcgaccacaggaagcggcccagccgctcgatgttgccgccctgctgcagcacctcgcacacgcacgccacttgctcctgcgtgaagccgaaggtgggcagcatggacatggtgccggctgcgtccccgcccgcccgcgcgcgccctcaccgggccgcgcggtcccgcatgggagcttcctcgccgggccgtccgggccgagacgcgggcggggctggccccctggcccggcactggcccccggtgagccccgagtcactgccgtacgtccccgcgccggccgcgggtcccacgaagctccgaaccccaacggcccgcgcgcctggcccaagccctcgcccaagcccgggggccgcccggggcgccgctccgcatgctccgcgcccgcccgccgttccctcgctcgcttctcactcgttctccctcccgtctagctggctctcagctttcttaataatattattctaagcgggcatgaggcgcggcggcccgcgccctgattggtccggttatctgacccggggcctgccagcgccagacaatagtcggagtcaaattattcgccatggagacgctgtcagtcactggtaacccgagcctcggcgggccgggcggctccccccggccggctccgctgacagatcgccccgctccgcgcagaactgagggcggctctactggagcctggggcgctctgagagcctgggaggcggagaggggccgggttggggccggcggcggcggaga

SEQ ID NO: 48111 - DNA, 147 bp, Homo sapiens; identical to SEQ ID NO: 27202
  chr2:45237178-45237325
  hyper

SEQ ID NO: 48112 - DNA, 28 bp, Homo sapiens
  chr2:45237645-45237673
  hyper
gcagggactctaggacggtggtggggct

SEQ ID NO: 48113 - DNA, 148 bp, Homo sapiens
  chr2:45237795-45237943
  hyper
tgaggtgctttaaaagggggtcctgttttttgcttctttgtcagggtgccaatggaaacatgtggtgctggtcctgtgggagaagggctcgcacaaaggtgggagaactgaggatgggtgtgttcttgctctacgttttgaaaagccc

SEQ ID NO: 48114 - DNA, 30 bp, Homo sapiens; identical to SEQ ID NO: 27205
  chr2:45240323-45240353
  hyper

SEQ ID NO: 48115 - DNA, 352 bp, Homo sapiens; identical to SEQ ID NO: 17508
  chr2:45240784-45241136
  hyper

SEQ ID NO: 48116 - DNA, 551 bp, Homo sapiens; identical to SEQ ID NO: 27208
  chr2:45241232-45241783
  hyper

SEQ ID NO: 48117 - DNA, 155 bp, Homo sapiens; identical to SEQ ID NO: 17511
  chr2:45396160-45396315
  hyper

SEQ ID NO: 48118 - DNA, 16 bp, Homo sapiens
  chr2:45396672-45396688
  hyper
ccgccaccctctgggc

SEQ ID NO: 48119 - DNA, 33 bp, Homo sapiens; identical to SEQ ID NO: 6164
  chr2:45397223-45397256
  hyper

SEQ ID NO: 48120 - DNA, 37 bp, Homo sapiens; identical to SEQ ID NO: 27213
  chr2:47596757-47596794
  hyper

SEQ ID NO: 48121 - DNA, 29 bp, Homo sapiens
  chr2:47748494-47748523
  hyper
ggaagttgcccaggcggtagagcccctgg

SEQ ID NO: 48122 - DNA, 40 bp, Homo sapiens; identical to SEQ ID NO: 27215
  chr2:47748726-47748766
  hyper

SEQ ID NO: 48123 - DNA, 293 bp, Homo sapiens
  chr2:47796750-47797043
  hyper
aaaacaggaaggaaccggtagcccttggcacgtattcttagaggagaaaacggaggctcacaaaggtcagatcacagagccggccagtgttggagcacaggcggcccggggtgagcgccagaggtgggctttcttccctcactgaaagccgggagggagagagagagagagaacgggggccggcggagaagagggcgagacgaaagtaagcaaagggacattagaagggaaggcagagccgagggacgcggaccgagcggccgagcagtggaaagggcggcaggtgaaaggca

SEQ ID NO: 48124 - DNA, 145 bp, Homo sapiens; identical to SEQ ID NO: 17515
  chr2:47797818-47797963
  hyper

SEQ ID NO: 48125 - DNA, 216 bp, Homo sapiens; identical to SEQ ID NO: 17516
  chr2:47797964-47798180
  hyper

SEQ ID NO: 48126 - DNA, 291 bp, Homo sapiens; identical to SEQ ID NO: 17517
  chr2:47798663-47798954
  hyper

SEQ ID NO: 48127 - DNA, 98 bp, Homo sapiens; identical to SEQ ID NO: 27219
  chr2:47799123-47799221
  hyper

SEQ ID NO: 48128 - DNA, 32 bp, Homo sapiens
  chr2:48982866-48982898
  hyper
gcccgcacccctctccccgccccttggctgcc

SEQ ID NO: 48129 - DNA, 111 bp, Homo sapiens
  chr2:50573484-50573595
  hyper
cgccccatccggccactgagtgaccttctggcaactgacgcccccttcccgcggggcccagccgcgcgaccagggctggtcctttagtaggtgtccacatctctctcccag

SEQ ID NO: 48130 - DNA, 24 bp, Homo sapiens
  chr2:50574097-50574121
  hyper
ccgccgaggggcagccgccgcggg

SEQ ID NO: 48131 - DNA, 57 bp, Homo sapiens; identical to SEQ ID NO: 27227
  chr2:51259509-51259566
  hyper

SEQ ID NO: 48132 - DNA, 71 bp, Homo sapiens; identical to SEQ ID NO: 6177
  chr2:56149951-56150022
  hyper

SEQ ID NO: 48133 - DNA, 206 bp, Homo sapiens; identical to SEQ ID NO: 27229
  chr2:56150227-56150433
  hyper

SEQ ID NO: 48134 - DNA, 113 bp, Homo sapiens; identical to SEQ ID NO: 27231
  chr2:56411049-56411162
  hyper

SEQ ID NO: 48135 - DNA, 33 bp, Homo sapiens; identical to SEQ ID NO: 17522
  chr2:56411733-56411766
  hyper

SEQ ID NO: 48136 - DNA, 98 bp, Homo sapiens; identical to SEQ ID NO: 27233
  chr2:58655439-58655537
  hyper

SEQ ID NO: 48137 - DNA, 51 bp, Homo sapiens; identical to SEQ ID NO: 17524
  chr2:58655998-58656049
  hyper

SEQ ID NO: 48138 - DNA, 72 bp, Homo sapiens; identical to SEQ ID NO: 17525
  chr2:58656125-58656197
  hyper

SEQ ID NO: 48139 - DNA, 39 bp, Homo sapiens; identical to SEQ ID NO: 27235
  chr2:60784424-60784463
  hyper

SEQ ID NO: 48140 - DNA, 58 bp, Homo sapiens
  chr2:60796529-60796587
  hyper
tgcattttgccttgccgcgtctcttcccacttccaacctacaccctctccaaatcttg

SEQ ID NO: 48141 - DNA, 20 bp, Homo sapiens
  chr2:60796669-60796689
  hyper
acgcacgcacacacacactt

SEQ ID NO: 48142 - DNA, 99 bp, Homo sapiens
  chr2:60797038-60797137
  hyper
tgtagtggaaatctacgtgggtttgcaggttcctgcttttcttgtgtagagcctccggtgccctccacctaaccctgccccaatgcctcgggtcttttt

SEQ ID NO: 48143 - DNA, 61 bp, Homo sapiens; identical to SEQ ID NO: 17527
  chr2:60797281-60797342
  hyper

SEQ ID NO: 48144 - DNA, 294 bp, Homo sapiens; identical to SEQ ID NO: 27239
  chr2:60962755-60963049
  hyper

SEQ ID NO: 48145 - DNA, 48 bp, Homo sapiens
  chr2:62798386-62798434
  hyper
cgtgactcacccgtgtccctcgctctcagccatcggaacagcagaagc

SEQ ID NO: 48146 - DNA, 615 bp, Homo sapiens; identical to SEQ ID NO: 27241
  chr2:63275877-63276492
  hyper

SEQ ID NO: 48147 - DNA, 259 bp, Homo sapiens
  chr2:63278703-63278962
  hyper
gcagcttcgcaaagccgtcgcagctttgagtcccattttccttcggccctagagccctggctgcttcccttccggtccccttcctacaagctggactccctcagcccaggtcttgggtcccagaagacgggggcgggaacggggctggggggagcttctttagctctaacttctctccttgaacgtcctagcccgagtccctggcttgcttcacagcgatcccgctaagcggggtgtagcgatggccccccagggcccc

SEQ ID NO: 48148 - DNA, 30 bp, Homo sapiens; identical to SEQ ID NO: 17533
  chr2:63278992-63279022
  hyper

SEQ ID NO: 48149 - DNA, 66 bp, Homo sapiens; identical to SEQ ID NO: 27244
  chr2:63282650-63282716
  hyper

SEQ ID NO: 48150 - DNA, 70 bp, Homo sapiens
  chr2:63283882-63283952
  hyper
gcccattggagcacccgcacactactccaaatcaaaaccactaagagttcctcccgcgcagactgctgcc

SEQ ID NO: 48151 - DNA, 219 bp, Homo sapiens
  chr2:63284558-63284777
  hyper
gtctaagcacagggtcgcagttccagtttacaaacctaaaacaagaaaaccaaaaccagggaacaaaacaacaaaacaaaacaaaatccgtaaaagtacagcattagggaaaaacaaacaaacccaggccccaaacccagttccaactcctctgtcggcttctctctttcaacacccttgttttgtctagtgagtttttagtgcaccttcgttctccga

SEQ ID NO: 48152 - DNA, 270 bp, Homo sapiens
  chr2:63284811-63285081
  hyper
tttggctttggccgcttcgtccagtaggtgggaaagtaatttgtaaatttgatttgtctgatgtgaagatcacaaattacttgttgaaatgtaaggcagtccccctcctcctctttatctacattacttcccgaaaataaatgcaaattaatgaacggcttgtcagtgttgctcttctgattccagcccgaggtcctggtctcggggggctaaaagcgagggaaactccgtgttaataacccgcgtgttaatgacctgcgtgaagctgga

SEQ ID NO: 48153 - DNA, 143 bp, Homo sapiens; identical to SEQ ID NO: 27250
  chr2:64455493-64455636
  hyper

SEQ ID NO: 48154 - DNA, 110 bp, Homo sapiens; identical to SEQ ID NO: 27251
  chr2:64836323-64836433
  hyper

SEQ ID NO: 48155 - DNA, 163 bp, Homo sapiens; identical to SEQ ID NO: 6195
  chr2:64836470-64836633
  hyper

SEQ ID NO: 48156 - DNA, 7 bp, Homo sapiens
  chr2:64836746-64836753
  hyper
cgcggcg

SEQ ID NO: 48157 - DNA, 148 bp, Homo sapiens; identical to SEQ ID NO: 27254
  chr2:66653040-66653188
  hyper

SEQ ID NO: 48158 - DNA, 268 bp, Homo sapiens
  chr2:66653496-66653764
  hyper
gcgagaagcttccagaattaggccaagaggcaggtggcggggtgatccggcgtccccgagtccagctggggagaaaggcgccctcggatgctcagccccaaagcagcagaagacagaagccggtgcgccatcgtcgctgcgccccagtccgcgggtcctcgcgctcctgctccggctcccgggctgccacccaccgctgcccaagcctgaccaactcccaactccctccggcacaggctgaggcgacccccaaagagaaaaataggat

SEQ ID NO: 48159 - DNA, 20 bp, Homo sapiens
  chr2:66653914-66653934
  hyper
atcctgccgggacccccacc

SEQ ID NO: 48160 - DNA, 226 bp, Homo sapiens; identical to SEQ ID NO: 27256
  chr2:66659963-66660189
  hyper

SEQ ID NO: 48161 - DNA, 47 bp, Homo sapiens; identical to SEQ ID NO: 17539
  chr2:66660603-66660650
  hyper

SEQ ID NO: 48162 - DNA, 318 bp, Homo sapiens; identical to SEQ ID NO: 27258
  chr2:66802623-66802941
  hyper

SEQ ID NO: 48163 - DNA, 157 bp, Homo sapiens; identical to SEQ ID NO: 27259
  chr2:66803441-66803598
  hyper

SEQ ID NO: 48164 - DNA, 202 bp, Homo sapiens
  chr2:66809361-66809563
  hyper
ctgccgcatgtagggcgatcttcattaacttggacgcccaacgtgattgaaatagagaggaggaaaaaacacatttgatctgggccgaccctttgtcttgaagcagattaggcagcctagaaataggaggaaaaacagaaagtctaggcaggaaaacttattgtgttcacaacatataaaaatgatccgagcggtctggtac

SEQ ID NO: 48165 - DNA, 75 bp, Homo sapiens; identical to SEQ ID NO: 17542
  chr2:68546249-68546324
  hyper

SEQ ID NO: 48166 - DNA, 221 bp, Homo sapiens
  chr2:68546892-68547113
  hyper
tgtttacgcaccacaatccccttcagctggggaagcggacatttaggctcctcctagaacagccccgggcaggaggaggagaggtttgggaggcactgggaaggcgctggagttaagcgaccactatgccaaggagcgagacccccggaatctggataccgcctcggccagctacgtgaggtggacactgctgctcgcggatccggcgccagccaggcggg

SEQ ID NO: 48167 - DNA, 123 bp, Homo sapiens; identical to SEQ ID NO: 27264
  chr2:68870366-68870489
  hyper

SEQ ID NO: 48168 - DNA, 292 bp, Homo sapiens; identical to SEQ ID NO: 27265
  chr2:68870746-68871038
  hyper

SEQ ID NO: 48169 - DNA, 631 bp, Homo sapiens; identical to SEQ ID NO: 27266
  chr2:69240089-69240720
  hyper

SEQ ID NO: 48170 - DNA, 40 bp, Homo sapiens; identical to SEQ ID NO: 27267
  chr2:69241225-69241265
  hyper

SEQ ID NO: 48171 - DNA, 175 bp, Homo sapiens; identical to SEQ ID NO: 27268
  chr2:69533635-69533810
  hyper

SEQ ID NO: 48172 - DNA, 57 bp, Homo sapiens; identical to SEQ ID NO: 27269
  chr2:70313348-70313405
  hyper

SEQ ID NO: 48173 - DNA, 377 bp, Homo sapiens
  chr2:71503413-71503790
  hyper
tctgtaaacagcaggcgaagaaattattagtcttaaaaaggacagaaagactcccgcaaaagcagcagcgcgtgccgaacaccttaggcctcacagaccttctatttgaggaatgtgctcccccaatcccagaccgctcctggtggggcgggcgcgagcgcaggaccgcggagcctgctgcgttgctcggctgcaggggaggagctgggccccgcccccggcttcccgcgctccgcgtccattggctggcctcgggggtgggcgggtcccgccgcacggagtcctgcgccttgaggctcaagcggcggcgtgcaaggcgtgtgaggcgcgtagagagccgcgcgcgccgtctgcgatgccccgggacggcgttcctg

SEQ ID NO: 48174 - DNA, 280 bp, Homo sapiens; identical to SEQ ID NO: 17549
  chr2:71503823-71504103
  hyper

SEQ ID NO: 48175 - DNA, 174 bp, Homo sapiens
  chr2:71504148-71504322
  hyper
ggcctcgcagtggcagcgcctcctgcgagcctagaccggctcagtggacgcgccgcgctgtgcacgcgggtctggggagacggcggttcttgaatgatccctcacactgcagggtatctgggagcggtggattgagggggcacaacgtggcttctgtgtcggtgaaatcgcttg

SEQ ID NO: 48176 - DNA, 149 bp, Homo sapiens
  chr2:71680684-71680833
  hyper
tctcctgtccaagagcgagatctgggctacgccgggcgcccggagccctagtccagcccccggccatcgcggccgccgcccagccaggtgcaaaatgccgtgtcattgggagactccgcagccggagcattagattacagctcgacgga

SEQ ID NO: 48177 - DNA, 379 bp, Homo sapiens
  chr2:71680863-71681242
  hyper
agcagaagcccctgttctcggaacgccggctgacaagcggggtgagcgcagccggggcggggacccagcctagcccactggagcagccgggggtggcccgttcccctttaagagcaactgctctaagccaggagccagagattcgagccggcctcgcccagccagccctctccagcgaggggacccacaagcggcgcctcggccctcccgacctttccgagccctctttgcgccctgggcgcacggggccctacacgcgccaagcatgctgagggtcttcatcctctatgccgagaacgtccacacacccgacaccgacatcagcgatgcctactgctccgcggtgtttgcaggtaggaggggccgaccaccctcgccc

SEQ ID NO: 48178 - DNA, 2 bp, Homo sapiens
  chr2:71693593-71693595
  hyper
ac

SEQ ID NO: 48179 - DNA, 43 bp, Homo sapiens; identical to SEQ ID NO: 27273
  chr2:71693820-71693863
  hyper

SEQ ID NO: 48180 - DNA, 171 bp, Homo sapiens; identical to SEQ ID NO: 27274
  chr2:71694277-71694448
  hyper

SEQ ID NO: 48181 - DNA, 30 bp, Homo sapiens; identical to SEQ ID NO: 27275
  chr2:72372207-72372237
  hyper

SEQ ID NO: 48182 - DNA, 167 bp, Homo sapiens; identical to SEQ ID NO: 27276
  chr2:72372591-72372758
  hyper

SEQ ID NO: 48183 - DNA, 127 bp, Homo sapiens; identical to SEQ ID NO: 6212
  chr2:72374563-72374690
  hyper

SEQ ID NO: 48184 - DNA, 30 bp, Homo sapiens; identical to SEQ ID NO: 27279
  chr2:72375350-72375380
  hyper

SEQ ID NO: 48185 - DNA, 30 bp, Homo sapiens; identical to SEQ ID NO: 27280
  chr2:72377270-72377300
  hyper

SEQ ID NO: 48186 - DNA, 58 bp, Homo sapiens; identical to SEQ ID NO: 6214
  chr2:73142033-73142091
  hyper

SEQ ID NO: 48187 - DNA, 30 bp, Homo sapiens; identical to SEQ ID NO: 27282
  chr2:73142786-73142816
  hyper

SEQ ID NO: 48188 - DNA, 30 bp, Homo sapiens; identical to SEQ ID NO: 27283
  chr2:73143592-73143622
  hyper

SEQ ID NO: 48189 - DNA, 30 bp, Homo sapiens; identical to SEQ ID NO: 6215
  chr2:73143902-73143932
  hyper

SEQ ID NO: 48190 - DNA, 408 bp, Homo sapiens
  chr2:73145232-73145640
  hyper
ctaccctcaccccagcgcggccgaggcggccttcgtgagtggcttccctgccgcggccgccgcgggcgcgggccgctcgctctacggtgggcccgagctcgtgttccccgaggccatgaaccaccccgcgctgaccgtgcatccggcgcaccagctgggcgcctccccgctgcagcccccgcactccttcttcggcgcccagcaccgggaccctctccatttctacccctgggtcctgcggaaccgcttcttcggccaccgcttccagggtgagtgtccacgctgtgcccgccgaggcggccggccggcgcccgtgctgcggcgatgcgggggaggctcgggggcgcgcggggctgtttagaagttactgccgggaaggctgcaggtccgcggaggtagattcccagg

SEQ ID NO: 48191 - DNA, 230 bp, Homo sapiens
  chr2:73145694-73145924
  hyper
caggaaagcaggtggagacctccaggcttttctagaaaatataccagttcggacgcaagcccaggcgcgtcctcggagcctgtgctggccctcgccacagcctgcccaattctctctcccagctgagccagtctcagaccagagtacaactcctcccgctctccctccgcccggcttaacctcgcaccacgcttctctcgcaagtccaccaccacctccgagacctcagc

SEQ ID NO: 48192 - DNA, 48 bp, Homo sapiens; identical to SEQ ID NO: 27286
  chr2:73146224-73146272
  hyper

SEQ ID NO: 48193 - DNA, 157 bp, Homo sapiens
  chr2:73147167-73147324
  hyper
aggagagggcggggtcgttcctaagtcctgtggcctccagccgttcagcttgtccggagtcggcatcctgggccgcaccctcggcttcgaatccagcccctgacgccctccgcaccgcggttcctgcctccgggcgccgagggccgggggcgcctgg

SEQ ID NO: 48194 - DNA, 17 bp, Homo sapiens
  chr2:73150907-73150924
  hyper
gtgtgcctagcaccccg

SEQ ID NO: 48195 - DNA, 18 bp, Homo sapiens
  chr2:73151831-73151849
  hyper
aagcgctaaagacctagc

SEQ ID NO: 48196 - DNA, 53 bp, Homo sapiens; identical to SEQ ID NO: 6222
  chr2:73152398-73152451
  hyper

SEQ ID NO: 48197 - DNA, 241 bp, Homo sapiens
  chr2:73152754-73152995
  hyper
accgtcccctcccaagtcccgggcagtgagaagatgcccggcatggggggcagccggagcctccctttagcagccagagtaggaagggggcttagtgagggagcccagacccaaacttcatccgcagctttcttcggcggaccttaccctctcctccttcagtggcattttggcatctattgtcgtcatatctgtctgctgccccacttaatctacaaatcgctcacgggtcggaggcagg

SEQ ID NO: 48198 - DNA, 168 bp, Homo sapiens
  chr2:73429355-73429523
  hyper
caggcactgccctaccgctctccagatcacagctccgcctctgcaaggccccggggaaacgggcatcccttcttcagtgagcaaaggagaaagacggagcccggtggctgggtgtttcgcccaggatcaccagcgagctcagagtcctccccacgaccgccccagggt

SEQ ID NO: 48199 - DNA, 309 bp, Homo sapiens
  chr2:73429614-73429923
  hyper
ggggccccgcccggaccgcagtggggagaggccgccccatgccccgccccgccaaatttaagagccttcgccgagcgccaggaggttcccagacaaccggtcttgctcgctgccttttgcagaatcttctcacttctcccgagctcccttccttgcgtccgtccgggcaacggccgcgtcatgcctagccccaggccgcgaggcagcccgccacccgctccctcgggctctcgggtccgacctccgcgctctggccgctctccggcgcccaggtcccctactggcccgaacacgccccgcgctcccgga

SEQ ID NO: 48200 - DNA, 13 bp, Homo sapiens
  chr2:73430743-73430756
  hyper
tgcatgcaatgct

SEQ ID NO: 48201 - DNA, 32 bp, Homo sapiens; identical to SEQ ID NO: 6228
  chr2:73512107-73512139
  hyper

SEQ ID NO: 48202 - DNA, 187 bp, Homo sapiens; identical to SEQ ID NO: 17562
  chr2:73518261-73518448
  hyper

SEQ ID NO: 48203 - DNA, 660 bp, Homo sapiens
  chr2:73518919-73519579
  hyper
gcggccgcgggcagaagcagcgcgtgctgcatttgccgccgcggcgccccttgcgtcgcgccttggcctgggggaaaggggtgggcggcggcggcggcacgggtggtgcagccacgccactgcttccagggatgtccgccaccagaggtttagggaagtccgccgcggcggcgctgcgaaggcccagcggggaaagctgaggctgcgtactggccagaaactctccgccgtcgccgctactccctccctccccactaggaggggtcaggagcccagggaggccctcagccccctcccctaagtcacccggggccagcgggaaagcgtcataggccccgctgggatagagtctgttggctgggacggccggcagttccgcagggcagctgatggacagcaagtcctcaatcttggtccctattacgggaaaacgagcctccggggcggcctggtagtctccctgtgacccacagttccctggggcccccacagaaagcagctcccagggcgcgtagggacccttgaaggcagagacagcgtccagcgctggcgaggcgggaggcgcccggaggccgggcttgacgtcgggcggggagagctgaggctcatacaggcactgcgagggggcacccgcgcaaggcgaggcctcccagaacgcct

SEQ ID NO: 48204 - DNA, 26 bp, Homo sapiens
  chr2:73519841-73519867
  hyper
gaagcaggagtcggctaagtccccac

SEQ ID NO: 48205 - DNA, 802 bp, Homo sapiens; identical to SEQ ID NO: 27300
  chr2:73520242-73521044
  hyper

SEQ ID NO: 48206 - DNA, 35 bp, Homo sapiens; identical to SEQ ID NO: 27301
  chr2:74229462-74229497
  hyper

SEQ ID NO: 48207 - DNA, 126 bp, Homo sapiens; identical to SEQ ID NO: 27302
  chr2:74230043-74230169
  hyper

SEQ ID NO: 48208 - DNA, 44 bp, Homo sapiens; identical to SEQ ID NO: 6233
  chr2:74726199-74726243
  hyper

SEQ ID NO: 48209 - DNA, 52 bp, Homo sapiens; identical to SEQ ID NO: 27305
  chr2:74730183-74730235
  hyper

SEQ ID NO: 48210 - DNA, 30 bp, Homo sapiens; identical to SEQ ID NO: 27306
  chr2:74730614-74730644
  hyper

SEQ ID NO: 48211 - DNA, 247 bp, Homo sapiens
  chr2:74740605-74740852
  hyper
cacaaggtcaccaagcggcttaggtctttccccacctcccttctctgacagctccaggccattttttgagtttgggtggggtaaaatgtttatgggaaacaaggcggccaggatccaaccaaggcctcagtgaggtcccacgtgtcccccgtggcgagatttcgccctcccgccgttgaggaggaagagtgtgagaacagacttcctaggcacagaatggaggggcagagtcctgcattgaggactc

SEQ ID NO: 48212 - DNA, 448 bp, Homo sapiens
  chr2:74741387-74741835
  hyper
ccatgctcgggcccctcccgcgctgagcctggctcctaacaccctggccccctgtccccctccccgcacatctccgccagccagccttccccctgcgcttggcgcaaacaggcgtcccttcccctttaactgctgggccccgcccctgccctacccccagcccccactacccacccgggccgatccgtcagtcactgccccagccggagctggccaaccctctccacccgggacttgggcagcggcgccggcagcccagcgtctatttgcgcttaagagccagcaaggaagctccaggggccccagctggccgtgctcccccgggatgcaagtccctgcgctgacgcccggcagcggctggcacgggcgcggctgctccgggtgcacagggatgctgctgtttcggggaccccggcgccctgccttggccagccccgcgggcccctga

SEQ ID NO: 48213 - DNA, 196 bp, Homo sapiens
  chr2:74741955-74742151
  hyper
cacacaacctcccacaccacgagccaatcagcttcggcatcgatcagatcctgagcggccccgaaaccccagggggcggtctaggcctgggtcgcgggggccagggtcatggggagaatggggcgttctcgggtggataccacggagcctcgggctacggtcccgccggctcacttgccccgctgcccggcagctc

SEQ ID NO: 48214 - DNA, 15 bp, Homo sapiens
  chr2:74743766-74743781
  hyper
cgaagcaatagaggg

SEQ ID NO: 48215 - DNA, 135 bp, Homo sapiens
  chr2:74781946-74782081
  hyper
ctggcgcatggatgccgaaccttatccgggctagtagtgggtgagagagcccagaaacagggagaggtgggcagcgggctggagagcggcgccgggagttggagagcctgtgactttcccgtgaagttgctttgc

SEQ ID NO: 48216 - DNA, 44 bp, Homo sapiens
  chr2:74782271-74782315
  hyper
tctccctagaggtggaggaagacctgggccgtgctctacccggc

SEQ ID NO: 48217 - DNA, 80 bp, Homo sapiens; identical to SEQ ID NO: 27315
  chr2:75146976-75147056
  hyper

SEQ ID NO: 48218 - DNA, 67 bp, Homo sapiens; identical to SEQ ID NO: 6243
  chr2:75426808-75426875
  hyper

SEQ ID NO: 48219 - DNA, 405 bp, Homo sapiens
  chr2:75427525-75427930
  hyper
cctgcaggccagagccgggctcggggtggcatcggtggtccttctccctgttccccttccaggtttgcataggggctggaggacaggtcagccagccttctctgcccgcctccatcctgccctgccgtcttctgactttgaggcctcgtatcccagtccaagaccatttcaaacggtagaactggtgccagacacttggaggaggcagggcaaagactcgccagtccgtataaacccttttggagaagccaagatgggatgagctccgcagcacgttcccgccagactgctgcaggcagagttccgcggaaaactgaaccccgggagtcctcaggggcccatctaccccggtgcaccgccccctcctttcactgcggggactcggagctgtgggactggagcgcg

SEQ ID NO: 48220 - DNA, 30 bp, Homo sapiens; identical to SEQ ID NO: 27318
  chr2:75428245-75428275
  hyper

SEQ ID NO: 48221 - DNA, 157 bp, Homo sapiens; identical to SEQ ID NO: 27319
  chr2:75787200-75787357
  hyper

SEQ ID NO: 48222 - DNA, 482 bp, Homo sapiens; identical to SEQ ID NO: 27320
  chr2:75787804-75788286
  hyper

SEQ ID NO: 48223 - DNA, 15 bp, Homo sapiens
  chr2:75788330-75788345
  hyper
cggtcctccaggctt

SEQ ID NO: 48224 - DNA, 166 bp, Homo sapiens; identical to SEQ ID NO: 27322
  chr2:79739850-79740016
  hyper

SEQ ID NO: 48225 - DNA, 242 bp, Homo sapiens; identical to SEQ ID NO: 27323
  chr2:79740063-79740305
  hyper

SEQ ID NO: 48226 - DNA, 79 bp, Homo sapiens
  chr2:80529299-80529378
  hyper
cagcctggtgcccgccggcccgtcccggctgcccaggcgtatttggtagcgcatgggttgagagccactgggacaatca

SEQ ID NO: 48227 - DNA, 233 bp, Homo sapiens; identical to SEQ ID NO: 17576
  chr2:80530022-80530255
  hyper

SEQ ID NO: 48228 - DNA, 72 bp, Homo sapiens; identical to SEQ ID NO: 27327
  chr2:80530256-80530328
  hyper

SEQ ID NO: 48229 - DNA, 97 bp, Homo sapiens
  chr2:80530408-80530505
  hyper
cgcacgggcacaaactggatggcgttggcccgcatatgcagcgtggtgagcttccgcagcccgtggaagaggtcgggcgcgagcgcctgcagcttgt

SEQ ID NO: 48230 - DNA, 29 bp, Homo sapiens
  chr2:80530558-80530587
  hyper
ggcagttgggtgatctggttggaactcag

SEQ ID NO: 48231 - DNA, 397 bp, Homo sapiens
  chr2:80531328-80531725
  hyper
taattatatgcagggcgagagaagacccctctgtgtttccgaggcagccccggtccgcggccggcggatctggcaggcgcacaatgtctcactttgctgctcggctcggggctgcaagggcggccggcaaggcggggaggcgacttctaggacccgcaagtttcccaactacgtgccggagcccgagcttcgccttcctgccgccttcctttccctctgcagttcggactgtgacgttgtggggggaaaaaactccaaactcggggctcgcgactccccaggatctgacagtctggttaatgtccgtcattggaaacgaccactgaccggcgccaccttttactccgcggaaacagcctgccattcgcgccccgggcagctgcagagagcgggctca

SEQ ID NO: 48232 - DNA, 258 bp, Homo sapiens
  chr2:80531755-80532013
  hyper
ggcgggcggtggggaggtgcggacggcggcgcggggagcggcgagcggcgcccgggctccttccctccaccaggcagtgtgcggcgcgagcttgcacaggcacctactgctcactgagtgtcgtaagctgctcacgattgtgcgtcttccccgagcacctcagacatgggcagattgaaaaggggtgggcataaaaccaacattttaccgaaccactaaagtaatatatgttttttgatgaaacggaaaacactttca

SEQ ID NO: 48233 - DNA, 14 bp, Homo sapiens
  chr2:80549571-80549585
  hyper
cacaattcgggccc

SEQ ID NO: 48234 - DNA, 19 bp, Homo sapiens
  chr2:85107435-85107454
  hyper
aacatctaaagcgcccggc

SEQ ID NO: 48235 - DNA, 114 bp, Homo sapiens
  chr2:85107538-85107652
  hyper
tcccagatcggtaaaaacaagggaaatggcttcaactccctaaagtcccttctaactcaggcactgaacatatgaaggttaagccaagcagcttcagggcgctgttaatatttt

SEQ ID NO: 48236 - DNA, 401 bp, Homo sapiens; identical to SEQ ID NO: 27332
  chr2:85360051-85360452
  hyper

SEQ ID NO: 48237 - DNA, 90 bp, Homo sapiens; identical to SEQ ID NO: 27333
  chr2:85360920-85361010
  hyper

SEQ ID NO: 48238 - DNA, 15 bp, Homo sapiens
  chr2:85361295-85361310
  hyper
cgcacccttgccctc

SEQ ID NO: 48239 - DNA, 4 bp, Homo sapiens
  chr2:87016575-87016579
  hyper
cgac

SEQ ID NO: 48240 - DNA, 238 bp, Homo sapiens
  chr2:87016636-87016874
  hyper
gcctcagatctcggtttcccaccacttggacagcccttgactctacctacagtatcagggctgtccctggcatgggctctccccgcggtgcgtgccgcccccgccccgggcccccgcacgcctcacctgcgccccccgccgctggccggcacgcctctgggcgcagggacaggggctgcgacgcgatggtgggcgccggtgttggtggtcgcggcgctggcgtcgtggtgggcttcgc

SEQ ID NO: 48241 - DNA, 67 bp, Homo sapiens; identical to SEQ ID NO: 17584
  chr2:87017729-87017796
  hyper

SEQ ID NO: 48242 - DNA, 367 bp, Homo sapiens; identical to SEQ ID NO: 27338
  chr2:87088683-87089050
  hyper

SEQ ID NO: 48243 - DNA, 30 bp, Homo sapiens; identical to SEQ ID NO: 27339
  chr2:88469803-88469833
  hyper

SEQ ID NO: 48244 - DNA, 16 bp, Homo sapiens
  chr2:88751800-88751816
  hyper
ggggcggcggcggcgg

SEQ ID NO: 48245 - DNA, 113 bp, Homo sapiens; identical to SEQ ID NO: 17587
  chr2:88751942-88752055
  hyper

SEQ ID NO: 48246 - DNA, 318 bp, Homo sapiens
  chr2:88752285-88752603
  hyper
ggtggccgcgggcctgggctctccacgcccccgccacgccccacctgcccgcgcgcccaaacccggagcccgcccgccccgcccctaccgcccctctgcccgggcccgggagcgtctgggaggccggcgcctccaggtttcgggcaaaaagcagcaccccattcctagcccacgtttcttaacatcataataagtaaagccacgaatattaaagagaagataacccgaacagtacgaatgatttctaaaaagttaacttggggtggccgctcgggccacctgcctagtcatccttttggcttttctacctctttcctc

SEQ ID NO: 48247 - DNA, 50 bp, Homo sapiens
  chr2:88752785-88752835
  hyper
agtttttctaaccaaactgtaggttcgctcacattcgggaagcatttatt

SEQ ID NO: 48248 - DNA, 38 bp, Homo sapiens; identical to SEQ ID NO: 27343
  chr2:88753098-88753136
  hyper

SEQ ID NO: 48249 - DNA, 221 bp, Homo sapiens
  chr2:89065278-89065499
  hyper
gctagggcggtttctccgcctcgggcctgttgggcggggccggctaaggtgcgcgtgctcgctggtcctaacggttctgttgggcgtttctgctgagaggcgggaggggctgagagtctgtgcgaaggtaggtggacagactgcattgcttgttgttgcgcttcggaggcggcgatccccgaaggcgagctgaaatacggctggagcgttcccaggctaca

SEQ ID NO: 48250 - DNA, 192 bp, Homo sapiens; identical to SEQ ID NO: 27346
  chr2:91635152-91635344
  hyper

SEQ ID NO: 48251 - DNA, 118 bp, Homo sapiens
  chr2:95664014-95664132
  hyper
cggccctcggtggggtcgactgggcggagccgccgcctcctatcttcccttgaaggcacctgcgcagggggacccgcggtgcctgggaggggagggggactttcgcatgaagcccctc

SEQ ID NO: 48252 - DNA, 243 bp, Homo sapiens
  chr2:95690793-95691036
  hyper
ccaccaccagcagccttctgctggggccggcacagctgggagcaacctcctactctcaggcagacgcgcagcaccaagcagagaggcccggtgcaggatcccagcgccgaaccagcgccggctcagtggacgcggaaggggccggcggccgcggccggtcccatcccccactgcagacccccagcctgtggcggtggtccagttccgccaggaaaccgccgcctggagctgtgggtcgcgcac

SEQ ID NO: 48253 - DNA, 231 bp, Homo sapiens; identical to SEQ ID NO: 17593
  chr2:95691269-95691500
  hyper

SEQ ID NO: 48254 - DNA, 29 bp, Homo sapiens
  chr2:95691501-95691530
  hyper
ctcgtcccgtcccaaggccgacgccagca

SEQ ID NO: 48255 - DNA, 225 bp, Homo sapiens
  chr2:95691769-95691994
  hyper
aagccagggaagtcccctcccacctccggtcctttgtgcccttctagaccaacagaatgaggggaacagtctacaggactatggaggaaaaactgggttcccaactggggtcagatgtaggcagcggggcagggggggacggctcttggttcgctggtcccaaagctgcgcgcggggcccacttgacgcgcgcagcgccaccgaagctcccgccgcgctttgcgc

SEQ ID NO: 48256 - DNA, 98 bp, Homo sapiens; identical to SEQ ID NO: 27350
  chr2:95873425-95873523
  hyper

SEQ ID NO: 48257 - DNA, 204 bp, Homo sapiens; identical to SEQ ID NO: 27351
  chr2:96012452-96012656
  hyper

SEQ ID NO: 48258 - DNA, 41 bp, Homo sapiens; identical to SEQ ID NO: 27352
  chr2:96192504-96192545
  hyper

SEQ ID NO: 48259 - DNA, 77 bp, Homo sapiens; identical to SEQ ID NO: 27353
  chr2:96781907-96781984
  hyper

SEQ ID NO: 48260 - DNA, 196 bp, Homo sapiens; identical to SEQ ID NO: 27354
  chr2:96782022-96782218
  hyper

SEQ ID NO: 48261 - DNA, 69 bp, Homo sapiens; identical to SEQ ID NO: 27355
  chr2:96987148-96987217
  hyper

SEQ ID NO: 48262 - DNA, 17 bp, Homo sapiens
  chr2:96990881-96990898
  hyper
agggaggccgagcagcg

SEQ ID NO: 48263 - DNA, 49 bp, Homo sapiens; identical to SEQ ID NO: 27357
  chr2:97193015-97193064
  hyper

SEQ ID NO: 48264 - DNA, 26 bp, Homo sapiens
  chr2:97193626-97193652
  hyper
aatcgccgttacgggaaaagtaaaac

SEQ ID NO: 48265 - DNA, 104 bp, Homo sapiens; identical to SEQ ID NO: 27359
  chr2:97203428-97203532
  hyper

SEQ ID NO: 48266 - DNA, 206 bp, Homo sapiens
  chr2:98962692-98962898
  hyper
ggagagaacccagaacggaacgacggacttgtttgctttcttgcccctgactctccccgtcctccctgggagggttggggatgtgaactaatgacttctgcctctttcggaccgcctttgaggctccagagcctcaccttactttcccacggagagggaggccacaggctccttcagcagtcgccgagcagagtcctgggccggga

SEQ ID NO: 48267 - DNA, 227 bp, Homo sapiens; identical to SEQ ID NO: 17600
  chr2:98963599-98963826
  hyper

SEQ ID NO: 48268 - DNA, 123 bp, Homo sapiens
  chr2:98964473-98964596
  hyper
caactgggtcttctacgccagagtcccagttgtagaaaagtcggccaggtcagaggacccagatgggatttcactaagctggtgggagcttctttgcgttctttggggtagggggaaggacag

SEQ ID NO: 48269 - DNA, 73 bp, Homo sapiens; identical to SEQ ID NO: 17601
  chr2:98964645-98964718
  hyper

SEQ ID NO: 48270 - DNA, 477 bp, Homo sapiens; identical to SEQ ID NO: 27366
  chr2:99552170-99552647
  hyper

SEQ ID NO: 48271 - DNA, 74 bp, Homo sapiens; identical to SEQ ID NO: 27367
  chr2:99553081-99553155
  hyper

SEQ ID NO: 48272 - DNA, 186 bp, Homo sapiens; identical to SEQ ID NO: 27369
  chr2:100720888-100721074
  hyper

SEQ ID NO: 48273 - DNA, 30 bp, Homo sapiens; identical to SEQ ID NO: 27370
  chr2:100721292-100721322
  hyper

SEQ ID NO: 48274 - DNA, 21 bp, Homo sapiens
  chr2:100939155-100939176
  hyper
tagcttcgacttaggaaattg

SEQ ID NO: 48275 - DNA, 61 bp, Homo sapiens; identical to SEQ ID NO: 27376
  chr2:101033731-101033792
  hyper

SEQ ID NO: 48276 - DNA, 244 bp, Homo sapiens
  chr2:101033998-101034242
  hyper
ggtcccgggatgtggcggcggcggcagcggaagtaaggaagacgcccggcgcgctagaccggctttgggggccagaacgccggcaccgcctcacgcggccccctcgcgcctatccggccgtgcgcgccgcctgcccgcgcgcgtccccgccgccgtccccggccgtgcgcgttccagcgggtcgcggggagtggggaggggcgcggccgcgggaccccaggcccggatcccgagtctccctttc

SEQ ID NO: 48277 - DNA, 41 bp, Homo sapiens; identical to SEQ ID NO: 27378
  chr2:101436001-101436042
  hyper

SEQ ID NO: 48278 - DNA, 159 bp, Homo sapiens; identical to SEQ ID NO: 27379
  chr2:102003995-102004154
  hyper

SEQ ID NO: 48279 - DNA, 825 bp, Homo sapiens
  chr2:102090355-102091180
  hyper
gcagggtccaaccaacgggtccccgcggggcagaccggatggctttccgcgggaagggtgacaacggggaagtcacagatgggaagcccggccccatcgccgattcgggcccggggcttttacgcgtgtgcgtgcatggcaggtccctccgcgctgcggcgggcgagcatcagaaagcgctgggcctggggccgctcctcacacccggctttgacccggcgtcccgagggcagccgtagcgggaaccacgcttcccctccccggccccacctcctccatcccagcgtcccaggcgcctggcggctcaccactggatgacgccgctgtgcgggccccggctaccctcgccgctcgacggcgaggccggcaccccctcggccatggctcggccccgggcctgcagcaccgaggcaggcagcgagcggcggccgtgggcggcgctgggttgcaccggtcctgctaccgccgctcctcggtgtttactttagaaaggagcgcgcggggggcgcgcggggcgcggggcgggagcccagtcctccaggcccgagcccgggggcgcggaaggcgcgcggcgagtacgggaggccacagctccccaacccccgcgccccgccgaggatgcgcggaccccgccctgcatcctgcggtgtgggctggagctgcctcccgctctcacccagcgcccttcccaccggcgtagcaaccagtcaaacagggacgcgaacaacaagcaccaacttacaccttttccaatctggtcgcggtgttgagtccgtgggtgtccttgacttgcttgagcgttggagttattcaggcagttttcaa

SEQ ID NO: 48280 - DNA, 37 bp, Homo sapiens; identical to SEQ ID NO: 27381
  chr2:103236062-103236099
  hyper

SEQ ID NO: 48281 - DNA, 124 bp, Homo sapiens
  chr2:105458957-105459081
  hyper
ttgggaagactcaggcgaaagagggagatgcccgtgtagagaaccgaggaggggggctggggtagaataatcagctctaaggttgcagatttagatctcaaggctgaaaaggataagcttccac

SEQ ID NO: 48282 - DNA, 6 bp, Homo sapiens
  chr2:105459902-105459908
  hyper
cggcag

SEQ ID NO: 48283 - DNA, 114 bp, Homo sapiens
  chr2:105460951-105461065
  hyper
tgctaaatgcagtggcgagaggagggagcagcgtctacatgaagcgaacttttcaagcgcagagccctgactcccaggcgcgggggctcaccgggaggggcccgggcgagagag

SEQ ID NO: 48284 - DNA, 24 bp, Homo sapiens
  chr2:105461163-105461187
  hyper
cggccggtgggcagccctcgaccc

SEQ ID NO: 48285 - DNA, 171 bp, Homo sapiens
  chr2:105461243-105461414
  hyper
ggggttaaccaggcaccgacctgaggcgccctgcagctgccaaaagctcgaccggaaacctagaacatgggacccaattcatcggttttcctcgtccatacatgcatccatccatccctgcatgcgtacatgcatgcaatacaaatcccgggacgccggcacggagagctg

SEQ ID NO: 48286 - DNA, 9 bp, Homo sapiens
  chr2:105461555-105461564
  hyper
cgcccgccg

SEQ ID NO: 48287 - DNA, 228 bp, Homo sapiens
  chr2:105468563-105468791
  hyper
ttatatatacatatacgcatacgtaaatataaaaagcaacctttgggggccgcagaggaaaaaaatccgttctgtttggggtttggttaccaccgcctttggtatctataccttggcaataatggctttgctaaaacctacctacgatggtatctcacccggcaagcaggagctggacaagagcctacataaattctacgcgtctagtgttaatcttgagatcacgcg

SEQ ID NO: 48288 - DNA, 737 bp, Homo sapiens
  chr2:105468908-105469645
  hyper
cggagcgcaccggcggccgctcctcggctgcgtcctgggctgccgctcgggctcgggactgccagatgcaggctctggctgggggcggcgggcgcaagcgggcgcacccgcagctaggggtgcggggtgcacgcacacgcacgctcattaagagccatgtatttattgaatgtccgagttgggttagttcattggaaatccccgaggagggctcaatttgcccttgttttcgttgccactttctcttttttcttggttcgctgaggttcctctgtgcagcgtttccgcttggccgcgtccccccaccccaccccaccccacccccgcttctctcgcctaccgggtgcactccccctcccatcccccttaactctttcagctgggttagagctgagaaagcatttgtcgccgccagccccatccaccacgcaaatccatctgagacagaaaggaaagaaaaaaaagcaccaccatgcctaagaatagagagcgagcaaacccccccaccgctaatcacacacacacacacacacacacacacacacacacacgaggaagcggtggagcagagaagggcgcggctagccgatcccggttctttcgcccggctcctgctgccacagggaattcctaaagccattggggtcgaatacacttacgatgaatctatgggggaaggtcggactgattgcttttcaaatacatcgcacggctccgctgaccggcaccctccaaac

SEQ ID NO: 48289 - DNA, 259 bp, Homo sapiens; identical to SEQ ID NO: 17614
  chr2:105470091-105470350
  hyper

SEQ ID NO: 48290 - DNA, 127 bp, Homo sapiens
  chr2:105470840-105470967
  hyper
acacacacacctccacctccaccaatgcactcttcttcctcctccttctccagacaactgctgggaaaaaaataaaacaccaaccccaaccgtcagcaacaaggtaacagagcgattcgacatcatt

SEQ ID NO: 48291 - DNA, 658 bp, Homo sapiens
  chr2:105471573-105472231
  hyper
gccggggctggggggcggccacgaccccccctgaagggggtggccacggagcgcaccccgagaagcgagcccccctccccagagcgctgctcctgcggctgctgctgctgctggtgaccaaggccggccggcgacccccgcgccctgccgagcggccttgcagctgcagccgggggccgcggcggcggcggcggcggcgggggcggaggcggcggcggaggaggaggcggcgaaggcggcggggccggcgggggcccggggcgggggcggggaaggagggggggaggaggcgggaggcggggggcgcggcggcggcggcggcggcggcggccgcggctgctgctgcggcggcggcggcggtggtggcggcggtggggtggcgggagcggagcggcatggccacggcggcttctaacccctacctgccggggaacagcctgctcgcggccggctctattgtgcactcggacgcggcaggggctggcggcggcgggggtggcggcggcggcggcggcgggggcggcgcagggggcgggggcggcggcatgcagccgggcagcgccgccgtgacctcgggcgcctaccggggggacccgtcctctgtcaagatggtccagagcgacttcatgcagggggccatggccgccagcaacggcgg

SEQ ID NO: 48292 - DNA, 403 bp, Homo sapiens; identical to SEQ ID NO: 17617
  chr2:105472845-105473248
  hyper

SEQ ID NO: 48293 - DNA, 215 bp, Homo sapiens; identical to SEQ ID NO: 6307
  chr2:105473599-105473814
  hyper

SEQ ID NO: 48294 - DNA, 78 bp, Homo sapiens
  chr2:105478684-105478762
  hyper
cgttcttgatgagtccggtcttcctcaaggaagagttggctctggaagtgacctcagaggggtctgggaagagggcaa

SEQ ID NO: 48295 - DNA, 13 bp, Homo sapiens
  chr2:105479089-105479102
  hyper
gccagactgtggc

SEQ ID NO: 48296 - DNA, 210 bp, Homo sapiens; identical to SEQ ID NO: 27398
  chr2:105479657-105479867
  hyper

SEQ ID NO: 48297 - DNA, 64 bp, Homo sapiens; identical to SEQ ID NO: 27399
  chr2:105483752-105483816
  hyper

SEQ ID NO: 48298 - DNA, 236 bp, Homo sapiens; identical to SEQ ID NO: 27400
  chr2:105484041-105484277
  hyper

SEQ ID NO: 48299 - DNA, 156 bp, Homo sapiens; identical to SEQ ID NO: 17620
  chr2:105488281-105488437
  hyper

SEQ ID NO: 48300 - DNA, 686 bp, Homo sapiens; identical to SEQ ID NO: 27402
  chr2:105488548-105489234
  hyper

SEQ ID NO: 48301 - DNA, 45 bp, Homo sapiens; identical to SEQ ID NO: 27403
  chr2:105489909-105489954
  hyper

SEQ ID NO: 48302 - DNA, 81 bp, Homo sapiens; identical to SEQ ID NO: 27404
  chr2:105760590-105760671
  hyper

SEQ ID NO: 48303 - DNA, 44 bp, Homo sapiens
  chr2:105760937-105760981
  hyper
tctgggcagaggccacgcggggacggaggaggcagagaggacgg

SEQ ID NO: 48304 - DNA, 47 bp, Homo sapiens; identical to SEQ ID NO: 17623
  chr2:105761037-105761084
  hyper

SEQ ID NO: 48305 - DNA, 171 bp, Homo sapiens; identical to SEQ ID NO: 27406
  chr2:106014945-106015116
  hyper

SEQ ID NO: 48306 - DNA, 9 bp, Homo sapiens
  chr2:106681724-106681733
  hyper
aggggaaca

SEQ ID NO: 48307 - DNA, 30 bp, Homo sapiens; identical to SEQ ID NO: 27409
  chr2:106682246-106682276
  hyper

SEQ ID NO: 48308 - DNA, 47 bp, Homo sapiens
  chr2:107103818-107103865
  hyper
cacccaccccagccgcgactgtctccgccgagcccccggggccaggt

SEQ ID NO: 48309 - DNA, 212 bp, Homo sapiens
  chr2:107103928-107104140
  hyper
aggcggcggcgcgcgggctgcccaaggtctgcgctcccggggcctgagcggggaggtgatacgtggctgtcctggccctggtcctggcagggtgcagcgtcgagcccgcggtggcggggcgcccgggaggcagcttggcaggcagggtccctaagggtggaaataaaatacccccatatcgcattaccccgggggaccggagagcccctgac

SEQ ID NO: 48310 - DNA, 19 bp, Homo sapiens
  chr2:107502581-107502600
  hyper
cgacaccgtggtgctcggt

SEQ ID NO: 48311 - DNA, 43 bp, Homo sapiens; identical to SEQ ID NO: 2030
  chr2:107502865-107502908
  hyper

SEQ ID NO: 48312 - DNA, 111 bp, Homo sapiens
  chr2:107503421-107503532
  hyper
cgaaggttacctgcacagtacccgcctggcaccgcgcctggacacctccggggcactcgggtcccgggcggcggcaggaatgcaggaatgcgcacaggctgtgggcggcca

SEQ ID NO: 48313 - DNA, 101 bp, Homo sapiens
  chr2:107503561-107503662
  hyper
aagtgagtctttgtgtaccctgtccaacacctccccccgccagcgcggaaggccgggctacctgcgcgcctggcagcgcctggcagccggctgggtggggc

SEQ ID NO: 48314 - DNA, 221 bp, Homo sapiens
  chr2:107503663-107503884
  hyper
caggggagcgcagcatcctccccggctcgctagctccctttgttcatctcgctcaaccaggctccgcactgccgcctggccctcgctcccagagcttctctaaggatatgggatggacttgggagcgggccacctttcatttgggaagggtagctcgccaagtccggtgacggtgctccctggagacccccacctgcccgcccctccacactgccggtccc

SEQ ID NO: 48315 - DNA, 30 bp, Homo sapiens; identical to SEQ ID NO: 27415
  chr2:108602866-108602896
  hyper

SEQ ID NO: 48316 - DNA, 114 bp, Homo sapiens; identical to SEQ ID NO: 27416
  chr2:108603211-108603325
  hyper

SEQ ID NO: 48317 - DNA, 41 bp, Homo sapiens
  chr2:109648039-109648080
  hyper
gtgcggcgaggagggcgcagtgaagttctgctgtgtgcacc

SEQ ID NO: 48318 - DNA, 51 bp, Homo sapiens; identical to SEQ ID NO: 17630
  chr2:109648222-109648273
  hyper

SEQ ID NO: 48319 - DNA, 30 bp, Homo sapiens; identical to SEQ ID NO: 6319
  chr2:109744973-109745003
  hyper

SEQ ID NO: 48320 - DNA, 755 bp, Homo sapiens
  chr2:109745234-109745989
  hyper
aggctcacgaaaagccgaaaaagactcggacgcttggaggaggcagggccaagcctgcgcaggagaggttccccggagccctggagatgtcctaggggaccaggctaatcgccggcttgcgcccaagcgaagggaagtcctgcaggcacggcgcctccttccctgagccccgcagtgaccgtgacctccgcgcgcacccccgcgcacgtgctcgcggccgaggaagaggaacggtcctgctgaatcctctggaggacagcgactagcgagcaggccaggggcgcatggaggtgccgcgggggcggtgcggctcgccagctgcgcggaggagcgtgcacgccgcgccccggcctccccggggacctggccggccgctgcccgcacttcctgccgctggtctcccaggcgcgagccgccgcttgcagcacagaacccgttgagcttcgtgcccggcagcacccccggtcccccgcgcggggcggacttgcggcgggacaggtgtagcccgcagccgcaggcgctgcgctcaggactgggcgggctcggctggccggtccccgccacgcaggccggtccccgccacgcaggccggtcggtgagccacttcgcaccgccacagccctagcatcgggccaccagccggggtgaagaaagtcacggcggagcccggctccccagtcctgatgctggctgccggtggcgggctccacgccggccccgggacctaggcagccgcgcgagaccgctgcgggcgc

SEQ ID NO: 48321 - DNA, 210 bp, Homo sapiens
  chr2:109746079-109746289
  hyper
cgagcgacggcggcgtcgggcggcggccaccgccgcgggggcgggcgaggacatggacgagtcgtcgctgctggacctgctggagtgctccgtgtgtctggagcgcctggacaccacggccaaggtgctgccatgccaacacactttctgccgccgctgcctggagagcatcgtgtgctcgcgccacgagctgcgctgccccgagtgccg

SEQ ID NO: 48322 - DNA, 24 bp, Homo sapiens
  chr2:109746477-109746501
  hyper
cgggttccccggttttcctctccg

SEQ ID NO: 48323 - DNA, 69 bp, Homo sapiens; identical to SEQ ID NO: 27421
  chr2:110371731-110371800
  hyper

SEQ ID NO: 48324 - DNA, 119 bp, Homo sapiens; identical to SEQ ID NO: 27422
  chr2:111490570-111490689
  hyper

SEQ ID NO: 48325 - DNA, 434 bp, Homo sapiens
  chr2:112656599-112657033
  hyper
gcatcgtggtgaagccgggtcggggtcggcgttgcaggctcccctcttcaccgcagaggaggaaatcgagctcggccgggcgcgctgcaagtcctgaagttccgacgagtggaacgtaggtagcaggtctggtctgggatgcgacgagaactttccactagagttgcatggtggggccccgctctggccggagtcccgggggccacagatccggtctcccgagggaccggcgcggggcgaacgaacgggctgcgggagtcggagccgcagtccgggagccgcgatagactgaggccgagcgacgggccagggggggacggcagtcctggctgctcccaatgggcccttacgggcattattagtatccctttttaggggcacccagagagtgtgggaaaaggggagcgttcttttcactcctgttatggcagaac

SEQ ID NO: 48326 - DNA, 53 bp, Homo sapiens; identical to SEQ ID NO: 27425
  chr2:113190973-113191026
  hyper

SEQ ID NO: 48327 - DNA, 38 bp, Homo sapiens
  chr2:114256940-114256978
  hyper
agacgaggtggaagacgaggaggaggaggcgagccaga

SEQ ID NO: 48328 - DNA, 51 bp, Homo sapiens; identical to SEQ ID NO: 17637
  chr2:114257137-114257188
  hyper

SEQ ID NO: 48329 - DNA, 301 bp, Homo sapiens
  chr2:114260999-114261300
  hyper
tcctcccggcctctgcgccaccgcccccggtgcaggacgcgctttgctctcgccgagacccagacgcgctgaaagcctcgcgcgggcagttccccgccccacgccccgggctgcgcgttctcccgcaaagcctctgccgagtgcgcgcaacggcgccgccggactccccgggaccgcgctcccgcgcacgcctgaccggagcaccccgcttcacgggggcgttctgcgcgtccttcctccccggtgcgatttccattctttttcctctcgcggtccccaggagcccaggcacccctcgact

SEQ ID NO: 48330 - DNA, 19 bp, Homo sapiens
  chr2:114261458-114261477
  hyper
tgcccgggaagctgggctg

SEQ ID NO: 48331 - DNA, 78 bp, Homo sapiens
  chr2:115920534-115920612
  hyper
aggtgcgctcacgtttgcatcaattaggaactccgggcagagagagctgcacttaggtcagggattaactgtggaccc

SEQ ID NO: 48332 - DNA, 57 bp, Homo sapiens; identical to SEQ ID NO: 27432
  chr2:115920613-115920670
  hyper

SEQ ID NO: 48333 - DNA, 25 bp, Homo sapiens
  chr2:118982497-118982522
  hyper
aaaagtcattcgtgatctttgggta

SEQ ID NO: 48334 - DNA, 77 bp, Homo sapiens
  chr2:119068049-119068126
  hyper
ccccccaccggccccctcccgggctcccctccccggtaaacagaaaagaaaacttctgtgggcgaaggagggagaaa

SEQ ID NO: 48335 - DNA, 78 bp, Homo sapiens
  chr2:119532083-119532161
  hyper
tgaaagcctcagtagcggacccggccgggaaaggcggagccgacagctgtcgcggggcggggcttccagggccgggag

SEQ ID NO: 48336 - DNA, 73 bp, Homo sapiens
  chr2:119532255-119532328
  hyper
tcgctctgactcctattgcggtgggatgtggtctctgagtctccgtttaccgattttacggaatggaacttat

SEQ ID NO: 48337 - DNA, 68 bp, Homo sapiens
  chr2:119566171-119566239
  hyper
tcgcagcaaagggcccgggctgggtgttgccgagcggtcctcggctccccggtggaccatgcccctcc

SEQ ID NO: 48338 - DNA, 578 bp, Homo sapiens
  chr2:119590773-119591351
  hyper
gatatggtacatggggctcctggctctccctgtgtaatgtgccccaagttcccctggattccactgaaaatagggagtggaagggtgggtttggagtgaggataaccaggatcgtcacactcacataagcacagaacctcagggatcttcagggctgacaccctgaacgcccaccactttccctagcccccagtgtctcagctctccaggcggggcctctgaggctagaccgctgtctcgcccagggatgctcgcggactgcggcactagcgaacgcgcaattcccttccccagggaagccacgcaggggctttccccgacggcgtctcacagccaagtgagcttgtgaacacggagacggccgaggatccgagacaaggagctcgctcgctcggtttttcccgggctgtgtttgccattcgcgggaataaatgaagcatcggtaatctccataaaagagctttcacgcttcattctctgaaactaagttgaggcttagacggaaaggagaaaagagacttttaatttaaagtaatgatcatcaacactcaggtgctagagggtctctggggaaaggg

SEQ ID NO: 48339 - DNA, 15 bp, Homo sapiens
  chr2:119591658-119591673
  hyper
cgccgcccgggaccc

SEQ ID NO: 48340 - DNA, 396 bp, Homo sapiens
  chr2:119593567-119593963
  hyper
tttggggtttcgcagttcctggggtcgggggcgggggtgaagtgccctcagagacctcggcggagccccagttgcgctcccatctccagcccccactggagagagggggtccagggccgtaccctcctgcggcctgggctgcgctgaccggaagtgcctgtaagaagcgccctccgcggaccgtgccgggcgcgggcagctccagccgggttggagcaaggccaagacgcccggatggggcgggccgtttcggcggacccagtctggacgcaggtgcgggaggaaagtgtgaggggggaaactgctgattgtgcggggataggggcatcttaatctgggaaaagatcggaatctcttgggacgctaatctgagacccgggtcggaggtgtagagta

SEQ ID NO: 48341 - DNA, 30 bp, Homo sapiens; identical to SEQ ID NO: 27443
  chr2:119594194-119594224
  hyper

SEQ ID NO: 48342 - DNA, 30 bp, Homo sapiens; identical to SEQ ID NO: 27444
  chr2:119594750-119594780
  hyper

SEQ ID NO: 48343 - DNA, 31 bp, Homo sapiens
  chr2:119599895-119599926
  hyper
ccgacagaagggacccgggaggtgggggaga

SEQ ID NO: 48344 - DNA, 301 bp, Homo sapiens
  chr2:119600031-119600332
  hyper
attcaaatgaaaaaggcaacgaaaacgaaactgggcgggggcagcgaggcggtgggggaggggataaaataattataataattataataattataacaataataataaaggagattaataaaaatgtccagcaaatagagatcgctacacgtatgtgttttccttacctgaaattaaatatatacaaggtcgtaagcggtttggctagatagagctttaaggagttcgcagtttcgtcccttatactgggaatagagaatggatcttatttttcgatagcacctgtccgagtctttctccc

SEQ ID NO: 48345 - DNA, 15 bp, Homo sapiens
  chr2:119600555-119600570
  hyper
gttgtacagtccctg

SEQ ID NO: 48346 - DNA, 117 bp, Homo sapiens
  chr2:119600747-119600864
  hyper
cagctgctcggccgtgaacgcggtccgcggccgcttgtcctccttctcgttcttcttcttcttcagcttcctggtgcgcggacctgcagcggcggagagggccggggtggggtgggg

SEQ ID NO: 48347 - DNA, 25 bp, Homo sapiens
  chr2:119603086-119603111
  hyper
aagcgccgcgcggggaggatgcggg

SEQ ID NO: 48348 - DNA, 30 bp, Homo sapiens; identical to SEQ ID NO: 27448
  chr2:119603388-119603418
  hyper

SEQ ID NO: 48349 - DNA, 215 bp, Homo sapiens
  chr2:119603817-119604032
  hyper
cttggcgttctggggcggtccgcggggccagaaggcatggcgcagcccggagttgggtactcaccggaggatggacgatccgaataacgtgtgcagtacacccaggcgggccatacgagaggctgctgcgagtcagttttgaccacgggcccgccgttggctgagcccataagtaggatagccgggttgccgtgctccgggtatttggtgccctg

SEQ ID NO: 48350 - DNA, 522 bp, Homo sapiens
  chr2:119604158-119604680
  hyper
agctttagacgcgcccgcgccggcggcggctggctgggagccgtcgggtgggccacagttcgcgtccggggcgcacaggagcgaggcagcgcctggcgcccgggtgcccaacgggtggacagggtctctacctgcggcagtctggcctctgtcacgctcgacccggcctcctcctcctgcgcctcctctggccgccgcagccaccagaagctgcggtggcggctgctcctttttgcagccgaagtccggcctcaggatgttgtcgatgaaaaagttggtggtgcggtgcagctgggccgctggctgcggctggtgagcaggcgccgcgagatgctgaggcggcgggggcggggggtgtggggggaggtgcgggtggtgggccaggggcggcaggcaaggcgccgcgggcggcgaggggggcgcaggctgcggggacaccggcacgctgtctccatcgctgccgctgccgctgctgccgctggcgcccggactgaggctcaggctgaggccgcccggagtcgc

SEQ ID NO: 48351 - DNA, 120 bp, Homo sapiens; identical to SEQ ID NO: 17649
  chr2:119604689-119604809
  hyper

SEQ ID NO: 48352 - DNA, 30 bp, Homo sapiens; identical to SEQ ID NO: 27452
  chr2:119605356-119605386
  hyper

SEQ ID NO: 48353 - DNA, 30 bp, Homo sapiens; identical to SEQ ID NO: 27453
  chr2:119605745-119605775
  hyper

SEQ ID NO: 48354 - DNA, 103 bp, Homo sapiens
  chr2:119606839-119606942
  hyper
agagaaaggatccctttggaaatattgtctatttgtgacatgcgaaagaatccccctacctccagttttccagaaaagtcacagagggttaggctaggaggaa

SEQ ID NO: 48355 - DNA, 182 bp, Homo sapiens; identical to SEQ ID NO: 2039
  chr2:119607442-119607624
  hyper

SEQ ID NO: 48356 - DNA, 15 bp, Homo sapiens
  chr2:119607847-119607862
  hyper
cgtccccccacctcc

SEQ ID NO: 48357 - DNA, 139 bp, Homo sapiens; identical to SEQ ID NO: 27457
  chr2:119610236-119610375
  hyper

SEQ ID NO: 48358 - DNA, 79 bp, Homo sapiens; identical to SEQ ID NO: 27458
  chr2:119610540-119610619
  hyper

SEQ ID NO: 48359 - DNA, 179 bp, Homo sapiens
  chr2:119611566-119611745
  hyper
ctgtctcccccaccccgcccacctccttcctcgtattgaatcggatgcggggggcgggagggggtcactgcaatgccaaggccttctcgggccatcttccctgttcccctgctccagcagaaagctgggaggggaacgagtgtgtagccccgcgcgtgcgtgtttgttcgtgactcaga

SEQ ID NO: 48360 - DNA, 59 bp, Homo sapiens; identical to SEQ ID NO: 27461
  chr2:119612755-119612814
  hyper

SEQ ID NO: 48361 - DNA, 738 bp, Homo sapiens; identical to SEQ ID NO: 27462
  chr2:119613153-119613891
  hyper

SEQ ID NO: 48362 - DNA, 178 bp, Homo sapiens
  chr2:119614602-119614780
  hyper
cgggaagccccggaacggtcctcgccagacatagccggctgtcctggtccttagcttcaggctggcggcgcaaggccagagcggctgccttctaggcacctgggtggaggtctcgcatagcattccctgagaagcgaaactgcccttggggccgcagcgagcctgccacatcgaactg

SEQ ID NO: 48363 - DNA, 203 bp, Homo sapiens; identical to SEQ ID NO: 17656
  chr2:119614852-119615055
  hyper

SEQ ID NO: 48364 - DNA, 180 bp, Homo sapiens
  chr2:119615975-119616155
  hyper
catgcccataccaagcgggaaacgaagcaccgaatatttccccagctcgtaggaagccagatgggggccagttccctcaggagacgctccaagtcgccctgcgggctccaggtggggacaggagttataaccttccctgcccttccccctgcaacacacgcgaggtctcagcgctcccag

SEQ ID NO: 48365 - DNA, 150 bp, Homo sapiens; identical to SEQ ID NO: 6359
  chr2:119769161-119769311
  hyper

SEQ ID NO: 48366 - DNA, 40 bp, Homo sapiens; identical to SEQ ID NO: 27467
  chr2:119914013-119914053
  hyper

SEQ ID NO: 48367 - DNA, 191 bp, Homo sapiens
  chr2:119914529-119914720
  hyper
cgtcctgtgcaatggcgctggcccggacctggggacaagcggtgggagcaggtgagccggggcacctcttcccgcgcctttgctcagcccacaccaggcgcgccactcacgggcctcccgcctgctgcttcagggtccacactcccaccccagctccatgttctctctccaacttagtcaactccttccag

SEQ ID NO: 48368 - DNA, 147 bp, Homo sapiens
  chr2:119914752-119914899
  hyper
gaaatagggagaggggaagcttcatgaacactgacccagagtggaagggtgggagccaggggccagggccaagaggaaaggaggctgcagggcaagggggcgacctggagagaactaaagaactgaggtttccgagaagcccacgga

SEQ ID NO: 48369 - DNA, 456 bp, Homo sapiens; identical to SEQ ID NO: 27469
  chr2:119915151-119915607
  hyper

SEQ ID NO: 48370 - DNA, 337 bp, Homo sapiens; identical to SEQ ID NO: 27471
  chr2:120190015-120190352
  hyper

SEQ ID NO: 48371 - DNA, 120 bp, Homo sapiens
  chr2:120281693-120281813
  hyper
ctcgggtccccagcctgcagaagggcgcagtactcaccgagtgcgcggcgcaggcgagcagcaccggcagtagtagctgctgcagcggcggcgacaggtggggacgcatggtgcccgcac

SEQ ID NO: 48372 - DNA, 87 bp, Homo sapiens; identical to SEQ ID NO: 27473
  chr2:120281814-120281901
  hyper

SEQ ID NO: 48373 - DNA, 36 bp, Homo sapiens; identical to SEQ ID NO: 27474
  chr2:121103048-121103084
  hyper

SEQ ID NO: 48374 - DNA, 47 bp, Homo sapiens; identical to SEQ ID NO: 27475
  chr2:121103883-121103930
  hyper

SEQ ID NO: 48375 - DNA, 394 bp, Homo sapiens; identical to SEQ ID NO: 27476
  chr2:121104242-121104636
  hyper

SEQ ID NO: 48376 - DNA, 514 bp, Homo sapiens; identical to SEQ ID NO: 27477
  chr2:121104696-121105210
  hyper

SEQ ID NO: 48377 - DNA, 46 bp, Homo sapiens; identical to SEQ ID NO: 27478
  chr2:121200039-121200085
  hyper

SEQ ID NO: 48378 - DNA, 180 bp, Homo sapiens; identical to SEQ ID NO: 27480
  chr2:121344837-121345017
  hyper

SEQ ID NO: 48379 - DNA, 36 bp, Homo sapiens; identical to SEQ ID NO: 27481
  chr2:121412155-121412191
  hyper

SEQ ID NO: 48380 - DNA, 498 bp, Homo sapiens; identical to SEQ ID NO: 27482
  chr2:121493449-121493947
  hyper

SEQ ID NO: 48381 - DNA, 88 bp, Homo sapiens; identical to SEQ ID NO: 27483
  chr2:121494156-121494244
  hyper

SEQ ID NO: 48382 - DNA, 30 bp, Homo sapiens; identical to SEQ ID NO: 27484
  chr2:121494978-121495008
  hyper

SEQ ID NO: 48383 - DNA, 44 bp, Homo sapiens; identical to SEQ ID NO: 27485
  chr2:122042116-122042160
  hyper

SEQ ID NO: 48384 - DNA, 30 bp, Homo sapiens; identical to SEQ ID NO: 27486
  chr2:122042918-122042948
  hyper

SEQ ID NO: 48385 - DNA, 234 bp, Homo sapiens
  chr2:124782458-124782692
  hyper
gttttcccctcccctccaaaggtgaggtgggggaacgcgtctcgttagctcattacaaagctttccgtgggaaattccctcttcctaatgcgtctgtcttgcaactcctattagcatccttcgacagcggcctttgaaaatctcctttaaatttcaatacctctactcgtttcccaaatggggggaagggaagagaaagccggggggtagagagaatttccttcccctttccct

SEQ ID NO: 48386 - DNA, 308 bp, Homo sapiens
  chr2:124783097-124783405
  hyper
gagcgagtgcctctccaagcgggggtgggagggggtcaggctgtgcagaggagagagacagcgagaagaagccgcggctggctactgcgaatttgggattcgattgggagggaccgctcactcgggggaaatggattctttaccacggctgaccagcgttttgactttgctgttctctggcttgtggcatttaggattaacagcgacaaactgtgagtacgaggagctgggggcgggaaggtgaggtggaaaacgatcgcattcagaaagacaatcaactatctaagcgtactcgattgtgtctgctt

SEQ ID NO: 48387 - DNA, 30 bp, Homo sapiens; identical to SEQ ID NO: 27488
  chr2:127534517-127534547
  hyper

SEQ ID NO: 48388 - DNA, 39 bp, Homo sapiens; identical to SEQ ID NO: 27489
  chr2:127534774-127534813
  hyper

SEQ ID NO: 48389 - DNA, 121 bp, Homo sapiens; identical to SEQ ID NO: 27490
  chr2:127643980-127644101
  hyper

SEQ ID NO: 48390 - DNA, 324 bp, Homo sapiens; identical to SEQ ID NO: 17669
  chr2:127783257-127783581
  hyper

SEQ ID NO: 48391 - DNA, 113 bp, Homo sapiens
  chr2:127863488-127863601
  hyper
ggcgtcagcagctggcgtgatccaattcaataaaccagaggtggcttgggatagacaactgaccgggtgcagacccccgcccctcaatctctgcatttcctgcacgctctggg

SEQ ID NO: 48392 - DNA, 153 bp, Homo sapiens
  chr2:127863725-127863878
  hyper
ccagtgccgccacccgctccccggccgccggaaacgctaagcccctgctggggcgagggcacctccttgcggggtgcgtagccctgggctcccggtggggccgggctgggcgggagcttccaggccgcaggcacctctcgggaaaggaaaccc

SEQ ID NO: 48393 - DNA, 93 bp, Homo sapiens
  chr2:127976374-127976467
  hyper
ccagaaataacagtgcgtgctgggccgggcacccggggaggcggacgatgggcgaaggcatcggagggcgccgccgcggctcgggtgcagtgc

SEQ ID NO: 48394 - DNA, 154 bp, Homo sapiens
  chr2:127976672-127976826
  hyper
ccgagcctccgtcccctcttcccccgccattacaaaatacaaaaaggactagaaatgaatacacacggtctcggccacctaaggacaccgagctccgcagagcctagaggagctagggaacctagcgctcccctcgggccggccccaggcagca

SEQ ID NO: 48395 - DNA, 38 bp, Homo sapiens; identical to SEQ ID NO: 27495
  chr2:128421812-128421850
  hyper

SEQ ID NO: 48396 - DNA, 24 bp, Homo sapiens
  chr2:128421947-128421971
  hyper
cagccgggccgccatggcgcgggg

SEQ ID NO: 48397 - DNA, 78 bp, Homo sapiens; identical to SEQ ID NO: 27497
  chr2:128432415-128432493
  hyper

SEQ ID NO: 48398 - DNA, 434 bp, Homo sapiens; identical to SEQ ID NO: 27498
  chr2:128433069-128433503
  hyper

SEQ ID NO: 48399 - DNA, 15 bp, Homo sapiens
  chr2:130737190-130737205
  hyper
aaaactgtgttgagg

SEQ ID NO: 48400 - DNA, 182 bp, Homo sapiens; identical to SEQ ID NO: 27500
  chr2:130737475-130737657
  hyper

SEQ ID NO: 48401 - DNA, 100 bp, Homo sapiens
  chr2:130763484-130763584
  hyper
gcagtcccagcgctccgaacgacggtgcctccggttgacagcaacctgagcggacccgcgcctaggccctccgccaggcctgcgctgcctcgccccggga

SEQ ID NO: 48402 - DNA, 54 bp, Homo sapiens
  chr2:130763623-130763677
  hyper
ggcccgtttcctttcagcgatcagtcccctggcgtcccagcagcgccttccccg

SEQ ID NO: 48403 - DNA, 104 bp, Homo sapiens; identical to SEQ ID NO: 27502
  chr2:130763729-130763833
  hyper

SEQ ID NO: 48404 - DNA, 51 bp, Homo sapiens; identical to SEQ ID NO: 27503
  chr2:130970991-130971042
  hyper

SEQ ID NO: 48405 - DNA, 87 bp, Homo sapiens
  chr2:130971062-130971149
  hyper
cgctgctgcccgccggcctccgggcatggtccccccggagcccccgccccggtccccgggctcagccccagcccgcctggggagtcc

SEQ ID NO: 48406 - DNA, 759 bp, Homo sapiens; identical to SEQ ID NO: 27505
  chr2:131484847-131485606
  hyper

SEQ ID NO: 48407 - DNA, 479 bp, Homo sapiens; identical to SEQ ID NO: 27506
  chr2:131513547-131514026
  hyper

SEQ ID NO: 48408 - DNA, 150 bp, Homo sapiens; identical to SEQ ID NO: 27507
  chr2:131594772-131594922
  hyper

SEQ ID NO: 48409 - DNA, 42 bp, Homo sapiens
  chr2:131594947-131594989
  hyper
cgcttggcgcagtaccagctgttttgggaaggagggctggtg

SEQ ID NO: 48410 - DNA, 208 bp, Homo sapiens
  chr2:131595019-131595227
  hyper
ctgttgttattccccaggctgagagtacgcgagggcgcagcagcggcaaggggctggaactggggtcggggctgttgggctcctgctcggggtgccccctctctggcccgatttccgggcccgctcaccatccgggacccactcagttgggacgcctccacctcgctgcccccacaggaaccccaagatgggccgggggctccggggc

SEQ ID NO: 48411 - DNA, 66 bp, Homo sapiens
  chr2:131720786-131720852
  hyper
cggccccttaatcaccacagggtgtgtcctgcccgggctgtcaggagggtcgcaggcgcccggtgg

SEQ ID NO: 48412 - DNA, 24 bp, Homo sapiens
  chr2:131721437-131721461
  hyper
cggctgagagcctccttaacggag

SEQ ID NO: 48413 - DNA, 55 bp, Homo sapiens; identical to SEQ ID NO: 27512
  chr2:131722233-131722288
  hyper

SEQ ID NO: 48414 - DNA, 38 bp, Homo sapiens
  chr2:131792222-131792260
  hyper
catccctccccaaagcgccggtgccaggcgttttggcc

SEQ ID NO: 48415 - DNA, 49 bp, Homo sapiens; identical to SEQ ID NO: 27516
  chr2:132088590-132088639
  hyper

SEQ ID NO: 48416 - DNA, 28 bp, Homo sapiens
  chr2:132088828-132088856
  hyper
cagccacctgagccgggctcagtcttcc

SEQ ID NO: 48417 - DNA, 207 bp, Homo sapiens; identical to SEQ ID NO: 27518
  chr2:132121322-132121529
  hyper

SEQ ID NO: 48418 - DNA, 129 bp, Homo sapiens
  chr2:132152232-132152361
  hyper
ggtgcggccctgacccgaaagcggggcaggggtgcggaggacaggatctccgatgtccctgctccgcgggcgcccgcagtgctgagccgaagctcggcggggctgagctccagctgggggcgggtagct

SEQ ID NO: 48419 - DNA, 29 bp, Homo sapiens
  chr2:132152495-132152524
  hyper
tttcttgtgtcctccgtgttcccctgtgg

SEQ ID NO: 48420 - DNA, 39 bp, Homo sapiens
  chr2:132182751-132182790
  hyper
ggcgggcgcgggaggcgggcgcgggaggcgggcgcggga

SEQ ID NO: 48421 - DNA, 164 bp, Homo sapiens
  chr2:132183089-132183253
  hyper
cccggttccccgcccgcccggcaaccctgtgatgaagttttcacatacgttcatttcattgaaacaaaagtcttgtaggcaccattggcaggggcaagaaacaagcacacaggttatttgcagaagaccacagaactggcaaatgacagcgccaggattcaatt

SEQ ID NO: 48422 - DNA, 109 bp, Homo sapiens
  chr2:132767348-132767457
  hyper
ggcaaaaagcctaggcggagggggcaaaaagccgcggcggcgggggcaaaaaggagcgggggcaaaaaccccacaaaaacccgcggcgacggggggaaaaaaccgcggc

SEQ ID NO: 48423 - DNA, 180 bp, Homo sapiens; identical to SEQ ID NO: 27522
  chr2:132767750-132767930
  hyper

SEQ ID NO: 48424 - DNA, 120 bp, Homo sapiens; identical to SEQ ID NO: 27523
  chr2:132795879-132795999
  hyper

SEQ ID NO: 48425 - DNA, 120 bp, Homo sapiens; identical to SEQ ID NO: 27524
  chr2:132796059-132796179
  hyper

SEQ ID NO: 48426 - DNA, 160 bp, Homo sapiens
  chr2:133015323-133015483
  hyper
gggggcctgcggtaccaggaaaaatctgcgtgcggcaaccttgagccttcgcggtctgggcagggggcctggccgctgcgcgtgcgcgcaatccccgaagggccccctagtccaccagcctcctttctcccaggcaaagcacctccaagtaaacccacac

SEQ ID NO: 48427 - DNA, 156 bp, Homo sapiens; identical to SEQ ID NO: 27526
  chr2:133015543-133015699
  hyper

SEQ ID NO: 48428 - DNA, 96 bp, Homo sapiens
  chr2:133062389-133062485
  hyper
tgctgggttgagtcccggctggaccgcgcccctctcggaagtgtagccaggagtaggggtgtaggatgtgcagctgtgacccgtccctgtggactg

SEQ ID NO: 48429 - DNA, 26 bp, Homo sapiens
  chr2:133426223-133426249
  hyper
ccactcctgggtctccgggtagggct

SEQ ID NO: 48430 - DNA, 88 bp, Homo sapiens
  chr2:133426279-133426367
  hyper
cgggtacctagggtcctacggaagaaagtggaatagtgcccgccacccctggaccccggctctagacacaaagcgcccatccattacc

SEQ ID NO: 48431 - DNA, 152 bp, Homo sapiens; identical to SEQ ID NO: 27529
  chr2:133427110-133427262
  hyper

SEQ ID NO: 48432 - DNA, 166 bp, Homo sapiens; identical to SEQ ID NO: 27530
  chr2:133427471-133427637
  hyper

SEQ ID NO: 48433 - DNA, 221 bp, Homo sapiens; identical to SEQ ID NO: 27531
  chr2:133427885-133428106
  hyper

SEQ ID NO: 48434 - DNA, 39 bp, Homo sapiens; identical to SEQ ID NO: 27532
  chr2:135475588-135475627
  hyper

SEQ ID NO: 48435 - DNA, 506 bp, Homo sapiens; identical to SEQ ID NO: 27533
  chr2:135475865-135476371
  hyper

SEQ ID NO: 48436 - DNA, 183 bp, Homo sapiens; identical to SEQ ID NO: 27534
  chr2:135476823-135477006
  hyper

SEQ ID NO: 48437 - DNA, 148 bp, Homo sapiens; identical to SEQ ID NO: 27535
  chr2:136875889-136876037
  hyper

SEQ ID NO: 48438 - DNA, 654 bp, Homo sapiens; identical to SEQ ID NO: 27536
  chr2:136876374-136877028
  hyper

SEQ ID NO: 48439 - DNA, 104 bp, Homo sapiens
  chr2:137522341-137522445
  hyper
gcacccagctcccggcgtttcccggagtcaccacaatgtttccctttctctctcccccacgtatgctgctaggggtactccccagataggattttctttgtctt

SEQ ID NO: 48440 - DNA, 275 bp, Homo sapiens
  chr2:137522475-137522750
  hyper
cccggggactgcagaggaacgccagaccatccggaccttgcgggatggctcggtgtgtgtgttttactgtgtgtcggagtgtcgcgcatgtgtgcgtgttggggcgcgttatcaacaggggcctagggcacccccactctttcttgctctcttcccccatcacttcatggacctccgaggcgcaaagcgctcgaccctctcctgggctcagtggcttgggtactccgggctgagctcagctggggagtccccttacccagcccgcaccggcaccc

SEQ ID NO: 48441 - DNA, 34 bp, Homo sapiens; identical to SEQ ID NO: 27538
  chr2:137522848-137522882
  hyper

SEQ ID NO: 48442 - DNA, 29 bp, Homo sapiens
  chr2:137523364-137523393
  hyper
actttgctctttcctcgccggacagccat

SEQ ID NO: 48443 - DNA, 78 bp, Homo sapiens; identical to SEQ ID NO: 27540
  chr2:137523516-137523594
  hyper

SEQ ID NO: 48444 - DNA, 298 bp, Homo sapiens
  chr2:139537145-139537443
  hyper
aagttatatcttgtgtccccagctggcagaaagccccatcccagtccctagcgccagacggaaaacgaagagaaatccaagctgtcccccaaatccgtattttgcctaagttttctcccagcaaggcgccactacctggctctgagaacgaggatgcatgcactatgctgtgctttgggagaagtgtctgtgtgcatctgggcaaaacaccacgtgaaaaataaacaccaccaagcctctcaaactgtgaacaggaggaaggtctttctgccccttctcatcctatcaatttactttc

SEQ ID NO: 48445 - DNA, 292 bp, Homo sapiens
  chr2:139537865-139538157
  hyper
catctccacttcgcggggcaggactgaggacgccagggacacagcgcggcgcttccctcccggaatccgagcgctgcgccgtgccgcgcagctctggccgggtgggcgggcagggaagggggagggtgggcggaccggaggtgcctctcccggccccccgcgcgcccctcctcggagggggccggcaaagagcctgcggggcagctcgagctccggcacgcggcggggggcttcagtcgcgccttggactctcccgcttggccgggcttggggtgagcgcgtggggcgcctg

SEQ ID NO: 48446 - DNA, 251 bp, Homo sapiens
  chr2:142888097-142888348
  hyper
cccggtcccggggagcggagctgcaaggacttaagtttcacactcacttatctgcaagcatcgcccagcaggaaagccaaggaagtcaggggaggggagcggggaggtgttctccttacctcggtcggctcccacggtcagcaccctggcaatcggcaataatcccgagagagtgagtaaggcgaggagaaactcggacattgtggtcgcccggtaaggaagcctgcgctggagactgctcggcggcacct

SEQ ID NO: 48447 - DNA, 123 bp, Homo sapiens
  chr2:142888418-142888541
  hyper
tcactggaaattcttcagctcaatgagtccagccagtcagccttctcctgcctggagcaggatgtggaaggtggagggatgcgcgcgtgcgggagagaggaggcagagcgtgtgtgagcgcga

SEQ ID NO: 48448 - DNA, 35 bp, Homo sapiens; identical to SEQ ID NO: 27544
  chr2:142889151-142889186
  hyper

SEQ ID NO: 48449 - DNA, 76 bp, Homo sapiens
  chr2:144694291-144694367
  hyper
aaaggtagtaggcatcggtgtttctggttttgcttagtgcgtcttcatcgtattccctcgctgaggactgagcctg

SEQ ID NO: 48450 - DNA, 122 bp, Homo sapiens; identical to SEQ ID NO: 17705
  chr2:144695135-144695257
  hyper

SEQ ID NO: 48451 - DNA, 67 bp, Homo sapiens; identical to SEQ ID NO: 27547
  chr2:144695258-144695325
  hyper

SEQ ID NO: 48452 - DNA, 77 bp, Homo sapiens; identical to SEQ ID NO: 17707
  chr2:145273327-145273404
  hyper

SEQ ID NO: 48453 - DNA, 39 bp, Homo sapiens; identical to SEQ ID NO: 17708
  chr2:145273751-145273790
  hyper

SEQ ID NO: 48454 - DNA, 106 bp, Homo sapiens; identical to SEQ ID NO: 17709
  chr2:145274080-145274186
  hyper

SEQ ID NO: 48455 - DNA, 56 bp, Homo sapiens; identical to SEQ ID NO: 17710
  chr2:145274455-145274511
  hyper

SEQ ID NO: 48456 - DNA, 238 bp, Homo sapiens; identical to SEQ ID NO: 17711
  chr2:145274576-145274814
  hyper

SEQ ID NO: 48457 - DNA, 404 bp, Homo sapiens
  chr2:145275213-145275617
  hyper
gacaagaattacatcttcaaaatgagtcataactcctgaccgtatgagggaatgcacacggcggtacagtaagaccgcttgactcagggctaggcggaccctttccttcgaaaagtcctcagcccccggctcgggaacttggggtgaggcgaggttttcttttcgttctcatcttttctcatccccccaccccccaattcccagaggaaacaaacaaacaaacaacgcgaaacagcccctggatgaagcacactcgggcaaattgataatagtaattataggaagcccactcgcccagcgccccctcccctccccttttggagtttatcgaggcactgtctcttcctccccccaccctcgcccccaaattaagatttcccgttttacgccgcaatgataaatat

SEQ ID NO: 48458 - DNA, 39 bp, Homo sapiens; identical to SEQ ID NO: 27552
  chr2:145275852-145275891
  hyper

SEQ ID NO: 48459 - DNA, 457 bp, Homo sapiens; identical to SEQ ID NO: 27553
  chr2:145277493-145277950
  hyper

SEQ ID NO: 48460 - DNA, 740 bp, Homo sapiens; identical to SEQ ID NO: 27554
  chr2:145281202-145281942
  hyper

SEQ ID NO: 48461 - DNA, 36 bp, Homo sapiens; identical to SEQ ID NO: 6423
  chr2:145281943-145281979
  hyper

SEQ ID NO: 48462 - DNA, 78 bp, Homo sapiens; identical to SEQ ID NO: 6424
  chr2:145282041-145282119
  hyper

SEQ ID NO: 48463 - DNA, 7 bp, Homo sapiens
  chr2:145282149-145282156
  hyper
gggacgg

SEQ ID NO: 48464 - DNA, 30 bp, Homo sapiens; identical to SEQ ID NO: 27557
  chr2:148601319-148601349
  hyper

SEQ ID NO: 48465 - DNA, 216 bp, Homo sapiens; identical to SEQ ID NO: 27558
  chr2:149632642-149632858
  hyper

SEQ ID NO: 48466 - DNA, 209 bp, Homo sapiens
  chr2:149632888-149633097
  hyper
cgcccgccgcgtggtcgcgggcaggtgggccggggggcgctgggcaggggcggggcagggccagggcaggccggtctgcagccggaggggccggagcggagaagctgcccaccttcccgggctcggagcggccggggctgctcagccggccgggctcgcgatgacctgctgagaagcgtcgtcggaggctgcaggaggcggcctagctg

SEQ ID NO: 48467 - DNA, 345 bp, Homo sapiens; identical to SEQ ID NO: 17718
  chr2:149633399-149633744
  hyper

SEQ ID NO: 48468 - DNA, 92 bp, Homo sapiens; identical to SEQ ID NO: 17719
  chr2:149633965-149634057
  hyper

SEQ ID NO: 48469 - DNA, 30 bp, Homo sapiens; identical to SEQ ID NO: 27563
  chr2:151343607-151343637
  hyper

SEQ ID NO: 48470 - DNA, 411 bp, Homo sapiens; identical to SEQ ID NO: 27564
  chr2:152954623-152955034
  hyper

SEQ ID NO: 48471 - DNA, 32 bp, Homo sapiens; identical to SEQ ID NO: 27565
  chr2:152956018-152956050
  hyper

SEQ ID NO: 48472 - DNA, 186 bp, Homo sapiens
  chr2:154333349-154333535
  hyper
gcagctacttttcctcgcattttataattccccttccctccgccccccggccccacccgtgggcagcatcccaaagccgcctggctgacgttggttagggtagagacgccctccctaaaggctgtccaagccgtctcttcctttcattagcggtgtaatcctgtgttcccgccggagcctggcacg

SEQ ID NO: 48473 - DNA, 164 bp, Homo sapiens; identical to SEQ ID NO: 17722
  chr2:154333567-154333731
  hyper

SEQ ID NO: 48474 - DNA, 221 bp, Homo sapiens
  chr2:154334051-154334272
  hyper
agaaacaactcaccccgttcaaattcgcaggctccccctccccccaccccttctcccacaatgacaaaactgtaactcctcaggcaggcaaacaggccactggggcagaaaaagacttatcaaacatttgtattcaagcaaacaaacacaaaacctcttaaaacggcacgttacaatcaaaggtatttatcgcccctcccctccagggcagggggggagca

SEQ ID NO: 48475 - DNA, 193 bp, Homo sapiens
  chr2:154335271-154335464
  hyper
cttctaaagccgtccgctccagccctggtggtgctcgttcccggcgctcgctcgagggggggctgttggaacttggcggggctggaccagcccggccgtgggaggtgcgggccgcggcggctgcagcggcggggtggctgcgctgagcaaacagcggccccttccggccgcaccgccgcgctgcgcgctgctc

SEQ ID NO: 48476 - DNA, 51 bp, Homo sapiens; identical to SEQ ID NO: 27570
  chr2:154727941-154727992
  hyper

SEQ ID NO: 48477 - DNA, 21 bp, Homo sapiens
  chr2:154729240-154729261
  hyper
cagccccggctgcgttgcggg

SEQ ID NO: 48478 - DNA, 314 bp, Homo sapiens; identical to SEQ ID NO: 27572
  chr2:154729747-154730061
  hyper

SEQ ID NO: 48479 - DNA, 228 bp, Homo sapiens
  chr2:157176364-157176592
  hyper
ccgcgggaagataagcgtacaggcggccccaaggcccctacaggcgcagccctgatctggccacttgactagacgctcgctccagcgctcgcaggcctagggctcattacatgcgttgcgaggagacctgaaagcagggcgggaacgcacaatctatcttcagagctttgggtcgtgagcacacgtgtggagcatggttgtggcatgggcgtctgggcccctctccta

SEQ ID NO: 48480 - DNA, 286 bp, Homo sapiens
  chr2:157176717-157177003
  hyper
gagactgaccggaaatcgttgggtgcagggagaagcaggagacgcgctccgcctcctgtgctcgtgccctagcgcaacagacgcgacctagaggcgacggcagcctgttgcagccttcgccctgagggtggggggcgggggggtgtagaacagctgaggaagacgcagggagcagctggggaggaaagggagggacaccgaggaaacaaagttcacccaagtgaatgcgtcctaattgctccaaggctctctccgcaaagtctacgactgcaagccgcaaagtcaa

SEQ ID NO: 48481 - DNA, 214 bp, Homo sapiens; identical to SEQ ID NO: 27576
  chr2:160760685-160760899
  hyper

SEQ ID NO: 48482 - DNA, 111 bp, Homo sapiens
  chr2:160760959-160761070
  hyper
cggctccagagcccccccgccccaacagcaaagcagccgtgacctgccccaggggcgcagccctgccccaggctggaaggcagcagagctgtggcgtcgaggcacccagcg

SEQ ID NO: 48483 - DNA, 50 bp, Homo sapiens; identical to SEQ ID NO: 27578
  chr2:160918710-160918760
  hyper

SEQ ID NO: 48484 - DNA, 30 bp, Homo sapiens; identical to SEQ ID NO: 27579
  chr2:161560586-161560616
  hyper

SEQ ID NO: 48485 - DNA, 30 bp, Homo sapiens; identical to SEQ ID NO: 27580
  chr2:162094291-162094321
  hyper

SEQ ID NO: 48486 - DNA, 30 bp, Homo sapiens; identical to SEQ ID NO: 27581
  chr2:162094680-162094710
  hyper

SEQ ID NO: 48487 - DNA, 128 bp, Homo sapiens; identical to SEQ ID NO: 27582
  chr2:162095511-162095639
  hyper

SEQ ID NO: 48488 - DNA, 100 bp, Homo sapiens
  chr2:162274338-162274438
  hyper
aaggcaagtccttccaattaacacattttcttgacacttatttaggtgagaatgattaattaaagcctttgtggactggctcgagcgacttttaaaacga

SEQ ID NO: 48489 - DNA, 280 bp, Homo sapiens
  chr2:162274866-162275146
  hyper
tctcaccccttcctccctgacatccagttcgtcagtgtaaagcagcatatggaactggatacacgtttctttgcttcattaaaaagacttaaaaattgtatttccaccctccaaatttatattaaatctgtaaagttgttctcattggcaacacctccgtcggcccaattttggagtgcccgaccttcccaagtactaatactgattgattttgagaagaaaccccacaagatctgcaggttgtggaaatctttgttcctccttacaggaggactaggag

SEQ ID NO: 48490 - DNA, 15 bp, Homo sapiens
  chr2:162279873-162279888
  hyper
ccgcaggatctacac

SEQ ID NO: 48491 - DNA, 85 bp, Homo sapiens
  chr2:162280956-162281041
  hyper
ctgtaaaccttttggttttcctacttactcttcttctgtggagttatcctcctacaattcccctccccctcgtctttctcttacc

SEQ ID NO: 48492 - DNA, 30 bp, Homo sapiens; identical to SEQ ID NO: 27591
  chr2:162282450-162282480
  hyper

SEQ ID NO: 48493 - DNA, 48 bp, Homo sapiens
  chr2:162284055-162284103
  hyper
gtcttgtccctttaaaacatgatcatttctcctcgcttccaagaagtc

SEQ ID NO: 48494 - DNA, 183 bp, Homo sapiens; identical to SEQ ID NO: 27594
  chr2:162284325-162284508
  hyper

SEQ ID NO: 48495 - DNA, 26 bp, Homo sapiens
  chr2:162930218-162930244
  hyper
ttctctacccctgcccgggttcgggc

SEQ ID NO: 48496 - DNA, 40 bp, Homo sapiens; identical to SEQ ID NO: 27596
  chr2:162930245-162930285
  hyper

SEQ ID NO: 48497 - DNA, 260 bp, Homo sapiens; identical to SEQ ID NO: 27597
  chr2:162930338-162930598
  hyper

SEQ ID NO: 48498 - DNA, 113 bp, Homo sapiens; identical to SEQ ID NO: 27598
  chr2:163694871-163694984
  hyper

SEQ ID NO: 48499 - DNA, 261 bp, Homo sapiens; identical to SEQ ID NO: 27599
  chr2:163695246-163695507
  hyper

SEQ ID NO: 48500 - DNA, 141 bp, Homo sapiens; identical to SEQ ID NO: 6454
  chr2:164592629-164592770
  hyper

SEQ ID NO: 48501 - DNA, 84 bp, Homo sapiens
  chr2:164593137-164593221
  hyper
cccgcgggctcttccctgccggttcccggccctctcgacagctgcggcccgtccgcccttccccaccccctctgcgcacgggac

SEQ ID NO: 48502 - DNA, 148 bp, Homo sapiens; identical to SEQ ID NO: 27602
  chr2:164593222-164593370
  hyper

SEQ ID NO: 48503 - DNA, 149 bp, Homo sapiens; identical to SEQ ID NO: 27603
  chr2:165478206-165478355
  hyper

SEQ ID NO: 48504 - DNA, 31 bp, Homo sapiens; identical to SEQ ID NO: 6456
  chr2:167233063-167233094
  hyper

SEQ ID NO: 48505 - DNA, 35 bp, Homo sapiens; identical to SEQ ID NO: 27605
  chr2:168149198-168149233
  hyper

SEQ ID NO: 48506 - DNA, 53 bp, Homo sapiens; identical to SEQ ID NO: 27606
  chr2:168149503-168149556
  hyper

SEQ ID NO: 48507 - DNA, 215 bp, Homo sapiens; identical to SEQ ID NO: 27607
  chr2:168149776-168149991
  hyper

SEQ ID NO: 48508 - DNA, 77 bp, Homo sapiens
  chr2:168149992-168150069
  hyper
cgcccgtgcggctccagctggtgcgttctcccttccgcgctcacagactttgacagcgcggggatggcattgtgtga

SEQ ID NO: 48509 - DNA, 506 bp, Homo sapiens
  chr2:168150245-168150751
  hyper
tggctcgtaaagagccgagcaaattgaactttattgcggtgattaaaaggagctgtggacctggcgcgccaggggagaggcgcgttccacgaggctccccaaagtcccactttgccccggggacttcggaggggaagggaagagagggaaaagtaactgttggtccacattgctgaagaaaaggaggaaagagaagttgggggtgggggtgggggtggaggttactcttgggggagtggcgacttttaggtgtctgaagccccgcgtgggaggcttgctacacttttctggagcgcagacttgaggatggagagtcccactctgaggtactggtagcggctcctcctgcctggtggcggcgtagggcgcagcgggacagcttggtggaggcagagcggggctccgacgcccgacggcccggcgtccaggtggggccactgcctccccaggccgctttggcccgctgacctcccaggttgagacccggcctggtgcgcctctggcag

SEQ ID NO: 48510 - DNA, 125 bp, Homo sapiens; identical to SEQ ID NO: 27609
  chr2:170218695-170218820
  hyper

SEQ ID NO: 48511 - DNA, 298 bp, Homo sapiens; identical to SEQ ID NO: 27610
  chr2:170219260-170219558
  hyper

SEQ ID NO: 48512 - DNA, 251 bp, Homo sapiens; identical to SEQ ID NO: 27611
  chr2:170219911-170220162
  hyper

SEQ ID NO: 48513 - DNA, 65 bp, Homo sapiens; identical to SEQ ID NO: 27612
  chr2:170220494-170220559
  hyper

SEQ ID NO: 48514 - DNA, 34 bp, Homo sapiens; identical to SEQ ID NO: 27613
  chr2:170335909-170335943
  hyper

SEQ ID NO: 48515 - DNA, 366 bp, Homo sapiens; identical to SEQ ID NO: 27614
  chr2:171568345-171568711
  hyper

SEQ ID NO: 48516 - DNA, 15 bp, Homo sapiens
  chr2:171570047-171570062
  hyper
gggagaaggtgggcc

SEQ ID NO: 48517 - DNA, 214 bp, Homo sapiens; identical to SEQ ID NO: 17745
  chr2:171570470-171570684
  hyper

SEQ ID NO: 48518 - DNA, 224 bp, Homo sapiens
  chr2:171570733-171570957
  hyper
ttgtgggaccacaacaaccaggcttcctcgaccgcgccttttttccagtagctcctggtctgccaggcttgcgagagggcgcgctggcttggcggggctccgggcgagaaatcaccagcagcgctggggctttcggccccccacagcccagcccgggcctcctgggtggcctggggagaagggggcgggacagcacagcttcttcccctcgggtgggcatgacg

SEQ ID NO: 48519 - DNA, 44 bp, Homo sapiens; identical to SEQ ID NO: 27618
  chr2:171571200-171571244
  hyper

SEQ ID NO: 48520 - DNA, 43 bp, Homo sapiens
  chr2:171571846-171571889
  hyper
agaccgcgcgcggggcgagcgagcggggcgcggcgaggggcaa

SEQ ID NO: 48521 - DNA, 230 bp, Homo sapiens; identical to SEQ ID NO: 27620
  chr2:171572347-171572577
  hyper

SEQ ID NO: 48522 - DNA, 503 bp, Homo sapiens
  chr2:171669846-171670349
  hyper
aatggaccttagctccgacttaagcagaatgaaaggttaagtaacgcttcccccagttctcgtctcgggagacagacgtttaaccggtgagcactgccattttttttttcctttctggtcataaattagacacttaaaatagattttaaggagccagctgaaacgaaccaataccatggctctaaattacgtttcctggaggctaaaaattctaattgcgtcaaaaaaaattgacgtgtcctgtctactcaccttgactgaccacgttttaggcgtgaagatctccccgcagcccgtttgggcgctccttcaacgcctcacgctcctcctactcacccgtttttccctttgcagaaaaggcttggccccaaatccggttggaatatctttaaacaatcccccacccacccacgacggggaaaggaataaagggcattgtgggcggagggtcgtgttcccaagtcccagcggtggttgacctaaggaaacgttatcctcggcag

SEQ ID NO: 48523 - DNA, 270 bp, Homo sapiens; identical to SEQ ID NO: 27622
  chr2:171670471-171670741
  hyper

SEQ ID NO: 48524 - DNA, 181 bp, Homo sapiens
  chr2:171671306-171671487
  hyper
agattccttctccaacgagattatttcattggctaaaacgttaggggtgttttgaactctggggtcaaaggaggaagtggttggaaatgtctcaatctcgtgccacaggtgaagtaaacgaatcttcctttccagggaatcacgggttttgggaaaaggttgaggcgagcgggcgtctatg

SEQ ID NO: 48525 - DNA, 125 bp, Homo sapiens; identical to SEQ ID NO: 27625
  chr2:171674091-171674216
  hyper

SEQ ID NO: 48526 - DNA, 41 bp, Homo sapiens
  chr2:171674698-171674739
  hyper
tcccccacacccttgcgtcttgtactggccttggaccccca

SEQ ID NO: 48527 - DNA, 55 bp, Homo sapiens
  chr2:171675306-171675361
  hyper
atggggctctgaccccgtccctgccagaggtcattcggctgtcagggacgctagg

SEQ ID NO: 48528 - DNA, 73 bp, Homo sapiens
  chr2:171675592-171675665
  hyper
tgacctcctcctttccccctgggctgtgttcaaagtctataatcagcggaaatttcgacgttaattgcagctt

SEQ ID NO: 48529 - DNA, 234 bp, Homo sapiens; identical to SEQ ID NO: 27629
  chr2:171677989-171678223
  hyper

SEQ ID NO: 48530 - DNA, 53 bp, Homo sapiens; identical to SEQ ID NO: 27630
  chr2:171678293-171678346
  hyper

SEQ ID NO: 48531 - DNA, 57 bp, Homo sapiens; identical to SEQ ID NO: 27631
  chr2:171678980-171679037
  hyper

SEQ ID NO: 48532 - DNA, 117 bp, Homo sapiens; identical to SEQ ID NO: 27632
  chr2:172379586-172379703
  hyper

SEQ ID NO: 48533 - DNA, 43 bp, Homo sapiens
  chr2:172946211-172946254
  hyper
gcttcaggaacaggaatccaagggcccacgctctgtctgccaa

SEQ ID NO: 48534 - DNA, 30 bp, Homo sapiens; identical to SEQ ID NO: 27635
  chr2:172946606-172946636
  hyper

SEQ ID NO: 48535 - DNA, 179 bp, Homo sapiens
  chr2:172948314-172948493
  hyper
ttgcttttgcttttctttttgctccaaccactctgcctgaaatatttctgcccccagcattgtgcccttaaaccaaaggagaggaattctgcgggcagcagcagctggtacagaagttaaaaaaaaagagaaaccccctctactaatatctgtaacgacagcaccgatgtaatttgttt

SEQ ID NO: 48536 - DNA, 501 bp, Homo sapiens
  chr2:172949711-172950212
  hyper
tcttaggagaacctctgtctgttggccgcctcgggcgcccccagtgcgcgactccgcgctccagaggcagaggtcagtctcctcctgagccgccctagctctgcgccgaactgagtggcagcgacgagaagcggtcccgggtgtccggtgttagggaccgctgaagggtggggacagtggtaggggggcggcggcgcggagccgctggttggttcctggggaggaaagcgcgcgagggaggcgggaggccgatgagccgcgggccgcaggggccccggcgcagacgccgcagcccattgtgcttcctgcccggcgcgctctgttgcagaggagccccggccgggaagtgtggatgcgtcttacccgaggccgggccgcctcgcccgctctagtccagcggagcccgagcgcctcggaccaatccccagtgattatgcaagacagcggaccaatcagctccgccagctcatgaatatttatgaccttcgctgagtcaaagct

SEQ ID NO: 48537 - DNA, 292 bp, Homo sapiens; identical to SEQ ID NO: 6480
  chr2:172951251-172951543
  hyper

SEQ ID NO: 48538 - DNA, 60 bp, Homo sapiens; identical to SEQ ID NO: 27641
  chr2:172951983-172952043
  hyper

SEQ ID NO: 48539 - DNA, 140 bp, Homo sapiens
  chr2:172952381-172952521
  hyper
tcggtgttatgcaggcgctgtatcttccgcaggcggtagccacggtcggactgagcccctggcaggctaaggcctggatcccggttctcccctcatcacaactcctccctggctctctgagagctgcccccgtgggctga

SEQ ID NO: 48540 - DNA, 249 bp, Homo sapiens; identical to SEQ ID NO: 17758
  chr2:172955545-172955794
  hyper

SEQ ID NO: 48541 - DNA, 98 bp, Homo sapiens
  chr2:172957809-172957907
  hyper
gtcacccccacccaccgctttcctaccccctccctcatcccccaatcttcgaggattaacacttcctgaaacatcaagtgtttttataaaaaggaaaa

SEQ ID NO: 48542 - DNA, 30 bp, Homo sapiens; identical to SEQ ID NO: 27647
  chr2:172958321-172958351
  hyper

SEQ ID NO: 48543 - DNA, 107 bp, Homo sapiens; identical to SEQ ID NO: 27648
  chr2:172960759-172960866
  hyper

SEQ ID NO: 48544 - DNA, 73 bp, Homo sapiens; identical to SEQ ID NO: 17759
  chr2:172961325-172961398
  hyper

SEQ ID NO: 48545 - DNA, 99 bp, Homo sapiens
  chr2:172961598-172961697
  hyper
ccatttttcattcgcgctttggggagctcagtagagcacggggggagcgtgtctgcgcggcggcgggctgatcacaggactccgcgtctccgggcgggc

SEQ ID NO: 48546 - DNA, 82 bp, Homo sapiens; identical to SEQ ID NO: 27650
  chr2:172961935-172962017
  hyper

SEQ ID NO: 48547 - DNA, 459 bp, Homo sapiens; identical to SEQ ID NO: 27651
  chr2:172963633-172964092
  hyper

SEQ ID NO: 48548 - DNA, 74 bp, Homo sapiens
  chr2:172964747-172964821
  hyper
caggaaggaaagaagcggcggggccgcccgggtcaaggggccacgtgggggagggcgggcaggcgggaccggga

SEQ ID NO: 48549 - DNA, 14 bp, Homo sapiens
  chr2:172966250-172966264
  hyper
tgagtcttttggaa

SEQ ID NO: 48550 - DNA, 610 bp, Homo sapiens; identical to SEQ ID NO: 17763
  chr2:172966442-172967052
  hyper

SEQ ID NO: 48551 - DNA, 173 bp, Homo sapiens; identical to SEQ ID NO: 27656
  chr2:172970574-172970747
  hyper

SEQ ID NO: 48552 - DNA, 420 bp, Homo sapiens; identical to SEQ ID NO: 27657
  chr2:172970950-172971370
  hyper

SEQ ID NO: 48553 - DNA, 53 bp, Homo sapiens; identical to SEQ ID NO: 27658
  chr2:172971641-172971694
  hyper

SEQ ID NO: 48554 - DNA, 37 bp, Homo sapiens
  chr2:172973218-172973255
  hyper
tccagccgtggcctttccgcggcgctgggcttctggt

SEQ ID NO: 48555 - DNA, 30 bp, Homo sapiens; identical to SEQ ID NO: 27660
  chr2:172974228-172974258
  hyper

SEQ ID NO: 48556 - DNA, 88 bp, Homo sapiens
  chr2:173099696-173099784
  hyper
cggcgccgggggagccgcgctcggggacagctggcggctcaacggcagcatcggcagcatcgagaaaggtgacgagttctgcaaataa

SEQ ID NO: 48557 - DNA, 283 bp, Homo sapiens; identical to SEQ ID NO: 17767
  chr2:173099814-173100097
  hyper

SEQ ID NO: 48558 - DNA, 164 bp, Homo sapiens; identical to SEQ ID NO: 17768
  chr2:173100098-173100262
  hyper

SEQ ID NO: 48559 - DNA, 454 bp, Homo sapiens; identical to SEQ ID NO: 27663
  chr2:173600547-173601001
  hyper

SEQ ID NO: 48560 - DNA, 100 bp, Homo sapiens
  chr2:175190771-175190871
  hyper
gaagaaagagaaactcgcgacaacagagttgccgaaagagaagtgttggcgcctcaaacttgaggatcagcttcttgggccccactccagggtgtcgcgg

SEQ ID NO: 48561 - DNA, 82 bp, Homo sapiens
  chr2:175193823-175193905
  hyper
tatgacgaactagaggctgggcccggttcttctccagaacagcgtgtggatgtaaaggagatgaaatcgtcctcccccactg

SEQ ID NO: 48562 - DNA, 122 bp, Homo sapiens
  chr2:175196967-175197089
  hyper
aaaaaatctgtcagacgaaaaaaatctggacttcctccgaaagatttccttggggccccaccttagagttgaagtggcccgggtgtttgcctgcgttcgtttggaagatttccctaactttt

SEQ ID NO: 48563 - DNA, 146 bp, Homo sapiens
  chr2:175197119-175197265
  hyper
atatgcgagtgcccacgtctagagtctgacagctggaactacggggaaaacggcgggagggggaggggaggggatccgaggggaggaggagaagaggaaggcgagcagggcgccggagcccgaggtgtctgcgagaactgttttaa

SEQ ID NO: 48564 - DNA, 65 bp, Homo sapiens; identical to SEQ ID NO: 27670
  chr2:175197980-175198045
  hyper

SEQ ID NO: 48565 - DNA, 79 bp, Homo sapiens
  chr2:175199448-175199527
  hyper
cttcagtccccagcccgccctcgccccccccccgcaagtatcccccactactcccccccacccccgcggccctagctag

SEQ ID NO: 48566 - DNA, 59 bp, Homo sapiens; identical to SEQ ID NO: 17774
  chr2:175202652-175202711
  hyper

SEQ ID NO: 48567 - DNA, 30 bp, Homo sapiens; identical to SEQ ID NO: 6510
  chr2:175203142-175203172
  hyper

SEQ ID NO: 48568 - DNA, 24 bp, Homo sapiens
  chr2:175204150-175204174
  hyper
ccgtcaaatggccctcgcaggtta

SEQ ID NO: 48569 - DNA, 200 bp, Homo sapiens; identical to SEQ ID NO: 17776
  chr2:175207028-175207228
  hyper

SEQ ID NO: 48570 - DNA, 278 bp, Homo sapiens; identical to SEQ ID NO: 17777
  chr2:175207258-175207536
  hyper

SEQ ID NO: 48571 - DNA, 330 bp, Homo sapiens
  chr2:175207981-175208311
  hyper
cccacccttcccagacgctggagtgtatagaaatatgtatgaggtaaatacatacagacatgcctcccccatatattgttgatgtaaatatagactgtgtgtttgcatctccagttaaggaaagggtttcagaatgtccgtggggacacgtccctccagggccggctgtcgaggacccggaaaaccacagcccctaagagttccagattttccaagacccttatactctcttcctgtagaatttcatactgggggttttgcattgttttgcaggcatgtaaccatttctgggtgattcatttatctataaaggaaatgcaaagtggcagg

SEQ ID NO: 48572 - DNA, 43 bp, Homo sapiens; identical to SEQ ID NO: 27688
  chr2:175351019-175351062
  hyper

SEQ ID NO: 48573 - DNA, 219 bp, Homo sapiens
  chr2:175546822-175547041
  hyper
tgtctctggagagttcgggggatcaccccccctcaacccccgtccccactccgggcgaaaagcactgaccgggactggagatgtctctaaggtcgacgcagacccctaacgcgcgcgtctacgccgacctggggcgagcgggccgcccgggagggccgggagggaggcgggctggagcgcgggaggggcacggttcccatagacaggcaggcgggcggt

SEQ ID NO: 48574 - DNA, 244 bp, Homo sapiens
  chr2:175547140-175547384
  hyper
cgagacctacggagatagtgggtcccgagccccacggggcggccccgggtccgcggagtccagcggtgagctcagcccgaggcgcgggacccaggctgtccacggccccttcctccccgggccatcagcgggcagcagaacgcgcgggccgctggcctggaattgcgcccctcccgaggccgcgcgcccgcgcccaccgctcgcaggggacgcggcctcgacgtccccagccgccccacccgcg

SEQ ID NO: 48575 - DNA, 655 bp, Homo sapiens
  chr2:175547413-175548068
  hyper
ccgccgtcgagcccagcccctcccggcgtctcccccggcccccgggagcccggaacccgggtcgcgccagaggcgacgcgtcccttaccgcgcagcggctccggacgactccgcagccccgcgccgcgctgggcattttttctgggaaacttctcccggggtccgcagggctgagccgggcgggcaggaaaagcgctcagcgccgggaggctgcgaccatccgggaacttcgccgagatgtgggccctcccctccggcgccgccgcccccccgccgccccgccacatgtggacgcgccgcgaggccccgccggcccgcgccctgccctccgcgcgcccgcctgccccgccagcaatggggctctgcgcctgcagcttcggcccgcagaggatcgcggcggggcgggatggtcggggctggagtccgcagtttcctcagtcccgctcccctgcgcggcgaggggaccgaggcaagaggacaggagtttgcagaggggcgggaactggaaggggagtctagcccagggcctttccccccaactcttgaatcttctccaccttcttgcggctgctggcggggggatcgggtgggggtgttccctctgttcgagccggaaggaacgccttttcccacgctttcccgtctgctctcaaaa

SEQ ID NO: 48576 - DNA, 30 bp, Homo sapiens; identical to SEQ ID NO: 27691
  chr2:176940611-176940641
  hyper

SEQ ID NO: 48577 - DNA, 199 bp, Homo sapiens
  chr2:176943568-176943767
  hyper
attattagcatcaaacttgacgtggcagttaacactagtgggttttgatgtacctttcttcaagttcaaggaaacccctccagtagccgggttggcagagcgggtctcagcaacccagcggtggctttgcagaggcgaaggcgcaatagacatgcgtgagaaatatgccaagaaccatttcacccgaggaaaaggaaag

SEQ ID NO: 48578 - DNA, 59 bp, Homo sapiens; identical to SEQ ID NO: 27693
  chr2:176944083-176944142
  hyper

SEQ ID NO: 48579 - DNA, 59 bp, Homo sapiens; identical to SEQ ID NO: 240
  chr2:176944346-176944405
  hyper

SEQ ID NO: 48580 - DNA, 562 bp, Homo sapiens
  chr2:176945784-176946346
  hyper
cccccgcgtccggctgctgctgctcctcaggcttttattcccttacttcttgctgcacttttttgtcccaatccaacctttcctctccctcccgccacccaccagtgccggtctcgctgagcacccgtctctcaatcccaggatttgtacggggattctgggcagcctttgaagagaggctgccgctcagcttttctgagaggtcgccgcgcgaagtcttgagccctccgaactgcaaggacctgcccctaggggcacgggtccgattttgatattgaagggatgattttgttggaatcgtttgccttaaatgagtgggtagagcaatgtctccataaacggggaaggggacgtttccacccctcccaacactatctaataaagacatcattcgtcacaactctaaattaaagaaagcccgatcaaaccagagggagacttccacactcctcccctaccccgtggagattttttcttttttctgcagtgtcgaacgctccatgaagggctcaccaaatcgcctaacctcccggctatctctcccagacgtataataaaatta

SEQ ID NO: 48581 - DNA, 37 bp, Homo sapiens
  chr2:176947903-176947940
  hyper
agcagaactggaaggcacggtcccagacatgcgtccc

SEQ ID NO: 48582 - DNA, 74 bp, Homo sapiens; identical to SEQ ID NO: 27701
  chr2:176947941-176948015
  hyper

SEQ ID NO: 48583 - DNA, 303 bp, Homo sapiens
  chr2:176948742-176949045
  hyper
tacgaatgacgctgttcgaataatcatttattgtaacaggtttataagcaaataaatacaccctcctgtcagtgggtaatgaaggcagcttcagagcagacaaatagatccaggtaggaggcgagaagagacaagtgaggaggaaggctccggtcctttgcccgctccgagccagttctgctcgcccgggggtttggcctcgggggtgaaattgacagtctgattaatagagcgcgccgcggcacatttcccccttcatttaggggcatcattacgctctcagtttgctaggttgccccttag

SEQ ID NO: 48584 - DNA, 46 bp, Homo sapiens; identical to SEQ ID NO: 27703
  chr2:176949372-176949418
  hyper

SEQ ID NO: 48585 - DNA, 14 bp, Homo sapiens
  chr2:176949681-176949695
  hyper
tttcctgaggggaa

SEQ ID NO: 48586 - DNA, 133 bp, Homo sapiens
  chr2:176949869-176950002
  hyper
aaagaggagacagccttcttcccctacctccccgctgccctcccttcccctttgcttttcttccttctctctttcctcccctcatcaaccccagccccttacctgcggccacaggtattcccagcgttgggtc

SEQ ID NO: 48587 - DNA, 68 bp, Homo sapiens; identical to SEQ ID NO: 17784
  chr2:176950074-176950142
  hyper

SEQ ID NO: 48588 - DNA, 6 bp, Homo sapiens
  chr2:176950258-176950264
  hyper
acgggg

SEQ ID NO: 48589 - DNA, 352 bp, Homo sapiens; identical to SEQ ID NO: 27706
  chr2:176952741-176953093
  hyper

SEQ ID NO: 48590 - DNA, 216 bp, Homo sapiens
  chr2:176957199-176957415
  hyper
ggggggagggcgggaatgggaggtggaccctgcaaggggcaggagaggggtgggggccggagtgggtgggtccagccaggcctgggccgggagccaggctcccccgcgttcctacccccacgtggccgcgcgcagccaatggcacgcccccggcgggggccctcggggcgggaggcggccccccgaccggcccaggccccctcccaacctgaactt

SEQ ID NO: 48591 - DNA, 219 bp, Homo sapiens
  chr2:176957919-176958138
  hyper
ctcccccagccaaagagtgcccagcacccacgcctgcagcggccgctgcagcgcccccgagcgctccagcgctgggctacggctaccacttcggcaacggctactacagctgccgtatgtcgcacggcgtgggcttacagcagaatgcgctcaagtcatcgccgcacgcctcgctgggaggctttcccgtggagaagtacatggacgtgtcaggcctgg

SEQ ID NO: 48592 - DNA, 141 bp, Homo sapiens
  chr2:176959148-176959289
  hyper
ctcagctaggtgctccgaatatcccagcctaatttttcttgtgcttttgtttgtatcaggggatgtggctctaaatcagccggacatgtgcgtctaccgaagagggaggaagaagagagtgccttacaccaaactgcagct

SEQ ID NO: 48593 - DNA, 65 bp, Homo sapiens; identical to SEQ ID NO: 27711
  chr2:176963189-176963254
  hyper

SEQ ID NO: 48594 - DNA, 127 bp, Homo sapiens
  chr2:176963321-176963448
  hyper
cgagggtcctgctgcaggctgagactggcgccggtcaccgggtctcccagggtcttgggatcagaggcaggaggggaggacccctagtcctctggccggactaggcaagagggccagcgacggggtc

SEQ ID NO: 48595 - DNA, 175 bp, Homo sapiens
  chr2:176963522-176963697
  hyper
cccggcacccctgggggcgctgaggcaaggaactctgctagccagctgcctccgaacgcccgctgttccccggccaggtggttctggctcttctgcctttccacacccagtcgggggagttcgtcctgctttgccctccacttggtggatggggacacctcggagttctggtttg

SEQ ID NO: 48596 - DNA, 3 bp, Homo sapiens
  chr2:176964082-176964085
  hyper
gga

SEQ ID NO: 48597 - DNA, 18 bp, Homo sapiens
  chr2:176965492-176965510
  hyper
gcgcgtggccagggccgg

SEQ ID NO: 48598 - DNA, 207 bp, Homo sapiens
  chr2:176969256-176969463
  hyper
cggagcggctggctgcgccccgaaggcctggtgcgctccctgcgtttcgggtggggccgcgcaggcaaggacaaggccacagagtcggggtcttcacggtaggttctcgagcgggacgcgcgggtccggaggctgcggttttccctgggtttggggaatgggggtaggaactaggagggagctggggccaaagagccaagcgggctg

SEQ ID NO: 48599 - DNA, 68 bp, Homo sapiens; identical to SEQ ID NO: 27718
  chr2:176970219-176970287
  hyper

SEQ ID NO: 48600 - DNA, 30 bp, Homo sapiens; identical to SEQ ID NO: 27719
  chr2:176970603-176970633
  hyper

SEQ ID NO: 48601 - DNA, 95 bp, Homo sapiens; identical to SEQ ID NO: 27720
  chr2:176971337-176971432
  hyper

SEQ ID NO: 48602 - DNA, 216 bp, Homo sapiens; identical to SEQ ID NO: 27721
  chr2:176972742-176972958
  hyper

SEQ ID NO: 48603 - DNA, 30 bp, Homo sapiens; identical to SEQ ID NO: 27722
  chr2:176974082-176974112
  hyper

SEQ ID NO: 48604 - DNA, 67 bp, Homo sapiens
  chr2:176982517-176982584
  hyper
cgcccgggcagaggaaaagcttgccggttttatttttcctgagctagacctgaacacaacaaaagag

SEQ ID NO: 48605 - DNA, 30 bp, Homo sapiens; identical to SEQ ID NO: 6548
  chr2:176983753-176983783
  hyper

SEQ ID NO: 48606 - DNA, 4 bp, Homo sapiens
  chr2:176986711-176986715
  hyper
cgcg

SEQ ID NO: 48607 - DNA, 209 bp, Homo sapiens; identical to SEQ ID NO: 17795
  chr2:176986848-176987057
  hyper

SEQ ID NO: 48608 - DNA, 83 bp, Homo sapiens
  chr2:176993464-176993547
  hyper
gctttgggaaaaattcgtaactttgaggcctgcgcgctctctcggcagtaatttcacaggcttggcggaggaagtaggatcgt

SEQ ID NO: 48609 - DNA, 176 bp, Homo sapiens
  chr2:176993855-176994031
  hyper
tctatcaagggtgaaatgatggaaactatattcatgggcatgatttccattaaatatcaattaacctgagagcctcggccaggcttgcggtgcgtcaagggtaaatgtacatctcatttccacagggcccgctcggctggaaaagaaaggctttgatttgctttgataacgccagg

SEQ ID NO: 48610 - DNA, 38 bp, Homo sapiens; identical to SEQ ID NO: 6554
  chr2:176996261-176996299
  hyper

SEQ ID NO: 48611 - DNA, 185 bp, Homo sapiens; identical to SEQ ID NO: 27734
  chr2:176997536-176997721
  hyper

SEQ ID NO: 48612 - DNA, 43 bp, Homo sapiens; identical to SEQ ID NO: 27735
  chr2:177000770-177000813
  hyper

SEQ ID NO: 48613 - DNA, 72 bp, Homo sapiens
  chr2:177001976-177002048
  hyper
aggatcccactgcctagatggagagcccctcaatcctaccctaggaaagtgtatagacgggttactactgaa

SEQ ID NO: 48614 - DNA, 320 bp, Homo sapiens; identical to SEQ ID NO: 27739
  chr2:177003734-177004054
  hyper

SEQ ID NO: 48615 - DNA, 48 bp, Homo sapiens; identical to SEQ ID NO: 27740
  chr2:177004450-177004498
  hyper

SEQ ID NO: 48616 - DNA, 11 bp, Homo sapiens
  chr2:177004555-177004566
  hyper
cgcatgtgcag

SEQ ID NO: 48617 - DNA, 48 bp, Homo sapiens
  chr2:177004658-177004706
  hyper
acccgatctttccattctccctccgtcaaggctcgctactcatcttgc

SEQ ID NO: 48618 - DNA, 697 bp, Homo sapiens; identical to SEQ ID NO: 27742
  chr2:177004982-177005679
  hyper

SEQ ID NO: 48619 - DNA, 224 bp, Homo sapiens; identical to SEQ ID NO: 27743
  chr2:177042579-177042803
  hyper

SEQ ID NO: 48620 - DNA, 71 bp, Homo sapiens
  chr2:177042913-177042984
  hyper
cggccaggctgcgggcggggtgggctggcgctcctgatccacctggaacacttttgcaaagacagacggtg

SEQ ID NO: 48621 - DNA, 41 bp, Homo sapiens
  chr2:177043515-177043556
  hyper
aataccgctctacacccagagagggacgaatacacctctga

SEQ ID NO: 48622 - DNA, 132 bp, Homo sapiens; identical to SEQ ID NO: 27746
  chr2:177052963-177053095
  hyper

SEQ ID NO: 48623 - DNA, 48 bp, Homo sapiens; identical to SEQ ID NO: 27749
  chr2:177053906-177053954
  hyper

SEQ ID NO: 48624 - DNA, 114 bp, Homo sapiens; identical to SEQ ID NO: 17803
  chr2:177053999-177054113
  hyper

SEQ ID NO: 48625 - DNA, 12 bp, Homo sapiens
  chr2:177054351-177054363
  hyper
aaaatgtgccag

SEQ ID NO: 48626 - DNA, 42 bp, Homo sapiens; identical to SEQ ID NO: 27751
  chr2:177502246-177502288
  hyper

SEQ ID NO: 48627 - DNA, 374 bp, Homo sapiens; identical to SEQ ID NO: 27752
  chr2:177502526-177502900
  hyper

SEQ ID NO: 48628 - DNA, 441 bp, Homo sapiens; identical to SEQ ID NO: 27753
  chr2:179278428-179278869
  hyper

SEQ ID NO: 48629 - DNA, 487 bp, Homo sapiens; identical to SEQ ID NO: 6570
  chr2:180725172-180725659
  hyper

SEQ ID NO: 48630 - DNA, 146 bp, Homo sapiens; identical to SEQ ID NO: 27755
  chr2:180725935-180726081
  hyper

SEQ ID NO: 48631 - DNA, 30 bp, Homo sapiens; identical to SEQ ID NO: 27756
  chr2:180726333-180726363
  hyper

SEQ ID NO: 48632 - DNA, 58 bp, Homo sapiens; identical to SEQ ID NO: 27757
  chr2:180726645-180726703
  hyper

SEQ ID NO: 48633 - DNA, 79 bp, Homo sapiens; identical to SEQ ID NO: 27759
  chr2:182321759-182321838
  hyper

SEQ ID NO: 48634 - DNA, 22 bp, Homo sapiens
  chr2:182322170-182322192
  hyper
gcgagtgcgcggcatcccaggc

SEQ ID NO: 48635 - DNA, 242 bp, Homo sapiens; identical to SEQ ID NO: 27762
  chr2:182521404-182521646
  hyper

SEQ ID NO: 48636 - DNA, 37 bp, Homo sapiens; identical to SEQ ID NO: 27763
  chr2:182542469-182542506
  hyper

SEQ ID NO: 48637 - DNA, 25 bp, Homo sapiens
  chr2:182542878-182542903
  hyper
agctgtccatggtaccgtaaggcgg

SEQ ID NO: 48638 - DNA, 385 bp, Homo sapiens; identical to SEQ ID NO: 17813
  chr2:182542933-182543318
  hyper

SEQ ID NO: 48639 - DNA, 6 bp, Homo sapiens
  chr2:182543758-182543764
  hyper
agtgtt

SEQ ID NO: 48640 - DNA, 177 bp, Homo sapiens
  chr2:182543925-182544102
  hyper
tgtggaaatgactgtacatttcagcgacttcatgtttatccaaatgtgttcaaagttactcacaactccataaaaaaaaaaaaaagctgtaaaatcacacattctacttccatttctgtcctggcttccagatacttagcgatttaagttgaacagccattgcgtaatttactaata

SEQ ID NO: 48641 - DNA, 30 bp, Homo sapiens; identical to SEQ ID NO: 27766
  chr2:182544495-182544525
  hyper

SEQ ID NO: 48642 - DNA, 14 bp, Homo sapiens
  chr2:182545197-182545211
  hyper
cctggggcctccgg

SEQ ID NO: 48643 - DNA, 264 bp, Homo sapiens
  chr2:182545275-182545539
  hyper
gcccagttagtgatgctaagcgcgggcggggccgctagctgaggggctagcaggtctatgcgcctgacgcctgcgcacgcgtccaggctgtgcgctccccgttctcccctcctccccacttctccccacgccttgctcgtctcccgccctcctccgacaaccgctcccctcaccctccacccctacccccgcccctcctccttcctccccggcatgcgccatatggtcttcccggtccagccaagagcctggaaccacgtgacc

SEQ ID NO: 48644 - DNA, 254 bp, Homo sapiens
  chr2:182545694-182545948
  hyper
gaggggatttgagggaaggaagggaaaagctaatgttaactaggtctagatcagagcgagtggcctgctttcgcgccggaagtaggacagaggtgaaagaggcagaagcggggagactgaggcacgcagtgaagagtcctcgctcctttcgatttcttgtcctgacactggcatccagagcagcatgactccttgccctctctgaaaggcccatcccttggcttcttctccttggcagacgctttgatcattgg

SEQ ID NO: 48645 - DNA, 47 bp, Homo sapiens
  chr2:182546388-182546435
  hyper
gttccctggccagcccgccctggacggcctcggctctctagtccagg

SEQ ID NO: 48646 - DNA, 70 bp, Homo sapiens
  chr2:182546465-182546535
  hyper
cgccacagccggacctgcgctcttgctcccctcagtctcgggtctgtataagatacttgattcagacaag

SEQ ID NO: 48647 - DNA, 186 bp, Homo sapiens
  chr2:182547199-182547385
  hyper
acttggctgacaaagcgcataggggaggataaaataattcacccaggagcctgggcccaggatttacccctgtactgtctgtatcttcagtgttgggctaaaactcgagggcgtcggagtactagcccttagaagatagtacacagcccgacgtttgcggcagggccaggttaagtactgcccctc

SEQ ID NO: 48648 - DNA, 319 bp, Homo sapiens; identical to SEQ ID NO: 17817
  chr2:182547613-182547932
  hyper

SEQ ID NO: 48649 - DNA, 389 bp, Homo sapiens; identical to SEQ ID NO: 27773
  chr2:182548400-182548789
  hyper

SEQ ID NO: 48650 - DNA, 207 bp, Homo sapiens; identical to SEQ ID NO: 27774
  chr2:182548819-182549026
  hyper

SEQ ID NO: 48651 - DNA, 51 bp, Homo sapiens
  chr2:182549037-182549088
  hyper
cgcctccgccccgggggaggcagttgggctcccgggtcctggcctgaggct

SEQ ID NO: 48652 - DNA, 203 bp, Homo sapiens; identical to SEQ ID NO: 17821
  chr2:182549134-182549337
  hyper

SEQ ID NO: 48653 - DNA, 91 bp, Homo sapiens
  chr2:182549454-182549545
  hyper
ttggaaggacttgtctctgattccctgtcaggatccaggggctttccttaaaccatccaacactcagaatcaacaacgtaaaatcaactca

SEQ ID NO: 48654 - DNA, 131 bp, Homo sapiens; identical to SEQ ID NO: 27776
  chr2:182549876-182550007
  hyper

SEQ ID NO: 48655 - DNA, 41 bp, Homo sapiens
  chr2:182550053-182550094
  hyper
cggcgccggagcgtcgcaagaacaatggttgctgcagtggg

SEQ ID NO: 48656 - DNA, 18 bp, Homo sapiens
  chr2:182819030-182819048
  hyper
gcgcgcacacacacacac

SEQ ID NO: 48657 - DNA, 133 bp, Homo sapiens; identical to SEQ ID NO: 17822
  chr2:182819216-182819349
  hyper

SEQ ID NO: 48658 - DNA, 121 bp, Homo sapiens
  chr2:183731173-183731294
  hyper
tcacaggctgcagcccgagccccgggcacccggagcaggcagagagcagccagggcaagcagcccggcccgcagcagcagcatccctcccgggctgccgcagaccatgatcccggcaggat

SEQ ID NO: 48659 - DNA, 285 bp, Homo sapiens; identical to SEQ ID NO: 17824
  chr2:183731524-183731809
  hyper

SEQ ID NO: 48660 - DNA, 30 bp, Homo sapiens; identical to SEQ ID NO: 17825
  chr2:183732076-183732106
  hyper

SEQ ID NO: 48661 - DNA, 230 bp, Homo sapiens
  chr2:185462639-185462869
  hyper
acaactaccctcccccgaaactatcatcaacacaagcacttacggtatctacaaatgtgtgggagcaggggtgggtggggggcatattttctttcctcgcctttccctaagactgaacagggtaccagcctccataccaaacacacattaaataacaaaatcaaataagccaaacccagtggatagcaattatcttgagaaagaagccgctgctggcaccggcctggatt

SEQ ID NO: 48662 - DNA, 213 bp, Homo sapiens
  chr2:185462980-185463193
  hyper
ctctccgcccccaccttccaggagtctcccacttggcggtggccgtcgcgtccccggccctctgcggcagcggcgccgcgcggggcgctcccactcgcgctcgggctggcgcggccgcgggtcccggcggcggggtgggcgggggaggcagcgggtgacagatgtactcctctgacagctctcagtatcagcccagtggctccctgccattgg

SEQ ID NO: 48663 - DNA, 45 bp, Homo sapiens
  chr2:186603443-186603488
  hyper
ccctcaggaggccaccgcccttctggggccgctaccattggaagc

SEQ ID NO: 48664 - DNA, 135 bp, Homo sapiens
  chr2:186603518-186603653
  hyper
tgggctctggccattcctggtcaggtccggacagagggacaacggggtgctagagaaggagagcggggcgggtgaggaaggggctgagggggctgtgccggccatggagctgtacctcggcgcctgctccaagcc

SEQ ID NO: 48665 - DNA, 210 bp, Homo sapiens; identical to SEQ ID NO: 27783
  chr2:189156634-189156844
  hyper

SEQ ID NO: 48666 - DNA, 75 bp, Homo sapiens; identical to SEQ ID NO: 27784
  chr2:190445180-190445255
  hyper

SEQ ID NO: 48667 - DNA, 61 bp, Homo sapiens; identical to SEQ ID NO: 27785
  chr2:191045133-191045194
  hyper

SEQ ID NO: 48668 - DNA, 32 bp, Homo sapiens; identical to SEQ ID NO: 27786
  chr2:192015371-192015403
  hyper

SEQ ID NO: 48669 - DNA, 14 bp, Homo sapiens
  chr2:193059011-193059025
  hyper
ggtctgtgctggat

SEQ ID NO: 48670 - DNA, 318 bp, Homo sapiens; identical to SEQ ID NO: 17829
  chr2:193060067-193060385
  hyper

SEQ ID NO: 48671 - DNA, 242 bp, Homo sapiens
  chr2:193060441-193060683
  hyper
ctctcctcatcacccgctcctctccagcccgtagcctattagtgtgtccacctgggaggtgcggtcagatgtgtttggaaggtcagattggtcgggacaagtggtctgagagaaagagaaaggctcctctgcatacgccgcgggtgggttgccgggagcatcggccgggcagcggcgtccgggaaggggagagcgggctccatttgttggcccaggcagtgaccctgcgttccttactcggg

SEQ ID NO: 48672 - DNA, 55 bp, Homo sapiens; identical to SEQ ID NO: 17831
  chr2:193060891-193060946
  hyper

SEQ ID NO: 48673 - DNA, 1078 bp, Homo sapiens; identical to SEQ ID NO: 27791
  chr2:197457183-197458261
  hyper

SEQ ID NO: 48674 - DNA, 90 bp, Homo sapiens; identical to SEQ ID NO: 27792
  chr2:198651504-198651594
  hyper

SEQ ID NO: 48675 - DNA, 35 bp, Homo sapiens; identical to SEQ ID NO: 27793
  chr2:198670222-198670257
  hyper

SEQ ID NO: 48676 - DNA, 60 bp, Homo sapiens; identical to SEQ ID NO: 27794
  chr2:200321938-200321998
  hyper

SEQ ID NO: 48677 - DNA, 219 bp, Homo sapiens; identical to SEQ ID NO: 27796
  chr2:200327575-200327794
  hyper

SEQ ID NO: 48678 - DNA, 133 bp, Homo sapiens; identical to SEQ ID NO: 27797
  chr2:200328171-200328304
  hyper

SEQ ID NO: 48679 - DNA, 18 bp, Homo sapiens
  chr2:200328667-200328685
  hyper
gaggctatgggcccacgc

SEQ ID NO: 48680 - DNA, 77 bp, Homo sapiens
  chr2:200329668-200329745
  hyper
tcggcgtcacgcgtccaaccctggggctgatttaaataactaataagctcagagaaattttacgaggggaacttttc

SEQ ID NO: 48681 - DNA, 15 bp, Homo sapiens
  chr2:200333744-200333759
  hyper
gtctgcgtgcctcac

SEQ ID NO: 48682 - DNA, 30 bp, Homo sapiens; identical to SEQ ID NO: 6604
  chr2:200334190-200334220
  hyper

SEQ ID NO: 48683 - DNA, 82 bp, Homo sapiens; identical to SEQ ID NO: 6607
  chr2:200336264-200336346
  hyper

SEQ ID NO: 48684 - DNA, 81 bp, Homo sapiens; identical to SEQ ID NO: 27808
  chr2:200524136-200524217
  hyper

SEQ ID NO: 48685 - DNA, 66 bp, Homo sapiens; identical to SEQ ID NO: 17839
  chr2:201450490-201450556
  hyper

SEQ ID NO: 48686 - DNA, 36 bp, Homo sapiens
  chr2:201450707-201450743
  hyper
ggactttaggctccagcaagccccgccccactcggc

SEQ ID NO: 48687 - DNA, 178 bp, Homo sapiens; identical to SEQ ID NO: 27810
  chr2:201450744-201450922
  hyper

SEQ ID NO: 48688 - DNA, 38 bp, Homo sapiens
  chr2:201451040-201451078
  hyper
gcctccggggcagctaaaggctgcgttttcagggactg

SEQ ID NO: 48689 - DNA, 147 bp, Homo sapiens
  chr2:202899715-202899862
  hyper
gccatcccgccgtgtcgttctctgtgcgagcgcgcccgccagggctgcgaggcgctcatgaacaagttcggcttccagtggcccgagcggctgcgctgcgagaacttcccggtgcacggtgcgggcgagatctgcgtgggccagaac

SEQ ID NO: 48690 - DNA, 77 bp, Homo sapiens
  chr2:202899891-202899968
  hyper
cggccccactgcctaccctaccgcgccctacctgccggacctgcccttcaccgcgctgcccccgggggcctcagatg

SEQ ID NO: 48691 - DNA, 30 bp, Homo sapiens; identical to SEQ ID NO: 27813
  chr2:206546689-206546719
  hyper

SEQ ID NO: 48692 - DNA, 30 bp, Homo sapiens; identical to SEQ ID NO: 27814
  chr2:206550029-206550059
  hyper

SEQ ID NO: 48693 - DNA, 429 bp, Homo sapiens; identical to SEQ ID NO: 27815
  chr2:206550262-206550691
  hyper

SEQ ID NO: 48694 - DNA, 42 bp, Homo sapiens; identical to SEQ ID NO: 27816
  chr2:206550973-206551015
  hyper

SEQ ID NO: 48695 - DNA, 24 bp, Homo sapiens
  chr2:206551450-206551474
  hyper
cggcttctgcggctccggctgaat

SEQ ID NO: 48696 - DNA, 22 bp, Homo sapiens
  chr2:207139050-207139072
  hyper
tagctctcttagccccgttttc

SEQ ID NO: 48697 - DNA, 53 bp, Homo sapiens
  chr2:207139102-207139155
  hyper
gcaagcagtttttatttggaccctcaaacgctaaaaccttggtctctacttcg

SEQ ID NO: 48698 - DNA, 130 bp, Homo sapiens; identical to SEQ ID NO: 17843
  chr2:207139217-207139347
  hyper

SEQ ID NO: 48699 - DNA, 218 bp, Homo sapiens; identical to SEQ ID NO: 17844
  chr2:207139605-207139823
  hyper

SEQ ID NO: 48700 - DNA, 120 bp, Homo sapiens; identical to SEQ ID NO: 27821
  chr2:207140044-207140164
  hyper

SEQ ID NO: 48701 - DNA, 15 bp, Homo sapiens
  chr2:207307463-207307478
  hyper
tctgtattgcttccc

SEQ ID NO: 48702 - DNA, 1240 bp, Homo sapiens
  chr2:207307562-207308802
  hyper
tcctcaaagaccccaggcaccggcagggaggacacaggccggggcagagcgcccctgcgcgggggattcctgccactccgcgccagcctgcggcgcaaacgctcttctcagccgcagtcccacccgctgctggcaatctgaatgaggagccgcgctatttttacctccccggctgcaatcctttatatttacatgcaggaagcaaatatataagggattaagaaggagatgcgtggccttagtttatccagagcaggaagaggttggaataggagagggtatgtgaagtctggggtggtggaaaaggcaggtggacttcggctggttgttttctcccgatcatccctgtctctggcctggaaacccccgtactctctttcttctggcttatccgtgactgccggctccccctccaccgcccccatcttttgaggtaccacccgtcacctccgatgctgcttgggctgctgcatcactctgctgctttacccccttccccgccccccaacaaagcatgcgcagtgcgttccgggccaggcaacagcagcagcacagcatccagcaacagcatcagcacccgaagccccgctcgggcgcgctctcggggggcggggcgcacgcccgctccgcgcgtccccgcgccgctcgctcccgcgcgtccccgcgccgctcgctcccgcgcgccgcctcagcatcctcaggcccggcggcagcccccgcagtcgctgaagcggccgcgcccgccgggggagggagtagccgctggggaggctccaagttggcggagcggcgaggacccctggactcctctgcgtcccgccccgggagtggctgcgaggctaggcgagccgggaaagggggcgccgcccagccccgagccccgcgccccgtgccccgagcccggagccccctgcccgccgcggcaccatgcgcgccgagccggcgtgaccggctccgcccgcggccgccccgcagctagcccggcgctctcgccggccacacggagcggcgcccgggagctatgagccatgaagccgcccggcagcagctcgcggcagccgcccctggcgggctgcagccttgccggcgcttcctgcggcccccaacgcggccccgccggctcggtgcctgccagcgccccggcccgcacgccgccctgccgcctgcttctcgtccttctcctgctgcctccgctcgccgcctcgtcccggccccgcgcctggggggctgctgcgcccag

SEQ ID NO: 48703 - DNA, 63 bp, Homo sapiens; identical to SEQ ID NO: 17850
  chr2:207308857-207308920
  hyper

SEQ ID NO: 48704 - DNA, 30 bp, Homo sapiens; identical to SEQ ID NO: 27824
  chr2:207309199-207309229
  hyper

SEQ ID NO: 48705 - DNA, 60 bp, Homo sapiens; identical to SEQ ID NO: 27826
  chr2:208030115-208030175
  hyper

SEQ ID NO: 48706 - DNA, 87 bp, Homo sapiens; identical to SEQ ID NO: 27827
  chr2:208546197-208546284
  hyper

SEQ ID NO: 48707 - DNA, 30 bp, Homo sapiens; identical to SEQ ID NO: 27828
  chr2:208633276-208633306
  hyper

SEQ ID NO: 48708 - DNA, 1 bp, Homo sapiens
  chr2:210636334-210636335
  hyper
g

SEQ ID NO: 48709 - DNA, 31 bp, Homo sapiens; identical to SEQ ID NO: 27834
  chr2:210636933-210636964
  hyper

SEQ ID NO: 48710 - DNA, 170 bp, Homo sapiens; identical to SEQ ID NO: 27835
  chr2:211089565-211089735
  hyper

SEQ ID NO: 48711 - DNA, 30 bp, Homo sapiens; identical to SEQ ID NO: 27836
  chr2:211090029-211090059
  hyper

SEQ ID NO: 48712 - DNA, 226 bp, Homo sapiens
  chr2:213401339-213401565
  hyper
gtgtcgcctgagacgaggaagaggacagctgcagaactaatttggattacattccttgcagaaattctgaaaagggcttttcggcatagctcaactcggagccgcacagttaataccaaattgctgcggactcggagcggggtcccccagtggcagaggctgaaccagacagcccccagtaggtcgcctcgtagaaattcctctcggctaagcctgcatgtcggtc

SEQ ID NO: 48713 - DNA, 47 bp, Homo sapiens
  chr2:213401566-213401613
  hyper
ccaatgcctttgaatgggtcaatgtgcataatcaacccattgaggga

SEQ ID NO: 48714 - DNA, 423 bp, Homo sapiens; identical to SEQ ID NO: 17853
  chr2:213402687-213403110
  hyper

SEQ ID NO: 48715 - DNA, 237 bp, Homo sapiens
  chr2:213403337-213403574
  hyper
agccgggcgcgcgtgggggtgcgaggggggcgggcgcggcgcgcgcggtgtggcgactcccagggcgggcgaccgagtccgcgcccgcgggtccagggccggggcccgaggagggggcgagtgtgagcgcgtgtgtgcgcgtgtgggagtgtgctcggtgtgtgcgcttggcgctctgggccggactgtgcagctatttccccgcgtgagccttcgcttgctcgctccctcctcact

SEQ ID NO: 48716 - DNA, 88 bp, Homo sapiens; identical to SEQ ID NO: 6628
  chr2:213403913-213404001
  hyper

SEQ ID NO: 48717 - DNA, 81 bp, Homo sapiens; identical to SEQ ID NO: 27841
  chr2:216300213-216300294
  hyper

SEQ ID NO: 48718 - DNA, 261 bp, Homo sapiens; identical to SEQ ID NO: 27842
  chr2:216301526-216301787
  hyper

SEQ ID NO: 48719 - DNA, 55 bp, Homo sapiens; identical to SEQ ID NO: 27843
  chr2:217236010-217236065
  hyper

SEQ ID NO: 48720 - DNA, 69 bp, Homo sapiens; identical to SEQ ID NO: 27844
  chr2:217237047-217237116
  hyper

SEQ ID NO: 48721 - DNA, 182 bp, Homo sapiens; identical to SEQ ID NO: 27845
  chr2:217497788-217497970
  hyper

SEQ ID NO: 48722 - DNA, 71 bp, Homo sapiens; identical to SEQ ID NO: 27846
  chr2:217557250-217557321
  hyper

SEQ ID NO: 48723 - DNA, 392 bp, Homo sapiens
  chr2:217558904-217559296
  hyper
agtagggggagggggcgggcaacgtgtgggtaggaggaaggagaaagagcgaaagctgggatagactcggctagacagttcccccgggtagcaggatcctccagggctccaattccggggtgcaaggaccctccccgactactcccgagctgcaccccagctcgaagccacttgctgcgcaaagcgcgcgggcccagccggtctcgtgtcccccgcccgtgcgccgcgtaactgactggcacactgagcgcgctcaccgatcttgacttgctcgcggtagctcttttcgttgaggcaaaccccgcggccgtgcagcagggcgtgcagcggcttctcctcgtcctgccgggggaggcagcgcagcccctgggcgcagcgctcggtgtagacgc

SEQ ID NO: 48724 - DNA, 198 bp, Homo sapiens
  chr2:217559326-217559524
  hyper
tcatgcagcagccgcagcccggctccttgaccagctcgcagcccagggggctgggggggcacatggagagggctttctcgtcgcagggctcgcagtgcacgaaggagcccaggctctgggccggccccgcataggcggccagcagcaggaggaccgcggtgagcaacaccatcttctcttagtcgccccctttacctc

SEQ ID NO: 48725 - DNA, 30 bp, Homo sapiens; identical to SEQ ID NO: 27849
  chr2:219232829-219232859
  hyper

SEQ ID NO: 48726 - DNA, 30 bp, Homo sapiens; identical to SEQ ID NO: 27850
  chr2:219723919-219723949
  hyper

SEQ ID NO: 48727 - DNA, 301 bp, Homo sapiens; identical to SEQ ID NO: 27851
  chr2:219724722-219725023
  hyper

SEQ ID NO: 48728 - DNA, 73 bp, Homo sapiens; identical to SEQ ID NO: 27852
  chr2:219735785-219735858
  hyper

SEQ ID NO: 48729 - DNA, 34 bp, Homo sapiens
  chr2:219736117-219736151
  hyper
ctggggcagccctcccgccgcaggtttcaggtcc

SEQ ID NO: 48730 - DNA, 142 bp, Homo sapiens; identical to SEQ ID NO: 27854
  chr2:219773737-219773879
  hyper

SEQ ID NO: 48731 - DNA, 56 bp, Homo sapiens; identical to SEQ ID NO: 27855
  chr2:219823921-219823977
  hyper

SEQ ID NO: 48732 - DNA, 69 bp, Homo sapiens; identical to SEQ ID NO: 27856
  chr2:219824277-219824346
  hyper

SEQ ID NO: 48733 - DNA, 307 bp, Homo sapiens; identical to SEQ ID NO: 27857
  chr2:219824786-219825093
  hyper

SEQ ID NO: 48734 - DNA, 419 bp, Homo sapiens; identical to SEQ ID NO: 27858
  chr2:219825130-219825549
  hyper

SEQ ID NO: 48735 - DNA, 30 bp, Homo sapiens; identical to SEQ ID NO: 27859
  chr2:219826854-219826884
  hyper

SEQ ID NO: 48736 - DNA, 466 bp, Homo sapiens; identical to SEQ ID NO: 27860
  chr2:219846405-219846871
  hyper

SEQ ID NO: 48737 - DNA, 295 bp, Homo sapiens; identical to SEQ ID NO: 27861
  chr2:219846894-219847189
  hyper

SEQ ID NO: 48738 - DNA, 476 bp, Homo sapiens; identical to SEQ ID NO: 17866
  chr2:219849001-219849477
  hyper

SEQ ID NO: 48739 - DNA, 276 bp, Homo sapiens; identical to SEQ ID NO: 27864
  chr2:219849996-219850272
  hyper

SEQ ID NO: 48740 - DNA, 30 bp, Homo sapiens; identical to SEQ ID NO: 27865
  chr2:219850482-219850512
  hyper

SEQ ID NO: 48741 - DNA, 343 bp, Homo sapiens; identical to SEQ ID NO: 27866
  chr2:219857780-219858123
  hyper

SEQ ID NO: 48742 - DNA, 76 bp, Homo sapiens; identical to SEQ ID NO: 27867
  chr2:219866496-219866572
  hyper

SEQ ID NO: 48743 - DNA, 224 bp, Homo sapiens; identical to SEQ ID NO: 27868
  chr2:219867715-219867939
  hyper

SEQ ID NO: 48744 - DNA, 30 bp, Homo sapiens; identical to SEQ ID NO: 27869
  chr2:219924566-219924596
  hyper

SEQ ID NO: 48745 - DNA, 59 bp, Homo sapiens; identical to SEQ ID NO: 27870
  chr2:219925148-219925207
  hyper

SEQ ID NO: 48746 - DNA, 69 bp, Homo sapiens; identical to SEQ ID NO: 27871
  chr2:219925544-219925613
  hyper

SEQ ID NO: 48747 - DNA, 97 bp, Homo sapiens; identical to SEQ ID NO: 27872
  chr2:219926046-219926143
  hyper

SEQ ID NO: 48748 - DNA, 48 bp, Homo sapiens
  chr2:220174296-220174344
  hyper
gcccatccctcctccatcaaatagtaggcgcctcgctagaattcccac

SEQ ID NO: 48749 - DNA, 67 bp, Homo sapiens; identical to SEQ ID NO: 17870
  chr2:220196567-220196634
  hyper

SEQ ID NO: 48750 - DNA, 344 bp, Homo sapiens; identical to SEQ ID NO: 27876
  chr2:220197187-220197531
  hyper

SEQ ID NO: 48751 - DNA, 151 bp, Homo sapiens; identical to SEQ ID NO: 17872
  chr2:220222947-220223098
  hyper

SEQ ID NO: 48752 - DNA, 520 bp, Homo sapiens
  chr2:220223128-220223648
  hyper
ggaacccgtggccatcgggtgtggggtgtgcagggtgcggagaaggctaggattcctcccaatcctctgctgcgccctcccccagccgcctccccaggttgaggggaggccccggcccaggactgggctcttcccgaggtggggactggatgcccgcgctccggactcctgccggagatgccaaccccccagcgctgggcaccttgccttgacccctcagcgcgtctcacatggcccggatctcggtcccttgggcactccctcttgcccaactccgaattggagttcttgtagttctagtttccaccccgtcttccgacgtttaagaccccgcttccaagacgccctctggctttctcttcccatcccgcacacttccctagcttctgagctgtgtgcacccaccaacccgcagccctccctcaggatcgcccctgcccttcccccaggtttcctcctgacggtggggactaatggcgtcccagccccccgggcggctgctcagcagcaggaagcagag

SEQ ID NO: 48753 - DNA, 4 bp, Homo sapiens
  chr2:220283127-220283131
  hyper
cggc

SEQ ID NO: 48754 - DNA, 118 bp, Homo sapiens; identical to SEQ ID NO: 27879
  chr2:220283172-220283290
  hyper

SEQ ID NO: 48755 - DNA, 107 bp, Homo sapiens
  chr2:220283519-220283626
  hyper
gcaggagctcaatgaccgcttcgccaactacatcgagaaggtgcgcttcctggagcagcagaacgcggcgctcgccgccgaagtgaaccggctcaagggccgcgagc

SEQ ID NO: 48756 - DNA, 27 bp, Homo sapiens
  chr2:220283711-220283738
  hyper
cgacgtcgagcgcgacaacctgctcga

SEQ ID NO: 48757 - DNA, 111 bp, Homo sapiens
  chr2:220299477-220299588
  hyper
cctccacggctccctcgcaacccgagccggggggcctaaaaatagcccccaggcgcaatcgccggccgccccggtgaccttctgggtagcacaggccgaaggcgggcgggc

SEQ ID NO: 48758 - DNA, 38 bp, Homo sapiens
  chr2:220300059-220300097
  hyper
gcggtgctcacagtgctggaggtcggaggtaaagggca

SEQ ID NO: 48759 - DNA, 91 bp, Homo sapiens
  chr2:220349706-220349797
  hyper
cacaaccagttggccgcccaggccggcgccaccacgccttccgccgagtccctgggctccgaggccagcgccacgtcgggctcctcaggtg

SEQ ID NO: 48760 - DNA, 28 bp, Homo sapiens
  chr2:220361419-220361447
  hyper
gtttaggggtctggccggtccagggggc

SEQ ID NO: 48761 - DNA, 76 bp, Homo sapiens; identical to SEQ ID NO: 27886
  chr2:220361826-220361902
  hyper

SEQ ID NO: 48762 - DNA, 105 bp, Homo sapiens; identical to SEQ ID NO: 27887
  chr2:220361983-220362088
  hyper

SEQ ID NO: 48763 - DNA, 53 bp, Homo sapiens; identical to SEQ ID NO: 27888
  chr2:220379221-220379274
  hyper

SEQ ID NO: 48764 - DNA, 39 bp, Homo sapiens
  chr2:220416340-220416379
  hyper
ggctgtgggtggggccgtggctgcgcatctcatacttat

SEQ ID NO: 48765 - DNA, 335 bp, Homo sapiens; identical to SEQ ID NO: 17880
  chr2:220416513-220416848
  hyper

SEQ ID NO: 48766 - DNA, 38 bp, Homo sapiens; identical to SEQ ID NO: 17881
  chr2:220417649-220417687
  hyper

SEQ ID NO: 48767 - DNA, 492 bp, Homo sapiens; identical to SEQ ID NO: 27890
  chr2:220435486-220435978
  hyper

SEQ ID NO: 48768 - DNA, 13 bp, Homo sapiens
  chr2:222435863-222435876
  hyper
gcgcacacacaca

SEQ ID NO: 48769 - DNA, 462 bp, Homo sapiens; identical to SEQ ID NO: 27892
  chr2:222435996-222436458
  hyper

SEQ ID NO: 48770 - DNA, 41 bp, Homo sapiens; identical to SEQ ID NO: 27893
  chr2:222436920-222436961
  hyper

SEQ ID NO: 48771 - DNA, 36 bp, Homo sapiens; identical to SEQ ID NO: 27894
  chr2:223104874-223104910
  hyper

SEQ ID NO: 48772 - DNA, 353 bp, Homo sapiens
  chr2:223159453-223159806
  hyper
agaaccaaagccgacttgtccgcgcccccccccacccccccgtaaatcaagtttcttttttttcctttcttcccttttttttttttttttaaggctataaagggtttaaatttcaactgcagaatcgtttcctattgtaaaaatcaaaagaaaatgcactctctcccacttattttttccagattccagtctggtaaacaaatccatgctctgaaatatgtttctcacagagggaaaaagggagtttccttttaattaaaaacaaaccctcccgtgcgccctctcgctggccccgtgcttgcccctcttctccctccgcctcccccaggctgccgtggcggggggctccggac

SEQ ID NO: 48773 - DNA, 51 bp, Homo sapiens; identical to SEQ ID NO: 17884
  chr2:223160065-223160116
  hyper

SEQ ID NO: 48774 - DNA, 214 bp, Homo sapiens
  chr2:223162565-223162779
  hyper
gaagggagtgggtggcgggggcgatgagcatctctgctggggcgccctaacctggaaaaccattgaaaacggctcaggcttgcaagacttcctgcctccccgggattcccagaatcttcaagtggacggaaaggcgattcctaaacaagttatagaaacttctagatgctatttgagatacatagaattctaatttatttaattattctaaaaa

SEQ ID NO: 48775 - DNA, 233 bp, Homo sapiens; identical to SEQ ID NO: 17885
  chr2:223163535-223163768
  hyper

SEQ ID NO: 48776 - DNA, 49 bp, Homo sapiens; identical to SEQ ID NO: 17886
  chr2:223163954-223164003
  hyper

SEQ ID NO: 48777 - DNA, 127 bp, Homo sapiens
  chr2:223164407-223164534
  hyper
ttcttttgtcttctccgtccgcaagcggggctaatgtgaagcacaggcagccgtcgctaggcccaagcactcgttagttgaaggctgggggtatgggggagggtgcagaaaaaaacctggctcctct

SEQ ID NO: 48778 - DNA, 223 bp, Homo sapiens; identical to SEQ ID NO: 27908
  chr2:223166003-223166226
  hyper

SEQ ID NO: 48779 - DNA, 41 bp, Homo sapiens
  chr2:223166408-223166449
  hyper
ccctttatttctttctgaagtctctccggagcccaagccac

SEQ ID NO: 48780 - DNA, 129 bp, Homo sapiens
  chr2:223166721-223166850
  hyper
ctcacgctctgtgcacgttcgaaatgaaacgggagccttgaagacgatatttggataatttgacaaaaaaaaaaaaaaggtgggcgggggagatagcttctattgtcccctctgcgcctctgcccccag

SEQ ID NO: 48781 - DNA, 163 bp, Homo sapiens
  chr2:223167226-223167389
  hyper
gcaggctgacacggtcgagcagagaagttcctggccacccgcccggccccaggcgtgattctcaggatgcagtaaaagttgggcaaacgccgagaaaccctcaatcccacagaaaggctgccgggggctcacggggaggacatcaaaacgccaggttcgtgat

SEQ ID NO: 48782 - DNA, 724 bp, Homo sapiens
  chr2:223168916-223169640
  hyper
cggagatatccaactccacccgggcgtctcctgagagcgcacagtccacagaccccgggagggctgcccgccctaggacacgtactctcccgacccctcactctttcaaaattggggaagaggcggaggagatgaaaaagaagaaagagagaaagagaagaaaagagagaaagaaggaaagaaattttaaaaaataataaaaggagggaagaatggaggtaaaacgcgggggagagaagaggggagaaactctcctcaccacaaccaaagcaggaggcctaagcttcctgaatttctacacatgacttgcattaagttccttcctagaacttaaactttttcatctcccgtcacccaagaaaacacccatttcctcttttaaataaagtttctttttctggagatgaacctttaaataagtcgtacgtttgggagcgagggacaggagaataattttgatccagaaccttggagattggagaagcaggtggaaaaattctaaaaagatgaaaactgaccatctccgacacagaaacccatcgaaaggggccaccgagacccgttgattagctggagggagcatgcggcagaagtgcagacccctcgctaacccgccaacctccaagagccctcttgcagaaagctgcccggctccccacggtggccctgcgcgcgcaccatcctcgcggtctcgcttcttcgccccggaaaactctatgagggg

SEQ ID NO: 48783 - DNA, 24 bp, Homo sapiens
  chr2:223169864-223169888
  hyper
gataaagatcgatatctacatgat

SEQ ID NO: 48784 - DNA, 21 bp, Homo sapiens
  chr2:223170354-223170375
  hyper
cttctttccatccctcggccc

SEQ ID NO: 48785 - DNA, 675 bp, Homo sapiens
  chr2:223170434-223171109
  hyper
ctggaggtaccctctagatggggtaaggacggggaaggatcaagaggttctgcgggaagtgtgcggggctggggggcgggggtgcccgccaatgtccgcagaaggcaaggaggcccactcgaggagggctggatggagacagacttgagtcgggccctgagccccagggagtgcggcccggtagatctcggggcgaggggaacaggatcgggtacacttgatccggaacaagaacgcctcggcctggcggttgcccgttagtcccggatcccagcggccgcttcaccactgagcccgagccgccgagggaattttccaaatgcaaatcaaacacccttggcgccccgcttcttcattaattaagaggaacgtttcgacaaaaccggcgtaatctttattaattacgcagcccttagcgcgccgttcgcatcaatcacgcccaaagcgaaagtgcagggggcgcctaatcccttcccagagcgcgtttggagaaggagccgcgtggccggcgtttccaccgtgacttccacctttctgggctcgcctggcactggctgctcagccggcgcgcagggaggcctttccggaaacaccggctggctgcgcgctagcaggaccgctctagatcccctgacaggccggaaaataacccccactcactatttgggcacgcgc

SEQ ID NO: 48786 - DNA, 184 bp, Homo sapiens
  chr2:223171180-223171364
  hyper
aggctcagtggggaccacgcggttctcagtcctcctcttccctaggaccctctaaaaaggagcctggggcgaaatgacagagggaggcagaaaacctcctgttgccccaggacgccccgaaaaactgctctgggggatggggcggggaagaccttagaagttgtcagggcgaccaactcctccc

SEQ ID NO: 48787 - DNA, 218 bp, Homo sapiens; identical to SEQ ID NO: 27914
  chr2:223171861-223172079
  hyper

SEQ ID NO: 48788 - DNA, 57 bp, Homo sapiens
  chr2:223173173-223173230
  hyper
cagatccccactctacaggacctgtcactcccatttcccatacgagaggaaactccc

SEQ ID NO: 48789 - DNA, 275 bp, Homo sapiens; identical to SEQ ID NO: 17895
  chr2:223176181-223176456
  hyper

SEQ ID NO: 48790 - DNA, 225 bp, Homo sapiens
  chr2:223176983-223177208
  hyper
ccgtaatggagctggcaagtgggacgaacgggacagcctaaagcgtcgttggcccggccaagaggggctcaacgcctgtcaccccgggcggccttgggtcctttgcagtcggagaggctgcaggggaggaggaagacccagccagctccagggtgcaggattctgcccttccacccgagagcctcccccggtgtcccagtggcagtggctgccccgggctgcggt

SEQ ID NO: 48791 - DNA, 71 bp, Homo sapiens
  chr2:223177244-223177315
  hyper
cgccctgccccttgggctcagctgcgagccaccgccggcgtgcgcacccacaaggagagaaatggaggtaa

SEQ ID NO: 48792 - DNA, 44 bp, Homo sapiens
  chr2:223177610-223177654
  hyper
tatccgcataatccgtcctcaaatcccctcgttgtcactgcatt

SEQ ID NO: 48793 - DNA, 41 bp, Homo sapiens; identical to SEQ ID NO: 27919
  chr2:223185352-223185393
  hyper

SEQ ID NO: 48794 - DNA, 133 bp, Homo sapiens; identical to SEQ ID NO: 27920
  chr2:223536428-223536561
  hyper

SEQ ID NO: 48795 - DNA, 45 bp, Homo sapiens; identical to SEQ ID NO: 27921
  chr2:225906010-225906055
  hyper

SEQ ID NO: 48796 - DNA, 375 bp, Homo sapiens; identical to SEQ ID NO: 6682
  chr2:225906404-225906779
  hyper

SEQ ID NO: 48797 - DNA, 572 bp, Homo sapiens; identical to SEQ ID NO: 27923
  chr2:225906790-225907362
  hyper

SEQ ID NO: 48798 - DNA, 128 bp, Homo sapiens; identical to SEQ ID NO: 27924
  chr2:225907439-225907567
  hyper

SEQ ID NO: 48799 - DNA, 174 bp, Homo sapiens; identical to SEQ ID NO: 27925
  chr2:226896159-226896333
  hyper

SEQ ID NO: 48800 - DNA, 85 bp, Homo sapiens; identical to SEQ ID NO: 27926
  chr2:227663424-227663509
  hyper

SEQ ID NO: 48801 - DNA, 3 bp, Homo sapiens
  chr2:228029415-228029418
  hyper
cgc

SEQ ID NO: 48802 - DNA, 2 bp, Homo sapiens
  chr2:228582794-228582796
  hyper
ca

SEQ ID NO: 48803 - DNA, 15 bp, Homo sapiens
  chr2:228582819-228582834
  hyper
cgtccagacctttca

SEQ ID NO: 48804 - DNA, 61 bp, Homo sapiens
  chr2:228736154-228736215
  hyper
tagctcctctgaggtcgcccttagtgaggacacgaggtgccctcacctctttcactctaga

SEQ ID NO: 48805 - DNA, 15 bp, Homo sapiens
  chr2:229046730-229046745
  hyper
ccctgaagttgttca

SEQ ID NO: 48806 - DNA, 593 bp, Homo sapiens; identical to SEQ ID NO: 27933
  chr2:230578129-230578722
  hyper

SEQ ID NO: 48807 - DNA, 34 bp, Homo sapiens; identical to SEQ ID NO: 27934
  chr2:231191860-231191894
  hyper

SEQ ID NO: 48808 - DNA, 87 bp, Homo sapiens; identical to SEQ ID NO: 27935
  chr2:231693406-231693493
  hyper

SEQ ID NO: 48809 - DNA, 46 bp, Homo sapiens; identical to SEQ ID NO: 27936
  chr2:231714930-231714976
  hyper

SEQ ID NO: 48810 - DNA, 132 bp, Homo sapiens; identical to SEQ ID NO: 27937
  chr2:231903040-231903172
  hyper

SEQ ID NO: 48811 - DNA, 30 bp, Homo sapiens
  chr2:232394940-232394970
  hyper
ccccggtggcggggacggggggcaccccga

SEQ ID NO: 48812 - DNA, 358 bp, Homo sapiens
  chr2:232395061-232395419
  hyper
gcacctaccatgcggcccgcggcccgcgagaccccggcttccaccctccgagcgacggacacagacgcggcgcgggagccagtggactgactgacagcggccccagcccgcgccccgacgccccgcctgtccggccgggaacgccgccagggggcagtgcagtccccgcagcccgggcggcgccccctcccgcactggcggaggacgcggccgttggaggcgacacctccacaagcagcgtggaggcgacacctccacaagcagcgttatctgacggaaccctcacaacaacccgttttacagatgagaaaactgagcctcagagagccgcagaggaggagcccgagagacctggggc

SEQ ID NO: 48813 - DNA, 41 bp, Homo sapiens; identical to SEQ ID NO: 27940
  chr2:232526765-232526806
  hyper

SEQ ID NO: 48814 - DNA, 32 bp, Homo sapiens; identical to SEQ ID NO: 27941
  chr2:232527207-232527239
  hyper

SEQ ID NO: 48815 - DNA, 174 bp, Homo sapiens
  chr2:232791530-232791704
  hyper
cgcagccctgcttgtcgccaaactcttccctgggcacctgacagccgcgggatggcattgcagctccgcctttcacctgccggtcagggcgggagcgcagaccacagcgacgtcgttaggttggggaggcagaggatggggttggaggactggggtgggaggcgcagggagagc

SEQ ID NO: 48816 - DNA, 17 bp, Homo sapiens
  chr2:232792012-232792029
  hyper
cccgctccagtatcctg

SEQ ID NO: 48817 - DNA, 30 bp, Homo sapiens; identical to SEQ ID NO: 6692
  chr2:233283450-233283480
  hyper

SEQ ID NO: 48818 - DNA, 63 bp, Homo sapiens; identical to SEQ ID NO: 27944
  chr2:233283709-233283772
  hyper

SEQ ID NO: 48819 - DNA, 30 bp, Homo sapiens; identical to SEQ ID NO: 27945
  chr2:233285064-233285094
  hyper

SEQ ID NO: 48820 - DNA, 66 bp, Homo sapiens; identical to SEQ ID NO: 6694
  chr2:233285777-233285843
  hyper

SEQ ID NO: 48821 - DNA, 319 bp, Homo sapiens; identical to SEQ ID NO: 27949
  chr2:233351415-233351734
  hyper

SEQ ID NO: 48822 - DNA, 218 bp, Homo sapiens; identical to SEQ ID NO: 27950
  chr2:233351789-233352007
  hyper

SEQ ID NO: 48823 - DNA, 72 bp, Homo sapiens
  chr2:233352853-233352925
  hyper
tggaaaggggctggagctggagatgaggagccgaggactcctccgaagggctgggggcggtgtcagtagtgc

SEQ ID NO: 48824 - DNA, 38 bp, Homo sapiens; identical to SEQ ID NO: 27954
  chr2:233367784-233367822
  hyper

SEQ ID NO: 48825 - DNA, 152 bp, Homo sapiens; identical to SEQ ID NO: 27955
  chr2:233368141-233368293
  hyper

SEQ ID NO: 48826 - DNA, 451 bp, Homo sapiens; identical to SEQ ID NO: 27956
  chr2:233388723-233389174
  hyper

SEQ ID NO: 48827 - DNA, 182 bp, Homo sapiens; identical to SEQ ID NO: 27957
  chr2:233498345-233498527
  hyper

SEQ ID NO: 48828 - DNA, 139 bp, Homo sapiens
  chr2:233498571-233498710
  hyper
cggagctgagcgcccagctgagccggcggctggacatcaacgagggcgctgcgcggccccggcgctgcagggtcttcaacccctacacggagttcccggagttcagccgccgcctcatcaaggacctggagagcatgtt

SEQ ID NO: 48829 - DNA, 621 bp, Homo sapiens; identical to SEQ ID NO: 27960
  chr2:233740929-233741550
  hyper

SEQ ID NO: 48830 - DNA, 67 bp, Homo sapiens; identical to SEQ ID NO: 27961
  chr2:234475179-234475246
  hyper

SEQ ID NO: 48831 - DNA, 30 bp, Homo sapiens; identical to SEQ ID NO: 27962
  chr2:234475473-234475503
  hyper

SEQ ID NO: 48832 - DNA, 117 bp, Homo sapiens; identical to SEQ ID NO: 6710
  chr2:235404416-235404533
  hyper

SEQ ID NO: 48833 - DNA, 273 bp, Homo sapiens; identical to SEQ ID NO: 27965
  chr2:235404629-235404902
  hyper

SEQ ID NO: 48834 - DNA, 30 bp, Homo sapiens; identical to SEQ ID NO: 27966
  chr2:235860068-235860098
  hyper

SEQ ID NO: 48835 - DNA, 22 bp, Homo sapiens
  chr2:236402749-236402771
  hyper
ccgcggcttgcaaggcgcctgc

SEQ ID NO: 48836 - DNA, 119 bp, Homo sapiens
  chr2:236403151-236403270
  hyper
cccgcgggccagccccgcgcctgctccgcccgcgcctttcttctcgcgcctcctccgcccgccgccggcgggcccggctccccgggggctgcggcgccccgggctcggcggcccgcggg

SEQ ID NO: 48837 - DNA, 30 bp, Homo sapiens; identical to SEQ ID NO: 27969
  chr2:236403854-236403884
  hyper

SEQ ID NO: 48838 - DNA, 89 bp, Homo sapiens; identical to SEQ ID NO: 27970
  chr2:236577966-236578055
  hyper

SEQ ID NO: 48839 - DNA, 44 bp, Homo sapiens; identical to SEQ ID NO: 27971
  chr2:236579046-236579090
  hyper

SEQ ID NO: 48840 - DNA, 163 bp, Homo sapiens; identical to SEQ ID NO: 27972
  chr2:237068390-237068553
  hyper

SEQ ID NO: 48841 - DNA, 21 bp, Homo sapiens
  chr2:237068626-237068647
  hyper
cgcagccgggcctcctgcctc

SEQ ID NO: 48842 - DNA, 16 bp, Homo sapiens
  chr2:237068925-237068941
  hyper
gcggtggaggctaggg

SEQ ID NO: 48843 - DNA, 298 bp, Homo sapiens; identical to SEQ ID NO: 17922
  chr2:237073056-237073354
  hyper

SEQ ID NO: 48844 - DNA, 82 bp, Homo sapiens; identical to SEQ ID NO: 17923
  chr2:237073414-237073496
  hyper

SEQ ID NO: 48845 - DNA, 28 bp, Homo sapiens
  chr2:237073564-237073592
  hyper
cgcttgcctcctccgggcacccacctcc

SEQ ID NO: 48846 - DNA, 55 bp, Homo sapiens; identical to SEQ ID NO: 27979
  chr2:237075130-237075185
  hyper

SEQ ID NO: 48847 - DNA, 47 bp, Homo sapiens; identical to SEQ ID NO: 27980
  chr2:237076012-237076059
  hyper

SEQ ID NO: 48848 - DNA, 34 bp, Homo sapiens; identical to SEQ ID NO: 6720
  chr2:237076602-237076636
  hyper

SEQ ID NO: 48849 - DNA, 69 bp, Homo sapiens; identical to SEQ ID NO: 6721
  chr2:237076656-237076725
  hyper

SEQ ID NO: 48850 - DNA, 171 bp, Homo sapiens; identical to SEQ ID NO: 27983
  chr2:237077033-237077204
  hyper

SEQ ID NO: 48851 - DNA, 167 bp, Homo sapiens
  chr2:237078348-237078515
  hyper
tggggagttggcccgtgttggacgtgtgttatgtatcacttacaagcacatttaattgggagataaagataaatcgatctttatgaatttatcgacccgattctttgaagctcttttttcgcgttcttcctctttctctcgctctagccccaaggccccccggggga

SEQ ID NO: 48852 - DNA, 30 bp, Homo sapiens; identical to SEQ ID NO: 27985
  chr2:237079095-237079125
  hyper

SEQ ID NO: 48853 - DNA, 91 bp, Homo sapiens
  chr2:237080173-237080264
  hyper
cagcccagcccaatccggaggaggaagcaccgcgaatggcgcgcttcgctgccgccgccagagtcgaggtaacgggtggtcgtggagaggg

SEQ ID NO: 48854 - DNA, 159 bp, Homo sapiens
  chr2:237081182-237081341
  hyper
cagaaacaaaacaaccgcaaaatagaaatgtgaaggggaggggcttttcttcttcttcatttcctcctgggagttgaaaaatgttatccgcaggcctgaaggctgggaaacgtgacccttcacacctgcgccgccctctccactccagcgacgaggaac

SEQ ID NO: 48855 - DNA, 38 bp, Homo sapiens
  chr2:237086468-237086506
  hyper
gccctggagagtcctccctctgtcgtctgctctcagca

SEQ ID NO: 48856 - DNA, 340 bp, Homo sapiens; identical to SEQ ID NO: 27992
  chr2:237086712-237087052
  hyper

SEQ ID NO: 48857 - DNA, 30 bp, Homo sapiens; identical to SEQ ID NO: 27993
  chr2:237087461-237087491
  hyper

SEQ ID NO: 48858 - DNA, 200 bp, Homo sapiens; identical to SEQ ID NO: 27994
  chr2:237088039-237088239
  hyper

SEQ ID NO: 48859 - DNA, 286 bp, Homo sapiens
  chr2:237145136-237145422
  hyper
tgtacgccttaaacacgtgccgcttgctgaatgtcaatcacacctcggtaaagctgcttttaaagagcattgctagaaccttgtttccttcctctttctcaagactggcgggggtccacgtggccccctgatcccccctctgaactcaaatgacctttcttaggtgggtcccctgcctgagtccctgaatgcccagcagtcccgcctgcctgcgttgctgcccctgctgggcaggacatccaggcaactttgacagtcggtggagaagcagcaagggcgatgcggt

SEQ ID NO: 48860 - DNA, 26 bp, Homo sapiens
  chr2:237145723-237145749
  hyper
ggcctccctagaggccggcacagctc

SEQ ID NO: 48861 - DNA, 38 bp, Homo sapiens; identical to SEQ ID NO: 27998
  chr2:237145963-237146001
  hyper

SEQ ID NO: 48862 - DNA, 291 bp, Homo sapiens; identical to SEQ ID NO: 27999
  chr2:237146260-237146551
  hyper

SEQ ID NO: 48863 - DNA, 146 bp, Homo sapiens
  chr2:237416070-237416216
  hyper
cgggcaggaaaaggtgaggccgggtttgcttcgcaggcacggagcgcgcaggcgcagagaggtgtttcactccttcccgtcgcgacccagagactcgcgaacctcacttcggccactcaggtgggcgcgacgcggccctagcaacg

SEQ ID NO: 48864 - DNA, 157 bp, Homo sapiens
  chr2:238395134-238395291
  hyper
tgagcacccaaaggccggccctagagtccaggagaagagcgcagcggcgcggagctcccaggcgttccccgcagcgcgtcctcggtcctggaaccaccgcgccgcgcgtcctggcttccacatctgccccatttgcccgcggatcttgactttttct

SEQ ID NO: 48865 - DNA, 99 bp, Homo sapiens
  chr2:238395356-238395455
  hyper
cctgatgcctggcagaatcgaaggggtgagggtacgctctctgcagcagaaagccctgggcttaaagtcctatttattatttggcgttgccacttactg

SEQ ID NO: 48866 - DNA, 41 bp, Homo sapiens; identical to SEQ ID NO: 28002
  chr2:238395845-238395886
  hyper

SEQ ID NO: 48867 - DNA, 505 bp, Homo sapiens; identical to SEQ ID NO: 28004
  chr2:238536208-238536713
  hyper

SEQ ID NO: 48868 - DNA, 43 bp, Homo sapiens; identical to SEQ ID NO: 2193
  chr2:238864588-238864631
  hyper

SEQ ID NO: 48869 - DNA, 386 bp, Homo sapiens
  chr2:238864913-238865299
  hyper
aagccgcagcgcccaggaatcccctgggcgcctccgcgtcccccgcgggctgtcccggcaggcaggcagcccaccccagggctcccctcgtggaaggacacccctgctgaccctggccctggttctggcggtgtctccactcagccctcggagggacgcccacctcccgcggagctgggggactgtggcttcctcctgcgcggggaggtcggtgggcgccgtggacccgtcccgcccctgtctgaggagccgagtcggccacagaggggcagcagactagggagggctgatgggccgtgcacttagctccctccgggctgctggccggggcccttgaacggacagatgccaactggcagatgagggggctgcgtccacccccaccc

SEQ ID NO: 48870 - DNA, 106 bp, Homo sapiens; identical to SEQ ID NO: 28007
  chr2:239072183-239072289
  hyper

SEQ ID NO: 48871 - DNA, 156 bp, Homo sapiens
  chr2:239140249-239140405
  hyper
ccgttggaggccgttgctcaccgttgggcaagtgctttaagaagcacgaggatgtcgagtgtcaaatgcggcaaagggctcagagctcgccgccaaggggcgtggcctccgggccgcggcggcctctgggagttgtagtcccgcctcaacttgtgg

SEQ ID NO: 48872 - DNA, 43 bp, Homo sapiens
  chr2:239755121-239755164
  hyper
ggagggcggtcaggccgggtggggctgggtgcggtggctctgc

SEQ ID NO: 48873 - DNA, 30 bp, Homo sapiens; identical to SEQ ID NO: 28010
  chr2:239757311-239757341
  hyper

SEQ ID NO: 48874 - DNA, 32 bp, Homo sapiens
  chr2:239757604-239757636
  hyper
gaccggtgactcccccggcgggttctgaagat

SEQ ID NO: 48875 - DNA, 163 bp, Homo sapiens; identical to SEQ ID NO: 28012
  chr2:239757898-239758061
  hyper

SEQ ID NO: 48876 - DNA, 201 bp, Homo sapiens
  chr2:239758144-239758345
  hyper
ctgacctaggaactgggagccctgagtcccaaccttgaccctggagtacccgggaggggccccgcccatccagccccgcagggatgggcgaggggtccaggctgggaaacgggtctgggggacagggaggctgtgcgcgccgggccctgcgcgaggagaaggctcgggggacacagctgccaggagcactccaagttctgg

SEQ ID NO: 48877 - DNA, 61 bp, Homo sapiens
  chr2:239758394-239758455
  hyper
agacaccttccaagtccctttagacaagctcgagccacggaggcgccgtccttaggctctg

SEQ ID NO: 48878 - DNA, 138 bp, Homo sapiens; identical to SEQ ID NO: 28014
  chr2:240874074-240874212
  hyper

SEQ ID NO: 48879 - DNA, 26 bp, Homo sapiens
  chr2:241393141-241393167
  hyper
agacccctgcgcacccgctccggctg

SEQ ID NO: 48880 - DNA, 2 bp, Homo sapiens
  chr2:241393198-241393200
  hyper
cg

SEQ ID NO: 48881 - DNA, 53 bp, Homo sapiens
  chr2:241758324-241758377
  hyper
cttggaaagggctgacgcttggggaaggggtcctccagtctctgggggaaagt

SEQ ID NO: 48882 - DNA, 189 bp, Homo sapiens
  chr2:241758819-241759008
  hyper
ccaggtgctgggtctttctggaagggagctggggtctctggcgtgggagggggtgatgggcaggccggccgtgcaacgaagcgggtggccaggccccaacgccgcagcccccgccccgcccgcctgttttgctcccggctccagcatccgccctcccccaccccgggaaccggagcagctgcccgcgcc

SEQ ID NO: 48883 - DNA, 555 bp, Homo sapiens
  chr2:241759042-241759597
  hyper
cgctgcagccgcgcaccctcccaggtgcggcgtcagcgtcctcagccccgctcaccatccctcccctcccccgccgtctgggcgcagcccctcccgcagccccgccggtggctcctctccagggaagcggaatagccggggaagggcgggggtatcccgatcccgccggccgggcgagccctcccgagggcgacccccgcccgcctaagccgagggtcccgctgcagccgagatcgcggcaaagggaccttttccagcggcacctgaagggcggacacccctgaatttcccccattgttctctgcggagatggaggaaggtctggaagtgaaggggcctcgcagtgcctgcgctttgggcggcaacaagggcgccgggccggagctccccgccctgggcgcagtgggtgcaggtgcgggctgcgggcgcgggctgccgggcgcaggtgcggggcgaggggcgcgggcgcgggaggccgggcgggcggcggccttacctctccggcgtcactggcggcggccccgcatgggcactggcatgggcgcgggctctcga

SEQ ID NO: 48884 - DNA, 169 bp, Homo sapiens
  chr2:241759694-241759863
  hyper
ccgaggcgctggttggctgcgcgcggcgtccgagctccagtcgccagctggtttgtcgcgcggggagagggacgggcgacgcggccgccgcggggatggggctggggacggagggggccggggccgggctgtgacgtcaccgctgacaccgcggcgggccccgcggagg

SEQ ID NO: 48885 - DNA, 270 bp, Homo sapiens
  chr2:241760224-241760494
  hyper
ccggatgatgcaacccgcccgcggacccgccgcctcgcctctaccgcggctcgtggggaccccccgccctcctctcgccccacctctccaggcccccattgtcctcaccccagcctgtccagtttaacttccttggacccccaagtcacacgccgctcgggggccaccccggcaaaccccagcctgcgtcacccgcccccagccgccttcctagttccaggggctgactggtatctctgtgcgcgccaccgtcctccctccaccgtccca

SEQ ID NO: 48886 - DNA, 273 bp, Homo sapiens
  chr2:241760523-241760796
  hyper
gcagctcgcccatgggaacctccccgcactgcggtgcgggggtgcacggatttcgggccaccctgaaccccggggctgggtcccctccagcccagcccctgccatcgagcccctgccatgggcatcctggcgtcgcctggctaagcctccctggcgcccagcaggggcctgcgctgccctagcggcctcgccgttaaccatttcatccacactcctgggagagccggcttcacctcagtcccgacagctgcgtgcgagcgccttgcaggtggc

SEQ ID NO: 48887 - DNA, 42 bp, Homo sapiens
  chr2:241771123-241771165
  hyper
gggatgcgcggatggcgggggtgccgaggtgggcaaagggat

SEQ ID NO: 48888 - DNA, 100 bp, Homo sapiens
  chr2:241771257-241771357
  hyper
tggaaggtcagggcctggaggggagctgggtccaggcagggaactcacagcagagacgccccgagggtggggtcgggccaagagccgcagccaggggatg

SEQ ID NO: 48889 - DNA, 137 bp, Homo sapiens; identical to SEQ ID NO: 28021
  chr2:241771622-241771759
  hyper

SEQ ID NO: 48890 - DNA, 53 bp, Homo sapiens; identical to SEQ ID NO: 28022
  chr2:241772052-241772105
  hyper

SEQ ID NO: 48891 - DNA, 43 bp, Homo sapiens; identical to SEQ ID NO: 28023
  chr2:242550007-242550050
  hyper

SEQ ID NO: 48892 - DNA, 310 bp, Homo sapiens
  chr3:238226-238536
  hyper
ggagggggtggggggcgtttcttttaaatgtcgcttttgcagataaacgagcagggatcctacctcttttgaccggagatgttgaaaagcacgaccaaagtttttggcttggtctcttgctttccacaacgagataaagtctgaagcctgtaactctccctgtcccgcgggagcgtgcaaagggagggaagataagcggcgtgggtgaggggtggcggcgcagaacccaggaagggagcagaggcgagagccagcctccggcaggagggcgtagaccccggtgccagccagaacggctccagccttcccg

SEQ ID NO: 48893 - DNA, 32 bp, Homo sapiens
  chr3:239094-239126
  hyper
cgctgctctctgaggaggattccagacccccc

SEQ ID NO: 48894 - DNA, 464 bp, Homo sapiens
  chr3:239158-239622
  hyper
cgaggtctagctggtctgggggtcagtcccggcctctgtctcccaccgcgcccctcgctcccctggacaccgcctggtgtgtggggctcagacccccccagtccactgcccctgtgtggctcctcctctcaggagaggattctagatcccagcccggggggggttccgaaaatgccgccagcctggagcggggaatccatggaccgtggggttgtggggttggggagcacgaaaacccagagaggggctagagctccacctccccagaccgccgaggggcgagagggcgcgccgggggccgtggttgccatggctcctggtagcggagcccggggggctggagatgccggtcgcggatggtcccttcttcctctttgtgcctctctctttctctcgctttttttttttttttggagtgtgagtgtgcgtggggaggcagcacggagaaagtgattaatttgggg

SEQ ID NO: 48895 - DNA, 39 bp, Homo sapiens
  chr3:240223-240262
  hyper
ctttctcaataatacggagattatcgataccctctatac

SEQ ID NO: 48896 - DNA, 32 bp, Homo sapiens; identical to SEQ ID NO: 6753
  chr3:2139944-2139976
  hyper

SEQ ID NO: 48897 - DNA, 37 bp, Homo sapiens; identical to SEQ ID NO: 17956
  chr3:2140398-2140435
  hyper

SEQ ID NO: 48898 - DNA, 169 bp, Homo sapiens; identical to SEQ ID NO: 28030
  chr3:2140827-2140996
  hyper

SEQ ID NO: 48899 - DNA, 288 bp, Homo sapiens
  chr3:3840758-3841046
  hyper
cgccgcaaagagatggggccccattgtgcctagctggcctcctagcacggacgtgtattttcttttggtctgtcttttgctaaaaaccggcagtgcgcttcgcctccctgcccagccgcagcctgccgtcccctagacaaaaagcggcgaccgcggcccggccacccgagccccgccgcgctgcgcctttgttgggcggtccacagatggtgcccagcacggggccgcgccgagggcgggggcgggaggccgcgaagagggtcgggcgggaggggaggagacggcgga

SEQ ID NO: 48900 - DNA, 430 bp, Homo sapiens; identical to SEQ ID NO: 28032
  chr3:3841494-3841924
  hyper

SEQ ID NO: 48901 - DNA, 422 bp, Homo sapiens; identical to SEQ ID NO: 6759
  chr3:3842186-3842608
  hyper

SEQ ID NO: 48902 - DNA, 262 bp, Homo sapiens; identical to SEQ ID NO: 28034
  chr3:4910288-4910550
  hyper

SEQ ID NO: 48903 - DNA, 104 bp, Homo sapiens; identical to SEQ ID NO: 28035
  chr3:5018985-5019089
  hyper

SEQ ID NO: 48904 - DNA, 161 bp, Homo sapiens
  chr3:5137799-5137960
  hyper
gaagcccctgcagtgcgccccgcgaccaccagctggaaccaaaaggcggcgcgcaggcgcggagcccacggggagcccaggctggggcgcgtgtcagctccgcctgacctgccaccttccctaggcagcggggggcgggggtggggggtggtgcggggagt

SEQ ID NO: 48905 - DNA, 273 bp, Homo sapiens
  chr3:6902353-6902626
  hyper
ggtttctctgcccctgcctcgctttctcccagagctaagagcctaggctccggacctagggtttgggagcagtcagcacgacgtcctcgccccatcccgcggctgatgacacccgtgcccagaacgtgggtgtgggtagggaggcttccacagtgagttagggtcgagagctaggctctcgcttgctccccgcaatccctagattccctggggaccacgaaactcccattccgaggaaacctccccccattccccagccgcccacccgtttcc

SEQ ID NO: 48906 - DNA, 130 bp, Homo sapiens; identical to SEQ ID NO: 28038
  chr3:6902969-6903099
  hyper

SEQ ID NO: 48907 - DNA, 86 bp, Homo sapiens; identical to SEQ ID NO: 28039
  chr3:6903624-6903710
  hyper

SEQ ID NO: 48908 - DNA, 65 bp, Homo sapiens; identical to SEQ ID NO: 28040
  chr3:6904142-6904207
  hyper

SEQ ID NO: 48909 - DNA, 318 bp, Homo sapiens; identical to SEQ ID NO: 28041
  chr3:8809397-8809715
  hyper

SEQ ID NO: 48910 - DNA, 63 bp, Homo sapiens
  chr3:8810220-8810283
  hyper
ggccacaagcccagagcccccagcgtgccagttcctcgggatgttcagcggcttccactgggg

SEQ ID NO: 48911 - DNA, 97 bp, Homo sapiens; identical to SEQ ID NO: 28043
  chr3:8810791-8810888
  hyper

SEQ ID NO: 48912 - DNA, 302 bp, Homo sapiens; identical to SEQ ID NO: 28044
  chr3:8811111-8811413
  hyper

SEQ ID NO: 48913 - DNA, 135 bp, Homo sapiens; identical to SEQ ID NO: 28045
  chr3:9177995-9178130
  hyper

SEQ ID NO: 48914 - DNA, 360 bp, Homo sapiens; identical to SEQ ID NO: 28046
  chr3:9541700-9542060
  hyper

SEQ ID NO: 48915 - DNA, 33 bp, Homo sapiens; identical to SEQ ID NO: 28047
  chr3:9542307-9542340
  hyper

SEQ ID NO: 48916 - DNA, 21 bp, Homo sapiens
  chr3:9594015-9594036
  hyper
gaaaagcgaaaagcaggtgat

SEQ ID NO: 48917 - DNA, 26 bp, Homo sapiens
  chr3:9594382-9594408
  hyper
ggcggcggcggcggctggcgggggcc

SEQ ID NO: 48918 - DNA, 83 bp, Homo sapiens; identical to SEQ ID NO: 28051
  chr3:9595598-9595681
  hyper

SEQ ID NO: 48919 - DNA, 125 bp, Homo sapiens; identical to SEQ ID NO: 28052
  chr3:9745353-9745478
  hyper

SEQ ID NO: 48920 - DNA, 30 bp, Homo sapiens; identical to SEQ ID NO: 28053
  chr3:9745793-9745823
  hyper

SEQ ID NO: 48921 - DNA, 107 bp, Homo sapiens
  chr3:9904554-9904661
  hyper
gccgatggccattaaagccccgccccccgcggctcaccgccgcctggccccgtccccgaggccagaaaagaggagacccgaggccgtcagaccgcctgtcaagggct

SEQ ID NO: 48922 - DNA, 237 bp, Homo sapiens
  chr3:9956827-9957064
  hyper
gcgggggcggagaggcgagcaccctacggtatcccgagagggtggggagaagagggctgagcagtccctcagccgcccagccttcatctgttgcttcccgccaccaggcccgggcccagcgcggccagtgctcctcctgcacgcggcggactcggaggcgcagcggcgcctggtgggagcgctggctgaactgctacgggcagcgctgggcggcgggcgcgacgtgatcgtggacct

SEQ ID NO: 48923 - DNA, 309 bp, Homo sapiens; identical to SEQ ID NO: 17975
  chr3:9957142-9957451
  hyper

SEQ ID NO: 48924 - DNA, 25 bp, Homo sapiens
  chr3:9993908-9993933
  hyper
ccgtgcaggcctggtcgcctgcgcc

SEQ ID NO: 48925 - DNA, 64 bp, Homo sapiens; identical to SEQ ID NO: 28057
  chr3:9993964-9994028
  hyper

SEQ ID NO: 48926 - DNA, 280 bp, Homo sapiens; identical to SEQ ID NO: 28058
  chr3:10206828-10207108
  hyper

SEQ ID NO: 48927 - DNA, 32 bp, Homo sapiens; identical to SEQ ID NO: 28059
  chr3:10547210-10547242
  hyper

SEQ ID NO: 48928 - DNA, 694 bp, Homo sapiens; identical to SEQ ID NO: 28060
  chr3:10749237-10749931
  hyper

SEQ ID NO: 48929 - DNA, 92 bp, Homo sapiens; identical to SEQ ID NO: 28061
  chr3:10857625-10857717
  hyper

SEQ ID NO: 48930 - DNA, 40 bp, Homo sapiens; identical to SEQ ID NO: 28062
  chr3:10858369-10858409
  hyper

SEQ ID NO: 48931 - DNA, 62 bp, Homo sapiens; identical to SEQ ID NO: 28063
  chr3:11034439-11034501
  hyper

SEQ ID NO: 48932 - DNA, 5 bp, Homo sapiens
  chr3:11034502-11034507
  hyper
ggagc

SEQ ID NO: 48933 - DNA, 354 bp, Homo sapiens
  chr3:11034716-11035070
  hyper
ggggggcggacacctcgagattcaagcccccgcgccgcaccttccctgagccacatgaaggagcagaggcgccgctcggaccccgacgtgcgcccaggccatccgtcccctgggacactcgggaggcaggagggctggaacagaggcgagagttgcatgccccttccctcccgcggtgccccactggccccgcaagttggcactggattctgctggagccgtcgaagctccctattcattccccagggcatggaggggacgcggagtgaatgacacgagcagcgttggggggccgtgcgccactttcccaatcctggggtcagctgagccgagttagagctatgcccctcattt

SEQ ID NO: 48934 - DNA, 23 bp, Homo sapiens
  chr3:11035330-11035353
  hyper
ttttggtctctgcgtgtactccc

SEQ ID NO: 48935 - DNA, 52 bp, Homo sapiens; identical to SEQ ID NO: 28066
  chr3:11035382-11035434
  hyper

SEQ ID NO: 48936 - DNA, 84 bp, Homo sapiens; identical to SEQ ID NO: 28067
  chr3:11196531-11196615
  hyper

SEQ ID NO: 48937 - DNA, 365 bp, Homo sapiens; identical to SEQ ID NO: 28068
  chr3:12045988-12046353
  hyper

SEQ ID NO: 48938 - DNA, 28 bp, Homo sapiens
  chr3:12046377-12046405
  hyper
cgccaggaaggccaaggtgctgctggtg

SEQ ID NO: 48939 - DNA, 301 bp, Homo sapiens; identical to SEQ ID NO: 28070
  chr3:12329724-12330025
  hyper

SEQ ID NO: 48940 - DNA, 79 bp, Homo sapiens; identical to SEQ ID NO: 28071
  chr3:12838044-12838123
  hyper

SEQ ID NO: 48941 - DNA, 7 bp, Homo sapiens
  chr3:12917599-12917606
  hyper
cagggcc

SEQ ID NO: 48942 - DNA, 38 bp, Homo sapiens
  chr3:12917655-12917693
  hyper
gtctggagggaggtggccccggccgccctcagaaatca

SEQ ID NO: 48943 - DNA, 55 bp, Homo sapiens
  chr3:13323439-13323494
  hyper
gcccgaaggtccacacggtgaggctgctccgggtttcgacaccgacactcatggg

SEQ ID NO: 48944 - DNA, 56 bp, Homo sapiens; identical to SEQ ID NO: 17987
  chr3:13323973-13324029
  hyper

SEQ ID NO: 48945 - DNA, 114 bp, Homo sapiens; identical to SEQ ID NO: 2205
  chr3:13324234-13324348
  hyper

SEQ ID NO: 48946 - DNA, 241 bp, Homo sapiens
  chr3:13324433-13324674
  hyper
cctgcaggtactcggccgcctggccggggggctcggcggcgctggccatggccccccgcccggaggccggccgcgcctcaggcgagcgggcggcggggcggcggcggcgcggccatggctgcgcggcggggacggcggctcggcgcggcgcggggctgccgcggccccgcctcggctcccgcctccgccggcgccgcccccggggcccccgcgcctcctgctccccgcgccgccgcgctcc

SEQ ID NO: 48947 - DNA, 107 bp, Homo sapiens; identical to SEQ ID NO: 17991
  chr3:13324740-13324847
  hyper

SEQ ID NO: 48948 - DNA, 78 bp, Homo sapiens; identical to SEQ ID NO: 28078
  chr3:13590973-13591051
  hyper

SEQ ID NO: 48949 - DNA, 125 bp, Homo sapiens; identical to SEQ ID NO: 28079
  chr3:13696641-13696766
  hyper

SEQ ID NO: 48950 - DNA, 1064 bp, Homo sapiens; identical to SEQ ID NO: 28080
  chr3:13919665-13920729
  hyper

SEQ ID NO: 48951 - DNA, 427 bp, Homo sapiens
  chr3:13920980-13921407
  hyper
ctggagcgtccctaccggctgtctctggtcctgggggattccagactcagacgtcctcaggatggccagtccccctgcctatatctcctggggtgtcctgcggggggcctttgtgcgtccaccgctcccacaccgcacccacccggcctctcagagaagctgtggaagttggccggcagaggctcgcaggcggcacacctccctccccgggccgtgccaactttgtcgaaacacgcgcggaaagggcgcaggcagcccttacccgatccggaggtagaccatgcccaggctgagaaagaggtggcccaggcagcgccgcgctttccggttcatagtcccgattggccgccggggccgcgggccgggctgtgctgatcccgcgggccggccccggcggggcaatcaacatagcccgcccgggaggcgc

SEQ ID NO: 48952 - DNA, 321 bp, Homo sapiens
  chr3:13921463-13921784
  hyper
tgagcctcgccaggagcacgggagccacggagcgggaggagggagggaggagcgagcgcggcgtggggcgacgccgggctgcgcgcgagcgaccggtgcaagtgtgcgagacgcggggagtgcgggggcgctgctgcctccagcccccgcccctccctcctttcccccgtccctcccccgccccctcccccgcccgcctccccggagcgcccgcccagcgcccctgcgcccgcgggacagggccgcctgcacaaggcgcgcgctcgcgcctttccatgcgcgctcccgggggccccctccctgctccggggtgcaggtggc

SEQ ID NO: 48953 - DNA, 757 bp, Homo sapiens; identical to SEQ ID NO: 28082
  chr3:14643752-14644509
  hyper

SEQ ID NO: 48954 - DNA, 25 bp, Homo sapiens
  chr3:14851825-14851850
  hyper
aactcgctgagttctcgtccttcga

SEQ ID NO: 48955 - DNA, 30 bp, Homo sapiens; identical to SEQ ID NO: 17998
  chr3:14851897-14851927
  hyper

SEQ ID NO: 48956 - DNA, 35 bp, Homo sapiens; identical to SEQ ID NO: 28084
  chr3:14852170-14852205
  hyper

SEQ ID NO: 48957 - DNA, 113 bp, Homo sapiens
  chr3:14852212-14852325
  hyper
cggagtccgaggcgcgccggggccgggcgggcgccagggggtgcgggccccgcggggcggccgcggagggaggcggtgtgcggagtcgcactgggacccgcggacggactgaa

SEQ ID NO: 48958 - DNA, 236 bp, Homo sapiens
  chr3:16554111-16554347
  hyper
caaaggcagcgacaccggaggtgaagggcaccagccctggcctaggactggggtgcgcgtgcctgacaacggggcttcccgaaatacacaaccacctcctcctcgcccagacccatatccatcctggcgtcccttgagtctagagaagtgggttaagacaagggaagaaaatcccttacagaagaggagatccccgttttcagtgctggggactctcggcacccgcgtccctgtgc

SEQ ID NO: 48959 - DNA, 277 bp, Homo sapiens
  chr3:16554633-16554910
  hyper
agagcctacgacccccaacaggctgctccgaagtgcctctccctacatcgctccaggaatgactcccctacacccgttccccgcaaaaaaaagttggcccaagatccaggcgtcccaaggatcagcccaggtccccatccgacgcgggccagggggtgctgctctggcagctccggagccccggcaaagagcaacctgcagggaggcgccacgcgcggttcccactacccgccagagacccggtccatggggccaaacggaggggcctgtgccggtc

SEQ ID NO: 48960 - DNA, 450 bp, Homo sapiens; identical to SEQ ID NO: 28089
  chr3:16554911-16555361
  hyper

SEQ ID NO: 48961 - DNA, 30 bp, Homo sapiens; identical to SEQ ID NO: 28090
  chr3:16925675-16925705
  hyper

SEQ ID NO: 48962 - DNA, 475 bp, Homo sapiens; identical to SEQ ID NO: 28091
  chr3:18485177-18485652
  hyper

SEQ ID NO: 48963 - DNA, 231 bp, Homo sapiens; identical to SEQ ID NO: 28092
  chr3:18486970-18487201
  hyper

SEQ ID NO: 48964 - DNA, 68 bp, Homo sapiens
  chr3:19189373-19189441
  hyper
tcggggccagtttcccggactaaaagaccctggtgactggggatgggcctcacaactaactcgggctg

SEQ ID NO: 48965 - DNA, 36 bp, Homo sapiens
  chr3:19189470-19189506
  hyper
gcaagtgctccggaagggggccgcctccccgtgggg

SEQ ID NO: 48966 - DNA, 365 bp, Homo sapiens
  chr3:19189778-19190143
  hyper
cccagaccccagagacgtcggtcagggcgcggcgccccgggccactgcgggctctttccgggcgggcgacgtggggggcgaggcaccgcgcggcggcgcctggcgggcactgttgcccgcggagggacggtgggggggtttcagcagctggcgggggtggagggggcgggagagggagcctgcgccgggctgagcctggaggtgcggggcgggctcggggagcgctcttggggctcctcctgccacagccggggcggctggaactctctccctttctccctccatccttccacttcccctgctcggccccgccgtcaggccgggtcccccttccctgccgtcatcaggttccccttctcccttct

SEQ ID NO: 48967 - DNA, 1 bp, Homo sapiens
  chr3:22413664-22413665
  hyper
g

SEQ ID NO: 48968 - DNA, 217 bp, Homo sapiens
  chr3:22413694-22413911
  hyper
ggccccgcaacctcacatctcttctccttggcaccgagaagaggctggggtgtgtggaccgatagtgcgggataccgaaaaggtggtccaaggtctgggcggtgcgaacgcccattccgcgccccccatgcgagccccagcccctcgcgcctggtatcccgcaggggcgcaaccctagctccttgcccggcgccccaacgaactccgccacctgaac

SEQ ID NO: 48969 - DNA, 104 bp, Homo sapiens; identical to SEQ ID NO: 18005
  chr3:22413974-22414078
  hyper

SEQ ID NO: 48970 - DNA, 116 bp, Homo sapiens; identical to SEQ ID NO: 28097
  chr3:24535479-24535595
  hyper

SEQ ID NO: 48971 - DNA, 203 bp, Homo sapiens; identical to SEQ ID NO: 28098
  chr3:24870641-24870844
  hyper

SEQ ID NO: 48972 - DNA, 97 bp, Homo sapiens; identical to SEQ ID NO: 28100
  chr3:24871789-24871886
  hyper

SEQ ID NO: 48973 - DNA, 156 bp, Homo sapiens; identical to SEQ ID NO: 28101
  chr3:24871946-24872102
  hyper

SEQ ID NO: 48974 - DNA, 19 bp, Homo sapiens
  chr3:25469358-25469377
  hyper
ggctggggggcgaggcggt

SEQ ID NO: 48975 - DNA, 52 bp, Homo sapiens
  chr3:25469406-25469458
  hyper
caccgttttccaagctaagccgccgcaaataaaaaggcgtaaagggagagaa

SEQ ID NO: 48976 - DNA, 21 bp, Homo sapiens
  chr3:26664119-26664140
  hyper
agcccccgcctcctctctcca

SEQ ID NO: 48977 - DNA, 877 bp, Homo sapiens
  chr3:26664755-26665632
  hyper
gcagagcgcgggatcatccctctgcccgggtacctaggccgtccctccaaggaacaagtagaggagaactattacaccagttctaagccgtgcctgtctaagcctccctgatcccttttgcgcagaccctgggagagacctcctcctggagagagagagtcgaccctcttcgctcctgttcagccggctgctatacaatagtctgcaaacttttgtgaccccttccctgcgcggtgctcaccccgtgctgtgcaacttgcaggtttagttcttgcccttcccccagcccctcttgccatatgcatctgcccatttctctctgtgtgttcttgccagtcgacttttcactccccgcagctctggctcctgaggcgagggtttgggacccagcagtgctcgtcctgcctctaggagctgggtagggacagagaaggtgaaataagagaggtgggacatggaggatggctgcggccacccctgaagcttcgtccagcgcgatgggagtcagtccatccttgcacacgccacccccaactcggcaatgaaacctttggagtggcttgcggctgtgcgccgtgggaactgcaagtgcagatatgggtgggtgaagtaagtggctcagggagggaaaggctgctcgtgcggtggaggaggaagctgagggtcgggtagatctgcccacggttgagggaaatgaaaaggtactgctaatgtgggcgagcggccagccctgagaggccatctgacgaagaggaaaagggatttgagtccggagggcgctggcctgggtatgtaaatacagatgggggaggggctgggtacctgggggcgcgtggagacaaggaatggagccccggaatgccgggcccttgggtac

SEQ ID NO: 48978 - DNA, 170 bp, Homo sapiens; identical to SEQ ID NO: 28106
  chr3:27410909-27411079
  hyper

SEQ ID NO: 48979 - DNA, 357 bp, Homo sapiens
  chr3:27754121-27754478
  hyper
ctccatacgtgccctcggcgacacacagaggactcccagagttgaagaagggggtggatgtgtgtgtgcgcactcgcccacgtctcgtgttttacttttcatttaagtcgtaataaggagaaattcgatgaccagcaaggctggagtcccatcgtcttgttgggggagaggggggagaagaaaaaggtgcctgtaacttcagactgtccaagatatcgcttagctcctgcgcccggaagaaaatccagcgcaggtcgggttccggcgcgcggaagccctgcgaaccccaaatgtgtgcgctgagccgaggcctctaagcggtaggagagaatctgacctccgacattcttttcaaga

SEQ ID NO: 48980 - DNA, 24 bp, Homo sapiens
  chr3:27754508-27754532
  hyper
gcttactcccgggctggaccttgg

SEQ ID NO: 48981 - DNA, 114 bp, Homo sapiens; identical to SEQ ID NO: 6813
  chr3:27754814-27754928
  hyper

SEQ ID NO: 48982 - DNA, 120 bp, Homo sapiens; identical to SEQ ID NO: 28109
  chr3:27756087-27756207
  hyper

SEQ ID NO: 48983 - DNA, 30 bp, Homo sapiens; identical to SEQ ID NO: 28110
  chr3:27756685-27756715
  hyper

SEQ ID NO: 48984 - DNA, 156 bp, Homo sapiens
  chr3:27762701-27762857
  hyper
gcaccctgcaagagccgccggggcactgacacagagggacaccgcattggagatgcggtgtctacggagatttattgcgcgcggtgaaacactctaagcaccgcgcggaacaactgggttcagctccctcatcccggaccttccccaggaccacac

SEQ ID NO: 48985 - DNA, 679 bp, Homo sapiens; identical to SEQ ID NO: 18015
  chr3:27762887-27763566
  hyper

SEQ ID NO: 48986 - DNA, 567 bp, Homo sapiens
  chr3:27763595-27764162
  hyper
ccgcctcgcaggagagactgccggaaaacttcttggacgctttgtctaagtccaacttctgaggagagggggccgcgctggggaggtggccagcgctcccgccgctgccgcctcgcgcactctccagcgggtagaagtgcgcgccaggcaggttcactgagctcaccaagagctgctcccctaactgcatgctttgcaaagcgcagacggcagctggctgcttcctctcctccggtggccttattataaaggcaggatgggggagccagcgccctcttccgaggggaaggtaacttccccttcctcccgcgccggggctacccacctgccgactcgcgggccgctactgcgcgtactggcgcgccctgaatccagcgtcctttccggaaggaaagcgccgtgagttggaaagcaggaggtggaaactaacccagaagccctctccttttccttcctcgtacctcttgctcctcaggacccccaccctcctcccaggctcacacgctggaagaaggtgacttagatctttgtccccatccacccactagcccgcgcctttctgccctt

SEQ ID NO: 48987 - DNA, 34 bp, Homo sapiens
  chr3:27764423-27764457
  hyper
tctgtaatttcgccggaatttagggggacaaagt

SEQ ID NO: 48988 - DNA, 76 bp, Homo sapiens
  chr3:27765105-27765181
  hyper
tgcgcctctgctctgcggcaaatacagaaggtagaataattagtgaaataatcagtttgatattgaattaaactcc

SEQ ID NO: 48989 - DNA, 15 bp, Homo sapiens
  chr3:27765347-27765362
  hyper
cgggagcgcattttc

SEQ ID NO: 48990 - DNA, 101 bp, Homo sapiens
  chr3:28616731-28616832
  hyper
ttcctcctaccccatcgaccctctgttgccgacctttacgccaaactccggcgcgccgcgagactcgcgtcctcgctgtccccgaggggccccaccccttc

SEQ ID NO: 48991 - DNA, 269 bp, Homo sapiens
  chr3:28617675-28617944
  hyper
cctcggcgagccatgcgtgccacgggcagctgagtagctgccgggcgccgctgccaagtctccactccgcttttgtcttgccctccagtgaatgggaagatggagatggatgttgagggagtttctccgcgcccggagcccatcccccgctcccagggggctggcggagcctgccaggcgccgccacagccgccccagccccagccgccgcctcagcagctggctcaggatgaactgcccggcgagagtgcaggcgctgaggacagcga

SEQ ID NO: 48992 - DNA, 30 bp, Homo sapiens; identical to SEQ ID NO: 28117
  chr3:29322482-29322512
  hyper

SEQ ID NO: 48993 - DNA, 168 bp, Homo sapiens; identical to SEQ ID NO: 28118
  chr3:32433865-32434033
  hyper

SEQ ID NO: 48994 - DNA, 294 bp, Homo sapiens; identical to SEQ ID NO: 28119
  chr3:32443174-32443468
  hyper

SEQ ID NO: 48995 - DNA, 635 bp, Homo sapiens
  chr3:32857718-32858353
  hyper
gagttctttaaaaaacgtaaaaagaaaaaaagaaaaggtgggtaaaaaccgagatctcccgggcagtggatatgtctcggttgagccagggattcagaatgaaatcttttcttttcttttttaaataaacggaagagtcgttctctgctcctcgctcagaaggtttcaaaggtcgtcacactgaagcccgggggcgttcatctccccagcggccgggagaagggaggaggttggagggcggagggagggagcacacaaaagcgggccgtgctgagagggctaatgtttcctgtttgcctggagccccctcccctgcctcccctcccccagccccctcccagcactcgggcggaagtgagtttgctcctttggagattaaaaggattccgaattccgatcagtcccaataaccggcgtactgaagagaagaggaggaggaggaggaggcagaggcggcaaagcagagaaagagggggcgcgcgcgcgcgcacgcaacccgaactgggggagttgtgcaaagccccaggaggccggggcacggcgggagcaaagctcggtaggcgcagcgcggccgaggccacccgcgtccggatcggcgactcctttcagaaagaagatgacgcgggcgcgagccg

SEQ ID NO: 48996 - DNA, 375 bp, Homo sapiens; identical to SEQ ID NO: 18023
  chr3:32859693-32860068
  hyper

SEQ ID NO: 48997 - DNA, 185 bp, Homo sapiens
  chr3:33259719-33259904
  hyper
cccactcatctttcacgtcttcccggaccaagccaaaatatccgagggagttttctaaccatcggcggtgtcctcaggggcacattaatagacgttgagaaactgagggacggcggaaaatcaccccttagcagaggaggttctagggcaccttagaggtgatttcattcgagctttcttggaga

SEQ ID NO: 48998 - DNA, 20 bp, Homo sapiens
  chr3:33260776-33260796
  hyper
gtcctcggcctctacttttc

SEQ ID NO: 48999 - DNA, 48 bp, Homo sapiens; identical to SEQ ID NO: 28124
  chr3:33318917-33318965
  hyper

SEQ ID NO: 49000 - DNA, 28 bp, Homo sapiens
  chr3:35680814-35680842
  hyper
cgtccggctgccgccacctcccgggtgt

SEQ ID NO: 49001 - DNA, 709 bp, Homo sapiens
  chr3:35680872-35681581
  hyper
gagcagctgtggagccacgtgcaacacgcgcgttgccctcagcccgggcggggaccggacgcatccggagctgcggggaggagccgggcgccgcccccggcggcagtgccagccgcgtgggagggcacggaccggcggaggggcagacgacggaggcggccaagctggaggaacgggaccgagggatcgaccgaggctggctggctaggggtgggactggcagagctacggacaggtgggagcagtcagacagcctgagagagggagaccagaacgcaaagagagcgagagcattaagtaggcagggagaggcacacagaaagatagacagcaacactcgcgtgctccctccctccacacgccctcctcttaccgagcgaagcggccaggggcacagagtgggagaggactgtgggcacagaagaccggaagagggacgctgcattgctggtgggacggagggattcggacggacggacagaccagcgcacagactggcagcctgcgagagtggcagctttgagagcagagcgcagcaaagcgagaatcccgcgccgagctgctagtcggacccacagacggtcggactgacagacgtgcagacggacagaagagcagacaggaggcgggggcgcgttcactcccggcggccagccggccagagaaggcggcggtggcaccttctgagcgcgtccggagcagagaccag

SEQ ID NO: 49002 - DNA, 30 bp, Homo sapiens; identical to SEQ ID NO: 28126
  chr3:36421872-36421902
  hyper

SEQ ID NO: 49003 - DNA, 214 bp, Homo sapiens
  chr3:36805601-36805815
  hyper
gcgaatgagtcctcccgcccccgccaaggtggcgcccagaacgggtcggtgccggagcgcacggtactcacccggggcaggccgcgccgggcaggctggggctggccgggccgggggcggcggcggctgcggggctggagtggcggcgggcatggcgcggcggcgggctcggggagagcctggagcagaggtggcagcgcggggacgcggctcg

SEQ ID NO: 49004 - DNA, 267 bp, Homo sapiens
  chr3:36805863-36806130
  hyper
ccgcgccgactctccctcttctctccctcccgccgcccgccgcccgcctgccagccccgcgccgcgcagcgcccggcgacagccaccgggaacgtctccgggggcgcgggacttagcaaccgcgcaccagctgcagccgccctctctgcgccggtcccgccatgcgcgccgctcctggccctggaggccgggcggggccgggctttgaacttgctcccacaccccctgcttctccagtgagcgcccaaaggcggtcccgcctctccc

SEQ ID NO: 49005 - DNA, 44 bp, Homo sapiens; identical to SEQ ID NO: 28129
  chr3:36986351-36986395
  hyper

SEQ ID NO: 49006 - DNA, 57 bp, Homo sapiens; identical to SEQ ID NO: 28130
  chr3:36986663-36986720
  hyper

SEQ ID NO: 49007 - DNA, 438 bp, Homo sapiens; identical to SEQ ID NO: 28131
  chr3:37493692-37494130
  hyper

SEQ ID NO: 49008 - DNA, 85 bp, Homo sapiens
  chr3:38035989-38036074
  hyper
ccgtggaggcggtgccttggctggggcagtcttgggatggccatcgtccacatccctgaatggggcaagccgggaggggttgggt

SEQ ID NO: 49009 - DNA, 83 bp, Homo sapiens; identical to SEQ ID NO: 28133
  chr3:38070745-38070828
  hyper

SEQ ID NO: 49010 - DNA, 474 bp, Homo sapiens; identical to SEQ ID NO: 28134
  chr3:38071100-38071574
  hyper

SEQ ID NO: 49011 - DNA, 59 bp, Homo sapiens
  chr3:38080626-38080685
  hyper
agcgatgacgggatccgagagaaaggcaaggcggaaggggtgaggccggaagccgaagt

SEQ ID NO: 49012 - DNA, 84 bp, Homo sapiens; identical to SEQ ID NO: 18031
  chr3:38080925-38081009
  hyper

SEQ ID NO: 49013 - DNA, 15 bp, Homo sapiens
  chr3:38081271-38081286
  hyper
attctagtggaagga

SEQ ID NO: 49014 - DNA, 108 bp, Homo sapiens
  chr3:38690516-38690624
  hyper
cagagaaagggggtgcgtggcttcctcccccatatccagccctgctcggtcagcccccgcaaaccccgctctctggaaccacattcatggcgcgcctagtcgccgctc

SEQ ID NO: 49015 - DNA, 59 bp, Homo sapiens
  chr3:38690668-38690727
  hyper
gaccctccccgagcctgcgccagggatggccgggaagctggggccgcagctccccctcc

SEQ ID NO: 49016 - DNA, 26 bp, Homo sapiens
  chr3:38691468-38691494
  hyper
cgacccggcgacgcttcaccacagat

SEQ ID NO: 49017 - DNA, 120 bp, Homo sapiens; identical to SEQ ID NO: 28139
  chr3:39851235-39851355
  hyper

SEQ ID NO: 49018 - DNA, 57 bp, Homo sapiens; identical to SEQ ID NO: 28140
  chr3:39851638-39851695
  hyper

SEQ ID NO: 49019 - DNA, 30 bp, Homo sapiens; identical to SEQ ID NO: 28141
  chr3:42305003-42305033
  hyper

SEQ ID NO: 49020 - DNA, 30 bp, Homo sapiens; identical to SEQ ID NO: 28142
  chr3:42305329-42305359
  hyper

SEQ ID NO: 49021 - DNA, 534 bp, Homo sapiens; identical to SEQ ID NO: 28143
  chr3:42543046-42543580
  hyper

SEQ ID NO: 49022 - DNA, 311 bp, Homo sapiens
  chr3:42814258-42814569
  hyper
gggaactgggagatgcggaagtgcacgccgtcgggtcgcatctttcagtgcggtgcgagagggcccagtggcagaggcccagcaaacagcgcttgtcaggcggacctgagttcgagttctgactgtgccatctacgctatgactttggggcaggcgacccaccctctgcgcctcattaacccatgtactgcatggaaaataagcgtctgcctgggttagaagagggctgtgtgtgaagattcaaaggacgaaggggaagagtcctcgctgggcgcccagcacgcggtgagcgcccggccagtggcagcgcg

SEQ ID NO: 49023 - DNA, 515 bp, Homo sapiens; identical to SEQ ID NO: 18036
  chr3:42814603-42815118
  hyper

SEQ ID NO: 49024 - DNA, 42 bp, Homo sapiens
  chr3:42947369-42947411
  hyper
gtctagtgaagtacccgctacctcctatcagcaaatatctgt

SEQ ID NO: 49025 - DNA, 120 bp, Homo sapiens
  chr3:42947552-42947672
  hyper
tccctccccgagcgagaaaggaggaccacagagatgcggcgccctccgccgtcctagagcaaccggagcggcccgagccccggcctcccggatgctggggcctggcgggtgtggagcacg

SEQ ID NO: 49026 - DNA, 36 bp, Homo sapiens; identical to SEQ ID NO: 28146
  chr3:42947925-42947961
  hyper

SEQ ID NO: 49027 - DNA, 498 bp, Homo sapiens; identical to SEQ ID NO: 28147
  chr3:43020926-43021424
  hyper

SEQ ID NO: 49028 - DNA, 330 bp, Homo sapiens; identical to SEQ ID NO: 28148
  chr3:43935852-43936182
  hyper

SEQ ID NO: 49029 - DNA, 27 bp, Homo sapiens
  chr3:44036233-44036260
  hyper
ccggtcctggcctctcggtgttcaggt

SEQ ID NO: 49030 - DNA, 240 bp, Homo sapiens; identical to SEQ ID NO: 18040
  chr3:44036330-44036570
  hyper

SEQ ID NO: 49031 - DNA, 220 bp, Homo sapiens; identical to SEQ ID NO: 18041
  chr3:44036600-44036820
  hyper

SEQ ID NO: 49032 - DNA, 422 bp, Homo sapiens; identical to SEQ ID NO: 18042
  chr3:44037203-44037625
  hyper

SEQ ID NO: 49033 - DNA, 212 bp, Homo sapiens; identical to SEQ ID NO: 18043
  chr3:44037662-44037874
  hyper

SEQ ID NO: 49034 - DNA, 248 bp, Homo sapiens; identical to SEQ ID NO: 18044
  chr3:44038646-44038894
  hyper

SEQ ID NO: 49035 - DNA, 20 bp, Homo sapiens
  chr3:44040006-44040026
  hyper
tgcgagttggattcgcacca

SEQ ID NO: 49036 - DNA, 455 bp, Homo sapiens; identical to SEQ ID NO: 18046
  chr3:44040056-44040511
  hyper

SEQ ID NO: 49037 - DNA, 243 bp, Homo sapiens; identical to SEQ ID NO: 18047
  chr3:44040553-44040796
  hyper

SEQ ID NO: 49038 - DNA, 111 bp, Homo sapiens
  chr3:44041039-44041150
  hyper
tgggatgctgtggggacagtgcgggggacgtgtggggtcttcggatgcgaacgcgagtccgtgcgatgcccaggtcaagtttgcagagagagtctgcggtgtctgtctcct

SEQ ID NO: 49039 - DNA, 94 bp, Homo sapiens
  chr3:44063340-44063434
  hyper
ttgatttttggcccccgctgcagcaagttgggggctggtgaggagtgtagcggtgactgggggcggagtgcggactcgcatccgctgtaccagg

SEQ ID NO: 49040 - DNA, 19 bp, Homo sapiens
  chr3:44063872-44063891
  hyper
ggtccggcacagaggctct

SEQ ID NO: 49041 - DNA, 207 bp, Homo sapiens; identical to SEQ ID NO: 28154
  chr3:44481337-44481544
  hyper

SEQ ID NO: 49042 - DNA, 15 bp, Homo sapiens
  chr3:44596464-44596479
  hyper
ggtgtagagctggga

SEQ ID NO: 49043 - DNA, 207 bp, Homo sapiens; identical to SEQ ID NO: 18050
  chr3:44596509-44596716
  hyper

SEQ ID NO: 49044 - DNA, 222 bp, Homo sapiens
  chr3:44596809-44597031
  hyper
ggccaggaccgcgcttcttcccggcggcaggcggcgcggtccccgtgactctcagaagccgcccgatgtagagccgcttctttgtctcatacccctgaccattcgtgcgtggcacggagccgggtatctgcgggtacagcgatgaacagggcagacgtggccaggtgagcggcgctgctgaagcctggtttaacacgaaaggtagatcgctgttttcccagc

SEQ ID NO: 49045 - DNA, 1 bp, Homo sapiens
  chr3:44626437-44626438
  hyper
g

SEQ ID NO: 49046 - DNA, 10 bp, Homo sapiens
  chr3:44626711-44626721
  hyper
ggaccaggct

SEQ ID NO: 49047 - DNA, 31 bp, Homo sapiens
  chr3:44726844-44726875
  hyper
tgggtataaatatgaccgcaaaactgccctt

SEQ ID NO: 49048 - DNA, 54 bp, Homo sapiens
  chr3:44727193-44727247
  hyper
tcgccgaccgctctaggaatctcggaggtcttttgacctcgacgcctccttacc

SEQ ID NO: 49049 - DNA, 40 bp, Homo sapiens; identical to SEQ ID NO: 28160
  chr3:44754372-44754412
  hyper

SEQ ID NO: 49050 - DNA, 110 bp, Homo sapiens; identical to SEQ ID NO: 28161
  chr3:44770966-44771076
  hyper

SEQ ID NO: 49051 - DNA, 632 bp, Homo sapiens; identical to SEQ ID NO: 28162
  chr3:45837540-45838172
  hyper

SEQ ID NO: 49052 - DNA, 30 bp, Homo sapiens; identical to SEQ ID NO: 28163
  chr3:46607744-46607774
  hyper

SEQ ID NO: 49053 - DNA, 229 bp, Homo sapiens; identical to SEQ ID NO: 28164
  chr3:46923250-46923479
  hyper

SEQ ID NO: 49054 - DNA, 325 bp, Homo sapiens; identical to SEQ ID NO: 28165
  chr3:46923931-46924256
  hyper

SEQ ID NO: 49055 - DNA, 39 bp, Homo sapiens; identical to SEQ ID NO: 28166
  chr3:46924989-46925028
  hyper

SEQ ID NO: 49056 - DNA, 30 bp, Homo sapiens
  chr3:48693274-48693304
  hyper
tgtcgcgaacctgggcggggtgggaggggg

SEQ ID NO: 49057 - DNA, 206 bp, Homo sapiens
  chr3:48699767-48699973
  hyper
ccctcgactattccgggcgctttgccttctccctcggagccccacgaagataggctccctgacccccaggccaggccccccatcctcccggaccccggaagactccggacaaagagctaaggctccgccaccgatatgcgcccttggccccgtagtggcagctaagcctgggtcccagccctggtgcccaccgccccccagctcct

SEQ ID NO: 49058 - DNA, 154 bp, Homo sapiens; identical to SEQ ID NO: 28172
  chr3:48700273-48700427
  hyper

SEQ ID NO: 49059 - DNA, 41 bp, Homo sapiens; identical to SEQ ID NO: 6865
  chr3:49851326-49851367
  hyper

SEQ ID NO: 49060 - DNA, 61 bp, Homo sapiens
  chr3:49907032-49907093
  hyper
caaatctgcaaagcccgcgcgctctgaccccgccaggacctcgagccctcgctgcgccccc

SEQ ID NO: 49061 - DNA, 223 bp, Homo sapiens
  chr3:49907130-49907353
  hyper
atcccccaaggccccacaacctgcgttcgggaagcgcccccagcccggcccgccccgcacctgcagcgccggttggtcacagggaggaagtgatcgcgggctcagcggggcgccgagggctccggggacggcgggcagaatccgctccgagcacgcggggcagacgcggcgccagatgcagccgcttcggctagcgaacctccagcatcgccagccgcttgcc

SEQ ID NO: 49062 - DNA, 108 bp, Homo sapiens; identical to SEQ ID NO: 28175
  chr3:49941331-49941439
  hyper

SEQ ID NO: 49063 - DNA, 41 bp, Homo sapiens; identical to SEQ ID NO: 28176
  chr3:50232113-50232154
  hyper

SEQ ID NO: 49064 - DNA, 429 bp, Homo sapiens
  chr3:50242954-50243383
  hyper
tggggacctgccagtcgggactcagcgccgagcttaagcagggccctgggggtaccgggagggacacgtcgtcgccttagggcctctcggcggggctgcgaggtacagcaggaggtcggcggcacccggggctgggaccacaggacgccttgttgggggctcgggcggcacaccacaggcttcctgaggcagggcccatggggcaggctggagagggcccgaggggaggacccaagaggggcctggagcagtccctggagcgctgccccgacgggcgcctgacaggcagagcagcccggctggcacgatgggaatccgggtatatttatctcggctgctccggacaagggcttgagggcagatcgggccgggccgcctgaggggccgcggggtacatgctggtcccagagccggtgccatttgcagagg

SEQ ID NO: 49065 - DNA, 40 bp, Homo sapiens; identical to SEQ ID NO: 18062
  chr3:50243480-50243520
  hyper

SEQ ID NO: 49066 - DNA, 76 bp, Homo sapiens
  chr3:50402944-50403020
  hyper
cacagaccctggcaaggtctccggcctccctcagtcgtagaccccaccctccccatggagtcgtcttagctcagat

SEQ ID NO: 49067 - DNA, 147 bp, Homo sapiens; identical to SEQ ID NO: 28180
  chr3:50540350-50540497
  hyper

SEQ ID NO: 49068 - DNA, 30 bp, Homo sapiens; identical to SEQ ID NO: 28181
  chr3:50567928-50567958
  hyper

SEQ ID NO: 49069 - DNA, 124 bp, Homo sapiens; identical to SEQ ID NO: 28182
  chr3:50605238-50605362
  hyper

SEQ ID NO: 49070 - DNA, 274 bp, Homo sapiens; identical to SEQ ID NO: 28183
  chr3:50712086-50712360
  hyper

SEQ ID NO: 49071 - DNA, 105 bp, Homo sapiens; identical to SEQ ID NO: 28184
  chr3:51990011-51990116
  hyper

SEQ ID NO: 49072 - DNA, 52 bp, Homo sapiens; identical to SEQ ID NO: 28185
  chr3:51990429-51990481
  hyper

SEQ ID NO: 49073 - DNA, 42 bp, Homo sapiens; identical to SEQ ID NO: 28186
  chr3:54154759-54154801
  hyper

SEQ ID NO: 49074 - DNA, 269 bp, Homo sapiens; identical to SEQ ID NO: 6870
  chr3:54155224-54155493
  hyper

SEQ ID NO: 49075 - DNA, 87 bp, Homo sapiens
  chr3:54155524-54155611
  hyper
cgagaaggcgcctcctccggcgctcactgcctcctgcccagtgcggtgggcgccggagtggggagcaggcaatcccccaggctcgga

SEQ ID NO: 49076 - DNA, 401 bp, Homo sapiens
  chr3:54155677-54156078
  hyper
ctcgctcaaccctgacatcccggtccccaccagtcaccgcagccgggcggactccgaaggcagcggccgctggggagccccggggcctgggtcgggcgcgcagggggccgctgcgctgcggccggatgccgggagccccgcgctggtgcgcccaagccgtggtggcagcaccgccctccgtgctttcccctgtcgggcgccgcggccggaggagcagctgcgggcggtcacgcagcgctgccctagccagagccccgagctcccacccagtcccatccccagcccgatccgccccgcgtgcgatcccgcctgccgccgcgagcctgtgctcctttctgagatttctgcttcttccccagctccctccccgcaggagaatcgcgcggcgggggcggagggcg

SEQ ID NO: 49077 - DNA, 273 bp, Homo sapiens; identical to SEQ ID NO: 28189
  chr3:54156356-54156629
  hyper

SEQ ID NO: 49078 - DNA, 420 bp, Homo sapiens; identical to SEQ ID NO: 28190
  chr3:54156654-54157074
  hyper

SEQ ID NO: 49079 - DNA, 66 bp, Homo sapiens; identical to SEQ ID NO: 18068
  chr3:54157315-54157381
  hyper

SEQ ID NO: 49080 - DNA, 353 bp, Homo sapiens
  chr3:54157450-54157803
  hyper
gccatagtcccatgtgtgcgtgtgcgtgtgcgtgcgtgttgactgtgacacgggtgttacatatcttcctgtgccccttctccctgtagggtgaagctctgggcctcggcttttggtggggagataaaatccattgctgctaagtactccggttcccagcttctgcaaaaggtaaggtttctgtggtggcaggaagcgatgatttttccggcacagaaaatggaggcagatttagttttccaaacaaacgtgagccccgagcagcatcagttatcggaggactctctgatccccgggtttcttggcattgtactatgcagtgacttcttcctaccaaccggttatttttagat

SEQ ID NO: 49081 - DNA, 209 bp, Homo sapiens; identical to SEQ ID NO: 28192
  chr3:55520384-55520593
  hyper

SEQ ID NO: 49082 - DNA, 355 bp, Homo sapiens; identical to SEQ ID NO: 28193
  chr3:55521035-55521390
  hyper

SEQ ID NO: 49083 - DNA, 204 bp, Homo sapiens; identical to SEQ ID NO: 28194
  chr3:55521754-55521958
  hyper

SEQ ID NO: 49084 - DNA, 511 bp, Homo sapiens
  chr3:55522595-55523106
  hyper
gcaggattttaaagccgtactacgggctggggtgccgggaggcggggtacactctccttgtctccccttctctaagttccccatcccccgcggcatctgctgaaagagagaggtccactccgcagccgctgcctgcctgccgcctggttgtctgcgctccttccagagccaccgaccggcgggaggctgaaccccaacttccccgcctggaccccttggctcgcccgcgtatcccagaccgctcccactggggctccacggagactgctgccttgacatggaacctcatgggggacctcctcattcttacctctgggggaggatacttaagcactggggctgatggatagggttaggcgctcacctcctgcaaagtccccagagtagtagggacttgggtagtgggatgcatgattgctcatctggctccggcccagagcatgaggcgcgatgcgtggtcctgccacggagatcttggcgggtgccctcaggtgaggagattgcgaagttt

SEQ ID NO: 49085 - DNA, 179 bp, Homo sapiens; identical to SEQ ID NO: 28196
  chr3:56502587-56502766
  hyper

SEQ ID NO: 49086 - DNA, 28 bp, Homo sapiens
  chr3:56502800-56502828
  hyper
cgacgccccttcccgggtacccccctcc

SEQ ID NO: 49087 - DNA, 30 bp, Homo sapiens; identical to SEQ ID NO: 28198
  chr3:57204154-57204184
  hyper

SEQ ID NO: 49088 - DNA, 30 bp, Homo sapiens; identical to SEQ ID NO: 28199
  chr3:58571373-58571403
  hyper

SEQ ID NO: 49089 - DNA, 91 bp, Homo sapiens; identical to SEQ ID NO: 28200
  chr3:61548917-61549008
  hyper

SEQ ID NO: 49090 - DNA, 30 bp, Homo sapiens; identical to SEQ ID NO: 28201
  chr3:61550498-61550528
  hyper

SEQ ID NO: 49091 - DNA, 74 bp, Homo sapiens; identical to SEQ ID NO: 28202
  chr3:62305019-62305093
  hyper

SEQ ID NO: 49092 - DNA, 34 bp, Homo sapiens
  chr3:62354249-62354283
  hyper
agggggtgccctttgcgttaagcatctttccctt

SEQ ID NO: 49093 - DNA, 57 bp, Homo sapiens
  chr3:62354328-62354385
  hyper
cagccacactcgccccctcaatggggaggttgcgtggaagcgcactcccgggccccg

SEQ ID NO: 49094 - DNA, 180 bp, Homo sapiens
  chr3:62354445-62354625
  hyper
cgcggatattaaaagtgtgtgtggggggaggcccggagcgacgcgccagtaatccgagctcttgattatccagattcggatcaaacggggcggcggcggccggccccctcctgggaatgattagatgattaatgtaatgctgtttgaagggtctctgttttctctcttaatttgggtcat

SEQ ID NO: 49095 - DNA, 142 bp, Homo sapiens
  chr3:62354914-62355056
  hyper
ttaggtctcccggagaaggggacgcgcccagaagctctccggtggggtagggcgtagatcgcttaccctcgcggggcgtggcgctttgctcaaggacgctcccaaaagctgctccccaacacccagtcgcttttaacccttt

SEQ ID NO: 49096 - DNA, 124 bp, Homo sapiens
  chr3:62355300-62355424
  hyper
ttgctgagctgacctcgccgcgaggggagagggggaaaaaaacgcgcactaatgattctgtttattgagttatatatgtatatattccgtgttcgcttgtacaggaggatttacatggctgtat

SEQ ID NO: 49097 - DNA, 296 bp, Homo sapiens
  chr3:62355478-62355774
  hyper
gttaaaactggctgccccaggagaagcggaggcctggaattaaatacgtttcggcgcactggatttaaataagtttcctgaatatacaaaggtgggggccacgagtttgctgccagtcatcgaggaaacatttagctttccaaaaatatgctggtttcgataaatagattttagcctctctgctatagtttttttttcttttaattttagaaataagtttatatgtgtgatctgttttcaggtggtacagggagggaaggaagggcaaggcagtagctctcagctctgcactgtcc

SEQ ID NO: 49098 - DNA, 129 bp, Homo sapiens; identical to SEQ ID NO: 18076
  chr3:62357495-62357624
  hyper

SEQ ID NO: 49099 - DNA, 4 bp, Homo sapiens
  chr3:62357667-62357671
  hyper
ccct

SEQ ID NO: 49100 - DNA, 382 bp, Homo sapiens; identical to SEQ ID NO: 28211
  chr3:62357735-62358117
  hyper

SEQ ID NO: 49101 - DNA, 194 bp, Homo sapiens; identical to SEQ ID NO: 18079
  chr3:62358336-62358530
  hyper

SEQ ID NO: 49102 - DNA, 365 bp, Homo sapiens
  chr3:62359011-62359376
  hyper
acattttgatggcaaacatcttcccctccgcgtgagatcactgtcttttacattcagctgacatcacatgaagtcacttgaagtggaatgacatgggcggcggcgcggctcccgtagcggcccctgtgttcccccgcgcctgccggccgccgccaccaccgcccctcaaactttaaaaggaggcaactggcgcccgcgctcctctcgggaaagtgcgagcggtttgcgaatagggaaagagggaagagacgggagggggagggggaggaatcgtgatggttttgccggtggaaggaaagggggggggggacccaaacccaaacctaggcagagttccgtgcgtgattcacaactttggaggcctg

SEQ ID NO: 49103 - DNA, 409 bp, Homo sapiens; identical to SEQ ID NO: 18080
  chr3:62359893-62360302
  hyper

SEQ ID NO: 49104 - DNA, 25 bp, Homo sapiens
  chr3:62362712-62362737
  hyper
ccgggcgcccaggcccgtggccttc

SEQ ID NO: 49105 - DNA, 86 bp, Homo sapiens
  chr3:62362816-62362902
  hyper
cgaggcctcagccccaggcctatttcacttggagcgcctcagcctagagccggacgctttggcttcttcgccatctggccctaggt

SEQ ID NO: 49106 - DNA, 30 bp, Homo sapiens; identical to SEQ ID NO: 18082
  chr3:62363596-62363626
  hyper

SEQ ID NO: 49107 - DNA, 213 bp, Homo sapiens; identical to SEQ ID NO: 18083
  chr3:62363693-62363906
  hyper

SEQ ID NO: 49108 - DNA, 407 bp, Homo sapiens; identical to SEQ ID NO: 28220
  chr3:62860194-62860601
  hyper

SEQ ID NO: 49109 - DNA, 32 bp, Homo sapiens; identical to SEQ ID NO: 28221
  chr3:62861293-62861325
  hyper

SEQ ID NO: 49110 - DNA, 54 bp, Homo sapiens; identical to SEQ ID NO: 6897
  chr3:62861840-62861894
  hyper

SEQ ID NO: 49111 - DNA, 46 bp, Homo sapiens; identical to SEQ ID NO: 28223
  chr3:63263792-63263838
  hyper

SEQ ID NO: 49112 - DNA, 586 bp, Homo sapiens; identical to SEQ ID NO: 28224
  chr3:63264254-63264840
  hyper

SEQ ID NO: 49113 - DNA, 335 bp, Homo sapiens; identical to SEQ ID NO: 28225
  chr3:64430570-64430905
  hyper

SEQ ID NO: 49114 - DNA, 232 bp, Homo sapiens; identical to SEQ ID NO: 28226
  chr3:64672181-64672413
  hyper

SEQ ID NO: 49115 - DNA, 26 bp, Homo sapiens
  chr3:65535077-65535103
  hyper
gttacctgcgggccccggagcggccc

SEQ ID NO: 49116 - DNA, 35 bp, Homo sapiens; identical to SEQ ID NO: 18087
  chr3:68057145-68057180
  hyper

SEQ ID NO: 49117 - DNA, 151 bp, Homo sapiens
  chr3:68980780-68980931
  hyper
tcccgcggaaagagacgcaacttccagacccgctccagttctccacttgggcgggaagctttgcgctcccagctggaagacgcctcccaagcgctcgctgcgcccttcaagcaagatcctagcaaccagagcttcagggtgggggtggggg

SEQ ID NO: 49118 - DNA, 190 bp, Homo sapiens
  chr3:68981113-68981303
  hyper
acatgaaccccgaaactggaagcggccgctgcctctctccagccacacatccttacttcggagtgccccttccaacttcgggttgcacgccgacctcagcacaggcactctccccggcgccccagagagccgggatgaggggagctgcaccgagctgagttaactcggtaccagccgagaggcagcggct

SEQ ID NO: 49119 - DNA, 189 bp, Homo sapiens; identical to SEQ ID NO: 28231
  chr3:68981626-68981815
  hyper

SEQ ID NO: 49120 - DNA, 15 bp, Homo sapiens
  chr3:68981851-68981866
  hyper
cgcgcccccactgcc

SEQ ID NO: 49121 - DNA, 181 bp, Homo sapiens; identical to SEQ ID NO: 28233
  chr3:68981867-68982048
  hyper

SEQ ID NO: 49122 - DNA, 507 bp, Homo sapiens; identical to SEQ ID NO: 28234
  chr3:69435151-69435658
  hyper

SEQ ID NO: 49123 - DNA, 51 bp, Homo sapiens
  chr3:69590888-69590939
  hyper
aaaagggcagccaaacgaaacccttagtgtcctctgctaactccagggatt

SEQ ID NO: 49124 - DNA, 158 bp, Homo sapiens
  chr3:69590969-69591127
  hyper
gtatctctgggggccagatctgggcttcatcagcttttctcccgacctcccacgaacgcgcggcaaccgaagcacgcggtccccggcggcgcgtttgcaaaccccaccaacgccaacgcctcgaaaccgccaaacttcctgtctccataccaccaaag

SEQ ID NO: 49125 - DNA, 53 bp, Homo sapiens
  chr3:69591310-69591363
  hyper
cgccctggcagcacgcttggggagcccggggcggtcgcccacctacctgctcc

SEQ ID NO: 49126 - DNA, 102 bp, Homo sapiens; identical to SEQ ID NO: 28238
  chr3:71179297-71179399
  hyper

SEQ ID NO: 49127 - DNA, 174 bp, Homo sapiens
  chr3:71802622-71802796
  hyper
aacgcgacttgtcgccaccttgcgtcctgggccctgcctccctcccggccgcctcccgaccccgcggctgctgcggaggcgcccccagcccagccgggcccaggcggtgcgggatgcctcggcggggctggcggcggcggccgcgctgcgcgctccggcggaggggagggggct

SEQ ID NO: 49128 - DNA, 270 bp, Homo sapiens
  chr3:71802856-71803126
  hyper
gcagagccaagaggcgcggcggcagcagcggaggagtaggaggagacggaggaggatgcggggggctgcggacggtggcgaggccctgtccgcagtgaagcccgcggcgcctagggcgcagggagtggccgcctcctcctgcgcgcaccattcctgagatggcggcggcggcacagcggcggctcggggagcccaggaggggccggccgggagcgggctgagccccgcaggacggggagctcgcccagggccggcggagcggcggagctc

SEQ ID NO: 49129 - DNA, 183 bp, Homo sapiens; identical to SEQ ID NO: 28242
  chr3:71803826-71804009
  hyper

SEQ ID NO: 49130 - DNA, 30 bp, Homo sapiens; identical to SEQ ID NO: 28243
  chr3:71833673-71833703
  hyper

SEQ ID NO: 49131 - DNA, 494 bp, Homo sapiens; identical to SEQ ID NO: 28244
  chr3:71834231-71834725
  hyper

SEQ ID NO: 49132 - DNA, 30 bp, Homo sapiens; identical to SEQ ID NO: 28245
  chr3:72788104-72788134
  hyper

SEQ ID NO: 49133 - DNA, 41 bp, Homo sapiens; identical to SEQ ID NO: 28246
  chr3:73674183-73674224
  hyper

SEQ ID NO: 49134 - DNA, 30 bp, Homo sapiens; identical to SEQ ID NO: 28247
  chr3:74664104-74664134
  hyper

SEQ ID NO: 49135 - DNA, 125 bp, Homo sapiens; identical to SEQ ID NO: 28248
  chr3:75955872-75955997
  hyper

SEQ ID NO: 49136 - DNA, 50 bp, Homo sapiens; identical to SEQ ID NO: 28250
  chr3:77089150-77089200
  hyper

SEQ ID NO: 49137 - DNA, 60 bp, Homo sapiens; identical to SEQ ID NO: 28251
  chr3:77089428-77089488
  hyper

SEQ ID NO: 49138 - DNA, 38 bp, Homo sapiens; identical to SEQ ID NO: 28252
  chr3:79068137-79068175
  hyper

SEQ ID NO: 49139 - DNA, 356 bp, Homo sapiens
  chr3:79815557-79815913
  hyper
atgtcttagcattccgtctcccccaccccacccatctgcgtgggacacagtgactcctagaagggtatcccaggattttagcggccaggtgtgagcgccctccacgcggtcctccgagacctcagggcgcgtggcaactgggcagaagccgtctctgcagcgccgctgccccgggtggagcggcagcccaggctgcagcagtggggttgccacgccgagttttccgcatcggccgcccgcagggctcgcctgcttctccccattgtgttctcagagctgtgggacccagccgcgcgcgcagccgcacccgcgccaacgctggaaccgaaggctcatggaagcggggctggcaagat

SEQ ID NO: 49140 - DNA, 40 bp, Homo sapiens
  chr3:79817318-79817358
  hyper
tgtaatgcctgctgcgatgtttaaccgaggggggaggaaa

SEQ ID NO: 49141 - DNA, 570 bp, Homo sapiens; identical to SEQ ID NO: 28256
  chr3:85007729-85008299
  hyper

SEQ ID NO: 49142 - DNA, 18 bp, Homo sapiens
  chr3:85008708-85008726
  hyper
agcatctacttgccccct

SEQ ID NO: 49143 - DNA, 69 bp, Homo sapiens; identical to SEQ ID NO: 28258
  chr3:85009234-85009303
  hyper

SEQ ID NO: 49144 - DNA, 96 bp, Homo sapiens; identical to SEQ ID NO: 28259
  chr3:85009769-85009865
  hyper

SEQ ID NO: 49145 - DNA, 40 bp, Homo sapiens; identical to SEQ ID NO: 28260
  chr3:85010590-85010630
  hyper

SEQ ID NO: 49146 - DNA, 56 bp, Homo sapiens; identical to SEQ ID NO: 28261
  chr3:87040188-87040244
  hyper

SEQ ID NO: 49147 - DNA, 57 bp, Homo sapiens; identical to SEQ ID NO: 28262
  chr3:87040446-87040503
  hyper

SEQ ID NO: 49148 - DNA, 161 bp, Homo sapiens; identical to SEQ ID NO: 28263
  chr3:87841521-87841682
  hyper

SEQ ID NO: 49149 - DNA, 188 bp, Homo sapiens; identical to SEQ ID NO: 28264
  chr3:87842058-87842246
  hyper

SEQ ID NO: 49150 - DNA, 78 bp, Homo sapiens; identical to SEQ ID NO: 28265
  chr3:87842247-87842325
  hyper

SEQ ID NO: 49151 - DNA, 73 bp, Homo sapiens; identical to SEQ ID NO: 28266
  chr3:89156550-89156623
  hyper

SEQ ID NO: 49152 - DNA, 186 bp, Homo sapiens; identical to SEQ ID NO: 28267
  chr3:96532078-96532264
  hyper

SEQ ID NO: 49153 - DNA, 33 bp, Homo sapiens; identical to SEQ ID NO: 28268
  chr3:96532523-96532556
  hyper

SEQ ID NO: 49154 - DNA, 33 bp, Homo sapiens
  chr3:96532784-96532817
  hyper
ctggtcaagtttgggcgacccgcgcggaggagg

SEQ ID NO: 49155 - DNA, 114 bp, Homo sapiens
  chr3:96532873-96532987
  hyper
ctcaccccctccagcggtggaaatgtggagaagtaagtgggaggcggtgtcgggaactgactcctcttaaaacggtcggcgccgctgctctgaaatgggcggctaagtgcttgt

SEQ ID NO: 49156 - DNA, 141 bp, Homo sapiens; identical to SEQ ID NO: 18110
  chr3:96533242-96533383
  hyper

SEQ ID NO: 49157 - DNA, 324 bp, Homo sapiens
  chr3:96533458-96533782
  hyper
ctgtggtggatgcaattcccctcgcctccagccgcgaggagctccccggcgccgcaggcagcgtcctcctccgaagcagctgcacctgcaactgggcagcctggaccctcgtgccctgttcccgggacctcgcgcagggggcgccccgggacaccccctgcgggccgggtggaggaggaagaggaggaggaggaagaagacgtggacaaggacccccatcctacccagaacacctgcctgcgctgccgccacttctctttaagggagaggaaaagagagcctaggagaaccatggggggctgcgaagtccgggaatttcttttg

SEQ ID NO: 49158 - DNA, 56 bp, Homo sapiens; identical to SEQ ID NO: 28272
  chr3:98451370-98451426
  hyper

SEQ ID NO: 49159 - DNA, 410 bp, Homo sapiens; identical to SEQ ID NO: 28273
  chr3:98451961-98452371
  hyper

SEQ ID NO: 49160 - DNA, 154 bp, Homo sapiens; identical to SEQ ID NO: 28274
  chr3:98452640-98452794
  hyper

SEQ ID NO: 49161 - DNA, 527 bp, Homo sapiens; identical to SEQ ID NO: 28275
  chr3:98620068-98620595
  hyper

SEQ ID NO: 49162 - DNA, 30 bp, Homo sapiens; identical to SEQ ID NO: 28276
  chr3:98621075-98621105
  hyper

SEQ ID NO: 49163 - DNA, 116 bp, Homo sapiens; identical to SEQ ID NO: 28277
  chr3:99356783-99356899
  hyper

SEQ ID NO: 49164 - DNA, 13 bp, Homo sapiens
  chr3:99594912-99594925
  hyper
tacctgaactgcc

SEQ ID NO: 49165 - DNA, 209 bp, Homo sapiens
  chr3:99595105-99595314
  hyper
gggcgccggtgaccgcgggaccctcggccgcggcggcggcgcagccacacaccccagctcccgcggatgttccggccgtgtgaacggaccgtggttcccggctcccagcggagggaatgagtggtgggccggtgggccggggcgccggcgccctcctgtcgggctaacaaagtcattgggaggcagggtcgatccgcttgtaacttttt

SEQ ID NO: 49166 - DNA, 30 bp, Homo sapiens; identical to SEQ ID NO: 28279
  chr3:107149033-107149063
  hyper

SEQ ID NO: 49167 - DNA, 42 bp, Homo sapiens; identical to SEQ ID NO: 28280
  chr3:107149805-107149847
  hyper

SEQ ID NO: 49168 - DNA, 30 bp, Homo sapiens; identical to SEQ ID NO: 6932
  chr3:110789665-110789695
  hyper

SEQ ID NO: 49169 - DNA, 49 bp, Homo sapiens; identical to SEQ ID NO: 28282
  chr3:110791365-110791414
  hyper

SEQ ID NO: 49170 - DNA, 64 bp, Homo sapiens; identical to SEQ ID NO: 28283
  chr3:112052498-112052562
  hyper

SEQ ID NO: 49171 - DNA, 56 bp, Homo sapiens; identical to SEQ ID NO: 28284
  chr3:112930381-112930437
  hyper

SEQ ID NO: 49172 - DNA, 15 bp, Homo sapiens
  chr3:112930455-112930470
  hyper
cgtcccctgcgttgt

SEQ ID NO: 49173 - DNA, 228 bp, Homo sapiens; identical to SEQ ID NO: 28286
  chr3:112931046-112931274
  hyper

SEQ ID NO: 49174 - DNA, 44 bp, Homo sapiens; identical to SEQ ID NO: 28287
  chr3:112931566-112931610
  hyper

SEQ ID NO: 49175 - DNA, 16 bp, Homo sapiens
  chr3:115231485-115231501
  hyper
ggggctgcagaagccc

SEQ ID NO: 49176 - DNA, 282 bp, Homo sapiens; identical to SEQ ID NO: 28289
  chr3:115231502-115231784
  hyper

SEQ ID NO: 49177 - DNA, 111 bp, Homo sapiens; identical to SEQ ID NO: 28290
  chr3:115377728-115377839
  hyper

SEQ ID NO: 49178 - DNA, 243 bp, Homo sapiens; identical to SEQ ID NO: 28291
  chr3:116163696-116163939
  hyper

SEQ ID NO: 49179 - DNA, 30 bp, Homo sapiens; identical to SEQ ID NO: 28292
  chr3:116583135-116583165
  hyper

SEQ ID NO: 49180 - DNA, 234 bp, Homo sapiens
  chr3:117716473-117716707
  hyper
aagggccccgctactgccatctagtgctcacagaacggcatcgccgcggctcttcttcgctgtgtgtctgtgccaagtctatccaacgccgccaaagtcccctctgctctcagcaaacacaggtgaagctcttgccttcttaaatccttgacttgaccttgctgtcccataagtcctgaatttctccttttcacgaggaagctcttggaacatgctagccgcacatcttcatca

SEQ ID NO: 49181 - DNA, 30 bp, Homo sapiens; identical to SEQ ID NO: 28297
  chr3:119298886-119298916
  hyper

SEQ ID NO: 49182 - DNA, 59 bp, Homo sapiens; identical to SEQ ID NO: 28298
  chr3:119421863-119421922
  hyper

SEQ ID NO: 49183 - DNA, 206 bp, Homo sapiens; identical to SEQ ID NO: 28299
  chr3:120003742-120003948
  hyper

SEQ ID NO: 49184 - DNA, 110 bp, Homo sapiens
  chr3:120169658-120169768
  hyper
cgggtcccgcaggctcgctccggccgcccaagcacccccggccgcccgaagagtccggcctccgcgccgtgcgccctgcgctcaccgtggtctggtccaggtctcctggg

SEQ ID NO: 49185 - DNA, 142 bp, Homo sapiens
  chr3:120169835-120169977
  hyper
gaggaaatgcgacctcccctcgccgccccttaagacctctccttccccgcctgcctgcccccccagctcctccccattctcctcccccttctgctgcagcggcccccgcggctcccgctccccctccttccgacccctgctc

SEQ ID NO: 49186 - DNA, 144 bp, Homo sapiens; identical to SEQ ID NO: 28302
  chr3:120170066-120170210
  hyper

SEQ ID NO: 49187 - DNA, 30 bp, Homo sapiens; identical to SEQ ID NO: 28303
  chr3:120627043-120627073
  hyper

SEQ ID NO: 49188 - DNA, 558 bp, Homo sapiens
  chr3:120627453-120628011
  hyper
cgcctcagcgctgggcctgggggagggacagcgggagcggcggctctgcgcgcccagcaggctgaggcgggactcgggccgcagccgtcgccgccaccgcttcacgtcccccgagagcggctgccgtgcagcggggagagcggacggcgggcgggcgaacaggcgggagagcgcggcggcggctgcgggcagaggtggagggaggggagcaggagatggggagaggggggaaagaggacgcggggagggagatgagggggaggtgagggggaggcggagggacaagtggaaacagacggtgtcgccgttctcctcctccccccctccccggcagctgttgctgtgggtcactcgcagatgttttggggtccgggctgctgggggatggggactagaaaaagtacccccctccccgcctttcatagtgacaaaaaaggaagcgttgaagctgatgggggaagagcccggaaggtggtggcagagtaaataccggctcccccaacgtcgtttttctgaaaataaaatactctgagccgaacgtttcgaagaaggaaagtc

SEQ ID NO: 49189 - DNA, 30 bp, Homo sapiens; identical to SEQ ID NO: 28305
  chr3:120628354-120628384
  hyper

SEQ ID NO: 49190 - DNA, 223 bp, Homo sapiens; identical to SEQ ID NO: 28306
  chr3:121902727-121902950
  hyper

SEQ ID NO: 49191 - DNA, 39 bp, Homo sapiens
  chr3:121903619-121903658
  hyper
aatgaacgggagcgcgcaccaaaacgcctgctgttggta

SEQ ID NO: 49192 - DNA, 45 bp, Homo sapiens; identical to SEQ ID NO: 6949
  chr3:122296693-122296738
  hyper

SEQ ID NO: 49193 - DNA, 33 bp, Homo sapiens; identical to SEQ ID NO: 28310
  chr3:122745310-122745343
  hyper

SEQ ID NO: 49194 - DNA, 47 bp, Homo sapiens; identical to SEQ ID NO: 28311
  chr3:122745601-122745648
  hyper

SEQ ID NO: 49195 - DNA, 224 bp, Homo sapiens; identical to SEQ ID NO: 28312
  chr3:122745957-122746181
  hyper

SEQ ID NO: 49196 - DNA, 32 bp, Homo sapiens; identical to SEQ ID NO: 28313
  chr3:123166974-123167006
  hyper

SEQ ID NO: 49197 - DNA, 240 bp, Homo sapiens
  chr3:123167529-123167769
  hyper
cggggcatcttggcacccccgtcctgagcggaggaggagggcacagccccgaggtgagaagtagctgaggatccgcgtcagaagtcccaggtccgaaatggagttgcctccgaggtggggtcgcagggactggtctggctgctgctgcgccgcacgcggagagacgtccgggatcctggctcgcgtcgagctcgacgagggccggagttgcggacgagacgggacggagtggtgtccttg

SEQ ID NO: 49198 - DNA, 160 bp, Homo sapiens
  chr3:123167827-123167987
  hyper
agcggagcccagctgctctcggggctcggcggcggcgagggcggctcggcgggggtcccggcgaagagacactgcgggtgcgctttcctcgcagcggactgggagcgactgggaggtgcgggcgccagccagcattattttcttacgaggggtggggagg

SEQ ID NO: 49199 - DNA, 27 bp, Homo sapiens
  chr3:123168541-123168568
  hyper
gcgccatgcacgcttcgggccctgcgc

SEQ ID NO: 49200 - DNA, 241 bp, Homo sapiens; identical to SEQ ID NO: 28316
  chr3:123168581-123168822
  hyper

SEQ ID NO: 49201 - DNA, 330 bp, Homo sapiens; identical to SEQ ID NO: 28317
  chr3:123602641-123602971
  hyper

SEQ ID NO: 49202 - DNA, 327 bp, Homo sapiens; identical to SEQ ID NO: 28318
  chr3:123603226-123603553
  hyper

SEQ ID NO: 49203 - DNA, 69 bp, Homo sapiens; identical to SEQ ID NO: 28319
  chr3:123752431-123752500
  hyper

SEQ ID NO: 49204 - DNA, 50 bp, Homo sapiens; identical to SEQ ID NO: 28320
  chr3:123752973-123753023
  hyper

SEQ ID NO: 49205 - DNA, 139 bp, Homo sapiens; identical to SEQ ID NO: 28321
  chr3:124606603-124606742
  hyper

SEQ ID NO: 49206 - DNA, 51 bp, Homo sapiens; identical to SEQ ID NO: 28322
  chr3:124773881-124773932
  hyper

SEQ ID NO: 49207 - DNA, 49 bp, Homo sapiens
  chr3:125899207-125899256
  hyper
ggtgagaaccgagtcctggagcccctggagcccccggagcccccggagc

SEQ ID NO: 49208 - DNA, 27 bp, Homo sapiens
  chr3:125899498-125899525
  hyper
tcagccgagtgggggcggcgctcaccg

SEQ ID NO: 49209 - DNA, 32 bp, Homo sapiens; identical to SEQ ID NO: 28325
  chr3:125931984-125932016
  hyper

SEQ ID NO: 49210 - DNA, 48 bp, Homo sapiens
  chr3:125932500-125932548
  hyper
ctgccgtgttcaggtcactgcgagggtgagccccgctttatctacccc

SEQ ID NO: 49211 - DNA, 178 bp, Homo sapiens; identical to SEQ ID NO: 28327
  chr3:125986552-125986730
  hyper

SEQ ID NO: 49212 - DNA, 60 bp, Homo sapiens; identical to SEQ ID NO: 28328
  chr3:126075183-126075243
  hyper

SEQ ID NO: 49213 - DNA, 125 bp, Homo sapiens; identical to SEQ ID NO: 28329
  chr3:126113532-126113657
  hyper

SEQ ID NO: 49214 - DNA, 116 bp, Homo sapiens; identical to SEQ ID NO: 28330
  chr3:126113794-126113910
  hyper

SEQ ID NO: 49215 - DNA, 66 bp, Homo sapiens; identical to SEQ ID NO: 28331
  chr3:126242937-126243003
  hyper

SEQ ID NO: 49216 - DNA, 38 bp, Homo sapiens; identical to SEQ ID NO: 28332
  chr3:126243423-126243461
  hyper

SEQ ID NO: 49217 - DNA, 33 bp, Homo sapiens
  chr3:126373487-126373520
  hyper
cccgggacccgcgggcgccccggcccggacccg

SEQ ID NO: 49218 - DNA, 72 bp, Homo sapiens; identical to SEQ ID NO: 28334
  chr3:126373752-126373824
  hyper

SEQ ID NO: 49219 - DNA, 80 bp, Homo sapiens; identical to SEQ ID NO: 28335
  chr3:126854425-126854505
  hyper

SEQ ID NO: 49220 - DNA, 163 bp, Homo sapiens
  chr3:126854536-126854699
  hyper
cgtcacgcgggttcttttcctcctccttaagaggctgacctaatttccactctttgtcattttctcccgaccaaactcggagtcggctttctccaggagctgctaggagcctgggctcccactgagcaatccagagcagcgtctccatttcctgggctctcca

SEQ ID NO: 49221 - DNA, 31 bp, Homo sapiens
  chr3:126854796-126854827
  hyper
atgagaaacagagcgccgggttgcagtgcca

SEQ ID NO: 49222 - DNA, 38 bp, Homo sapiens; identical to SEQ ID NO: 28337
  chr3:127176205-127176243
  hyper

SEQ ID NO: 49223 - DNA, 251 bp, Homo sapiens; identical to SEQ ID NO: 28338
  chr3:127347860-127348111
  hyper

SEQ ID NO: 49224 - DNA, 39 bp, Homo sapiens; identical to SEQ ID NO: 28339
  chr3:127633909-127633948
  hyper

SEQ ID NO: 49225 - DNA, 30 bp, Homo sapiens; identical to SEQ ID NO: 28340
  chr3:127634282-127634312
  hyper

SEQ ID NO: 49226 - DNA, 114 bp, Homo sapiens
  chr3:127794432-127794546
  hyper
gaagtcgcgcactttcgtcgcgacttcccaagtcgtgctgggtgtgacttggaatctcggatccctgggctaggcctggccacgcccccatggggggaggggcagcgcggcggg

SEQ ID NO: 49227 - DNA, 15 bp, Homo sapiens
  chr3:127795148-127795163
  hyper
cccaacagcatgacc

SEQ ID NO: 49228 - DNA, 98 bp, Homo sapiens
  chr3:128202349-128202447
  hyper
cggggagggctgagccacaaggaaaagtacttcatggccctatttttaaaaaagagctaagcagaggccagaggacaggagtccggcccgtggacact

SEQ ID NO: 49229 - DNA, 283 bp, Homo sapiens; identical to SEQ ID NO: 28344
  chr3:128205402-128205685
  hyper

SEQ ID NO: 49230 - DNA, 98 bp, Homo sapiens; identical to SEQ ID NO: 28345
  chr3:128206332-128206430
  hyper

SEQ ID NO: 49231 - DNA, 200 bp, Homo sapiens; identical to SEQ ID NO: 28346
  chr3:128207015-128207215
  hyper

SEQ ID NO: 49232 - DNA, 120 bp, Homo sapiens; identical to SEQ ID NO: 28347
  chr3:128207713-128207833
  hyper

SEQ ID NO: 49233 - DNA, 552 bp, Homo sapiens; identical to SEQ ID NO: 28348
  chr3:128208053-128208605
  hyper

SEQ ID NO: 49234 - DNA, 114 bp, Homo sapiens
  chr3:128209232-128209346
  hyper
agcctccttgcccgcaatccggtgtagaggaaaaaaaggaaacaggagttctgccaggtcctttcaggccttggggttgccttcctcgacaacgcaggcaggagccggcttgac

SEQ ID NO: 49235 - DNA, 161 bp, Homo sapiens; identical to SEQ ID NO: 18139
  chr3:128273832-128273993
  hyper

SEQ ID NO: 49236 - DNA, 44 bp, Homo sapiens; identical to SEQ ID NO: 18140
  chr3:128274611-128274655
  hyper

SEQ ID NO: 49237 - DNA, 41 bp, Homo sapiens; identical to SEQ ID NO: 28352
  chr3:128326970-128327011
  hyper

SEQ ID NO: 49238 - DNA, 37 bp, Homo sapiens; identical to SEQ ID NO: 28353
  chr3:128327483-128327520
  hyper

SEQ ID NO: 49239 - DNA, 46 bp, Homo sapiens
  chr3:128417155-128417201
  hyper
gcactcctgcgtgagcgacttccattcgggacggctcagccgcccg

SEQ ID NO: 49240 - DNA, 390 bp, Homo sapiens
  chr3:128417231-128417621
  hyper
caggcctcccggggcacctagaactgcgtgcctcacgcgggccccgctgggctcctcacccgctcagccactgccacctgcctgggaccctccccctgcggagcgggatgtttggcggggagaaatgcggaggggaaccctaggctggcggctttcctccttccgcagaacccacggtcctgatctccggccgcctccttctgacccggggttctggccccctcctcccccaggacctcagcgcggcaccccacccaccaccccccgcccccaacccaggccagctgtctctttttcctcaggggtcgggctcccagcctctgccctccacaaccacccgcctgcctcaccagggcccagcctggcccctgggagcggccacagcgccga

SEQ ID NO: 49241 - DNA, 258 bp, Homo sapiens
  chr3:128720611-128720869
  hyper
gatcgtggtgctggccaccggcctggaccagtacctgcaggaggtcttccaccacctggactgccgcggcgccggccgtctgccccgcgccgacttccgagcgctctgcgctgtgctggggctgcgcgcggagggggccaccacggccgggcaggcagcaggtgacgggaactccagagatgtgacccccggggatgcggccgctgagttggccacggacggggactcagataccgatgaagaggcgcgcctggcgct

SEQ ID NO: 49242 - DNA, 86 bp, Homo sapiens; identical to SEQ ID NO: 18143
  chr3:128721229-128721315
  hyper

SEQ ID NO: 49243 - DNA, 8 bp, Homo sapiens
  chr3:128764836-128764844
  hyper
cggggtcc

SEQ ID NO: 49244 - DNA, 92 bp, Homo sapiens; identical to SEQ ID NO: 28362
  chr3:129324567-129324659
  hyper

SEQ ID NO: 49245 - DNA, 30 bp, Homo sapiens; identical to SEQ ID NO: 28363
  chr3:129324893-129324923
  hyper

SEQ ID NO: 49246 - DNA, 30 bp, Homo sapiens; identical to SEQ ID NO: 28364
  chr3:129346534-129346564
  hyper

SEQ ID NO: 49247 - DNA, 37 bp, Homo sapiens
  chr3:129693071-129693108
  hyper
ccccattctctctctctctctctttctctctctctct

SEQ ID NO: 49248 - DNA, 126 bp, Homo sapiens; identical to SEQ ID NO: 18144
  chr3:130064484-130064610
  hyper

SEQ ID NO: 49249 - DNA, 38 bp, Homo sapiens
  chr3:130064780-130064818
  hyper
cggtttccagggtccggagtgtcccctgaccccgggaa

SEQ ID NO: 49250 - DNA, 45 bp, Homo sapiens; identical to SEQ ID NO: 28370
  chr3:130235542-130235587
  hyper

SEQ ID NO: 49251 - DNA, 256 bp, Homo sapiens
  chr3:130235793-130236049
  hyper
ctttcttttctcccacggtcgggaccttagggtaggagtttcaagaggggagaagccggtggagcagtaacagccttcataatgtctccagtcccgcttccgtcacctccctaaggctgcgcccccctcctgggggacgtgcgctgggcccggggccgccggggcggggaagggtcgggcccggggcggggagaagcgtttatatgtcggcgaggggcgtgggagctgccacccgcttgcctgcgggacaccggag

SEQ ID NO: 49252 - DNA, 180 bp, Homo sapiens; identical to SEQ ID NO: 28373
  chr3:131752606-131752786
  hyper

SEQ ID NO: 49253 - DNA, 56 bp, Homo sapiens
  chr3:131753975-131754031
  hyper
cccaggccttggcggcggcgctctccgtggtcctgccgcgcccgcagtctgggctt

SEQ ID NO: 49254 - DNA, 48 bp, Homo sapiens
  chr3:132757017-132757065
  hyper
aacccccagagacatcggagcgggcgctgccgagggcaatttggtgat

SEQ ID NO: 49255 - DNA, 376 bp, Homo sapiens
  chr3:132757104-132757480
  hyper
gcgaccggattggctgtcgcggacgctgacggacaaggccggggcgggccagagcctggtcggaggggcgcgcgcgggggcccgaggggcgaaggcgcgagtgcgcgagagcgcgtgcgcgagcggtggggctttctcctgagccgtcggagggagccggagcgcttctcccgaggtaagcggcgctccggggcgtccccccagtccttcccatgctgggtcccggcaagcgggttaggctgggctgggcggggctcggggaggtgtggggtcagcttgccccgggagcccagcttcagggaggatgcagccccggttgccttggtttcccttttcctatcctctcaggcaccttcccatcctccccactgcgtga

SEQ ID NO: 49256 - DNA, 372 bp, Homo sapiens; identical to SEQ ID NO: 28376
  chr3:132757536-132757908
  hyper

SEQ ID NO: 49257 - DNA, 51 bp, Homo sapiens; identical to SEQ ID NO: 28377
  chr3:133613719-133613770
  hyper

SEQ ID NO: 49258 - DNA, 62 bp, Homo sapiens; identical to SEQ ID NO: 28378
  chr3:133615071-133615133
  hyper

SEQ ID NO: 49259 - DNA, 130 bp, Homo sapiens; identical to SEQ ID NO: 28379
  chr3:133646291-133646421
  hyper

SEQ ID NO: 49260 - DNA, 34 bp, Homo sapiens; identical to SEQ ID NO: 28380
  chr3:133748071-133748105
  hyper

SEQ ID NO: 49261 - DNA, 127 bp, Homo sapiens; identical to SEQ ID NO: 28381
  chr3:134032405-134032532
  hyper

SEQ ID NO: 49262 - DNA, 554 bp, Homo sapiens; identical to SEQ ID NO: 28382
  chr3:134125220-134125774
  hyper

SEQ ID NO: 49263 - DNA, 44 bp, Homo sapiens; identical to SEQ ID NO: 28383
  chr3:134369475-134369519
  hyper

SEQ ID NO: 49264 - DNA, 59 bp, Homo sapiens; identical to SEQ ID NO: 28384
  chr3:134369552-134369611
  hyper

SEQ ID NO: 49265 - DNA, 100 bp, Homo sapiens; identical to SEQ ID NO: 28385
  chr3:134369983-134370083
  hyper

SEQ ID NO: 49266 - DNA, 524 bp, Homo sapiens; identical to SEQ ID NO: 28386
  chr3:134514264-134514788
  hyper

SEQ ID NO: 49267 - DNA, 1 bp, Homo sapiens
  chr3:134515127-134515128
  hyper
a

SEQ ID NO: 49268 - DNA, 307 bp, Homo sapiens
  chr3:134515369-134515676
  hyper
gaaagcgcgctccaaagacaccgtgcccggcgcagcggggagcctgggcgctcggtagcgctcgcgaatccctgtgggaaatcccggcccagctccccgcctcccgccccttcccccgcctctgttcttcgcagcctagcagcggccgcggcagcctcctgggaacacagctccgcgggagagcggagttggagttgtcgggagaaaaccaactctaggggtgatgcgctgccgcagtccggctagcagccccactttccggtgtcctgctccggatggaactcctctgggggactccaagccgggg

SEQ ID NO: 49269 - DNA, 99 bp, Homo sapiens
  chr3:134516222-134516321
  hyper
gggtgagcgcatttgcaagggcaattccagactggacttgcagcattggggtggcgtcatgcaggtccgaggctcggtccggcccgcggctctttgcgc

SEQ ID NO: 49270 - DNA, 11 bp, Homo sapiens
  chr3:136537631-136537642
  hyper
gaaggaataga

SEQ ID NO: 49271 - DNA, 449 bp, Homo sapiens
  chr3:136537730-136538179
  hyper
caggcaattgcttcaaacaagcgccctccaagggcgtaagctagaggggcccgggcgggcgctttcccgtggaccctcccacctcgcgggtagaggaagtccttcagttcaggcacaaccctgagcgtcccccgcagtctccaactccggcgccagtcaggttgtggggtgggggcggcggagggcggagagcgcaggcgcagagtccgcgcggcggcgcccctctccctccgcagtactccgggcagcgcccgcctcgattttcccaggcgagggcacgcccgcgtcagtcgcctccggggcaccttcctcgccacgacacgcaggtaaccgggccccgggagccggtcggcggcggcggactgggaccttgatcctgcctgcccggccgcccgacaagggaatgagagcggaccccgaactccacacacccgcgtttagccgccaca

SEQ ID NO: 49272 - DNA, 80 bp, Homo sapiens
  chr3:136751561-136751641
  hyper
gcagggcactttcttcgggaaggactcctgggagctcaggagtttgcatacgaagccgagggagcgaggggcttctgata

SEQ ID NO: 49273 - DNA, 103 bp, Homo sapiens
  chr3:137479130-137479233
  hyper
cttgggggggtgggccggattaactgtcttgtctctaaacacctgggtgcgctggcgctcactctcagctgcgagctgaagcccacgctgctctcaggcttcc

SEQ ID NO: 49274 - DNA, 91 bp, Homo sapiens
  chr3:137479510-137479601
  hyper
cagagaggagggggccggagggtggggcggagccttgtggcaaggcaggtgggtgcaggcctctggggccccagactgccgcgtctggctc

SEQ ID NO: 49275 - DNA, 54 bp, Homo sapiens
  chr3:137479687-137479741
  hyper
gaaactttactgagagtcttctctgagtttggaattatgcggaaattgaaccca

SEQ ID NO: 49276 - DNA, 37 bp, Homo sapiens; identical to SEQ ID NO: 18158
  chr3:137479943-137479980
  hyper

SEQ ID NO: 49277 - DNA, 32 bp, Homo sapiens
  chr3:137481315-137481347
  hyper
gactgggctgaaaagtgcgtttgcttcctgag

SEQ ID NO: 49278 - DNA, 84 bp, Homo sapiens
  chr3:137481774-137481858
  hyper
gggtgagaagttccacgcgtctttctaattttaggaaggggaagcaaagtcttctcctcaaacttgatacactacatgctagag

SEQ ID NO: 49279 - DNA, 30 bp, Homo sapiens; identical to SEQ ID NO: 28397
  chr3:137483214-137483244
  hyper

SEQ ID NO: 49280 - DNA, 30 bp, Homo sapiens; identical to SEQ ID NO: 28398
  chr3:137483668-137483698
  hyper

SEQ ID NO: 49281 - DNA, 14 bp, Homo sapiens
  chr3:137484002-137484016
  hyper
gggccttcttgccg

SEQ ID NO: 49282 - DNA, 180 bp, Homo sapiens
  chr3:137484225-137484405
  hyper
gccctgtaactgtaccgcctggtctgcctccaccctgcagccccccgtcgcctacatcctcttcccaggcatgaccaagactggcatagacccttattcgtcagcccacgctacggccatgtaacccccagcccggcccggacctgaggcgtggtctgaaagccgggtctgcaccctgtc

SEQ ID NO: 49283 - DNA, 157 bp, Homo sapiens; identical to SEQ ID NO: 18159
  chr3:137484531-137484688
  hyper

SEQ ID NO: 49284 - DNA, 548 bp, Homo sapiens; identical to SEQ ID NO: 28401
  chr3:137485061-137485609
  hyper

SEQ ID NO: 49285 - DNA, 92 bp, Homo sapiens; identical to SEQ ID NO: 18161
  chr3:137485937-137486029
  hyper

SEQ ID NO: 49286 - DNA, 270 bp, Homo sapiens
  chr3:137486550-137486820
  hyper
gacgcctataaataatagatagataaataaatgagcgatcaggcgaaggtaaacaaaggcgggctgagggaggtgtagggggagtccgggctggctgcgccacgcttacttagcattacaaaacccttttacaaatcgagacaattaggaagtgacttgcctctggtggccgtccggtctgggggcctgggcgcttagggaaggcccctcctcccgccccctaggaagcccaggaggcctgggacggagacgccacggttttcctgtctg

SEQ ID NO: 49287 - DNA, 56 bp, Homo sapiens; identical to SEQ ID NO: 28404
  chr3:137487025-137487081
  hyper

SEQ ID NO: 49288 - DNA, 17 bp, Homo sapiens
  chr3:137487082-137487099
  hyper
gacggtggctgaagctg

SEQ ID NO: 49289 - DNA, 132 bp, Homo sapiens; identical to SEQ ID NO: 28406
  chr3:137487656-137487788
  hyper

SEQ ID NO: 49290 - DNA, 114 bp, Homo sapiens
  chr3:137487850-137487964
  hyper
cgcgtccggtagccagggagccccagacttctctcgcttagcaacctgggcctccttcgagcggggttggcagggagggcccggacctctcgcctgaggctcccattgcttccc

SEQ ID NO: 49291 - DNA, 245 bp, Homo sapiens; identical to SEQ ID NO: 28408
  chr3:137488337-137488582
  hyper

SEQ ID NO: 49292 - DNA, 143 bp, Homo sapiens; identical to SEQ ID NO: 18165
  chr3:137488807-137488950
  hyper

SEQ ID NO: 49293 - DNA, 64 bp, Homo sapiens; identical to SEQ ID NO: 28412
  chr3:138066780-138066844
  hyper

SEQ ID NO: 49294 - DNA, 59 bp, Homo sapiens
  chr3:138153904-138153963
  hyper
ttccttgacaatgaacgcgagttcatcagccgcgagctgcggggccagcacctgccagc

SEQ ID NO: 49295 - DNA, 284 bp, Homo sapiens
  chr3:138153993-138154277
  hyper
ggtggggagatgcctttcgaggttcggaggaacttgcggtcagcggggagctggtgcgcgcaaacccgaggcagggcgggagcccggcgacctgcacaccccgttccccaccgctcccggggcgcagaccctggggacggtgaccgcccctcccgcggcgcgcagcaccctcacgtccacctctggtccgactgcggtgggagtggggaacttgggtttcatttaaggccccagagctcgagagaagagtcacgggcagaccacacccgggagaaaaacaaggg

SEQ ID NO: 49296 - DNA, 10 bp, Homo sapiens
  chr3:138659099-138659109
  hyper
ggtgctcgca

SEQ ID NO: 49297 - DNA, 47 bp, Homo sapiens; identical to SEQ ID NO: 18167
  chr3:138662087-138662134
  hyper

SEQ ID NO: 49298 - DNA, 16 bp, Homo sapiens
  chr3:138662164-138662180
  hyper
ctcctggcccaccagc

SEQ ID NO: 49299 - DNA, 86 bp, Homo sapiens; identical to SEQ ID NO: 18169
  chr3:138662296-138662382
  hyper

SEQ ID NO: 49300 - DNA, 30 bp, Homo sapiens; identical to SEQ ID NO: 28422
  chr3:138663076-138663106
  hyper

SEQ ID NO: 49301 - DNA, 218 bp, Homo sapiens
  chr3:138664165-138664383
  hyper
gcgcgcagagaggcagcttcaggccaggggagtgcaaggtcacagaggtcagggaggtgagcacaggaggacataaactgaggggacaaagaggagcgacaggagcttaggaaagcgaaaaagcacagagggaccctgggcgctggctccagaggcgggcccagagggtgtgaggtcaggctggcggcggcgtcgtcggctgcgaccggggccggcgt

SEQ ID NO: 49302 - DNA, 68 bp, Homo sapiens; identical to SEQ ID NO: 28425
  chr3:138664701-138664769
  hyper

SEQ ID NO: 49303 - DNA, 126 bp, Homo sapiens
  chr3:138664802-138664928
  hyper
cgaggcggccgggcccgccagccccttgaccacagcggccgcgccagggctaccggggcccgcggctgcagccgcagctgctgcagccgctgcggctgccgccatctggcaggaggcatagggcat

SEQ ID NO: 49304 - DNA, 13 bp, Homo sapiens
  chr3:138665323-138665336
  hyper
agatgccggacag

SEQ ID NO: 49305 - DNA, 132 bp, Homo sapiens; identical to SEQ ID NO: 28427
  chr3:138665396-138665528
  hyper

SEQ ID NO: 49306 - DNA, 23 bp, Homo sapiens
  chr3:138665539-138665562
  hyper
cgggctcggggtagctggccatc

SEQ ID NO: 49307 - DNA, 126 bp, Homo sapiens
  chr3:138666294-138666420
  hyper
cgcggctttcaggtgaaagaaaacgactcctttgctctgccgtttgctgccgtcttgaggctgaacttctagctcggggctggggaggggcgagacggcgagggggctggacggggtagggtgggg

SEQ ID NO: 49308 - DNA, 15 bp, Homo sapiens
  chr3:138668670-138668685
  hyper
ttacttctcaacctt

SEQ ID NO: 49309 - DNA, 105 bp, Homo sapiens; identical to SEQ ID NO: 321
  chr3:138679188-138679293
  hyper

SEQ ID NO: 49310 - DNA, 87 bp, Homo sapiens
  chr3:139258180-139258267
  hyper
ccgggggcaccggaccgcggctcgccgggatggaggcaggcaggcagcgtctcgggagggctctagggagcggcccggagctgctcg

SEQ ID NO: 49311 - DNA, 231 bp, Homo sapiens
  chr3:139258316-139258547
  hyper
actcctcgaaattctcgttgaccaacatcttccagtacccagtgaagtcgactggcatttcggggagtgactggagccagttggccacaagcgggcgggacggctggagactgccgggacagcggctgccggtgctacgcgggtggtgggcggcccggaaatgagcgccctccggggacagggggctctgcggggcggcgacagctggattcccagcgcgcacaaagcctg

SEQ ID NO: 49312 - DNA, 350 bp, Homo sapiens; identical to SEQ ID NO: 28434
  chr3:139396463-139396813
  hyper

SEQ ID NO: 49313 - DNA, 46 bp, Homo sapiens
  chr3:139653445-139653491
  hyper
ttctcggagatgacgcggagccctgccattgccatccaggtccaag

SEQ ID NO: 49314 - DNA, 179 bp, Homo sapiens; identical to SEQ ID NO: 18175
  chr3:139653693-139653872
  hyper

SEQ ID NO: 49315 - DNA, 1228 bp, Homo sapiens; identical to SEQ ID NO: 28437
  chr3:139653873-139655101
  hyper

SEQ ID NO: 49316 - DNA, 77 bp, Homo sapiens
  chr3:140769436-140769513
  hyper
gttagcaaatgactgcgtaatggacctaaagtcaattctgggagcacagacgagggccaccaaaccaagaactttca

SEQ ID NO: 49317 - DNA, 203 bp, Homo sapiens; identical to SEQ ID NO: 18178
  chr3:140769705-140769908
  hyper

SEQ ID NO: 49318 - DNA, 476 bp, Homo sapiens
  chr3:140770829-140771305
  hyper
ttatggtaagtactctccagctcctggtgaggggcgcgcgggggccgggagccgagatccggctgcacggactttgtgcgggccagcactcgacacagctggcgctcctgacgtcccagtccctgagaattcctctctgcaggttgtggcagttcgagatggttgatttgcgcgcagccctggggcgtttggggcccggcctttggtatcatgggttctaagccctttgcttctctgcgtagcggacaacgcacaaaaaactgccatccgattcacccgctttggtttggatccaggatccgtcactcactggctgagtgaccttggacagggcgccaaacctgtttcctcatccgtaggatgggaatgataattgtgcacattttataggggtattggaaagatctatgggatggtgttcgtaggtagacatgtgctgggcacacaggaaacactcaatcatatgttagctagta

SEQ ID NO: 49319 - DNA, 175 bp, Homo sapiens; identical to SEQ ID NO: 28442
  chr3:140771638-140771813
  hyper

SEQ ID NO: 49320 - DNA, 310 bp, Homo sapiens
  chr3:141516079-141516389
  hyper
ccgcccaggaagtggcggcagaaagcgagccctgagaagccaggggcaggagcggcctccgcgcgacactgcggcgctcctgattctgcggcctggggccgagcatgcggggcgggcggagcctcgagctaagtcccctggggtcccagggccgcattcctccgaggtctgcaaaggccactgcttaaaggcgcagaggagcagctgggaacgagaacaaagcggccaggcccccctcggaggaaggaaggagagagccccaggaaacagctgatagcgctaagctcagcttgtttttttcctctgctca

SEQ ID NO: 49321 - DNA, 25 bp, Homo sapiens
  chr3:141516719-141516744
  hyper
gaaggacctgcgcacactcatactt

SEQ ID NO: 49322 - DNA, 264 bp, Homo sapiens; identical to SEQ ID NO: 28444
  chr3:142443587-142443851
  hyper

SEQ ID NO: 49323 - DNA, 30 bp, Homo sapiens; identical to SEQ ID NO: 28445
  chr3:142607418-142607448
  hyper

SEQ ID NO: 49324 - DNA, 41 bp, Homo sapiens; identical to SEQ ID NO: 7032
  chr3:142607792-142607833
  hyper

SEQ ID NO: 49325 - DNA, 140 bp, Homo sapiens; identical to SEQ ID NO: 28447
  chr3:142681855-142681995
  hyper

SEQ ID NO: 49326 - DNA, 224 bp, Homo sapiens; identical to SEQ ID NO: 18186
  chr3:142682049-142682273
  hyper

SEQ ID NO: 49327 - DNA, 845 bp, Homo sapiens
  chr3:142682392-142683237
  hyper
gagcgcggagcgcgcgaggctcagcggcttcctcgccaagcccctgctaccggcgcgcggccgcccgcgctgcggcagcggcggcggcgcggctgactgcggcggcagcgcggcagcggtgactgggcatcgcgcggtgcgggtgcctccgccgccgccgcccccggagcgggaggtggggatgtgcgagccgaggcgcggagggagggacgggcgcaccgaggaagggcgggggcctcccaggctagggtttcgcggccgcttcgggggatagagttgtcccctgtctcgagttccgtaccatccccctcctcgggccgccgcagcccgggccgccccgttaatgattgatgcgggggccgcaggctggtcggcgacgcggcggcgcgcgcgccgagtactagagtcggccctggggttcgaaacccgacagccacgcgggcgttctggaggacactggggagccgcgttcgcggggggcggggagctgcggctgcggggggaggggagggcgccggagccgggcagggcggagagatgcgccagcggtaatctccggaggtcgccggggaggggggcactccggaagtcggggggctttaagcccgcgtccggatcggggccgtgtcattgtcagctacctggggatgcgcctctcgctccctcactgtctttgcgtgtgtgttagtgtgtgtgtgtgtgtgtgtgtgtgtgtgtcggcctgtctacgcactacacgaaggcttagttggtcttctttcgtctagtgggcgcactcaggtgcgtcaccattctgccgtttccctcgcccttgtcctgtccgaaagaaccgtccgcaagctgcc

SEQ ID NO: 49328 - DNA, 110 bp, Homo sapiens
  chr3:142837870-142837980
  hyper
cccaattccagaggacgtcaatcacagtggacgcagcaccgcgagcggaaatgcggagagcatcggggctccgcatgtggggcacaatgaaacaagagcagccccggcca

SEQ ID NO: 49329 - DNA, 142 bp, Homo sapiens; identical to SEQ ID NO: 18189
  chr3:142838479-142838621
  hyper

SEQ ID NO: 49330 - DNA, 37 bp, Homo sapiens
  chr3:142839036-142839073
  hyper
atataagccgcccccagccatcgcccccagccggctt

SEQ ID NO: 49331 - DNA, 322 bp, Homo sapiens; identical to SEQ ID NO: 28452
  chr3:142839204-142839526
  hyper

SEQ ID NO: 49332 - DNA, 18 bp, Homo sapiens
  chr3:142840236-142840254
  hyper
ctacgagccagtgtggca

SEQ ID NO: 49333 - DNA, 46 bp, Homo sapiens; identical to SEQ ID NO: 28459
  chr3:143566766-143566812
  hyper

SEQ ID NO: 49334 - DNA, 33 bp, Homo sapiens; identical to SEQ ID NO: 7046
  chr3:145878520-145878553
  hyper

SEQ ID NO: 49335 - DNA, 39 bp, Homo sapiens; identical to SEQ ID NO: 28461
  chr3:147072631-147072670
  hyper

SEQ ID NO: 49336 - DNA, 30 bp, Homo sapiens; identical to SEQ ID NO: 28462
  chr3:147073006-147073036
  hyper

SEQ ID NO: 49337 - DNA, 30 bp, Homo sapiens; identical to SEQ ID NO: 28463
  chr3:147073973-147074003
  hyper

SEQ ID NO: 49338 - DNA, 32 bp, Homo sapiens
  chr3:147075006-147075038
  hyper
gtcttttccgccaggcgcggctccagtttaga

SEQ ID NO: 49339 - DNA, 291 bp, Homo sapiens
  chr3:147076998-147077289
  hyper
cctttctcctcctcccgccaggtgctggagtttttacaccggtgctttgttacttaaggagaaaaactgcctgcatggtgcaggatgctgaaggggagacagaaagagaaggtctggcggcctgggggcggccatgcgtgtagccctccccggtatgtttttgtgcacagagttggcgccagggcagcgccccagaccccagtcctggctggacaataaatgaccggacagctgcggccgctacaaaggagcccctcgaccgcgtcgctgtttacttagtgtcgggtctga

SEQ ID NO: 49340 - DNA, 58 bp, Homo sapiens
  chr3:147079188-147079246
  hyper
tctaatggggctagtggcctcaaatgggagatgcatcttgacacgaaaacaatcccta

SEQ ID NO: 49341 - DNA, 309 bp, Homo sapiens
  chr3:147087253-147087562
  hyper
cttccctacgttcagcgaatacagggcatcactttccagtgaaatatgcctcccccaccaatatatctacaccgtctcccacagataatgccagttatttttccagcccctaaaaaaaaatacaaatgatttcaagtggatgtcaacttgagcaactcggaagtggaatatttttagggttaaacaaacgtgcgcacgcaccaaccggtagggtttactctgcatcaatagtcatttggcaagaaccaatggctgagtttttgcaaatcgtccatttaaaggaatagtttttttcccttgataaacccc

SEQ ID NO: 49342 - DNA, 30 bp, Homo sapiens; identical to SEQ ID NO: 28468
  chr3:147087807-147087837
  hyper

SEQ ID NO: 49343 - DNA, 19 bp, Homo sapiens
  chr3:147088421-147088440
  hyper
tcgggagactttgctcgtt

SEQ ID NO: 49344 - DNA, 256 bp, Homo sapiens; identical to SEQ ID NO: 28471
  chr3:147090427-147090683
  hyper

SEQ ID NO: 49345 - DNA, 98 bp, Homo sapiens; identical to SEQ ID NO: 28472
  chr3:147096028-147096126
  hyper

SEQ ID NO: 49346 - DNA, 52 bp, Homo sapiens
  chr3:147098379-147098431
  hyper
agccagggcaacaagcgtgtcccccattgacaaggagccctattcagactgc

SEQ ID NO: 49347 - DNA, 217 bp, Homo sapiens
  chr3:147098470-147098687
  hyper
aaggttgttggagattagtgttcagccctaataactaaagcgcttgatttacattggaaaaaagccccctcagccgtgaaaacaaaatctttgaacgcgtgatcattgcgagggcggctgatatcctaatacgtgcattgttctcggcctggcccaggcgcgccccggcctccttaggaagggcaaggcctgggctgctggccgtggaccaggtccc

SEQ ID NO: 49348 - DNA, 35 bp, Homo sapiens; identical to SEQ ID NO: 28474
  chr3:147102662-147102697
  hyper

SEQ ID NO: 49349 - DNA, 30 bp, Homo sapiens; identical to SEQ ID NO: 28475
  chr3:147103192-147103222
  hyper

SEQ ID NO: 49350 - DNA, 15 bp, Homo sapiens
  chr3:147105883-147105898
  hyper
taaacgtgggcaagt

SEQ ID NO: 49351 - DNA, 54 bp, Homo sapiens
  chr3:147108787-147108841
  hyper
ccgacgagggcgacacgagggcagacggtgtagccgaatcgtagccagagctgg

SEQ ID NO: 49352 - DNA, 105 bp, Homo sapiens; identical to SEQ ID NO: 28478
  chr3:147110010-147110115
  hyper

SEQ ID NO: 49353 - DNA, 42 bp, Homo sapiens; identical to SEQ ID NO: 18200
  chr3:147110683-147110725
  hyper

SEQ ID NO: 49354 - DNA, 60 bp, Homo sapiens
  chr3:147111089-147111149
  hyper
ggccaggtgaggccgcgccccagcttgctccggagctgcaggaggcgccctggtctctgc

SEQ ID NO: 49355 - DNA, 365 bp, Homo sapiens; identical to SEQ ID NO: 28481
  chr3:147111965-147112330
  hyper

SEQ ID NO: 49356 - DNA, 39 bp, Homo sapiens; identical to SEQ ID NO: 7062
  chr3:147114179-147114218
  hyper

SEQ ID NO: 49357 - DNA, 45 bp, Homo sapiens; identical to SEQ ID NO: 18204
  chr3:147126992-147127037
  hyper

SEQ ID NO: 49358 - DNA, 138 bp, Homo sapiens
  chr3:147127067-147127205
  hyper
cgcaccaatgggcgccagcgtcggcagcacgtgacacctcccccctgctcccattcatcaagggggggacggtgtcgtcctttcaattcatttatctgcaggaatgattgctgctatcagtctcgcgctcaccgcccg

SEQ ID NO: 49359 - DNA, 5 bp, Homo sapiens
  chr3:147127676-147127681
  hyper
gcagc

SEQ ID NO: 49360 - DNA, 11 bp, Homo sapiens
  chr3:147127902-147127913
  hyper
ctcctggacgc

SEQ ID NO: 49361 - DNA, 68 bp, Homo sapiens
  chr3:147136863-147136931
  hyper
tagggggtgcaacagcgagacttccccacaacacctccaccgaaggctgggtcgtcagcgtttgaggg

SEQ ID NO: 49362 - DNA, 207 bp, Homo sapiens
  chr3:147137164-147137371
  hyper
tgtttgttttcaaaccgcgctggtttaagtgagttcacactgcggagccgacagcagagggtagagcaacctggggctgctgccattggaacggcgagttgagcgggcctgtcagggcctctccgccgagggccgggggctgcatggtgctcgagccccagccggccacaccccagtgcatcgggtggctgggcttccagtttacac

SEQ ID NO: 49363 - DNA, 89 bp, Homo sapiens; identical to SEQ ID NO: 28487
  chr3:147137428-147137517
  hyper

SEQ ID NO: 49364 - DNA, 143 bp, Homo sapiens; identical to SEQ ID NO: 18207
  chr3:147138856-147138999
  hyper

SEQ ID NO: 49365 - DNA, 124 bp, Homo sapiens
  chr3:147139250-147139374
  hyper
cgtagacctccccaaattgcccgtctccggtatgactgaatctgtctgctggcctctcagctaccaactctgcccgaaatctagatcccagacctggtaagtcgcgttcctcccctaccccgcc

SEQ ID NO: 49366 - DNA, 43 bp, Homo sapiens
  chr3:147139528-147139571
  hyper
aggaatgtcgcggggctccccagtgaggcgggagcgaaaagag

SEQ ID NO: 49367 - DNA, 127 bp, Homo sapiens; identical to SEQ ID NO: 28490
  chr3:147141097-147141224
  hyper

SEQ ID NO: 49368 - DNA, 87 bp, Homo sapiens; identical to SEQ ID NO: 18209
  chr3:148415340-148415427
  hyper

SEQ ID NO: 49369 - DNA, 196 bp, Homo sapiens
  chr3:148415644-148415840
  hyper
agcaacgcccctcactataaattcggagctgcctcctcgccaatgattccagcgcctgacagccaggaccccaggcagcagcgagtgacaggacgtctggaccggcgcgccgctagcagctctgccgggccgcggcggtgatcgatggggagcggctggagcggacccagcgagtgagggcgcacagccgggacgc

SEQ ID NO: 49370 - DNA, 194 bp, Homo sapiens; identical to SEQ ID NO: 28492
  chr3:148415861-148416055
  hyper

SEQ ID NO: 49371 - DNA, 30 bp, Homo sapiens; identical to SEQ ID NO: 28493
  chr3:148943086-148943116
  hyper

SEQ ID NO: 49372 - DNA, 383 bp, Homo sapiens
  chr3:149375023-149375406
  hyper
ggtcctgcgtgacgtggatcacttgctgcccaggcggcgggagcggagggggcgccgaggccggattcatcttctgcaaaaagaaggtcagatcagccttttatttaaagtcggaggaagtgggtaagagggttacagggtgagagggcgagatggtgggagaaagaatagagggaaaaggaaacgaggagacagataattgcccgcctggagatcccagacactcagcggtaagaccagcaggatgggggaggggtccctcctggcctcgagaattatgcaactttcttgaagcaaagaagttgcctggaggaggagaagatagggcgaggggtggagggaataactgcactcggggcttgctgaaccgcaggatggcaaag

SEQ ID NO: 49373 - DNA, 94 bp, Homo sapiens
  chr3:150802887-150802981
  hyper
agggtacagtaagaccgtggaaggttgtaaggaccagagattctgactatcaagatcctggcacgtagcgaaggctccataaatggcagccatc

SEQ ID NO: 49374 - DNA, 584 bp, Homo sapiens
  chr3:150803080-150803664
  hyper
cgcgccaggtggcccagcatcttggtgcccgcgccccgaagcgaggagcgagggcgggttggatgaccaaggtctgccctggaggatcaccccccccgccccttccacgctcccggcgcaggtgaggttttcggcccaggccacggggaccgcgacctctggggaggtcgaggcggagggtgcagcggggggcttggagcagggctccagagggcgctccctccctcgcccaggttcaccccagggccagcctcggcgccggggcccgcgggctgcgcgctctgcggctgcgaaaacccggagaggcggattggagcgcgctcaccgcgctctcagccaactcctccgcggtccggccgccgagctgggcatgctcagtgcggacgccgcgccgccgtccgccaactcggaagctcgcgctcccgggccgtgggggcgagaacgccggcggcgagccggcgtcgctcgccgcccccagacagtggcaaacttcgcggcgttcccggagctcgtccgggcgaggcagataccgcacaaataaaatcaaatccaagtcccccatcccaacccgaatgatggaggct

SEQ ID NO: 49375 - DNA, 153 bp, Homo sapiens
  chr3:150803890-150804043
  hyper
tcggccccacgccaccgtgagcacggccccctccagccgccgcgaccgccagcagcgcgcctcggcgcctgcccggagccgccgaggggaccgtagctgcggatgcgccactggaacctggcgggcgtctaggaggcaccggccgcttcccac

SEQ ID NO: 49376 - DNA, 2 bp, Homo sapiens
  chr3:150804077-150804079
  hyper
cc

SEQ ID NO: 49377 - DNA, 433 bp, Homo sapiens; identical to SEQ ID NO: 28498
  chr3:150804463-150804896
  hyper

SEQ ID NO: 49378 - DNA, 31 bp, Homo sapiens; identical to SEQ ID NO: 18217
  chr3:150804936-150804967
  hyper

SEQ ID NO: 49379 - DNA, 22 bp, Homo sapiens
  chr3:150805030-150805052
  hyper
tgccggtcgctttcccgttgcc

SEQ ID NO: 49380 - DNA, 489 bp, Homo sapiens; identical to SEQ ID NO: 28500
  chr3:152552388-152552877
  hyper

SEQ ID NO: 49381 - DNA, 68 bp, Homo sapiens; identical to SEQ ID NO: 18219
  chr3:152553275-152553343
  hyper

SEQ ID NO: 49382 - DNA, 274 bp, Homo sapiens
  chr3:152553384-152553658
  hyper
ggcccgcggcgaacgcggggccagagctggcgtgggcgagcccctgcgcgccccctcccgcggggatccagttcgcctgctcccttccgctcgctggcttttccgatgcttgctgcgcccctggccgccgctgccctctcgccgcctcctacccctcggagccgccgcctaagtcgaggaggagagaatgaccgaggtgctgtggccggctgtccccaacgggacggacgctgccttcctggccggtccgggttcgtcctgggggaacagcacg

SEQ ID NO: 49383 - DNA, 124 bp, Homo sapiens
  chr3:153838870-153838994
  hyper
cagggcttcctaagctgcaattcagcagggctcccttgcttgttctcactctgtgcccccggcaacgaccccgcgcgcctacactcccgtgccgcctcagctactagtccgcaacttctagccc

SEQ ID NO: 49384 - DNA, 225 bp, Homo sapiens; identical to SEQ ID NO: 28504
  chr3:154145627-154145852
  hyper

SEQ ID NO: 49385 - DNA, 112 bp, Homo sapiens
  chr3:154146542-154146654
  hyper
aggcttcagccccagcggcagcgggcgcacccggtccgaacacggtgtcggagctcggagagcatcccccagagcgccgcagactcgggcctggagcatcctctggggacag

SEQ ID NO: 49386 - DNA, 70 bp, Homo sapiens
  chr3:154146908-154146978
  hyper
ccgagagcagcagactggctgcccacacggtcagcaccacgccgagcacctggcccgatcttctggaggc

SEQ ID NO: 49387 - DNA, 75 bp, Homo sapiens; identical to SEQ ID NO: 18223
  chr3:154797703-154797778
  hyper

SEQ ID NO: 49388 - DNA, 184 bp, Homo sapiens; identical to SEQ ID NO: 7082
  chr3:154797835-154798019
  hyper

SEQ ID NO: 49389 - DNA, 158 bp, Homo sapiens; identical to SEQ ID NO: 18225
  chr3:156009425-156009583
  hyper

SEQ ID NO: 49390 - DNA, 30 bp, Homo sapiens; identical to SEQ ID NO: 7085
  chr3:156009875-156009905
  hyper

SEQ ID NO: 49391 - DNA, 30 bp, Homo sapiens; identical to SEQ ID NO: 28513
  chr3:157155701-157155731
  hyper

SEQ ID NO: 49392 - DNA, 83 bp, Homo sapiens; identical to SEQ ID NO: 28515
  chr3:157261119-157261202
  hyper

SEQ ID NO: 49393 - DNA, 42 bp, Homo sapiens
  chr3:157812154-157812196
  hyper
aagaggaggcaagggcgccgcgagctccccggatgcactggt

SEQ ID NO: 49394 - DNA, 140 bp, Homo sapiens; identical to SEQ ID NO: 28519
  chr3:157813465-157813605
  hyper

SEQ ID NO: 49395 - DNA, 79 bp, Homo sapiens
  chr3:157820497-157820576
  hyper
tggctcagttcctctcgcatgaaggcgtcgggatagtgggtctcgtcaaaaagcctctccagctcattgagttgttcca

SEQ ID NO: 49396 - DNA, 264 bp, Homo sapiens
  chr3:157820605-157820869
  hyper
ttgattttggtctggccttcgtcctccatccctttcgcatcctctttgcgatctttcagctccggggacactggagggggcaccccagcggggccacacgtgcatccacacgaacacacacacacacgcacacacacacggacgaaaacagcacagcaaatcctgttaccagatttgtcgcaaaaaagaatagagaatccttccccctcgtggaatcctggtccggcttctcaacccacccggaggaagaatatcccggagaag

SEQ ID NO: 49397 - DNA, 30 bp, Homo sapiens; identical to SEQ ID NO: 28523
  chr3:157822056-157822086
  hyper

SEQ ID NO: 49398 - DNA, 15 bp, Homo sapiens
  chr3:157822865-157822880
  hyper
gcccgggagaagcag

SEQ ID NO: 49399 - DNA, 62 bp, Homo sapiens
  chr3:157823011-157823073
  hyper
cgaccggagggttaagctttccacctctgccccttctccctcccggcaaactctgcgctaga

SEQ ID NO: 49400 - DNA, 321 bp, Homo sapiens
  chr3:157823143-157823464
  hyper
gcctgcgggccatccgggctgcgggcccatcctcccgctggtgaaaaatgcatttcggtggaatgggaacatctgggaagggcgcgcacaaaccccacacgcttccccccacgccacccccacaacacactaggaccccacccatgaccgagcataccaccggacccccacccttccactatcactctagctgacaaagctggggtccagggccctctccgtgtccctctcccctccccgctgggcctcggagtcctctcccgcccgagaggagtccggaaggcgggaaggggaaccgctgccgggggtcagtcaggtcgt

SEQ ID NO: 49401 - DNA, 381 bp, Homo sapiens
  chr3:157823493-157823874
  hyper
tccctgcttctctcggcggcgcccatgtccagctcccggacgggagagcgccctcctccagctcctccgcctgctcctcctcctcctacacctcctccgcctcctccgccgccgcctccgcctcctccgccgccgcctccgccggccgcccggactgccgggctgctgcggtcgtcgcggcccgcctcggtgcagccggtcggctccttggccccgcgcagcggcccgctctccagcacctcccggtacgtgatcgcctccttcttctccttcactttctggtcaaaagacttggagacgaacgccgtaagttcttccatcgccgccgcacgtcagcccggcgctcaacctctgccagcagagccccgctctttttttcct

SEQ ID NO: 49402 - DNA, 30 bp, Homo sapiens; identical to SEQ ID NO: 28527
  chr3:157824303-157824333
  hyper

SEQ ID NO: 49403 - DNA, 38 bp, Homo sapiens; identical to SEQ ID NO: 18232
  chr3:157824871-157824909
  hyper

SEQ ID NO: 49404 - DNA, 117 bp, Homo sapiens
  chr3:157825059-157825176
  hyper
cgctctattattcgtgtcctggagcccagctgactcctctatggacagaccccgctaaaagggaccagtcgatttaacaagtttccccagcagctgttagctgacagatctcatttt

SEQ ID NO: 49405 - DNA, 92 bp, Homo sapiens; identical to SEQ ID NO: 7099
  chr3:158288920-158289012
  hyper

SEQ ID NO: 49406 - DNA, 230 bp, Homo sapiens; identical to SEQ ID NO: 28531
  chr3:158449969-158450199
  hyper

SEQ ID NO: 49407 - DNA, 37 bp, Homo sapiens
  chr3:159756650-159756687
  hyper
ccgccctttctcctccgtggctccccagccaggaggc

SEQ ID NO: 49408 - DNA, 41 bp, Homo sapiens
  chr3:159756856-159756897
  hyper
gaagactcggcgagcttttgtagccgcgggtagggacagcc

SEQ ID NO: 49409 - DNA, 300 bp, Homo sapiens; identical to SEQ ID NO: 28533
  chr3:159943920-159944220
  hyper

SEQ ID NO: 49410 - DNA, 49 bp, Homo sapiens; identical to SEQ ID NO: 18234
  chr3:159944437-159944486
  hyper

SEQ ID NO: 49411 - DNA, 57 bp, Homo sapiens
  chr3:159944546-159944603
  hyper
ctgaggagaaaggaccgcagttccactcctttccctacctgccgcctggacaggtct

SEQ ID NO: 49412 - DNA, 185 bp, Homo sapiens; identical to SEQ ID NO: 28535
  chr3:160167683-160167868
  hyper

SEQ ID NO: 49413 - DNA, 109 bp, Homo sapiens; identical to SEQ ID NO: 28536
  chr3:160822766-160822875
  hyper

SEQ ID NO: 49414 - DNA, 217 bp, Homo sapiens; identical to SEQ ID NO: 28537
  chr3:161090326-161090543
  hyper

SEQ ID NO: 49415 - DNA, 137 bp, Homo sapiens; identical to SEQ ID NO: 28538
  chr3:164911621-164911758
  hyper

SEQ ID NO: 49416 - DNA, 512 bp, Homo sapiens
  chr3:164913872-164914384
  hyper
agcccttgcttttccagggtgtctttgctctttgccctttaggtgggtgggagtgggggttggtggcgtgtagatgagagaagaaaagggtggggagaggcggaaaggaggcaggaagggggcgactagatctcagatcccagcattggtcagacggcgaaggtggggggaaagaaggagagggggagagaagatacaaatacacagtatggctgtgcacaccaaattccacttggatttgggagatctcaggcaaagcacgaaggtgaagcgataccgttggcagagagtgagtcctctgaccgctcaccattcaagcaccctcacttctcgagcgggagaaggtgcgggggaggggggtgggagggggaggggactgctgaacgtttcaggccaaggagacgctcgcggcggcggcggcggcggcatcttttaagactgacctgctttaaaagtgccactttaatggcctaggaaataactaaaatcggattacacgttacttaccaacg

SEQ ID NO: 49417 - DNA, 184 bp, Homo sapiens
  chr3:164914796-164914980
  hyper
cctctcccccattatcggtcacaacctggcagctcttcaagagacaccctgtgaaattgagtgtcgggaagtcagcattctgtacccgtggattgatttgtaacttttatttgcaaatgagagagatgcctgtttggaaaattacagcccaaaaggtggagggtgatcaaattaagaacatctg

SEQ ID NO: 49418 - DNA, 116 bp, Homo sapiens; identical to SEQ ID NO: 18237
  chr3:164915129-164915245
  hyper

SEQ ID NO: 49419 - DNA, 30 bp, Homo sapiens; identical to SEQ ID NO: 7107
  chr3:167097947-167097977
  hyper

SEQ ID NO: 49420 - DNA, 66 bp, Homo sapiens; identical to SEQ ID NO: 28544
  chr3:167967494-167967560
  hyper

SEQ ID NO: 49421 - DNA, 384 bp, Homo sapiens; identical to SEQ ID NO: 28545
  chr3:167967946-167968330
  hyper

SEQ ID NO: 49422 - DNA, 47 bp, Homo sapiens; identical to SEQ ID NO: 28546
  chr3:168864015-168864062
  hyper

SEQ ID NO: 49423 - DNA, 30 bp, Homo sapiens; identical to SEQ ID NO: 28547
  chr3:168960419-168960449
  hyper

SEQ ID NO: 49424 - DNA, 149 bp, Homo sapiens; identical to SEQ ID NO: 28548
  chr3:169375895-169376044
  hyper

SEQ ID NO: 49425 - DNA, 30 bp, Homo sapiens; identical to SEQ ID NO: 28549
  chr3:169376305-169376335
  hyper

SEQ ID NO: 49426 - DNA, 78 bp, Homo sapiens
  chr3:169376602-169376680
  hyper
ggttctccatctcaccgcccgcttccagcggaggcaacgcgcaggggggtgccgggagagagggggccgagccgggcg

SEQ ID NO: 49427 - DNA, 210 bp, Homo sapiens; identical to SEQ ID NO: 28551
  chr3:169379435-169379645
  hyper

SEQ ID NO: 49428 - DNA, 42 bp, Homo sapiens; identical to SEQ ID NO: 28552
  chr3:169386544-169386586
  hyper

SEQ ID NO: 49429 - DNA, 64 bp, Homo sapiens; identical to SEQ ID NO: 28553
  chr3:169483001-169483065
  hyper

SEQ ID NO: 49430 - DNA, 428 bp, Homo sapiens; identical to SEQ ID NO: 28554
  chr3:169529973-169530401
  hyper

SEQ ID NO: 49431 - DNA, 107 bp, Homo sapiens; identical to SEQ ID NO: 7111
  chr3:170136940-170137047
  hyper

SEQ ID NO: 49432 - DNA, 73 bp, Homo sapiens
  chr3:170302544-170302617
  hyper
ctaccttgcccccagcgctctcctagaccctatacctagggggaggcagggtgacatcctgcggcccttgggc

SEQ ID NO: 49433 - DNA, 58 bp, Homo sapiens
  chr3:170303029-170303087
  hyper
agcttccctggacaccgctcccgtcacgtcctcttcgccgctcccgggagagtcacca

SEQ ID NO: 49434 - DNA, 14 bp, Homo sapiens
  chr3:170303129-170303143
  hyper
cggggtgctgggct

SEQ ID NO: 49435 - DNA, 72 bp, Homo sapiens
  chr3:170303423-170303495
  hyper
gcgagtcagagcccggtgcccccagaccgcgggcagtcggggcctcattccgggccagagcaggaaagagcc

SEQ ID NO: 49436 - DNA, 71 bp, Homo sapiens
  chr3:170303844-170303915
  hyper
gctcctcaattattcagattgggcccccaccccccgaacccctccccgtgcctgctcgtcctccctccagc

SEQ ID NO: 49437 - DNA, 346 bp, Homo sapiens; identical to SEQ ID NO: 28560
  chr3:170625828-170626174
  hyper

SEQ ID NO: 49438 - DNA, 63 bp, Homo sapiens; identical to SEQ ID NO: 28561
  chr3:170626617-170626680
  hyper

SEQ ID NO: 49439 - DNA, 11 bp, Homo sapiens
  chr3:172165432-172165443
  hyper
gttctggtccc

SEQ ID NO: 49440 - DNA, 33 bp, Homo sapiens; identical to SEQ ID NO: 28565
  chr3:172166672-172166705
  hyper

SEQ ID NO: 49441 - DNA, 43 bp, Homo sapiens; identical to SEQ ID NO: 28567
  chr3:172167431-172167474
  hyper

SEQ ID NO: 49442 - DNA, 65 bp, Homo sapiens
  chr3:172167595-172167660
  hyper
cgaattcacaaatccgaccggcccctcccggcccaccgacctcgggaccgccccaggaacatatt

SEQ ID NO: 49443 - DNA, 32 bp, Homo sapiens; identical to SEQ ID NO: 28569
  chr3:173113479-173113511
  hyper

SEQ ID NO: 49444 - DNA, 386 bp, Homo sapiens; identical to SEQ ID NO: 28570
  chr3:173114201-173114587
  hyper

SEQ ID NO: 49445 - DNA, 252 bp, Homo sapiens
  chr3:173114985-173115237
  hyper
acagtggaggagattcgccttccgtttctgcataaaaccaatacattttacttggagggtaatttgccagagttgagcgagacgaagccgtgtctaaataagtacatgacactaaatttccttttaaatccaccttttacaccatggccagtcgcttgtttaactcccgttcaagggacacggttttcaaacgtgaccttttggggagatgtgggaacttcccctcatttcttcttctgtgccgctaacctc

SEQ ID NO: 49446 - DNA, 144 bp, Homo sapiens
  chr3:173115550-173115694
  hyper
aggatcaggcggcggcgcggagagcgcgcccgggcggccagcgccgagcgcgcggagctggcgtggggagacacggcaggaaaggcgagtcggagtgggtgatgagaggccgggagagcccgtccgagccggagagaccggaga

SEQ ID NO: 49447 - DNA, 210 bp, Homo sapiens; identical to SEQ ID NO: 7127
  chr3:173115965-173116175
  hyper

SEQ ID NO: 49448 - DNA, 65 bp, Homo sapiens; identical to SEQ ID NO: 18250
  chr3:173302927-173302992
  hyper

SEQ ID NO: 49449 - DNA, 374 bp, Homo sapiens; identical to SEQ ID NO: 18251
  chr3:179169266-179169640
  hyper

SEQ ID NO: 49450 - DNA, 732 bp, Homo sapiens; identical to SEQ ID NO: 28581
  chr3:180397310-180398042
  hyper

SEQ ID NO: 49451 - DNA, 321 bp, Homo sapiens
  chr3:181413421-181413742
  hyper
gacccacccagccgggcccgatccctcaagacactttcagcctcagcccccgtttctcctcgggtttccacagacccaggaaaggacagaggcggcgagcaggctgacaagtttattctagaggctttgaaaaatgaggtttccaggtctcttcgcacgcgcgcgcgcgcgttctcgggctaaaggttcgaagctagagtttgaatttaagccacgtcctgggacaggtcgcgttcagcgtgggcgtcggccccgccgcggccccaggcctcttcgaagtgcgcgtcaagtggggtgtcgggtcgttttgttttttctcta

SEQ ID NO: 49452 - DNA, 73 bp, Homo sapiens
  chr3:181414330-181414403
  hyper
ctctttcttctttcctcctctccttttcccctttctctttttcttcctcaatctaggtcgtttctgctgaatg

SEQ ID NO: 49453 - DNA, 95 bp, Homo sapiens; identical to SEQ ID NO: 28583
  chr3:181419696-181419791
  hyper

SEQ ID NO: 49454 - DNA, 154 bp, Homo sapiens
  chr3:181419911-181420065
  hyper
aaagaatttagcctttaatctctttttatccacgaagactaaagctctgtactcgaccccgcgagcggctctcgccttccggggctggaacccgactcagatgtgaagcggcactgagccgctgcgcaggttcgtgcccagcgccccctgttgg

SEQ ID NO: 49455 - DNA, 200 bp, Homo sapiens; identical to SEQ ID NO: 18258
  chr3:181420116-181420316
  hyper

SEQ ID NO: 49456 - DNA, 112 bp, Homo sapiens
  chr3:181420374-181420486
  hyper
ttttctgtagccgtggagaatcaagcaaagtatacttcctccgttttgtccacatttcaaaaaattaaacggaagatgctgctgcttgctgttttgacgttgtcagcagcgt

SEQ ID NO: 49457 - DNA, 162 bp, Homo sapiens
  chr3:181421249-181421411
  hyper
acctcccaaaattagcgaattcgagataacatttcaaggggaattgctatttagtgcgatgagagatgacttctccatctggttccagaattagatctcggcttaggttttttagtaagtaggttcagatgcaatggaaggagagaagaatcaagccttttg

SEQ ID NO: 49458 - DNA, 103 bp, Homo sapiens
  chr3:181422282-181422385
  hyper
agcttaggcccactgagaccctgccaactcctcagacccttttccccttcatccctcacacctttcatgatgaacccaggaaagaacccgaactctgaaaaac

SEQ ID NO: 49459 - DNA, 190 bp, Homo sapiens; identical to SEQ ID NO: 18261
  chr3:181422985-181423175
  hyper

SEQ ID NO: 49460 - DNA, 75 bp, Homo sapiens
  chr3:181428313-181428388
  hyper
ctattgaaatctttacgtcgggacaatgggagagcggctaaaattaccctcttgggtcctgggcgggcaagattc

SEQ ID NO: 49461 - DNA, 56 bp, Homo sapiens
  chr3:181428772-181428828
  hyper
ccagcccccatttgaaagccgcacgaccgaaacccttcttacggggaggcatggga

SEQ ID NO: 49462 - DNA, 32 bp, Homo sapiens; identical to SEQ ID NO: 28588
  chr3:181430289-181430321
  hyper

SEQ ID NO: 49463 - DNA, 551 bp, Homo sapiens
  chr3:181430771-181431322
  hyper
ctccatgaccagctcgcagacctacatgaacggctcgcccacctacagcatgtcctactcgcagcagggcacccctggcatggctcttggctccatgggttcggtggtcaagtccgaggccagctccagcccccctgtggttacctcttcctcccactccagggcgccctgccaggccggggacctccgggacatgatcagcatgtatctccccggcgccgaggtgccggaacccgccgcccccagcagacttcacatgtcccagcactaccagagcggcccggtgcccggcacggccattaacggcacactgcccctctcacacatgtgagggccggacagcgaactggaggggggagaaattttcaaagaaaaacgagggaaatgggaggggtgcaaaagaggagagtaagaaacagcatggagaaaacccggtacgctcaaaaagaaaaaggaaaaaaaaaaatcccatcacccacagcaaatgacagctgcaaaagagaacaccaatcccatccacactcacgcaaaaaccgcgatgccgacaagaa

SEQ ID NO: 49464 - DNA, 181 bp, Homo sapiens
  chr3:181437349-181437530
  hyper
atggggctccccaagaaggtgctgtgtggggctcgagttctctctgcccgggctctgctcaaacggtcgcattccctctccctcaggcaccgacccgcgtcagacaagtctagaaagtctcccgaggcgttggggccctcaccactccagagtcctctgcctcctgcgccccagcccaagc

SEQ ID NO: 49465 - DNA, 27 bp, Homo sapiens
  chr3:181438167-181438194
  hyper
gtattaaataaggagcggtgaattctt

SEQ ID NO: 49466 - DNA, 70 bp, Homo sapiens; identical to SEQ ID NO: 18265
  chr3:181438353-181438423
  hyper

SEQ ID NO: 49467 - DNA, 30 bp, Homo sapiens; identical to SEQ ID NO: 7147
  chr3:181440785-181440815
  hyper

SEQ ID NO: 49468 - DNA, 218 bp, Homo sapiens
  chr3:181441927-181442145
  hyper
actcctaccccctttgctcacaggtacacttgtgtggaaattgcctcttccgtagttcttataaactcctcccagacaggcagaattctcagagcatcggaaccagggaacttgcagggaaccagggaaggtttgcactgtttgggattaattgagaataattaacactggagccgttaatcaccactttgctgctctctccctcctttcgggtctgc

SEQ ID NO: 49469 - DNA, 16 bp, Homo sapiens
  chr3:181442410-181442426
  hyper
tttctagacagtgttg

SEQ ID NO: 49470 - DNA, 51 bp, Homo sapiens
  chr3:181442963-181443014
  hyper
ctggaagagcacatgaaactcagagaactacaatgcagacgacaacgccta

SEQ ID NO: 49471 - DNA, 58 bp, Homo sapiens
  chr3:181444050-181444108
  hyper
cataattatgcactgcagattctccagcctcctcgccctcaatcttggtaacctggtc

SEQ ID NO: 49472 - DNA, 356 bp, Homo sapiens; identical to SEQ ID NO: 18268
  chr3:181445013-181445369
  hyper

SEQ ID NO: 49473 - DNA, 261 bp, Homo sapiens
  chr3:181445464-181445725
  hyper
tttgcaattgctcacccctccctgcccccaaccaccctgcttactttcgcgaagcgcattaggatgtgggctctggcttgagctccaaaatagcttgcttgtcaattgcgagctgcagcaatatcaaagtgaactgtcccaagtaactcttgtctagaagctgggaagaagcttaagcagctcgctttaatgatgatttgtagctcggcgaggggcacggacagcaaacaccccgcaggtgtgtgccgtaacaccatcatc

SEQ ID NO: 49474 - DNA, 30 bp, Homo sapiens; identical to SEQ ID NO: 28603
  chr3:182896611-182896641
  hyper

SEQ ID NO: 49475 - DNA, 224 bp, Homo sapiens; identical to SEQ ID NO: 28604
  chr3:182896884-182897108
  hyper

SEQ ID NO: 49476 - DNA, 313 bp, Homo sapiens; identical to SEQ ID NO: 28605
  chr3:182897157-182897470
  hyper

SEQ ID NO: 49477 - DNA, 110 bp, Homo sapiens; identical to SEQ ID NO: 28606
  chr3:182971127-182971237
  hyper

SEQ ID NO: 49478 - DNA, 41 bp, Homo sapiens; identical to SEQ ID NO: 18272
  chr3:183145371-183145412
  hyper

SEQ ID NO: 49479 - DNA, 55 bp, Homo sapiens; identical to SEQ ID NO: 28608
  chr3:183948534-183948589
  hyper

SEQ ID NO: 49480 - DNA, 78 bp, Homo sapiens; identical to SEQ ID NO: 28609
  chr3:183978018-183978096
  hyper

SEQ ID NO: 49481 - DNA, 522 bp, Homo sapiens; identical to SEQ ID NO: 28610
  chr3:183980079-183980601
  hyper

SEQ ID NO: 49482 - DNA, 37 bp, Homo sapiens; identical to SEQ ID NO: 28611
  chr3:183993816-183993853
  hyper

SEQ ID NO: 49483 - DNA, 374 bp, Homo sapiens; identical to SEQ ID NO: 28612
  chr3:184243074-184243448
  hyper

SEQ ID NO: 49484 - DNA, 169 bp, Homo sapiens; identical to SEQ ID NO: 28613
  chr3:184301502-184301671
  hyper

SEQ ID NO: 49485 - DNA, 205 bp, Homo sapiens
  chr3:184319891-184320096
  hyper
cattttggccggggaatctgtgtaaagtgtttaaaaagaaaaactctccggaggaggacgtaaccttttcttaacatctggggctcaattagctaatgacagcaaagccttctccggtgtcgctgacccctgggcggcagcccagctcccccacccccggtatttatacagctgcggcccctcgctgggacggggggcagggggc

SEQ ID NO: 49486 - DNA, 95 bp, Homo sapiens; identical to SEQ ID NO: 28616
  chr3:184321779-184321874
  hyper

SEQ ID NO: 49487 - DNA, 47 bp, Homo sapiens; identical to SEQ ID NO: 28617
  chr3:184322209-184322256
  hyper

SEQ ID NO: 49488 - DNA, 46 bp, Homo sapiens; identical to SEQ ID NO: 28618
  chr3:184870261-184870307
  hyper

SEQ ID NO: 49489 - DNA, 262 bp, Homo sapiens; identical to SEQ ID NO: 28619
  chr3:184871031-184871293
  hyper

SEQ ID NO: 49490 - DNA, 43 bp, Homo sapiens; identical to SEQ ID NO: 28620
  chr3:185543626-185543669
  hyper

SEQ ID NO: 49491 - DNA, 60 bp, Homo sapiens; identical to SEQ ID NO: 28621
  chr3:185544035-185544095
  hyper

SEQ ID NO: 49492 - DNA, 43 bp, Homo sapiens
  chr3:186078723-186078766
  hyper
agtccgaggaggcagcggcgcagcgcgggagagcgcgcccacg

SEQ ID NO: 49493 - DNA, 306 bp, Homo sapiens
  chr3:186078898-186079204
  hyper
ccatctgggaggtggttctagctctagtcccaagctttccactgcagtgatggtggggatgggggcagcacgtcaaatcacctgtagggctttttagaactccacagccccctcccctaattctattccactagttcaaacgaagaaaatctcagactaggcaaggggaggtggaccggtggagtctgcgaaagcaccacaggtgactccgggtacgcactcctcaggacacaagcacacacacggacacatcttgtgactctgagactacacagatcaacctcagattcgacccttccctccttt

SEQ ID NO: 49494 - DNA, 104 bp, Homo sapiens; identical to SEQ ID NO: 7167
  chr3:186079667-186079771
  hyper

SEQ ID NO: 49495 - DNA, 370 bp, Homo sapiens
  chr3:186079818-186080188
  hyper
cgagagacagaagggggaccgaagctggcctctgggcgtcttcccgcctgcgcagccctctcgggggagggggatgcagccccagtgggtgccgcggagaccaggctgccaggctgtggttggtagcgccggggtcttcaccctgtgctcggagttcagcagctccaaagctgtctatctccgtggcccgctactacggcactgcggctctgtgccctgcccctcgcagcctggcaagtccagctgccactctcactgcggagccctgcccccgggcgcagagcccgcccccgccacacacaccggcgcgcgcgcgtacacacacggcacacacagacacgcgcttccacacatgcacacgcgtgcgcac

SEQ ID NO: 49496 - DNA, 27 bp, Homo sapiens
  chr3:186080218-186080245
  hyper
tgaccccctttggtgcaactagggcgc

SEQ ID NO: 49497 - DNA, 49 bp, Homo sapiens; identical to SEQ ID NO: 7169
  chr3:186080246-186080295
  hyper

SEQ ID NO: 49498 - DNA, 102 bp, Homo sapiens
  chr3:186857050-186857152
  hyper
tgcaagggcctggggcgcgggcggaaaaggcgggcccagctccctcaggtctgcgtgtcaccgacccgaacccgctccgtcgtcctgacgcccccggcctag

SEQ ID NO: 49499 - DNA, 107 bp, Homo sapiens
  chr3:186857607-186857714
  hyper
ggaaccgccaatgcctccagggggcgctctccctcccatcgagccaccgccgggccattggagaccaggaggacctctcagctccatccctgcgtctctaacaattg

SEQ ID NO: 49500 - DNA, 59 bp, Homo sapiens; identical to SEQ ID NO: 18284
  chr3:187387791-187387850
  hyper

SEQ ID NO: 49501 - DNA, 1255 bp, Homo sapiens; identical to SEQ ID NO: 28629
  chr3:187455388-187456643
  hyper

SEQ ID NO: 49502 - DNA, 542 bp, Homo sapiens; identical to SEQ ID NO: 28630
  chr3:187457112-187457654
  hyper

SEQ ID NO: 49503 - DNA, 329 bp, Homo sapiens; identical to SEQ ID NO: 28631
  chr3:189838508-189838837
  hyper

SEQ ID NO: 49504 - DNA, 39 bp, Homo sapiens; identical to SEQ ID NO: 28632
  chr3:190039913-190039952
  hyper

SEQ ID NO: 49505 - DNA, 48 bp, Homo sapiens; identical to SEQ ID NO: 28633
  chr3:190529604-190529652
  hyper

SEQ ID NO: 49506 - DNA, 107 bp, Homo sapiens; identical to SEQ ID NO: 28634
  chr3:190580805-190580912
  hyper

SEQ ID NO: 49507 - DNA, 97 bp, Homo sapiens; identical to SEQ ID NO: 18289
  chr3:192126863-192126960
  hyper

SEQ ID NO: 49508 - DNA, 393 bp, Homo sapiens
  chr3:192126961-192127354
  hyper
ctctttctctttccgcttgctttccggcacgagacgggcacagttggtgattatttagggaatcctaaatctggaatgactcagtagtttaaataagccccctcaaaaggcagcgatgccgaaggtgtcctctccagctcggcgcccacacgcctttaactggagctccccgccatggtccacccggggccgccgcaccgagctggtctccgcacaggctcagagggagcgagggaagggagggaaggaaggggcgccctggcgggctcgggatcaggtcatcgccgcgctgctgcccgtgccccctaggctcgcgcgccccggcagtcagcagctcacaggcagcagatcagatggggattacccgccggacgcaaggccgatcactcagtc

SEQ ID NO: 49509 - DNA, 66 bp, Homo sapiens
  chr3:192128074-192128140
  hyper
tcctctctgtgtcttctgtctctccccttttctcctctctacgcaatcctacgtgattgaggtttg

SEQ ID NO: 49510 - DNA, 201 bp, Homo sapiens; identical to SEQ ID NO: 28642
  chr3:192231876-192232077
  hyper

SEQ ID NO: 49511 - DNA, 19 bp, Homo sapiens
  chr3:192232078-192232097
  hyper
agcaacttttcggagacac

SEQ ID NO: 49512 - DNA, 245 bp, Homo sapiens; identical to SEQ ID NO: 28644
  chr3:192232574-192232819
  hyper

SEQ ID NO: 49513 - DNA, 379 bp, Homo sapiens
  chr3:192233150-192233529
  hyper
agggggtggggtagggaggcggggacgtggaataaagaaagctcctgggtgccggctatgagaagtcaggtgtgcgtaggcgtggacagagtgccgatgtgggagtctggacacctggattttctggtcggggctctgtgtccttgggtaagtcacttaccaccctgggcgtctccccgtcaatctgggtggggaagagggtgtgagatagaggattggcagcggcgtgcttgtttgtccccgtgcctttcaggctcctagaaaagcttagcataggtgcagtgggaagtggagctagaagggacagagggagaggaggcaggtgaggcgagaaatctgaagacaaaagagcgcttcgctttggcgccagtattctggc

SEQ ID NO: 49514 - DNA, 30 bp, Homo sapiens; identical to SEQ ID NO: 28647
  chr3:192445447-192445477
  hyper

SEQ ID NO: 49515 - DNA, 136 bp, Homo sapiens; identical to SEQ ID NO: 28648
  chr3:192634345-192634481
  hyper

SEQ ID NO: 49516 - DNA, 32 bp, Homo sapiens; identical to SEQ ID NO: 28649
  chr3:192959076-192959108
  hyper

SEQ ID NO: 49517 - DNA, 13 bp, Homo sapiens
  chr3:193776076-193776089
  hyper
cggttcctctgca

SEQ ID NO: 49518 - DNA, 60 bp, Homo sapiens; identical to SEQ ID NO: 18297
  chr3:193776119-193776179
  hyper

SEQ ID NO: 49519 - DNA, 69 bp, Homo sapiens; identical to SEQ ID NO: 28651
  chr3:193776392-193776461
  hyper

SEQ ID NO: 49520 - DNA, 33 bp, Homo sapiens; identical to SEQ ID NO: 28652
  chr3:194208225-194208258
  hyper

SEQ ID NO: 49521 - DNA, 23 bp, Homo sapiens
  chr3:194208562-194208585
  hyper
cttcttgccgctacttacagaac

SEQ ID NO: 49522 - DNA, 216 bp, Homo sapiens; identical to SEQ ID NO: 28654
  chr3:194407566-194407782
  hyper

SEQ ID NO: 49523 - DNA, 98 bp, Homo sapiens
  chr3:194409021-194409119
  hyper
ggctctgttgcgcgtggggatgcggggagatttgagaggggaaaaccccgccaggagggagagagaggcacccctctgggatgcgggtgagggaaggt

SEQ ID NO: 49524 - DNA, 95 bp, Homo sapiens; identical to SEQ ID NO: 28657
  chr3:195474927-195475022
  hyper

SEQ ID NO: 49525 - DNA, 174 bp, Homo sapiens; identical to SEQ ID NO: 28659
  chr3:196366687-196366861
  hyper

SEQ ID NO: 49526 - DNA, 30 bp, Homo sapiens; identical to SEQ ID NO: 28660
  chr3:196755999-196756029
  hyper

SEQ ID NO: 49527 - DNA, 145 bp, Homo sapiens; identical to SEQ ID NO: 28661
  chr3:197183201-197183346
  hyper

SEQ ID NO: 49528 - DNA, 131 bp, Homo sapiens; identical to SEQ ID NO: 28662
  chr3:197840417-197840548
  hyper

SEQ ID NO: 49529 - DNA, 607 bp, Homo sapiens
  chr4:330715-331322
  hyper
gggtgagcttggggagggagacacactctcagcccacctcgccccgcccgacagcgctccgagtcctgagtcccctcacccccattctacagacacgaaggtgaagccaaagacgggacgctcacttcctgagaatttgctgcctgctgcgtggacaccaccgacctattgtttacagcggtcagggacccgccccccagacccccaggaccgcgcttccgggggaggagggtgtcctcagcaacggtgacccgcaccaaagccctcctcaccggggtcaccgccacagccggtgcgaggcccgcagggcgctggggatgcgcgaccgactcccgtgaacctgctcctcgcgcgtcagggagagctgtgcacccaactaggctctgtgaggacggactgaggtcggcctgcaggctgcggccccgaaggcaggatttgtggagagatgattcgcgagccttggaggaaggatgggctgtgcgtgcgtgggtgcgtgcgtgtgtgtgtgtgtgtgtctgtgacttttgtatgtttatgtgagactgcgtacgtgcgcgcgtctgtgtgtgcgcgcgcgcgtatatgtctgtgtgtgtgcgtgcgtgta

SEQ ID NO: 49530 - DNA, 172 bp, Homo sapiens; identical to SEQ ID NO: 28664
  chr4:331562-331734
  hyper

SEQ ID NO: 49531 - DNA, 121 bp, Homo sapiens; identical to SEQ ID NO: 28665
  chr4:332122-332243
  hyper

SEQ ID NO: 49532 - DNA, 30 bp, Homo sapiens; identical to SEQ ID NO: 28666
  chr4:380533-380563
  hyper

SEQ ID NO: 49533 - DNA, 116 bp, Homo sapiens
  chr4:568313-568429
  hyper
tcgctctgtccccctcgcctcggaccaccaggcagagcagccccagggtttggacttgccaagaaaagtgcagtcgggctagccaagcccaaacatttattgtaaacttgaaaatg

SEQ ID NO: 49534 - DNA, 33 bp, Homo sapiens; identical to SEQ ID NO: 28671
  chr4:570224-570257
  hyper

SEQ ID NO: 49535 - DNA, 203 bp, Homo sapiens; identical to SEQ ID NO: 7201
  chr4:570298-570501
  hyper

SEQ ID NO: 49536 - DNA, 130 bp, Homo sapiens; identical to SEQ ID NO: 18304
  chr4:570836-570966
  hyper

SEQ ID NO: 49537 - DNA, 495 bp, Homo sapiens; identical to SEQ ID NO: 18305
  chr4:571013-571508
  hyper

SEQ ID NO: 49538 - DNA, 264 bp, Homo sapiens
  chr4:571689-571953
  hyper
gaggctctgtctgaaggaagctgcacccacagactccatccaggcagcgcgggcgcggtcctgtcgcctacctttctcggaagccatctgcccatgtgaatctatgtgaaggcccttcatgcgctcctggacatctgcgtgggatttacttcaactgctatcgctgcgaggaggacgagcatgtttcactgtatttttagcagagagtgcagattttagaacctcgcgaacggtcctgtatctcctgcacgatgactctccaga

SEQ ID NO: 49539 - DNA, 108 bp, Homo sapiens; identical to SEQ ID NO: 28674
  chr4:779786-779894
  hyper

SEQ ID NO: 49540 - DNA, 154 bp, Homo sapiens; identical to SEQ ID NO: 28675
  chr4:788810-788964
  hyper

SEQ ID NO: 49541 - DNA, 341 bp, Homo sapiens; identical to SEQ ID NO: 28676
  chr4:789169-789510
  hyper

SEQ ID NO: 49542 - DNA, 15 bp, Homo sapiens
  chr4:967602-967617
  hyper
cgggccagacttctc

SEQ ID NO: 49543 - DNA, 36 bp, Homo sapiens; identical to SEQ ID NO: 28678
  chr4:967716-967752
  hyper

SEQ ID NO: 49544 - DNA, 44 bp, Homo sapiens; identical to SEQ ID NO: 7207
  chr4:996495-996539
  hyper

SEQ ID NO: 49545 - DNA, 103 bp, Homo sapiens
  chr4:1165470-1165573
  hyper
ccgcatccccggaaccgcacaccgcaggcgctcggcaaacattctggtgttagagtctcccgacgtcagcacgccccagactgggaagcgccgccgtgcagct

SEQ ID NO: 49546 - DNA, 307 bp, Homo sapiens; identical to SEQ ID NO: 28683
  chr4:1165999-1166306
  hyper

SEQ ID NO: 49547 - DNA, 172 bp, Homo sapiens
  chr4:1396406-1396578
  hyper
ctcaaggccaacacccgaggagccttggtccccaccggagaggattcacgggtgggcccggccgggcggagggcggcgcgggagcctgggagaagggggcgcggccgcctgcggtttattgattgagtgaagttccgcaaagtgcttcgcagcgggccgagcccgcgggagc

SEQ ID NO: 49548 - DNA, 20 bp, Homo sapiens
  chr4:1397376-1397396
  hyper
cgcgccctggcaacccgacc

SEQ ID NO: 49549 - DNA, 26 bp, Homo sapiens
  chr4:1398277-1398303
  hyper
gggtagggccctgctcggcctcacca

SEQ ID NO: 49550 - DNA, 72 bp, Homo sapiens; identical to SEQ ID NO: 7212
  chr4:1399065-1399137
  hyper

SEQ ID NO: 49551 - DNA, 30 bp, Homo sapiens; identical to SEQ ID NO: 28689
  chr4:1399500-1399530
  hyper

SEQ ID NO: 49552 - DNA, 92 bp, Homo sapiens; identical to SEQ ID NO: 7213
  chr4:1400248-1400340
  hyper

SEQ ID NO: 49553 - DNA, 525 bp, Homo sapiens; identical to SEQ ID NO: 28691
  chr4:1400997-1401522
  hyper

SEQ ID NO: 49554 - DNA, 69 bp, Homo sapiens
  chr4:1401642-1401711
  hyper
cgcgtgcaccggcgggtgtgcgcgccgccttacactgcggtccccggagcctgttccgcgcgcagggcg

SEQ ID NO: 49555 - DNA, 87 bp, Homo sapiens
  chr4:1401743-1401830
  hyper
tggaagcagaaattaaaagttgggagaaataatggtggaccgatcggctgtaatttgggccaagctcggacacgctgagccccaggg

SEQ ID NO: 49556 - DNA, 99 bp, Homo sapiens; identical to SEQ ID NO: 28693
  chr4:1402294-1402393
  hyper

SEQ ID NO: 49557 - DNA, 99 bp, Homo sapiens; identical to SEQ ID NO: 28694
  chr4:1403967-1404066
  hyper

SEQ ID NO: 49558 - DNA, 411 bp, Homo sapiens; identical to SEQ ID NO: 28695
  chr4:1404120-1404531
  hyper

SEQ ID NO: 49559 - DNA, 172 bp, Homo sapiens; identical to SEQ ID NO: 28696
  chr4:1407948-1408120
  hyper

SEQ ID NO: 49560 - DNA, 41 bp, Homo sapiens; identical to SEQ ID NO: 28697
  chr4:1515026-1515067
  hyper

SEQ ID NO: 49561 - DNA, 42 bp, Homo sapiens; identical to SEQ ID NO: 7219
  chr4:1811789-1811831
  hyper

SEQ ID NO: 49562 - DNA, 66 bp, Homo sapiens; identical to SEQ ID NO: 28699
  chr4:1864167-1864233
  hyper

SEQ ID NO: 49563 - DNA, 75 bp, Homo sapiens; identical to SEQ ID NO: 28700
  chr4:1864268-1864343
  hyper

SEQ ID NO: 49564 - DNA, 56 bp, Homo sapiens; identical to SEQ ID NO: 28703
  chr4:2042655-2042711
  hyper

SEQ ID NO: 49565 - DNA, 82 bp, Homo sapiens; identical to SEQ ID NO: 28704
  chr4:2043082-2043164
  hyper

SEQ ID NO: 49566 - DNA, 90 bp, Homo sapiens; identical to SEQ ID NO: 28705
  chr4:2048818-2048908
  hyper

SEQ ID NO: 49567 - DNA, 148 bp, Homo sapiens; identical to SEQ ID NO: 28706
  chr4:2060007-2060155
  hyper

SEQ ID NO: 49568 - DNA, 115 bp, Homo sapiens; identical to SEQ ID NO: 28707
  chr4:2060173-2060288
  hyper

SEQ ID NO: 49569 - DNA, 44 bp, Homo sapiens; identical to SEQ ID NO: 28708
  chr4:2061725-2061769
  hyper

SEQ ID NO: 49570 - DNA, 114 bp, Homo sapiens; identical to SEQ ID NO: 28709
  chr4:2061972-2062086
  hyper

SEQ ID NO: 49571 - DNA, 107 bp, Homo sapiens; identical to SEQ ID NO: 28710
  chr4:2418673-2418780
  hyper

SEQ ID NO: 49572 - DNA, 84 bp, Homo sapiens; identical to SEQ ID NO: 18324
  chr4:2765778-2765862
  hyper

SEQ ID NO: 49573 - DNA, 317 bp, Homo sapiens
  chr4:2765910-2766227
  hyper
tgatgaaagctcgaatcttataggatccgtattcatttcccgtgggctcaagcccagcctccgcgggcggcgcgggccctcgcggcgagtgtccacgaggaggcggtgtggacccgcggccccagaccaggcctcaggcagaaggcgagcgcgagcgccccgcccagcccctccccgtcccgcaacccgcgccccgaccagcgcccccagcacctctccaccctcgctctcgagcagtctccacgtttgtctcagaggagacccactttgctccccagcgtgggcccctgagcgctgggggaagttggttggtttgt

SEQ ID NO: 49574 - DNA, 584 bp, Homo sapiens; identical to SEQ ID NO: 28712
  chr4:3767309-3767893
  hyper

SEQ ID NO: 49575 - DNA, 91 bp, Homo sapiens; identical to SEQ ID NO: 28713
  chr4:3768116-3768207
  hyper

SEQ ID NO: 49576 - DNA, 48 bp, Homo sapiens
  chr4:3769574-3769622
  hyper
gcccggcccgctcttcaagttcttcttctggatcggctactgcaacag

SEQ ID NO: 49577 - DNA, 611 bp, Homo sapiens; identical to SEQ ID NO: 18329
  chr4:3873083-3873694
  hyper

SEQ ID NO: 49578 - DNA, 154 bp, Homo sapiens; identical to SEQ ID NO: 28718
  chr4:3882096-3882250
  hyper

SEQ ID NO: 49579 - DNA, 96 bp, Homo sapiens; identical to SEQ ID NO: 28719
  chr4:4145235-4145331
  hyper

SEQ ID NO: 49580 - DNA, 46 bp, Homo sapiens; identical to SEQ ID NO: 28720
  chr4:4145386-4145432
  hyper

SEQ ID NO: 49581 - DNA, 84 bp, Homo sapiens; identical to SEQ ID NO: 7234
  chr4:4228084-4228168
  hyper

SEQ ID NO: 49582 - DNA, 34 bp, Homo sapiens; identical to SEQ ID NO: 18333
  chr4:4228241-4228275
  hyper

SEQ ID NO: 49583 - DNA, 45 bp, Homo sapiens
  chr4:4229644-4229689
  hyper
ctgccctgttgctaccggcgcccaagcgtcttcactagccccttc

SEQ ID NO: 49584 - DNA, 116 bp, Homo sapiens
  chr4:4229781-4229897
  hyper
tgggaagtttcagctgaagagcgttctacgggtctggcgtggctgacaggaggcgccggaccccagccccccagccgcaggttggagaggggagttgggagcgagcctggggcaag

SEQ ID NO: 49585 - DNA, 73 bp, Homo sapiens
  chr4:4387460-4387533
  hyper
gtcacctgtcaaagacggctagccctcctggggattttgaaatcagggcacccgcggcaagttcccaggctgt

SEQ ID NO: 49586 - DNA, 878 bp, Homo sapiens
  chr4:4387627-4388505
  hyper
gccgcggggaagtccccggaaagggtgtgaaaaagtatcgaatttgggtgatgcctcctcctcgtccagcgcctgacagggcccagctcctggcccaggtgcccaggaggcaccgatccccgcagccggcctcctcccgcgcgggctccactcccatttcggcctcgcccccacaccccatagtctttcatccgtgagtcctgcaggcaggacgggttggaggtctgcaaacaggaccctctctgggaagccgcgacagcggctgagctcggggtttgggggcgcaggtcgggctagaaccaccccccttctctccgcgtccgggcatcgtcccagcggcccctcctctgtgcccaggatgctcgggcggcggctgcagtgggacctccaccttctctgccaaccagagcggaggaacctttccgcctccctccaagcggcgcactgagcgctctttgcctagaacgacttccctcccgctgcctggggcagcctcaccctgggcgcccacaccccagccctgggagagcgctactccgcctcccgcaccaccgaaaacctcctcctcctttacgggccgcgcctcctttacgggccgcgccccctttatacgcggacgcgccctcttttggtcgccccctccccaacccagcactaaggagcaccctgctctggtctccgccaccacccagcgcctcctggacccatccccccaaacccttgaacgtcctcaggacccccaggtgagcgcggcgcgctgcgggcggggaccctctctgcacctccccgcacccctgggggtcgctctgtccctacggtccccgcctcccctttctcctttctaagcgcctcgcgcccaggccgccgcccggggtggc

SEQ ID NO: 49587 - DNA, 505 bp, Homo sapiens; identical to SEQ ID NO: 28725
  chr4:4388506-4389011
  hyper

SEQ ID NO: 49588 - DNA, 35 bp, Homo sapiens; identical to SEQ ID NO: 28726
  chr4:4389262-4389297
  hyper

SEQ ID NO: 49589 - DNA, 30 bp, Homo sapiens; identical to SEQ ID NO: 28727
  chr4:4854402-4854432
  hyper

SEQ ID NO: 49590 - DNA, 433 bp, Homo sapiens
  chr4:4854669-4855102
  hyper
ctctcctgcctgggccgacccggcgctttactgcttctcacgaaggtgcgccggctgctccagaaatcgcagactgcctccaggaagaacttgctggagtcacagcagcttctcagcgacttgacagcagtgattcagacttcaacttgggcggaggggcgggggaggagaaagagatttccagagaaaacgactgagcggtagggaggggaagagagaccgagccacgcgcctcgagaagcagtgcagagagcggaagagacagaggctgcgagacctacccacagagaccaagagagacgctcggaggggagaccgccttaggcgcagagattcagaggcagacagacaggcagacagaaggatacaggaaaggaatgtcgccgaaaggcagggacaaacctgagtcccagaaaaataagagacaactccc

SEQ ID NO: 49591 - DNA, 21 bp, Homo sapiens
  chr4:4855171-4855192
  hyper
gctgcccccgcgaaggtgggg

SEQ ID NO: 49592 - DNA, 141 bp, Homo sapiens
  chr4:4855230-4855371
  hyper
cgcccctcctttccagcctcagctctggcctttctcggcatccccagcttgccttcagtttcactccatatctgggtctctcagaggcctcgggaggtcttccgttctctctgtcgccgtgtccacggaaggagcctcccc

SEQ ID NO: 49593 - DNA, 210 bp, Homo sapiens
  chr4:4855433-4855643
  hyper
attgctcctgcccgtcctcgcccatttcaaagacgaccaacagaggcttagaaaaattggccctccaccctcggctggttacctggctcgtagccctgggtctgttttcttctcagagagacctgagatcctcgacatttcctaaattcatggaaaacctcgacagtgttcaggactcccaaagaaggtggtgggcgggagggggaggag

SEQ ID NO: 49594 - DNA, 171 bp, Homo sapiens; identical to SEQ ID NO: 28730
  chr4:4858696-4858867
  hyper

SEQ ID NO: 49595 - DNA, 226 bp, Homo sapiens; identical to SEQ ID NO: 28731
  chr4:4861342-4861568
  hyper

SEQ ID NO: 49596 - DNA, 183 bp, Homo sapiens; identical to SEQ ID NO: 28732
  chr4:4861780-4861963
  hyper

SEQ ID NO: 49597 - DNA, 280 bp, Homo sapiens; identical to SEQ ID NO: 28733
  chr4:4862165-4862445
  hyper

SEQ ID NO: 49598 - DNA, 107 bp, Homo sapiens; identical to SEQ ID NO: 18344
  chr4:4867591-4867698
  hyper

SEQ ID NO: 49599 - DNA, 30 bp, Homo sapiens; identical to SEQ ID NO: 7247
  chr4:4868050-4868080
  hyper

SEQ ID NO: 49600 - DNA, 21 bp, Homo sapiens
  chr4:4868545-4868566
  hyper
ataggggcgtctcaccggccc

SEQ ID NO: 49601 - DNA, 127 bp, Homo sapiens; identical to SEQ ID NO: 2364
  chr4:4869131-4869258
  hyper

SEQ ID NO: 49602 - DNA, 61 bp, Homo sapiens; identical to SEQ ID NO: 28740
  chr4:4870173-4870234
  hyper

SEQ ID NO: 49603 - DNA, 44 bp, Homo sapiens; identical to SEQ ID NO: 28741
  chr4:4871340-4871384
  hyper

SEQ ID NO: 49604 - DNA, 149 bp, Homo sapiens; identical to SEQ ID NO: 28742
  chr4:4871883-4872032
  hyper

SEQ ID NO: 49605 - DNA, 29 bp, Homo sapiens
  chr4:4872059-4872088
  hyper
cggagcatagaggcaggatggtgacctga

SEQ ID NO: 49606 - DNA, 97 bp, Homo sapiens; identical to SEQ ID NO: 28744
  chr4:4873139-4873236
  hyper

SEQ ID NO: 49607 - DNA, 149 bp, Homo sapiens
  chr4:5052921-5053070
  hyper
ctacctctagacctccgtctactgcgctctaaaatatgaacgatgctttcttactgctgggttgtcggaggcggatgtgggatggtgctaacaaagcgcgtagccgaggcctggccatagtgggtgctgacaaaccgcttactgcctgc

SEQ ID NO: 49608 - DNA, 229 bp, Homo sapiens; identical to SEQ ID NO: 18352
  chr4:5053518-5053747
  hyper

SEQ ID NO: 49609 - DNA, 12 bp, Homo sapiens
  chr4:5054093-5054105
  hyper
gcaagggcctgt

SEQ ID NO: 49610 - DNA, 88 bp, Homo sapiens
  chr4:5712891-5712979
  hyper
gctgaaagttttgagcggtgatccaggctcctccctccggctcggcgaagcagggaaggggagagaagcaggagtcgggagactgcac

SEQ ID NO: 49611 - DNA, 832 bp, Homo sapiens
  chr4:5889116-5889948
  hyper
tgggctccagtggtccgcatccctcaggaacagtcaggctccacgctgatgccaggcaggaactggggcggagggccagctcctgaccgctgcgccctcagctccccaccccgagacaaagcgtaaagacggggattcctttgtttccggccacacccagggacgcagcccggctgttctgcctccaccaccgtccccaccctctcgcggcccagcgtcgggaacattaacccttcccgggccgcagccgccagcgtcgccccattaggttatttttagctgcggggaggggtggaccgagcttccatcatggcgctgtccctaggtccggacttccactccatcagtaaaggcggggagtggggagcgctggatgatctttttccctcctccagcgggggaggtaccgggctgtggggtgcatgggccggacggtgcgggggccgagccaaggaggctcagctcaccctcccacccccgcgcgaggcctgcggggagggggttcggacccctgcccctccctcttttgttcggctccgcatcctccctgtccacgccatcctctggcacatcccgtggggggagggggcggcaagcccgcggggagagggactcccggctccagccccgccccgccatgcggggctcccccacccccattgtccccagaggctgggggagggggctgaaatcccgagaccggccccgccccacccgcggcgacgcaggaggcctcggggggcgcccctgccggcgccccgtggatctggaccctgccgggcgcccactcccagcccacaaaggccagcgcggggcggcgggggcgggggcc

SEQ ID NO: 49612 - DNA, 229 bp, Homo sapiens; identical to SEQ ID NO: 18356
  chr4:5890045-5890274
  hyper

SEQ ID NO: 49613 - DNA, 162 bp, Homo sapiens
  chr4:5890444-5890606
  hyper
atggttttcagggctcctttaaaagaaaaagacggcgcggtcagggcccgcgggcggcgccacaggtgtgtggccgcgcgtctggaggcctccccggaacatctgcgggggtgtggggggagggagtgtgggacgggggccaaggatcggcccaagctgctg

SEQ ID NO: 49614 - DNA, 35 bp, Homo sapiens
  chr4:5892194-5892229
  hyper
gtgaggcccgccccggaacccgagcccactgtaac

SEQ ID NO: 49615 - DNA, 30 bp, Homo sapiens; identical to SEQ ID NO: 28751
  chr4:5892597-5892627
  hyper

SEQ ID NO: 49616 - DNA, 237 bp, Homo sapiens; identical to SEQ ID NO: 28752
  chr4:5893517-5893754
  hyper

SEQ ID NO: 49617 - DNA, 300 bp, Homo sapiens; identical to SEQ ID NO: 28754
  chr4:5894812-5895112
  hyper

SEQ ID NO: 49618 - DNA, 69 bp, Homo sapiens
  chr4:6200828-6200897
  hyper
cagctgaagttagggcgttcgcggagagagcacagcactggcaaaggccaaggacagtgtgcctgcgag

SEQ ID NO: 49619 - DNA, 58 bp, Homo sapiens; identical to SEQ ID NO: 18361
  chr4:6201235-6201293
  hyper

SEQ ID NO: 49620 - DNA, 299 bp, Homo sapiens; identical to SEQ ID NO: 28756
  chr4:6201349-6201648
  hyper

SEQ ID NO: 49621 - DNA, 208 bp, Homo sapiens; identical to SEQ ID NO: 18363
  chr4:6201895-6202103
  hyper

SEQ ID NO: 49622 - DNA, 382 bp, Homo sapiens
  chr4:6202276-6202658
  hyper
gcagctccctcggtcgcccgcgcccggctcaggcacggcaccgcccctccccccggggagcccctccgattggtctgtcttcctgccagtcaggcaggagggcgcggcgcccgccccgccccgcccccgcccccgccccgggcagatgccgggagctctcctgccgccgtgggagggggagctgagctgccggagcgtgcgcactgggccagcgggcggccggggcagggctggggtcccggcgctgagcgcccccagccgcgccgggcagcctggcgcctcgctgagtcggagcaacccccggcaggagctttcaggctctggtcaagcctcgggacccgggaagctatccctgccctcgggggctcgagcctggagtggg

SEQ ID NO: 49623 - DNA, 73 bp, Homo sapiens; identical to SEQ ID NO: 28758
  chr4:6223724-6223797
  hyper

SEQ ID NO: 49624 - DNA, 35 bp, Homo sapiens; identical to SEQ ID NO: 28759
  chr4:6224121-6224156
  hyper

SEQ ID NO: 49625 - DNA, 152 bp, Homo sapiens
  chr4:6247199-6247351
  hyper
ctcgggtgtgggggtcgcccgcgctcctgggagccgagcaagggcgcgcaccccgcagtgggagaggggcttcctgcgcagcgcgggaggagcttccaggacgggagctgtctggggcagagccctggctacggtggcctcgcagcacagcg

SEQ ID NO: 49626 - DNA, 336 bp, Homo sapiens; identical to SEQ ID NO: 18365
  chr4:6247381-6247717
  hyper

SEQ ID NO: 49627 - DNA, 30 bp, Homo sapiens; identical to SEQ ID NO: 28761
  chr4:6472398-6472428
  hyper

SEQ ID NO: 49628 - DNA, 100 bp, Homo sapiens; identical to SEQ ID NO: 28762
  chr4:6472882-6472982
  hyper

SEQ ID NO: 49629 - DNA, 172 bp, Homo sapiens; identical to SEQ ID NO: 28763
  chr4:6473792-6473964
  hyper

SEQ ID NO: 49630 - DNA, 277 bp, Homo sapiens; identical to SEQ ID NO: 7269
  chr4:6473965-6474242
  hyper

SEQ ID NO: 49631 - DNA, 40 bp, Homo sapiens; identical to SEQ ID NO: 28765
  chr4:6474447-6474487
  hyper

SEQ ID NO: 49632 - DNA, 136 bp, Homo sapiens; identical to SEQ ID NO: 28766
  chr4:6564642-6564778
  hyper

SEQ ID NO: 49633 - DNA, 59 bp, Homo sapiens
  chr4:6565042-6565101
  hyper
ccccggcacttcggaccctagcagagccagccctgccccaggaccgccccggggtcggt

SEQ ID NO: 49634 - DNA, 161 bp, Homo sapiens; identical to SEQ ID NO: 28768
  chr4:7194377-7194538
  hyper

SEQ ID NO: 49635 - DNA, 93 bp, Homo sapiens; identical to SEQ ID NO: 28769
  chr4:7194789-7194882
  hyper

SEQ ID NO: 49636 - DNA, 30 bp, Homo sapiens; identical to SEQ ID NO: 7272
  chr4:7195153-7195183
  hyper

SEQ ID NO: 49637 - DNA, 30 bp, Homo sapiens; identical to SEQ ID NO: 28771
  chr4:7195419-7195449
  hyper

SEQ ID NO: 49638 - DNA, 290 bp, Homo sapiens; identical to SEQ ID NO: 28772
  chr4:8201139-8201429
  hyper

SEQ ID NO: 49639 - DNA, 289 bp, Homo sapiens; identical to SEQ ID NO: 28773
  chr4:8271325-8271614
  hyper

SEQ ID NO: 49640 - DNA, 70 bp, Homo sapiens; identical to SEQ ID NO: 28774
  chr4:8582115-8582185
  hyper

SEQ ID NO: 49641 - DNA, 39 bp, Homo sapiens; identical to SEQ ID NO: 28775
  chr4:8594420-8594459
  hyper

SEQ ID NO: 49642 - DNA, 137 bp, Homo sapiens; identical to SEQ ID NO: 28776
  chr4:8690019-8690156
  hyper

SEQ ID NO: 49643 - DNA, 33 bp, Homo sapiens
  chr4:8858794-8858827
  hyper
gcggaccatctcaataacaaaccgaaactctgg

SEQ ID NO: 49644 - DNA, 200 bp, Homo sapiens; identical to SEQ ID NO: 18373
  chr4:8859738-8859938
  hyper

SEQ ID NO: 49645 - DNA, 98 bp, Homo sapiens; identical to SEQ ID NO: 28780
  chr4:8861448-8861546
  hyper

SEQ ID NO: 49646 - DNA, 44 bp, Homo sapiens
  chr4:8861605-8861649
  hyper
cgggcagtggcccacggctctgggcccggatctgtgtccacctc

SEQ ID NO: 49647 - DNA, 169 bp, Homo sapiens
  chr4:8862014-8862183
  hyper
gggaccggcccgtgcgttgagcgcctcggaggtgctccgggtcatggtgggtgctgagcgggaacacggaaggctgtgtacacagcagcaagcaatgcacccgcgctcccgtcattacatcgcgccgccttcacccccgctacgatgaccactccgcagatgggcaaga

SEQ ID NO: 49648 - DNA, 404 bp, Homo sapiens
  chr4:8862393-8862797
  hyper
ctccgctctagccttcgggttaacaccgcttccttccagaagcctaaggaggcccgggcggatcagacgcctcccttctccgcagccccatgccctgcccgcagcttgagctcaccgcccttctcggggtggcggtgcggagaccggacggctccactgtgcagaccccgaggggtaaggggccgggtaggggaggggagcgagaagtggcgaggtgagaactgaggggcgaggctgaaggctgagccagacttccagacgccagagagacgccaggtgagccgggcgggggcgggggcgagggcgggggagggggcggggccggaaccgcggggagggggcggggcgcccgggagggccgcgagctgggaaggtcccgggcggccggagacggtgaagaggcg

SEQ ID NO: 49649 - DNA, 111 bp, Homo sapiens
  chr4:8863330-8863441
  hyper
ggagccccgggggcacggccgaggctgcgcttcaggagtgtccgccaggcgccttcccgggcggttggcgaaacccgaggaggcccacagctctggcctggggcgccgtcg

SEQ ID NO: 49650 - DNA, 79 bp, Homo sapiens; identical to SEQ ID NO: 28785
  chr4:8863856-8863935
  hyper

SEQ ID NO: 49651 - DNA, 18 bp, Homo sapiens
  chr4:8864598-8864616
  hyper
ttccgtgcatgacacgca

SEQ ID NO: 49652 - DNA, 62 bp, Homo sapiens
  chr4:8865058-8865120
  hyper
ggagaggcactgacagaaagggaaagagaagcccacccggcctctcccgcctccctggtgct

SEQ ID NO: 49653 - DNA, 112 bp, Homo sapiens
  chr4:8868710-8868822
  hyper
agggacggcacccagcgcagcttgagctgtctctgccctcgtgatcacaaagcagtgaaactgtccagaaaatgtccctttttattccatacgcaaataagtagattcattt

SEQ ID NO: 49654 - DNA, 233 bp, Homo sapiens; identical to SEQ ID NO: 18377
  chr4:8869368-8869601
  hyper

SEQ ID NO: 49655 - DNA, 32 bp, Homo sapiens
  chr4:8869813-8869845
  hyper
gctggaagacctggctgcgggagaagactgtg

SEQ ID NO: 49656 - DNA, 30 bp, Homo sapiens; identical to SEQ ID NO: 28791
  chr4:8870046-8870076
  hyper

SEQ ID NO: 49657 - DNA, 330 bp, Homo sapiens
  chr4:8872724-8873054
  hyper
cctgcaaaacctcctcgttagcggagctcctgccccagagggtgggcctccaaaccagcccaaccaggggctcctgggggccccacaaggcccagacgccgttccacagaagggagaggatggcccagaacgggcggcgacgagcccgaagtcccccagcaaatgcgcagggaggaagtcgggccccaccgcctgacccaccctccccgcgccctcactcactgtcaggactgaggccgcctccatagccaccgtgcgcccgtgggtaccagcgcgctgcgcctccgcagcccagagcgaagggcggcccgggaccggggggcggccgag

SEQ ID NO: 49658 - DNA, 36 bp, Homo sapiens; identical to SEQ ID NO: 18379
  chr4:8873773-8873809
  hyper

SEQ ID NO: 49659 - DNA, 9 bp, Homo sapiens
  chr4:8874476-8874485
  hyper
ctcccatat

SEQ ID NO: 49660 - DNA, 121 bp, Homo sapiens
  chr4:8875756-8875877
  hyper
ctggccaccaccaggcgggtggtggccctgagcgcataacgctcgcgggtgtcttcccactgcctctggggggcgcgcatgagaggggcgcttccacacactgccgcgtggggcctgggat

SEQ ID NO: 49661 - DNA, 21 bp, Homo sapiens
  chr4:8875907-8875928
  hyper
gaggaccgtgcacccttttcc

SEQ ID NO: 49662 - DNA, 128 bp, Homo sapiens; identical to SEQ ID NO: 28796
  chr4:8878547-8878675
  hyper

SEQ ID NO: 49663 - DNA, 103 bp, Homo sapiens; identical to SEQ ID NO: 28797
  chr4:8879491-8879594
  hyper

SEQ ID NO: 49664 - DNA, 61 bp, Homo sapiens; identical to SEQ ID NO: 28798
  chr4:8893403-8893464
  hyper

SEQ ID NO: 49665 - DNA, 100 bp, Homo sapiens
  chr4:8893931-8894031
  hyper
cattttatggaggaagactgaggctttgggttgcatgggacccgcggttaccccgcaaacacagacgcttacgaagacgctatcgcgagccgaacagtct

SEQ ID NO: 49666 - DNA, 204 bp, Homo sapiens
  chr4:8895350-8895554
  hyper
ctgtgggggtgaggtcgcagccctgctccctcctcagttccgccacccaccccttcggtagtaacgccgttctcaaaatgggcccagggccccttccggccaaacacagcctggactcctgggcagagaccgagcgcggcagaggtggcccgaaggccgggttgcgggggatcccggcctctgcccaactgccccggaatctgg

SEQ ID NO: 49667 - DNA, 46 bp, Homo sapiens; identical to SEQ ID NO: 18385
  chr4:8896052-8896098
  hyper

SEQ ID NO: 49668 - DNA, 205 bp, Homo sapiens; identical to SEQ ID NO: 2376
  chr4:8896117-8896322
  hyper

SEQ ID NO: 49669 - DNA, 40 bp, Homo sapiens; identical to SEQ ID NO: 28804
  chr4:9499335-9499375
  hyper

SEQ ID NO: 49670 - DNA, 113 bp, Homo sapiens; identical to SEQ ID NO: 28805
  chr4:9499921-9500034
  hyper

SEQ ID NO: 49671 - DNA, 17 bp, Homo sapiens
  chr4:10458378-10458395
  hyper
aaccaaaaccgtcaacg

SEQ ID NO: 49672 - DNA, 130 bp, Homo sapiens
  chr4:10459121-10459251
  hyper
aggctgcgcccgcccccgccgggcttctaagctgtccagagcggggagcctcagacccagccgagccccacttctgggcttagagcttgacccaacacgttcgcaccgtagcgagcgaggtccacattta

SEQ ID NO: 49673 - DNA, 58 bp, Homo sapiens; identical to SEQ ID NO: 18387
  chr4:10462775-10462833
  hyper

SEQ ID NO: 49674 - DNA, 70 bp, Homo sapiens
  chr4:11429633-11429703
  hyper
ccatccctcacctccatccgctgccactacccaagggcccggaaatagaaaaccacgaagggggaaaaaa

SEQ ID NO: 49675 - DNA, 78 bp, Homo sapiens
  chr4:13523948-13524026
  hyper
tccctaccttcctcccgagggagaggcagagcctctagctccatttcagacctgcaaggaaagggctttgagaaggga

SEQ ID NO: 49676 - DNA, 37 bp, Homo sapiens; identical to SEQ ID NO: 28814
  chr4:13529606-13529643
  hyper

SEQ ID NO: 49677 - DNA, 68 bp, Homo sapiens; identical to SEQ ID NO: 28815
  chr4:13530912-13530980
  hyper

SEQ ID NO: 49678 - DNA, 54 bp, Homo sapiens; identical to SEQ ID NO: 18390
  chr4:13537688-13537742
  hyper

SEQ ID NO: 49679 - DNA, 30 bp, Homo sapiens; identical to SEQ ID NO: 28817
  chr4:13539344-13539374
  hyper

SEQ ID NO: 49680 - DNA, 43 bp, Homo sapiens; identical to SEQ ID NO: 28818
  chr4:13541880-13541923
  hyper

SEQ ID NO: 49681 - DNA, 86 bp, Homo sapiens
  chr4:13545940-13546026
  hyper
cgcccctctggcgcggccagcccgccgcgctcctctttcttgttgaggatcgcctggatggagaaggacgtcaaggtgttggcgcc

SEQ ID NO: 49682 - DNA, 240 bp, Homo sapiens; identical to SEQ ID NO: 28820
  chr4:13546362-13546602
  hyper

SEQ ID NO: 49683 - DNA, 445 bp, Homo sapiens
  chr4:13548895-13549340
  hyper
ctggacgcgaccgcgcgggcgtgcctgggtcccgcttcctgcccatcgagggcgacttccttcgggctcagctgtgagctccaggaactctgcaacctcccgacgggcgccacgctccggcttgggccggcccgggagttggcggagctgcgcggcccggccgggcggccggtgaggctttcgagaggcaccgggctcgctcagcgtccgcgcctctctaccccgccgcgccccctccgcgcccacgggcccattttttcctagtcttctgcctctcttccttcttcctccctcccctcctcctccacacctttgtcttcttcctcctccctcctcctgcttctcctccgcagtttggatcctacgggccccctacgtgccgcgcccttcggtccccggaaccgcccgggctgggggtgctgctgcgcggtgagacttccgcggg

SEQ ID NO: 49684 - DNA, 125 bp, Homo sapiens
  chr4:13549510-13549635
  hyper
gcccgccacctgtgccctgggccgccttccctgacgccagcggccggaggtcgcgcgcgccgggtgctgcccagcaacgaaaggccatgcggggttcgtccctcagatgccggtgaccttgattg

SEQ ID NO: 49685 - DNA, 179 bp, Homo sapiens
  chr4:15780044-15780223
  hyper
actgcgagttcagcccggtgtccggggacaaaccctgctgccggctctctaggagagcccaactctgtcttggcgtcagtatcctggtcctgatcctcgtcgtggtgctcgcggtggtcgtcccgaggtggcgccagcagtggagcggtccgggcaccaccaagcgctttcccgagacc

SEQ ID NO: 49686 - DNA, 240 bp, Homo sapiens
  chr4:15780320-15780560
  hyper
cccgcgcgcagggaagccgcccggatcgcccggaaccgggcatcttccgtggcgggtcagccgagagcccgccgggtggtgctgagtagggagtcccgggctcggggctccgcgggccgctttcaggagcagctggccttggcaccgagcgtgcccgcgggaggcgggggggggcgctgctcggtggctctgctgcgtagccggtgaacacttggcaccgatgcccgccttctgggcaag

SEQ ID NO: 49687 - DNA, 48 bp, Homo sapiens; identical to SEQ ID NO: 28824
  chr4:16083930-16083978
  hyper

SEQ ID NO: 49688 - DNA, 60 bp, Homo sapiens; identical to SEQ ID NO: 7312
  chr4:16084408-16084468
  hyper

SEQ ID NO: 49689 - DNA, 221 bp, Homo sapiens
  chr4:16085381-16085602
  hyper
acccggcttctgggaccaccgcgacggctttcggagagcccgcctcccactgccggccgcggaggggctcaggcggcgctgcggccggaccctcggacgtggcgggaggcaggagaaaggcccgggtgcccggggggacccgttgcggcttcctctgtcccggacggggacctaggtatggggccgccgtaatggaaaggattccttaaacatactcaccg

SEQ ID NO: 49690 - DNA, 18 bp, Homo sapiens
  chr4:16085682-16085700
  hyper
ggacgcactctgattgga

SEQ ID NO: 49691 - DNA, 30 bp, Homo sapiens; identical to SEQ ID NO: 28831
  chr4:17326218-17326248
  hyper

SEQ ID NO: 49692 - DNA, 65 bp, Homo sapiens
  chr4:17782938-17783003
  hyper
gcactcagactctctcgttttctccctgcccaccgtgtgcacgtgcgtgcgcgcgcgggcgtgcg

SEQ ID NO: 49693 - DNA, 275 bp, Homo sapiens; identical to SEQ ID NO: 28835
  chr4:20253687-20253962
  hyper

SEQ ID NO: 49694 - DNA, 84 bp, Homo sapiens; identical to SEQ ID NO: 28836
  chr4:20254239-20254323
  hyper

SEQ ID NO: 49695 - DNA, 27 bp, Homo sapiens
  chr4:20254723-20254750
  hyper
tttgtaaaccatcgttggctgtcggga

SEQ ID NO: 49696 - DNA, 51 bp, Homo sapiens; identical to SEQ ID NO: 7323
  chr4:20255045-20255096
  hyper

SEQ ID NO: 49697 - DNA, 38 bp, Homo sapiens; identical to SEQ ID NO: 28839
  chr4:20255330-20255368
  hyper

SEQ ID NO: 49698 - DNA, 291 bp, Homo sapiens; identical to SEQ ID NO: 18404
  chr4:20255861-20256152
  hyper

SEQ ID NO: 49699 - DNA, 15 bp, Homo sapiens
  chr4:20256562-20256577
  hyper
aagtaaatgcagacc

SEQ ID NO: 49700 - DNA, 62 bp, Homo sapiens; identical to SEQ ID NO: 28842
  chr4:20256841-20256903
  hyper

SEQ ID NO: 49701 - DNA, 32 bp, Homo sapiens; identical to SEQ ID NO: 28843
  chr4:21950123-21950155
  hyper

SEQ ID NO: 49702 - DNA, 92 bp, Homo sapiens
  chr4:21950156-21950248
  hyper
gaagcgggcgcccgctcgcaagcttattgcatcctaccgcctgtagagctggcctcctccagctgagccgaaatgctttccaccctcctcac

SEQ ID NO: 49703 - DNA, 40 bp, Homo sapiens; identical to SEQ ID NO: 28845
  chr4:21950838-21950878
  hyper

SEQ ID NO: 49704 - DNA, 90 bp, Homo sapiens; identical to SEQ ID NO: 28846
  chr4:24473588-24473678
  hyper

SEQ ID NO: 49705 - DNA, 232 bp, Homo sapiens
  chr4:24914406-24914638
  hyper
cccatcccgcctggccggcgccgcggcctcacctcgctcaccagcccctgccagtcgctctcagtccggtcgccgttcatggcctcctcctccatgcgctggccggcctcctggacccccgccgcctcctcctcctcgcgacgtcgcgtcgccgccgccgcccgggccccgcgcggccccgagagggcccggcgcctccgagccgctgcgccgccgcctctcgcggccgcca

SEQ ID NO: 49706 - DNA, 235 bp, Homo sapiens; identical to SEQ ID NO: 28849
  chr4:25657130-25657365
  hyper

SEQ ID NO: 49707 - DNA, 48 bp, Homo sapiens; identical to SEQ ID NO: 28850
  chr4:25657366-25657414
  hyper

SEQ ID NO: 49708 - DNA, 22 bp, Homo sapiens
  chr4:25657415-25657437
  hyper
gccagcctctttgcgcaacacc

SEQ ID NO: 49709 - DNA, 137 bp, Homo sapiens; identical to SEQ ID NO: 28852
  chr4:26030429-26030566
  hyper

SEQ ID NO: 49710 - DNA, 15 bp, Homo sapiens
  chr4:26030635-26030650
  hyper
cgtcccaggggacct

SEQ ID NO: 49711 - DNA, 250 bp, Homo sapiens; identical to SEQ ID NO: 28855
  chr4:30719374-30719624
  hyper

SEQ ID NO: 49712 - DNA, 43 bp, Homo sapiens; identical to SEQ ID NO: 28856
  chr4:30719991-30720034
  hyper

SEQ ID NO: 49713 - DNA, 367 bp, Homo sapiens; identical to SEQ ID NO: 28857
  chr4:30720054-30720421
  hyper

SEQ ID NO: 49714 - DNA, 34 bp, Homo sapiens; identical to SEQ ID NO: 28858
  chr4:30720861-30720895
  hyper

SEQ ID NO: 49715 - DNA, 30 bp, Homo sapiens; identical to SEQ ID NO: 28859
  chr4:30721247-30721277
  hyper

SEQ ID NO: 49716 - DNA, 30 bp, Homo sapiens; identical to SEQ ID NO: 28860
  chr4:30722839-30722869
  hyper

SEQ ID NO: 49717 - DNA, 21 bp, Homo sapiens
  chr4:30724228-30724249
  hyper
gaccgacaaggccaccgtggt

SEQ ID NO: 49718 - DNA, 81 bp, Homo sapiens; identical to SEQ ID NO: 18407
  chr4:30724372-30724453
  hyper

SEQ ID NO: 49719 - DNA, 45 bp, Homo sapiens; identical to SEQ ID NO: 2391
  chr4:37245537-37245582
  hyper

SEQ ID NO: 49720 - DNA, 283 bp, Homo sapiens; identical to SEQ ID NO: 18409
  chr4:37245851-37246134
  hyper

SEQ ID NO: 49721 - DNA, 81 bp, Homo sapiens; identical to SEQ ID NO: 18410
  chr4:37247015-37247096
  hyper

SEQ ID NO: 49722 - DNA, 22 bp, Homo sapiens
  chr4:37247216-37247238
  hyper
cacaaacagtagctctcctccc

SEQ ID NO: 49723 - DNA, 138 bp, Homo sapiens; identical to SEQ ID NO: 28866
  chr4:37247293-37247431
  hyper

SEQ ID NO: 49724 - DNA, 116 bp, Homo sapiens; identical to SEQ ID NO: 28867
  chr4:39047287-39047403
  hyper

SEQ ID NO: 49725 - DNA, 674 bp, Homo sapiens
  chr4:41259176-41259850
  hyper
cccccgcgagcgccgaggcgggggcgcccaccggttccggctgctggcagggaccaagccgcccgctgcgagcaccggagacggccgggctggggcgtgggctgggcgcctttcctgggcccctgcatttagcgggtgactctacgaaaccggtcacggggagacggagggggctgcgccccgtggcgagcgagcgccaggcggagctcccgagggcgtggcgcgggcagcacagactcggctgcacgggcttcgcgggcgccacgtgtgggccgcgctttgtgctgtgtcattgcgccggcccgggtgggggtggcagggcgggactggggctcctcccaggctcgggtgcgggcgcggagggcgcgcgcctcctggccccgccccctggcaggtgcccgcgacccgcgtgtccccgtgcgcctggccgccttgtctcctctccgcaggtgctgtcccggctgggggtcgccggccagtggcgcttcgtggacgtgctggggctggaagaggagtctctgggctcggtgccagcgcctgcctgcgcgctgctgctgctgtttcccctcacggcccaggtagggcgtggggcccaggatgcgccggccgccggcagtgcacgccgctccccagcttgagtcctcgggggctccccgccccgccccctcccctgt

SEQ ID NO: 49726 - DNA, 208 bp, Homo sapiens; identical to SEQ ID NO: 28870
  chr4:41362555-41362763
  hyper

SEQ ID NO: 49727 - DNA, 157 bp, Homo sapiens; identical to SEQ ID NO: 28871
  chr4:41362780-41362937
  hyper

SEQ ID NO: 49728 - DNA, 185 bp, Homo sapiens
  chr4:41746824-41747009
  hyper
agaagaaaatgccgacggggtaggcgggagcgagggggaaaaaaagagttgcgaaacatgagacacattttgcagagtttgcagatgaaaaggcatctcatggatagggcatctttcagggccgaacggctgcaaagattcggggttgggagttgcaactgtgtggggttccgatgcgctaatgg

SEQ ID NO: 49729 - DNA, 103 bp, Homo sapiens; identical to SEQ ID NO: 18415
  chr4:41747133-41747236
  hyper

SEQ ID NO: 49730 - DNA, 48 bp, Homo sapiens
  chr4:41747445-41747493
  hyper
cagacacacattccccgagacagacacaaactgacacgcagacacagc

SEQ ID NO: 49731 - DNA, 187 bp, Homo sapiens
  chr4:41747582-41747769
  hyper
gtgcgaagccagggaagtttgtttgttttgtttgggggttgaggaagggggtaggagtggggttgaaatgagggcgacgccgttttccctttattcttagcgcgattactttaggccctcaatgaaaaagccatggcagcagcgacgacaatagccttgggcctacccgctcgcccactcgcccgcc

SEQ ID NO: 49732 - DNA, 70 bp, Homo sapiens; identical to SEQ ID NO: 18416
  chr4:41747888-41747958
  hyper

SEQ ID NO: 49733 - DNA, 364 bp, Homo sapiens
  chr4:41748296-41748660
  hyper
gctcctgcttgcgaaacttggcgcggcggttctggaaccacacctggcccaagacggaaggagagacggtgaagcagggggagaaagaagaaaatgggaaagaaaagcaccggttagggtggcccaagttctacttcggcttgttttaacaccctcctccccatgcgctgtgatcacccccgcgcgcacatccaccaagtctaccgcttcttattgctgtgcattttcggagaaactttcttagggggagtgagcacgccagggacatgaaggcttgcggcagagtttaaaaagccgcaggtcccagaaagacccgaaaagggaaggccttattttggtgggcctctgttcagtcggcttcttg

SEQ ID NO: 49734 - DNA, 121 bp, Homo sapiens
  chr4:41750102-41750223
  hyper
attttctaagctttacgtctcatcgcaaagtaaataaattatgcctatcattttggcagcttaagataattttgttggcggttcgggtgtgactaggatagtgtaaccctgtaagtgaatt

SEQ ID NO: 49735 - DNA, 95 bp, Homo sapiens; identical to SEQ ID NO: 18418
  chr4:41750504-41750599
  hyper

SEQ ID NO: 49736 - DNA, 30 bp, Homo sapiens; identical to SEQ ID NO: 28878
  chr4:41751372-41751402
  hyper

SEQ ID NO: 49737 - DNA, 151 bp, Homo sapiens
  chr4:41751719-41751870
  hyper
ctctttcatctctttcgggcgctctccctctttctcgcctctttttttttttcaggtgcccacaatcctccacagacccggggattgtgtctgtttgccttttaggtttgcggactgtagtgagggaaattcttgccatgtaaatgcccag

SEQ ID NO: 49738 - DNA, 10 bp, Homo sapiens
  chr4:41752441-41752451
  hyper
tgcaaatcct

SEQ ID NO: 49739 - DNA, 14 bp, Homo sapiens
  chr4:41752954-41752968
  hyper
gcacaaggctgaga

SEQ ID NO: 49740 - DNA, 212 bp, Homo sapiens; identical to SEQ ID NO: 18420
  chr4:41753398-41753610
  hyper

SEQ ID NO: 49741 - DNA, 224 bp, Homo sapiens; identical to SEQ ID NO: 28885
  chr4:41867612-41867836
  hyper

SEQ ID NO: 49742 - DNA, 20 bp, Homo sapiens
  chr4:41875410-41875430
  hyper
aaccttttttgtaaccggct

SEQ ID NO: 49743 - DNA, 42 bp, Homo sapiens
  chr4:41881343-41881385
  hyper
ccacgcgcccccatccgaggggacctcacccctgggaagact

SEQ ID NO: 49744 - DNA, 6 bp, Homo sapiens
  chr4:41881425-41881431
  hyper
ttttaa

SEQ ID NO: 49745 - DNA, 30 bp, Homo sapiens; identical to SEQ ID NO: 28888
  chr4:41881717-41881747
  hyper

SEQ ID NO: 49746 - DNA, 1 bp, Homo sapiens
  chr4:41882112-41882113
  hyper
c

SEQ ID NO: 49747 - DNA, 197 bp, Homo sapiens
  chr4:41882894-41883091
  hyper
tcgggtgttagtgagcgtaatctgaccgcagaaaagctgatgggaaacctgggcttcgcgccgcgtcccgcttttcctactttcccattccattcccatctcccttccctttccttcccttctctaccttatcctccattcccttcccttcccttcctaggcatttaaataagaacaaagattacacccacaaaaag

SEQ ID NO: 49748 - DNA, 208 bp, Homo sapiens; identical to SEQ ID NO: 18425
  chr4:41883302-41883510
  hyper

SEQ ID NO: 49749 - DNA, 822 bp, Homo sapiens
  chr4:41883610-41884432
  hyper
gctcacccgccccgggtttgggcgctgggggtggggaagggagagaaggttcgaacagttttgtctctcccgcgccccggctcccccagggtgctgcgcctccagccgccccgaggcgcttcccccggcgtccgcgcgctcctctccgcaggggtctcgcgcccacggtgccgcagccgcgcggctcagccgccctccgcacccgcgcctttccagcgcccgggttcccaaaccatcgctaaaggcggacggggggcgccaggagtaacggctgctccccggagaccccaccgagcccagcgcccgcccccgccccctgggcgccctgccccattttctccctttcccaactatcccagacccccagaagggccagaattttccagaactgtcccactccacccgcgcccagggcttctgcacattgcccttggcaggacgcgagccggtcgaggggcatttaggggtggccctgcacggccctcactgctgtcccttcttctccctccgttctccgggccagggtcctcggagaccccgttccgcggcaagtacccctcccccacccccggaggcgggtgcagtgcagggcgggggcggcggtcgcagcggctcagaagccgaccctccttgaacccgaagctgccctggcccgagtatccgcactggcctgggcccgagcgaggctgcaaccctgtgaaaccccctgcaaggcggaagcctccaaacccaaacgaccccgagggcgattccgccagaaatccaacgcgggcccaaataaagtccgaggcctttttgtcggaagcccgggaggtgcccggc

SEQ ID NO: 49750 - DNA, 48 bp, Homo sapiens; identical to SEQ ID NO: 28891
  chr4:42152718-42152766
  hyper

SEQ ID NO: 49751 - DNA, 255 bp, Homo sapiens; identical to SEQ ID NO: 18429
  chr4:42154025-42154280
  hyper

SEQ ID NO: 49752 - DNA, 26 bp, Homo sapiens
  chr4:42154359-42154385
  hyper
cgagctcctgattgacaggctgcctc

SEQ ID NO: 49753 - DNA, 276 bp, Homo sapiens; identical to SEQ ID NO: 18431
  chr4:42154386-42154662
  hyper

SEQ ID NO: 49754 - DNA, 100 bp, Homo sapiens
  chr4:42154997-42155097
  hyper
gatttcccccccattataaagatgagaaaaccgaggctctgagaggttgaagggaattgcccaaagtcagacactcgggagtgtgcggctgtgttgcact

SEQ ID NO: 49755 - DNA, 28 bp, Homo sapiens
  chr4:42398814-42398842
  hyper
ctttgcgggcgtgaacggagaagtcgtg

SEQ ID NO: 49756 - DNA, 38 bp, Homo sapiens; identical to SEQ ID NO: 18432
  chr4:42399099-42399137
  hyper

SEQ ID NO: 49757 - DNA, 497 bp, Homo sapiens
  chr4:42399191-42399688
  hyper
gaattcggcagccctcaacgtcactctgcagagatttccgggctgtgagagagttggggtgtgcggcgggggaggggagggtctgatatcttcaggttgagagtcaagtcctgggggagcggcatgggcgggggtggccggggggaggcggaggatggagcgcgaaccagaaagcgcagaggaccctcggcccgcgccgcacccgctgtgattagctccagaggcgcgatccgggagggcggactctttcttaaccctcattgtctcctcctccctcttcctttttaaaagacgccttgcgggcagagctgtcagcaaccccgcggccgtttgtacttggccgcggcggagctgactcctgctcctgtgacagataggggctggggctgagcggccgcctgtctggggtactcgcacgtggggaacaaattcttttcctccggctcctctcgggacccggcgatcgccacaggttgggactctgtgcggcgctggag

SEQ ID NO: 49758 - DNA, 623 bp, Homo sapiens
  chr4:42399872-42400495
  hyper
cccggcctgcggaactcgtagtgcagcccctgtcgcctccccggcccctgctatcccacgcaggactggcttcggccgccggggccagcagcttgcgacgtgtccctggggaggcggaatcgctgtgcgccctgagcccgggctcagcccttcgctttccagctgcgtcctgctcccggccgcccagggagcccagtggcgatgagggcactgctggcgctttgccttctccttggctggctgcgctggggcccggcgggcgcccagcagtccggagagtactgccacggctgggtggacgtgcagggcaactaccacgagggcttccagtgcccagaggacttcgacacgctggacgctaccatctgctgcggctcctgcgcgctccgctactgttgcgccgcggccgacgccaggctggagcagggcggctgcaccaacgaccgccgcgaactggagcacccaggcatcactgcgcgtaagtgcggggccctcggggacatatccccgcccgcctaacggcggcggctgcatgtgtgcgcgggaggatgcacagacccaggcaggtctatgcgccttcctgggtctgtgcgccagggggacgcggccgggtgggggaatca

SEQ ID NO: 49759 - DNA, 207 bp, Homo sapiens; identical to SEQ ID NO: 28898
  chr4:42400850-42401057
  hyper

SEQ ID NO: 49760 - DNA, 77 bp, Homo sapiens; identical to SEQ ID NO: 28899
  chr4:44448966-44449043
  hyper

SEQ ID NO: 49761 - DNA, 91 bp, Homo sapiens; identical to SEQ ID NO: 28901
  chr4:44449652-44449743
  hyper

SEQ ID NO: 49762 - DNA, 206 bp, Homo sapiens; identical to SEQ ID NO: 28902
  chr4:44449971-44450177
  hyper

SEQ ID NO: 49763 - DNA, 294 bp, Homo sapiens; identical to SEQ ID NO: 28903
  chr4:44450741-44451035
  hyper

SEQ ID NO: 49764 - DNA, 32 bp, Homo sapiens; identical to SEQ ID NO: 28904
  chr4:46391678-46391710
  hyper

SEQ ID NO: 49765 - DNA, 30 bp, Homo sapiens; identical to SEQ ID NO: 28905
  chr4:46392469-46392499
  hyper

SEQ ID NO: 49766 - DNA, 191 bp, Homo sapiens
  chr4:46994970-46995161
  hyper
cgaaaaaaaaaaaaccgggggcggaggagattattttaagaatccatcagagaacaggtgcaaacaggtttgttttctagggaaagagtcgcttgccccaagctaaaggagaggaggttgggggttgggatgcagaagacagaaatggtcaggaaaagcgcgccccgccgcaagacccccagtgcccacac

SEQ ID NO: 49767 - DNA, 554 bp, Homo sapiens; identical to SEQ ID NO: 18440
  chr4:46995835-46996389
  hyper

SEQ ID NO: 49768 - DNA, 30 bp, Homo sapiens; identical to SEQ ID NO: 28908
  chr4:47034011-47034041
  hyper

SEQ ID NO: 49769 - DNA, 432 bp, Homo sapiens; identical to SEQ ID NO: 28909
  chr4:47034321-47034753
  hyper

SEQ ID NO: 49770 - DNA, 154 bp, Homo sapiens; identical to SEQ ID NO: 18442
  chr4:47034754-47034908
  hyper

SEQ ID NO: 49771 - DNA, 38 bp, Homo sapiens
  chr4:47034938-47034976
  hyper
cggatgcaccaaggccctgccaccgagagcacagtctg

SEQ ID NO: 49772 - DNA, 30 bp, Homo sapiens; identical to SEQ ID NO: 28911
  chr4:47839373-47839403
  hyper

SEQ ID NO: 49773 - DNA, 97 bp, Homo sapiens
  chr4:48486389-48486486
  hyper
aaggctgggattccatgcgcagcgcggcccttcagcagggtccctcgccgtcctccccgagcgtcggggtggcagcgcaggtcgttgtccagtggaa

SEQ ID NO: 49774 - DNA, 186 bp, Homo sapiens
  chr4:48492433-48492619
  hyper
gcgcggcaggggctgccttcccgcctcctccccctgctcggcgggcgcggcctcgttgtccttcccgggctgcgggcggctgacggccgccgagtacttcgacagctaccagcgggagcggctcatggctctcctggcgcaggtggggccgggtctcgggccgcgcgcccgcagggccggcagctg

SEQ ID NO: 49775 - DNA, 197 bp, Homo sapiens
  chr4:48987912-48988109
  hyper
catctgggtctccagcggtccttcctctctgccttctcctcgcagagcaccccgtgggcctagtctaaacgagggcaccactggtccggagttgcacttgttcgctccctcctgggctctggcagcgctgcatccccggggttgcttcgggttcgggcccaatagcagagtcagagccgagacgcatgtcccctgca

SEQ ID NO: 49776 - DNA, 68 bp, Homo sapiens; identical to SEQ ID NO: 28917
  chr4:48988465-48988533
  hyper

SEQ ID NO: 49777 - DNA, 75 bp, Homo sapiens; identical to SEQ ID NO: 28918
  chr4:52917590-52917665
  hyper

SEQ ID NO: 49778 - DNA, 117 bp, Homo sapiens; identical to SEQ ID NO: 28919
  chr4:52917964-52918081
  hyper

SEQ ID NO: 49779 - DNA, 114 bp, Homo sapiens; identical to SEQ ID NO: 28920
  chr4:53617401-53617515
  hyper

SEQ ID NO: 49780 - DNA, 52 bp, Homo sapiens; identical to SEQ ID NO: 28921
  chr4:53617855-53617907
  hyper

SEQ ID NO: 49781 - DNA, 181 bp, Homo sapiens; identical to SEQ ID NO: 28922
  chr4:53728041-53728222
  hyper

SEQ ID NO: 49782 - DNA, 1055 bp, Homo sapiens
  chr4:54965799-54966854
  hyper
aggggtaggtgtaaccgtggccagagctgcgctcagggactggacgactgccagtccgtcgcccgcacaatcctgctccaaaccgcaggcctcacacttcaccgcgccgcagccacccctaccacagaggagctggaaacactgagcattcctattaaataagcctccaagtccccacctggtacgctttgcggtggggcgtggggaagagttgggctgcggccagggtagcgagagggggtgggatggaggatgcagcgctgtgatttctcagtaaagcgtggagaaagagggggaggaggccggcctccccgggaaattaacaaaacctacactttgcaaagtctcccccatccccctcccccgagttcttccccgccgcgcgcccgcccctcctcgcggcttctgttgtgactcgggcagcctatcccgagggtgcggagctgccgaggagcctgagccgagcggtactccgcagcatcacgtgccagggtggggggctataaaatacccgagccggggcgccgggcgggggacgtgaggaccagccctctccggggacccctttgttcccagcccagacgccaacacctctgcgtccccaagggcttgactgcccgtgtctgcgcggctcccagggcagagcttagaacactagaggagaggggtcgccgcgaactgccggggcttccagccacccacccctctcgacatgtcgcgctccttctatgtcgactcgctcatcatcaaggacacctcacggcctgcgccctcgctgcctgaaccgcaccccgggccggatttcttcatcccgcttggcatgccgcccccattggtgatgtccgtgtccggccccggctgcccgtcccgcaagagcggcgcgttctgcgtgtgccctctctgcgtcacttcgcacctgcactcctctcgggggtctgtgggcgccggcagcgggggcgcaggggccggggttaccggggccggaggcagtggggtggcaggggccgcaggggcactgcctctgcttaagggccagttctcttcggctcctgggg

SEQ ID NO: 49783 - DNA, 267 bp, Homo sapiens
  chr4:54967075-54967342
  hyper
ctcaccatgggtagggcggggtcttggggcacctgcgctccgcgcctttcgcgctcctggagcaaactttccacctccagtggaggaagtgggagcccggggacagggtgaagagagaggacgggcttttagtgtaaccgtagagtcagccacagaagttccacgaaagtggaagttagtttgccagcttctccactcagcctggtgcgttttactcctagtagtaggtgctcgagtattgccttattaatactggggccttaggga

SEQ ID NO: 49784 - DNA, 8 bp, Homo sapiens
  chr4:54967484-54967492
  hyper
ctcaaagg

SEQ ID NO: 49785 - DNA, 24 bp, Homo sapiens
  chr4:54969747-54969771
  hyper
gagtgttgtctttagcgcgcgcgc

SEQ ID NO: 49786 - DNA, 2 bp, Homo sapiens
  chr4:54969831-54969833
  hyper
ga

SEQ ID NO: 49787 - DNA, 274 bp, Homo sapiens; identical to SEQ ID NO: 18451
  chr4:54970095-54970369
  hyper

SEQ ID NO: 49788 - DNA, 33 bp, Homo sapiens; identical to SEQ ID NO: 18452
  chr4:54970482-54970515
  hyper

SEQ ID NO: 49789 - DNA, 164 bp, Homo sapiens; identical to SEQ ID NO: 28927
  chr4:54975768-54975932
  hyper

SEQ ID NO: 49790 - DNA, 15 bp, Homo sapiens
  chr4:54976170-54976185
  hyper
cgtgggaaagagacg

SEQ ID NO: 49791 - DNA, 134 bp, Homo sapiens
  chr4:55092914-55093048
  hyper
aaaagacccgcagcccgcctcaggagggcaaggtttctagccccctgcggctccgggaccacccaggacccggggcgtcgtgggaccgatctcgaaggatcttagaacgacactgggagagcgcggcaagaact

SEQ ID NO: 49792 - DNA, 578 bp, Homo sapiens
  chr4:55093255-55093833
  hyper
accactgggtttattttgcttttgcagaggaggcagatgttgacctctcttctttgcacagtctctccgcaaaattttcccccaaccatttgctttcttgcgccaccccccaccggggcactatccctggagtcagctcctcaggcctttaaaccttccagaatgtcacacatggaaacctttagcaaatgtttgttaatgatcataacaaaggcatcattcaaattaggcaggtaattactaccagaaggacaactgggtgctcgcttgctcatccattgctttctgctttaaactcccgaggagtcgctgcctggagacactcccgcccggactgcttctcgggccccattaaacggctctgaaatgaactgtgaagttaccatttgtgggcggagagcgctggggccctgcggacggaagaccctggcttgaccggactaacagtgtcgccgaagcaaagcagcccctctgggtaggctgtctgtctcgcctcctaccctctggggcaactagcctaaaaacccggttctcaacttaacagcatgtggcccagcacccgcttttgccttttattc

SEQ ID NO: 49793 - DNA, 123 bp, Homo sapiens; identical to SEQ ID NO: 7383
  chr4:55093888-55094011
  hyper

SEQ ID NO: 49794 - DNA, 74 bp, Homo sapiens; identical to SEQ ID NO: 28932
  chr4:55094012-55094086
  hyper

SEQ ID NO: 49795 - DNA, 92 bp, Homo sapiens; identical to SEQ ID NO: 28933
  chr4:55094514-55094606
  hyper

SEQ ID NO: 49796 - DNA, 25 bp, Homo sapiens
  chr4:55096214-55096239
  hyper
tacagcacagggagccggccgaatg

SEQ ID NO: 49797 - DNA, 103 bp, Homo sapiens; identical to SEQ ID NO: 28935
  chr4:55096538-55096641
  hyper

SEQ ID NO: 49798 - DNA, 69 bp, Homo sapiens
  chr4:55098605-55098674
  hyper
aaacccgacttggggcgcctccttccctgcctcctactgcagtttctcggcccccgcgaaaggggagcg

SEQ ID NO: 49799 - DNA, 25 bp, Homo sapiens
  chr4:55098744-55098769
  hyper
cagaaggcacttttgtgtgtgtgtg

SEQ ID NO: 49800 - DNA, 104 bp, Homo sapiens; identical to SEQ ID NO: 28939
  chr4:55099069-55099173
  hyper

SEQ ID NO: 49801 - DNA, 30 bp, Homo sapiens; identical to SEQ ID NO: 28940
  chr4:55099383-55099413
  hyper

SEQ ID NO: 49802 - DNA, 208 bp, Homo sapiens; identical to SEQ ID NO: 28941
  chr4:55523645-55523853
  hyper

SEQ ID NO: 49803 - DNA, 689 bp, Homo sapiens; identical to SEQ ID NO: 28943
  chr4:55524562-55525251
  hyper

SEQ ID NO: 49804 - DNA, 161 bp, Homo sapiens
  chr4:55990946-55991107
  hyper
ccgatccgggagacccggcctgagattccggcaaggttttcttccccgggcccggactaggatgttgcgcgcagccagacaacttttcaccgcctgttctcgcctgcggaggcacctcctgcctgccaaccccaggcgccttcccaccccagcctcccaag

SEQ ID NO: 49805 - DNA, 15 bp, Homo sapiens
  chr4:55992169-55992184
  hyper
cgagaatctgcagca

SEQ ID NO: 49806 - DNA, 86 bp, Homo sapiens; identical to SEQ ID NO: 28946
  chr4:56501604-56501690
  hyper

SEQ ID NO: 49807 - DNA, 30 bp, Homo sapiens; identical to SEQ ID NO: 28947
  chr4:56503489-56503519
  hyper

SEQ ID NO: 49808 - DNA, 41 bp, Homo sapiens
  chr4:56660021-56660062
  hyper
accctttggatttttctcttccacaccgcctcatccgaggg

SEQ ID NO: 49809 - DNA, 72 bp, Homo sapiens
  chr4:57371963-57372035
  hyper
gggcccagagccaccgctcagcacgcgggcacgcggcgggagggaaggaaaccgcggcgctggggatggaga

SEQ ID NO: 49810 - DNA, 192 bp, Homo sapiens; identical to SEQ ID NO: 28952
  chr4:57396459-57396651
  hyper

SEQ ID NO: 49811 - DNA, 61 bp, Homo sapiens
  chr4:57397264-57397325
  hyper
cgccgcagtaatgatctccccctctctgatcaccagagccccgccacggcctcagctgtct

SEQ ID NO: 49812 - DNA, 15 bp, Homo sapiens
  chr4:57521381-57521396
  hyper
aattttttaaaaaat

SEQ ID NO: 49813 - DNA, 51 bp, Homo sapiens
  chr4:57687669-57687720
  hyper
gtcgccgaggccgcccggagcagggcagggtccgccgccggtctgactccc

SEQ ID NO: 49814 - DNA, 74 bp, Homo sapiens
  chr4:57687782-57687856
  hyper
taactgccaggagcagcagcgccaagcgcagcaccgacagcgccatcctcctcccgcgccggctgtcttgcccc

SEQ ID NO: 49815 - DNA, 256 bp, Homo sapiens
  chr4:57975777-57976033
  hyper
ttctacatatacacccggccctcactttctggacgcacgcagcaaactctcaaaataaaaccaccaaaaaggagaagggggggcgtcgcccaccgctcctggcattccgcggctgccaactctttccctcccatctggctcctgggatgcccgcgggggaatcgcagtgagcagcgcggggcgaggccgccgcggacgccccgtcggatgtgcccttcgctgggccgagcggcgcagggttggagagggaagcgct

SEQ ID NO: 49816 - DNA, 231 bp, Homo sapiens
  chr4:57976185-57976416
  hyper
cacacgccgcttacacccggaccgccggctgctgccccggctttacccttccgcctcttgcggctcttcacgcactccatgcccggcgcgcagtaccccctgccggcgccgccacccccgcacggctcgccctcgccgcgggcgcacatagggcagcagccgcacgcgtcgcgggtctcgcccagcaggcagcccagcgggggcaggggcgggcaggaggccggctcgcag

SEQ ID NO: 49817 - DNA, 127 bp, Homo sapiens
  chr4:57976573-57976700
  hyper
gccttaaacccgccgccccgcccggcctgtccgcgggaaccacaccccggggcggtgagagcacgggggccccgcccgtgccgccctcccggccccgcggggcctgcgcgcgcgctcctgctggcgt

SEQ ID NO: 49818 - DNA, 30 bp, Homo sapiens; identical to SEQ ID NO: 7405
  chr4:57977077-57977107
  hyper

SEQ ID NO: 49819 - DNA, 290 bp, Homo sapiens; identical to SEQ ID NO: 28961
  chr4:62065781-62066071
  hyper

SEQ ID NO: 49820 - DNA, 63 bp, Homo sapiens
  chr4:62066133-62066196
  hyper
cgtcgcccccctcgcctgctggcccggcaccgctcgctccagttcccaggagcggggatgcag

SEQ ID NO: 49821 - DNA, 360 bp, Homo sapiens; identical to SEQ ID NO: 28963
  chr4:62066855-62067215
  hyper

SEQ ID NO: 49822 - DNA, 71 bp, Homo sapiens; identical to SEQ ID NO: 18473
  chr4:62067440-62067511
  hyper

SEQ ID NO: 49823 - DNA, 52 bp, Homo sapiens
  chr4:62068150-62068202
  hyper
ttaggcggttttggctggagaaagctgccactttcgtgggtggcccgggctg

SEQ ID NO: 49824 - DNA, 116 bp, Homo sapiens; identical to SEQ ID NO: 28966
  chr4:62068237-62068353
  hyper

SEQ ID NO: 49825 - DNA, 30 bp, Homo sapiens; identical to SEQ ID NO: 28967
  chr4:62068633-62068663
  hyper

SEQ ID NO: 49826 - DNA, 30 bp, Homo sapiens; identical to SEQ ID NO: 28968
  chr4:66534335-66534365
  hyper

SEQ ID NO: 49827 - DNA, 236 bp, Homo sapiens
  chr4:66534894-66535130
  hyper
ccactccttcaagcccgaaatgtcacttccccacgcgccttaagtgaggcccagccgcacccatccccctggaacgggcctccattccccaaaggaggcctcgacctcctttcccccaaggttttccaccttcccagccccccaaccagcctctgtccacacgcatgttccttgcccagcactccgcagctaacgtcaaacaatgcaaccaaaaaccgcagaggggagcgaaaagg

SEQ ID NO: 49828 - DNA, 475 bp, Homo sapiens; identical to SEQ ID NO: 28970
  chr4:66535574-66536049
  hyper

SEQ ID NO: 49829 - DNA, 48 bp, Homo sapiens; identical to SEQ ID NO: 28971
  chr4:66536391-66536439
  hyper

SEQ ID NO: 49830 - DNA, 228 bp, Homo sapiens; identical to SEQ ID NO: 28972
  chr4:71600396-71600624
  hyper

SEQ ID NO: 49831 - DNA, 241 bp, Homo sapiens; identical to SEQ ID NO: 28973
  chr4:73433899-73434140
  hyper

SEQ ID NO: 49832 - DNA, 279 bp, Homo sapiens; identical to SEQ ID NO: 28974
  chr4:73434964-73435243
  hyper

SEQ ID NO: 49833 - DNA, 69 bp, Homo sapiens; identical to SEQ ID NO: 28975
  chr4:74702331-74702400
  hyper

SEQ ID NO: 49834 - DNA, 12 bp, Homo sapiens
  chr4:74809865-74809877
  hyper
gactcgctgggt

SEQ ID NO: 49835 - DNA, 100 bp, Homo sapiens
  chr4:74809933-74810033
  hyper
agggcgccgggacccatctgccgctcgccggccggaggctaccaggagcaggagcagcagcgccgcccgcagtagccggggagcgcgggggacagcgggg

SEQ ID NO: 49836 - DNA, 62 bp, Homo sapiens; identical to SEQ ID NO: 28977
  chr4:74810262-74810324
  hyper

SEQ ID NO: 49837 - DNA, 234 bp, Homo sapiens; identical to SEQ ID NO: 28978
  chr4:74904177-74904411
  hyper

SEQ ID NO: 49838 - DNA, 92 bp, Homo sapiens; identical to SEQ ID NO: 28979
  chr4:75230955-75231047
  hyper

SEQ ID NO: 49839 - DNA, 81 bp, Homo sapiens; identical to SEQ ID NO: 28980
  chr4:76555351-76555432
  hyper

SEQ ID NO: 49840 - DNA, 32 bp, Homo sapiens; identical to SEQ ID NO: 28982
  chr4:77228302-77228334
  hyper

SEQ ID NO: 49841 - DNA, 30 bp, Homo sapiens; identical to SEQ ID NO: 28983
  chr4:77819543-77819573
  hyper

SEQ ID NO: 49842 - DNA, 15 bp, Homo sapiens
  chr4:79472968-79472983
  hyper
tgttcgcagtttact

SEQ ID NO: 49843 - DNA, 229 bp, Homo sapiens
  chr4:81106122-81106351
  hyper
tttcagaagcagttgcgctgggggtggggaaagggagggaagggacattgaaaggccgcagtggctggcaactccgcgcccgtccgatgtcctctctaatcccccagtgttctggcgcgtacccacagtgcccccagaccctccgctcgcccgtgcgccgaggtcgttgggttttagacccagagagcacgttccgtaagctcccggcccaaatcccctcggaaaaatt

SEQ ID NO: 49844 - DNA, 325 bp, Homo sapiens; identical to SEQ ID NO: 28986
  chr4:81123055-81123380
  hyper

SEQ ID NO: 49845 - DNA, 232 bp, Homo sapiens; identical to SEQ ID NO: 28987
  chr4:81123381-81123613
  hyper

SEQ ID NO: 49846 - DNA, 290 bp, Homo sapiens; identical to SEQ ID NO: 28988
  chr4:81123614-81123904
  hyper

SEQ ID NO: 49847 - DNA, 156 bp, Homo sapiens; identical to SEQ ID NO: 18482
  chr4:81124121-81124277
  hyper

SEQ ID NO: 49848 - DNA, 69 bp, Homo sapiens
  chr4:81124662-81124731
  hyper
aggcacatgacctcgcataattgactcggaaaggaccccagctttccacgcgcgcgcaagcacagttaa

SEQ ID NO: 49849 - DNA, 37 bp, Homo sapiens; identical to SEQ ID NO: 28990
  chr4:81186703-81186740
  hyper

SEQ ID NO: 49850 - DNA, 6 bp, Homo sapiens
  chr4:81187040-81187046
  hyper
cgtcat

SEQ ID NO: 49851 - DNA, 483 bp, Homo sapiens
  chr4:81187076-81187559
  hyper
agaaagcagctccagtcgtggcatgatgactcagggtggcgttttaaacgctgaataaacccattccttagctctttaataaatcgctaataacagcaaaaacagccttctccccgaaccgcgccacaccaaaggcttcccaagttgggctgcgaatccctgtttggttttccaacgccgaaagacgtagaagcagtgggatctcctggtgggacgcatttctccaagggctcccagagagaggacgagatagcagggtttacagggcaaagagaggagaacctggaaatcgtgtcctggggggcaagagtgcgttgcccagtcacaagtgtgctgtagaggtgggagaggacaaggacccatttccacatttcaaccctccgtttctatcgctgcccctggaggactcagctgctaacgccgagctcgtttccacgcggctctggtcctagtcggggaatccgggtggccgcgcgacgcgag

SEQ ID NO: 49852 - DNA, 209 bp, Homo sapiens
  chr4:81187589-81187798
  hyper
ggcgcacccagcgtccggggcgcaggttctctcagcccagcttctcctcccactcactcgctcggatctcctccctccttcacatcccccgcccccgggaccgcgaggctccctccccgcaccggccagtgagtacacaaagccgcgggtgaggggaagcttcgcaggcgtgcacggagcagtgagatcactggcgttataaatatccc

SEQ ID NO: 49853 - DNA, 517 bp, Homo sapiens; identical to SEQ ID NO: 28992
  chr4:81187799-81188316
  hyper

SEQ ID NO: 49854 - DNA, 2 bp, Homo sapiens
  chr4:81188489-81188491
  hyper
tg

SEQ ID NO: 49855 - DNA, 24 bp, Homo sapiens
  chr4:81189911-81189935
  hyper
agggccctccgcacacgcaccagc

SEQ ID NO: 49856 - DNA, 405 bp, Homo sapiens; identical to SEQ ID NO: 28995
  chr4:81256834-81257239
  hyper

SEQ ID NO: 49857 - DNA, 31 bp, Homo sapiens
  chr4:81951400-81951431
  hyper
aggaagctatgatgacgggctgcaggtgcag

SEQ ID NO: 49858 - DNA, 41 bp, Homo sapiens
  chr4:81951460-81951501
  hyper
gggaaagtaagcgagaatggtgttcacgttgtgactttgtt

SEQ ID NO: 49859 - DNA, 100 bp, Homo sapiens; identical to SEQ ID NO: 28997
  chr4:81951777-81951877
  hyper

SEQ ID NO: 49860 - DNA, 4 bp, Homo sapiens
  chr4:81951937-81951941
  hyper
aact

SEQ ID NO: 49861 - DNA, 200 bp, Homo sapiens
  chr4:81951970-81952170
  hyper
ccctggaaaaggcaatcgagcgccctccggaccgctgcgcacagccccggctccgacctggcgcccaaaacagagctagtcctagtccctcgcgcggccagtttggccgggtgttcccaaaaataaagcgaggagggaaggtacagacagatcttgaaaacacccgggccacacacgccgcgacctacagctctttctca

SEQ ID NO: 49862 - DNA, 573 bp, Homo sapiens; identical to SEQ ID NO: 28999
  chr4:81952363-81952936
  hyper

SEQ ID NO: 49863 - DNA, 149 bp, Homo sapiens
  chr4:82136056-82136205
  hyper
cggcgcccaagacccccggcccacgaacctcaccagacagccgggtaactttccaggtgcgcagcttgtcacctcggcgcggccgcccctgcgtctcagcgtcctctcccacgccgccctccccagccgcctgcggcgccggagcccag

SEQ ID NO: 49864 - DNA, 142 bp, Homo sapiens; identical to SEQ ID NO: 29002
  chr4:82136243-82136385
  hyper

SEQ ID NO: 49865 - DNA, 172 bp, Homo sapiens; identical to SEQ ID NO: 18499
  chr4:82136635-82136807
  hyper

SEQ ID NO: 49866 - DNA, 110 bp, Homo sapiens
  chr4:82136837-82136947
  hyper
ccgaagcagctcgtcgacgcgcccctcccggactctggggccataacttacatctagtttgccagttcacgtgatgctgggggcaggggttgaatcgagtttcgagggac

SEQ ID NO: 49867 - DNA, 316 bp, Homo sapiens; identical to SEQ ID NO: 29004
  chr4:82965388-82965704
  hyper

SEQ ID NO: 49868 - DNA, 36 bp, Homo sapiens; identical to SEQ ID NO: 29005
  chr4:83482690-83482726
  hyper

SEQ ID NO: 49869 - DNA, 278 bp, Homo sapiens; identical to SEQ ID NO: 29006
  chr4:83483094-83483372
  hyper

SEQ ID NO: 49870 - DNA, 44 bp, Homo sapiens; identical to SEQ ID NO: 29007
  chr4:83719361-83719405
  hyper

SEQ ID NO: 49871 - DNA, 29 bp, Homo sapiens
  chr4:85402747-85402776
  hyper
cccctctgtctaccttgcggagactattc

SEQ ID NO: 49872 - DNA, 137 bp, Homo sapiens
  chr4:85403776-85403913
  hyper
ctgtggttgccttttcggtttcaaagtaataaccaagcaaggaagagagaagaccgaaaactaccccgcggaaactagcacagtgtgcctggatgtctgtgtcccgggacctcggggaagagggcccgcaccggtct

SEQ ID NO: 49873 - DNA, 189 bp, Homo sapiens; identical to SEQ ID NO: 7440
  chr4:85414148-85414337
  hyper

SEQ ID NO: 49874 - DNA, 268 bp, Homo sapiens
  chr4:85414457-85414725
  hyper
ggctcggacgcgtgcagtaggaggccgccgccgccgccgctgctggacttgtgcttcttcaacagctgcgtgattttctcgtcgtccgagttgggatccagaggcttattgtagtcgtcgtcctcttcctcgttctccgaggcccccttgaggcgctctgtctccgagtcctgcttcttcttggccgtggccatctcggcagcgtgcttcttcctccacttggtccggcggttctggaaccagacctgagggcggagaaaagggagga

SEQ ID NO: 49875 - DNA, 178 bp, Homo sapiens
  chr4:85414846-85415024
  hyper
tctcggccgtcaaagtcagtctccgtcgccccaagttccccctgagtaactggcaccaacaaactgactgccgttgccatagcgatggtaacacaagagtattgaggttgtcagtgagcgagttctcaaaagtaaaaacaaaactcggaaacttaaaaatgagcgtccctaaaagtga

SEQ ID NO: 49876 - DNA, 432 bp, Homo sapiens
  chr4:85416904-85417336
  hyper
aagtcttctccagggcgaagatctgctgtccggaaaaagtgggtctcgtgtgttttctcttcccgtctttgtccaacaaaatggatccttgatctgtgagaaccaataaacaacgagagagggggaaaaacaatcggttacaagcggctgcactagggggaaaaaacgaactcgaaaaacaatgttttgtggggaaagaaagctcagtctgtggcggacaccagaagtgtagtggcgcttccagactaacggcacgtctccctttgcttttttacatccacctgttttttaaaagccgcgtgtttggcgcagcagtaaataccttctgctcaacaccgacgtcaaacagctagggagcctattgctaaagtttgccagagcctaatcgcaaggccccattaaattaacgactgccagaaaaaggccactctc

SEQ ID NO: 49877 - DNA, 53 bp, Homo sapiens; identical to SEQ ID NO: 7444
  chr4:85417666-85417719
  hyper

SEQ ID NO: 49878 - DNA, 144 bp, Homo sapiens
  chr4:85418079-85418223
  hyper
ggggacgctggactgtcttcaatgggctcacccaggccgagtgtactcgggcggcgagggcgaagaggtgaggtggggacaccccaggcggagacgtgcatgcaaatacactcacttcccgggcggtggagggctcaccgctgc

SEQ ID NO: 49879 - DNA, 106 bp, Homo sapiens; identical to SEQ ID NO: 29019
  chr4:85418264-85418370
  hyper

SEQ ID NO: 49880 - DNA, 521 bp, Homo sapiens; identical to SEQ ID NO: 29021
  chr4:85419120-85419641
  hyper

SEQ ID NO: 49881 - DNA, 230 bp, Homo sapiens; identical to SEQ ID NO: 29022
  chr4:85419661-85419891
  hyper

SEQ ID NO: 49882 - DNA, 35 bp, Homo sapiens
  chr4:85422432-85422467
  hyper
cttcggacactccaccctggcggtggtacccaacc

SEQ ID NO: 49883 - DNA, 197 bp, Homo sapiens; identical to SEQ ID NO: 29025
  chr4:85423633-85423830
  hyper

SEQ ID NO: 49884 - DNA, 225 bp, Homo sapiens
  chr4:85424176-85424401
  hyper
tttgcttcctataaacgccgtagagtggaaactgcacctttgccacaacttctgctgcccagcacttaaggtagagatttgggaagaattgaagcagacagcgtggaaaagcgccgtaggatcttgcgttcggcgctctcccagtggaggccaacaccaaacaagtggggaagcgaccagtgtaaacagccccatccattctaccacagaaaagatctcgaagtc

SEQ ID NO: 49885 - DNA, 24 bp, Homo sapiens
  chr4:85424483-85424507
  hyper
agtgcgctccgaagggtggcttct

SEQ ID NO: 49886 - DNA, 301 bp, Homo sapiens; identical to SEQ ID NO: 29027
  chr4:85504300-85504601
  hyper

SEQ ID NO: 49887 - DNA, 61 bp, Homo sapiens; identical to SEQ ID NO: 29028
  chr4:85887114-85887175
  hyper

SEQ ID NO: 49888 - DNA, 127 bp, Homo sapiens; identical to SEQ ID NO: 29029
  chr4:87281168-87281295
  hyper

SEQ ID NO: 49889 - DNA, 121 bp, Homo sapiens
  chr4:87515216-87515337
  hyper
agcctctggctagtccgaagaacgcgaaaagccaggcccaaggcactggttgtcatggcaaccggggcgctggtctccctggcgacctcgtccctagggaggaggtggagctggatgccag

SEQ ID NO: 49890 - DNA, 684 bp, Homo sapiens
  chr4:87515367-87516051
  hyper
gtgggagatctgcggtcctcccagtgccggggaatggttgagtgacaggaccgggggggcggagccggcgcggctgcccgaggtggagccccagtggtgcgagtagctccagcggccacgctgaggcgagggtgacacaccatgctcacggcccctggagaccgtcgtgctggcgagccgtgctccgtagctccccggtccgcctcggcagcggtcagagtcgcctacaggagttgagccgcccgcgccagaaggttttggcgaagctcttggagaggcgtcgagcacagtagggcggcgggggtgcgttgagcgctcgggggtcaggcagtcggccgggatcgccgctggggagcgtttccgaggcgaggaggaggaggaggagatgctgctcctcttctccccctccccaggctccttctacagctccttcagcccacgcccgcagccgcttgtgggagaagtggtggtggctctcggcgcccgcggcggctgccggcggcccgccccgacgccgcgtccctgcagccctcgcccggcgctccagtagcaggacccggtctcgggaccagccggtaaggacgagagccgccctgggctctgcgctgcatgtgcagaagtgcaaaacaaagtacattgcgctcgttctcttcctcctctctctgctttcgctccagtccctaa

SEQ ID NO: 49891 - DNA, 30 bp, Homo sapiens; identical to SEQ ID NO: 29031
  chr4:87813050-87813080
  hyper

SEQ ID NO: 49892 - DNA, 126 bp, Homo sapiens
  chr4:89378338-89378464
  hyper
gcctgaggcagtgggcgcgctcagtcccgggaccaggcgttctctcctctcgcctctgggcctgggaccccgcaaagcggcgatggagcggaggtcgcggaggaagtcgcggcgcaacgggcgctc

SEQ ID NO: 49893 - DNA, 128 bp, Homo sapiens
  chr4:89378497-89378625
  hyper
gaagtctccgggcgcacagctctggctctttcccagcgccgcgggcctccaccgcgcgctgctccggagggtggaggtgacgcgccaactctgctgctcgccggggcgcctcgcggtcttggaacgcg

SEQ ID NO: 49894 - DNA, 9 bp, Homo sapiens
  chr4:89378888-89378897
  hyper
actggcgac

SEQ ID NO: 49895 - DNA, 15 bp, Homo sapiens
  chr4:90758090-90758105
  hyper
agtgggaggcaaacc

SEQ ID NO: 49896 - DNA, 642 bp, Homo sapiens
  chr4:90758134-90758776
  hyper
agttctccgctcacgagggtggaaaggcagaaggcttgaaggcaaggcgtgagggagcgcccaggacgctctcggaggggccgggccggggtctgcgctgcagcccgcacgcacctcacttccgcgtcgcggcgctcggtcgctcgccccctctcttgggccccttctggtcgtcgccgtcctcctcctcctagtcctcctccttctccttctcctcggctctccgcccccaccgctgatttgtcagcgcttctgcccgcccctctcccggcgctcgctgctttccctgcagcgtgctcctcgtccctatctcggatggggatggggcagggggcgcggggtgagccatcaactccagccgcctgcctggccgcgcaaggcgggaaagtgggggcgcttttgcgcctcacgttaagtttagggtcacgagcactcttgtggagatcgggagcggttgggctagggatgatgcctcttcctctttccccttcccctcccttcttgtccccgcctttcctctgggtcctcccggggaccaccccctacccctcgtcagagtcgccctgggagagccgagggcctgagggtcgaccaccaagggcagagcctatcccttggggagctgctggaggagacaggcag

SEQ ID NO: 49897 - DNA, 29 bp, Homo sapiens
  chr4:90758883-90758912
  hyper
atcttcaaggttttcgtttgctcttaatc

SEQ ID NO: 49898 - DNA, 56 bp, Homo sapiens; identical to SEQ ID NO: 29036
  chr4:90759319-90759375
  hyper

SEQ ID NO: 49899 - DNA, 95 bp, Homo sapiens; identical to SEQ ID NO: 29037
  chr4:93225325-93225420
  hyper

SEQ ID NO: 49900 - DNA, 30 bp, Homo sapiens; identical to SEQ ID NO: 29038
  chr4:93226097-93226127
  hyper

SEQ ID NO: 49901 - DNA, 38 bp, Homo sapiens; identical to SEQ ID NO: 29040
  chr4:94750202-94750240
  hyper

SEQ ID NO: 49902 - DNA, 30 bp, Homo sapiens; identical to SEQ ID NO: 29041
  chr4:94750621-94750651
  hyper

SEQ ID NO: 49903 - DNA, 118 bp, Homo sapiens
  chr4:94750864-94750982
  hyper
gccagcggccgaccccgcccgggagttgccggactcgcttctcagccccagcttctgcgggagggtactcggtgcagctggacgctctgcacttctcgactttcgaggacagcgccct

SEQ ID NO: 49904 - DNA, 279 bp, Homo sapiens
  chr4:94751140-94751419
  hyper
aggaaggtgacagaagcctgaaaactgagacagaaacaaaactgccctttcccagtgcgcgggaagccccgcggttaaagatccccgcaccctttaatttttgctctgcgatggtcgttgtttagcaacgacttggcttcagatggcagctacatttgatggtttgcaaatgccgccgctgttccaaacttcctacggtccatattgtttgatgaaaactttctgttaaaattgtgtcctttccgcccaccttctgctccccctttagatagatacggt

SEQ ID NO: 49905 - DNA, 97 bp, Homo sapiens; identical to SEQ ID NO: 18519
  chr4:94751502-94751599
  hyper

SEQ ID NO: 49906 - DNA, 20 bp, Homo sapiens
  chr4:94752906-94752926
  hyper
ggaaaagctaatagtcgtgc

SEQ ID NO: 49907 - DNA, 136 bp, Homo sapiens
  chr4:94753279-94753415
  hyper
taatgcactagggagcgcaggttctggtctccttaagtaagaaactgcagaaccagctttttactgaccacctgggtatctgtggctttcagcggaagccgaccaagagatgcagagaacgtccgccagctctctg

SEQ ID NO: 49908 - DNA, 30 bp, Homo sapiens; identical to SEQ ID NO: 29045
  chr4:94755600-94755630
  hyper

SEQ ID NO: 49909 - DNA, 136 bp, Homo sapiens; identical to SEQ ID NO: 29047
  chr4:95678866-95679002
  hyper

SEQ ID NO: 49910 - DNA, 76 bp, Homo sapiens; identical to SEQ ID NO: 29048
  chr4:95679062-95679138
  hyper

SEQ ID NO: 49911 - DNA, 56 bp, Homo sapiens; identical to SEQ ID NO: 29049
  chr4:95679689-95679745
  hyper

SEQ ID NO: 49912 - DNA, 56 bp, Homo sapiens; identical to SEQ ID NO: 29050
  chr4:96469013-96469069
  hyper

SEQ ID NO: 49913 - DNA, 30 bp, Homo sapiens; identical to SEQ ID NO: 29051
  chr4:96469768-96469798
  hyper

SEQ ID NO: 49914 - DNA, 30 bp, Homo sapiens; identical to SEQ ID NO: 29052
  chr4:96470085-96470115
  hyper

SEQ ID NO: 49915 - DNA, 64 bp, Homo sapiens; identical to SEQ ID NO: 29053
  chr4:96470823-96470887
  hyper

SEQ ID NO: 49916 - DNA, 73 bp, Homo sapiens; identical to SEQ ID NO: 29054
  chr4:96470888-96470961
  hyper

SEQ ID NO: 49917 - DNA, 83 bp, Homo sapiens; identical to SEQ ID NO: 18524
  chr4:101111504-101111587
  hyper

SEQ ID NO: 49918 - DNA, 60 bp, Homo sapiens
  chr4:101111797-101111857
  hyper
aagcctgtggtagagcggacacctgttgcttccagggtagatctcgggccactgggaccg

SEQ ID NO: 49919 - DNA, 30 bp, Homo sapiens; identical to SEQ ID NO: 29058
  chr4:103997969-103997999
  hyper

SEQ ID NO: 49920 - DNA, 130 bp, Homo sapiens
  chr4:107955181-107955311
  hyper
aaaggatagctgaaacggttcacacttcaaagctctgggaagagttctggaactgcaaaactagcaaaactgcaaaattgtccccgtgagagggcagtagggggccaagcccgggtcttgtctctctgtc

SEQ ID NO: 49921 - DNA, 38 bp, Homo sapiens
  chr4:107956638-107956676
  hyper
gagttgagtttggcccgcgaactgccgatctgtgagct

SEQ ID NO: 49922 - DNA, 113 bp, Homo sapiens; identical to SEQ ID NO: 7472
  chr4:107957249-107957362
  hyper

SEQ ID NO: 49923 - DNA, 10 bp, Homo sapiens
  chr4:107957363-107957373
  hyper
ttgtcccctg

SEQ ID NO: 49924 - DNA, 137 bp, Homo sapiens
  chr4:107957466-107957603
  hyper
tgctctctccccagtcctctttgctttttatagcttcccacagtgaggactttttttttttttttacctccgcccccaattcaagagtgacaaagagtgaaaatttttctctcactccccaccgcttccgcccccct

SEQ ID NO: 49925 - DNA, 68 bp, Homo sapiens; identical to SEQ ID NO: 29063
  chr4:107957925-107957993
  hyper

SEQ ID NO: 49926 - DNA, 112 bp, Homo sapiens; identical to SEQ ID NO: 29064
  chr4:107958393-107958505
  hyper

SEQ ID NO: 49927 - DNA, 99 bp, Homo sapiens; identical to SEQ ID NO: 29065
  chr4:108853188-108853287
  hyper

SEQ ID NO: 49928 - DNA, 258 bp, Homo sapiens; identical to SEQ ID NO: 29066
  chr4:109088205-109088463
  hyper

SEQ ID NO: 49929 - DNA, 231 bp, Homo sapiens; identical to SEQ ID NO: 29067
  chr4:109089045-109089276
  hyper

SEQ ID NO: 49930 - DNA, 30 bp, Homo sapiens; identical to SEQ ID NO: 29068
  chr4:109090379-109090409
  hyper

SEQ ID NO: 49931 - DNA, 122 bp, Homo sapiens; identical to SEQ ID NO: 29069
  chr4:109092563-109092685
  hyper

SEQ ID NO: 49932 - DNA, 237 bp, Homo sapiens
  chr4:109093168-109093405
  hyper
aggagagacagggtagtgacccccactcacaccagaaaacccctccccccggcgattttgctgccaactcgagtcggctacagacagtccagtgagtccttaattacaaggacgagagaaaagcacggtgcccctcgagtcctctccgccccctcggtcctaacccccgcccaggctccaggtcttcccctttgtgtggcctggactctctcccagctacgactttggtgggatcca

SEQ ID NO: 49933 - DNA, 777 bp, Homo sapiens
  chr4:109093506-109094283
  hyper
ctctatttcccaccccggcttcacccggagacgaaagctgtgggcatcttcagtttaacggacttcgcggaaaaggagagaaggggggcgagggaaatggcagtttgtgtcccaggggttcttccccttcttcttgccgcctcctaaagacaaacaaactcaaccccccaccctccggggtatcagggaactcgtgggaccgtgaaaaagtcgttcccaaatccggccgcctgcggacgtcggacttccgcggggccggcgcccgttggcgtctgtagctcggcgcagccacgcggggctccagcgagcggggtccgccacccctcgcgccctcctgcggctttcccagcgctgggccagtgcaggccgagccctgcgtccctgcctcgctgggtgggggtccggggcgcggctgtccacagggccgcctcctcctgcggcccgcggggaaggggcgcatcccaccccgctctgcaggccgcccttctgccagctgggaggcgagggcacacgtcctaaggctgcccaagggggagaggaatcgcgccggtaggagagcgcacgggaaccaggaacgcaaggcgggcacaggggagccgaaggagccagacagggcccggccacgcgccctcctcgctcggctgcgctccgtgacgggaacccaggctcccacgcacggggaatgcctagaacggagctagaatggaggtgggagctggagtcattttgcgggccacaggactgctcatttcgtgggcaggacgtgacattcttgtc

SEQ ID NO: 49934 - DNA, 55 bp, Homo sapiens; identical to SEQ ID NO: 29071
  chr4:109094529-109094584
  hyper

SEQ ID NO: 49935 - DNA, 190 bp, Homo sapiens; identical to SEQ ID NO: 29072
  chr4:109683609-109683799
  hyper

SEQ ID NO: 49936 - DNA, 70 bp, Homo sapiens; identical to SEQ ID NO: 7481
  chr4:109684016-109684086
  hyper

SEQ ID NO: 49937 - DNA, 381 bp, Homo sapiens
  chr4:110223980-110224361
  hyper
gaaggcaaagcaggagcccgccttattatcataatgtattcaccttggcccagcccgcgggccggcccggggaacccccaagggaggcgggaagcttgggtgggagcggggcaggaggtctgttattagcataatgtatgcaaatagctggagcggccaccgtgattggagaggagcctggcgacccctccccctgcgcggagtaacttcagcatctccgagggccacctctctggcctgggccggggccgaagcggggtcggctgcgcaagaggcggcaactttggcttatactgactcagcccagcgccccctttttatcccacataaaaatggagaaatggcctccgggaggaagatgtgaagcggcacgctctatct

SEQ ID NO: 49938 - DNA, 72 bp, Homo sapiens; identical to SEQ ID NO: 29078
  chr4:111531853-111531925
  hyper

SEQ ID NO: 49939 - DNA, 28 bp, Homo sapiens
  chr4:111531943-111531971
  hyper
cgcgcctccccttcgtccccaggccctg

SEQ ID NO: 49940 - DNA, 77 bp, Homo sapiens; identical to SEQ ID NO: 29080
  chr4:111532245-111532322
  hyper

SEQ ID NO: 49941 - DNA, 49 bp, Homo sapiens; identical to SEQ ID NO: 18540
  chr4:111532961-111533010
  hyper

SEQ ID NO: 49942 - DNA, 32 bp, Homo sapiens; identical to SEQ ID NO: 29082
  chr4:111533328-111533360
  hyper

SEQ ID NO: 49943 - DNA, 30 bp, Homo sapiens; identical to SEQ ID NO: 29083
  chr4:111535304-111535334
  hyper

SEQ ID NO: 49944 - DNA, 40 bp, Homo sapiens
  chr4:111536248-111536288
  hyper
agcgctcaaggagcacggcggcagtgcgctgaggccagtg

SEQ ID NO: 49945 - DNA, 17 bp, Homo sapiens
  chr4:111536943-111536960
  hyper
gagacctaaatcctccg

SEQ ID NO: 49946 - DNA, 15 bp, Homo sapiens
  chr4:111537066-111537081
  hyper
cggagaggccgggac

SEQ ID NO: 49947 - DNA, 117 bp, Homo sapiens; identical to SEQ ID NO: 29088
  chr4:111539478-111539595
  hyper

SEQ ID NO: 49948 - DNA, 33 bp, Homo sapiens; identical to SEQ ID NO: 29089
  chr4:111539809-111539842
  hyper

SEQ ID NO: 49949 - DNA, 13 bp, Homo sapiens
  chr4:111540186-111540199
  hyper
cggggcagcaggc

SEQ ID NO: 49950 - DNA, 19 bp, Homo sapiens
  chr4:111540360-111540379
  hyper
ggtacgtgctcccttaaca

SEQ ID NO: 49951 - DNA, 49 bp, Homo sapiens; identical to SEQ ID NO: 29091
  chr4:111540595-111540644
  hyper

SEQ ID NO: 49952 - DNA, 30 bp, Homo sapiens; identical to SEQ ID NO: 29092
  chr4:111542950-111542980
  hyper

SEQ ID NO: 49953 - DNA, 42 bp, Homo sapiens
  chr4:111543190-111543232
  hyper
tgctcgcgcccttagcgccccaggagccgggccggtcgaggg

SEQ ID NO: 49954 - DNA, 211 bp, Homo sapiens
  chr4:111543450-111543661
  hyper
cctccagcctgtgcttggaggagtccagcgaccggggctgaccgggagccagaaccgaagccatggctaacggctggggatggtgacaggaagatgaggagacggccgacagcttggtccccgctgctcggtgctccaagtgaagcgggcctttcatgcagttcatggacgagggagcgcgacgctctactagtccttggctactgccccg

SEQ ID NO: 49955 - DNA, 214 bp, Homo sapiens; identical to SEQ ID NO: 29096
  chr4:111543967-111544181
  hyper

SEQ ID NO: 49956 - DNA, 83 bp, Homo sapiens; identical to SEQ ID NO: 18544
  chr4:111544298-111544381
  hyper

SEQ ID NO: 49957 - DNA, 30 bp, Homo sapiens; identical to SEQ ID NO: 29098
  chr4:111549751-111549781
  hyper

SEQ ID NO: 49958 - DNA, 188 bp, Homo sapiens; identical to SEQ ID NO: 29099
  chr4:111549982-111550170
  hyper

SEQ ID NO: 49959 - DNA, 110 bp, Homo sapiens
  chr4:111550508-111550618
  hyper
acgtagtatatgctccgcaaacattcgctgattgaatgagaggcgcgggggcggggcggcggagaggggtctgcggccgccaaggccgccagggttaacccaggtccttc

SEQ ID NO: 49960 - DNA, 15 bp, Homo sapiens
  chr4:111550834-111550849
  hyper
cgcaaagccaggcgt

SEQ ID NO: 49961 - DNA, 105 bp, Homo sapiens; identical to SEQ ID NO: 18547
  chr4:111552994-111553099
  hyper

SEQ ID NO: 49962 - DNA, 466 bp, Homo sapiens
  chr4:111553450-111553916
  hyper
cggaggcgggtgcccagcgcgcggcctgcgcttccctcccggccttaccattggcgccaggatgctgccgcgggaagaacttgctgctggctgcctcttttcggctctcaggagagtccgtgaactcgacctttttgatttcggagtctttggagaagagacattcaacggccgccggctgcacgcctgggccacgcgcgcgcccgccccacgtgcggagagaggcgtcccggaccgcggccgaaaggagccggggacgggaggagggggaggggcgaggcaggccggaggagaaagagggacaaagagcaaagacccagttagaggaaagagctgacggcatccccgtcccccggaccctctggcaacccggggcaggatggcgtactctttctgcgcctccccggttgccggcggttccagccgggaggagtaggctggggggcttcggtacacagcgcgccgc

SEQ ID NO: 49963 - DNA, 453 bp, Homo sapiens
  chr4:111555343-111555796
  hyper
ggagctgggccctggggagcctctggccaaggtcgctgcctacaggaggggctgcccggcgctgtggcgtggggatccagggtggggacggccaggcggttcccccacccgctagcgagaacgcgggcggggactctgccgattcgatccttgtgggcccgtgggcccagaagtagcagtttggcggctccagatttagtgattctgcagtaaaatcacaggattagtccctgattgagatgtctgttcgtgagatattacaaaattcattatcacagctttctactaactcgatatgaagtaacacagatgggattttattagtccagacttcaaatgtttacttatgataatttcggaggaaatttgcatgtcatcatcatttcgataatcttttttttttatatgtctgaactggctgcattattagctggtagccggagcactgcagat

SEQ ID NO: 49964 - DNA, 337 bp, Homo sapiens
  chr4:111557628-111557965
  hyper
tgctaatccttggcccgaggatttgttcctgcagtgttggcaccgagatttaagggaagatacctcgttttaaatgccagccacggtctggcttccctctcgacttcagcaccctgtagattgttagtgtctgtggcgggggacgaaaggaacagggctttgcaaggtctgtttgccgactgcgttaccttgggcgaaacttagccccaaaagccacaaatcacctacggtgaagattctccgaagtggaacaaatttccagactcgcattatctcacatccctgcgggatagatggcctccacttaccggctaccgggagagagctgctgtctccg

SEQ ID NO: 49965 - DNA, 394 bp, Homo sapiens
  chr4:111558049-111558443
  hyper
tgcagggctcctgagggtgccaagttccgaaggagtccacgggtgcactggggcctccgaaatctagccgccactggcagtttctttctgctcctctccagctttctcgctcggtctcgcactctctctcctctccctccctctcatccctctctcttccctctgctcctactccgtgtggggagtgacgtgacgtcagcagagattccaccaaactccactgcacagtggcgcgcgggcggccggccgagcccggctgcgcggctggcgatccaggagcgagcacagcgcccgggcgagcgccggggggagcgagcaggggcgacgagaaacgaggcaggggagggaagcagatgccagcgggccgaagagtcgggagccggagccgggagag

SEQ ID NO: 49966 - DNA, 53 bp, Homo sapiens
  chr4:111558498-111558551
  hyper
cggactcccactgtggaaaggaggaccagaagggaggatgggatggaagagaa

SEQ ID NO: 49967 - DNA, 18 bp, Homo sapiens
  chr4:111559233-111559251
  hyper
tggcgaggatggtattaa

SEQ ID NO: 49968 - DNA, 30 bp, Homo sapiens; identical to SEQ ID NO: 29107
  chr4:111560186-111560216
  hyper

SEQ ID NO: 49969 - DNA, 83 bp, Homo sapiens
  chr4:111560636-111560719
  hyper
cctttcaggtttcagaggtttgcaaaccagggctgagaggaaggggctcgggaagctcacgttcctctcgccccccttctgtc

SEQ ID NO: 49970 - DNA, 24 bp, Homo sapiens
  chr4:111562353-111562377
  hyper
atctcgcactcaaaacggagtttc

SEQ ID NO: 49971 - DNA, 85 bp, Homo sapiens
  chr4:111562491-111562576
  hyper
cggtggctcaggccctttgctcggaccgggaccttacagttctaacccaggagcgttaaactctggaagactccgggccagccct

SEQ ID NO: 49972 - DNA, 42 bp, Homo sapiens
  chr4:111562648-111562690
  hyper
gctatggcagtgagctttccgcgcaaacggagagctggaacc

SEQ ID NO: 49973 - DNA, 21 bp, Homo sapiens
  chr4:113430619-113430640
  hyper
ctccaatttggatcccgggag

SEQ ID NO: 49974 - DNA, 25 bp, Homo sapiens
  chr4:113430672-113430697
  hyper
caggctggagcgcgaagccggcgcc

SEQ ID NO: 49975 - DNA, 83 bp, Homo sapiens; identical to SEQ ID NO: 29112
  chr4:113431075-113431158
  hyper

SEQ ID NO: 49976 - DNA, 111 bp, Homo sapiens
  chr4:113431723-113431834
  hyper
cccaggctgggggagcgagaaaggggggtattggagccctcacgttttattggtctaacctaatttcactaattctcttttcacacatttcttttgcagattcggaggccg

SEQ ID NO: 49977 - DNA, 36 bp, Homo sapiens
  chr4:113432573-113432609
  hyper
gcgccgcagcgcgctagctggcgttggaaagatcta

SEQ ID NO: 49978 - DNA, 379 bp, Homo sapiens; identical to SEQ ID NO: 18553
  chr4:113435837-113436216
  hyper

SEQ ID NO: 49979 - DNA, 298 bp, Homo sapiens
  chr4:113436287-113436585
  hyper
agtctacgggtcttcttgatgcgctgcaccgtctcggccgtcttggcgcctcgggagacggcccgcgcccgggaagggcgccgtttgcaatcgtgtaccagacccagcagccgtgcgggccggcagccctccgcacccgcagccacgccgccccgcgccccctgcccggcctcagccccgcgctgccgacgcgccccgcctgacgcgcccggctcctcctcctcttcttcgtcggcgctggatgacagcggggtcagggccgccaaggcgggggaggccgatccgagcagcactaaca

SEQ ID NO: 49980 - DNA, 314 bp, Homo sapiens; identical to SEQ ID NO: 29118
  chr4:113436841-113437155
  hyper

SEQ ID NO: 49981 - DNA, 579 bp, Homo sapiens; identical to SEQ ID NO: 29119
  chr4:113437622-113438201
  hyper

SEQ ID NO: 49982 - DNA, 198 bp, Homo sapiens; identical to SEQ ID NO: 7510
  chr4:113438506-113438704
  hyper

SEQ ID NO: 49983 - DNA, 365 bp, Homo sapiens
  chr4:113441733-113442098
  hyper
ctaaaataacaagatgaagtacctgacaagggggctttgtaacccaaatcctaatcctccgagtgagttctcagaaagatggaaagatggcgggaaaaagttggtaaatcctaaacatcttttacatcaacggtctctagttcttcgctgcaggctagaaacgcagcttccagagcaggagagcctggtatggaaacaattagctttctccgcagagcaccccttgcaacgctaggattcgttattgatagtggtgagcgctgggaatgagtgtgaattcggagtttctgacggtcccctatccgggagccaaggaagccaaggagaaaacaatgtaaattcgccccgatccccagttactgcat

SEQ ID NO: 49984 - DNA, 9 bp, Homo sapiens
  chr4:113444011-113444020
  hyper
tgttttata

SEQ ID NO: 49985 - DNA, 500 bp, Homo sapiens; identical to SEQ ID NO: 29125
  chr4:113444944-113445444
  hyper

SEQ ID NO: 49986 - DNA, 99 bp, Homo sapiens; identical to SEQ ID NO: 29126
  chr4:113626580-113626679
  hyper

SEQ ID NO: 49987 - DNA, 53 bp, Homo sapiens; identical to SEQ ID NO: 29127
  chr4:113627418-113627471
  hyper

SEQ ID NO: 49988 - DNA, 64 bp, Homo sapiens; identical to SEQ ID NO: 29128
  chr4:114900586-114900650
  hyper

SEQ ID NO: 49989 - DNA, 55 bp, Homo sapiens; identical to SEQ ID NO: 29129
  chr4:115520068-115520123
  hyper

SEQ ID NO: 49990 - DNA, 190 bp, Homo sapiens; identical to SEQ ID NO: 29130
  chr4:115520755-115520945
  hyper

SEQ ID NO: 49991 - DNA, 51 bp, Homo sapiens; identical to SEQ ID NO: 29131
  chr4:117847235-117847286
  hyper

SEQ ID NO: 49992 - DNA, 93 bp, Homo sapiens; identical to SEQ ID NO: 18560
  chr4:117847306-117847399
  hyper

SEQ ID NO: 49993 - DNA, 1 bp, Homo sapiens
  chr4:117847458-117847459
  hyper
c

SEQ ID NO: 49994 - DNA, 21 bp, Homo sapiens
  chr4:117847469-117847490
  hyper
cgggcccgctcgtcctgggac

SEQ ID NO: 49995 - DNA, 42 bp, Homo sapiens; identical to SEQ ID NO: 29134
  chr4:118955083-118955125
  hyper

SEQ ID NO: 49996 - DNA, 47 bp, Homo sapiens; identical to SEQ ID NO: 29135
  chr4:118955468-118955515
  hyper

SEQ ID NO: 49997 - DNA, 54 bp, Homo sapiens; identical to SEQ ID NO: 29136
  chr4:119273444-119273498
  hyper

SEQ ID NO: 49998 - DNA, 66 bp, Homo sapiens; identical to SEQ ID NO: 29137
  chr4:121843230-121843296
  hyper

SEQ ID NO: 49999 - DNA, 56 bp, Homo sapiens; identical to SEQ ID NO: 18563
  chr4:121844007-121844063
  hyper

SEQ ID NO: 50000 - DNA, 193 bp, Homo sapiens
  chr4:121992072-121992265
  hyper
gcccgcggcaaactccgaggagctgatgcggggcgggtccggggaactgccgggagctctcacgcctgggcctgggatagggtgcgggcagaaaggtgaaccgagagcgcacaatgcaacgaaaccgcactccaaattcagcagtttgcaaagtgcctccaagaaaacagctgggacctgcaatcactcgttc

SEQ ID NO: 50001 - DNA, 384 bp, Homo sapiens
  chr4:121992312-121992696
  hyper
gtagcgcgggtgagagcgaaccccaactcacgcacagacaggacgagggcacgaagccgagtctcctggctggggccgtagggggcgtcacctcggtggccgctctgctctccggaagaaagtatgagccggtcccaggccacctcgctcagcccaaggaagtttctataacgatgctcgcctaccacgcagaggacaaatgaggagccagagcggttgggggtcgggccaaccgaactcccggccccggctgcgcagctcccagacgcccaccaagaactcgtgcgctgcctggacctctagcttttcgccctacacgcagacgccctctgcaaaaccccagtcccgcagactttccctagcggcgggcggagggcatgaacc

SEQ ID NO: 50002 - DNA, 280 bp, Homo sapiens; identical to SEQ ID NO: 29140
  chr4:121993436-121993716
  hyper

SEQ ID NO: 50003 - DNA, 2 bp, Homo sapiens
  chr4:121993995-121993997
  hyper
cc

SEQ ID NO: 50004 - DNA, 96 bp, Homo sapiens
  chr4:121994251-121994347
  hyper
gcaaactgtgcattcatgtcccacttttcacccgaacgcctgcctatcacagccttcactcagggagcgcttccccctcggcgcagaccgagcctc

SEQ ID NO: 50005 - DNA, 154 bp, Homo sapiens
  chr4:122301962-122302116
  hyper
cgggaaaggagagcagctcagggatcaaacccacgataaagaggcgggaagccaaagcactgggagactcgatctcagtgaccaaaaaatgttcgcggttcaaataaagttcttcccttgctcttccctaaggcgaggcgccgccacggtctgg

SEQ ID NO: 50006 - DNA, 92 bp, Homo sapiens
  chr4:122302246-122302338
  hyper
cagcttcagtggcgccaacgccgcttccccgcaccctcagggcgagggaagacttccctggctcaccaacttgctgccgcccagcgcctttc

SEQ ID NO: 50007 - DNA, 96 bp, Homo sapiens
  chr4:122686113-122686209
  hyper
cgagaggcgcccgggctggagcgccccggccgtgttggccacggagttcttcagctgcttgatgaccacgaagagcaggaggaaaagtaagaagag

SEQ ID NO: 50008 - DNA, 174 bp, Homo sapiens
  chr4:122686507-122686681
  hyper
aggtgctcttgaggacgcgagcgacttccctaggagcgaacttccgcgggcacggacgccagaagaggtaacagctcagtcttccaggggaggtcgggactggtgttttgtaaatgatttaaaagttccacccccaacatccagtagggtccctagctccgctgcgttcccaat

SEQ ID NO: 50009 - DNA, 86 bp, Homo sapiens
  chr4:122871208-122871294
  hyper
gaagtgagctggtggcgctttcatcccaaaggatataccttccctccatttcctgggccgtttccattccacgcttatcttcagca

SEQ ID NO: 50010 - DNA, 239 bp, Homo sapiens; identical to SEQ ID NO: 18571
  chr4:122871334-122871573
  hyper

SEQ ID NO: 50011 - DNA, 460 bp, Homo sapiens
  chr4:122872000-122872460
  hyper
cccaaatgtgactgaaccacagagagacgaggcgcctgggcaaaccttcaacccacaccctgtatcgcactgtcccctccctactccccacttctctgcccccgcccccgacgtcccagagcgtcggaggggacccaagtccacgctgggacgcccgggaggagttcagggttcaagtgcgcgcctgggtctgtgcacatcttccccttcctcggcctccctgggtaagctcgggaccccggggtccgtcttccaaggggtgcccagccctggcagcagtcgtgcgagctcctcggctctaatacagggagtggctgctcgccaggatgcttgtctgaagtcagtgtgcccgcctgcgggctgttccgtgtgcttgagcctggacagagcccctgccacgcactcggcagcccctgtgtccctccaccgcgcgggaccgagggggcgagcctccggccga

SEQ ID NO: 50012 - DNA, 497 bp, Homo sapiens; identical to SEQ ID NO: 29148
  chr4:122872667-122873164
  hyper

SEQ ID NO: 50013 - DNA, 1100 bp, Homo sapiens; identical to SEQ ID NO: 29149
  chr4:123747826-123748926
  hyper

SEQ ID NO: 50014 - DNA, 127 bp, Homo sapiens; identical to SEQ ID NO: 29150
  chr4:124426734-124426861
  hyper

SEQ ID NO: 50015 - DNA, 51 bp, Homo sapiens; identical to SEQ ID NO: 29151
  chr4:126235891-126235942
  hyper

SEQ ID NO: 50016 - DNA, 30 bp, Homo sapiens; identical to SEQ ID NO: 29152
  chr4:126236943-126236973
  hyper

SEQ ID NO: 50017 - DNA, 370 bp, Homo sapiens
  chr4:126237654-126238024
  hyper
tactgtcattgcttccggggcaggcctgggtccacggggccgagccgcgccaggtgttccaagtgctggaagagcaacctccaggcactctggtaggcaccatccagacgcgccccggcttcacctacaggctcagcgaaagccacgccctgtttgccataaacagtagcaccggagccctgtacaccacctccaccatcgaccgcgagagcctgcccagcgacgtgatcaacctggtggtcctttccagcgcgcccacctaccccaccgaagtgcgagtgctggtgcgggacctcaatgacaacgcccccgttttcccggacccctctatcgtggtcactttcaaggaagacagtagcagcggacgcca

SEQ ID NO: 50018 - DNA, 228 bp, Homo sapiens
  chr4:128544161-128544389
  hyper
gctcgcgcccagcgccggagacgggctgtgtgttgggccagtggaagacaccggagaaacccagacgtggaagaccgggcagcctggacttcgcgagccctggtggggctggcggcccacagagcccccacctgccccgagctcccacagcgaggagtggccgcgccgcccgccagtgcgccgggctccgagaccggcaggggagcacgcgggcgaaggaggggccgc

SEQ ID NO: 50019 - DNA, 17 bp, Homo sapiens
  chr4:128544789-128544806
  hyper
gccgttgggacctgcac

SEQ ID NO: 50020 - DNA, 91 bp, Homo sapiens
  chr4:134067790-134067881
  hyper
ggaagaagaccctaccgtcactccgccggtccctggctggcgccacaaagactagaagtcggagaggcgagacctctagggggcctgggct

SEQ ID NO: 50021 - DNA, 13 bp, Homo sapiens
  chr4:134068004-134068017
  hyper
cctgtaacccacg

SEQ ID NO: 50022 - DNA, 77 bp, Homo sapiens; identical to SEQ ID NO: 29158
  chr4:134068322-134068399
  hyper

SEQ ID NO: 50023 - DNA, 130 bp, Homo sapiens
  chr4:134068791-134068921
  hyper
ctctcagaagcacgtctcaggctactatcacgcccatggacactagccctccttaactccttgccaggaggaaatggcaacgtatctccaggtcggaaaacgactctacttttcccgcaggttgtggtgg

SEQ ID NO: 50024 - DNA, 150 bp, Homo sapiens; identical to SEQ ID NO: 29162
  chr4:134070219-134070369
  hyper

SEQ ID NO: 50025 - DNA, 4 bp, Homo sapiens
  chr4:134070370-134070374
  hyper
gtgg

SEQ ID NO: 50026 - DNA, 35 bp, Homo sapiens
  chr4:134070403-134070438
  hyper
atgagggcgctgcgcaaaaacggagaagccgagcg

SEQ ID NO: 50027 - DNA, 596 bp, Homo sapiens
  chr4:134071052-134071648
  hyper
gatgaggaaaggggacgcctgtcacccttcctgtgctaagatttaaaaaaaaatgaggctggattgcgggaagctctaaaatgaagcaaaaggagtaagatttttaaagacagaaagccacaggagcccccacgtagcgcacttttatttgtattttttcagatttttttttgtttcgtggtggtgggggaggtgattgggtggctgactggctgcgggaagctacttcctttccttttggagatgattgtgctattattgtttgccttgctctggatggtggaaggagtcttttcccagcttcactacacggtacaggaggagcaggaacatggcactttcgtggggaatatcgctgaagatctgggtctggacattacaaaactttcggctcgcgggtttcagacggtgcccaactcaaggaccccttacttagacctcaacctggagacaggggtgctgtacgtgaacgagaaaatagaccgcgaacaaatctgcaaacagagcccctcctgtgtcctgcacctggaggtctttctggagaaccccctggagctgttccaggtggagatcgaggtgctggacattaatgacaa

SEQ ID NO: 50028 - DNA, 13 bp, Homo sapiens
  chr4:134072967-134072980
  hyper
ccactgtcaacat

SEQ ID NO: 50029 - DNA, 246 bp, Homo sapiens
  chr4:134073322-134073568
  hyper
tcagctggtggatggcgccgtggagccccagggcgggggcgggagcggaggcggagggtcaggagagcaccagcgccccagtcgctctggcggcggggaaacctcgctagacctcaccctcatcctcatcatcgcgttgggctcggtgtccttcatcttcctgctggccatgatcgtgctggccgtgcgttgccaaaaagagaagaagctcaacatctatacttgtctggccagcgattgctgcct

SEQ ID NO: 50030 - DNA, 91 bp, Homo sapiens
  chr4:140201462-140201553
  hyper
cctttgtagtcctcaccatcctcccctaacccatctccagctctgttgctatccctgaggtctctagagctgaccgcggcatctcagaaaa

SEQ ID NO: 50031 - DNA, 629 bp, Homo sapiens; identical to SEQ ID NO: 29170
  chr4:140655870-140656499
  hyper

SEQ ID NO: 50032 - DNA, 59 bp, Homo sapiens
  chr4:140657089-140657148
  hyper
ctgcggtgtgctccagcgggcgcatttcccaggccccgccacatcgtgtgtgttagtgg

SEQ ID NO: 50033 - DNA, 47 bp, Homo sapiens; identical to SEQ ID NO: 7547
  chr4:141294349-141294396
  hyper

SEQ ID NO: 50034 - DNA, 218 bp, Homo sapiens; identical to SEQ ID NO: 29173
  chr4:141294633-141294851
  hyper

SEQ ID NO: 50035 - DNA, 208 bp, Homo sapiens; identical to SEQ ID NO: 29174
  chr4:141295066-141295274
  hyper

SEQ ID NO: 50036 - DNA, 274 bp, Homo sapiens
  chr4:141348151-141348425
  hyper
ggagactgagacagccgagcctattttgatctcgtttgggtttctgtaaggagcagtcagcagagtgagcagcgcccagacgcgccccgggccccctctacaaccattgggagagcgccccgggctcaagcgtggaacggggctgcaatggcaaccgctggaataacggcctcggctcccggtggctcctcaagcccgcaggggaggccggccgggctaggcacctagctgtccccgtgctcgtccgccccagcccgggcgcagcaggtggatg

SEQ ID NO: 50037 - DNA, 54 bp, Homo sapiens
  chr4:141418867-141418921
  hyper
gaaggaggaaagatgcggacagatgctggctgtgtaagagcagttcttggggtc

SEQ ID NO: 50038 - DNA, 39 bp, Homo sapiens
  chr4:141419418-141419457
  hyper
gataatgccagggacggggttgagcgcgcagagccccct

SEQ ID NO: 50039 - DNA, 54 bp, Homo sapiens
  chr4:141488816-141488870
  hyper
atatgaatgttttctcgccaatttgttatgaaaaccactcctctgtgtgttaca

SEQ ID NO: 50040 - DNA, 15 bp, Homo sapiens
  chr4:142053505-142053520
  hyper
tggtgttggagccca

SEQ ID NO: 50041 - DNA, 505 bp, Homo sapiens
  chr4:142053734-142054239
  hyper
gcgcccgcactccgtcttctccgtgtgcagctccgcgccgccgccgcccgccgccccggccccggggtccggcgcgggctcggcgtaggtgatgttcacgaaggcggtgtaccattcctccttctcggccacggtaaagtccaggcagagcagatgcacgaaacaaaaggaaagcagccatgttgagagagccagactgcagcacgcttggatgagagacattgccatctttatccgccggggccccctccccgcccccgcgccctccctccgtcccgtccctcctccccagccccggccaaccccgggccgctgcctctcctcctgctgctgctcactcccgggccggaggggccgcggccgggacgcgcagccgccgcggggaccggattccgggcgagcggatggcgctggccccttcccctctcagctgtagcgcggtggttgcattttgcttcttgggcgcccggggggcgcgggaacagagggcccgcggggcttgcgg

SEQ ID NO: 50042 - DNA, 214 bp, Homo sapiens
  chr4:142054460-142054674
  hyper
ccgctgctgccctgcgccggttccctcaggctgcgggcgctgcgctcctgatctcgccggtggctgcgcctgggcacgcacttgccgcgggcggggcgggcttggggacagtgggagcgagcaggcagagcggagtaagcggtccgtgtgtgtgtgtctgtatgtttgtgtgtgtgtgtgtgtgtgtgtataatgtgtgcgtgcaaggaggagc

SEQ ID NO: 50043 - DNA, 169 bp, Homo sapiens
  chr4:143766930-143767099
  hyper
gaagtgagagcgagtgcccgggccaacctcagcgtctctcagggacagcgcaggtgggcgcagccttggaaggtcagcgaggccagagctcagagttccacgggggcccggagagtgtgcgtgtgtgagtgagaatgcgaaaacgcgcgcgcgccgggcagaggggcgc

SEQ ID NO: 50044 - DNA, 32 bp, Homo sapiens; identical to SEQ ID NO: 29181
  chr4:143767625-143767657
  hyper

SEQ ID NO: 50045 - DNA, 358 bp, Homo sapiens; identical to SEQ ID NO: 29182
  chr4:143767920-143768278
  hyper

SEQ ID NO: 50046 - DNA, 42 bp, Homo sapiens; identical to SEQ ID NO: 29183
  chr4:144480322-144480364
  hyper

SEQ ID NO: 50047 - DNA, 30 bp, Homo sapiens; identical to SEQ ID NO: 29184
  chr4:144620978-144621008
  hyper

SEQ ID NO: 50048 - DNA, 38 bp, Homo sapiens
  chr4:144621298-144621336
  hyper
accaaaggcctgttacgcgtcaccagctccagctggga

SEQ ID NO: 50049 - DNA, 173 bp, Homo sapiens
  chr4:144622058-144622231
  hyper
gctggcttctggggaccccagatacgcgcccagcgcggcgagacttagcgagggtgcagcgctgtcccctccgctcctgggcgcttcacccagcctaccttacacaccttctcgccgggagccgtggccgccgcactgctgcccgcgctgccagactccgaccagctgtctgg

SEQ ID NO: 50050 - DNA, 30 bp, Homo sapiens; identical to SEQ ID NO: 29188
  chr4:145567357-145567387
  hyper

SEQ ID NO: 50051 - DNA, 127 bp, Homo sapiens; identical to SEQ ID NO: 29189
  chr4:145567810-145567937
  hyper

SEQ ID NO: 50052 - DNA, 233 bp, Homo sapiens
  chr4:145568226-145568459
  hyper
ataacttttctatagcgctaacgtgattccgttgtgtgttcctctggggtaagcaagtagcatttcctcccccagagtccgcggtcgggatgctgtgcaaacttgcctatctctgaaaacagacgtttctgcggtacccgcaccctgggctgggtaaatattttaaaagaatcgcgatgaacagtgtgttttggatcgaatggggcattggctgcggtgaaactgtaaattaa

SEQ ID NO: 50053 - DNA, 156 bp, Homo sapiens
  chr4:147558116-147558272
  hyper
gctaggagttcccttcggctactatttattattttcctccacacaggggaagagaaagggaagcccgagaggatccagggaaagcagaagggggttaaggaccatggacagagcccgtcgcgcgctcgttgctgccgccttccccagcactctggc

SEQ ID NO: 50054 - DNA, 112 bp, Homo sapiens; identical to SEQ ID NO: 18590
  chr4:147558504-147558616
  hyper

SEQ ID NO: 50055 - DNA, 131 bp, Homo sapiens; identical to SEQ ID NO: 18591
  chr4:147559190-147559321
  hyper

SEQ ID NO: 50056 - DNA, 18 bp, Homo sapiens
  chr4:147560915-147560933
  hyper
ttgtaggcgcggcgacgg

SEQ ID NO: 50057 - DNA, 40 bp, Homo sapiens; identical to SEQ ID NO: 18592
  chr4:147562055-147562095
  hyper

SEQ ID NO: 50058 - DNA, 151 bp, Homo sapiens; identical to SEQ ID NO: 29200
  chr4:147569117-147569268
  hyper

SEQ ID NO: 50059 - DNA, 257 bp, Homo sapiens; identical to SEQ ID NO: 29201
  chr4:147569278-147569535
  hyper

SEQ ID NO: 50060 - DNA, 30 bp, Homo sapiens; identical to SEQ ID NO: 29202
  chr4:147569897-147569927
  hyper

SEQ ID NO: 50061 - DNA, 131 bp, Homo sapiens
  chr4:147576046-147576177
  hyper
gcggtgacagatgagcggctgggtcaggaaggagcccagttggtggaaatgacactctttccccgctccgggtcccctcccccaccccattcgcgttttctctctcggcctctcctccctcctcgccttgc

SEQ ID NO: 50062 - DNA, 205 bp, Homo sapiens; identical to SEQ ID NO: 18594
  chr4:147576639-147576844
  hyper

SEQ ID NO: 50063 - DNA, 356 bp, Homo sapiens; identical to SEQ ID NO: 29205
  chr4:148402241-148402597
  hyper

SEQ ID NO: 50064 - DNA, 46 bp, Homo sapiens; identical to SEQ ID NO: 29206
  chr4:149365169-149365215
  hyper

SEQ ID NO: 50065 - DNA, 139 bp, Homo sapiens; identical to SEQ ID NO: 29207
  chr4:150999450-150999589
  hyper

SEQ ID NO: 50066 - DNA, 57 bp, Homo sapiens; identical to SEQ ID NO: 29208
  chr4:151000206-151000263
  hyper

SEQ ID NO: 50067 - DNA, 202 bp, Homo sapiens; identical to SEQ ID NO: 29209
  chr4:154143837-154144039
  hyper

SEQ ID NO: 50068 - DNA, 79 bp, Homo sapiens; identical to SEQ ID NO: 29210
  chr4:154144397-154144476
  hyper

SEQ ID NO: 50069 - DNA, 195 bp, Homo sapiens; identical to SEQ ID NO: 29211
  chr4:154680759-154680954
  hyper

SEQ ID NO: 50070 - DNA, 21 bp, Homo sapiens
  chr4:154681176-154681197
  hyper
gggagcctcccggcacgcccc

SEQ ID NO: 50071 - DNA, 139 bp, Homo sapiens; identical to SEQ ID NO: 29213
  chr4:154681198-154681337
  hyper

SEQ ID NO: 50072 - DNA, 93 bp, Homo sapiens; identical to SEQ ID NO: 29214
  chr4:154709106-154709199
  hyper

SEQ ID NO: 50073 - DNA, 48 bp, Homo sapiens; identical to SEQ ID NO: 18600
  chr4:154709476-154709524
  hyper

SEQ ID NO: 50074 - DNA, 169 bp, Homo sapiens
  chr4:154712003-154712172
  hyper
agagctaataaagagcgtgagctctgagagatgctacgacttgggcctgggagtgggataagggccctctcgctttcacgcccccccaaccccccgccggccccggccaacccctaaatccccaacgccctccgctggggtcgcctcctccccgcagagccccttgttg

SEQ ID NO: 50075 - DNA, 117 bp, Homo sapiens
  chr4:154712594-154712711
  hyper
gcccatatgagcagcgcagggatgggacactgggtgcccatcccagcgcgcctccccagactggtccctgggatgctcacacgtggcgcggcaccgcggcggcgccttcacgaaccc

SEQ ID NO: 50076 - DNA, 257 bp, Homo sapiens; identical to SEQ ID NO: 29221
  chr4:154713532-154713789
  hyper

SEQ ID NO: 50077 - DNA, 159 bp, Homo sapiens
  chr4:154713790-154713949
  hyper
aggggtggggggatgacctcattccttcgcctttggccctccctctacccggccccacaacgaggacgcccctgcagctggctgggccgcttcctcttgccacgcggggggacctgtgcccgcggccgtgcacctccgtgtacgcttctgctcctcgga

SEQ ID NO: 50078 - DNA, 119 bp, Homo sapiens
  chr4:155254047-155254166
  hyper
cagcatttgtgtcatcggtgagagagactcactgacttccacttgatagaccaaatgttcgaaagtccaggatgggctgtgttcgcgtttctcgataacgactgtcagcaccagcaggg

SEQ ID NO: 50079 - DNA, 134 bp, Homo sapiens
  chr4:155254196-155254330
  hyper
ccctgagagtcagcgtgagctcccgctgctcgcccgcgcccaggctgccgttgaggaacagcacccccagggctctgtcgatggcaaagacgcctggctgcgggctggcgatggagtaccggatgagtccgttc

SEQ ID NO: 50080 - DNA, 56 bp, Homo sapiens; identical to SEQ ID NO: 7579
  chr4:155411438-155411494
  hyper

SEQ ID NO: 50081 - DNA, 164 bp, Homo sapiens
  chr4:155412279-155412443
  hyper
cccctcatctacggaaagggtgaggttgaacaactgggcagaggagcccgaggccgcccacagccacacgtgcaccaagagccagagcagggagcgctgcgtcctggcgccgctgctgcctgaccgcccatggggtgtatctctcctcccggggagcagaagga

SEQ ID NO: 50082 - DNA, 185 bp, Homo sapiens; identical to SEQ ID NO: 29226
  chr4:155413374-155413559
  hyper

SEQ ID NO: 50083 - DNA, 258 bp, Homo sapiens; identical to SEQ ID NO: 29227
  chr4:155548046-155548304
  hyper

SEQ ID NO: 50084 - DNA, 274 bp, Homo sapiens
  chr4:155663647-155663921
  hyper
atgaatgttccttcatccatcatccgcagagtaccctcaggcgtgcgtagaatctgctgatgaaacctattagcgccgactgggcagctttgtggagccacccgaggctctccattgtggcctttgtctgcagaatttaagcatttacataatgcattagcacggaactcagcacccggtggggacatcgcgtgccaagcctggcgcggccaacgcttcagcggctccctcacccggcagctccctaggaccaccctcgaggaggcattggagt

SEQ ID NO: 50085 - DNA, 110 bp, Homo sapiens; identical to SEQ ID NO: 7583
  chr4:155664194-155664304
  hyper

SEQ ID NO: 50086 - DNA, 60 bp, Homo sapiens; identical to SEQ ID NO: 18608
  chr4:155665385-155665445
  hyper

SEQ ID NO: 50087 - DNA, 57 bp, Homo sapiens; identical to SEQ ID NO: 29231
  chr4:155665721-155665778
  hyper

SEQ ID NO: 50088 - DNA, 159 bp, Homo sapiens; identical to SEQ ID NO: 29232
  chr4:156129228-156129387
  hyper

SEQ ID NO: 50089 - DNA, 8 bp, Homo sapiens
  chr4:156129443-156129451
  hyper
cgctcgcc

SEQ ID NO: 50090 - DNA, 251 bp, Homo sapiens
  chr4:156129495-156129746
  hyper
ccgccccgcctttgccctcgccttttcccggggcggatttggtgaagtcggcctcaagtccaggaggtctgtcttcgccgggccagctctcgcggaactggggggtagagagcaaagggagagattcgtggaagggaagggaggtaggggtggcgcaaacgcccagagtatcaaacttgggggtggcacagtaggtgacagcagcagctgcaggtggtggctggggacccgcgagggggcgcccctctggg

SEQ ID NO: 50091 - DNA, 250 bp, Homo sapiens; identical to SEQ ID NO: 18611
  chr4:156129797-156130047
  hyper

SEQ ID NO: 50092 - DNA, 29 bp, Homo sapiens
  chr4:156297387-156297416
  hyper
cttcaaaataagtcacgtcttatttaaaa

SEQ ID NO: 50093 - DNA, 30 bp, Homo sapiens; identical to SEQ ID NO: 29236
  chr4:156588105-156588135
  hyper

SEQ ID NO: 50094 - DNA, 227 bp, Homo sapiens; identical to SEQ ID NO: 29237
  chr4:156588456-156588683
  hyper

SEQ ID NO: 50095 - DNA, 355 bp, Homo sapiens; identical to SEQ ID NO: 29238
  chr4:156588684-156589039
  hyper

SEQ ID NO: 50096 - DNA, 69 bp, Homo sapiens; identical to SEQ ID NO: 29239
  chr4:156589040-156589109
  hyper

SEQ ID NO: 50097 - DNA, 70 bp, Homo sapiens; identical to SEQ ID NO: 7591
  chr4:156680699-156680769
  hyper

SEQ ID NO: 50098 - DNA, 200 bp, Homo sapiens; identical to SEQ ID NO: 7592
  chr4:156680770-156680970
  hyper

SEQ ID NO: 50099 - DNA, 130 bp, Homo sapiens; identical to SEQ ID NO: 29243
  chr4:156681218-156681348
  hyper

SEQ ID NO: 50100 - DNA, 41 bp, Homo sapiens; identical to SEQ ID NO: 29244
  chr4:157892721-157892762
  hyper

SEQ ID NO: 50101 - DNA, 49 bp, Homo sapiens; identical to SEQ ID NO: 29245
  chr4:157997406-157997455
  hyper

SEQ ID NO: 50102 - DNA, 30 bp, Homo sapiens; identical to SEQ ID NO: 29247
  chr4:158141957-158141987
  hyper

SEQ ID NO: 50103 - DNA, 25 bp, Homo sapiens
  chr4:158142822-158142847
  hyper
gctatttcctaggggcgccgatcaa

SEQ ID NO: 50104 - DNA, 24 bp, Homo sapiens
  chr4:158142999-158143023
  hyper
gaaggccagcgagtgtgagtgtgt

SEQ ID NO: 50105 - DNA, 74 bp, Homo sapiens; identical to SEQ ID NO: 18617
  chr4:158143369-158143443
  hyper

SEQ ID NO: 50106 - DNA, 2 bp, Homo sapiens
  chr4:158143609-158143611
  hyper
cg

SEQ ID NO: 50107 - DNA, 30 bp, Homo sapiens; identical to SEQ ID NO: 7595
  chr4:158144242-158144272
  hyper

SEQ ID NO: 50108 - DNA, 25 bp, Homo sapiens
  chr4:164252966-164252991
  hyper
gcttcgggtgtctatcggggcgcag

SEQ ID NO: 50109 - DNA, 30 bp, Homo sapiens; identical to SEQ ID NO: 29254
  chr4:164253751-164253781
  hyper

SEQ ID NO: 50110 - DNA, 183 bp, Homo sapiens; identical to SEQ ID NO: 29255
  chr4:164264670-164264853
  hyper

SEQ ID NO: 50111 - DNA, 250 bp, Homo sapiens; identical to SEQ ID NO: 29256
  chr4:164265192-164265442
  hyper

SEQ ID NO: 50112 - DNA, 297 bp, Homo sapiens; identical to SEQ ID NO: 29257
  chr4:164265443-164265740
  hyper

SEQ ID NO: 50113 - DNA, 58 bp, Homo sapiens
  chr4:165304457-165304515
  hyper
cagttgcagtgaacccgactcagggttgagcgcatcagcgctaaacccaagacaaagg

SEQ ID NO: 50114 - DNA, 446 bp, Homo sapiens
  chr4:165304578-165305024
  hyper
cacactaggagcgcgtgagcctgtgaagtggctgtcatcgactccgcgctttccgaggggtgcggctccgtgactagtaccacgccggtgtaaacagcgcgccgcgcactggggatccgccagaaacggcgcgcgcgcagagcgggcgctgggggccaatagtagcaactaccccaggctgcgggctggagccgcctcctctcaccagagaggcgcctactgggcgagcccgccgcccgcaggttgggtggcagcacccgccgcgaaccccagccacgctccccagtggacccaccaggcaaaggcacctgctgcctgccctccagggctgatgctgtgccaagccccgctcgggatcagggacaagccgcccaggactaccagccggagagaaggggctcccagtgaggctgattgaatgaatgatgtttgcagtcacttaccgg

SEQ ID NO: 50115 - DNA, 27 bp, Homo sapiens
  chr4:165305163-165305190
  hyper
ccggctctggctcggctccccagtcct

SEQ ID NO: 50116 - DNA, 492 bp, Homo sapiens; identical to SEQ ID NO: 29260
  chr4:166299918-166300410
  hyper

SEQ ID NO: 50117 - DNA, 71 bp, Homo sapiens; identical to SEQ ID NO: 29261
  chr4:166793784-166793855
  hyper

SEQ ID NO: 50118 - DNA, 74 bp, Homo sapiens; identical to SEQ ID NO: 18627
  chr4:166794697-166794771
  hyper

SEQ ID NO: 50119 - DNA, 254 bp, Homo sapiens; identical to SEQ ID NO: 18628
  chr4:166794909-166795163
  hyper

SEQ ID NO: 50120 - DNA, 32 bp, Homo sapiens; identical to SEQ ID NO: 29263
  chr4:166795606-166795638
  hyper

SEQ ID NO: 50121 - DNA, 64 bp, Homo sapiens
  chr4:166796212-166796276
  hyper
gtaaaggttgcatggtggttggggctaacctagcagagcggtttgtaagcggaaggcacgttag

SEQ ID NO: 50122 - DNA, 239 bp, Homo sapiens; identical to SEQ ID NO: 18630
  chr4:168155269-168155508
  hyper

SEQ ID NO: 50123 - DNA, 72 bp, Homo sapiens; identical to SEQ ID NO: 29267
  chr4:168155795-168155867
  hyper

SEQ ID NO: 50124 - DNA, 443 bp, Homo sapiens; identical to SEQ ID NO: 29268
  chr4:170947424-170947867
  hyper

SEQ ID NO: 50125 - DNA, 552 bp, Homo sapiens; identical to SEQ ID NO: 29269
  chr4:172733596-172734148
  hyper

SEQ ID NO: 50126 - DNA, 73 bp, Homo sapiens; identical to SEQ ID NO: 18632
  chr4:172734203-172734276
  hyper

SEQ ID NO: 50127 - DNA, 115 bp, Homo sapiens; identical to SEQ ID NO: 404
  chr4:172734277-172734392
  hyper

SEQ ID NO: 50128 - DNA, 15 bp, Homo sapiens
  chr4:172734845-172734860
  hyper
gattgatgggcagag

SEQ ID NO: 50129 - DNA, 185 bp, Homo sapiens; identical to SEQ ID NO: 29274
  chr4:172735016-172735201
  hyper

SEQ ID NO: 50130 - DNA, 10 bp, Homo sapiens
  chr4:174429648-174429658
  hyper
cggacctctg

SEQ ID NO: 50131 - DNA, 77 bp, Homo sapiens
  chr4:174430233-174430310
  hyper
tattattccacttcacgagtactaaggaggagtccagaattggtggccgtcctccctcttgttttctcatgcaaata

SEQ ID NO: 50132 - DNA, 78 bp, Homo sapiens
  chr4:174431072-174431150
  hyper
ctttctggccctcatttcccctgcttctcactttagttcactgctgttttaaaaattcatatgcgggctcatttaaaa

SEQ ID NO: 50133 - DNA, 498 bp, Homo sapiens; identical to SEQ ID NO: 29278
  chr4:174437937-174438435
  hyper

SEQ ID NO: 50134 - DNA, 91 bp, Homo sapiens
  chr4:174440257-174440348
  hyper
cagaggaggagtaaatgcagagaaaaaatagaggaaggaataaaaaaaaaaacaaaacaaaaacacgtaacatacacgcactcaaaaccaa

SEQ ID NO: 50135 - DNA, 47 bp, Homo sapiens
  chr4:174440713-174440760
  hyper
ggctgatgtcattgctctcacaagatcataaacgtaaaagagtcatc

SEQ ID NO: 50136 - DNA, 12 bp, Homo sapiens
  chr4:174443551-174443563
  hyper
agatgtccctaa

SEQ ID NO: 50137 - DNA, 139 bp, Homo sapiens
  chr4:174443934-174444073
  hyper
ggcccccggaaacgtgggattggtttcctctcccggagttctcccctcccccttctttctaaacatttaaaaaacacgtagtccgtctcccccaacccccattcccggtagacttaatcccaacagcaattcattgcac

SEQ ID NO: 50138 - DNA, 155 bp, Homo sapiens; identical to SEQ ID NO: 29283
  chr4:174448460-174448615
  hyper

SEQ ID NO: 50139 - DNA, 38 bp, Homo sapiens; identical to SEQ ID NO: 29284
  chr4:174449624-174449662
  hyper

SEQ ID NO: 50140 - DNA, 17 bp, Homo sapiens
  chr4:174449933-174449950
  hyper
tgccttgaaggcctccg

SEQ ID NO: 50141 - DNA, 127 bp, Homo sapiens
  chr4:174451728-174451855
  hyper
aagaaagaaagaaaacgcaggtattgcttttcgaagtgctttgtaggtaatcgaggtaagaaaatatacgcaggcagcctcttacaattttatgcaggggcgccgggagcctcgtgacgggcggtgg

SEQ ID NO: 50142 - DNA, 75 bp, Homo sapiens
  chr4:174452098-174452173
  hyper
ttatttccacatccttcagggacaccagtccctacgaagaccttgggcgattttgaagtgcgggcacctcgattc

SEQ ID NO: 50143 - DNA, 61 bp, Homo sapiens; identical to SEQ ID NO: 29289
  chr4:174452696-174452757
  hyper

SEQ ID NO: 50144 - DNA, 144 bp, Homo sapiens; identical to SEQ ID NO: 29292
  chr4:174459923-174460067
  hyper

SEQ ID NO: 50145 - DNA, 29 bp, Homo sapiens
  chr4:175134868-175134897
  hyper
cctctgggtccttaccgaaagggaaggtc

SEQ ID NO: 50146 - DNA, 38 bp, Homo sapiens
  chr4:175135672-175135710
  hyper
gcggcagtgaggctgggtggtttcgcccccctcatccc

SEQ ID NO: 50147 - DNA, 131 bp, Homo sapiens; identical to SEQ ID NO: 29296
  chr4:175136030-175136161
  hyper

SEQ ID NO: 50148 - DNA, 30 bp, Homo sapiens; identical to SEQ ID NO: 7627
  chr4:175137723-175137753
  hyper

SEQ ID NO: 50149 - DNA, 418 bp, Homo sapiens
  chr4:175138546-175138964
  hyper
ggacttatcctctgacctgcaatgtctccccacctggtgctctacagctccagagagcagggatttcagcttttcctccctcattggatccaatttcaatcccctcggttaactgaaagtgtgttgacttccacccagccggcaggaccctaagggcgcctggagcagtctggtgcgggtcctggctgcagcatgcccagcagagctccgggtgcaggaggctgcaaagccaccgccgcgtccaggccccttgagcggaggtgggaacgatccgccttagagttcaaggtgaattgctgtgacagtggcgggtggaggaggggagttcgagccgttcgcctcggggaagaattatccccgatcatttatttttagatctgaattcctccagaacccagcagaggctgtggccagagcc

SEQ ID NO: 50150 - DNA, 305 bp, Homo sapiens
  chr4:175139254-175139559
  hyper
tgaatcttcccagttccttccctgtttatttctcaacccagcagttcaaaaattcactttataacggtcccctaacaaaaacacgagtaagaaagatagcaaagaattaagctggacaggcacccatgttgcgaaaaaggttttgcttggagactgcaggagagggctatccctctttacaattcacgacgttactaccaactttgccattgagtggttcctctccctgcccgaattcctggccatcttcgttccagagagcgatgcaatcatggccttgaaaccgaacggggcgtaacgtgcca

SEQ ID NO: 50151 - DNA, 30 bp, Homo sapiens; identical to SEQ ID NO: 29299
  chr4:175749823-175749853
  hyper

SEQ ID NO: 50152 - DNA, 192 bp, Homo sapiens; identical to SEQ ID NO: 18643
  chr4:175750264-175750456
  hyper

SEQ ID NO: 50153 - DNA, 15 bp, Homo sapiens
  chr4:176922653-176922668
  hyper
gttcttcctcccctc

SEQ ID NO: 50154 - DNA, 50 bp, Homo sapiens; identical to SEQ ID NO: 29302
  chr4:176922729-176922779
  hyper

SEQ ID NO: 50155 - DNA, 301 bp, Homo sapiens; identical to SEQ ID NO: 29303
  chr4:176922780-176923081
  hyper

SEQ ID NO: 50156 - DNA, 342 bp, Homo sapiens
  chr4:176923082-176923424
  hyper
ctattcggatcctgggtctcttagtctttctttatttcccaaataccgcccccagcacggtagaccggacccccaggcttgggtcctggggccggcgcagaggatcagcgcccaagcgcagccccccaccctcccgacccactgtaaacagtcgggcaccctccctcgcctccaggtgccaccccatcgccatcgcctctctcccagaaaaaaaagtccggagacaagagggcggggggcgggggacgccaggcgcggggggaacagagctgggaaggacgcagtctgaggccgaggaacattcattttctttctataatgcccattcccgaggccgagcct

SEQ ID NO: 50157 - DNA, 85 bp, Homo sapiens; identical to SEQ ID NO: 18647
  chr4:176923558-176923643
  hyper

SEQ ID NO: 50158 - DNA, 124 bp, Homo sapiens; identical to SEQ ID NO: 2495
  chr4:176987050-176987174
  hyper

SEQ ID NO: 50159 - DNA, 5 bp, Homo sapiens
  chr4:176987175-176987180
  hyper
cccgc

SEQ ID NO: 50160 - DNA, 107 bp, Homo sapiens; identical to SEQ ID NO: 2497
  chr4:176987206-176987313
  hyper

SEQ ID NO: 50161 - DNA, 10 bp, Homo sapiens
  chr4:176987314-176987324
  hyper
agaggggctc

SEQ ID NO: 50162 - DNA, 614 bp, Homo sapiens; identical to SEQ ID NO: 29310
  chr4:177713605-177714219
  hyper

SEQ ID NO: 50163 - DNA, 327 bp, Homo sapiens
  chr4:180979300-180979627
  hyper
aggtgggtctggagtgtcacgtaggcaccccaactcgcgccgggggccgtggtccgcagactcccacttcattgccccggaggcctgagcccgccccgcccggctgtggctgcacctttcccgagagtcggggcagcggcggctcgaaagtggaggcagcctaaccgcgtagcgctgaaaccaccattcacaaatgcaaacccctgtcttctgtggataaacggtggcggcgcgcgtccgagcgtccccgaggggctgtggggagcccccggggagagcaggaaaggaagcggggtggcggtggctaggaagcgactgagccttctc

SEQ ID NO: 50164 - DNA, 19 bp, Homo sapiens
  chr4:180980278-180980297
  hyper
gcgcctttggcgaggcggc

SEQ ID NO: 50165 - DNA, 91 bp, Homo sapiens; identical to SEQ ID NO: 7642
  chr4:183062455-183062546
  hyper

SEQ ID NO: 50166 - DNA, 23 bp, Homo sapiens
  chr4:183063950-183063973
  hyper
cactcactcggcagccccaagca

SEQ ID NO: 50167 - DNA, 219 bp, Homo sapiens
  chr4:183064655-183064874
  hyper
ctgccacctcctcgggtgactcagctgacctgaaatgcccaccctacggaagatcaagaaaagtagttttctaagaaggttagaggtttgattacacagagaagtgtttccacttaagtccaaagcaattacccgccccctcccccagggccgcctccccgccacccgcagcagaaaaggacagacccccacgcacgtacccccattttgttggtgcgt

SEQ ID NO: 50168 - DNA, 527 bp, Homo sapiens
  chr4:183064966-183065493
  hyper
atcagcgtgaagtgttattcacggatgacccctaaatcacggcgagagtagtaaaggcactgattggtcacagcatgggagcctcggtgctttcccgaacccgacgcggccgggaggagggaaggagggaggggcggcgaacgtggttcagtccggcaaatcccatttgacagaaaaaggcagtaaacggggaatctctttttttgaataaagaagaagaagaaataaagtacctgtcatcttgacaagtggcggagcggaggagtcaaggattataaatgatcacagccaggtccagctcgccccgtgattgggctctcccgcgatctgcaccgggggaagcgcatggtaggctcctctcctctcctcctctccctcgcacactcccgcacacacacacacacacacacacacggacacgtgtacgcgcccgggctcgggcacactcggcccggcgcgtcccccgccgcacaattacggtcctggatgccgctccctggccgggcgtcccgcgggcctcctcacct

SEQ ID NO: 50169 - DNA, 297 bp, Homo sapiens; identical to SEQ ID NO: 29316
  chr4:183369261-183369558
  hyper

SEQ ID NO: 50170 - DNA, 37 bp, Homo sapiens; identical to SEQ ID NO: 29317
  chr4:183369966-183370003
  hyper

SEQ ID NO: 50171 - DNA, 40 bp, Homo sapiens; identical to SEQ ID NO: 29318
  chr4:183727758-183727798
  hyper

SEQ ID NO: 50172 - DNA, 30 bp, Homo sapiens; identical to SEQ ID NO: 29320
  chr4:184019532-184019562
  hyper

SEQ ID NO: 50173 - DNA, 9 bp, Homo sapiens
  chr4:184020179-184020188
  hyper
taagctcag

SEQ ID NO: 50174 - DNA, 156 bp, Homo sapiens; identical to SEQ ID NO: 29322
  chr4:184020571-184020727
  hyper

SEQ ID NO: 50175 - DNA, 75 bp, Homo sapiens; identical to SEQ ID NO: 29323
  chr4:184021203-184021278
  hyper

SEQ ID NO: 50176 - DNA, 61 bp, Homo sapiens
  chr4:184718199-184718260
  hyper
tcattaaccagtcagcgaatccacttgttccagcgagaggtgggaggtgggggcaggggtg

SEQ ID NO: 50177 - DNA, 63 bp, Homo sapiens
  chr4:184718352-184718415
  hyper
ctcgaggcccaacacccaaaggctcacccctaggccatccgcgctccccgaccacctccctca

SEQ ID NO: 50178 - DNA, 100 bp, Homo sapiens; identical to SEQ ID NO: 29325
  chr4:184718735-184718835
  hyper

SEQ ID NO: 50179 - DNA, 154 bp, Homo sapiens; identical to SEQ ID NO: 29326
  chr4:184719233-184719387
  hyper

SEQ ID NO: 50180 - DNA, 74 bp, Homo sapiens; identical to SEQ ID NO: 29328
  chr4:184826583-184826657
  hyper

SEQ ID NO: 50181 - DNA, 56 bp, Homo sapiens; identical to SEQ ID NO: 29330
  chr4:184827574-184827630
  hyper

SEQ ID NO: 50182 - DNA, 54 bp, Homo sapiens
  chr4:185089642-185089696
  hyper
gctggaagctttgcacgggggtgaaagttacaggcagacactgcccgcggggct

SEQ ID NO: 50183 - DNA, 95 bp, Homo sapiens
  chr4:185937889-185937984
  hyper
caggcctggctctgcgccctgaggctcccaggtcccaccagctagaagagcgccgcctacccacccctgccaaggtctaacgaccccaagggggg

SEQ ID NO: 50184 - DNA, 267 bp, Homo sapiens
  chr4:185938230-185938497
  hyper
ggcagcaagtgtgagcgaggcccgtcctgggggaggtggcctctggccgcggggccaggttgccctcagaggcgcaggcggccaagagagttcccagccgccgccgcccccctccttccccttgggcccgtccagcaaatttcctccctcgtttctgttcgtgccttccctccctcctcctccccccgatattttcgctttctaaaaccataaaaaagagatcaacttcccaaacttcacagggcccttttcagtgacaaatattga

SEQ ID NO: 50185 - DNA, 182 bp, Homo sapiens
  chr4:185938564-185938746
  hyper
aaaagttaacaatgctgtgaaaatatgtttgcagaaaatagacaatcgttggattaaacgtattcaagtatgaaataatgcctttttgtgtcaaaacttgggcgatgggcgggtacaaaagttccctgtggcagctacttgctccctttgtgagccgtgcgctttggcgtctccacttgggc

SEQ ID NO: 50186 - DNA, 212 bp, Homo sapiens; identical to SEQ ID NO: 7652
  chr4:185939694-185939906
  hyper

SEQ ID NO: 50187 - DNA, 44 bp, Homo sapiens; identical to SEQ ID NO: 18661
  chr4:185940294-185940338
  hyper

SEQ ID NO: 50188 - DNA, 30 bp, Homo sapiens; identical to SEQ ID NO: 29337
  chr4:185941006-185941036
  hyper

SEQ ID NO: 50189 - DNA, 25 bp, Homo sapiens
  chr4:185941560-185941585
  hyper
ttgcagtccaaggcccgcctgggcg

SEQ ID NO: 50190 - DNA, 174 bp, Homo sapiens; identical to SEQ ID NO: 18663
  chr4:185942760-185942934
  hyper

SEQ ID NO: 50191 - DNA, 225 bp, Homo sapiens; identical to SEQ ID NO: 29340
  chr4:186048748-186048973
  hyper

SEQ ID NO: 50192 - DNA, 561 bp, Homo sapiens; identical to SEQ ID NO: 29341
  chr4:186049504-186050065
  hyper

SEQ ID NO: 50193 - DNA, 214 bp, Homo sapiens; identical to SEQ ID NO: 29342
  chr4:186456012-186456226
  hyper

SEQ ID NO: 50194 - DNA, 34 bp, Homo sapiens; identical to SEQ ID NO: 29343
  chr4:186456784-186456818
  hyper

SEQ ID NO: 50195 - DNA, 163 bp, Homo sapiens; identical to SEQ ID NO: 29344
  chr4:187026723-187026886
  hyper

SEQ ID NO: 50196 - DNA, 31 bp, Homo sapiens; identical to SEQ ID NO: 29345
  chr5:53156-53187
  hyper

SEQ ID NO: 50197 - DNA, 116 bp, Homo sapiens; identical to SEQ ID NO: 29346
  chr5:53500-53616
  hyper

SEQ ID NO: 50198 - DNA, 7 bp, Homo sapiens
  chr5:53842-53849
  hyper
acgtgaa

SEQ ID NO: 50199 - DNA, 3 bp, Homo sapiens
  chr5:54002-54005
  hyper
cgc

SEQ ID NO: 50200 - DNA, 42 bp, Homo sapiens; identical to SEQ ID NO: 29349
  chr5:54390-54432
  hyper

SEQ ID NO: 50201 - DNA, 229 bp, Homo sapiens; identical to SEQ ID NO: 29350
  chr5:91895-92124
  hyper

SEQ ID NO: 50202 - DNA, 52 bp, Homo sapiens
  chr5:320788-320840
  hyper
cgccagtgacagcctcggccgcgttgctgaaaaccgaccttgcgggatgaag

SEQ ID NO: 50203 - DNA, 352 bp, Homo sapiens; identical to SEQ ID NO: 18670
  chr5:320982-321334
  hyper

SEQ ID NO: 50204 - DNA, 30 bp, Homo sapiens; identical to SEQ ID NO: 29352
  chr5:321585-321615
  hyper

SEQ ID NO: 50205 - DNA, 148 bp, Homo sapiens; identical to SEQ ID NO: 29353
  chr5:321900-322048
  hyper

SEQ ID NO: 50206 - DNA, 191 bp, Homo sapiens; identical to SEQ ID NO: 29354
  chr5:322061-322252
  hyper

SEQ ID NO: 50207 - DNA, 138 bp, Homo sapiens; identical to SEQ ID NO: 29355
  chr5:322265-322403
  hyper

SEQ ID NO: 50208 - DNA, 30 bp, Homo sapiens; identical to SEQ ID NO: 29356
  chr5:344257-344287
  hyper

SEQ ID NO: 50209 - DNA, 87 bp, Homo sapiens
  chr5:374266-374353
  hyper
tgtgcccccacccgcgctgccccagcccgcggacctcggcggggagcgcccagggccagcacgggggtctcacggggcgaccccagc

SEQ ID NO: 50210 - DNA, 25 bp, Homo sapiens
  chr5:523778-523803
  hyper
ctgctgggtttcatgcgggtagcac

SEQ ID NO: 50211 - DNA, 481 bp, Homo sapiens
  chr5:523856-524337
  hyper
cgtttctctaaaaagcctgagaaccccgaaggaaacccggccccggggactccctgggcgcgagcagcctgcagtctgcggggctcggagcggaggcggggcggagaccccacagggacccgggagccgggagtccggggctccgaggctgtgcccccgccggggaggggagacctcgggacccgcaggggcggcttagcgcggccagagtcgctcccgagtctcgctctgctggacccgagagccggactctcccgggcggccgccgcgcggctccgacctgatgcgcgcggccacaacgaagcccccaggcccagcagaggcggccgcacaccccgcgggcagatccggagaccccggggccacttaccgatcttggccaagctggccacgaggatccagagcgcgatgacgtagggatcctgcacgtgggcccactcgaaggtgaccacctggaagcccccgctctcgccgtgcgcgc

SEQ ID NO: 50212 - DNA, 456 bp, Homo sapiens
  chr5:524404-524860
  hyper
ccggtcggggccccgggccccgagtccccacattgccgcctgctcagcgcagggctgggacgcgcatgtcgcggggggtcccggctgggctgggccgacgcgcggggctgggacccggcgaggacccggcgcgctccggtgccggtaccggctacagtccgatccccgcccgccggggtggcctttaatcccgcggccccctcccgccccggggcggagcctgcccgcccccgccgcgcactcgcgagcgcagacaccgccgcagctcccggcacgcccgccccgcccgcgcacgcccaccccgcgctccctggtgcccaccctcccccggagcccgcggcctggaggtccgggaggtcgcggcaagagcgagcccgggactgcgcggccgccttcctggggcgtggggagcacagcgcggggcagcgggacaggcggttccgcgcagctcctggg

SEQ ID NO: 50213 - DNA, 32 bp, Homo sapiens; identical to SEQ ID NO: 29360
  chr5:926725-926757
  hyper

SEQ ID NO: 50214 - DNA, 154 bp, Homo sapiens; identical to SEQ ID NO: 29361
  chr5:1155721-1155875
  hyper

SEQ ID NO: 50215 - DNA, 55 bp, Homo sapiens; identical to SEQ ID NO: 29362
  chr5:1156350-1156405
  hyper

SEQ ID NO: 50216 - DNA, 73 bp, Homo sapiens
  chr5:1294557-1294630
  hyper
acgtcgtcgcccacgcggcgcagcagcagcccccacgccccgctcccccgcagtgcgtcggtcaccgtgttgg

SEQ ID NO: 50217 - DNA, 264 bp, Homo sapiens; identical to SEQ ID NO: 18674
  chr5:1294767-1295031
  hyper

SEQ ID NO: 50218 - DNA, 37 bp, Homo sapiens
  chr5:1295662-1295699
  hyper
tccgggcaccacgaatgccggacgtgaaggggaggac

SEQ ID NO: 50219 - DNA, 66 bp, Homo sapiens; identical to SEQ ID NO: 29365
  chr5:1444697-1444763
  hyper

SEQ ID NO: 50220 - DNA, 320 bp, Homo sapiens
  chr5:1444851-1445171
  hyper
cgctcctgaacgcggggcctcagaggcgagttttgggtctacacagcaaaatgtggcccgttagaaagcgtccttcctcaccgcgcccagaacaagaagcggcgctgcctggcgagtcctcgcccggcctccccgccctgcccagagcaccagcgcgcagcccgcgcccgccaccacccccaacacagacaaagcccccgcgagatggagcggcggtgtacaaaacccactccgatcggatctgggatgcgccgcacccctagtagggttaagttccacgagaagaaaccaggacccccgagtcacagccatagacaccc

SEQ ID NO: 50221 - DNA, 76 bp, Homo sapiens; identical to SEQ ID NO: 29367
  chr5:1445485-1445561
  hyper

SEQ ID NO: 50222 - DNA, 5 bp, Homo sapiens
  chr5:1445562-1445567
  hyper
gcctc

SEQ ID NO: 50223 - DNA, 170 bp, Homo sapiens
  chr5:1445568-1445738
  hyper
ggctcttatccagtagacagggtccgccccgccccgccctcccgccgacggggtcgccctcgcgtcctggctcctcctcctcacctccccgggccgcgcccccgcccccgcctcccggacgcagatggctgggagcaagcggcggccacggctccactgtcctgcgcgtc

SEQ ID NO: 50224 - DNA, 173 bp, Homo sapiens
  chr5:1445928-1446101
  hyper
gcggctgcgcgcggggaactgctgggaccccgtcgggccgacccttccctccctccccatcaggggcccctacggtggccccgcgctctggggaccacgtccctcccaccccgccgctccacgctctgaccagcgggctcgggaccccgccgaggactctgcacgcttcccgg

SEQ ID NO: 50225 - DNA, 83 bp, Homo sapiens; identical to SEQ ID NO: 18679
  chr5:1446236-1446319
  hyper

SEQ ID NO: 50226 - DNA, 366 bp, Homo sapiens; identical to SEQ ID NO: 29373
  chr5:1667728-1668094
  hyper

SEQ ID NO: 50227 - DNA, 467 bp, Homo sapiens; identical to SEQ ID NO: 29374
  chr5:1851534-1852001
  hyper

SEQ ID NO: 50228 - DNA, 354 bp, Homo sapiens; identical to SEQ ID NO: 18682
  chr5:1875099-1875453
  hyper

SEQ ID NO: 50229 - DNA, 373 bp, Homo sapiens
  chr5:1875497-1875870
  hyper
ccaagggaagggtgtgggggaagcgcccagcgaggggatgccatttcctgcgcgtccccttagaatgtggctgaatccgcctccccacccgacgtctttatttaacacaatctcgcagcttattcaaataagccagctttgtcagccagttccaccaagatccgggggctccagcgagatggaattcctatggccagggccacggggaggggctggggtcccgagggcagcaagcttggctggcggcaggagccctgggtcctccccaggagagggacccagagcccagaccaagtccaacccgccaacctgcgccacccatgcgcgcactgggggctgcagagccccgccaggctgcccgcggccgggagcg

SEQ ID NO: 50230 - DNA, 61 bp, Homo sapiens
  chr5:1876860-1876921
  hyper
gatggggaggggagcccggatttctgagcgtagccacggcttggccgggccccccgagccc

SEQ ID NO: 50231 - DNA, 14 bp, Homo sapiens
  chr5:1877089-1877103
  hyper
ggaaataggagagc

SEQ ID NO: 50232 - DNA, 196 bp, Homo sapiens
  chr5:1877818-1878014
  hyper
tggcctcttctgctccgagagcctctccttccgcgtcccaaatttgggaatggcccggtcaggctcaggcccaggcggtggaggccccggcgtggcagcgccgggcttgtccatgttcccaggagtccaagttcagaagccccctctccggtgggttggcggcttcgcggtggccgcgctagtcttcctctggaaa

SEQ ID NO: 50233 - DNA, 49 bp, Homo sapiens; identical to SEQ ID NO: 18685
  chr5:1878528-1878577
  hyper

SEQ ID NO: 50234 - DNA, 78 bp, Homo sapiens
  chr5:1879527-1879605
  hyper
ttgggacccccaagacgtcctagaaccgcagagaaggcactgtgcctgcactccagggcctcagcccccagtgacaac

SEQ ID NO: 50235 - DNA, 6 bp, Homo sapiens
  chr5:1879719-1879725
  hyper
tccgcg

SEQ ID NO: 50236 - DNA, 239 bp, Homo sapiens; identical to SEQ ID NO: 18687
  chr5:1882605-1882844
  hyper

SEQ ID NO: 50237 - DNA, 83 bp, Homo sapiens; identical to SEQ ID NO: 29385
  chr5:1883131-1883214
  hyper

SEQ ID NO: 50238 - DNA, 300 bp, Homo sapiens
  chr5:1883215-1883515
  hyper
gtggacggaggggccattcctccgggcgttagcaaataaattccatccgagtcaatatcgcccagcgaacggtgtttctctttagtcacccgagaacgagaggcacttttaattagaaattaattaatgagcagctgctccttcccgccccactgtaatcattcgtctcaattacaaatgagacctatgaaaggacacgctgaagatgtaatcaacagttaaaattagcccggcgctgcgcaggcggccggcccggcctcgcgctggcgcgctctgctccgagtggcaggaaggggctcg

SEQ ID NO: 50239 - DNA, 299 bp, Homo sapiens; identical to SEQ ID NO: 18689
  chr5:1883879-1884178
  hyper

SEQ ID NO: 50240 - DNA, 38 bp, Homo sapiens
  chr5:1884237-1884275
  hyper
cgggccatcccgaacccgttccccgccttctgcgccat

SEQ ID NO: 50241 - DNA, 108 bp, Homo sapiens
  chr5:1884698-1884806
  hyper
attcagacagtttagcgtcggtagccgcgagaaatatataaagaacacgagtcaaatgacattaataattgtttctgaattctgtattgatttcgcggcaggccgcgt

SEQ ID NO: 50242 - DNA, 241 bp, Homo sapiens
  chr5:1885458-1885699
  hyper
accaccaccgccaccttctcctgttctcttttgcctttccagcctgtgtgcataaatcgacgctccagtccccaccagcgggcgaccctttctccgtgacccagaaacctggcctctgaatcggctttcccaggccgccgcacacacacgctccacttcctgcccgccagcaggccccagcgcctggggtccgggcccagtcacagtcaccctgcctcgggaagctcgcaactgcccagga

SEQ ID NO: 50243 - DNA, 163 bp, Homo sapiens
  chr5:1886379-1886542
  hyper
ggagggagctccttccagcccagagaagttaactccagccaaaggcgaagccgggagcccggggcaccaggcaagggcctttctttctgagacctggggccagagaccttgggggcgcctgtgcccgcccaccgctcgggacacccggctggggtgtgggttt

SEQ ID NO: 50244 - DNA, 231 bp, Homo sapiens
  chr5:1886581-1886812
  hyper
cgaggttggcaggtcatttcctcacagccccgaggccccctcggagccagtggtaggagaaggagccacagggacaagcggtgaatctctggattcccaaccgccctccatgggggcccgcggccctctccctcctctctcccgctgcgcccccgccgcttgctccctgggtacggcctgaggctggacggagcgccgtccgggcgtccaggactcaggcctggccactcc

SEQ ID NO: 50245 - DNA, 288 bp, Homo sapiens
  chr5:1887737-1888025
  hyper
cctccgaggtcttagtatttcccccctcccccaccccccaaggcctgtggagggcgaggctgctgctccagccaaccctcggaattggctgcagggcgctcaggtcctgcctttcttcccctgcccctctcccaagcccctccgtgctaagcggcccagttctgggttctctcctggtgcccacgctagtccctagccggctcactctcaaaacagcaggctgtggcaggggcaaagcctaggtccgggcaccaggacccgggcaagtgggcgcgaatggaccacggt

SEQ ID NO: 50246 - DNA, 245 bp, Homo sapiens
  chr5:1931754-1931999
  hyper
tttggtctccgcagagctgggactcccgaaggccttaccagaaactcaggagcagccccagccctgcagagcccgcgagggtggagacgggagacccgctgtggggcctgaggctgagatgccggcctgcggtgaagccggcgggacgttccaacccgctcagacccgcccactccgcagggcccgggcccaccccccggcctgtggcctgtgctgggctgcgcagccggcggtggagggacctg

SEQ ID NO: 50247 - DNA, 138 bp, Homo sapiens; identical to SEQ ID NO: 29400
  chr5:1952723-1952861
  hyper

SEQ ID NO: 50248 - DNA, 281 bp, Homo sapiens
  chr5:2038424-2038705
  hyper
tgcactgttgaaaagcggcatttgcccaggcgtttcctctttacagacgagtcagtgtctttgccgtttggaaccttgtcttcactatgggatggcacttgatcgaggcggccccgcagcctgttccgcggtgctggcgtctccctctccctggcgaggctgccccgaacccctctgcaccctccctccaggtaccgcccctgggaggtccggtggggaccacggcccgcgacggccgccgcacagccacctcccggcgcgtgcagtgcgggcccggagcc

SEQ ID NO: 50249 - DNA, 13 bp, Homo sapiens
  chr5:2038850-2038863
  hyper
tcaggatctgacc

SEQ ID NO: 50250 - DNA, 15 bp, Homo sapiens
  chr5:2038947-2038962
  hyper
cgctggctccagcca

SEQ ID NO: 50251 - DNA, 32 bp, Homo sapiens
  chr5:2738816-2738848
  hyper
ctcaccacccccagccgcacgcttgggcctcc

SEQ ID NO: 50252 - DNA, 252 bp, Homo sapiens; identical to SEQ ID NO: 29405
  chr5:2739551-2739803
  hyper

SEQ ID NO: 50253 - DNA, 17 bp, Homo sapiens
  chr5:2739860-2739877
  hyper
cgggcctgaggctgagg

SEQ ID NO: 50254 - DNA, 31 bp, Homo sapiens; identical to SEQ ID NO: 18698
  chr5:2743713-2743744
  hyper

SEQ ID NO: 50255 - DNA, 62 bp, Homo sapiens; identical to SEQ ID NO: 29411
  chr5:2747745-2747807
  hyper

SEQ ID NO: 50256 - DNA, 82 bp, Homo sapiens
  chr5:2748292-2748374
  hyper
ctttggcttccatctcgccctccgccctcactctgctaattctgggtcccaggagtggccccctggatcttcttcccggacc

SEQ ID NO: 50257 - DNA, 31 bp, Homo sapiens
  chr5:2748459-2748490
  hyper
tttcttgggctcgtagccgccgcccggggac

SEQ ID NO: 50258 - DNA, 231 bp, Homo sapiens; identical to SEQ ID NO: 29413
  chr5:2748549-2748780
  hyper

SEQ ID NO: 50259 - DNA, 33 bp, Homo sapiens
  chr5:2749180-2749213
  hyper
gcacggtgggtggcacgaggggacagcgcaggc

SEQ ID NO: 50260 - DNA, 88 bp, Homo sapiens
  chr5:2751894-2751982
  hyper
ccgcccgctgcagcctccgggccgcggccgggggaggggcagagagacgggagggaggcgggggagggcggaggcgacggaggcgggc

SEQ ID NO: 50261 - DNA, 322 bp, Homo sapiens; identical to SEQ ID NO: 29417
  chr5:2752120-2752442
  hyper

SEQ ID NO: 50262 - DNA, 483 bp, Homo sapiens
  chr5:2752508-2752991
  hyper
cggtccactccgcccagcatggacctggatccggggcgccttggttgcgaattgccaggagggccctgaggtgagctttctgcccccaaatccgcagcgcaacccccggggccctgaacgttacgactttccactgttgggaatgacgccagggcttcagctaagaagacgccgtcccctaaagagttttattttattttgtttttctaagttgactcctctttcagatttgtgttgtcaaaacactggggggatgattgttacctgacaaaccgcctctggcaggacctgaagcctcccagtcacgtcgagaacgggcaggagctcaggttggcgccgccggtgcagtgggcattacaggtagctcaggtgacgcgcggctggagtaggggggcggttgccttgcggggctcagaagcgaggcggttggcgagggttcctaggaccccagcttcctagaaccctctccccatcacgcttctc

SEQ ID NO: 50263 - DNA, 8 bp, Homo sapiens
  chr5:2753040-2753048
  hyper
tccgaagg

SEQ ID NO: 50264 - DNA, 294 bp, Homo sapiens
  chr5:2753078-2753372
  hyper
aagagtgtcaggtctgtgctggcctattgggagcacccacccagcaggtgcctctatcctcggaagccgtctcgggtgggtgcggtggagaagagagagcgcagtggcctggggcgggcctcagctcaggcctgcagccgactcctgcacccctgctggccctgcagcctgcggagcagccttagtgatctcaggacgcagggcatgttgcggcctccctgtggtgcggctgcagcggcgcggagggagcggagcccgggttgccagtctggtccagggcgcaagagaaacact

SEQ ID NO: 50265 - DNA, 30 bp, Homo sapiens; identical to SEQ ID NO: 7713
  chr5:2754590-2754620
  hyper

SEQ ID NO: 50266 - DNA, 3 bp, Homo sapiens
  chr5:2755320-2755323
  hyper
ggg

SEQ ID NO: 50267 - DNA, 211 bp, Homo sapiens
  chr5:2756388-2756599
  hyper
gccttcctcccacagatgccccgcctccgacgtgcttcctgaagtttctctcccgctcagggtgcccacaatcctgaattctccagcatctcgccgactccgtctctaccctcctctccttcctaatctcgcgctggcttcgcccttttctctctcctcctccttcctacgcgccccgccccctccccccaggtcgcacctctccccgccc

SEQ ID NO: 50268 - DNA, 155 bp, Homo sapiens
  chr5:2757427-2757582
  hyper
ttgccaactgtaaattcggcgtgtgtgcccgaaactgctagccctgaccaggggctcggcagcacatggccaggcacacaccgaactcctccttcccaaatccttctgcaggatcctacacccctggagtatataggcagcgggaggggagggtt

SEQ ID NO: 50269 - DNA, 64 bp, Homo sapiens; identical to SEQ ID NO: 29422
  chr5:3122140-3122204
  hyper

SEQ ID NO: 50270 - DNA, 163 bp, Homo sapiens; identical to SEQ ID NO: 29423
  chr5:3197731-3197894
  hyper

SEQ ID NO: 50271 - DNA, 24 bp, Homo sapiens
  chr5:3197991-3198015
  hyper
cgcccggcacgagctccgtgacga

SEQ ID NO: 50272 - DNA, 55 bp, Homo sapiens
  chr5:3590350-3590405
  hyper
gatgcaaacacaacacggagaggggatgtctcctgtctagagattccagggcagt

SEQ ID NO: 50273 - DNA, 100 bp, Homo sapiens; identical to SEQ ID NO: 29426
  chr5:3590803-3590903
  hyper

SEQ ID NO: 50274 - DNA, 231 bp, Homo sapiens
  chr5:3591123-3591354
  hyper
ttacgtgtgtgcacacgcatgtaattcacttccttcgacactggggacggcgtcgtagcggcactccaggccaggccactgcggtccattcctctgccctgcgtttgtgggaaatacgggcccagtgccgcagctttagggcctgggtcgcccttggtccgcccgccgcgttcccgggtggtgtccccacgctgctgaggacctggttccgcgatgcttgccgcggggggc

SEQ ID NO: 50275 - DNA, 60 bp, Homo sapiens
  chr5:3591388-3591448
  hyper
gcttctgggcgtttccttctggggtttccttggagcggctcgagtcgactcctcccgcct

SEQ ID NO: 50276 - DNA, 86 bp, Homo sapiens
  chr5:3592642-3592728
  hyper
cgacccctagacctggttttgtcaggctcctcgtctttgtctctggcacagtgaccagggggcagccaccgggtgcggccagctcc

SEQ ID NO: 50277 - DNA, 203 bp, Homo sapiens
  chr5:3594047-3594250
  hyper
gaggaggttgaagatcggaaatctgtcttagggttagaaggtgtctggtggtaggctggggaacaggaaaaagctgcagttaggggcttcccggatttgtgtcaccaagaatccactccccaccaaccctcggcgtccccacaaacccagcccggaatctatgtaaaagcaggaaaggaaccctggaggttgtaggcggatcc

SEQ ID NO: 50278 - DNA, 15 bp, Homo sapiens
  chr5:3594777-3594792
  hyper
cggagctctccagcc

SEQ ID NO: 50279 - DNA, 191 bp, Homo sapiens
  chr5:3595178-3595369
  hyper
tttctgggtgaagagaaagcccctccccccgcgtctcccccacccctccctccgagaacccgcggcgccgactgcgcctgcttcccccgagctggcgacttctccgcgggatttgccctcgctcaaagtttgcacaattgaaagagcccgcagagctcggccgctccccgcttccccaagggcggcgaggc

SEQ ID NO: 50280 - DNA, 66 bp, Homo sapiens
  chr5:3595991-3596057
  hyper
gcgcgcgattgcggatccgggcgcagccgggagccgggcgcctgcgagcaccgggcagaggagccg

SEQ ID NO: 50281 - DNA, 52 bp, Homo sapiens
  chr5:3596880-3596932
  hyper
tagcaggacttcccttcctggccgcgggttccactcgcgcggcctctttagt

SEQ ID NO: 50282 - DNA, 3 bp, Homo sapiens
  chr5:3597461-3597464
  hyper
cct

SEQ ID NO: 50283 - DNA, 81 bp, Homo sapiens; identical to SEQ ID NO: 29437
  chr5:3599364-3599445
  hyper

SEQ ID NO: 50284 - DNA, 106 bp, Homo sapiens; identical to SEQ ID NO: 29438
  chr5:3599502-3599608
  hyper

SEQ ID NO: 50285 - DNA, 85 bp, Homo sapiens; identical to SEQ ID NO: 29439
  chr5:3600390-3600475
  hyper

SEQ ID NO: 50286 - DNA, 21 bp, Homo sapiens
  chr5:3600732-3600753
  hyper
cgtccccaggccagattcgcc

SEQ ID NO: 50287 - DNA, 137 bp, Homo sapiens; identical to SEQ ID NO: 29441
  chr5:3601025-3601162
  hyper

SEQ ID NO: 50288 - DNA, 167 bp, Homo sapiens; identical to SEQ ID NO: 29443
  chr5:3606268-3606435
  hyper

SEQ ID NO: 50289 - DNA, 191 bp, Homo sapiens; identical to SEQ ID NO: 29444
  chr5:3606711-3606902
  hyper

SEQ ID NO: 50290 - DNA, 45 bp, Homo sapiens; identical to SEQ ID NO: 29445
  chr5:3607103-3607148
  hyper

SEQ ID NO: 50291 - DNA, 100 bp, Homo sapiens; identical to SEQ ID NO: 18713
  chr5:5139900-5140000
  hyper

SEQ ID NO: 50292 - DNA, 139 bp, Homo sapiens
  chr5:5140031-5140170
  hyper
cgagtccccagccccaaggcagggcaggagcgcgcaccggccggaggtccatgctgagcatcgcccgcgccggtgcccggcagcctctccaactgtgtggtccccgcgcgggcagagaggcacggactgcaggccgtgg

SEQ ID NO: 50293 - DNA, 231 bp, Homo sapiens
  chr5:5140225-5140456
  hyper
tccctctgctccccgctcgcctccgcctcagcgccccgctgacctcgcctcctcccctctgctctttgtccctgcactctcccctcctcggtcctctgacccccccgccctcacctcctcccctcctctctcccctgcccgccccgcgctctcccaccgctcccgccgcccccgccgccgcggctgccactccgccccccgcgccgcacggagcttcagtaataaccccgg

SEQ ID NO: 50294 - DNA, 103 bp, Homo sapiens; identical to SEQ ID NO: 18716
  chr5:5140527-5140630
  hyper

SEQ ID NO: 50295 - DNA, 192 bp, Homo sapiens; identical to SEQ ID NO: 18717
  chr5:6448738-6448930
  hyper

SEQ ID NO: 50296 - DNA, 272 bp, Homo sapiens; identical to SEQ ID NO: 18718
  chr5:6583189-6583461
  hyper

SEQ ID NO: 50297 - DNA, 139 bp, Homo sapiens
  chr5:6583579-6583718
  hyper
gcacctgcacgcctaggagggcgcaggccgcgtgtccctgtgggaggaaggccccggcaacctgcaaagacctcacgtcacagaaacttgcggcgtttgcccccgatgcgcgcgtcaggtgctccgtcccttccaggtg

SEQ ID NO: 50298 - DNA, 150 bp, Homo sapiens
  chr5:6687127-6687277
  hyper
cgcttcctaataaaacggcattccaggttctagaaagcatttcggtaaaacaggctcagaaacaccagattcaagagaataaccattatatgtgaatacatttaaaaatagatcacacactctaacaactgaaatgtacagaaaagatga

SEQ ID NO: 50299 - DNA, 17 bp, Homo sapiens
  chr5:6687431-6687448
  hyper
accgcctgtatctgaaa

SEQ ID NO: 50300 - DNA, 30 bp, Homo sapiens; identical to SEQ ID NO: 29453
  chr5:7394911-7394941
  hyper

SEQ ID NO: 50301 - DNA, 102 bp, Homo sapiens
  chr5:7395538-7395640
  hyper
caccgcggggaggcgggaagggtgggaaatcctctccagctccccaaaagagtgaaaaggagggagaccccgctgtcctctgacccgcgtactaaaggaggg

SEQ ID NO: 50302 - DNA, 134 bp, Homo sapiens; identical to SEQ ID NO: 29456
  chr5:7395952-7396086
  hyper

SEQ ID NO: 50303 - DNA, 211 bp, Homo sapiens; identical to SEQ ID NO: 29457
  chr5:7396534-7396745
  hyper

SEQ ID NO: 50304 - DNA, 16 bp, Homo sapiens
  chr5:7396962-7396978
  hyper
ggaataggtcttcccc

SEQ ID NO: 50305 - DNA, 56 bp, Homo sapiens; identical to SEQ ID NO: 29459
  chr5:7396979-7397035
  hyper

SEQ ID NO: 50306 - DNA, 30 bp, Homo sapiens; identical to SEQ ID NO: 29460
  chr5:7850282-7850312
  hyper

SEQ ID NO: 50307 - DNA, 100 bp, Homo sapiens; identical to SEQ ID NO: 29461
  chr5:7850518-7850618
  hyper

SEQ ID NO: 50308 - DNA, 93 bp, Homo sapiens
  chr5:7850922-7851015
  hyper
gcccagccgcccagccgcccagccgcccagccttccggtctccgcgcccagtccgcggtcctcacccgcgccgggcggtagtagtagctgtgc

SEQ ID NO: 50309 - DNA, 178 bp, Homo sapiens
  chr5:7851121-7851299
  hyper
cgtcgtcctccatgccgccaccgtccagcgcccccgccttggccgcggtccgtcccgcccgcccaggggcccagtcggagtctgcaggcctcaggttgctcagcgccagcgtctagcccgcgtctgtgttcggtcgttgcctggaaaccgccgcctggcgacccggagctgccctgca

SEQ ID NO: 50310 - DNA, 150 bp, Homo sapiens; identical to SEQ ID NO: 29463
  chr5:9544685-9544835
  hyper

SEQ ID NO: 50311 - DNA, 43 bp, Homo sapiens; identical to SEQ ID NO: 29464
  chr5:9545077-9545120
  hyper

SEQ ID NO: 50312 - DNA, 76 bp, Homo sapiens; identical to SEQ ID NO: 29465
  chr5:9545555-9545631
  hyper

SEQ ID NO: 50313 - DNA, 48 bp, Homo sapiens
  chr5:9546564-9546612
  hyper
gacgtggctgcaccccggaggggggcgccggccgagacctgagacgtg

SEQ ID NO: 50314 - DNA, 40 bp, Homo sapiens
  chr5:9546648-9546688
  hyper
gcggttccctcggctaaatctggcccgggggatggggggc

SEQ ID NO: 50315 - DNA, 97 bp, Homo sapiens; identical to SEQ ID NO: 29467
  chr5:10307612-10307709
  hyper

SEQ ID NO: 50316 - DNA, 158 bp, Homo sapiens
  chr5:10333530-10333688
  hyper
ctgccgaccttagaccgcgggggtgtggggcgccggggaaggagacagaaggacaggcgccgcccagggccgcggggacacttggggctgcgtcctgggtgggcgcgatgctcccccagaacgactggagatggagagtgtcggggagggaaacggga

SEQ ID NO: 50317 - DNA, 134 bp, Homo sapiens; identical to SEQ ID NO: 29469
  chr5:10442381-10442515
  hyper

SEQ ID NO: 50318 - DNA, 30 bp, Homo sapiens; identical to SEQ ID NO: 29470
  chr5:10563541-10563571
  hyper

SEQ ID NO: 50319 - DNA, 70 bp, Homo sapiens; identical to SEQ ID NO: 29471
  chr5:10564589-10564659
  hyper

SEQ ID NO: 50320 - DNA, 221 bp, Homo sapiens; identical to SEQ ID NO: 18726
  chr5:10564800-10565021
  hyper

SEQ ID NO: 50321 - DNA, 113 bp, Homo sapiens
  chr5:10565607-10565720
  hyper
cggggctccccagagtcagggcatagggagagccccagagccgcgggcatccacccgggtagggcaggaggcgtggaggcaggcacaggctatcctttcgttatgaccagatt

SEQ ID NO: 50322 - DNA, 225 bp, Homo sapiens
  chr5:11385363-11385588
  hyper
cacgcgcacttagcgagggagaagcacacggcccacccggcccagcccggccccgagagcagaggcacaccggggatgccgcgggcgcccggcggctctgcgatcccagctgcgctcggggcagtacgcgaacctgcgccccgaactctcctggggcggatttcttgtcctgacactggcacaggccagctgactactggagggaagtcacgtttgacaaatgag

SEQ ID NO: 50323 - DNA, 180 bp, Homo sapiens; identical to SEQ ID NO: 7749
  chr5:11903545-11903725
  hyper

SEQ ID NO: 50324 - DNA, 49 bp, Homo sapiens
  chr5:11904696-11904745
  hyper
acgcacgccctggacctgagatgggtggatgctccggagctaggcgaaa

SEQ ID NO: 50325 - DNA, 30 bp, Homo sapiens; identical to SEQ ID NO: 7754
  chr5:11904962-11904992
  hyper

SEQ ID NO: 50326 - DNA, 30 bp, Homo sapiens; identical to SEQ ID NO: 29482
  chr5:14142742-14142772
  hyper

SEQ ID NO: 50327 - DNA, 30 bp, Homo sapiens; identical to SEQ ID NO: 29483
  chr5:15499838-15499868
  hyper

SEQ ID NO: 50328 - DNA, 119 bp, Homo sapiens; identical to SEQ ID NO: 29484
  chr5:15500570-15500689
  hyper

SEQ ID NO: 50329 - DNA, 13 bp, Homo sapiens
  chr5:15500735-15500748
  hyper
cgccgcagctatg

SEQ ID NO: 50330 - DNA, 367 bp, Homo sapiens
  chr5:15500927-15501294
  hyper
ccatttggcaccctgtctgggtcaccaccttctcctttggcagtgagtgaccagtgagtaggtcaggcgccccgaggatgcttttccactgtgggggtctctttaagcaacttcccagtttgtctttgggaaggctcaagttgcatctctgctgtgtttctgagcacatatgccttaaccttccttccctgggcatctggggtttaggagatgatggtttggcagatggcggaagacgtttttgaaaaataactcagtgaaaactttcccgggcctttgtgctccagccccctggactctactgtagcagaaaaaacttctggaaggagaagttaagtttccattctttgctcgctgctcctgctct

SEQ ID NO: 50331 - DNA, 12 bp, Homo sapiens
  chr5:16179141-16179153
  hyper
ccttacctgctc

SEQ ID NO: 50332 - DNA, 141 bp, Homo sapiens; identical to SEQ ID NO: 29488
  chr5:16179266-16179407
  hyper

SEQ ID NO: 50333 - DNA, 61 bp, Homo sapiens; identical to SEQ ID NO: 18733
  chr5:16180260-16180321
  hyper

SEQ ID NO: 50334 - DNA, 399 bp, Homo sapiens; identical to SEQ ID NO: 29491
  chr5:16180371-16180770
  hyper

SEQ ID NO: 50335 - DNA, 30 bp, Homo sapiens; identical to SEQ ID NO: 29492
  chr5:16934552-16934582
  hyper

SEQ ID NO: 50336 - DNA, 159 bp, Homo sapiens; identical to SEQ ID NO: 29493
  chr5:16935883-16936042
  hyper

SEQ ID NO: 50337 - DNA, 37 bp, Homo sapiens; identical to SEQ ID NO: 29494
  chr5:16936738-16936775
  hyper

SEQ ID NO: 50338 - DNA, 333 bp, Homo sapiens; identical to SEQ ID NO: 29495
  chr5:17216805-17217138
  hyper

SEQ ID NO: 50339 - DNA, 184 bp, Homo sapiens; identical to SEQ ID NO: 29496
  chr5:17217681-17217865
  hyper

SEQ ID NO: 50340 - DNA, 204 bp, Homo sapiens
  chr5:17217991-17218195
  hyper
cgccccgcagcccccgggctctcccttcatgcagcgggcagcagggatgtgggcccggattggacggcaagggcctggggtccctctgtgagggctccgtcgcacttcggggatcccgggtgatggggggcccagaagtgggaggcttcagccgctcgcatggtggaggggtgaggggggcggcgaggttggtaaacggagctg

SEQ ID NO: 50341 - DNA, 709 bp, Homo sapiens
  chr5:17218225-17218934
  hyper
cgggtgacgggaggaattgccgaatgcgaaaccccctcagtgcgttgagtcccggggagacggttctgtgggctgaagggagcgcttccgtcatcggagcccttaccagcctgggagaaagcgctcggggcgaggggcgcagcagccaaagatggagggtgggggtggggtggggcgggagtccggggagaaagaagatggggaatctggcccgatcagaaggaagtgggtggctttttgctttggcaaacgggttttctcgacccatgggactcctggatcttggttctggggccaaggaatacgaggttcacacggcgacgtgcactcagaagcacctcccgagcagatcggagccccagcctcgtcagtggcggaattgccttcctacgaacccgtgggctgcctcggagcagtttgttttttcgagcctttggttccaagaatgcgccaggcgcctccgccctgggtcccggccccggcccgggcccggggggtgtgggcttgaacctgacagcgcgcggccctaactgggctcagccccgctgggagcgtagggttggggttgagcagcttttgcccaaagcgctaaagctgaaacccggcgcccggttcctgctccccccgcccccgtcccccctccatttccagaaaaataaaaattgcggaatcctggatccgatcgcacgcacaatgcgcggctgcaaac

SEQ ID NO: 50342 - DNA, 201 bp, Homo sapiens
  chr5:17219018-17219219
  hyper
tcggtggacagcccttgcccatgtaattctcactctgctgaaattagcacagcacacatgggtgcattttttaggaccttgtacaggttgacaacacctctgtctcccccgcggccactcgcactgtggggcgggctaaaacccaacactagcgtcgaaatggccttctgctatagggttgtggaccgaccccccaccccc

SEQ ID NO: 50343 - DNA, 152 bp, Homo sapiens; identical to SEQ ID NO: 29499
  chr5:22853104-22853256
  hyper

SEQ ID NO: 50344 - DNA, 30 bp, Homo sapiens; identical to SEQ ID NO: 29500
  chr5:22853539-22853569
  hyper

SEQ ID NO: 50345 - DNA, 54 bp, Homo sapiens
  chr5:31193883-31193937
  hyper
ccgcgacagcaagaacggcagagccggcgaccgcggcggcggcggcggcggagg

SEQ ID NO: 50346 - DNA, 79 bp, Homo sapiens
  chr5:31193989-31194068
  hyper
agaggtgggttcgggctccgttggctatgcatacatctccctttttttttttttaattctgtagcgttgatagaagcca

SEQ ID NO: 50347 - DNA, 15 bp, Homo sapiens
  chr5:31194276-31194291
  hyper
gggggcaccgggaag

SEQ ID NO: 50348 - DNA, 64 bp, Homo sapiens
  chr5:31194311-31194375
  hyper
cgctgcctttctctacgccggcagaggctgccaggggagctctggcatttgcaaagttggctgg

SEQ ID NO: 50349 - DNA, 43 bp, Homo sapiens
  chr5:31639641-31639684
  hyper
gtttagctacaaatccgggtgcgggaatcccagccctggcagg

SEQ ID NO: 50350 - DNA, 35 bp, Homo sapiens; identical to SEQ ID NO: 29505
  chr5:31854940-31854975
  hyper

SEQ ID NO: 50351 - DNA, 270 bp, Homo sapiens; identical to SEQ ID NO: 7769
  chr5:31855221-31855491
  hyper

SEQ ID NO: 50352 - DNA, 139 bp, Homo sapiens
  chr5:32710192-32710331
  hyper
agttccattttgacccgccccgccgcgcggcggactcccgcgatgctcctctggtcacggacttctccagagccgcttccctccggtctccaccgctgctgtggctatggccagtgggaggactgggtctccgaggcag

SEQ ID NO: 50353 - DNA, 311 bp, Homo sapiens
  chr5:32710470-32710781
  hyper
agtccctttatttaggtacctggtttagcaaacaaagccccgaggacgctttggggatgctttccaagctttgtgacacctccagaagttgaaccattccctcgcctttgggagcaacaagtttcactttcctgctctcagtgcgctgacagagggtccgtgagctgggacactgtgacctcggcaccgctgcgattccagcgcaaacctgcgtggcccagggggagggggctggcgcggggctgaggaaggcggggtgtaggtgacgcccgggccagccgggcacaccaggtccgcgatggagccatctg

SEQ ID NO: 50354 - DNA, 73 bp, Homo sapiens
  chr5:32711753-32711826
  hyper
tctattttgttaaagcgcccaagggggcgcagggaccttggagagaagagtggggaggaaagaggaagggtgg

SEQ ID NO: 50355 - DNA, 273 bp, Homo sapiens; identical to SEQ ID NO: 18746
  chr5:32712491-32712764
  hyper

SEQ ID NO: 50356 - DNA, 29 bp, Homo sapiens
  chr5:33892054-33892083
  hyper
gggtgcatggtcaggcgcgagaaggcagc

SEQ ID NO: 50357 - DNA, 298 bp, Homo sapiens; identical to SEQ ID NO: 18748
  chr5:33892115-33892413
  hyper

SEQ ID NO: 50358 - DNA, 113 bp, Homo sapiens
  chr5:33892443-33892556
  hyper
caggccagccccccggcgtgcttaaatacaagctcaaaatgaggagaacagagttgaggcagaggggggccccactccctccatccttccgcgctcagcgctgccccctcccc

SEQ ID NO: 50359 - DNA, 26 bp, Homo sapiens
  chr5:33936336-33936362
  hyper
acccactgacctccaggaagctgagc

SEQ ID NO: 50360 - DNA, 123 bp, Homo sapiens; identical to SEQ ID NO: 18751
  chr5:33936363-33936486
  hyper

SEQ ID NO: 50361 - DNA, 83 bp, Homo sapiens
  chr5:33936516-33936599
  hyper
gaccgcgggacacggagaggggaagtctgcgttgtacataaggacctagggactccgagcttggcctgagaacccttggacgc

SEQ ID NO: 50362 - DNA, 27 bp, Homo sapiens
  chr5:33936663-33936690
  hyper
ctgcgtccagggcgttcgctgcgcgcc

SEQ ID NO: 50363 - DNA, 37 bp, Homo sapiens; identical to SEQ ID NO: 29517
  chr5:34655873-34655910
  hyper

SEQ ID NO: 50364 - DNA, 41 bp, Homo sapiens; identical to SEQ ID NO: 29519
  chr5:35230049-35230090
  hyper

SEQ ID NO: 50365 - DNA, 30 bp, Homo sapiens; identical to SEQ ID NO: 29520
  chr5:36607079-36607109
  hyper

SEQ ID NO: 50366 - DNA, 133 bp, Homo sapiens; identical to SEQ ID NO: 7780
  chr5:36690192-36690325
  hyper

SEQ ID NO: 50367 - DNA, 30 bp, Homo sapiens; identical to SEQ ID NO: 29522
  chr5:37371493-37371523
  hyper

SEQ ID NO: 50368 - DNA, 69 bp, Homo sapiens
  chr5:37834615-37834684
  hyper
cgcaccccttgcccacgggtcggtaggccacacagccatcaggctggcttggggtacgtgcggggctgg

SEQ ID NO: 50369 - DNA, 23 bp, Homo sapiens
  chr5:37834714-37834737
  hyper
gcggcccccccgcggggagggaa

SEQ ID NO: 50370 - DNA, 556 bp, Homo sapiens
  chr5:37837992-37838548
  hyper
ctggcaggctgggaggtttgtttgggctttgccttcaagatccaggtctcagagagagaaaaaggaggcggtggggcggggagacgggtttgctataaactcggtttttttttttttttttttggcggggggaggtagagacagaaattgctggaagatctattgcttttcttaactatgcttcgtgtccttgactgacagaggacttattctcccctcaaccccccataactgcggggcccaagatgagggaaggaaaaagaatttgggacacttctcgcaggcaaactgggaaagcggtctgtttaaagggccaggttccaggcccgagagcacccgaattgctagcgggaaagggctagggacacggcggacttcccagagatcggacacttgttacttgttgaaaaggcgccaccttccctgacaaagcgaaggcgcagcgaaacagtacgagtttggtcgaggccggctttgacggctttgcgggactgggtgcgtgaatgaggttggaagaaacatctcttccttgaaatacctaagcatatattccaaa

SEQ ID NO: 50371 - DNA, 72 bp, Homo sapiens
  chr5:37838885-37838957
  hyper
gagaaaaaggggtcattaaaataataacctcaatggcctagtggagtctcaagaatacgttcgagacagaga

SEQ ID NO: 50372 - DNA, 499 bp, Homo sapiens; identical to SEQ ID NO: 29525
  chr5:37839237-37839736
  hyper

SEQ ID NO: 50373 - DNA, 95 bp, Homo sapiens; identical to SEQ ID NO: 18757
  chr5:37840125-37840220
  hyper

SEQ ID NO: 50374 - DNA, 96 bp, Homo sapiens; identical to SEQ ID NO: 2551
  chr5:37840267-37840363
  hyper

SEQ ID NO: 50375 - DNA, 41 bp, Homo sapiens
  chr5:38257444-38257485
  hyper
tgtgaagagccaggacgcccaccgagtcctggcagcgttgc

SEQ ID NO: 50376 - DNA, 236 bp, Homo sapiens
  chr5:38257606-38257842
  hyper
ttattccctcttggtttatttattgtatctgctttctcttctcgctggtttggaggtcagaacgccagtatgcaacgggacttgtgtcccaggcagggtctcccctctccaggcactaccgcgaaatctggcaaaaggtacattttactgagtcctagggcagcaaattcagcggcggagaaagagtctttctccattcaggagacaacccaggaagcccgatcccgggatcagag

SEQ ID NO: 50377 - DNA, 496 bp, Homo sapiens; identical to SEQ ID NO: 7793
  chr5:38258174-38258670
  hyper

SEQ ID NO: 50378 - DNA, 287 bp, Homo sapiens; identical to SEQ ID NO: 29534
  chr5:38258671-38258958
  hyper

SEQ ID NO: 50379 - DNA, 111 bp, Homo sapiens; identical to SEQ ID NO: 29535
  chr5:38556250-38556361
  hyper

SEQ ID NO: 50380 - DNA, 24 bp, Homo sapiens
  chr5:38556411-38556435
  hyper
cgcccacccgcccccaggactcac

SEQ ID NO: 50381 - DNA, 238 bp, Homo sapiens; identical to SEQ ID NO: 29537
  chr5:38556436-38556674
  hyper

SEQ ID NO: 50382 - DNA, 134 bp, Homo sapiens; identical to SEQ ID NO: 29538
  chr5:38556773-38556907
  hyper

SEQ ID NO: 50383 - DNA, 560 bp, Homo sapiens; identical to SEQ ID NO: 29541
  chr5:39425003-39425563
  hyper

SEQ ID NO: 50384 - DNA, 70 bp, Homo sapiens; identical to SEQ ID NO: 29542
  chr5:40680557-40680627
  hyper

SEQ ID NO: 50385 - DNA, 309 bp, Homo sapiens
  chr5:40681367-40681676
  hyper
gtgcgagtacagcaccttcattctgctcttcttcagcctgtccggcctcagcatcatctgcgccatgagtgtcgagcgctacctggccatcaaccatgcctatttctacagccactacgtggacaagcgattggcgggcctcacgctctttgcagtctatgcgtccaacgtgctcttttgcgcgctgcccaacatgggtctcggtagctcgcggctgcagtacccagacacctggtgcttcatcgactggaccaccaacgtgacggcgcacgccgcctactcctacatgtacgcgggcttcagctcctt

SEQ ID NO: 50386 - DNA, 14 bp, Homo sapiens
  chr5:40682069-40682083
  hyper
gcctttaggtcggg

SEQ ID NO: 50387 - DNA, 34 bp, Homo sapiens; identical to SEQ ID NO: 29546
  chr5:41510835-41510869
  hyper

SEQ ID NO: 50388 - DNA, 38 bp, Homo sapiens; identical to SEQ ID NO: 29547
  chr5:42423455-42423493
  hyper

SEQ ID NO: 50389 - DNA, 30 bp, Homo sapiens; identical to SEQ ID NO: 29548
  chr5:42423828-42423858
  hyper

SEQ ID NO: 50390 - DNA, 150 bp, Homo sapiens; identical to SEQ ID NO: 18764
  chr5:42424672-42424822
  hyper

SEQ ID NO: 50391 - DNA, 99 bp, Homo sapiens; identical to SEQ ID NO: 18765
  chr5:42425060-42425159
  hyper

SEQ ID NO: 50392 - DNA, 88 bp, Homo sapiens; identical to SEQ ID NO: 29550
  chr5:42950080-42950168
  hyper

SEQ ID NO: 50393 - DNA, 40 bp, Homo sapiens; identical to SEQ ID NO: 18766
  chr5:42991785-42991825
  hyper

SEQ ID NO: 50394 - DNA, 91 bp, Homo sapiens
  chr5:42992934-42993025
  hyper
accccgcagattcgtctgtcgttggcttgttggtcctaacaagtttcgatttcagggtgcctgcgtttctttttcttttctcttcttttcc

SEQ ID NO: 50395 - DNA, 24 bp, Homo sapiens
  chr5:42994670-42994694
  hyper
gctctgcttctaatgcggagctgg

SEQ ID NO: 50396 - DNA, 118 bp, Homo sapiens; identical to SEQ ID NO: 18768
  chr5:43007818-43007936
  hyper

SEQ ID NO: 50397 - DNA, 236 bp, Homo sapiens; identical to SEQ ID NO: 18769
  chr5:43007966-43008202
  hyper

SEQ ID NO: 50398 - DNA, 199 bp, Homo sapiens; identical to SEQ ID NO: 7810
  chr5:43008737-43008936
  hyper

SEQ ID NO: 50399 - DNA, 228 bp, Homo sapiens
  chr5:43019010-43019238
  hyper
atgcgattttttttaggtttaccgatgatcagtttagcagtgcctgggagctcttataccaagtttgttttcgcaatattgagtcccaccttagctaagcttgtgtgtattttaaactcccatggaagtcaggaaatgtccgcaaacgcgatttctggttaccaagctccgtttggcaatagcaagtcctgccgaacgcgactttttcctcttgtggaccaagtctga

SEQ ID NO: 50400 - DNA, 159 bp, Homo sapiens
  chr5:43019650-43019809
  hyper
ccggggagccgagctcggtctcagtctccctgctgtcaggtgccaggttgtgtctggtggctctccttcgtatgcggagctgatggttttgcatcagcgcttttgccagtagagccgactagcgttttctcagttacggcaccgttcttagcgcccagt

SEQ ID NO: 50401 - DNA, 8 bp, Homo sapiens
  chr5:43040862-43040870
  hyper
acacaatt

SEQ ID NO: 50402 - DNA, 64 bp, Homo sapiens
  chr5:43040964-43041028
  hyper
aaaagtgacagcactgagaacctaaggaccccgcgaacgggaaatgtcacgttgggtgcagcaa

SEQ ID NO: 50403 - DNA, 32 bp, Homo sapiens; identical to SEQ ID NO: 29567
  chr5:43043256-43043288
  hyper

SEQ ID NO: 50404 - DNA, 267 bp, Homo sapiens; identical to SEQ ID NO: 29568
  chr5:43191854-43192121
  hyper

SEQ ID NO: 50405 - DNA, 682 bp, Homo sapiens; identical to SEQ ID NO: 29569
  chr5:43192458-43193140
  hyper

SEQ ID NO: 50406 - DNA, 33 bp, Homo sapiens; identical to SEQ ID NO: 18776
  chr5:43396969-43397002
  hyper

SEQ ID NO: 50407 - DNA, 160 bp, Homo sapiens; identical to SEQ ID NO: 29571
  chr5:43397305-43397465
  hyper

SEQ ID NO: 50408 - DNA, 369 bp, Homo sapiens; identical to SEQ ID NO: 29572
  chr5:44388243-44388612
  hyper

SEQ ID NO: 50409 - DNA, 65 bp, Homo sapiens; identical to SEQ ID NO: 29573
  chr5:44388856-44388921
  hyper

SEQ ID NO: 50410 - DNA, 174 bp, Homo sapiens; identical to SEQ ID NO: 29574
  chr5:44389326-44389500
  hyper

SEQ ID NO: 50411 - DNA, 502 bp, Homo sapiens
  chr5:44389852-44390354
  hyper
acggtatcttcccgctttccgaattttgctgtcttccagcctgaaccaatcccttctggggagcccctttctcacttgctttccagcgtaggatctcctccccccacccccatttcttttggcagtgaagtacttgagagccacctggagcctggtgcttggctgacttttcctcccttctcactcccagaagaggagagggctgggagaaagcagaagatgctgaggattttaaaccgtccaaagcagcaggttataaactggtcagaacgagcacagaaaaggaagacataattagtgtcctttcctcctctgctgccagcttccaaggaggtctcctctttaatgaatcactgatttctcgcttccgttgctgaagtaaaaagttcacactttggccctctctgccttttaagctcagggagatttatcgtcacccttaaaagttgcctctctcggcgcaaatgaaatcagggacccaaataaccgatttctaattgct

SEQ ID NO: 50412 - DNA, 43 bp, Homo sapiens
  chr5:45695143-45695186
  hyper
tttggtgagacctcacgtcagggactatccaagtgcaaattgc

SEQ ID NO: 50413 - DNA, 75 bp, Homo sapiens; identical to SEQ ID NO: 18781
  chr5:45695533-45695608
  hyper

SEQ ID NO: 50414 - DNA, 24 bp, Homo sapiens
  chr5:45695648-45695672
  hyper
cgccggcagcgccaccccccgccc

SEQ ID NO: 50415 - DNA, 17 bp, Homo sapiens
  chr5:45695947-45695964
  hyper
tcttcgaagccccccgc

SEQ ID NO: 50416 - DNA, 23 bp, Homo sapiens
  chr5:45696313-45696336
  hyper
tcgcggcggcggcggcggcggcg

SEQ ID NO: 50417 - DNA, 16 bp, Homo sapiens
  chr5:45696439-45696455
  hyper
tgaagctgaggctgcc

SEQ ID NO: 50418 - DNA, 9 bp, Homo sapiens
  chr5:45696456-45696465
  hyper
gagctaggc

SEQ ID NO: 50419 - DNA, 57 bp, Homo sapiens; identical to SEQ ID NO: 29582
  chr5:45696466-45696523
  hyper

SEQ ID NO: 50420 - DNA, 293 bp, Homo sapiens; identical to SEQ ID NO: 18783
  chr5:49736685-49736978
  hyper

SEQ ID NO: 50421 - DNA, 201 bp, Homo sapiens; identical to SEQ ID NO: 29584
  chr5:49737098-49737299
  hyper

SEQ ID NO: 50422 - DNA, 84 bp, Homo sapiens; identical to SEQ ID NO: 18785
  chr5:50263484-50263568
  hyper

SEQ ID NO: 50423 - DNA, 111 bp, Homo sapiens; identical to SEQ ID NO: 29586
  chr5:50264180-50264291
  hyper

SEQ ID NO: 50424 - DNA, 217 bp, Homo sapiens
  chr5:50264603-50264820
  hyper
taaagtgtccaggactggaactcacgtccctgaggcaggggacagtaagtttgcttgtaacacagacagttttccttgactgcaggaaacaagaaaaatagtaatcataaaacaagcacaaatcccccaaacatcaggggggtaaaacccccattattagccatcacaaaccaaaacccaaaccgagtcttttctgctgaattgctgcaagatcaca

SEQ ID NO: 50425 - DNA, 96 bp, Homo sapiens; identical to SEQ ID NO: 29588
  chr5:50265070-50265166
  hyper

SEQ ID NO: 50426 - DNA, 135 bp, Homo sapiens
  chr5:50265190-50265325
  hyper
cgggcgagagcaaggagcctcccggccacacagccacaggcgctgcggaacccagcccggactctccccggctggagtgtgcgaagggcttcccgcccaggggcccagggtggtcttagtgaaaaagggatggcg

SEQ ID NO: 50427 - DNA, 243 bp, Homo sapiens; identical to SEQ ID NO: 18787
  chr5:50265429-50265672
  hyper

SEQ ID NO: 50428 - DNA, 6 bp, Homo sapiens
  chr5:50675007-50675013
  hyper
gagaat

SEQ ID NO: 50429 - DNA, 32 bp, Homo sapiens; identical to SEQ ID NO: 29592
  chr5:50678159-50678191
  hyper

SEQ ID NO: 50430 - DNA, 286 bp, Homo sapiens; identical to SEQ ID NO: 29593
  chr5:50683270-50683556
  hyper

SEQ ID NO: 50431 - DNA, 143 bp, Homo sapiens; identical to SEQ ID NO: 29594
  chr5:50685653-50685796
  hyper

SEQ ID NO: 50432 - DNA, 229 bp, Homo sapiens; identical to SEQ ID NO: 7833
  chr5:50685846-50686075
  hyper

SEQ ID NO: 50433 - DNA, 63 bp, Homo sapiens; identical to SEQ ID NO: 29596
  chr5:50694717-50694780
  hyper

SEQ ID NO: 50434 - DNA, 190 bp, Homo sapiens; identical to SEQ ID NO: 29597
  chr5:50695051-50695241
  hyper

SEQ ID NO: 50435 - DNA, 343 bp, Homo sapiens; identical to SEQ ID NO: 29599
  chr5:52776466-52776809
  hyper

SEQ ID NO: 50436 - DNA, 30 bp, Homo sapiens; identical to SEQ ID NO: 29600
  chr5:52778616-52778646
  hyper

SEQ ID NO: 50437 - DNA, 267 bp, Homo sapiens
  chr5:54179796-54180063
  hyper
cagcgccctcctccccgctcgcccaccctctccaagcgggctccgcgcggccggggatgggacgaggaggggaagtttggggcgcgtacctcctagcgccccgcagaaccccaggcaggcagccagtaggacgaggcggcgggccccgaaccgccccatcccgccgcggcggccccgcgtcccgcgctcactccccagcggcggccgagctacctgcgccgccgcgacccggagcccggcaagggggcgccgccccccaacatctcg

SEQ ID NO: 50438 - DNA, 44 bp, Homo sapiens; identical to SEQ ID NO: 29602
  chr5:54472206-54472250
  hyper

SEQ ID NO: 50439 - DNA, 30 bp, Homo sapiens; identical to SEQ ID NO: 29603
  chr5:54472512-54472542
  hyper

SEQ ID NO: 50440 - DNA, 37 bp, Homo sapiens; identical to SEQ ID NO: 18791
  chr5:54516334-54516371
  hyper

SEQ ID NO: 50441 - DNA, 43 bp, Homo sapiens; identical to SEQ ID NO: 29607
  chr5:54519598-54519641
  hyper

SEQ ID NO: 50442 - DNA, 293 bp, Homo sapiens; identical to SEQ ID NO: 18792
  chr5:54527343-54527636
  hyper

SEQ ID NO: 50443 - DNA, 379 bp, Homo sapiens
  chr5:57877892-57878271
  hyper
gcggcagtgtgtgcgcgctaatgacggcggaaggtgcctgggggagggcctggggaggggctggccagcgctatcgcgcccctggcacttcctaagagactgagccctttctctgcagctgcagcttggattccacgctttccctccagaggaaagaagccctccatctaaatcagctgtcttctccacatccctcctttttctctccgccagacgccacccctaccccttctattgtgttgtgccttttcattttagccccgcttcctacgtagagccctaacctcctttgtagcgagggcacttgagaatttctgaacctcgagttgtaatggagctgtatggaaaggtaagcaggcgaaaggagttccttggggtg

SEQ ID NO: 50444 - DNA, 165 bp, Homo sapiens; identical to SEQ ID NO: 18794
  chr5:57878375-57878540
  hyper

SEQ ID NO: 50445 - DNA, 16 bp, Homo sapiens
  chr5:57878937-57878953
  hyper
gtgcagagtgtggagc

SEQ ID NO: 50446 - DNA, 236 bp, Homo sapiens; identical to SEQ ID NO: 29611
  chr5:57878954-57879190
  hyper

SEQ ID NO: 50447 - DNA, 204 bp, Homo sapiens; identical to SEQ ID NO: 29612
  chr5:58335149-58335353
  hyper

SEQ ID NO: 50448 - DNA, 305 bp, Homo sapiens; identical to SEQ ID NO: 29613
  chr5:58335572-58335877
  hyper

SEQ ID NO: 50449 - DNA, 30 bp, Homo sapiens; identical to SEQ ID NO: 29614
  chr5:59188418-59188448
  hyper

SEQ ID NO: 50450 - DNA, 90 bp, Homo sapiens
  chr5:59188965-59189055
  hyper
gaatgggggagggggcgctctccactcaccgcctgagtccctggaacgaggagggccaggacatcctggatttcttcaggccgggccggt

SEQ ID NO: 50451 - DNA, 292 bp, Homo sapiens; identical to SEQ ID NO: 18798
  chr5:59189206-59189498
  hyper

SEQ ID NO: 50452 - DNA, 33 bp, Homo sapiens
  chr5:59189830-59189863
  hyper
aagcagcagcaacggcggcggcggcagtggtag

SEQ ID NO: 50453 - DNA, 81 bp, Homo sapiens; identical to SEQ ID NO: 18799
  chr5:59189948-59190029
  hyper

SEQ ID NO: 50454 - DNA, 30 bp, Homo sapiens; identical to SEQ ID NO: 29619
  chr5:63257323-63257353
  hyper

SEQ ID NO: 50455 - DNA, 171 bp, Homo sapiens; identical to SEQ ID NO: 29621
  chr5:63461448-63461619
  hyper

SEQ ID NO: 50456 - DNA, 205 bp, Homo sapiens; identical to SEQ ID NO: 29622
  chr5:63461914-63462119
  hyper

SEQ ID NO: 50457 - DNA, 199 bp, Homo sapiens
  chr5:63801808-63802007
  hyper
caacgtcagccggaccgattctctgcgtctgccagtcccgccacagattcatctgggatcttcaaacagacaagcccttagagacgagggatcaaggcagccgattagagccaattgcttgctttggggacggccagtccttccaggcctggcgacagtggagggaggggaaagacgaaccgagtgccgctgcgggaag

SEQ ID NO: 50458 - DNA, 31 bp, Homo sapiens
  chr5:63802514-63802545
  hyper
cagatcagcaagcccccgctgcagagcggag

SEQ ID NO: 50459 - DNA, 38 bp, Homo sapiens; identical to SEQ ID NO: 18801
  chr5:63986450-63986488
  hyper

SEQ ID NO: 50460 - DNA, 155 bp, Homo sapiens
  chr5:63986807-63986962
  hyper
agagaaatctcgccccggctcggagctcccccgggagccaggacaggaggcgaggcgcacgctggaggagcgcgggctttgcgcccagggcgcacttggggcccgcctggctggccccgctgagttccccgcccgcctcccgggagccgactgct

SEQ ID NO: 50461 - DNA, 30 bp, Homo sapiens; identical to SEQ ID NO: 29628
  chr5:65891802-65891832
  hyper

SEQ ID NO: 50462 - DNA, 56 bp, Homo sapiens; identical to SEQ ID NO: 29629
  chr5:65893398-65893454
  hyper

SEQ ID NO: 50463 - DNA, 291 bp, Homo sapiens; identical to SEQ ID NO: 29630
  chr5:67583945-67584236
  hyper

SEQ ID NO: 50464 - DNA, 44 bp, Homo sapiens
  chr5:71014676-71014720
  hyper
gcaaggcagggctggcgaggtggatgttgcagctgtcaccactg

SEQ ID NO: 50465 - DNA, 84 bp, Homo sapiens
  chr5:71014895-71014979
  hyper
tctgcgctctagcccatctgtgcgcagagcctcgttcccaggcgcctggaacccggcgggcattgacgtcaagcgccggcggag

SEQ ID NO: 50466 - DNA, 149 bp, Homo sapiens
  chr5:71015031-71015180
  hyper
cgcctcctccctctttcctgcacgggggctcgggctcactataaaaggtgggagcgcgtggtgccccagcaacgacgagtttcagaacgatggagagctcccgcgtgaggctgctgcccctcctgggcgccgccctgctgctgatgcta

SEQ ID NO: 50467 - DNA, 40 bp, Homo sapiens; identical to SEQ ID NO: 29633
  chr5:71015825-71015865
  hyper

SEQ ID NO: 50468 - DNA, 30 bp, Homo sapiens; identical to SEQ ID NO: 29634
  chr5:71402862-71402892
  hyper

SEQ ID NO: 50469 - DNA, 444 bp, Homo sapiens
  chr5:71403122-71403566
  hyper
gtctccatataaaagcggcgccgcctccccgccctctctcactccccgctcctctccgccgcgcactctccgcggcgctgggagagggcggagggggaggcggcgcgcggcgccagaggaggggggacgcagggggcggagcggagacagtaccttcggagataatcctttctcctgccgcagtggagaggagcggccggagcgagacacttcgccgaggcacagcagccggcaggatggcgaccgtggtggtggaagccaccgagccggagccgtccggcagcatcgccaacccggcggcgtccacctcgcctagcctgtcgcaccgcttccttgacagcaagttctacttgctggtggtcgtcggcgagatcgtgaccgaggagcacctgcggcgtgccatcggcaacatcgagctcggtaagtggccccgcgcccccagag

SEQ ID NO: 50470 - DNA, 77 bp, Homo sapiens; identical to SEQ ID NO: 29637
  chr5:71404665-71404742
  hyper

SEQ ID NO: 50471 - DNA, 112 bp, Homo sapiens; identical to SEQ ID NO: 29638
  chr5:71404743-71404855
  hyper

SEQ ID NO: 50472 - DNA, 19 bp, Homo sapiens
  chr5:72415904-72415923
  hyper
tggccaaggccaaggcggc

SEQ ID NO: 50473 - DNA, 143 bp, Homo sapiens; identical to SEQ ID NO: 29640
  chr5:72416022-72416165
  hyper

SEQ ID NO: 50474 - DNA, 207 bp, Homo sapiens; identical to SEQ ID NO: 29641
  chr5:72497943-72498150
  hyper

SEQ ID NO: 50475 - DNA, 97 bp, Homo sapiens; identical to SEQ ID NO: 29642
  chr5:72512278-72512375
  hyper

SEQ ID NO: 50476 - DNA, 29 bp, Homo sapiens
  chr5:72526037-72526066
  hyper
gctactgctagccctcgccccagactgtc

SEQ ID NO: 50477 - DNA, 18 bp, Homo sapiens
  chr5:72526395-72526413
  hyper
gtgggcccaatgctccgg

SEQ ID NO: 50478 - DNA, 27 bp, Homo sapiens
  chr5:72526643-72526670
  hyper
gttagggggctgcgctagcagggacat

SEQ ID NO: 50479 - DNA, 114 bp, Homo sapiens; identical to SEQ ID NO: 29646
  chr5:72528189-72528303
  hyper

SEQ ID NO: 50480 - DNA, 30 bp, Homo sapiens; identical to SEQ ID NO: 29647
  chr5:72528599-72528629
  hyper

SEQ ID NO: 50481 - DNA, 191 bp, Homo sapiens
  chr5:72529098-72529289
  hyper
ccgttgccctcgttgcgtttaattctcccgtcactccccagtcactaagggaggcctcctactcgcgcctcagcttcaagggcggatgtggctgggaccaccctgggactcgggtgtctccaaatgtggctcaggccgccccacgccgaacgaggtgggatcagatattcccgcttgtgagtgttggtggg

SEQ ID NO: 50482 - DNA, 27 bp, Homo sapiens
  chr5:72530609-72530636
  hyper
agttgggaggaccgtggggatgtagat

SEQ ID NO: 50483 - DNA, 26 bp, Homo sapiens
  chr5:72594776-72594802
  hyper
aaaaggcaccgggcacggaggtttaa

SEQ ID NO: 50484 - DNA, 483 bp, Homo sapiens
  chr5:72595059-72595542
  hyper
ggcttcccagtcaccctgcggcgacgcttctccctcccgggaatgacaccttcgctcgctttcacacagccaagccgttggagaggcagaaacagtgggtcccgagcccgcaggagaagttcccatcccgcccctctagccctcgggcgttggcagtggagtaacaaagacgctgccgcgccgttgaccccgaagaagctctgatgaaaaggagggcgggccgcgggataggagtttctacaattagttttttctgcctttacgttcccaagaagaagccgaggaagtagaaaggagagagatctgggaaaggcaagatccagaaatcaggagccattatgtttctcattttggagaaaaactgtaaaacagctcggcctcttgtccaccttgccccgaaggcaagtctggatatgaaaagaaaaaggcgggcaacggaggagatttatttttcattttaactttcctctcccaggcttcctc

SEQ ID NO: 50485 - DNA, 30 bp, Homo sapiens; identical to SEQ ID NO: 7871
  chr5:72596861-72596891
  hyper

SEQ ID NO: 50486 - DNA, 72 bp, Homo sapiens; identical to SEQ ID NO: 7872
  chr5:72598030-72598102
  hyper

SEQ ID NO: 50487 - DNA, 20 bp, Homo sapiens
  chr5:72599059-72599079
  hyper
cgaatgcagcgcccgggagt

SEQ ID NO: 50488 - DNA, 25 bp, Homo sapiens
  chr5:72599833-72599858
  hyper
ttctcctcaccgttaataactggca

SEQ ID NO: 50489 - DNA, 30 bp, Homo sapiens; identical to SEQ ID NO: 7875
  chr5:72608427-72608457
  hyper

SEQ ID NO: 50490 - DNA, 44 bp, Homo sapiens
  chr5:72716058-72716102
  hyper
atgtcccctaaagcacgggaagcttcgtgttttatgtttgggct

SEQ ID NO: 50491 - DNA, 30 bp, Homo sapiens; identical to SEQ ID NO: 29666
  chr5:72731806-72731836
  hyper

SEQ ID NO: 50492 - DNA, 26 bp, Homo sapiens
  chr5:72732884-72732910
  hyper
gtgcccgaggtttctctgcccttctc

SEQ ID NO: 50493 - DNA, 81 bp, Homo sapiens
  chr5:72733012-72733093
  hyper
gctcgccacagccggcgggaggcggggaagggagcagcccgggtggcttggagaacactgaacctttaattgggctataaa

SEQ ID NO: 50494 - DNA, 30 bp, Homo sapiens; identical to SEQ ID NO: 7879
  chr5:72733558-72733588
  hyper

SEQ ID NO: 50495 - DNA, 26 bp, Homo sapiens
  chr5:72740121-72740147
  hyper
cccgcgctcctggctcgcccatccag

SEQ ID NO: 50496 - DNA, 155 bp, Homo sapiens
  chr5:72740184-72740339
  hyper
ccacacctctcgcagctcatacctcacccgccccgcggccctgcttcccccagtctcatcctctcgggagcaggcccgcagggtctgcaaggccaagaacggaaccccaaacgcagagggtggggaggtgagcggcaggacgcaaaactcggaat

SEQ ID NO: 50497 - DNA, 232 bp, Homo sapiens; identical to SEQ ID NO: 7881
  chr5:72742850-72743082
  hyper

SEQ ID NO: 50498 - DNA, 1092 bp, Homo sapiens; identical to SEQ ID NO: 29672
  chr5:72743389-72744481
  hyper

SEQ ID NO: 50499 - DNA, 485 bp, Homo sapiens; identical to SEQ ID NO: 29673
  chr5:72744697-72745182
  hyper

SEQ ID NO: 50500 - DNA, 161 bp, Homo sapiens; identical to SEQ ID NO: 29675
  chr5:72746992-72747153
  hyper

SEQ ID NO: 50501 - DNA, 34 bp, Homo sapiens; identical to SEQ ID NO: 29676
  chr5:72747486-72747520
  hyper

SEQ ID NO: 50502 - DNA, 67 bp, Homo sapiens; identical to SEQ ID NO: 29677
  chr5:74161713-74161780
  hyper

SEQ ID NO: 50503 - DNA, 87 bp, Homo sapiens; identical to SEQ ID NO: 29678
  chr5:74162506-74162593
  hyper

SEQ ID NO: 50504 - DNA, 30 bp, Homo sapiens; identical to SEQ ID NO: 29679
  chr5:74348254-74348284
  hyper

SEQ ID NO: 50505 - DNA, 57 bp, Homo sapiens; identical to SEQ ID NO: 29680
  chr5:74349876-74349933
  hyper

SEQ ID NO: 50506 - DNA, 264 bp, Homo sapiens
  chr5:75378033-75378297
  hyper
cgtgaggatgccctacttcccgcagcatccggatggcagggtctgcgtcggaaggcccgggagggcgacgccctccactgctgccgcggggtgggtgcgccaggcctgggtgtggcctcacgggagcgagtttctctccagccgcctggcccaccgctttggaacagtgaagctcgagttggggtctcctgcacgccaaggggagaaatgtttgtttctgacaacacaagcaaaattctctctcctgcacgccaaggggagaaa

SEQ ID NO: 50507 - DNA, 30 bp, Homo sapiens; identical to SEQ ID NO: 29682
  chr5:75378559-75378589
  hyper

SEQ ID NO: 50508 - DNA, 689 bp, Homo sapiens; identical to SEQ ID NO: 29683
  chr5:75379005-75379694
  hyper

SEQ ID NO: 50509 - DNA, 96 bp, Homo sapiens; identical to SEQ ID NO: 18826
  chr5:75380067-75380163
  hyper

SEQ ID NO: 50510 - DNA, 431 bp, Homo sapiens
  chr5:75380193-75380624
  hyper
ttctcttagtgggcttttccccttccgcctgggttctagaactgggaagacttttctccagagcgtcgcggggagcgccccgggctgggcccacggggactgcggaatacggggatgaacttggcttggggcagccagcaccccacggcagatgaacaatcgggagcagatctgtgggcgtgcggggaccttaggcggcgcgcgggggcggggggaggggctgagccacgggggctagaggtgccgcctggacggcctgagctgggggcgctcgcgtcaccttctacgtgtgcgagtgatgcaaatgcagacccgcgaggggcgggcgggggtggcgggcgggggcaggcgacggagtctccgtctgggagcgcgcgtgtgtgcgtcaaaagctctgggttgatggatgccccgcggcgcgcctggcgcgg

SEQ ID NO: 50511 - DNA, 48 bp, Homo sapiens; identical to SEQ ID NO: 29685
  chr5:75699645-75699693
  hyper

SEQ ID NO: 50512 - DNA, 30 bp, Homo sapiens; identical to SEQ ID NO: 29686
  chr5:75700119-75700149
  hyper

SEQ ID NO: 50513 - DNA, 79 bp, Homo sapiens
  chr5:76011206-76011285
  hyper
aagggaagagctccgcgaggccgcgcgggggggaagcgggagaagccgctcttcctattccactcgcagtctgcgtgtg

SEQ ID NO: 50514 - DNA, 17 bp, Homo sapiens
  chr5:76011337-76011354
  hyper
gacgtataaaagttcaa

SEQ ID NO: 50515 - DNA, 30 bp, Homo sapiens; identical to SEQ ID NO: 29688
  chr5:76115162-76115192
  hyper

SEQ ID NO: 50516 - DNA, 114 bp, Homo sapiens; identical to SEQ ID NO: 29689
  chr5:76115495-76115609
  hyper

SEQ ID NO: 50517 - DNA, 26 bp, Homo sapiens
  chr5:76250409-76250435
  hyper
cttggttagaaggcccgccccacacg

SEQ ID NO: 50518 - DNA, 394 bp, Homo sapiens; identical to SEQ ID NO: 29694
  chr5:76476379-76476773
  hyper

SEQ ID NO: 50519 - DNA, 30 bp, Homo sapiens; identical to SEQ ID NO: 29695
  chr5:76506145-76506175
  hyper

SEQ ID NO: 50520 - DNA, 253 bp, Homo sapiens; identical to SEQ ID NO: 29696
  chr5:76506506-76506759
  hyper

SEQ ID NO: 50521 - DNA, 275 bp, Homo sapiens; identical to SEQ ID NO: 18830
  chr5:76506760-76507035
  hyper

SEQ ID NO: 50522 - DNA, 88 bp, Homo sapiens
  chr5:76507114-76507202
  hyper
cgtgggggccgtccgccccgtcggcggggctcgcacgggtagggggctccggcggagttgggtgaccgtgaggcggttggtttggaga

SEQ ID NO: 50523 - DNA, 64 bp, Homo sapiens; identical to SEQ ID NO: 29700
  chr5:76924416-76924480
  hyper

SEQ ID NO: 50524 - DNA, 167 bp, Homo sapiens; identical to SEQ ID NO: 29701
  chr5:76924754-76924921
  hyper

SEQ ID NO: 50525 - DNA, 107 bp, Homo sapiens
  chr5:76925454-76925561
  hyper
gtgacctaggtgcaccgtgtctgtgcgcgcgcgtgtgtagcgtctgagcgtgagcgagagtgcgagtgtgtgtgtttctgcccacaaaccagtccattggtgtctga

SEQ ID NO: 50526 - DNA, 742 bp, Homo sapiens
  chr5:76925690-76926432
  hyper
gtaggcgtcgcgtcgaaggtgtgggtgggaacgccgcccgtcagaaggccaggaggagggcgcgagcacggccagcgcaagcagggaggccagggtggcgggaagggtgggctgaggcgctggagaccgagccgagggcgcagctgggtgggaagggaagaggggcggccgggagacgggggaccgcgggcgatcgaaatcaggcggaggggaggcctcgcgggctggggcttggggtgagcccgagcgagtggaggagagaggcgaggacgaaacgagacggggcgaaggccggggcgggacggggcagggcgccggggtccgggtgcgcgccggaagggcctcggggcggcccccggggcggtgctgggggcggagcgggccggggcgcggctgcattaagtgaagctcatagagactgtgtgctctagcgccttgcggcggagggaggcgatgctggtgccccgccacacgtcgctgctgtccggggagctgcagagctggggcgaaccggagacgttgctggggccggggagggaggcgggcaccatgccggggaaggcgggctggtagaggtgcgactgcagccccgcgccgttggaacccgccaggctgttggacaggcccatggagttgggcggcggaccggccgccaggctgcactgggacagcgactgcgccatggcctgctgcctgcccagcgccggcggcagaggcagctgtgacacgccaggcatggcgg

SEQ ID NO: 50527 - DNA, 128 bp, Homo sapiens; identical to SEQ ID NO: 29703
  chr5:76926728-76926856
  hyper

SEQ ID NO: 50528 - DNA, 54 bp, Homo sapiens
  chr5:76928397-76928451
  hyper
caggcaagcgtagacgcactctacgcttaccagtgtgaacggtgttgcagtcta

SEQ ID NO: 50529 - DNA, 10 bp, Homo sapiens
  chr5:76928678-76928688
  hyper
caattgagct

SEQ ID NO: 50530 - DNA, 34 bp, Homo sapiens; identical to SEQ ID NO: 18837
  chr5:76928906-76928940
  hyper

SEQ ID NO: 50531 - DNA, 20 bp, Homo sapiens
  chr5:76932282-76932302
  hyper
tatttgtcaataatgcgagc

SEQ ID NO: 50532 - DNA, 210 bp, Homo sapiens; identical to SEQ ID NO: 18839
  chr5:76932332-76932542
  hyper

SEQ ID NO: 50533 - DNA, 55 bp, Homo sapiens; identical to SEQ ID NO: 29707
  chr5:76933464-76933519
  hyper

SEQ ID NO: 50534 - DNA, 133 bp, Homo sapiens
  chr5:76934040-76934173
  hyper
cctaacaaattatcacggggtatatcgcctttcgaaaaaaaaaaaaaggcgggggaggggggaagagaaaaataagaaaaacaaaaagtaacaacattccccaactcctttcttggatctacatattccatag

SEQ ID NO: 50535 - DNA, 150 bp, Homo sapiens
  chr5:76934870-76935020
  hyper
ctgagctaacatcttcctagggcaggggcagagcaggggtcagagcgggccatgaccctggcgtgacctgagggtcgcccccacctgcgctctctgggcctgccgctcatattggcccgccagcccagggcgcgacgagggcacaccgcg

SEQ ID NO: 50536 - DNA, 7 bp, Homo sapiens
  chr5:76937416-76937423
  hyper
tccctct

SEQ ID NO: 50537 - DNA, 39 bp, Homo sapiens
  chr5:76939774-76939813
  hyper
gggtgcaagggccggtcccttgctcgttttttctcccat

SEQ ID NO: 50538 - DNA, 35 bp, Homo sapiens
  chr5:76940374-76940409
  hyper
cgctccccgcccggctcctacgtcccaatcctttt

SEQ ID NO: 50539 - DNA, 344 bp, Homo sapiens
  chr5:76940857-76941201
  hyper
ccctcgtcccctccccgcaacccgagtgcggctaattccgggcgtctatattcactcaattagagaaatctacagagaagatcgatcttccatctgcagacatgccagcttaacaaattagattcttgtttcgtgcaggtgatttggtgacagttggggaattagaagtaataagttgttgtgtttgagcccgggcccccgccccccgcccgcgcccctccccgcccgggggcccctcggccgcgcccgccgcccgggcaccccctaccgcaccccccagccggcccgcgccgccgccgccgtcgccgcatcccccgccgtaattagtgctgctgccctccatg

SEQ ID NO: 50540 - DNA, 172 bp, Homo sapiens; identical to SEQ ID NO: 18845
  chr5:76941326-76941498
  hyper

SEQ ID NO: 50541 - DNA, 389 bp, Homo sapiens; identical to SEQ ID NO: 7912
  chr5:76941512-76941901
  hyper

SEQ ID NO: 50542 - DNA, 37 bp, Homo sapiens
  chr5:77147526-77147563
  hyper
gtgtgcgtgtgtgcacgcgcgagaagtgcgtgtgtag

SEQ ID NO: 50543 - DNA, 105 bp, Homo sapiens; identical to SEQ ID NO: 18848
  chr5:77148393-77148498
  hyper

SEQ ID NO: 50544 - DNA, 25 bp, Homo sapiens
  chr5:77269309-77269334
  hyper
ccttactcctcgcaggcttcaacct

SEQ ID NO: 50545 - DNA, 47 bp, Homo sapiens
  chr5:78407604-78407651
  hyper
taaagaggcaggctgcggactcggagcagctcggggctgcgcagcgg

SEQ ID NO: 50546 - DNA, 11 bp, Homo sapiens
  chr5:78408181-78408192
  hyper
gatatcccgtc

SEQ ID NO: 50547 - DNA, 16 bp, Homo sapiens
  chr5:79330913-79330929
  hyper
ctttctctccagcccc

SEQ ID NO: 50548 - DNA, 205 bp, Homo sapiens; identical to SEQ ID NO: 29728
  chr5:79330930-79331135
  hyper

SEQ ID NO: 50549 - DNA, 108 bp, Homo sapiens; identical to SEQ ID NO: 7923
  chr5:79331229-79331337
  hyper

SEQ ID NO: 50550 - DNA, 3 bp, Homo sapiens
  chr5:79331476-79331479
  hyper
cgc

SEQ ID NO: 50551 - DNA, 63 bp, Homo sapiens
  chr5:79864835-79864898
  hyper
ctggcagcgtctccacggtccccgccgacccctggaaccaggcgcgtttcctcagtttttcct

SEQ ID NO: 50552 - DNA, 367 bp, Homo sapiens; identical to SEQ ID NO: 18854
  chr5:79865078-79865445
  hyper

SEQ ID NO: 50553 - DNA, 140 bp, Homo sapiens; identical to SEQ ID NO: 29732
  chr5:79865522-79865662
  hyper

SEQ ID NO: 50554 - DNA, 46 bp, Homo sapiens
  chr5:79866414-79866460
  hyper
cccattgagggaagcacgcacccctacgtcacgggctttggctcct

SEQ ID NO: 50555 - DNA, 41 bp, Homo sapiens; identical to SEQ ID NO: 18856
  chr5:80255775-80255816
  hyper

SEQ ID NO: 50556 - DNA, 58 bp, Homo sapiens; identical to SEQ ID NO: 7929
  chr5:80256312-80256370
  hyper

SEQ ID NO: 50557 - DNA, 138 bp, Homo sapiens; identical to SEQ ID NO: 29736
  chr5:80256428-80256566
  hyper

SEQ ID NO: 50558 - DNA, 59 bp, Homo sapiens; identical to SEQ ID NO: 29737
  chr5:80256887-80256946
  hyper

SEQ ID NO: 50559 - DNA, 60 bp, Homo sapiens; identical to SEQ ID NO: 18859
  chr5:80689735-80689795
  hyper

SEQ ID NO: 50560 - DNA, 239 bp, Homo sapiens
  chr5:80689879-80690118
  hyper
cgccggctggatggcttggctcatgaccacctcgccgggcgccggccgctccatggccagggcgagagcgctacgcctgcggcccccgacaccccaccatgcccgctccgcccgccccgccctccccgcccagctccagagggcactggcgccgcccgcccgggccgcgaacccctggccgccaggtggtgggagctgcgagtgagggggcccgcactgtcatcccaggactatcgcga

SEQ ID NO: 50561 - DNA, 30 bp, Homo sapiens; identical to SEQ ID NO: 7933
  chr5:81075100-81075130
  hyper

SEQ ID NO: 50562 - DNA, 258 bp, Homo sapiens
  chr5:82767171-82767429
  hyper
ccagaactagctgcacggggggcggggaaatgggggtggggaaggagtgggagggcagtggtttccgcgagcagagcgatgttactgagtgagtccctgaatggggagcgctgctgtccccaagccgattggtacttcttgtcaggaagaaacgccaagaggtgggagtgcctggggagggaggcaggcggtccctaccgcaggcgcggggagctgcctttccgcccctccgcctgctttccaagcctggactcttag

SEQ ID NO: 50563 - DNA, 17 bp, Homo sapiens
  chr5:82767793-82767810
  hyper
agcgctgcagtgaattt

SEQ ID NO: 50564 - DNA, 675 bp, Homo sapiens
  chr5:82768217-82768892
  hyper
ttgttgttcttaacacgctcgaggcaaaagtttgaatggggactaccaagacttgccacagacaagtccccgaagccgccttggtgcaggccacctggtttcccagcccctggtgtgtggtcagtgcctggtgttcctggaaagccactcccgggcagctcctgacagtgcgacccggcgcccaagcagcctgggaccttgcgcggacctgaccccttcagaccgcaggcagtctgggaggaggtccggccgggggaggtgcaggatccccgccgtgtctctttgacgacttggggactgtcacggttctctcccggcgcccctgggttcttttgtcctgcacgcggtgcgaaggggccagcagggaaggagcagaggatggggggtggggttgttggagccccgcggaggtctgggaggcccctgggcgggaaaagcctgttctgaatcggcagggatgtgcaacaatttttctcaccctgaagagtgaaatagggtctgtcgctcccatctcaacaagcaaaccggcacccagagcgcactgcagacaaaggtggctcggggacccgaatcaggggcctctgggtcagtcctctcgcccagactacaggagtcctccgtttccttacatattccccaccctctcctagttctccgctctagttgagcaacttt

SEQ ID NO: 50565 - DNA, 308 bp, Homo sapiens
  chr5:82769061-82769369
  hyper
ggcgtggagcggtctgggtgttaggcagaggagagcggggtagaaaaatagtgtcatagcctaaactatttgctctccaatccaactgcgtctcggcaagtcctgcatgtccctgggagatgctgcgggaagggggagaaatctacacggcgcctggagagttgtcctgccgcgcgcacacccgcggcagagtctctctgggtcgcgttcctcatctttgtgtctccctctgtctccatcttctctgcctcccttcccctctcccagcctctgttctctctctctagcttctgcgtcccctcccccac

SEQ ID NO: 50566 - DNA, 293 bp, Homo sapiens; identical to SEQ ID NO: 29743
  chr5:82769910-82770203
  hyper

SEQ ID NO: 50567 - DNA, 112 bp, Homo sapiens; identical to SEQ ID NO: 29744
  chr5:83017828-83017940
  hyper

SEQ ID NO: 50568 - DNA, 206 bp, Homo sapiens
  chr5:83678989-83679195
  hyper
gaggattctattacccgcggatccctcacaaggggccgcccgcatctgtgagcgcaggagtggcacagctcccccaggcacagctcccactcgcctccccacacaccctgctgcccccgctgcccttttccggcgactacttcagccccggccagcggtgagacccaggtcagcacaagggtttgtatggacaagctgcacctcgc

SEQ ID NO: 50569 - DNA, 56 bp, Homo sapiens; identical to SEQ ID NO: 29746
  chr5:83679587-83679643
  hyper

SEQ ID NO: 50570 - DNA, 37 bp, Homo sapiens
  chr5:83679644-83679681
  hyper
ccagagcaccgcacccgggggcggacggccctgcagc

SEQ ID NO: 50571 - DNA, 29 bp, Homo sapiens
  chr5:83680340-83680369
  hyper
attcttggagagggcgagagtggtgacta

SEQ ID NO: 50572 - DNA, 131 bp, Homo sapiens; identical to SEQ ID NO: 29748
  chr5:87436611-87436742
  hyper

SEQ ID NO: 50573 - DNA, 30 bp, Homo sapiens; identical to SEQ ID NO: 29749
  chr5:87955350-87955380
  hyper

SEQ ID NO: 50574 - DNA, 101 bp, Homo sapiens; identical to SEQ ID NO: 29751
  chr5:87955839-87955940
  hyper

SEQ ID NO: 50575 - DNA, 41 bp, Homo sapiens
  chr5:87956158-87956199
  hyper
gcccagagtggcaagcgctcaccaacgccggccaccgagca

SEQ ID NO: 50576 - DNA, 236 bp, Homo sapiens
  chr5:87956964-87957200
  hyper
gcagcagctgcaggaggactcgggcagttggcggtcaccgggaggcgtcgtcctgccccgcggcgggccagccgccttcgctgctgccactgcctagcctaaccgcatctgcagccagtcacagagtcggctgtctcctctttgcaccgcccacgccaagtaccttgcaaggcggctgctaagcctggctaattttagatctccagaatgcgctatgcccgcgctcaactaaaacc

SEQ ID NO: 50577 - DNA, 221 bp, Homo sapiens; identical to SEQ ID NO: 29754
  chr5:87962639-87962860
  hyper

SEQ ID NO: 50578 - DNA, 22 bp, Homo sapiens
  chr5:87968077-87968099
  hyper
agcaaaccgcaaagacctagct

SEQ ID NO: 50579 - DNA, 62 bp, Homo sapiens
  chr5:87968858-87968920
  hyper
atccaaagtcacagcacggccgcagcacacaaacaggcttctttcggcgtctccaaaaaaaa

SEQ ID NO: 50580 - DNA, 73 bp, Homo sapiens; identical to SEQ ID NO: 472
  chr5:87970041-87970114
  hyper

SEQ ID NO: 50581 - DNA, 78 bp, Homo sapiens; identical to SEQ ID NO: 18870
  chr5:87970115-87970193
  hyper

SEQ ID NO: 50582 - DNA, 46 bp, Homo sapiens
  chr5:87970872-87970918
  hyper
gcaaaacaccaggccaaatccggcaaggcggcggctacagaatggc

SEQ ID NO: 50583 - DNA, 387 bp, Homo sapiens; identical to SEQ ID NO: 29761
  chr5:87971517-87971904
  hyper

SEQ ID NO: 50584 - DNA, 18 bp, Homo sapiens
  chr5:87972106-87972124
  hyper
gcataatcagggctccgc

SEQ ID NO: 50585 - DNA, 20 bp, Homo sapiens
  chr5:87974084-87974104
  hyper
aatctcccttattggcgcat

SEQ ID NO: 50586 - DNA, 211 bp, Homo sapiens
  chr5:87974307-87974518
  hyper
ccccgccctcacccccatcctcccctcccctcccttctgcgcctcccccaaccccccgccccgcattaccatatggaggccgagtccctgcgaatcacagcagcagcgggaggtatttgaataagccccgcaaccccgcgcagaccccaactcctccgagagcagcatgccctgcaccaagagccaccactctggccggtaacctggcagc

SEQ ID NO: 50587 - DNA, 30 bp, Homo sapiens; identical to SEQ ID NO: 29764
  chr5:87976608-87976638
  hyper

SEQ ID NO: 50588 - DNA, 31 bp, Homo sapiens; identical to SEQ ID NO: 18875
  chr5:87979725-87979756
  hyper

SEQ ID NO: 50589 - DNA, 73 bp, Homo sapiens; identical to SEQ ID NO: 18876
  chr5:87979912-87979985
  hyper

SEQ ID NO: 50590 - DNA, 156 bp, Homo sapiens; identical to SEQ ID NO: 29767
  chr5:87980430-87980586
  hyper

SEQ ID NO: 50591 - DNA, 308 bp, Homo sapiens
  chr5:87980646-87980954
  hyper
tttagaggcaaaagcttgcttattcagaggagagagggagggggagagggagaaaggaggcgggagggaggagagacgggggagagagaagtaaaagggggatggaggatgaagaggaggtggagaatcagaaggtagtgcgggcgttgttagagaaggaggaggaagaggaggaggaggaggagggatgggaggggtagggtggagtaaccaaagatgggctgggatgggacggcgaggaataaattgctccccacccagctgcggtgcgacgcccccagcgtcccaggggagccggtgcgtcagct

SEQ ID NO: 50592 - DNA, 30 bp, Homo sapiens; identical to SEQ ID NO: 29769
  chr5:87983365-87983395
  hyper

SEQ ID NO: 50593 - DNA, 30 bp, Homo sapiens; identical to SEQ ID NO: 29770
  chr5:87984984-87985014
  hyper

SEQ ID NO: 50594 - DNA, 179 bp, Homo sapiens; identical to SEQ ID NO: 29771
  chr5:87985348-87985527
  hyper

SEQ ID NO: 50595 - DNA, 90 bp, Homo sapiens
  chr5:87985954-87986044
  hyper
aagattttttctcaaaagaattaagagctctagaggcgcctcttccactcactagggcaccatgtcaaagggactcgtcatggcgattta

SEQ ID NO: 50596 - DNA, 63 bp, Homo sapiens; identical to SEQ ID NO: 29773
  chr5:87986310-87986373
  hyper

SEQ ID NO: 50597 - DNA, 108 bp, Homo sapiens; identical to SEQ ID NO: 29774
  chr5:87988193-87988301
  hyper

SEQ ID NO: 50598 - DNA, 67 bp, Homo sapiens
  chr5:87988584-87988651
  hyper
ccgtcccctcctttctcggccggagacgttaagagttcccggtgaatgacaccgtccagggtcagaa

SEQ ID NO: 50599 - DNA, 90 bp, Homo sapiens
  chr5:87990318-87990408
  hyper
gaacccgaaaagcctcgcgttttttctcttgtgttttcctcacttttctttttctcaaactgcaaaattttagtgcctgaatggcgaatg

SEQ ID NO: 50600 - DNA, 30 bp, Homo sapiens; identical to SEQ ID NO: 29777
  chr5:87991432-87991462
  hyper

SEQ ID NO: 50601 - DNA, 121 bp, Homo sapiens; identical to SEQ ID NO: 29778
  chr5:88179851-88179972
  hyper

SEQ ID NO: 50602 - DNA, 76 bp, Homo sapiens; identical to SEQ ID NO: 29779
  chr5:88180270-88180346
  hyper

SEQ ID NO: 50603 - DNA, 534 bp, Homo sapiens; identical to SEQ ID NO: 29780
  chr5:88184853-88185387
  hyper

SEQ ID NO: 50604 - DNA, 82 bp, Homo sapiens; identical to SEQ ID NO: 18880
  chr5:88185388-88185470
  hyper

SEQ ID NO: 50605 - DNA, 333 bp, Homo sapiens; identical to SEQ ID NO: 18881
  chr5:89854523-89854856
  hyper

SEQ ID NO: 50606 - DNA, 67 bp, Homo sapiens
  chr5:89854902-89854969
  hyper
ggggcatagctgcccgcgtcggttctgtccaaggctgcggttttgcagggagcgttaggttcctgca

SEQ ID NO: 50607 - DNA, 29 bp, Homo sapiens
  chr5:92915099-92915128
  hyper
cgctagggtcacgccgggtcccaggggcc

SEQ ID NO: 50608 - DNA, 57 bp, Homo sapiens; identical to SEQ ID NO: 29784
  chr5:92915510-92915567
  hyper

SEQ ID NO: 50609 - DNA, 328 bp, Homo sapiens; identical to SEQ ID NO: 29785
  chr5:92915837-92916165
  hyper

SEQ ID NO: 50610 - DNA, 24 bp, Homo sapiens
  chr5:92940177-92940201
  hyper
ggggtgggccggggccggctgcga

SEQ ID NO: 50611 - DNA, 52 bp, Homo sapiens; identical to SEQ ID NO: 29787
  chr5:94620527-94620579
  hyper

SEQ ID NO: 50612 - DNA, 277 bp, Homo sapiens; identical to SEQ ID NO: 29788
  chr5:94620857-94621134
  hyper

SEQ ID NO: 50613 - DNA, 95 bp, Homo sapiens
  chr5:94955586-94955681
  hyper
ctgctgtgctttacacgtaaatagagaatggatgaggttctcagcgcccaggggtccgcggcttccgcgagggtagcgtcgggggccgctgcaga

SEQ ID NO: 50614 - DNA, 1016 bp, Homo sapiens
  chr5:94955919-94956935
  hyper
actttggtttcccgcgtcctgcccgccctcttcggtgcctcctcttcctccgggacaaggatggaggatctctttagcccctcaattctgccgccggcgcccaacatttccgtgcccatcttgctgggctggggtctcaacctgaccttggggcaaggagcccctgcctctgggccgcccagccgccgcgtccgcctggtgttcctgggggtcatcctggtggtggcggtggcaggcaacaccacagtgctgtgccgcctgtgcggcggcggcgggccctgggcgggccccaagcgtcgcaagatggacttcctgctggtgcagctggccctggcggacctgtacgcgtgcgggggcacggcgctgtcacagctggcctgggaactgctgggcgagccccgcgcggccacgggggacctggcgtgccgcttcctgcagctgctgcaggcatccgggcggggcgcctcggcccacctcgtggtgctcatcgccctcgagcgccggcgcgcggtgcgtcttccgcacggccggccgctgcccgcgcgtgccctcgccgccctgggctggctgctggcactgctgctggcgctgcccccggccttcgtggtgcgcggggactccccctcgccgctgccgccgccgccgccgccaacgtccctgcagccaggcgcgcccccggccgcccgcgcctggccgggggagcgtcgctgccacgggatcttcgcgcccctgccgcgctggcacctgcaggtctacgcgttctacgaggccgtcgcgggcttcgtcgcgcctgttacggtcctgggcgtcgcttgcggccacctactctccgtctggtggcggcaccggccgcaggcccccgcggctgcagcgccctggtcggcgagcccaggtcgagcccctgcgcccagcgcgctgccccgcgccaaggtgcagagcctgaagatgagcctgctgctggcgctgctgttcgtgggctgcgagctgccctactttgccgcccggctggcggccgc

SEQ ID NO: 50615 - DNA, 242 bp, Homo sapiens
  chr5:94957000-94957242
  hyper
cgatggccaacagcgctctcaatcccttcgtctacctcttcttccaggcgggcgactgccggctccggcgacagctgcggaagcggctgggctctctgtgctgcgcgccgcagggaggcgcggaggacgaggaggggccccggggccaccaggcgctctaccgccaacgctggccccaccctcattatcaccatgctcggcgggaaccgctggacgagggcggcttgcgcccaccccctccg

SEQ ID NO: 50616 - DNA, 53 bp, Homo sapiens; identical to SEQ ID NO: 29790
  chr5:95067679-95067732
  hyper

SEQ ID NO: 50617 - DNA, 480 bp, Homo sapiens
  chr5:100236202-100236682
  hyper
tcacaagcttttccacgaacctttcatcctggagaaaaaggaaagtgctcagggagcctagctgccctcgcattgttcctggcagctccaactccttgcacagtcttggtctctcaggagaccaaggcagtcaggacgctacagggcacgggtgtaagcgcgacgttcgcggccagccctctgccttgccccactgtaattgcgggttttgattaagaaggaggagccagttgccgactgagctttgaaagtgactttgggtggggggtgggggtggggtgggggtggaaggaggggagggaccaaaagagcctgagtcctgcaataaaggtttccccctatcttctcactcattctttccccctcgccgccggcgctctggcagcaggggataaccccggtgcgcgcctctcttcctgtttggtttactcaagcgcctgccccaacgccttctcagtcaagctgggaggaaactgcttc

SEQ ID NO: 50618 - DNA, 256 bp, Homo sapiens
  chr5:100236757-100237013
  hyper
aacgcctagggctgcgcccaccagccggcaacgtccaggaaagggccacaggagaaatgacacccgtgcaatgcggagtgtcccggctccgcttccccgcagggactcgaggtgcgctccttttcctggccacggtttagggaggctcggagatggacacctcggcagtatctggcgaccctcttctcactcgctccgcccactcctgctctccagggtcccagccaagggcccgaaccctcggagtcctagtgag

SEQ ID NO: 50619 - DNA, 150 bp, Homo sapiens; identical to SEQ ID NO: 29794
  chr5:100237567-100237717
  hyper

SEQ ID NO: 50620 - DNA, 115 bp, Homo sapiens; identical to SEQ ID NO: 29795
  chr5:100238283-100238398
  hyper

SEQ ID NO: 50621 - DNA, 201 bp, Homo sapiens
  chr5:100238681-100238882
  hyper
ggttgccccagctcccgcaccttctcttgatataaaggctccgttttggggagatagtcgcgggggtgaaatctgtaaaatgcgaggagagcttggagccgggatcccgggatcagatcactggggtcttctgtggccgagctccctctggtcctcgaacgctgcccagcgacctctcgccctgtttgcgccagctctgcc

SEQ ID NO: 50622 - DNA, 521 bp, Homo sapiens; identical to SEQ ID NO: 29800
  chr5:100239203-100239724
  hyper

SEQ ID NO: 50623 - DNA, 30 bp, Homo sapiens; identical to SEQ ID NO: 29801
  chr5:100240068-100240098
  hyper

SEQ ID NO: 50624 - DNA, 44 bp, Homo sapiens; identical to SEQ ID NO: 29802
  chr5:101631539-101631583
  hyper

SEQ ID NO: 50625 - DNA, 30 bp, Homo sapiens; identical to SEQ ID NO: 29803
  chr5:101632034-101632064
  hyper

SEQ ID NO: 50626 - DNA, 141 bp, Homo sapiens; identical to SEQ ID NO: 7974
  chr5:107005171-107005312
  hyper

SEQ ID NO: 50627 - DNA, 83 bp, Homo sapiens; identical to SEQ ID NO: 29805
  chr5:107005635-107005718
  hyper

SEQ ID NO: 50628 - DNA, 155 bp, Homo sapiens; identical to SEQ ID NO: 29807
  chr5:107006762-107006917
  hyper

SEQ ID NO: 50629 - DNA, 34 bp, Homo sapiens; identical to SEQ ID NO: 29808
  chr5:107007264-107007298
  hyper

SEQ ID NO: 50630 - DNA, 554 bp, Homo sapiens; identical to SEQ ID NO: 29809
  chr5:110408656-110409210
  hyper

SEQ ID NO: 50631 - DNA, 174 bp, Homo sapiens; identical to SEQ ID NO: 29810
  chr5:110559554-110559728
  hyper

SEQ ID NO: 50632 - DNA, 80 bp, Homo sapiens; identical to SEQ ID NO: 29811
  chr5:110560039-110560119
  hyper

SEQ ID NO: 50633 - DNA, 414 bp, Homo sapiens; identical to SEQ ID NO: 29812
  chr5:110560138-110560552
  hyper

SEQ ID NO: 50634 - DNA, 58 bp, Homo sapiens; identical to SEQ ID NO: 29813
  chr5:111754705-111754763
  hyper

SEQ ID NO: 50635 - DNA, 30 bp, Homo sapiens; identical to SEQ ID NO: 29814
  chr5:112629248-112629278
  hyper

SEQ ID NO: 50636 - DNA, 62 bp, Homo sapiens; identical to SEQ ID NO: 18898
  chr5:112629674-112629736
  hyper

SEQ ID NO: 50637 - DNA, 119 bp, Homo sapiens; identical to SEQ ID NO: 29816
  chr5:112630330-112630449
  hyper

SEQ ID NO: 50638 - DNA, 34 bp, Homo sapiens; identical to SEQ ID NO: 7978
  chr5:112824097-112824131
  hyper

SEQ ID NO: 50639 - DNA, 315 bp, Homo sapiens; identical to SEQ ID NO: 29821
  chr5:113696418-113696733
  hyper

SEQ ID NO: 50640 - DNA, 277 bp, Homo sapiens; identical to SEQ ID NO: 29822
  chr5:113696955-113697232
  hyper

SEQ ID NO: 50641 - DNA, 265 bp, Homo sapiens; identical to SEQ ID NO: 29823
  chr5:113697471-113697736
  hyper

SEQ ID NO: 50642 - DNA, 140 bp, Homo sapiens; identical to SEQ ID NO: 29824
  chr5:113698000-113698140
  hyper

SEQ ID NO: 50643 - DNA, 13 bp, Homo sapiens
  chr5:113698141-113698154
  hyper
cacctcctcgccg

SEQ ID NO: 50644 - DNA, 181 bp, Homo sapiens
  chr5:113698386-113698567
  hyper
accaccaccaccacccgcacccggcgcaccaccagcaccaccagccccaggcgcgccgcgagagcaaccccttcaccgaaatagccatgagcagctgcaggtacaacgggggcgtcatgcggccgctcagcaacttgagcgcgtcccgccggaacctgcacgagatggactcagaggcgca

SEQ ID NO: 50645 - DNA, 61 bp, Homo sapiens
  chr5:113698783-113698844
  hyper
cagtggcaccaagtccagcaaaaagaaaaaccagaacatcggctacaagctgggccaccgg

SEQ ID NO: 50646 - DNA, 57 bp, Homo sapiens
  chr5:113698951-113699008
  hyper
cgacaaggtacaggcttgaaccccagcccacgctaccggagtcgggcactgggtggt

SEQ ID NO: 50647 - DNA, 156 bp, Homo sapiens; identical to SEQ ID NO: 7987
  chr5:113699401-113699557
  hyper

SEQ ID NO: 50648 - DNA, 216 bp, Homo sapiens; identical to SEQ ID NO: 29832
  chr5:114515900-114516116
  hyper

SEQ ID NO: 50649 - DNA, 104 bp, Homo sapiens
  chr5:115151163-115151267
  hyper
gggggctgaaaaaaacgacggtcgaatatttaatctgcgaaacttggcagtggatttgaataaacccacagtcggggaagttagttaaattggtttgggaaagg

SEQ ID NO: 50650 - DNA, 39 bp, Homo sapiens; identical to SEQ ID NO: 18908
  chr5:115152638-115152677
  hyper

SEQ ID NO: 50651 - DNA, 6 bp, Homo sapiens
  chr5:115297186-115297192
  hyper
agactc

SEQ ID NO: 50652 - DNA, 292 bp, Homo sapiens
  chr5:115298204-115298496
  hyper
cgatacaagagaggaggggcaggggtcgcagcactgaacaccctggccggggttttgacagctgccacagtctctgagctccagcctcgcgcctgaacccggtccctgccatggggcccccttccagctcaggcttctatgtgagccgcgcagtggccctgctgctggctgggctggtagccgccctcctgctggcgctggccgtactcgccgccttgtacggccactgcgagcgcgtcccaccgtcggagctgcctggactcagggacttggaagccgagtcttcccctcc

SEQ ID NO: 50653 - DNA, 204 bp, Homo sapiens; identical to SEQ ID NO: 18910
  chr5:115298781-115298985
  hyper

SEQ ID NO: 50654 - DNA, 61 bp, Homo sapiens
  chr5:115299041-115299102
  hyper
cccccgcccctgcgtcccggtgcaggctgcgggtccagctgactaccgtgtccaggtgcgc

SEQ ID NO: 50655 - DNA, 30 bp, Homo sapiens; identical to SEQ ID NO: 29841
  chr5:115908915-115908945
  hyper

SEQ ID NO: 50656 - DNA, 42 bp, Homo sapiens; identical to SEQ ID NO: 29842
  chr5:115911133-115911175
  hyper

SEQ ID NO: 50657 - DNA, 30 bp, Homo sapiens; identical to SEQ ID NO: 7998
  chr5:115911931-115911961
  hyper

SEQ ID NO: 50658 - DNA, 19 bp, Homo sapiens
  chr5:119799986-119800005
  hyper
gtctcgggagttgatggca

SEQ ID NO: 50659 - DNA, 57 bp, Homo sapiens; identical to SEQ ID NO: 29845
  chr5:119800264-119800321
  hyper

SEQ ID NO: 50660 - DNA, 753 bp, Homo sapiens
  chr5:119800546-119801299
  hyper
aactagtgttttaatcgatggacctgggctggtgggagggatgaacgcacgcgtgtctctgaatctgtgtgtgtgacgacgggggagagggttagctgggggtgtgtcggcagaggaagtcgtgagcagcccggctggagcgtgcaagatgctcctctcctgccctattgcttccccagagtcctttggcaagtccgctgcctatctgtcagcctccccaagtcagggctgaagaggggccgggttctgggccctgggccagatcagggagggcagcctggaggaagcttggctcagactaccctccctgtctctcgagcctcgctgtagggaaggcgacccgggctgctggcagccttggggctaaggagggggtctgggactttctcactttctcagtttctgaagcatcccctgctctcctccgaacgtcgttaccagtaactctgggccttcccgccaccctacctctgcttccttccttccaccctgtcgccacttggcattgaacccgagaagcaggacgcgcaggagagtgtatgtgtggccggggtcttgccattggcgtcctggctctctgcagctgggactgcttcggttcttccccgcttttcctatcccacttcggttcagccctactcccgcccgcccctagccccaggtgatccagatggaaagaagcagagaaggtgtcagggctgaggctgcgtaactcaggcggcggctccgggcgggggcgggggccgggctggg

SEQ ID NO: 50661 - DNA, 61 bp, Homo sapiens
  chr5:119801445-119801506
  hyper
tagaacttcgaaggtggcggtggctgcagcgggaaaaggggtggggcgtagtctaggtcca

SEQ ID NO: 50662 - DNA, 505 bp, Homo sapiens; identical to SEQ ID NO: 29847
  chr5:121412800-121413305
  hyper

SEQ ID NO: 50663 - DNA, 221 bp, Homo sapiens
  chr5:121413590-121413811
  hyper
ctgctgttggccggcggcgggaggggcgcagtgcactagcgcgcagagctgcaaaggcccgagcaggagcacggtccaggcgaagcgcatcactccttttgccagattgaccccgctcgaggaggacgtggctcacagaaaataaaaacggggctcaaatcacgtgagggaaggagaaatcttcaaccaaggaggcgagcggagcacgggtatctcagtct

SEQ ID NO: 50664 - DNA, 159 bp, Homo sapiens; identical to SEQ ID NO: 29849
  chr5:121647435-121647594
  hyper

SEQ ID NO: 50665 - DNA, 494 bp, Homo sapiens; identical to SEQ ID NO: 29850
  chr5:121647801-121648295
  hyper

SEQ ID NO: 50666 - DNA, 201 bp, Homo sapiens; identical to SEQ ID NO: 29851
  chr5:121648762-121648963
  hyper

SEQ ID NO: 50667 - DNA, 23 bp, Homo sapiens
  chr5:122422292-122422315
  hyper
agctctgcgggcatcccggaagc

SEQ ID NO: 50668 - DNA, 183 bp, Homo sapiens
  chr5:122422651-122422834
  hyper
ctctcccatgatagcccctctggcgtcagtctggaccgagtggctacaggttggactagggtaggcagaagatgcacttggcaccttaccgaacggtatttgaatccgtctccattactcattaatggcgtgaccttaggcaacccatctaaactttccgaacctcagcggtccccatctaca

SEQ ID NO: 50669 - DNA, 187 bp, Homo sapiens; identical to SEQ ID NO: 29855
  chr5:122423874-122424061
  hyper

SEQ ID NO: 50670 - DNA, 252 bp, Homo sapiens; identical to SEQ ID NO: 29856
  chr5:122424436-122424688
  hyper

SEQ ID NO: 50671 - DNA, 217 bp, Homo sapiens
  chr5:122424911-122425128
  hyper
acccacgtgtccagccgggaagctgccagagcgtggaaccaaggagccaggacgcggcagcggccaagcgcagcagcccacggcggttgagtcgggcgcccaggtccgtccgcactctcgcgccctccgcgggcctcccaattttctcgcttgcaggtcgggaggtttccgggcggcacaatctctaggactctcctcccgcgctgctcaggggcat

SEQ ID NO: 50672 - DNA, 164 bp, Homo sapiens; identical to SEQ ID NO: 18921
  chr5:122425168-122425332
  hyper

SEQ ID NO: 50673 - DNA, 79 bp, Homo sapiens; identical to SEQ ID NO: 8010
  chr5:122425562-122425641
  hyper

SEQ ID NO: 50674 - DNA, 192 bp, Homo sapiens; identical to SEQ ID NO: 29859
  chr5:122425701-122425893
  hyper

SEQ ID NO: 50675 - DNA, 304 bp, Homo sapiens; identical to SEQ ID NO: 29860
  chr5:122426110-122426414
  hyper

SEQ ID NO: 50676 - DNA, 53 bp, Homo sapiens; identical to SEQ ID NO: 29861
  chr5:122426796-122426849
  hyper

SEQ ID NO: 50677 - DNA, 117 bp, Homo sapiens; identical to SEQ ID NO: 29862
  chr5:122430742-122430859
  hyper

SEQ ID NO: 50678 - DNA, 54 bp, Homo sapiens
  chr5:122431064-122431118
  hyper
atctagcctatagctcgagaaggcagtggggggaccgcaggctggagccccggg

SEQ ID NO: 50679 - DNA, 8 bp, Homo sapiens
  chr5:122431378-122431386
  hyper
gcaggctt

SEQ ID NO: 50680 - DNA, 75 bp, Homo sapiens; identical to SEQ ID NO: 29864
  chr5:122434453-122434528
  hyper

SEQ ID NO: 50681 - DNA, 112 bp, Homo sapiens; identical to SEQ ID NO: 29865
  chr5:122434605-122434717
  hyper

SEQ ID NO: 50682 - DNA, 401 bp, Homo sapiens; identical to SEQ ID NO: 29866
  chr5:124083481-124083882
  hyper

SEQ ID NO: 50683 - DNA, 59 bp, Homo sapiens; identical to SEQ ID NO: 29867
  chr5:124084195-124084254
  hyper

SEQ ID NO: 50684 - DNA, 112 bp, Homo sapiens; identical to SEQ ID NO: 29868
  chr5:124084771-124084883
  hyper

SEQ ID NO: 50685 - DNA, 334 bp, Homo sapiens; identical to SEQ ID NO: 29869
  chr5:125930586-125930920
  hyper

SEQ ID NO: 50686 - DNA, 97 bp, Homo sapiens; identical to SEQ ID NO: 29870
  chr5:126366983-126367080
  hyper

SEQ ID NO: 50687 - DNA, 30 bp, Homo sapiens; identical to SEQ ID NO: 29872
  chr5:127537200-127537230
  hyper

SEQ ID NO: 50688 - DNA, 73 bp, Homo sapiens
  chr5:127872869-127872942
  hyper
gaaggaaaagggggacgcgctcctgggggtctttggatattctggcaaagggggctgcagctctaggctccag

SEQ ID NO: 50689 - DNA, 190 bp, Homo sapiens
  chr5:127872990-127873180
  hyper
tcccccctcccccaagccggagccctaggtgcggagccgcttgcccacttaccctcggagcacgtcctgctgtcctcgccggcggacgcggctggccactgcggcaccctcctcgcgatactcgggcgctagaaacccgccttcagagcctgctgtagcggaccgaacctgttgcggcggcggctggggc

SEQ ID NO: 50690 - DNA, 96 bp, Homo sapiens
  chr5:127873710-127873806
  hyper
cgctccgaagacggatattggaaagctgcaaaagtcaccagaaagaaacaggcaagcaaacaaaagtcgcccccagaagaagaggagggttccctc

SEQ ID NO: 50691 - DNA, 467 bp, Homo sapiens
  chr5:127873981-127874448
  hyper
cggggcgggccggcgggcggcggctgtcagtgggggcgcggccgtccacacgtggggctcaacccggactgagaggccggcgcagagtgggcggggacagagtaagggagagatcgggactgaggaacgaggggaaccagggttgggtgaggggaagaggaaggaagggggggagggcgaagggagggaagaggacggagattggggagaaggggggcgaacccgagaggaaggccgggctggaagagggacttggaaagagggattggcgagcccgggtgcgagaggaaatgagcgggggatgggggcgaagttagggcaaagagagaagtgggaaaggagagggagggccaaggtccgggcgccgagaggaggggcccggggggccggctggagggggcgaggcgctaggcggctttgcttcccgtccccgtcaattggccgctagctctgttttgactgcctgt

SEQ ID NO: 50692 - DNA, 119 bp, Homo sapiens
  chr5:127874839-127874958
  hyper
ggctgggagtttccagattgaaatgcgccctccaccaccaagagggagctcacgcggccgcggggggccgaggcagccagccggcgccgcggtcctggggagtccgtgcaggggtgtgc

SEQ ID NO: 50693 - DNA, 25 bp, Homo sapiens
  chr5:128300655-128300680
  hyper
tggatgacctttgtgcgacactgtt

SEQ ID NO: 50694 - DNA, 246 bp, Homo sapiens; identical to SEQ ID NO: 29879
  chr5:128301033-128301279
  hyper

SEQ ID NO: 50695 - DNA, 392 bp, Homo sapiens
  chr5:128795689-128796081
  hyper
cagaggcagcactcccggctctcggctggctgtgggtctgtcttgtggggctccagcactagcctgctcggcctcggaaactcctgcagcgtccagaacacagaaaatagactcatctcctaattcgccagggagctcgagggctgcggggccgcggggctgcctcccccgctcctcccccaacccgaccccaccccacccccgccagggcttcggcggcctcccggagtcacacagcctacccccccaccccaacaccccctcccccggcagacaaagggcctgggcaaattcgccgcccggcctcctagcgctccggggaggccgctgcgccccggagtggatcgcgctggaggcgtgcgccgggcgagaagccgcggccgcgggagcgc

SEQ ID NO: 50696 - DNA, 277 bp, Homo sapiens
  chr5:128796244-128796521
  hyper
gcagggctggtgcaaccggtgcgtggagagcagggctcagtgggtagcaataaaaatgagcttgaggtgcaggttaaggggtcaagttcggaaatgaagcacacttctgccggcctcgttttaaccgtatgtggaatagtttccttctaattagagcaataatatttgcaaaggtacgtttacagcacctggaggaaaattagaacgtacctaagttgatagcaacgctctgctctagcatacacttcagaaatcgtttactcgtgctggagtcttt

SEQ ID NO: 50697 - DNA, 131 bp, Homo sapiens
  chr5:128796736-128796867
  hyper
ttgtgctactggaaccgcggcactttaagccccgcacttctgtctgccccgcccgcagagctgcagttcgcccccgaccgcgaggagtgggaagtcgtgtttcctgcgctctggcgccgggagccggtgga

SEQ ID NO: 50698 - DNA, 359 bp, Homo sapiens; identical to SEQ ID NO: 18938
  chr5:128796985-128797344
  hyper

SEQ ID NO: 50699 - DNA, 84 bp, Homo sapiens; identical to SEQ ID NO: 18939
  chr5:128797386-128797470
  hyper

SEQ ID NO: 50700 - DNA, 137 bp, Homo sapiens; identical to SEQ ID NO: 29883
  chr5:129240373-129240510
  hyper

SEQ ID NO: 50701 - DNA, 65 bp, Homo sapiens; identical to SEQ ID NO: 29884
  chr5:129240766-129240831
  hyper

SEQ ID NO: 50702 - DNA, 81 bp, Homo sapiens; identical to SEQ ID NO: 29885
  chr5:129241413-129241494
  hyper

SEQ ID NO: 50703 - DNA, 30 bp, Homo sapiens; identical to SEQ ID NO: 29886
  chr5:129241724-129241754
  hyper

SEQ ID NO: 50704 - DNA, 360 bp, Homo sapiens; identical to SEQ ID NO: 29887
  chr5:131346877-131347237
  hyper

SEQ ID NO: 50705 - DNA, 39 bp, Homo sapiens; identical to SEQ ID NO: 29888
  chr5:131347702-131347741
  hyper

SEQ ID NO: 50706 - DNA, 123 bp, Homo sapiens; identical to SEQ ID NO: 29889
  chr5:131593289-131593412
  hyper

SEQ ID NO: 50707 - DNA, 15 bp, Homo sapiens
  chr5:131593472-131593487
  hyper
cgcctggtgggcggc

SEQ ID NO: 50708 - DNA, 66 bp, Homo sapiens
  chr5:131992030-131992096
  hyper
agcttccagactggccggtctgcgcgcccacccctgcctcccggaccggccaccgccggaggccgc

SEQ ID NO: 50709 - DNA, 136 bp, Homo sapiens; identical to SEQ ID NO: 18943
  chr5:131992157-131992293
  hyper

SEQ ID NO: 50710 - DNA, 246 bp, Homo sapiens; identical to SEQ ID NO: 29892
  chr5:132083083-132083329
  hyper

SEQ ID NO: 50711 - DNA, 90 bp, Homo sapiens; identical to SEQ ID NO: 29893
  chr5:132947087-132947177
  hyper

SEQ ID NO: 50712 - DNA, 21 bp, Homo sapiens
  chr5:132947465-132947486
  hyper
ccctttgggctgcagcgagga

SEQ ID NO: 50713 - DNA, 693 bp, Homo sapiens; identical to SEQ ID NO: 18945
  chr5:132947836-132948529
  hyper

SEQ ID NO: 50714 - DNA, 155 bp, Homo sapiens; identical to SEQ ID NO: 29895
  chr5:133449703-133449858
  hyper

SEQ ID NO: 50715 - DNA, 32 bp, Homo sapiens
  chr5:134367203-134367235
  hyper
gtaggcaggacggggagcgggtcacctgggct

SEQ ID NO: 50716 - DNA, 641 bp, Homo sapiens
  chr5:134375210-134375851
  hyper
gcgcaggactcggccgccacctccctgcgcccctccaccgcggagaccctgcgcccctagcccagcgtctcttaccccacctgggcagcgctgcgtctgcggctcgtgggctccgggctcgcccgccgcggactctggctcaggtttcggctccggctggggccccggatccagctctggctctggcactgcacggttcttcggcccctgctggttcgctacatcccagcgcgcgaggccggggcttcctcggctcggcccgctcctcccgccgccgccgcccgtcgcccgcggggaaggcggggacactggccgggaggcgggaagggtggggggaggggaagctaggtgttcgccgggacctgcggggagaggggcggcgcgcagtcccgccggctaggggtcctggcctccctcggggcgtaggctggggtccgcgcggctggcggccgggcctcgaggccggggagcgcgccctgggacctccgtggaggggccctgccgcatgcggacgaagccagagcgggtcccagcctggccctggggcactttctctccctgggcccagtttcccacctgactcgtgaggggctggccctacttccgtttagacgggggctggtggtcgagtttggggtttt

SEQ ID NO: 50717 - DNA, 30 bp, Homo sapiens; identical to SEQ ID NO: 29899
  chr5:134376833-134376863
  hyper

SEQ ID NO: 50718 - DNA, 39 bp, Homo sapiens
  chr5:134385913-134385952
  hyper
ggaagggcaggagggcgaggggctagggcgatggaaggg

SEQ ID NO: 50719 - DNA, 97 bp, Homo sapiens; identical to SEQ ID NO: 29902
  chr5:134801812-134801909
  hyper

SEQ ID NO: 50720 - DNA, 93 bp, Homo sapiens; identical to SEQ ID NO: 29903
  chr5:134802273-134802366
  hyper

SEQ ID NO: 50721 - DNA, 13 bp, Homo sapiens
  chr5:134825450-134825463
  hyper
tccgagcccgtgg

SEQ ID NO: 50722 - DNA, 36 bp, Homo sapiens
  chr5:134826006-134826042
  hyper
cacagtagattcacacccctccgaggggactaataa

SEQ ID NO: 50723 - DNA, 19 bp, Homo sapiens
  chr5:134826479-134826498
  hyper
cgtgcgctgagggcccgga

SEQ ID NO: 50724 - DNA, 265 bp, Homo sapiens
  chr5:134870515-134870780
  hyper
gcgacctaacaagcggctcaggtatccccgactgctttaaagctcccgcttcctccctccgcctggagagggggtcccgaggcggcagctggggccccatctattgcctgctgactaggggagggggaaagtaacagtgtctacaaagggcctagtggtaaggaatgaaacagggcgttgtgtggagcaagtctttgggcaggcttgggaaggagaaaacagggtcgccggggcggtaggtgaagtcttcggaggcggctgggct

SEQ ID NO: 50725 - DNA, 184 bp, Homo sapiens
  chr5:134871417-134871601
  hyper
cgctcagagcgctgcagcccggactgagggcagagccgccagggcgcacttacgttcccaacagcctggggttgttactctgtgccagttgcgggtgcgagagcctggaagggtgcaggggcgcacggagaacttggcctggcctcctcgcctcgcctgcaggggccacgcgcccggccggtct

SEQ ID NO: 50726 - DNA, 50 bp, Homo sapiens
  chr5:134879428-134879478
  hyper
caagtcttgagcaaacgaccctagcgccgtggctcttcctacggcggggg

SEQ ID NO: 50727 - DNA, 376 bp, Homo sapiens
  chr5:134914251-134914627
  hyper
ggcttagttgctaggcggtctcctgcccctcgaccaccttggtgcccacccagaccaccccccgcgggatcccaggatgcctagaaattggcgcttgggttccccaggacaggacaagacgagacggcgacaaggggagctccccgcactcaccgtccacacgcgcggtgtacagcgccagcagcagcaggagcagcgcggccgccaggagcctcatgctgaccggaggggcgcggcgtgggagcagggacatggggagggcgctggcccgtcggagcggcggcccggagacgccacccagctctgctcggctttctctgcccggggcgcgccttccggctctgctggctccggctgcgccgtcggtggatgccca

SEQ ID NO: 50728 - DNA, 4 bp, Homo sapiens
  chr5:134914748-134914752
  hyper
atat

SEQ ID NO: 50729 - DNA, 290 bp, Homo sapiens; identical to SEQ ID NO: 29911
  chr5:135170256-135170546
  hyper

SEQ ID NO: 50730 - DNA, 172 bp, Homo sapiens; identical to SEQ ID NO: 29912
  chr5:135170997-135171169
  hyper

SEQ ID NO: 50731 - DNA, 36 bp, Homo sapiens
  chr5:135265701-135265737
  hyper
gcattgataaaggggcgcccttcatcgggagtaagt

SEQ ID NO: 50732 - DNA, 93 bp, Homo sapiens; identical to SEQ ID NO: 18953
  chr5:135265767-135265860
  hyper

SEQ ID NO: 50733 - DNA, 12 bp, Homo sapiens
  chr5:135265919-135265931
  hyper
cgccaggtgggc

SEQ ID NO: 50734 - DNA, 182 bp, Homo sapiens; identical to SEQ ID NO: 18955
  chr5:135265932-135266114
  hyper

SEQ ID NO: 50735 - DNA, 33 bp, Homo sapiens
  chr5:135266672-135266705
  hyper
cgagtgtgccttttaagacgcttccaagataaa

SEQ ID NO: 50736 - DNA, 62 bp, Homo sapiens; identical to SEQ ID NO: 29917
  chr5:135527945-135528007
  hyper

SEQ ID NO: 50737 - DNA, 647 bp, Homo sapiens
  chr5:135528233-135528880
  hyper
ccagccggaccgcttcacttggcctggagcatactggcgcgacccggcgcctccatggcgcgcccctcccgccctgccgcgcccaactgaccgagagtcggtgccttggggccggcggggactgcaaagaccccgggacgcgtccgctcactcgcctccgcgctcagctgctttccccgccggctggcggaccccagttctcggagctggacagttctgtgcccgcgcccctcgggctcactgtttctctccgtcgccaccaggacagaggtcccagtcactgactcgcctttcggctttacaacagcccgctcagctcggaccctcagctccagtgagctccaggtgctgggcgcctctgggctgcggcggcggggagaggcactcagcaagtgcagccgcagcccggggtctctgctgagcgcccggtggcagagcgcacggagggcgggtggccagggagtcctccgcgtcctccggcgccgccgccaccgcagcgtctcggaacagtcctgcaggctctggtccctgtcgagacgcccagtgttcagcgagcttgtccccactccctccggctgctgcgctcctgttttgagcaggagactgagctttctggcggctctgagcgcgctcgtgtcccgggcggg

SEQ ID NO: 50738 - DNA, 24 bp, Homo sapiens
  chr5:136834026-136834050
  hyper
cgcgccccccagggccgggtggcg

SEQ ID NO: 50739 - DNA, 158 bp, Homo sapiens
  chr5:136834506-136834664
  hyper
ccgagtgccccacagatgccgccctcctatcaggggcttggtacccctccccagaagcggggagcccgggtccgcacgccgcactcccacagacggtgcggtgcacacggctttggggcaggagaggggagaacagggctccagcagcacccgagctc

SEQ ID NO: 50740 - DNA, 14 bp, Homo sapiens
  chr5:136834706-136834720
  hyper
cgacagctaaggga

SEQ ID NO: 50741 - DNA, 55 bp, Homo sapiens
  chr5:136834826-136834881
  hyper
actactccaagttggggcgcggggttcctctgggcacgtaccttgggggccggcc

SEQ ID NO: 50742 - DNA, 107 bp, Homo sapiens; identical to SEQ ID NO: 29923
  chr5:136834912-136835019
  hyper

SEQ ID NO: 50743 - DNA, 1 bp, Homo sapiens
  chr5:137225091-137225092
  hyper
c

SEQ ID NO: 50744 - DNA, 364 bp, Homo sapiens; identical to SEQ ID NO: 29925
  chr5:137577620-137577984
  hyper

SEQ ID NO: 50745 - DNA, 33 bp, Homo sapiens
  chr5:139047957-139047990
  hyper
acgcggacgtgcctgcgcggctctggcggccgc

SEQ ID NO: 50746 - DNA, 60 bp, Homo sapiens
  chr5:139048162-139048222
  hyper
gggagccagctctgctcgcctggcttaacccagacgagcccaggacgccctatccctgaa

SEQ ID NO: 50747 - DNA, 49 bp, Homo sapiens; identical to SEQ ID NO: 29927
  chr5:139175487-139175536
  hyper

SEQ ID NO: 50748 - DNA, 62 bp, Homo sapiens; identical to SEQ ID NO: 29928
  chr5:139175815-139175877
  hyper

SEQ ID NO: 50749 - DNA, 58 bp, Homo sapiens; identical to SEQ ID NO: 29929
  chr5:139175929-139175987
  hyper

SEQ ID NO: 50750 - DNA, 48 bp, Homo sapiens
  chr5:139227725-139227773
  hyper
acgccgaggctgagccgccgcccgagccgctgctcagcgacagcgagt

SEQ ID NO: 50751 - DNA, 12 bp, Homo sapiens
  chr5:139227909-139227921
  hyper
ggtctcgtactc

SEQ ID NO: 50752 - DNA, 36 bp, Homo sapiens; identical to SEQ ID NO: 29931
  chr5:139283710-139283746
  hyper

SEQ ID NO: 50753 - DNA, 490 bp, Homo sapiens; identical to SEQ ID NO: 29932
  chr5:139283973-139284463
  hyper

SEQ ID NO: 50754 - DNA, 305 bp, Homo sapiens; identical to SEQ ID NO: 18969
  chr5:139525423-139525728
  hyper

SEQ ID NO: 50755 - DNA, 128 bp, Homo sapiens; identical to SEQ ID NO: 29934
  chr5:140012165-140012293
  hyper

SEQ ID NO: 50756 - DNA, 35 bp, Homo sapiens; identical to SEQ ID NO: 29935
  chr5:140012364-140012399
  hyper

SEQ ID NO: 50757 - DNA, 65 bp, Homo sapiens
  chr5:140174733-140174798
  hyper
gcctgttccgggtggcgtccaaaagacacggggaccttctggaggtaaatctgcagaatggcatt

SEQ ID NO: 50758 - DNA, 11 bp, Homo sapiens
  chr5:140187083-140187094
  hyper
ccacctggagg

SEQ ID NO: 50759 - DNA, 32 bp, Homo sapiens; identical to SEQ ID NO: 29938
  chr5:140214378-140214410
  hyper

SEQ ID NO: 50760 - DNA, 60 bp, Homo sapiens; identical to SEQ ID NO: 29939
  chr5:140248774-140248834
  hyper

SEQ ID NO: 50761 - DNA, 111 bp, Homo sapiens; identical to SEQ ID NO: 29940
  chr5:140261900-140262011
  hyper

SEQ ID NO: 50762 - DNA, 173 bp, Homo sapiens; identical to SEQ ID NO: 18971
  chr5:140305805-140305978
  hyper

SEQ ID NO: 50763 - DNA, 122 bp, Homo sapiens
  chr5:140306050-140306172
  hyper
caccgtttaaggagagaagtgttagtgtctcggggcgtctcccaggctccgccctgcgcccgcagccagcgtggtggtcgagaccccagcccgctgctactggagacagcacctctcgcgcc

SEQ ID NO: 50764 - DNA, 54 bp, Homo sapiens
  chr5:140306733-140306787
  hyper
tgtgcagggccaaagctgcctgcgtcttgacctacgacctggtgctcgaggacc

SEQ ID NO: 50765 - DNA, 30 bp, Homo sapiens; identical to SEQ ID NO: 8071
  chr5:140345497-140345527
  hyper

SEQ ID NO: 50766 - DNA, 30 bp, Homo sapiens; identical to SEQ ID NO: 29945
  chr5:140345821-140345851
  hyper

SEQ ID NO: 50767 - DNA, 40 bp, Homo sapiens; identical to SEQ ID NO: 29946
  chr5:140346709-140346749
  hyper

SEQ ID NO: 50768 - DNA, 140 bp, Homo sapiens
  chr5:140514751-140514891
  hyper
aatagtaaattaggacgcctggtggcgctgcaggctaagagtgtggatagtgggctctgcggataactcagacgccattaagctggggaatccaaactctaaaagaaggacgcattttaggtaagatctagtggctagat

SEQ ID NO: 50769 - DNA, 29 bp, Homo sapiens
  chr5:140514921-140514950
  hyper
cagtcaagaaagatcggattcgcggttat

SEQ ID NO: 50770 - DNA, 182 bp, Homo sapiens; identical to SEQ ID NO: 29948
  chr5:140593316-140593498
  hyper

SEQ ID NO: 50771 - DNA, 21 bp, Homo sapiens
  chr5:140604438-140604459
  hyper
ctcctacaccctgttcgtccg

SEQ ID NO: 50772 - DNA, 12 bp, Homo sapiens
  chr5:140604501-140604513
  hyper
cacagacagaga

SEQ ID NO: 50773 - DNA, 73 bp, Homo sapiens
  chr5:140613853-140613926
  hyper
agagtcgcatggtggcgctgcaggataagacggtgaaatttttgtaaccgcagatgctctggttttccttaac

SEQ ID NO: 50774 - DNA, 28 bp, Homo sapiens
  chr5:140614383-140614411
  hyper
cgagcagctggaccgggaggcactttgt

SEQ ID NO: 50775 - DNA, 120 bp, Homo sapiens; identical to SEQ ID NO: 29953
  chr5:140713985-140714105
  hyper

SEQ ID NO: 50776 - DNA, 45 bp, Homo sapiens; identical to SEQ ID NO: 29954
  chr5:140767211-140767256
  hyper

SEQ ID NO: 50777 - DNA, 182 bp, Homo sapiens; identical to SEQ ID NO: 18976
  chr5:140777487-140777669
  hyper

SEQ ID NO: 50778 - DNA, 85 bp, Homo sapiens; identical to SEQ ID NO: 29956
  chr5:140787848-140787933
  hyper

SEQ ID NO: 50779 - DNA, 290 bp, Homo sapiens
  chr5:140797342-140797632
  hyper
cctgggccgaatgctcttttagcgcggtagagtgcactttctccaactggaaaagcggggacccagcgagaacccgagcgaacgatgggagggagctgcgcgcagaggcgccgggccggcccgcggcaggtactatttcctttgctgctgcctttgttctaccccacgctgtgtgagccgatccgctactcgattccggaggagctggccaagggctcggtggtggggaacctcgctaaggatctagggcttagtgtcctggatgtgtcggctcgcgagctgcgagtgag

SEQ ID NO: 50780 - DNA, 21 bp, Homo sapiens
  chr5:140800458-140800479
  hyper
taagctctacaaatacgtgtg

SEQ ID NO: 50781 - DNA, 16 bp, Homo sapiens
  chr5:140801246-140801262
  hyper
gcgatttgctcttcct

SEQ ID NO: 50782 - DNA, 11 bp, Homo sapiens
  chr5:140856622-140856633
  hyper
gacaccaaact

SEQ ID NO: 50783 - DNA, 89 bp, Homo sapiens; identical to SEQ ID NO: 29963
  chr5:140864611-140864700
  hyper

SEQ ID NO: 50784 - DNA, 38 bp, Homo sapiens; identical to SEQ ID NO: 29964
  chr5:141030807-141030845
  hyper

SEQ ID NO: 50785 - DNA, 317 bp, Homo sapiens; identical to SEQ ID NO: 18980
  chr5:141262718-141263035
  hyper

SEQ ID NO: 50786 - DNA, 288 bp, Homo sapiens; identical to SEQ ID NO: 29966
  chr5:141293747-141294035
  hyper

SEQ ID NO: 50787 - DNA, 10 bp, Homo sapiens
  chr5:141931330-141931340
  hyper
ctcacttctc

SEQ ID NO: 50788 - DNA, 155 bp, Homo sapiens; identical to SEQ ID NO: 29969
  chr5:142781720-142781875
  hyper

SEQ ID NO: 50789 - DNA, 186 bp, Homo sapiens
  chr5:142784781-142784967
  hyper
gggaggtaacttttgcgcccccacaggtgacatcgcttgccagctcctgacacgggcgggggctgccgcagctccacctaatcctgctcgggcgctcggccacagccactctctcacctcccgccgcgctcagactgacggcggctccccctgctctgacatcttgaagacgattggggaagcgcg

SEQ ID NO: 50790 - DNA, 287 bp, Homo sapiens; identical to SEQ ID NO: 29971
  chr5:143584834-143585121
  hyper

SEQ ID NO: 50791 - DNA, 182 bp, Homo sapiens; identical to SEQ ID NO: 29972
  chr5:145214963-145215145
  hyper

SEQ ID NO: 50792 - DNA, 50 bp, Homo sapiens; identical to SEQ ID NO: 29973
  chr5:145316176-145316226
  hyper

SEQ ID NO: 50793 - DNA, 4 bp, Homo sapiens
  chr5:145713641-145713645
  hyper
cgtg

SEQ ID NO: 50794 - DNA, 196 bp, Homo sapiens
  chr5:145716979-145717175
  hyper
cagggcgggaaccagcggagggggctggctcggatggggagaaaagcaactggagggcgccgaggggaagagggagcccggatctgtcagggcgtcctcttggactaagggatgttcccctaaaccacaccaccccacctcgttcagattctgggaaacccggcacgcacataccctgcacaataacaggcagggt

SEQ ID NO: 50795 - DNA, 265 bp, Homo sapiens; identical to SEQ ID NO: 29977
  chr5:145717780-145718045
  hyper

SEQ ID NO: 50796 - DNA, 36 bp, Homo sapiens; identical to SEQ ID NO: 29978
  chr5:145718465-145718501
  hyper

SEQ ID NO: 50797 - DNA, 12 bp, Homo sapiens
  chr5:145719925-145719937
  hyper
ccttaaaaagaa

SEQ ID NO: 50798 - DNA, 280 bp, Homo sapiens; identical to SEQ ID NO: 2659
  chr5:145720018-145720298
  hyper

SEQ ID NO: 50799 - DNA, 169 bp, Homo sapiens; identical to SEQ ID NO: 29986
  chr5:145723301-145723470
  hyper

SEQ ID NO: 50800 - DNA, 166 bp, Homo sapiens
  chr5:145724336-145724502
  hyper
gctttgcacactgtgcgtcccagctacgcaaggaacgaagtattctctccctgggagtgcctggtgcgaatacatagctcccactgagaagcttggccccggtcagcggctccaggagcccggaacctcctccctggcggaatcccgggcaccattcagccttttc

SEQ ID NO: 50801 - DNA, 45 bp, Homo sapiens; identical to SEQ ID NO: 29988
  chr5:145724793-145724838
  hyper

SEQ ID NO: 50802 - DNA, 83 bp, Homo sapiens
  chr5:145725844-145725927
  hyper
cccacgcgttgcttatacctttctttgtaaactgtcagatttctgccccctccctcagttcagccctgcgcagccttgcctgc

SEQ ID NO: 50803 - DNA, 30 bp, Homo sapiens; identical to SEQ ID NO: 29990
  chr5:146256927-146256957
  hyper

SEQ ID NO: 50804 - DNA, 35 bp, Homo sapiens; identical to SEQ ID NO: 29991
  chr5:146257159-146257194
  hyper

SEQ ID NO: 50805 - DNA, 798 bp, Homo sapiens
  chr5:146257602-146258400
  hyper
ttgattttgcgggtatcaatgtcctcctccattgacagcaggcttacttgcgtgggaaccagaagccggcagacaagtatccatgatccctccccgcagccagtctcacaggagaggggggcaggggagccagtgggactgcaccatggtccgagcctgaggaggagacggggaggcggagagaaaaaaaataaaaacccggcaatggagctgtcacctcctccactcgggttctgcgaggctgcggcggctcctcccgcgcggtgcgctcactccagctccagttcccagcgaggatgctgcgcctgcctccgctgcctccgggtgccaagatacgccgtgccccgaggggtctggtcccgcccgcccgccccggaggcgctcacaagcgggtctggggagatgcccaacaggttcccctccttggcagccgctccaaaatgcaaaaaagatccctcctccccctgggagagcgggcagccgcgacaaaatggtgcctttctggacccgagctgcagtggcgagatggcagggacaggattcaggcttgcctggccggaatgagggtgctggtcccacgggagggcggctccggcaggcgggggtagggaagctggcggggagctgggcagggcgctgcagccggcgccagcgcactcaccctcacacccacacgcgcgcactcgcagctgctgctgctgctgctgctgctgctgctgcaggaggctggaggcggctggtgcattaaaggcgaggctcctcccaaccgcgtcagcagccccacgactctttcccagc

SEQ ID NO: 50806 - DNA, 35 bp, Homo sapiens; identical to SEQ ID NO: 29994
  chr5:146614297-146614332
  hyper

SEQ ID NO: 50807 - DNA, 35 bp, Homo sapiens; identical to SEQ ID NO: 29995
  chr5:146614703-146614738
  hyper

SEQ ID NO: 50808 - DNA, 36 bp, Homo sapiens; identical to SEQ ID NO: 29996
  chr5:146832654-146832690
  hyper

SEQ ID NO: 50809 - DNA, 362 bp, Homo sapiens; identical to SEQ ID NO: 29997
  chr5:146888821-146889183
  hyper

SEQ ID NO: 50810 - DNA, 239 bp, Homo sapiens
  chr5:146889575-146889814
  hyper
cctagcgagccagcgagccacacagccagctagcgcgcggagcaggggcccagagtagcgccgcgcttggctcactcgctggacctctcgcccggccgcacctcctcacgcacccccaaccctaacgtggcctcccgggctgacgcagcgtcggtgcccatcacaatcacaaaccaaacttggcgcgcgcgcacacgcacacacaggcgcacactgcccgctcgcgcaacagccttgcc

SEQ ID NO: 50811 - DNA, 38 bp, Homo sapiens; identical to SEQ ID NO: 30000
  chr5:148033734-148033772
  hyper

SEQ ID NO: 50812 - DNA, 160 bp, Homo sapiens; identical to SEQ ID NO: 8110
  chr5:148206272-148206432
  hyper

SEQ ID NO: 50813 - DNA, 272 bp, Homo sapiens; identical to SEQ ID NO: 30002
  chr5:148521059-148521331
  hyper

SEQ ID NO: 50814 - DNA, 184 bp, Homo sapiens; identical to SEQ ID NO: 30003
  chr5:148651223-148651407
  hyper

SEQ ID NO: 50815 - DNA, 484 bp, Homo sapiens; identical to SEQ ID NO: 30004
  chr5:148651703-148652187
  hyper

SEQ ID NO: 50816 - DNA, 22 bp, Homo sapiens
  chr5:149546581-149546603
  hyper
actctcacgtggagccggcccc

SEQ ID NO: 50817 - DNA, 363 bp, Homo sapiens; identical to SEQ ID NO: 30006
  chr5:149569485-149569848
  hyper

SEQ ID NO: 50818 - DNA, 43 bp, Homo sapiens
  chr5:149682031-149682074
  hyper
tgcgagggagttcagcgccccccggggacggtccagtgtctgg

SEQ ID NO: 50819 - DNA, 43 bp, Homo sapiens
  chr5:150051058-150051101
  hyper
attcttgcctccccccgacctttttttttggtggagggagaac

SEQ ID NO: 50820 - DNA, 125 bp, Homo sapiens
  chr5:150051667-150051792
  hyper
caagaccaacccgcgctgcgaactcgtggcttcctcactgcagtcctccgtgtttcctgggatggggaggggtctcctgtgctggagcaactgtggcttcccattcccgccgtcctctcccctaa

SEQ ID NO: 50821 - DNA, 30 bp, Homo sapiens; identical to SEQ ID NO: 30009
  chr5:150052081-150052111
  hyper

SEQ ID NO: 50822 - DNA, 201 bp, Homo sapiens
  chr5:150399922-150400123
  hyper
aaaagaggaagggaccgcctcccacgtccacagggacctgacttccacctctctgcccagatttgcttatgtcactgtcgccccgggacggggaggtggggagctgagggcaagtcgcgcccgcccctgaaatcccagccgcctagcgattggctgcaagggtctcggcttggccgcggattggtcacacccgagggcttg

SEQ ID NO: 50823 - DNA, 206 bp, Homo sapiens; identical to SEQ ID NO: 19001
  chr5:150400203-150400409
  hyper

SEQ ID NO: 50824 - DNA, 142 bp, Homo sapiens
  chr5:151066300-151066442
  hyper
agccgggaggagaggcgcatcctcagcagagcttccctcccttgcacacgagctgacggcgtgaacgggggtgtcggggttggtgcaactatagaagggaaaggctgggcgggggtcacacatacctcagtggcaggcaggc

SEQ ID NO: 50825 - DNA, 26 bp, Homo sapiens
  chr5:151066474-151066500
  hyper
ctgaaggaccgcgggaatgtggaggg

SEQ ID NO: 50826 - DNA, 147 bp, Homo sapiens; identical to SEQ ID NO: 19003
  chr5:151304224-151304371
  hyper

SEQ ID NO: 50827 - DNA, 238 bp, Homo sapiens; identical to SEQ ID NO: 19004
  chr5:151304401-151304639
  hyper

SEQ ID NO: 50828 - DNA, 33 bp, Homo sapiens; identical to SEQ ID NO: 8118
  chr5:151304708-151304741
  hyper

SEQ ID NO: 50829 - DNA, 126 bp, Homo sapiens; identical to SEQ ID NO: 30014
  chr5:152870193-152870319
  hyper

SEQ ID NO: 50830 - DNA, 239 bp, Homo sapiens
  chr5:153852425-153852664
  hyper
gcttttccagctgtgcggtgggagctggggatgtggcgtgggcgtgggaggccgctggagtcaggcgtggggagagtgggggactatccagtgaccctctcaatgggcgccggctccgtctcggctcccgggttcagggactgcacgtttctgagaccgagtttagggctccaaggctctcttcccaaagagggtttggggccagcaggattgggttttctgaagaggcctggttatgc

SEQ ID NO: 50831 - DNA, 512 bp, Homo sapiens
  chr5:153852792-153853304
  hyper
tcctgggagctgggacctgtgtatagccagaggtttgtgtgtgagcgaagttggagtcctgggttcgaatctagataagcttccctccgtgctgtggggcttagatcacctccctccctgagtctgtttctccatgcgcgccggaatttctaaacggactcccagaaagaaacggaaagaaagaaggtaaagaaaagaaaaacaaaacaacaagaaagaaactttgatttttctctctgctcctccccaagggccctggggcctcgggccgggtactgaggccgaggaaggggtgcgtcggacaggctcattaccgccaagtgttgccctagttaaatcgcgggcctgtttgatctggcggcgggtggcgagagggaaaaaagaaaaaagtaggggggcgagagtagagagagaagctcacacctcccccactgtttcctagcgcccataaaacaccttttattaactccttcgcgtccggaaaggcccgcgtggcctctcggcccctgcta

SEQ ID NO: 50832 - DNA, 34 bp, Homo sapiens; identical to SEQ ID NO: 19008
  chr5:153853386-153853420
  hyper

SEQ ID NO: 50833 - DNA, 41 bp, Homo sapiens; identical to SEQ ID NO: 19009
  chr5:153853478-153853519
  hyper

SEQ ID NO: 50834 - DNA, 147 bp, Homo sapiens
  chr5:153855264-153855411
  hyper
cagtcgccggagcccagagcctggcgttcgccgctgccttcctctcctcccggggcttcaggagtggctggcctggccaggtcctcggcgcgggcctcggctcactggtttaactccagcgcccagacttgctgcggccagccggtg

SEQ ID NO: 50835 - DNA, 88 bp, Homo sapiens
  chr5:153855839-153855927
  hyper
acttccgccagcctcccaacctggtttaaacatcagggcttggatgcaggcttggggccccctaagccggagctgggagcctcagata

SEQ ID NO: 50836 - DNA, 264 bp, Homo sapiens
  chr5:153856396-153856660
  hyper
aaagaagtggctcttatttacatgcaaagccactgaagtcgtcctcagaaccagtccatggggagaaccagaactggccctggactgagtagaagacccgatctgttttacctcacctccaccctggactcctcagataggtgcttttcctgccccgacccactctgggccctcagtttccctatttatacaatgatggaagtagactagccggtccagcaaaggccctttgaaaacaggaaccgagcccgggcacataaattc

SEQ ID NO: 50837 - DNA, 74 bp, Homo sapiens
  chr5:153856862-153856936
  hyper
ctccatgcacaggatcgcacgctgtgaccaaccatctcagaactcttcccaacctttccaaatcggacacagga

SEQ ID NO: 50838 - DNA, 202 bp, Homo sapiens
  chr5:153856996-153857198
  hyper
ggctggagcatgcaagccccaggactcaccagctcccttttccgcttgctctcacggccgccatccgccttcttgagttcagccttgaaggcctcgggatcgccagactgtgcatccttggccagcacgtccatcaggtaggcgatgtagctggtggctaggcgcagagtcttgatcttggagagcttggtgtcggccggca

SEQ ID NO: 50839 - DNA, 95 bp, Homo sapiens
  chr5:153857284-153857379
  hyper
cgccggccaagacggccgccaagcgcctccagccgcccggggctctgcccaggcctggcgtcaggaccataggcggtggcggctgcagcggccgc

SEQ ID NO: 50840 - DNA, 452 bp, Homo sapiens
  chr5:153857429-153857881
  hyper
gcagccagctctggaagtagggcctttcctgatgacagcgcgaggccggaccgaagaggaagggttcgtggagcatggggtgcgcagggtgcgggtggtgatggtggtgatggtgtgcgtagctgcccacgaggttcatgttggagcggctactggcctgcgccgccagccctattaacgccgctccatgcgccccagagactgccgggggccacctgtgggctctggagccactactgggcgccggctttgggagagtccgggcaaggctgaaaatgagacgcgcagcccactgtcttcttaccggtttctgccgcgggcgaggtcgccgaagcccaaagacctgtttaacccttctgcggactcccctgcggatctggcttatataagaccgcggctttgatgtcaacctctcccgggagccaatggcaggggggcggggataaggaaaa

SEQ ID NO: 50841 - DNA, 296 bp, Homo sapiens
  chr5:153858599-153858895
  hyper
agatccactccggcctcccgggtgcctgatccattccgaaggccagcccggctggcgcagagacagtctggcgtccgccttgggcccggggcatctggccagcaggtctcctctggtctgtccgcaggactcgcaccgagacctgggagcgcggctacgtcgggccgctctacccagatcatcactccttaagaatctttggttctttaaagacaccggccccgaagctcacacctcgagacaccagcattcggcgttagacacacgcagaggggaccaagactgcacagcatccg

SEQ ID NO: 50842 - DNA, 22 bp, Homo sapiens
  chr5:153858916-153858938
  hyper
cgacgtccggcatctctcacgc

SEQ ID NO: 50843 - DNA, 290 bp, Homo sapiens
  chr5:153859386-153859676
  hyper
tgaacagatatggaacgtgaagcccagagaagaagagcgattttctcgaggtccggtagggagtggatgagtggaattccactcctggacaagagagtgaatgaagggtggggggttacatacaggagtgacggagacaaaagcctgggcctgctggttccacctgtgggagctcagcagggctgtgggccctggaggtgcatgggggggtggtgcagggaggtcctggtttcctgcccgaggcgggctggaaaccccccgctctccccggcgcctggcgccagcagcgc

SEQ ID NO: 50844 - DNA, 6 bp, Homo sapiens
  chr5:153859708-153859714
  hyper
gcgggg

SEQ ID NO: 50845 - DNA, 44 bp, Homo sapiens; identical to SEQ ID NO: 30027
  chr5:153863373-153863417
  hyper

SEQ ID NO: 50846 - DNA, 3 bp, Homo sapiens
  chr5:153863418-153863421
  hyper
ttc

SEQ ID NO: 50847 - DNA, 30 bp, Homo sapiens; identical to SEQ ID NO: 30029
  chr5:153863972-153864002
  hyper

SEQ ID NO: 50848 - DNA, 304 bp, Homo sapiens; identical to SEQ ID NO: 30030
  chr5:153990970-153991274
  hyper

SEQ ID NO: 50849 - DNA, 406 bp, Homo sapiens; identical to SEQ ID NO: 19018
  chr5:155107388-155107794
  hyper

SEQ ID NO: 50850 - DNA, 31 bp, Homo sapiens
  chr5:155107848-155107879
  hyper
tgccgctgccggagcccgaacccaagcccca

SEQ ID NO: 50851 - DNA, 207 bp, Homo sapiens
  chr5:155108526-155108733
  hyper
gcgggatagcgtttatacccaggggtgagtaggccgctaatggaggccccctttacccccagctagcggcttgcatggacggcaaagagacgggagaaagttgggtctccttgcgcttaatctggcattggcagaggaatgcaacactgtttcctccaactcgattgccgcgggggtttccccagttccctccatctctaagccaag

SEQ ID NO: 50852 - DNA, 86 bp, Homo sapiens; identical to SEQ ID NO: 19019
  chr5:155108763-155108849
  hyper

SEQ ID NO: 50853 - DNA, 255 bp, Homo sapiens; identical to SEQ ID NO: 30034
  chr5:155109192-155109447
  hyper

SEQ ID NO: 50854 - DNA, 455 bp, Homo sapiens; identical to SEQ ID NO: 30035
  chr5:156887049-156887504
  hyper

SEQ ID NO: 50855 - DNA, 15 bp, Homo sapiens
  chr5:157001843-157001858
  hyper
cgcttcacagaaggg

SEQ ID NO: 50856 - DNA, 30 bp, Homo sapiens; identical to SEQ ID NO: 30037
  chr5:157002174-157002204
  hyper

SEQ ID NO: 50857 - DNA, 332 bp, Homo sapiens; identical to SEQ ID NO: 30038
  chr5:157002447-157002779
  hyper

SEQ ID NO: 50858 - DNA, 91 bp, Homo sapiens
  chr5:157098271-157098362
  hyper
gccccgccagcaggccggggtcactgcagtccccacgtcgaagcggaaaaggtctgctcagctcaccgcaccccacttcttccagacccgt

SEQ ID NO: 50859 - DNA, 91 bp, Homo sapiens
  chr5:157098619-157098710
  hyper
gcaatgacacagccgactaggccctcggtcacctgtgaccagggatcctccacgatcggcgggaccgccgcccaggcgaccaccagttcca

SEQ ID NO: 50860 - DNA, 25 bp, Homo sapiens
  chr5:158478441-158478466
  hyper
cccacccccccaccccgccgcccgg

SEQ ID NO: 50861 - DNA, 51 bp, Homo sapiens
  chr5:158478764-158478815
  hyper
agccgatcccgctttgcagttgtgcacaatcacaatcgcagccagcagttt

SEQ ID NO: 50862 - DNA, 6 bp, Homo sapiens
  chr5:158524686-158524692
  hyper
atgtgg

SEQ ID NO: 50863 - DNA, 289 bp, Homo sapiens; identical to SEQ ID NO: 30043
  chr5:158526129-158526418
  hyper

SEQ ID NO: 50864 - DNA, 32 bp, Homo sapiens
  chr5:158527411-158527443
  hyper
ataacgtcatctttccgcccaccgcagccaat

SEQ ID NO: 50865 - DNA, 45 bp, Homo sapiens
  chr5:158528069-158528114
  hyper
tgccagggttgggcactgttctcactcacacgctcacctctctcg

SEQ ID NO: 50866 - DNA, 155 bp, Homo sapiens; identical to SEQ ID NO: 30046
  chr5:158533542-158533697
  hyper

SEQ ID NO: 50867 - DNA, 96 bp, Homo sapiens; identical to SEQ ID NO: 30047
  chr5:159200128-159200224
  hyper

SEQ ID NO: 50868 - DNA, 145 bp, Homo sapiens; identical to SEQ ID NO: 30048
  chr5:159343442-159343587
  hyper

SEQ ID NO: 50869 - DNA, 23 bp, Homo sapiens
  chr5:159399072-159399095
  hyper
tcgcctgggcggctgcgcctaca

SEQ ID NO: 50870 - DNA, 188 bp, Homo sapiens; identical to SEQ ID NO: 30050
  chr5:159399509-159399697
  hyper

SEQ ID NO: 50871 - DNA, 86 bp, Homo sapiens; identical to SEQ ID NO: 30051
  chr5:159615222-159615308
  hyper

SEQ ID NO: 50872 - DNA, 30 bp, Homo sapiens; identical to SEQ ID NO: 30052
  chr5:159738710-159738740
  hyper

SEQ ID NO: 50873 - DNA, 30 bp, Homo sapiens; identical to SEQ ID NO: 30053
  chr5:159739156-159739186
  hyper

SEQ ID NO: 50874 - DNA, 61 bp, Homo sapiens; identical to SEQ ID NO: 30054
  chr5:159739813-159739874
  hyper

SEQ ID NO: 50875 - DNA, 336 bp, Homo sapiens; identical to SEQ ID NO: 30055
  chr5:160973454-160973790
  hyper

SEQ ID NO: 50876 - DNA, 249 bp, Homo sapiens; identical to SEQ ID NO: 30056
  chr5:160974612-160974861
  hyper

SEQ ID NO: 50877 - DNA, 257 bp, Homo sapiens; identical to SEQ ID NO: 30057
  chr5:160975090-160975347
  hyper

SEQ ID NO: 50878 - DNA, 100 bp, Homo sapiens; identical to SEQ ID NO: 8154
  chr5:160975348-160975448
  hyper

SEQ ID NO: 50879 - DNA, 180 bp, Homo sapiens; identical to SEQ ID NO: 19035
  chr5:160975754-160975934
  hyper

SEQ ID NO: 50880 - DNA, 15 bp, Homo sapiens
  chr5:160975955-160975970
  hyper
cggaagtagctccac

SEQ ID NO: 50881 - DNA, 30 bp, Homo sapiens; identical to SEQ ID NO: 8157
  chr5:161274605-161274635
  hyper

SEQ ID NO: 50882 - DNA, 110 bp, Homo sapiens; identical to SEQ ID NO: 30062
  chr5:161275376-161275486
  hyper

SEQ ID NO: 50883 - DNA, 55 bp, Homo sapiens; identical to SEQ ID NO: 30063
  chr5:161275816-161275871
  hyper

SEQ ID NO: 50884 - DNA, 30 bp, Homo sapiens; identical to SEQ ID NO: 30064
  chr5:161495166-161495196
  hyper

SEQ ID NO: 50885 - DNA, 69 bp, Homo sapiens; identical to SEQ ID NO: 30065
  chr5:162931214-162931283
  hyper

SEQ ID NO: 50886 - DNA, 191 bp, Homo sapiens; identical to SEQ ID NO: 30066
  chr5:162931522-162931713
  hyper

SEQ ID NO: 50887 - DNA, 100 bp, Homo sapiens; identical to SEQ ID NO: 30067
  chr5:166405747-166405847
  hyper

SEQ ID NO: 50888 - DNA, 42 bp, Homo sapiens; identical to SEQ ID NO: 30068
  chr5:166406152-166406194
  hyper

SEQ ID NO: 50889 - DNA, 222 bp, Homo sapiens; identical to SEQ ID NO: 30069
  chr5:166406254-166406476
  hyper

SEQ ID NO: 50890 - DNA, 50 bp, Homo sapiens; identical to SEQ ID NO: 30070
  chr5:167001021-167001071
  hyper

SEQ ID NO: 50891 - DNA, 87 bp, Homo sapiens; identical to SEQ ID NO: 19042
  chr5:167956090-167956177
  hyper

SEQ ID NO: 50892 - DNA, 129 bp, Homo sapiens; identical to SEQ ID NO: 30073
  chr5:167956694-167956823
  hyper

SEQ ID NO: 50893 - DNA, 136 bp, Homo sapiens; identical to SEQ ID NO: 30074
  chr5:167956844-167956980
  hyper

SEQ ID NO: 50894 - DNA, 448 bp, Homo sapiens
  chr5:168727476-168727924
  hyper
caggtgggtggcccgcgtggggtggggcaggggtactcacaggcgctcagcgttgcgggggatgccccgaggaaccgcgcggaggcccagcccgtggcagtccacgctggcagcggagcaggtacacttggtggggcaggcgacggctggaggcccactcaggacgctcgccagcgccaaggccagcgccaggcgggcgcgcacggcggcgccgacccctgcccacccgggggccatggtgtgcagggccccgctcctggaggaggctgcctctgcggggcaagacgcgtggagcccgaggaggcgcgcggggagcgcgggcggcctggggagcgggcggcggagttagcgcggaggaggggcgagctcggtgctcaggcgcacggggcgcgggcggagcggggcgctccgggcggcggcggcggcagcaacagcagctccatcggcg

SEQ ID NO: 50895 - DNA, 82 bp, Homo sapiens; identical to SEQ ID NO: 8166
  chr5:168727994-168728076
  hyper

SEQ ID NO: 50896 - DNA, 276 bp, Homo sapiens; identical to SEQ ID NO: 30077
  chr5:168728077-168728353
  hyper

SEQ ID NO: 50897 - DNA, 30 bp, Homo sapiens; identical to SEQ ID NO: 30078
  chr5:168728570-168728600
  hyper

SEQ ID NO: 50898 - DNA, 305 bp, Homo sapiens
  chr5:169064022-169064327
  hyper
gcggtggtggtctggcgagccccaggtggggactggcctctgctccctcgcctggggaggagacaaagtgggagtggtccccaagttttgcgtgaagtggggtggggtggcgtgtcttagcctacggggcaccagccttctagtgtgcccctgcccaacgggagggaggagggagcggggagccccggcgagggaggagagggcgggccctgagaggagtttgaaaagaggaaggaagtggggccctgcggcgcccagccaccccctgacggcttccccacgggaggacgcgaggccccggccca

SEQ ID NO: 50899 - DNA, 30 bp, Homo sapiens; identical to SEQ ID NO: 30081
  chr5:169930863-169930893
  hyper

SEQ ID NO: 50900 - DNA, 104 bp, Homo sapiens; identical to SEQ ID NO: 30082
  chr5:169931223-169931327
  hyper

SEQ ID NO: 50901 - DNA, 131 bp, Homo sapiens; identical to SEQ ID NO: 30083
  chr5:169931353-169931484
  hyper

SEQ ID NO: 50902 - DNA, 328 bp, Homo sapiens
  chr5:170107959-170108287
  hyper
tggtggaaaataaaccgtgcactttagaacagcaggaagggaggcttggaagcctggttttctggctttgaatgaccgcctagcgcttgccggtgcgccagggtgctgtgaggatgtgggcagagggcgagtccgaagggctccagacactgggaatagtggtggtcgtgtgctcctccctgaaacttttgcactacctcggactgattgacttgtcagacggtaagcgaaccctggagcttccccgttttctgtgaatgtgtttttgtggcttcggttgctgtgacagtcgtttcgaaaatgcacggaaatgagggcggagacccga

SEQ ID NO: 50903 - DNA, 70 bp, Homo sapiens
  chr5:170108372-170108442
  hyper
tgaaatgtggtgcgcctggggagtgcgggagccaggaagttagggtctcctgctccggccctatgagcat

SEQ ID NO: 50904 - DNA, 42 bp, Homo sapiens
  chr5:170735112-170735154
  hyper
aacgattttagaattcgctggaagaaaatgattccgcttgtc

SEQ ID NO: 50905 - DNA, 115 bp, Homo sapiens
  chr5:170735206-170735321
  hyper
tgccctgggccgggtagacagtcactgaggcgcgagcagaacggggagtggttccagcgcccaaagtggactggagccgggaagggctcaccagtcgcgtttcccaaagaaatcc

SEQ ID NO: 50906 - DNA, 219 bp, Homo sapiens
  chr5:170737479-170737698
  hyper
ttaaggctatccactacccccgcccccctctgcctcccccaaacacacccccaccccgccttcgcagattgtacctcttcctttcacccttctcgctggcctgtgcttctctctccatcgtggtctcccacgccttggtttctcctccatccccatccccatctttcgtgagcccctccaactctctccccgtgttttgtacggtctcctgcgttcact

SEQ ID NO: 50907 - DNA, 342 bp, Homo sapiens; identical to SEQ ID NO: 19055
  chr5:170739481-170739823
  hyper

SEQ ID NO: 50908 - DNA, 6 bp, Homo sapiens
  chr5:170740455-170740461
  hyper
aaggca

SEQ ID NO: 50909 - DNA, 86 bp, Homo sapiens
  chr5:170745303-170745389
  hyper
gttgagctcaggggccgatggtgattatccagcatgcgaagctgccttgcatttgcatccactgttcaggtgctacagctggggca

SEQ ID NO: 50910 - DNA, 102 bp, Homo sapiens; identical to SEQ ID NO: 30103
  chr5:172386993-172387095
  hyper

SEQ ID NO: 50911 - DNA, 54 bp, Homo sapiens
  chr5:172655825-172655879
  hyper
caaggctgttgcctgcggcgtagaagcgctgggcctgagctcggaatgcttccc

SEQ ID NO: 50912 - DNA, 346 bp, Homo sapiens
  chr5:172656215-172656561
  hyper
taatttttttccctttcttttttaaataaacctaccttccttcccccattttttccttttaatatcgctgtttatctccattttttttaactgcggcgtgttcttgttcgattttaaaaaatactaaaaataaaatgagtcccctaggtgcctccctggcgccctaggcatggagagctcatgcctgcgccaccctcatctccgctggctttgccacctcggaggcgccccacacttctcctttgttttgcttttctctgagccggttgagttttcttaccctgaatgcgtcgtttatacaattagcaactgaacacagaacaaatatcaccgatataattggggt

SEQ ID NO: 50913 - DNA, 200 bp, Homo sapiens
  chr5:172659655-172659855
  hyper
gacgccgaagttcacgaagttgttgttggcggcggcagtggccggctgcgctggggaaggcccggcggggtaagcggcagtgcagctgtagccagggctgcaggccgcgccgccgtaacccggataggcggggtaggcgttataaccgtagggattgaggcccacgccgtaggcaggcgcgtagggcgccgagtccccta

SEQ ID NO: 50914 - DNA, 36 bp, Homo sapiens
  chr5:172660218-172660254
  hyper
gggaacagagaggcagagagacgcttggtaagagcg

SEQ ID NO: 50915 - DNA, 643 bp, Homo sapiens
  chr5:172661684-172662327
  hyper
tggccctgagtttcttggggacgaaagcgacccaggaggggagaagggggcctgtgtttcctcctcacctttcttttcggctctagggtccttggctgggtcggggtcgctgtaggcacgtggatagaaggcgggggcggcgggaaaggcagacgcacacttggccggtgaaggcgcgcggcccagctctgcgcgcagctctgggaggcccggcgcagccgcctcgggcccagcgtaggcctctggcttgaaggcggccagcatgcaggaggagggcgccagggtcgcctccaggcgggcagagagctctccggcggcagccaggctgcgctgctgctgttccaggtttaggatgtctttgactgagaagggcgtgggcgtgagagcagggctggggaacatggtggcagcgccagtctcacagcgccaggtgggcggcagaaagcggcgctgcccacggcccctggcagcttccctgcatggtgccgccgcccgcccgcgcacccgtcggccagctctggatgtgtccgggcagcaggtagcgctgagcacaaggggcaggagaggcgggaccaggccagaggagggggactcagcctgccattgggccaggggcctcgatgacaggagcgatgagcagttt

SEQ ID NO: 50916 - DNA, 16 bp, Homo sapiens
  chr5:172664210-172664226
  hyper
caaattctccttggac

SEQ ID NO: 50917 - DNA, 110 bp, Homo sapiens
  chr5:172664487-172664597
  hyper
ctgctggccaggcggctcgcgatgacagtttgaaagattagtgtgagcggacgcctgaaatattaccgtttaatgggggacatcgaggctacatccgggatccctgtttt

SEQ ID NO: 50918 - DNA, 142 bp, Homo sapiens
  chr5:172665448-172665590
  hyper
ggaatgtcattaatgcgctggggagacgtccattggagacaggcggcgttatccgcggctttatcttcaacaacgcctcgctctcggcccgcgcgggggaaacagatgggagtttctgtctgggacgctcgccccatgttta

SEQ ID NO: 50919 - DNA, 53 bp, Homo sapiens
  chr5:172665812-172665865
  hyper
cctccgcctccgcctccgcgctgggcccctccgccgcccggcttccttcctgg

SEQ ID NO: 50920 - DNA, 162 bp, Homo sapiens
  chr5:172670821-172670983
  hyper
gtttgcctcggattccgaggatccgagggagtcgctttcagacttccggtgtcctttcgcgttaatttcgtcctcttttcttctctgggctggggctggtggctgccacatcccaccccttctgccccgacggctgcaaaccgcttcagccaaaacgggcgg

SEQ ID NO: 50921 - DNA, 80 bp, Homo sapiens
  chr5:172671018-172671098
  hyper
ctcggagtcccgtcgctggaggtcacagctgggaaaatcaggtgacattcgagtcagatggacaacgactcagatacagt

SEQ ID NO: 50922 - DNA, 146 bp, Homo sapiens; identical to SEQ ID NO: 30115
  chr5:172672747-172672893
  hyper

SEQ ID NO: 50923 - DNA, 97 bp, Homo sapiens; identical to SEQ ID NO: 30116
  chr5:172672960-172673057
  hyper

SEQ ID NO: 50924 - DNA, 109 bp, Homo sapiens; identical to SEQ ID NO: 30117
  chr5:172710849-172710958
  hyper

SEQ ID NO: 50925 - DNA, 234 bp, Homo sapiens
  chr5:172754355-172754589
  hyper
tgctttgcagcttgccggtgagccaagagccggtagagcagaggaggcgcacggttcgggtcgtgtcaccatttcttggcttgctgacctggccaggagctggggatggcggcagcaccgcggaggtacgctttgcgctgccctcacgctcccttccgaaagcagtgcccccagggggaaagttcgcaatgccatttgtctcgccggcaaagttctgggatgtcgggcatcttt

SEQ ID NO: 50926 - DNA, 211 bp, Homo sapiens; identical to SEQ ID NO: 19067
  chr5:172754621-172754832
  hyper

SEQ ID NO: 50927 - DNA, 62 bp, Homo sapiens; identical to SEQ ID NO: 30119
  chr5:172755316-172755378
  hyper

SEQ ID NO: 50928 - DNA, 50 bp, Homo sapiens
  chr5:172755420-172755470
  hyper
cggcaatggcagggatggtgcctcaaatatccctggaagctctggtgtca

SEQ ID NO: 50929 - DNA, 671 bp, Homo sapiens; identical to SEQ ID NO: 19068
  chr5:172756377-172757048
  hyper

SEQ ID NO: 50930 - DNA, 111 bp, Homo sapiens
  chr5:172757111-172757222
  hyper
gagggggtggggagggcgtcttcagagtgggcttcccctgcgctggagcgccagggagcatccataaattgtcactttgaaggtccgaacctgcggcggtagggaccatgc

SEQ ID NO: 50931 - DNA, 400 bp, Homo sapiens; identical to SEQ ID NO: 30123
  chr5:173738828-173739228
  hyper

SEQ ID NO: 50932 - DNA, 55 bp, Homo sapiens; identical to SEQ ID NO: 8210
  chr5:174119987-174120042
  hyper

SEQ ID NO: 50933 - DNA, 103 bp, Homo sapiens
  chr5:174147420-174147523
  hyper
cctctcccctctctgcgcctggacgacttcatctgtggaatggggagaaagctcaggctttagggggccttcagtaatctgcatcgtgcttttggcaaaagct

SEQ ID NO: 50934 - DNA, 23 bp, Homo sapiens
  chr5:174150445-174150468
  hyper
tcgaagctcgctctccccttccc

SEQ ID NO: 50935 - DNA, 72 bp, Homo sapiens; identical to SEQ ID NO: 30128
  chr5:174151125-174151197
  hyper

SEQ ID NO: 50936 - DNA, 306 bp, Homo sapiens; identical to SEQ ID NO: 30129
  chr5:174151463-174151769
  hyper

SEQ ID NO: 50937 - DNA, 5 bp, Homo sapiens
  chr5:174159588-174159593
  hyper
tcagg

SEQ ID NO: 50938 - DNA, 30 bp, Homo sapiens; identical to SEQ ID NO: 30131
  chr5:174162217-174162247
  hyper

SEQ ID NO: 50939 - DNA, 37 bp, Homo sapiens; identical to SEQ ID NO: 8213
  chr5:174162509-174162546
  hyper

SEQ ID NO: 50940 - DNA, 86 bp, Homo sapiens; identical to SEQ ID NO: 30133
  chr5:174162770-174162856
  hyper

SEQ ID NO: 50941 - DNA, 41 bp, Homo sapiens; identical to SEQ ID NO: 30134
  chr5:174178168-174178209
  hyper

SEQ ID NO: 50942 - DNA, 126 bp, Homo sapiens; identical to SEQ ID NO: 30135
  chr5:174178667-174178793
  hyper

SEQ ID NO: 50943 - DNA, 86 bp, Homo sapiens; identical to SEQ ID NO: 30136
  chr5:174220856-174220942
  hyper

SEQ ID NO: 50944 - DNA, 39 bp, Homo sapiens
  chr5:174870699-174870738
  hyper
accttgccttggggtcgtctctctcaaagcccctggagc

SEQ ID NO: 50945 - DNA, 388 bp, Homo sapiens; identical to SEQ ID NO: 19074
  chr5:174870786-174871174
  hyper

SEQ ID NO: 50946 - DNA, 381 bp, Homo sapiens; identical to SEQ ID NO: 19075
  chr5:174871497-174871878
  hyper

SEQ ID NO: 50947 - DNA, 97 bp, Homo sapiens
  chr5:175085050-175085147
  hyper
aggccgtgcgcgcgccgcccgctgcatccctgcccggagcgcagccggcgcgggcgcgggaccgaggcgaaccgggtgcggagccaatacccgcggc

SEQ ID NO: 50948 - DNA, 106 bp, Homo sapiens; identical to SEQ ID NO: 19077
  chr5:175085209-175085315
  hyper

SEQ ID NO: 50949 - DNA, 25 bp, Homo sapiens
  chr5:175085719-175085744
  hyper
gaccgatgaccggagccacaacagg

SEQ ID NO: 50950 - DNA, 30 bp, Homo sapiens; identical to SEQ ID NO: 30140
  chr5:175223481-175223511
  hyper

SEQ ID NO: 50951 - DNA, 70 bp, Homo sapiens; identical to SEQ ID NO: 30141
  chr5:175223880-175223950
  hyper

SEQ ID NO: 50952 - DNA, 321 bp, Homo sapiens; identical to SEQ ID NO: 30142
  chr5:175224441-175224762
  hyper

SEQ ID NO: 50953 - DNA, 40 bp, Homo sapiens; identical to SEQ ID NO: 8222
  chr5:175298910-175298950
  hyper

SEQ ID NO: 50954 - DNA, 138 bp, Homo sapiens
  chr5:175299156-175299294
  hyper
cccggaggagggagtcgcccccaggggtacagtgcgcactcccggagtgagtcagagggcggcggcaggggggcggacagaccgcaggtggaggggaggagaacgtagacattgacaggggatgggggaccaagggga

SEQ ID NO: 50955 - DNA, 550 bp, Homo sapiens; identical to SEQ ID NO: 30146
  chr5:175299591-175300141
  hyper

SEQ ID NO: 50956 - DNA, 29 bp, Homo sapiens
  chr5:175300142-175300171
  hyper
cagggatagaccaaggcttcccgcagaat

SEQ ID NO: 50957 - DNA, 135 bp, Homo sapiens; identical to SEQ ID NO: 19083
  chr5:175300216-175300351
  hyper

SEQ ID NO: 50958 - DNA, 31 bp, Homo sapiens; identical to SEQ ID NO: 19084
  chr5:175300381-175300412
  hyper

SEQ ID NO: 50959 - DNA, 54 bp, Homo sapiens; identical to SEQ ID NO: 30149
  chr5:175488184-175488238
  hyper

SEQ ID NO: 50960 - DNA, 308 bp, Homo sapiens; identical to SEQ ID NO: 30150
  chr5:175560514-175560822
  hyper

SEQ ID NO: 50961 - DNA, 48 bp, Homo sapiens
  chr5:175621342-175621390
  hyper
gccggcgcctgctcccgcagacctgccatgccaatgctctccaagctg

SEQ ID NO: 50962 - DNA, 4 bp, Homo sapiens
  chr5:175621501-175621505
  hyper
agcc

SEQ ID NO: 50963 - DNA, 83 bp, Homo sapiens; identical to SEQ ID NO: 30152
  chr5:175626566-175626649
  hyper

SEQ ID NO: 50964 - DNA, 108 bp, Homo sapiens; identical to SEQ ID NO: 30153
  chr5:175792208-175792316
  hyper

SEQ ID NO: 50965 - DNA, 325 bp, Homo sapiens
  chr5:175792540-175792865
  hyper
cgcacctgcgtccctcgcccggcccgatggcgccgcggccgctgggccccttggtgctggcgctgggcggcgccgcggcggtgctgggctcggtgctcttcatcctctggaagacctacttcggccgcggccgagagcggcgctgggaccggggagaggcctggtggggcgcggaggctgcccgcctccccgagtgggacgagtgggacgtgagtgccgggccgaggcctgcggaagggcgggcaggctgggctgcgactccgcgcatgtggccaaggggtgtgaccacggaacggccctgctggtgccgggagcttggggggtc

SEQ ID NO: 50966 - DNA, 155 bp, Homo sapiens
  chr5:175793063-175793218
  hyper
tcggctcgcgcccctccggcgcctgcgcagtgcaccccgcccgggggtggggatgtcgggagaaaccccatcccctcccgcctgcggtcgggactccgagaccggtggaggaagcggggcgcgcgagcgtttaaggaattcgccaagggtttgga

SEQ ID NO: 50967 - DNA, 71 bp, Homo sapiens; identical to SEQ ID NO: 30157
  chr5:176038550-176038621
  hyper

SEQ ID NO: 50968 - DNA, 74 bp, Homo sapiens
  chr5:176046289-176046363
  hyper
gcctcggtgcaagcgcggagagagggcctctgcggcaagagggcaggggcggggcctcgcgcagggactgccta

SEQ ID NO: 50969 - DNA, 48 bp, Homo sapiens
  chr5:176046554-176046602
  hyper
cggcgccttcgtgggggtgggagggtggagcaccggaggccagggctc

SEQ ID NO: 50970 - DNA, 659 bp, Homo sapiens; identical to SEQ ID NO: 30159
  chr5:176056505-176057164
  hyper

SEQ ID NO: 50971 - DNA, 141 bp, Homo sapiens; identical to SEQ ID NO: 30160
  chr5:176057373-176057514
  hyper

SEQ ID NO: 50972 - DNA, 30 bp, Homo sapiens; identical to SEQ ID NO: 30161
  chr5:176057751-176057781
  hyper

SEQ ID NO: 50973 - DNA, 194 bp, Homo sapiens
  chr5:176107080-176107274
  hyper
gccttagcgcctccccgcagctcagaggatgggactggggtccagctccctgcccgccccgcaccccgtaccccgcagcctgtccgtccatccgccccgcttcacttcgctgtcccctgtcggggttcgagtcgcagcctccagcctcaacccgcacctcccgccctgcagctcaactctcgcctccgctgcaa

SEQ ID NO: 50974 - DNA, 30 bp, Homo sapiens; identical to SEQ ID NO: 30164
  chr5:176170309-176170339
  hyper

SEQ ID NO: 50975 - DNA, 100 bp, Homo sapiens
  chr5:176236898-176236998
  hyper
ccagcctgcgaggctgggactgcgggtgtccccgagtctggcctgccagctctggtggccagggcacctctgcgcgcgggccagggccccggggctctcc

SEQ ID NO: 50976 - DNA, 17 bp, Homo sapiens
  chr5:176237148-176237165
  hyper
cgcgccggggtcgccgc

SEQ ID NO: 50977 - DNA, 95 bp, Homo sapiens; identical to SEQ ID NO: 2711
  chr5:177411327-177411422
  hyper

SEQ ID NO: 50978 - DNA, 131 bp, Homo sapiens
  chr5:177411507-177411638
  hyper
cgcggagatgggccagagtccggccatccagaagtgcctggagcgcacagcaaggccctgccctcggctccgtgaaggtgagggggtaaagtcggcccggagtccccgggggtgcaggaggggccccgcgg

SEQ ID NO: 50979 - DNA, 68 bp, Homo sapiens
  chr5:177412141-177412209
  hyper
atcgtaaacggggcaacttccaactctgccagttttaagcttctagagtatctcctcggcggagcgcg

SEQ ID NO: 50980 - DNA, 90 bp, Homo sapiens; identical to SEQ ID NO: 30170
  chr5:177412560-177412650
  hyper

SEQ ID NO: 50981 - DNA, 30 bp, Homo sapiens; identical to SEQ ID NO: 30171
  chr5:177666777-177666807
  hyper

SEQ ID NO: 50982 - DNA, 38 bp, Homo sapiens
  chr5:178004287-178004325
  hyper
cgtctcccctcttctcgggacaccagccctgttggatc

SEQ ID NO: 50983 - DNA, 49 bp, Homo sapiens
  chr5:178017867-178017916
  hyper
agaggcagggtcgagattgcgccaaacagaaatacgccccttagaatct

SEQ ID NO: 50984 - DNA, 43 bp, Homo sapiens; identical to SEQ ID NO: 30176
  chr5:178422264-178422307
  hyper

SEQ ID NO: 50985 - DNA, 217 bp, Homo sapiens; identical to SEQ ID NO: 30177
  chr5:178450901-178451118
  hyper

SEQ ID NO: 50986 - DNA, 346 bp, Homo sapiens
  chr5:178487398-178487744
  hyper
cggggacagctcgcggcctttcgggggttctcctggcttgggccatccaggcttggctaggattgccggcctggggttgaggcgctcgcagtggtctcttccgggccggggtggatccgggcctctccagcgagtgggcggcgtgcagcctcgtctgggcttctgggaccagccctacgcggctcgggccccttggccactgggtcccggggcgccgtccgcgagcggcctggactgccggagacccgcgggagggagcgcctcgccaggtgagctgggtgcgccgggccgctggggtggggatgccagccttttgtcgttgttcattctgcgattttcttctgtg

SEQ ID NO: 50987 - DNA, 338 bp, Homo sapiens; identical to SEQ ID NO: 30180
  chr5:178594123-178594461
  hyper

SEQ ID NO: 50988 - DNA, 145 bp, Homo sapiens; identical to SEQ ID NO: 30181
  chr5:178770760-178770905
  hyper

SEQ ID NO: 50989 - DNA, 116 bp, Homo sapiens; identical to SEQ ID NO: 19103
  chr5:178771198-178771314
  hyper

SEQ ID NO: 50990 - DNA, 15 bp, Homo sapiens
  chr5:178771967-178771982
  hyper
cgccagtgctccgag

SEQ ID NO: 50991 - DNA, 21 bp, Homo sapiens
  chr5:178772184-178772205
  hyper
acctacctggggggtcggcgg

SEQ ID NO: 50992 - DNA, 331 bp, Homo sapiens; identical to SEQ ID NO: 19106
  chr5:178772272-178772603
  hyper

SEQ ID NO: 50993 - DNA, 58 bp, Homo sapiens; identical to SEQ ID NO: 2722
  chr5:178772778-178772836
  hyper

SEQ ID NO: 50994 - DNA, 40 bp, Homo sapiens
  chr5:178957597-178957637
  hyper
cgagggtgatctgagatccaaagtcaggagtcttctgcat

SEQ ID NO: 50995 - DNA, 2 bp, Homo sapiens
  chr5:178957944-178957946
  hyper
ac

SEQ ID NO: 50996 - DNA, 31 bp, Homo sapiens; identical to SEQ ID NO: 30189
  chr5:179243847-179243878
  hyper

SEQ ID NO: 50997 - DNA, 22 bp, Homo sapiens
  chr5:179244320-179244342
  hyper
gggcgttcgtcctccatccctc

SEQ ID NO: 50998 - DNA, 34 bp, Homo sapiens; identical to SEQ ID NO: 30191
  chr5:179498329-179498363
  hyper

SEQ ID NO: 50999 - DNA, 30 bp, Homo sapiens; identical to SEQ ID NO: 30192
  chr5:179498867-179498897
  hyper

SEQ ID NO: 51000 - DNA, 55 bp, Homo sapiens; identical to SEQ ID NO: 30193
  chr5:179635756-179635811
  hyper

SEQ ID NO: 51001 - DNA, 39 bp, Homo sapiens; identical to SEQ ID NO: 30194
  chr5:179636267-179636306
  hyper

SEQ ID NO: 51002 - DNA, 135 bp, Homo sapiens; identical to SEQ ID NO: 8263
  chr5:179779648-179779783
  hyper

SEQ ID NO: 51003 - DNA, 173 bp, Homo sapiens; identical to SEQ ID NO: 8264
  chr5:179779840-179780013
  hyper

SEQ ID NO: 51004 - DNA, 69 bp, Homo sapiens; identical to SEQ ID NO: 19112
  chr5:179780035-179780104
  hyper

SEQ ID NO: 51005 - DNA, 562 bp, Homo sapiens
  chr5:179780144-179780706
  hyper
agaggctgcggcgccgggacccgcggacggcgtggaggaggcggctcgggcgggcgcggcactcaccgcacatcgtggctgcttctcgggctccttcgcggctcgagggggtctgcccgttcggacgctggggctcctccgtgggctcctccgtgggctccgtgggctccgtgggctccgcgggctccagctcccgtccgctcggcctccagcccttataacccggagccctccgagagggcggggaagggggcggggaaggggcggggcttcccccgcccgcctgctcccattggcccccggttgtcgtgacaacgacgggacccggcccccaggagccagggaggggggccgaggggcggctcccaggcgcgggtcgggcgtgtaaggctggggcgccgggcgccagatcccggagcggggcttagggcaaccaacggcccgagttcagaccccgactcaaccagagtaggcgtggaagccgggcagggcccgatcgcgctgtgcctccgctttcccgtctgtgaaacggggctacccagggaagctccctcccacgggg

SEQ ID NO: 51006 - DNA, 307 bp, Homo sapiens
  chr5:179780985-179781292
  hyper
ccgcggagcccgagcttgaaggcgagggttccgcaggttgtgaacgaagctggaggcgccccaggaagccccgaccccacccgcgccgagctgccccctccccagatctgcctcgcgctgcaggcccgcgagggacccgggggttcctacgcctggggtcggaatccgaccccccagtgaggcaccaaggcccgcgtttctccgccctggttcccggccgtccctcccgttccccctgcactctgggcccctcgtctcccgaggaaggtcacgagaaccggcccaacgtttgcgcactttgaagttt

SEQ ID NO: 51007 - DNA, 410 bp, Homo sapiens
  chr5:180017198-180017608
  hyper
ttgtcctcaggtgtagatgctccagtctcggctcagccaaacactgtcagggccccctggaaagcagaagccgagcttgagtgcccccagccctgccaccaagaactcaggcgggggcgcggcagcggccggctctgtggggagcgggagcggggcggttccgctggcgtctccgggggacgcgcacccgcgcggggccatctccgccttccccgcccctgcagctcggatgcgccccacccagttcccacccggagacccgggcttctcccagggacagggcttggaggggcaggacgggaaacagccctgacgtagggccgggacacctctggtgcagttttgaggctggccgggaagggatgcccgcgcaggaagggcacccggggtgcccactttaccagcagggc

SEQ ID NO: 51008 - DNA, 199 bp, Homo sapiens; identical to SEQ ID NO: 19118
  chr5:180017933-180018132
  hyper

SEQ ID NO: 51009 - DNA, 181 bp, Homo sapiens
  chr5:180018498-180018679
  hyper
tgcccgggcaaggccacgaggcttcttatacccggtcctcgcccctccagcgccggcctcgcccgcgctcctgagaaagccctgcccgctccgctcacggccgtgccctggccaacttcctgctgcggccggcgggccctgggaagcccgtgcccccttccctgcccgggcctcgaggact

SEQ ID NO: 51010 - DNA, 55 bp, Homo sapiens
  chr5:180075791-180075846
  hyper
tcctcagctggccttcgaggcccctgtcccctcaaatccggggacccctggcctt

SEQ ID NO: 51011 - DNA, 141 bp, Homo sapiens; identical to SEQ ID NO: 19121
  chr5:180076317-180076458
  hyper

SEQ ID NO: 51012 - DNA, 35 bp, Homo sapiens; identical to SEQ ID NO: 19122
  chr5:180076532-180076567
  hyper

SEQ ID NO: 51013 - DNA, 202 bp, Homo sapiens; identical to SEQ ID NO: 19123
  chr5:180076602-180076804
  hyper

SEQ ID NO: 51014 - DNA, 88 bp, Homo sapiens
  chr5:180076996-180077084
  hyper
agacccagtctcaaaaataaacaagcaaataaataaaataatacgccgagcttggttgtgcgcgcctgtaatcccagcttctcggggg

SEQ ID NO: 51015 - DNA, 258 bp, Homo sapiens; identical to SEQ ID NO: 30205
  chr5:180100616-180100874
  hyper

SEQ ID NO: 51016 - DNA, 193 bp, Homo sapiens
  chr5:180527353-180527546
  hyper
atctcccacccttgccgccctctggatccagcgtccaccgagcactttttccagttccttcattctgcgcgcgagtcagcttgctgtgtagggacagaagatgacgaagtgaattcctgcagcccgccgagctgttgctgtcgccctgggagcagggcacgctcttgaccatccactcgcagatctgcgacag

SEQ ID NO: 51017 - DNA, 46 bp, Homo sapiens; identical to SEQ ID NO: 30208
  chr5:180527793-180527839
  hyper

SEQ ID NO: 51018 - DNA, 29 bp, Homo sapiens
  chr5:180530748-180530777
  hyper
gctgggattacaggcgtgagcccccgcgc

SEQ ID NO: 51019 - DNA, 139 bp, Homo sapiens; identical to SEQ ID NO: 30210
  chr5:180531166-180531305
  hyper

SEQ ID NO: 51020 - DNA, 84 bp, Homo sapiens
  chr5:180600774-180600858
  hyper
cctacaacactccaccgctatctccacctggttaaggaaaaaaggctatcaagggtatttatacctttgcctttccgcctcaac

SEQ ID NO: 51021 - DNA, 184 bp, Homo sapiens
  chr5:180601218-180601402
  hyper
tcgcagaaccaccgccttccagcaggattcgcgggccagaggcaccagctgggaaacggctccaccagcgccccagcagagaagattcgcgacgcgcaggcctcggaatttgctttgggggccactcagaaagtcagaaagtcacccacattggccctctttggggaggcggcgtgagaggagg

SEQ ID NO: 51022 - DNA, 243 bp, Homo sapiens; identical to SEQ ID NO: 30213
  chr5:180632859-180633102
  hyper

SEQ ID NO: 51023 - DNA, 89 bp, Homo sapiens
  chr6:711053-711142
  hyper
tccagtggcatttcccgtcttacacgatgagcttcatccacgttctccataaccccctccccgccacgggaagcgtcagccacctggaa

SEQ ID NO: 51024 - DNA, 189 bp, Homo sapiens; identical to SEQ ID NO: 30222
  chr6:1311809-1311998
  hyper

SEQ ID NO: 51025 - DNA, 30 bp, Homo sapiens; identical to SEQ ID NO: 30223
  chr6:1312754-1312784
  hyper

SEQ ID NO: 51026 - DNA, 62 bp, Homo sapiens; identical to SEQ ID NO: 30224
  chr6:1314000-1314062
  hyper

SEQ ID NO: 51027 - DNA, 23 bp, Homo sapiens
  chr6:1378199-1378222
  hyper
catattggaggaagtcggccggc

SEQ ID NO: 51028 - DNA, 210 bp, Homo sapiens; identical to SEQ ID NO: 30226
  chr6:1379267-1379477
  hyper

SEQ ID NO: 51029 - DNA, 210 bp, Homo sapiens
  chr6:1379699-1379909
  hyper
cggggggaagacagtcgccggccgccgggctcctgccacgctgtggcgcgcgtggaaggtgagggtcctccgctgtcccgccgcctcccacagggcggcccagagcctgcatcttttgcaaagggaacataggatggagagaaagaaagtcccgcctgaaataagcaaacgcggtggcggctttgcggtcggccacgtccgctaggaacc

SEQ ID NO: 51030 - DNA, 191 bp, Homo sapiens; identical to SEQ ID NO: 30228
  chr6:1381893-1382084
  hyper

SEQ ID NO: 51031 - DNA, 186 bp, Homo sapiens; identical to SEQ ID NO: 30229
  chr6:1382452-1382638
  hyper

SEQ ID NO: 51032 - DNA, 448 bp, Homo sapiens; identical to SEQ ID NO: 30230
  chr6:1382993-1383441
  hyper

SEQ ID NO: 51033 - DNA, 147 bp, Homo sapiens
  chr6:1384971-1385118
  hyper
tctccactcactccccgcaaccccgcaactcgccacccctaaacgcagcgggctgtaggcgaagtcgaagaggtgctccgcctggtaccgcggcctgcgcactgggatcggggcctgcaggccgctgggctggctcctgggatcatc

SEQ ID NO: 51034 - DNA, 126 bp, Homo sapiens
  chr6:1385170-1385296
  hyper
tgcggaaatggggtgaggccggtcttcgcttgagggtctcgtagattggacccctttttcccccttcaagcaccctcagacctggccagtgggtcatcgagtcgtgcccaccgcccaggccaggag

SEQ ID NO: 51035 - DNA, 33 bp, Homo sapiens; identical to SEQ ID NO: 30236
  chr6:1385653-1385686
  hyper

SEQ ID NO: 51036 - DNA, 35 bp, Homo sapiens; identical to SEQ ID NO: 30237
  chr6:1386121-1386156
  hyper

SEQ ID NO: 51037 - DNA, 118 bp, Homo sapiens
  chr6:1389006-1389124
  hyper
acactaactggggtgcgggggtggggggaagaagtggaagcaaatgcaaccctaagtcccatgagatccaggtttccagagtctttgaaacttggcctaggtttctcagtgtaaatcc

SEQ ID NO: 51038 - DNA, 13 bp, Homo sapiens
  chr6:1389262-1389275
  hyper
tctggcaccccgg

SEQ ID NO: 51039 - DNA, 291 bp, Homo sapiens
  chr6:1389950-1390241
  hyper
gctcggggagggatgcgccgggcgttgcctcccgcccgccgccgccgccgccgccagaagccccagaggagctgagggaggcgacgccgaagcgctggcccggagtggccacggctgcagcccgggcggcgggctagggcgctcgcagggcttctgggccgaccccgctccggcgcctccgcttcccgcccggggcccgccctcgcggcccggcctcgctcccgggtcccagatgaccaccgagggcgggccgccgccggccccgctccgccgcgcgtgcagcccggtccc

SEQ ID NO: 51040 - DNA, 283 bp, Homo sapiens; identical to SEQ ID NO: 19133
  chr6:1391035-1391318
  hyper

SEQ ID NO: 51041 - DNA, 27 bp, Homo sapiens
  chr6:1391379-1391406
  hyper
agctgggcgcaccgcttctaggcctcc

SEQ ID NO: 51042 - DNA, 86 bp, Homo sapiens
  chr6:1605301-1605387
  hyper
aaggaaggctggctgcggccccggcgcctgggtccgctgcggcgccgggccggagacctgggaacagccagccacctgcaaggttg

SEQ ID NO: 51043 - DNA, 57 bp, Homo sapiens
  chr6:1605454-1605511
  hyper
cttcccacacccacagccaaggcgcgtccgtgcaggggcacacgccttctgctccag

SEQ ID NO: 51044 - DNA, 370 bp, Homo sapiens; identical to SEQ ID NO: 30244
  chr6:1611389-1611759
  hyper

SEQ ID NO: 51045 - DNA, 10 bp, Homo sapiens
  chr6:1614190-1614200
  hyper
ccgggaagat

SEQ ID NO: 51046 - DNA, 49 bp, Homo sapiens; identical to SEQ ID NO: 30246
  chr6:1614286-1614335
  hyper

SEQ ID NO: 51047 - DNA, 39 bp, Homo sapiens; identical to SEQ ID NO: 30247
  chr6:1619896-1619935
  hyper

SEQ ID NO: 51048 - DNA, 500 bp, Homo sapiens; identical to SEQ ID NO: 30249
  chr6:2903017-2903517
  hyper

SEQ ID NO: 51049 - DNA, 92 bp, Homo sapiens; identical to SEQ ID NO: 30250
  chr6:3228298-3228390
  hyper

SEQ ID NO: 51050 - DNA, 45 bp, Homo sapiens
  chr6:3228984-3229029
  hyper
agggtggcccaagcccgagtaacaaactttcttatcttccatcgc

SEQ ID NO: 51051 - DNA, 15 bp, Homo sapiens
  chr6:3229059-3229074
  hyper
cggttgaagggtggg

SEQ ID NO: 51052 - DNA, 36 bp, Homo sapiens
  chr6:3229387-3229423
  hyper
acacttcggaagggccgttggcgaggtgacgtgacc

SEQ ID NO: 51053 - DNA, 358 bp, Homo sapiens; identical to SEQ ID NO: 30253
  chr6:3231580-3231938
  hyper

SEQ ID NO: 51054 - DNA, 37 bp, Homo sapiens; identical to SEQ ID NO: 30254
  chr6:4135160-4135197
  hyper

SEQ ID NO: 51055 - DNA, 41 bp, Homo sapiens; identical to SEQ ID NO: 8306
  chr6:4775411-4775452
  hyper

SEQ ID NO: 51056 - DNA, 137 bp, Homo sapiens; identical to SEQ ID NO: 30256
  chr6:5026605-5026742
  hyper

SEQ ID NO: 51057 - DNA, 591 bp, Homo sapiens; identical to SEQ ID NO: 30257
  chr6:5085738-5086329
  hyper

SEQ ID NO: 51058 - DNA, 30 bp, Homo sapiens; identical to SEQ ID NO: 30258
  chr6:5851459-5851489
  hyper

SEQ ID NO: 51059 - DNA, 114 bp, Homo sapiens; identical to SEQ ID NO: 30259
  chr6:5851703-5851817
  hyper

SEQ ID NO: 51060 - DNA, 683 bp, Homo sapiens; identical to SEQ ID NO: 30260
  chr6:5996021-5996704
  hyper

SEQ ID NO: 51061 - DNA, 254 bp, Homo sapiens
  chr6:5996989-5997243
  hyper
aaacgaaaccaacaaaatgcaactattttccaaaaccccgagcgtttgctggtgggtgaccaccccgcgcaggtagcgcggatctgctttggttttgactgagaacccgggttttgactgagacctccgtcgggaggaggggactgggtgggagttagcgggcgaaacgattccccggagtggccccgagcggcgcgtgcgtgaacgcgcggccgtaatatatgctgccattaagaatccgtgcagcttccagc

SEQ ID NO: 51062 - DNA, 245 bp, Homo sapiens
  chr6:5997557-5997802
  hyper
cagttctttctcccccgcctactccaggcctgcagtccccggacccgggtcgcctctgcccatttactccggaatgtttacttctctttaaggccatgcggggcctataaataggagaggtggaatcagccccactgccagatcaatagggcccgtctcctcgccatttcagctgagctgtcttattaattatgaaaggattcacctgatccctgccagggaacacagcctctcggcccctctgc

SEQ ID NO: 51063 - DNA, 18 bp, Homo sapiens
  chr6:6003269-6003287
  hyper
aagcctcaggcttggcgc

SEQ ID NO: 51064 - DNA, 16 bp, Homo sapiens
  chr6:6006358-6006374
  hyper
gttccctatcactctc

SEQ ID NO: 51065 - DNA, 69 bp, Homo sapiens
  chr6:6006883-6006952
  hyper
tgcctcccgcctccagcctccagccgggctgagcggccacttacctatttgcaccgcgaggatcagtga

SEQ ID NO: 51066 - DNA, 344 bp, Homo sapiens
  chr6:6007249-6007593
  hyper
acagcctcacgcccacgagcaggcctgacgtgggggatgacacggaatgattttttttttaatatagacaccttggtagagaatcgccatttatagtcatcagaagctggaattaatcagatatctccaattaatgtgcgatctgaacgaaattttgcctcccgggggtgagcactttcctattctagcggtcacccctgcctcttcctcgttccgggggccccccagccccgccgcctccctgcgcagaacaggggctccccctcccttccccgccaggagctggggagtcctggcgcgcccactcgattgtttcaacctgctccccctcctccatcagcacc

SEQ ID NO: 51067 - DNA, 172 bp, Homo sapiens
  chr6:6008277-6008449
  hyper
ctgcactgtcttttgatgctcaggcacagaccctgtgtaggtgtagcctaccctgcaacaaaatacttctgcagctggctttgtgctaggtgcaagctgctatcgacgacagcttgagtcaaaaccgaaaaactaacagggctatttcctttctaaacgcctttaagctctg

SEQ ID NO: 51068 - DNA, 294 bp, Homo sapiens; identical to SEQ ID NO: 30270
  chr6:6009258-6009552
  hyper

SEQ ID NO: 51069 - DNA, 676 bp, Homo sapiens; identical to SEQ ID NO: 30271
  chr6:6546546-6547222
  hyper

SEQ ID NO: 51070 - DNA, 40 bp, Homo sapiens; identical to SEQ ID NO: 30272
  chr6:7051798-7051838
  hyper

SEQ ID NO: 51071 - DNA, 1 bp, Homo sapiens
  chr6:7051873-7051874
  hyper
c

SEQ ID NO: 51072 - DNA, 26 bp, Homo sapiens
  chr6:7726308-7726334
  hyper
ggtacctgagccgggcgcgcagcaga

SEQ ID NO: 51073 - DNA, 27 bp, Homo sapiens
  chr6:7726363-7726390
  hyper
ggcgtggagaggcgggagaccgaattc

SEQ ID NO: 51074 - DNA, 252 bp, Homo sapiens
  chr6:7726700-7726952
  hyper
gaggggcgtgcgccacggtgatgccgggcatctcccgcagctcgtgagcggccccgctccccgctgccccgggtcccactcagtcgccagggagagcgcggggcagcgcacgtgtgcggccagcgaggcccagagtgaccgcgccgcgactcgcaggagccagggcgcaggctgcagtgcagcccggactcagacgcacctggcctggaccgcgcgcctctagagacctgcgcgaggctgtgaggctcccct

SEQ ID NO: 51075 - DNA, 718 bp, Homo sapiens
  chr6:7726981-7727699
  hyper
tcgccccttcgccacctctctagcctgggcaactgggggcgccccggacgaccatgagagataaggactgagggccaggaaggggaagcgagcccgccgagaggtggcggggactgctcacgccaagggccacagcggccgcgctccggcctcgctccgccgctccacgcctcgcgggatccgcgggggcagcccggccgggcggggatgccggggctggggcggagggcgcagtggctgtgctggtggtgggggctgctgtgcagctgctgcgggcccccgccgctgcggccgcccttgcccgctgccgcggccgccgccgccggggggcagctgctgggggacggcgggagccccggccgcacggagcagccgccgccgtcgccgcagtcctcctcgggcttcctgtaccggcggctcaagacgcaggagaagcgggagatgcagaaggagatcttgtcggtgctggggctcccgcaccggccccggcccctgcacggcctccaacagccgcagcccccggcgctccggcagcaggaggagcagcagcagcagcagcagctgcctcgcggagagccccctcccgggcgactgaagtccgcgcccctcttcatgctggatctgtacaacgccctgtccgccgacaacgacgaggacggggcgtcggagggggagaggcagcagtcctggccccacgaagcagccagctcgtcccagc

SEQ ID NO: 51076 - DNA, 707 bp, Homo sapiens
  chr6:7728142-7728849
  hyper
tccctgagcacgttccgcgctttttttcacttctgcccagctctggccaggttaactcaactgcagcaggagagtccagcccgagtgtggccatcctgggaagagggctcttcagtacgattttcccctctaaactgccgccttttgccccctaacttggagtgcagttttcccaccgagacttttagggaatccgacagcggctgggaactttgaaaacttggcatgagtatgtttagaggtatccacggcactaggggaggttgcagagggaagtcccaaaaggaccgcggaaggcgctcggatcccggccgggcggggctcgcttctgtttggggcgggatgaaagctcaactggggtaatccatcctgtgccccggctcacatgcccttggccattgtccccaaaggctgaacctttgatcaatgcagcccaagctgcacgggcagagaaagggtgcggggtaggggccggggttgggcgctgagctcctctgaaccggttgccaggcaacagaatggaaattcacgggcggctaaatggagctccgccacaaatgttctgtggcaaacccggacccagtcacatcgccctttctcccccctcccaccccactgagttttctcatctgtaaatgagaagggtgcagagaagactcttttcttcggagtcagtgcctccggtttgcactgcttttcattcataa

SEQ ID NO: 51077 - DNA, 180 bp, Homo sapiens
  chr6:7728941-7729121
  hyper
tgcgcggcggggtggggcttcacgggcctccttcccatgtgagacggtggttgtgcccaggccctgaagtgggtgagcagacactcgccaaaggagcacacgggtctcccagccacgtcaaagacgctcatcttttaacggcattacttactggaatgattcccgcgtagactatctggg

SEQ ID NO: 51078 - DNA, 15 bp, Homo sapiens
  chr6:10113574-10113589
  hyper
gccgactggggagcc

SEQ ID NO: 51079 - DNA, 55 bp, Homo sapiens; identical to SEQ ID NO: 30278
  chr6:10113619-10113674
  hyper

SEQ ID NO: 51080 - DNA, 46 bp, Homo sapiens; identical to SEQ ID NO: 30281
  chr6:10382321-10382367
  hyper

SEQ ID NO: 51081 - DNA, 237 bp, Homo sapiens; identical to SEQ ID NO: 30283
  chr6:10383837-10384074
  hyper

SEQ ID NO: 51082 - DNA, 65 bp, Homo sapiens; identical to SEQ ID NO: 30284
  chr6:10384438-10384503
  hyper

SEQ ID NO: 51083 - DNA, 271 bp, Homo sapiens
  chr6:10385939-10386210
  hyper
ctcaaaaacttccctccttggtctccgcattagggaaactgaggtactgctggcatggctgtccatacgtttgctaaatcagctactccagaggcctagagaagggagggaacgccctgggttttccagaacaagacacagatctctccgtagcctaaagaaagtccttgcgccccaggtctgaaagccaaggggagcctgtgtttgctcccagcggggtcgccggccgtctccacaacccttgcttcctacaggcagaattgaatgcagg

SEQ ID NO: 51084 - DNA, 114 bp, Homo sapiens
  chr6:10389909-10390023
  hyper
ctccacataagcagtcgatttctgtggtttcaaagaaaaaaaaaaaaaagatgaaacatgtcttctctttgagggtgacctttgacctttctttccaatacacctgacacaaag

SEQ ID NO: 51085 - DNA, 29 bp, Homo sapiens
  chr6:10391187-10391216
  hyper
ggcccttaaaactctgacctggagcctcc

SEQ ID NO: 51086 - DNA, 132 bp, Homo sapiens; identical to SEQ ID NO: 30288
  chr6:10391324-10391456
  hyper

SEQ ID NO: 51087 - DNA, 370 bp, Homo sapiens
  chr6:10410578-10410948
  hyper
gcgagaggaaaggtaaagaacaaggaatcaggcgtcgagctacaactatccacacaaaatccacttgacaagtctgcgtgggaaatcgcccgttcccgttggctggccgccgggaaaaaatcagctctaagttcttttcaggaaataccctcaagtgaaacagaccgaacaacgcagagaaactgtatatggagggggcacaagagactatttaggggtttctttcaaagagaggaaaagatagaaaagggtctcctggaacacagcccattaaactgcagcgtgaaatctctcttaagcaaaattaaaattcctcctaaatactaaacagcagaagcggccttttcttttcccccgatttgaacctgtc

SEQ ID NO: 51088 - DNA, 103 bp, Homo sapiens
  chr6:10411253-10411356
  hyper
gagagaggtgcaccccggggctgtggccccccccccccgccccttccaccccagccccaaagggcagaagaaacgcctgactttaggtttctctattgcaatt

SEQ ID NO: 51089 - DNA, 36 bp, Homo sapiens
  chr6:10411510-10411546
  hyper
actcaaggaaatcaagatgaacgtggggagaaacac

SEQ ID NO: 51090 - DNA, 90 bp, Homo sapiens; identical to SEQ ID NO: 30291
  chr6:10411946-10412036
  hyper

SEQ ID NO: 51091 - DNA, 310 bp, Homo sapiens; identical to SEQ ID NO: 30292
  chr6:10414201-10414511
  hyper

SEQ ID NO: 51092 - DNA, 135 bp, Homo sapiens
  chr6:10414978-10415113
  hyper
agaagggagcatccacgtcctctctctgcagcttctcccccgcgttcttcgggcgaatccgagggacgggcgctgcgctggggaaagtttgtcccacccgcgtttcgcagctggttgcaaggagaggaggaggag

SEQ ID NO: 51093 - DNA, 31 bp, Homo sapiens
  chr6:10415215-10415246
  hyper
cattttcatggatcggcgtgaacggatatgc

SEQ ID NO: 51094 - DNA, 39 bp, Homo sapiens
  chr6:10415713-10415752
  hyper
acaccccctctcttaccccaattccgccacattcccctt

SEQ ID NO: 51095 - DNA, 9 bp, Homo sapiens
  chr6:10419077-10419086
  hyper
tctcctaca

SEQ ID NO: 51096 - DNA, 26 bp, Homo sapiens
  chr6:10419506-10419532
  hyper
gctctcctgggcgctgccaggcgcgc

SEQ ID NO: 51097 - DNA, 61 bp, Homo sapiens
  chr6:10419941-10420002
  hyper
cagctccagcttttcccaacagccccaacccgctttcccggtcagtccctggcccgggaac

SEQ ID NO: 51098 - DNA, 150 bp, Homo sapiens; identical to SEQ ID NO: 30300
  chr6:10420118-10420268
  hyper

SEQ ID NO: 51099 - DNA, 37 bp, Homo sapiens; identical to SEQ ID NO: 30301
  chr6:10420718-10420755
  hyper

SEQ ID NO: 51100 - DNA, 177 bp, Homo sapiens
  chr6:10420876-10421053
  hyper
cgcctgggccaggcccagttaccctcccgggctgctgtcgccgggacttggagacgaacaaagaaccagttttaaatcgtcttctctgacatgtcaggcaaatatgtgtaaaaggtcagctccacgctgtggagcagagacctgtcccccaggcaccaaaacctcccctttctaacc

SEQ ID NO: 51101 - DNA, 26 bp, Homo sapiens
  chr6:10422635-10422661
  hyper
cgctgccaccacgaagcaggttcact

SEQ ID NO: 51102 - DNA, 155 bp, Homo sapiens; identical to SEQ ID NO: 30305
  chr6:10423932-10424087
  hyper

SEQ ID NO: 51103 - DNA, 15 bp, Homo sapiens
  chr6:10425463-10425478
  hyper
aaaaacttgagaccc

SEQ ID NO: 51104 - DNA, 183 bp, Homo sapiens
  chr6:10882057-10882240
  hyper
gttctgaaaaatagaagaaaaaaggacaggtgcgccaggtgggttttttttcttctctttaaagaagaaagtggggtgtgtgaaggggaggtgcagagagagagaaagagagagaggctgtttagatatctggaagctggggacaatggttatggacccgggcggggccttgtccttggccgc

SEQ ID NO: 51105 - DNA, 47 bp, Homo sapiens; identical to SEQ ID NO: 30310
  chr6:10882241-10882288
  hyper

SEQ ID NO: 51106 - DNA, 72 bp, Homo sapiens; identical to SEQ ID NO: 30312
  chr6:10883114-10883186
  hyper

SEQ ID NO: 51107 - DNA, 161 bp, Homo sapiens
  chr6:10886917-10887078
  hyper
attacaggcgtgagccaccgcgcctggccgcccctctggctttttaaggcggggcaaaaacttggaacagctaccacaaagcgaacgcctatctgtttggaatttcgcaaataaggaacgtttaaatgacgtagttcacatcctttgagtgctggctttct

SEQ ID NO: 51108 - DNA, 30 bp, Homo sapiens
  chr6:10887686-10887716
  hyper
ctttccaccttgctgcgtagaaagtgcaga

SEQ ID NO: 51109 - DNA, 372 bp, Homo sapiens
  chr6:11043690-11044062
  hyper
acacgggtgaacacacacacacacacacacagcttactgccgaggagaaagaagcgttactaatccagagtggaggactggcctgggaaatcgggcagagagaggagttgtcggaaagaacacaccagaagcccctccgagcccagacactgatagaaacccagccgcttcccaagccaatctgcaaacccaggaggcacccacgagtgcacagacacacccccggggtgcaggcgcggtgaagggaggagaggggcaagagcttgaccgttagggcccgaaccccagaactcccgaggcagggtgtgtgccgcgcgcgggaaacgccgttctccgctccaggcgtcggcgggcggtggcgagagcaggttc

SEQ ID NO: 51110 - DNA, 336 bp, Homo sapiens
  chr6:11044572-11044908
  hyper
cccacacccacgcccggcgcgcgcacacccgcccgcgcctccccgccccctcgggctcgcgccgccgccgcgcggcgctccgagcctcggggccgtttcgtccccgccccctctcccacaggggcctcgccggccgccgcgccaggagggcgcgcgggggaggggcgcagggcaagtgaggcggcgccccccgcccctgcggcctcgcgcgccccctcctgggcgaccgacctcgccctcgcgtccgcggcgtcccctgccggccgggcggcgatttgcaggtccagccggcgccggtttcgcgcggcggctcaacgtccacggagccccaggaat

SEQ ID NO: 51111 - DNA, 79 bp, Homo sapiens
  chr6:12749820-12749899
  hyper
ccctcctcccccttccgcctctctccctctccctccgtctccttctccctctcagctcgccgggcgaccctgctcctgc

SEQ ID NO: 51112 - DNA, 100 bp, Homo sapiens; identical to SEQ ID NO: 30319
  chr6:12750364-12750464
  hyper

SEQ ID NO: 51113 - DNA, 506 bp, Homo sapiens; identical to SEQ ID NO: 30320
  chr6:13013570-13014076
  hyper

SEQ ID NO: 51114 - DNA, 176 bp, Homo sapiens; identical to SEQ ID NO: 30321
  chr6:13488419-13488595
  hyper

SEQ ID NO: 51115 - DNA, 699 bp, Homo sapiens; identical to SEQ ID NO: 30322
  chr6:13924890-13925589
  hyper

SEQ ID NO: 51116 - DNA, 30 bp, Homo sapiens; identical to SEQ ID NO: 30323
  chr6:17102273-17102303
  hyper

SEQ ID NO: 51117 - DNA, 37 bp, Homo sapiens; identical to SEQ ID NO: 30324
  chr6:17281225-17281262
  hyper

SEQ ID NO: 51118 - DNA, 386 bp, Homo sapiens; identical to SEQ ID NO: 30325
  chr6:18122677-18123063
  hyper

SEQ ID NO: 51119 - DNA, 430 bp, Homo sapiens; identical to SEQ ID NO: 30326
  chr6:18277531-18277961
  hyper

SEQ ID NO: 51120 - DNA, 64 bp, Homo sapiens; identical to SEQ ID NO: 30327
  chr6:18277979-18278043
  hyper

SEQ ID NO: 51121 - DNA, 156 bp, Homo sapiens
  chr6:19691841-19691997
  hyper
tgcatttgaaggagctaaatattaggcaggaaagaaagtgctctttttgaaagcctgagaaaatgtccccgctcggggctgctccgccatctgggccgcgggctgggcgcgcggctcccgcccccagctccttggcagaggcgccggaggaagggg

SEQ ID NO: 51122 - DNA, 81 bp, Homo sapiens
  chr6:21664923-21665004
  hyper
gggcatctctggtcccgggatgcgattgtcccggtttctccttctggcccactcgccgcgcgcacgaactctaggggaagt

SEQ ID NO: 51123 - DNA, 126 bp, Homo sapiens
  chr6:21665043-21665169
  hyper
gtgaagcgcggggcgggggaggcgaggacagaagctctcctcgcggcgtctttgttctgctctggaggagagaccttggcaaggagtcgccgggcgggtgcagggacctaccgccaccacattccg

SEQ ID NO: 51124 - DNA, 141 bp, Homo sapiens; identical to SEQ ID NO: 30331
  chr6:21665754-21665895
  hyper

SEQ ID NO: 51125 - DNA, 42 bp, Homo sapiens; identical to SEQ ID NO: 30332
  chr6:21666457-21666499
  hyper

SEQ ID NO: 51126 - DNA, 175 bp, Homo sapiens; identical to SEQ ID NO: 30333
  chr6:24126308-24126483
  hyper

SEQ ID NO: 51127 - DNA, 15 bp, Homo sapiens
  chr6:24494664-24494679
  hyper
cgcggggtcacactt

SEQ ID NO: 51128 - DNA, 106 bp, Homo sapiens
  chr6:24494766-24494872
  hyper
gggcaggcaccagcgcatctatggaccgcgcacaaattccggggatgccgaatttgggggatgctaaggggagagagtgggtctctagcagcgattgggggctcag

SEQ ID NO: 51129 - DNA, 94 bp, Homo sapiens; identical to SEQ ID NO: 30335
  chr6:25652379-25652473
  hyper

SEQ ID NO: 51130 - DNA, 229 bp, Homo sapiens; identical to SEQ ID NO: 30336
  chr6:26020909-26021138
  hyper

SEQ ID NO: 51131 - DNA, 30 bp, Homo sapiens; identical to SEQ ID NO: 30337
  chr6:26034014-26034044
  hyper

SEQ ID NO: 51132 - DNA, 90 bp, Homo sapiens; identical to SEQ ID NO: 30338
  chr6:26087615-26087705
  hyper

SEQ ID NO: 51133 - DNA, 88 bp, Homo sapiens; identical to SEQ ID NO: 30339
  chr6:26088186-26088274
  hyper

SEQ ID NO: 51134 - DNA, 152 bp, Homo sapiens; identical to SEQ ID NO: 30340
  chr6:26172018-26172170
  hyper

SEQ ID NO: 51135 - DNA, 74 bp, Homo sapiens; identical to SEQ ID NO: 19182
  chr6:26184021-26184095
  hyper

SEQ ID NO: 51136 - DNA, 195 bp, Homo sapiens; identical to SEQ ID NO: 30344
  chr6:26197272-26197467
  hyper

SEQ ID NO: 51137 - DNA, 25 bp, Homo sapiens
  chr6:26198574-26198599
  hyper
gttttgagacagtctcgctctgtcg

SEQ ID NO: 51138 - DNA, 85 bp, Homo sapiens; identical to SEQ ID NO: 30346
  chr6:26198839-26198924
  hyper

SEQ ID NO: 51139 - DNA, 450 bp, Homo sapiens; identical to SEQ ID NO: 30347
  chr6:26199182-26199632
  hyper

SEQ ID NO: 51140 - DNA, 40 bp, Homo sapiens; identical to SEQ ID NO: 30348
  chr6:26199835-26199875
  hyper

SEQ ID NO: 51141 - DNA, 39 bp, Homo sapiens; identical to SEQ ID NO: 30349
  chr6:26200115-26200154
  hyper

SEQ ID NO: 51142 - DNA, 613 bp, Homo sapiens; identical to SEQ ID NO: 30350
  chr6:26204685-26205298
  hyper

SEQ ID NO: 51143 - DNA, 210 bp, Homo sapiens; identical to SEQ ID NO: 30351
  chr6:26205502-26205712
  hyper

SEQ ID NO: 51144 - DNA, 24 bp, Homo sapiens
  chr6:26216371-26216395
  hyper
ttacaaaatcggaaaaattattcc

SEQ ID NO: 51145 - DNA, 99 bp, Homo sapiens; identical to SEQ ID NO: 30353
  chr6:26216596-26216695
  hyper

SEQ ID NO: 51146 - DNA, 98 bp, Homo sapiens; identical to SEQ ID NO: 30354
  chr6:26216755-26216853
  hyper

SEQ ID NO: 51147 - DNA, 30 bp, Homo sapiens; identical to SEQ ID NO: 30355
  chr6:26217548-26217578
  hyper

SEQ ID NO: 51148 - DNA, 754 bp, Homo sapiens; identical to SEQ ID NO: 30356
  chr6:26233978-26234732
  hyper

SEQ ID NO: 51149 - DNA, 191 bp, Homo sapiens; identical to SEQ ID NO: 30357
  chr6:26234942-26235133
  hyper

SEQ ID NO: 51150 - DNA, 151 bp, Homo sapiens
  chr6:26241118-26241269
  hyper
gatcttcctaagatggcggatgtgctaaggagaaagggaaggcgaaacattagaaacttgttcaggtatttcgatcgcaaacattcacaggaaaagatggtggaaatggtttgggaataccagcagccttttatgacgtatgtgatgtgtt

SEQ ID NO: 51151 - DNA, 41 bp, Homo sapiens; identical to SEQ ID NO: 30359
  chr6:26249960-26250001
  hyper

SEQ ID NO: 51152 - DNA, 287 bp, Homo sapiens
  chr6:26250181-26250468
  hyper
cgggctcccacagtactgggattacaaggcgtgagccgccactatcggccattttgaagacaatggccaagacacaaaagcctagtttagaagagccaccggccctgcccccatcccctaaccctccaccctccttgttttaggagacattactccctagtgctacggcgctttcaactgaaattgttggtggctctgaaaagagcctttggtttaagttggcgcacaccctcagtacaacttatgccctctctccgcgaatgcggcgagcgagctggatgtccttg

SEQ ID NO: 51153 - DNA, 228 bp, Homo sapiens
  chr6:26250826-26251054
  hyper
gtgccataggaatgggtttcaagcaatggtcacaactgaacaaacagttgttcttactcctatttataaaggcaaagtccttctgattggtccgaatcttccagtttcgcgccctgaattatgtagtgtgataggacttgtgatcagctactaggtctcattttagaaaatcttaacctatctaaatgcttttttcccctagttccttacattttattatgttttatg

SEQ ID NO: 51154 - DNA, 276 bp, Homo sapiens
  chr6:26251540-26251816
  hyper
tagaaacataatatccgtctttgtttctgtttaaattctcacctaaggagacagaacttataggtagatgttactggcaaggcattagtttttctaatgttttgaatgaaaaactacgttttttcccccgggaggtgtagaaaaggatttagggtaggtttcgcataaatatccaatcaaaaagtagacttgaatttaacttttttattggctgatttggtccaatcagggattgagaatgattaagcacctatttgcataaaagacctacaaaaa

SEQ ID NO: 51155 - DNA, 29 bp, Homo sapiens
  chr6:26252151-26252180
  hyper
tccagggagatccagacagccgtgcgcct

SEQ ID NO: 51156 - DNA, 39 bp, Homo sapiens; identical to SEQ ID NO: 30365
  chr6:26252240-26252279
  hyper

SEQ ID NO: 51157 - DNA, 35 bp, Homo sapiens; identical to SEQ ID NO: 19194
  chr6:26271371-26271406
  hyper

SEQ ID NO: 51158 - DNA, 54 bp, Homo sapiens
  chr6:26271762-26271816
  hyper
attactggaaaatctgattggatgaatcacttcatttttgaatcctctcttctc

SEQ ID NO: 51159 - DNA, 24 bp, Homo sapiens
  chr6:26271817-26271841
  hyper
gttagtctgcgatccaagaacgtt

SEQ ID NO: 51160 - DNA, 46 bp, Homo sapiens; identical to SEQ ID NO: 30368
  chr6:26272059-26272105
  hyper

SEQ ID NO: 51161 - DNA, 81 bp, Homo sapiens
  chr6:26272431-26272512
  hyper
gacagggcaacagcacggcctgaatattgggcaggacaccgccctgcgcgatagtaactttgcccaacagcttgttgagct

SEQ ID NO: 51162 - DNA, 236 bp, Homo sapiens
  chr6:26272617-26272853
  hyper
gcaccgcctccaggtacaccggcgcaccggcccggacccgcttggcgtagttgcccttgcggaggaggcggtgcactcggcccacagaaaactggagaccagccctggaagagtgcgttttagccttggcgcgagctttgctgccctgcattccacatccagacgcagtgaagtatttaaatacttgtttagaagaaggaaagtgattgattctagtaaaacgcaagagctaaact

SEQ ID NO: 51163 - DNA, 159 bp, Homo sapiens; identical to SEQ ID NO: 8394
  chr6:26273111-26273270
  hyper

SEQ ID NO: 51164 - DNA, 180 bp, Homo sapiens; identical to SEQ ID NO: 8395
  chr6:26273570-26273750
  hyper

SEQ ID NO: 51165 - DNA, 120 bp, Homo sapiens; identical to SEQ ID NO: 30372
  chr6:26322568-26322688
  hyper

SEQ ID NO: 51166 - DNA, 108 bp, Homo sapiens; identical to SEQ ID NO: 30375
  chr6:26331703-26331811
  hyper

SEQ ID NO: 51167 - DNA, 44 bp, Homo sapiens
  chr6:26332134-26332178
  hyper
ggtgagttttaaattcgtttccaaagttcactgcaggtcacaac

SEQ ID NO: 51168 - DNA, 48 bp, Homo sapiens
  chr6:26332218-26332266
  hyper
tgtttgtgctgcatcttttctgagagataacggcgcctccctgtagcc

SEQ ID NO: 51169 - DNA, 227 bp, Homo sapiens
  chr6:26550767-26550994
  hyper
atggcctggaagagccgtactctggatacccgagggcgcggccccagcgccgcgacgccccgcccctctggctgctccgctctgggatgcacttccgacgccctctaggcttgggagttccgcgcctctcggtgtcgcctggggggcgtgctccggttggcgcactgattcccagttgggtaggggaggcttgactgagctcccacccggaatttcaccttagacct

SEQ ID NO: 51170 - DNA, 25 bp, Homo sapiens
  chr6:26551034-26551059
  hyper
ctagtcctctttagtggagttccgg

SEQ ID NO: 51171 - DNA, 46 bp, Homo sapiens; identical to SEQ ID NO: 30379
  chr6:26551083-26551129
  hyper

SEQ ID NO: 51172 - DNA, 27 bp, Homo sapiens
  chr6:26577131-26577158
  hyper
tacacagaatacttccggtgtatgaga

SEQ ID NO: 51173 - DNA, 166 bp, Homo sapiens; identical to SEQ ID NO: 8404
  chr6:26577722-26577888
  hyper

SEQ ID NO: 51174 - DNA, 97 bp, Homo sapiens
  chr6:27059686-27059783
  hyper
aattgtctaagcaggcgagtactgaatccggacttcttctaagggcagacaccggaatgttgatgcggctgcagctgcgctctcccacctctgtctg

SEQ ID NO: 51175 - DNA, 51 bp, Homo sapiens
  chr6:27059848-27059899
  hyper
ccgagtgctggaggggaaacgtgagttgcagtcaaccggttatcttcctct

SEQ ID NO: 51176 - DNA, 54 bp, Homo sapiens
  chr6:27064628-27064682
  hyper
cgactccggtgtgaacggttttgggaacctcggtctcctgctggctcccaggtg

SEQ ID NO: 51177 - DNA, 70 bp, Homo sapiens; identical to SEQ ID NO: 19205
  chr6:27065198-27065268
  hyper

SEQ ID NO: 51178 - DNA, 49 bp, Homo sapiens; identical to SEQ ID NO: 30386
  chr6:27094912-27094961
  hyper

SEQ ID NO: 51179 - DNA, 84 bp, Homo sapiens; identical to SEQ ID NO: 30387
  chr6:27100309-27100393
  hyper

SEQ ID NO: 51180 - DNA, 600 bp, Homo sapiens; identical to SEQ ID NO: 30388
  chr6:27100453-27101053
  hyper

SEQ ID NO: 51181 - DNA, 24 bp, Homo sapiens
  chr6:27101113-27101137
  hyper
ccgcaacgacgaggagctcaacaa

SEQ ID NO: 51182 - DNA, 20 bp, Homo sapiens
  chr6:27173508-27173528
  hyper
aagagatgaattgcccggct

SEQ ID NO: 51183 - DNA, 91 bp, Homo sapiens
  chr6:27182899-27182990
  hyper
tagataatcgacagacgcagactgagtggccagtagtcaaaagcgcaaccgagggccagtggcgcaatggataacgcgtctgactacggat

SEQ ID NO: 51184 - DNA, 62 bp, Homo sapiens
  chr6:27203207-27203269
  hyper
aaagatataccctgacggaacggataaatttaaagttcattttaactaattcaaaactgaaa

SEQ ID NO: 51185 - DNA, 230 bp, Homo sapiens
  chr6:27205441-27205671
  hyper
ctttcaattttaaaaaagcaaaatgtttgttgtttttgtgtttctttaacactaaaggaaattcttttcctctcctcaaagggatgtcttttaaaataattttaattgcgactacgtaatattgtttcttcaaacttctgttggtgttttgcattttcccttcctgcactcccgcagggaagaaggaaaacaaaaacaaaaacaaggacaaggccaaaaactctacctcc

SEQ ID NO: 51186 - DNA, 217 bp, Homo sapiens
  chr6:27206040-27206257
  hyper
tgctccactacgcgttattataattaactgcttgtgttactctttgtgctgtcttgctcttcattctcctggtacctcgggtgcccgcacagcatggtaagctgctcaatagttcaatgaatggggaaaaggtgtgcagaggtcatttctgctgattatcaagacttcaattcttcgaagtggagcacgaggatcctctaggcggcaggcaaatgtc

SEQ ID NO: 51187 - DNA, 8 bp, Homo sapiens
  chr6:27228172-27228180
  hyper
gaagagcc

SEQ ID NO: 51188 - DNA, 64 bp, Homo sapiens; identical to SEQ ID NO: 19208
  chr6:27228395-27228459
  hyper

SEQ ID NO: 51189 - DNA, 197 bp, Homo sapiens; identical to SEQ ID NO: 30398
  chr6:27242926-27243123
  hyper

SEQ ID NO: 51190 - DNA, 16 bp, Homo sapiens
  chr6:27247620-27247636
  hyper
ctggcccagtgctccc

SEQ ID NO: 51191 - DNA, 15 bp, Homo sapiens
  chr6:27247724-27247739
  hyper
cgaaccaagtccttg

SEQ ID NO: 51192 - DNA, 56 bp, Homo sapiens; identical to SEQ ID NO: 30400
  chr6:27248054-27248110
  hyper

SEQ ID NO: 51193 - DNA, 155 bp, Homo sapiens
  chr6:27255942-27256097
  hyper
tgctttccttcgccgcggttgcggccgcgaccctgttcttaccaccagcaattcctccagggacttggtcagcagcccaacttgatctgcgtctctctgctaaggtgtttccgcaacagggtcaactccaagtctcacctttctaggaatcccgg

SEQ ID NO: 51194 - DNA, 210 bp, Homo sapiens
  chr6:27256173-27256383
  hyper
agagattgtcagttatccaactgtcaatagagccgccgctccagcgagtttaatttaggcacagaaaagtcctgcctgggttgaggtgggcttaggatgagtttacttgagtgtgtgatttagaaatagatctatgggacagacagacacgaaatcgggcattggggccctcgcaggcagggtatctagactggcagctgccggtgcagg

SEQ ID NO: 51195 - DNA, 27 bp, Homo sapiens
  chr6:27256420-27256447
  hyper
tggggacgaagacgtcctggttgcaag

SEQ ID NO: 51196 - DNA, 320 bp, Homo sapiens; identical to SEQ ID NO: 30402
  chr6:27258104-27258424
  hyper

SEQ ID NO: 51197 - DNA, 50 bp, Homo sapiens; identical to SEQ ID NO: 19213
  chr6:27279795-27279845
  hyper

SEQ ID NO: 51198 - DNA, 774 bp, Homo sapiens
  chr6:27280012-27280786
  hyper
ctgcagaatcggacagagtcgaagagcgcagtgttcggttgacggttgggattcacgcgctaggaaagcgcgagtctcagggtgcttagcactctccaggcccggcacccgcgggaacgggggacacgcgggacttcggcagtcccagtaacttgctttgctgttctgagacctcagcggggcggtcagacctctgctgtctccgcagcgagttgcagtacttggcgcggggagaggaactcgagaggaagctcactgcgcctcgcccctggcgtcggcagcggctgtctgggaccctgtggtccggattcaccaagtggcgcagagctggaatcgagtgggtgcacagtttccaggctccgactattactggcctcgaaggtacaggctcaggcggctcagggccccggcgcagatctgtcggcccgcgggatccccggagtctgagtggggagcactatccgcaccccgtagagtgagtgcgggcggctttcgcaggtgctcaggactggagatctggaccggtggctgtgccgcccggatggcatttgtggcactagcagtcgggaaagcagctgattgaggatttccgcgtttctctttttttgcagatcgtgacgccgccagtaggtgtcagtcatttgccgcacagccacctttgagatccacctgtgtctcccagcggccgaatccaggtttccttcctattcgcacttggagaactcatgcagattgccgtcaggagtggcctcagagatccggagtgggcgaatg

SEQ ID NO: 51199 - DNA, 328 bp, Homo sapiens; identical to SEQ ID NO: 30404
  chr6:27342701-27343029
  hyper

SEQ ID NO: 51200 - DNA, 66 bp, Homo sapiens; identical to SEQ ID NO: 30405
  chr6:27356988-27357054
  hyper

SEQ ID NO: 51201 - DNA, 33 bp, Homo sapiens; identical to SEQ ID NO: 8419
  chr6:27471362-27471395
  hyper

SEQ ID NO: 51202 - DNA, 6 bp, Homo sapiens
  chr6:27513487-27513493
  hyper
aaggcg

SEQ ID NO: 51203 - DNA, 36 bp, Homo sapiens; identical to SEQ ID NO: 19216
  chr6:27534341-27534377
  hyper

SEQ ID NO: 51204 - DNA, 32 bp, Homo sapiens; identical to SEQ ID NO: 30411
  chr6:27551251-27551283
  hyper

SEQ ID NO: 51205 - DNA, 288 bp, Homo sapiens
  chr6:27572883-27573171
  hyper
gactgatcagttgaacggctaaggaaaagaactgggtgttaccgtcgttgctagagcggtgtgagtttacgacagttgctggtcagatcaatgtccgactcccctttcagagagacagacgatatacaggaatctggaacattcctacagggctctctgagaacggagacctttttctcgtgccttttttcttttcttttctttttttgtttgtttaatttttatgttagcggattcacagaccaatagatggaaatccgctgcttactttctcgcaggagaaaatga

SEQ ID NO: 51206 - DNA, 223 bp, Homo sapiens
  chr6:27573392-27573615
  hyper
agggaaaaacaaaagatcaggctgtgtcagaagtgggattcgaacccacgcctccatacggagaccagaagacccgaacacaggaagcagtaagcttgagtctggcgccttagaccactcggccatcctgacactgtgacaaaaatccttgaaactatacatgatgagtaatcacggcttacggctcgccttctggctgaatcccagccgcaaaagttctctc

SEQ ID NO: 51207 - DNA, 53 bp, Homo sapiens; identical to SEQ ID NO: 30414
  chr6:27585093-27585146
  hyper

SEQ ID NO: 51208 - DNA, 66 bp, Homo sapiens; identical to SEQ ID NO: 19219
  chr6:27598672-27598738
  hyper

SEQ ID NO: 51209 - DNA, 20 bp, Homo sapiens
  chr6:27635245-27635265
  hyper
aagaatgaaaaacatcgaag

SEQ ID NO: 51210 - DNA, 29 bp, Homo sapiens
  chr6:27635434-27635463
  hyper
aagttccaaaaacacgaaggaaaccccag

SEQ ID NO: 51211 - DNA, 211 bp, Homo sapiens; identical to SEQ ID NO: 30418
  chr6:27635858-27636069
  hyper

SEQ ID NO: 51212 - DNA, 161 bp, Homo sapiens; identical to SEQ ID NO: 30419
  chr6:27636349-27636510
  hyper

SEQ ID NO: 51213 - DNA, 195 bp, Homo sapiens
  chr6:27647517-27647712
  hyper
gtaggggttggcgatcgaccatcaggagagcccagtctttgccacttgcggggagtcacttattgcaggcagggtgttaactgagtttaacactaggagacaaaatgaggaaataatctctcagaatgtaggttaggaaagtagaaacgccctccgagtgtatgtctatcccagaagaaaacctgtcttaaagtt

SEQ ID NO: 51214 - DNA, 351 bp, Homo sapiens
  chr6:27647896-27648247
  hyper
gagctgaacgctcattgctgagtcctgggagaaggtcgcgtttgtacagaaggctcctggcagcgagcaaggccgggagtgggcccagtgcgcacgaagtcgcgccccgaattcccactgggaggaacgcactggaattgaaatgtctgagatcaagccccgctgagaatcaagtcccagaggatcttctcggctggtggaaacgtggaggggaaaggcggtcacgaaaattgaagtctcctagtccaatacagattatccaggccgttgacggcaggaatatatttttatttattcctttacccttctctcctcacagctcttccttctcgtccacgcttgatgggtttt

SEQ ID NO: 51215 - DNA, 76 bp, Homo sapiens; identical to SEQ ID NO: 30422
  chr6:27648814-27648890
  hyper

SEQ ID NO: 51216 - DNA, 280 bp, Homo sapiens; identical to SEQ ID NO: 30424
  chr6:27661759-27662039
  hyper

SEQ ID NO: 51217 - DNA, 331 bp, Homo sapiens; identical to SEQ ID NO: 30425
  chr6:27774914-27775245
  hyper

SEQ ID NO: 51218 - DNA, 441 bp, Homo sapiens; identical to SEQ ID NO: 30426
  chr6:27777715-27778156
  hyper

SEQ ID NO: 51219 - DNA, 206 bp, Homo sapiens; identical to SEQ ID NO: 30427
  chr6:27782436-27782642
  hyper

SEQ ID NO: 51220 - DNA, 213 bp, Homo sapiens; identical to SEQ ID NO: 30428
  chr6:27833079-27833292
  hyper

SEQ ID NO: 51221 - DNA, 279 bp, Homo sapiens; identical to SEQ ID NO: 30429
  chr6:27834035-27834314
  hyper

SEQ ID NO: 51222 - DNA, 28 bp, Homo sapiens
  chr6:27834835-27834863
  hyper
tcttcggagtcttcttcactgccttttt

SEQ ID NO: 51223 - DNA, 143 bp, Homo sapiens
  chr6:27834904-27835047
  hyper
cgggcttcttagctttagcggcgcctgccttcttggctttgggcttggcttccccggaggccgccttcttgttgagtttaaaggagccagaagcaccagtgcccttggtctgcaccagggtgcccttgctcaccaagctcttg

SEQ ID NO: 51224 - DNA, 43 bp, Homo sapiens
  chr6:27839683-27839726
  hyper
tatgccctctcccctcggatgcggcgcgcaagctggatgtctt

SEQ ID NO: 51225 - DNA, 461 bp, Homo sapiens; identical to SEQ ID NO: 19230
  chr6:27840082-27840543
  hyper

SEQ ID NO: 51226 - DNA, 107 bp, Homo sapiens; identical to SEQ ID NO: 30434
  chr6:27841143-27841250
  hyper

SEQ ID NO: 51227 - DNA, 211 bp, Homo sapiens
  chr6:27858304-27858515
  hyper
gccgagctctggaaacgaaggtcggttttgaaatcctgcgcgatttctcgcaccaggcgctgaaatggcagtttgcggatgagcagctcagtcgacttctgataacggcggatctcacgcaaggccacggtgcctggcctgtagcggtggggcttcttcacaccgccagtcgctggagcgcttttgcgcgctgccttggtggccagctgct

SEQ ID NO: 51228 - DNA, 67 bp, Homo sapiens
  chr6:27858637-27858704
  hyper
gatgatctgatcctgattggtcagaactgttgtaggaaaaacctggttggttgttaatactatcttc

SEQ ID NO: 51229 - DNA, 96 bp, Homo sapiens; identical to SEQ ID NO: 30436
  chr6:28129482-28129578
  hyper

SEQ ID NO: 51230 - DNA, 70 bp, Homo sapiens; identical to SEQ ID NO: 19232
  chr6:28176212-28176282
  hyper

SEQ ID NO: 51231 - DNA, 170 bp, Homo sapiens; identical to SEQ ID NO: 30438
  chr6:28249409-28249579
  hyper

SEQ ID NO: 51232 - DNA, 38 bp, Homo sapiens; identical to SEQ ID NO: 30439
  chr6:28303451-28303489
  hyper

SEQ ID NO: 51233 - DNA, 30 bp, Homo sapiens; identical to SEQ ID NO: 30441
  chr6:28304271-28304301
  hyper

SEQ ID NO: 51234 - DNA, 55 bp, Homo sapiens; identical to SEQ ID NO: 19233
  chr6:28367054-28367109
  hyper

SEQ ID NO: 51235 - DNA, 104 bp, Homo sapiens
  chr6:28367774-28367878
  hyper
tgatcttaagacagggaaatcccttgcgtctccattcactttgggattctgtgtctctgaggttagagatgcctcaaagggatgttctccgggggaccttccca

SEQ ID NO: 51236 - DNA, 87 bp, Homo sapiens
  chr6:28410889-28410976
  hyper
cctaagatgcagatacggagagttcagagtgccatcagtacagggcagagaggttgaagagctcaggaacagacatagggtggggga

SEQ ID NO: 51237 - DNA, 140 bp, Homo sapiens
  chr6:28411353-28411493
  hyper
ctctgtggtcgtcactctgaatcccgtctgtagtcttaagtgagatactaggtgacacattgtcttccacgcggcaatataataacggccaacatagtgttttaacacgtattaattcattaccccgcataacaaccctg

SEQ ID NO: 51238 - DNA, 35 bp, Homo sapiens
  chr6:28414942-28414977
  hyper
atccagcattgcagccgccgcggcggtctaagagc

SEQ ID NO: 51239 - DNA, 118 bp, Homo sapiens; identical to SEQ ID NO: 30450
  chr6:28415091-28415209
  hyper

SEQ ID NO: 51240 - DNA, 36 bp, Homo sapiens
  chr6:28457572-28457608
  hyper
ttctcctctgtaacccgtccttccacgtcccggtgg

SEQ ID NO: 51241 - DNA, 223 bp, Homo sapiens
  chr6:28457638-28457861
  hyper
cggggacctgcaaggagccccgcccgcaggctttgaaccgatttcggctccgcgtccaggagcaggccctacgtagggccgggggaattcaggtgcgtctgcggggcccagggcacccagggcaggcggggactgagacgactgagggttgagggacaaggaggttgggactggggaggggagacccgggacccgcccagaacgctttcgtggggttggagag

SEQ ID NO: 51242 - DNA, 34 bp, Homo sapiens
  chr6:28458158-28458192
  hyper
tgagacgtcaactaagcgccgtttcagtcccaga

SEQ ID NO: 51243 - DNA, 119 bp, Homo sapiens; identical to SEQ ID NO: 30453
  chr6:32632538-32632657
  hyper

SEQ ID NO: 51244 - DNA, 128 bp, Homo sapiens; identical to SEQ ID NO: 30454
  chr6:34110456-34110584
  hyper

SEQ ID NO: 51245 - DNA, 87 bp, Homo sapiens; identical to SEQ ID NO: 30455
  chr6:34111685-34111772
  hyper

SEQ ID NO: 51246 - DNA, 1141 bp, Homo sapiens; identical to SEQ ID NO: 30456
  chr6:34112299-34113440
  hyper

SEQ ID NO: 51247 - DNA, 80 bp, Homo sapiens; identical to SEQ ID NO: 30457
  chr6:34119186-34119266
  hyper

SEQ ID NO: 51248 - DNA, 527 bp, Homo sapiens; identical to SEQ ID NO: 30458
  chr6:34433517-34434044
  hyper

SEQ ID NO: 51249 - DNA, 144 bp, Homo sapiens; identical to SEQ ID NO: 30459
  chr6:35181280-35181424
  hyper

SEQ ID NO: 51250 - DNA, 58 bp, Homo sapiens; identical to SEQ ID NO: 30460
  chr6:35466126-35466184
  hyper

SEQ ID NO: 51251 - DNA, 19 bp, Homo sapiens
  chr6:35992409-35992428
  hyper
gggcgggctgaggagatga

SEQ ID NO: 51252 - DNA, 57 bp, Homo sapiens; identical to SEQ ID NO: 30462
  chr6:36088966-36089023
  hyper

SEQ ID NO: 51253 - DNA, 118 bp, Homo sapiens
  chr6:36252866-36252984
  hyper
taacaattattattacgttggggtagggtattcaagatatacccacaggaaaatgcagattacaattcagtctgcaattagggaccagatagcagccaactctcaggtgatccatgca

SEQ ID NO: 51254 - DNA, 165 bp, Homo sapiens; identical to SEQ ID NO: 30464
  chr6:36806918-36807083
  hyper

SEQ ID NO: 51255 - DNA, 147 bp, Homo sapiens
  chr6:36808176-36808323
  hyper
tctctgctgagtgtgcgccctactcgggggcgggtctcagttcagaaacagaccctacatctccttctggggaggtgtgtgggggcgaccccagtgccaggagggactacctcggtttcccagtggcccaggtggggtcggtgcatg

SEQ ID NO: 51256 - DNA, 111 bp, Homo sapiens
  chr6:36808441-36808552
  hyper
ccaggtctagaagctcctgccacccagtctggtggcaaccagactgggagatcggcccgagctccctgggcttctatgcagccagcaccgagtaggcgcgtgctgtgtgcc

SEQ ID NO: 51257 - DNA, 155 bp, Homo sapiens
  chr6:37663985-37664140
  hyper
agggccaggggatgccggcatcctgatcagggtgtcaagccctgagtagaagaagcgaagccgcagcaacagcggggaaggcgagcccgccgcccggccttggtgctgacagccggctcgcccgcaagccgcgcggcaactccggctcatgcatc

SEQ ID NO: 51258 - DNA, 272 bp, Homo sapiens; identical to SEQ ID NO: 19242
  chr6:37664187-37664459
  hyper

SEQ ID NO: 51259 - DNA, 71 bp, Homo sapiens; identical to SEQ ID NO: 30467
  chr6:37664481-37664552
  hyper

SEQ ID NO: 51260 - DNA, 312 bp, Homo sapiens
  chr6:37673008-37673320
  hyper
gcagccccagtggaacgcatcaagtttcgctgagctggtctttctaactttctccccggcagctccgcgggaagcaggatcaaatgttctccagcctgaaaagcccggctggggtgtgaggagaaaggagaaggggaggaggggcggccaatctgcggtattggaaggggaggggccggggccgggccccagggacaggcctcgtgactctccttgctccctttctgtttaaccctcccagccaattctttttcctttagccattagctctttttgatccacgtaaaagggggtggggggcgggaaatctgg

SEQ ID NO: 51261 - DNA, 79 bp, Homo sapiens; identical to SEQ ID NO: 30469
  chr6:39016246-39016325
  hyper

SEQ ID NO: 51262 - DNA, 240 bp, Homo sapiens; identical to SEQ ID NO: 30470
  chr6:39016390-39016630
  hyper

SEQ ID NO: 51263 - DNA, 251 bp, Homo sapiens; identical to SEQ ID NO: 8461
  chr6:39016678-39016929
  hyper

SEQ ID NO: 51264 - DNA, 190 bp, Homo sapiens; identical to SEQ ID NO: 30472
  chr6:39197136-39197326
  hyper

SEQ ID NO: 51265 - DNA, 173 bp, Homo sapiens; identical to SEQ ID NO: 19246
  chr6:39281133-39281306
  hyper

SEQ ID NO: 51266 - DNA, 208 bp, Homo sapiens; identical to SEQ ID NO: 19247
  chr6:39281616-39281824
  hyper

SEQ ID NO: 51267 - DNA, 124 bp, Homo sapiens
  chr6:39281875-39281999
  hyper
agcgccgggcggtccagacacgtgaagttctgcaacagctcccacttgtcgcgctggaagctgcggctggagtcctgcgccgcgcggccctccagcgtccagaacacgccggtgcccagcgcca

SEQ ID NO: 51268 - DNA, 388 bp, Homo sapiens; identical to SEQ ID NO: 30475
  chr6:39759800-39760188
  hyper

SEQ ID NO: 51269 - DNA, 193 bp, Homo sapiens; identical to SEQ ID NO: 30476
  chr6:39902169-39902362
  hyper

SEQ ID NO: 51270 - DNA, 64 bp, Homo sapiens; identical to SEQ ID NO: 19250
  chr6:40554589-40554653
  hyper

SEQ ID NO: 51271 - DNA, 161 bp, Homo sapiens
  chr6:40554699-40554860
  hyper
ccccggctgggtggcaccgaggccggctccgcggggcgcccgggctccccggctcggccacgcatccttccccgcccgagacagactcgagctaaaccctccggcggctccggcgaatgcaggcagatggtggcctcggacgtccacgcggggaaagccct

SEQ ID NO: 51272 - DNA, 29 bp, Homo sapiens
  chr6:40555212-40555241
  hyper
cccggtttctctctccgctccacacacac

SEQ ID NO: 51273 - DNA, 48 bp, Homo sapiens
  chr6:41337024-41337072
  hyper
aggcaacaggtgggacggggagccagggagtggaaacgccggaggtcc

SEQ ID NO: 51274 - DNA, 96 bp, Homo sapiens
  chr6:41337128-41337224
  hyper
ccgggaccctatccatgtcccattccgggcaccttcctcaaaagtaggggtgggaggggcataagccggtcaagtatttcccgggccttccggagc

SEQ ID NO: 51275 - DNA, 38 bp, Homo sapiens
  chr6:41339225-41339263
  hyper
tccccagagagcgatcgccccggacttgtgcctgtgtt

SEQ ID NO: 51276 - DNA, 168 bp, Homo sapiens
  chr6:41339838-41340006
  hyper
gaacttttctctcctccttcttccctcgctctgcctctctcggggcggtctccggggactgtctctcacatccattctcctctcctccttgatttatgctgcagagtggaacgaccttccctgacctcattttcatgtcggcgcgagcacacccggagccggctacgc

SEQ ID NO: 51277 - DNA, 28 bp, Homo sapiens
  chr6:41341549-41341577
  hyper
cctggatcttccgcggcagagaagcctg

SEQ ID NO: 51278 - DNA, 28 bp, Homo sapiens
  chr6:41342779-41342807
  hyper
gggtccttcaaaaagcgccactttggag

SEQ ID NO: 51279 - DNA, 613 bp, Homo sapiens
  chr6:41342837-41343450
  hyper
tcccctactcccaacccctcgctcctcatcactgcccctcctagaccctgctgtgtagacgggacctcaaggagttcccgagggaacagatttgaaagcccagctccgggttccatggacagtgtttgacaggtcagcccctcgctgtcctcctatccccctcctccaagtccggtccccctctttcaccccaacccccactctcgcgtgggactcagacactgatcccggagcgagaatgcggctgacagttaaattgcagtgtaggccgagggggggaaaagggaccatgtctctttaacgggccctgcagacaaagcgtctccccttggagcgagcggagccaggcgcagccgcgcgcagacctgtcagcgcgtctcacgcgcttgggagagagtttgcaaagtcataattatatctcttaacctgtcttgctctctgcagaagaaggtcccattatattgaaatgagattattagccatcaaatactttctttctcgggagttttttttttttttaattcaaataccttaacgacttggcaattgcattttgatcagatttagttggcgccccagcccggagcgggagccggggcgggaaggcagctgg

SEQ ID NO: 51280 - DNA, 52 bp, Homo sapiens; identical to SEQ ID NO: 30486
  chr6:41343650-41343702
  hyper

SEQ ID NO: 51281 - DNA, 278 bp, Homo sapiens; identical to SEQ ID NO: 30487
  chr6:41438225-41438503
  hyper

SEQ ID NO: 51282 - DNA, 41 bp, Homo sapiens
  chr6:41605896-41605937
  hyper
acaggcaaaggaaaacgtgcagcccgcggatctccgggcct

SEQ ID NO: 51283 - DNA, 80 bp, Homo sapiens
  chr6:41606542-41606622
  hyper
ccagcgcagccccgggcccaggtaggaccgggagtggcgagcgaagctggacaggggcgggtgggcggctgaaggggcca

SEQ ID NO: 51284 - DNA, 161 bp, Homo sapiens
  chr6:42879393-42879554
  hyper
gggtcttcctccttccggttcttgggaagatcctgcaatctgaaagaggcaggagagctctttccccatctgtaatgtggtaaccgagcccgagccagctcctccctgggctggagggtgggagagtcgttagggacacctgccccgctccctccccctcc

SEQ ID NO: 51285 - DNA, 42 bp, Homo sapiens
  chr6:42879718-42879760
  hyper
tattaaaatagccatccagacggaaatcgagtgaggctggca

SEQ ID NO: 51286 - DNA, 151 bp, Homo sapiens
  chr6:43211311-43211462
  hyper
gccgccgccggagggagcgggtcacccaacgccgcactgagccgcccccgccccgccccggccccgggggatgcgccgccccgagctgctgcctccgccgccgccgcagccgcagccgcagcgggcacagagcaggtgaggcggggcgggg

SEQ ID NO: 51287 - DNA, 438 bp, Homo sapiens; identical to SEQ ID NO: 30494
  chr6:43237245-43237683
  hyper

SEQ ID NO: 51288 - DNA, 116 bp, Homo sapiens; identical to SEQ ID NO: 30495
  chr6:43242817-43242933
  hyper

SEQ ID NO: 51289 - DNA, 42 bp, Homo sapiens; identical to SEQ ID NO: 30496
  chr6:43243433-43243475
  hyper

SEQ ID NO: 51290 - DNA, 30 bp, Homo sapiens; identical to SEQ ID NO: 30497
  chr6:43244222-43244252
  hyper

SEQ ID NO: 51291 - DNA, 165 bp, Homo sapiens
  chr6:43613067-43613232
  hyper
gaggcccccgggacgggctccccagagggtggctacctggaggcagggcggggtgggcgggtcgcagcaattgaaaggggcggggcccatggggccaagggaggtgtgggcgggatctgagatgagtggaatgggggagaccctggggggcgggcctggggacgg

SEQ ID NO: 51292 - DNA, 30 bp, Homo sapiens; identical to SEQ ID NO: 30500
  chr6:44264917-44264947
  hyper

SEQ ID NO: 51293 - DNA, 66 bp, Homo sapiens; identical to SEQ ID NO: 30501
  chr6:44265201-44265267
  hyper

SEQ ID NO: 51294 - DNA, 238 bp, Homo sapiens; identical to SEQ ID NO: 30502
  chr6:44265569-44265807
  hyper

SEQ ID NO: 51295 - DNA, 60 bp, Homo sapiens; identical to SEQ ID NO: 30503
  chr6:45387578-45387638
  hyper

SEQ ID NO: 51296 - DNA, 260 bp, Homo sapiens; identical to SEQ ID NO: 30504
  chr6:45387838-45388098
  hyper

SEQ ID NO: 51297 - DNA, 38 bp, Homo sapiens; identical to SEQ ID NO: 30505
  chr6:45388359-45388397
  hyper

SEQ ID NO: 51298 - DNA, 30 bp, Homo sapiens; identical to SEQ ID NO: 30506
  chr6:45388792-45388822
  hyper

SEQ ID NO: 51299 - DNA, 408 bp, Homo sapiens; identical to SEQ ID NO: 30507
  chr6:45391133-45391541
  hyper

SEQ ID NO: 51300 - DNA, 178 bp, Homo sapiens; identical to SEQ ID NO: 30508
  chr6:45982792-45982970
  hyper

SEQ ID NO: 51301 - DNA, 30 bp, Homo sapiens; identical to SEQ ID NO: 30509
  chr6:45983617-45983647
  hyper

SEQ ID NO: 51302 - DNA, 105 bp, Homo sapiens; identical to SEQ ID NO: 30510
  chr6:46138639-46138744
  hyper

SEQ ID NO: 51303 - DNA, 388 bp, Homo sapiens; identical to SEQ ID NO: 19264
  chr6:46702594-46702982
  hyper

SEQ ID NO: 51304 - DNA, 227 bp, Homo sapiens; identical to SEQ ID NO: 19265
  chr6:46703123-46703350
  hyper

SEQ ID NO: 51305 - DNA, 89 bp, Homo sapiens; identical to SEQ ID NO: 19266
  chr6:46703436-46703525
  hyper

SEQ ID NO: 51306 - DNA, 192 bp, Homo sapiens; identical to SEQ ID NO: 30512
  chr6:49518808-49519000
  hyper

SEQ ID NO: 51307 - DNA, 9 bp, Homo sapiens
  chr6:50674363-50674372
  hyper
gttaccagg

SEQ ID NO: 51308 - DNA, 95 bp, Homo sapiens; identical to SEQ ID NO: 19268
  chr6:50681604-50681699
  hyper

SEQ ID NO: 51309 - DNA, 122 bp, Homo sapiens; identical to SEQ ID NO: 19269
  chr6:50681942-50682064
  hyper

SEQ ID NO: 51310 - DNA, 54 bp, Homo sapiens
  chr6:50682265-50682319
  hyper
agggagcaagttgaacgatttgcacagactggattttttaaaatatatggacaa

SEQ ID NO: 51311 - DNA, 211 bp, Homo sapiens; identical to SEQ ID NO: 19270
  chr6:50682448-50682659
  hyper

SEQ ID NO: 51312 - DNA, 14 bp, Homo sapiens
  chr6:50689899-50689913
  hyper
ctgcgtgctgactc

SEQ ID NO: 51313 - DNA, 49 bp, Homo sapiens; identical to SEQ ID NO: 8491
  chr6:50690631-50690680
  hyper

SEQ ID NO: 51314 - DNA, 294 bp, Homo sapiens
  chr6:50691789-50692083
  hyper
attaatatctgctgccgtggggggagaggtaacatggggggaggggtaacatgggggaggagggttaggaagggtgagaggctagagaggaagcagcagagaataattctccccacccaactcacaggcgcacctcgcagaaatgcaaccgcagaacaaacagggacaggaaactcttgtaatcgcttacacatttttaatgtgtcagaaaaaaaagagcgatcactggagatgaagaaggggagaagaaaaatccctgccgtttgtatttctttcatttgaattgtaaacatc

SEQ ID NO: 51315 - DNA, 31 bp, Homo sapiens; identical to SEQ ID NO: 19273
  chr6:50692481-50692512
  hyper

SEQ ID NO: 51316 - DNA, 49 bp, Homo sapiens
  chr6:50788352-50788401
  hyper
tccttaacaggcgggataatggtaaagtccaaggcgctagaactgtcct

SEQ ID NO: 51317 - DNA, 30 bp, Homo sapiens; identical to SEQ ID NO: 30525
  chr6:50789549-50789579
  hyper

SEQ ID NO: 51318 - DNA, 52 bp, Homo sapiens
  chr6:50791135-50791187
  hyper
tcccgagccacagctcgcggctctcccagctgggctcggtgtcccaaggacc

SEQ ID NO: 51319 - DNA, 247 bp, Homo sapiens
  chr6:50793404-50793651
  hyper
gctgtcgggaatacagaccacagaggtagagagctgaaaggagaaaagcagcaggcagcacaccggagccacttgcaggctctccactcacccaacccccaccctgttcctcccctgctttatctcatttcgtcacctgccgggaggcccacgggaccttcttgggacgacccctatagtgcaagggacacaccctgctcctgtccctagagggaaacagcaaagacagggacggtctctgcctccg

SEQ ID NO: 51320 - DNA, 47 bp, Homo sapiens
  chr6:50794693-50794740
  hyper
tgaatatcctgtacaaaaacccagcaggcggccgtaattagatagaa

SEQ ID NO: 51321 - DNA, 218 bp, Homo sapiens; identical to SEQ ID NO: 30530
  chr6:50798960-50799178
  hyper

SEQ ID NO: 51322 - DNA, 30 bp, Homo sapiens
  chr6:50803804-50803834
  hyper
aatgatgaataaagacggcttcctgggagg

SEQ ID NO: 51323 - DNA, 264 bp, Homo sapiens
  chr6:50803867-50804131
  hyper
cgtcccaggccgtttgtctctgctcagttcaacttcgaagtacaaagtaactgtgggagaagttcagagacggctgtcgccccctgaatgcctcaatgcatctctcctcggcggagtcctcagaaggtaaccccaccacgaaaaacaaaaacaaaaacaaaaaaacaaacaaaaacccaccagtttttatttattggacagtgaggagaaggttccagcaaaacccaatctgcagtctgacgcagttgcctagcaaccgggtgg

SEQ ID NO: 51324 - DNA, 30 bp, Homo sapiens; identical to SEQ ID NO: 30532
  chr6:50805801-50805831
  hyper

SEQ ID NO: 51325 - DNA, 47 bp, Homo sapiens
  chr6:50808634-50808681
  hyper
gcctgcagtgggcggcgctgcgtgcgcccgcacgtttctcttgcagg

SEQ ID NO: 51326 - DNA, 45 bp, Homo sapiens; identical to SEQ ID NO: 30536
  chr6:50811838-50811883
  hyper

SEQ ID NO: 51327 - DNA, 127 bp, Homo sapiens
  chr6:50817229-50817356
  hyper
attaaaaatagtgctggaaggaagacccgattatttttttatgaagccacattccttttcttcatttgcaaataacagttccgtagggtcccttcccagggaccctgggcgccgaagttaggggcca

SEQ ID NO: 51328 - DNA, 30 bp, Homo sapiens; identical to SEQ ID NO: 30540
  chr6:50817727-50817757
  hyper

SEQ ID NO: 51329 - DNA, 214 bp, Homo sapiens; identical to SEQ ID NO: 19278
  chr6:50818706-50818920
  hyper

SEQ ID NO: 51330 - DNA, 8 bp, Homo sapiens
  chr6:50819000-50819008
  hyper
tttggggg

SEQ ID NO: 51331 - DNA, 138 bp, Homo sapiens; identical to SEQ ID NO: 30542
  chr6:50819287-50819425
  hyper

SEQ ID NO: 51332 - DNA, 1 bp, Homo sapiens
  chr6:52227751-52227752
  hyper
t

SEQ ID NO: 51333 - DNA, 5 bp, Homo sapiens
  chr6:52227781-52227786
  hyper
tcgga

SEQ ID NO: 51334 - DNA, 235 bp, Homo sapiens
  chr6:55443946-55444181
  hyper
gcgcccctccggtgcactggctgtgaggaccagagctgttctgcgcactgcggcggcgccgagagggcggggagtggggcgtggcaggtggccgcgcctggggcagcgggtgcacggggcacctgcgggaatcgacagaaatgccgagcacctgaacaggagagaaaggagctgagccagaggatgtccaggggtgtctcattttccgcactacactgagcgcccagggctgact

SEQ ID NO: 51335 - DNA, 89 bp, Homo sapiens; identical to SEQ ID NO: 19281
  chr6:56112173-56112262
  hyper

SEQ ID NO: 51336 - DNA, 20 bp, Homo sapiens
  chr6:56112386-56112406
  hyper
ggaggcggagcccgggagat

SEQ ID NO: 51337 - DNA, 86 bp, Homo sapiens; identical to SEQ ID NO: 30547
  chr6:56708805-56708891
  hyper

SEQ ID NO: 51338 - DNA, 113 bp, Homo sapiens; identical to SEQ ID NO: 30548
  chr6:56716187-56716300
  hyper

SEQ ID NO: 51339 - DNA, 285 bp, Homo sapiens
  chr6:56716410-56716695
  hyper
aatgacacagaaaaagcattaacagcaaaatactcacatatgctcaatgatttaaacatctcccccaccaaccaccgccgccctccctgcccccaaactgggtctggcatatcctgcaccatcctcggagctgagggaatatgcagaaaccaaaaaaataaaacccggagctcaccatcttttcttggccaagtctccaatcgtaaaaacaatacacaggcagtttcaatacatgaagatttgcacggaagaagtgtgtggcctgtggtccggccaccagctcac

SEQ ID NO: 51340 - DNA, 280 bp, Homo sapiens; identical to SEQ ID NO: 19283
  chr6:56818937-56819217
  hyper

SEQ ID NO: 51341 - DNA, 8 bp, Homo sapiens
  chr6:56819637-56819645
  hyper
gatcctct

SEQ ID NO: 51342 - DNA, 82 bp, Homo sapiens; identical to SEQ ID NO: 30551
  chr6:56820782-56820864
  hyper

SEQ ID NO: 51343 - DNA, 19 bp, Homo sapiens
  chr6:58147428-58147447
  hyper
gaaaaccgcatctcccgaa

SEQ ID NO: 51344 - DNA, 31 bp, Homo sapiens; identical to SEQ ID NO: 19286
  chr6:58147480-58147511
  hyper

SEQ ID NO: 51345 - DNA, 28 bp, Homo sapiens
  chr6:58147762-58147790
  hyper
acaggcccggcggcggagccctgctccc

SEQ ID NO: 51346 - DNA, 30 bp, Homo sapiens; identical to SEQ ID NO: 30554
  chr6:58148921-58148951
  hyper

SEQ ID NO: 51347 - DNA, 26 bp, Homo sapiens
  chr6:58180231-58180257
  hyper
ccgcagccctggagccgggcagtgag

SEQ ID NO: 51348 - DNA, 68 bp, Homo sapiens; identical to SEQ ID NO: 19288
  chr6:62996146-62996214
  hyper

SEQ ID NO: 51349 - DNA, 228 bp, Homo sapiens
  chr6:62996215-62996443
  hyper
gtagcgcaagtcgggtggcctgactggcaggaggcagctgcagaggggaagggagctcggaagatgcaaacgctttcttcttgcgcccaagccttccctggctattaggcatgcccagttttgtggagttctctgtgtcttcagctaaggcgcagaggagagagagcgcgggaaaagcgcaggttaaagagagaggtctgagtacaagtggacaggggagatggagat

SEQ ID NO: 51350 - DNA, 152 bp, Homo sapiens
  chr6:62996489-62996641
  hyper
caggaaggtagatgggacttcacctgcgtccctaaggcacaggtgtctcctttccctcacacagctcaggcgcactccagttgtgcaggaatcagcagcgcactgggtctggaaatacaatgaagactgcatgtgatcggcagctggtattt

SEQ ID NO: 51351 - DNA, 326 bp, Homo sapiens; identical to SEQ ID NO: 30560
  chr6:69344323-69344649
  hyper

SEQ ID NO: 51352 - DNA, 461 bp, Homo sapiens; identical to SEQ ID NO: 30561
  chr6:69344978-69345439
  hyper

SEQ ID NO: 51353 - DNA, 32 bp, Homo sapiens; identical to SEQ ID NO: 30562
  chr6:69345820-69345852
  hyper

SEQ ID NO: 51354 - DNA, 370 bp, Homo sapiens; identical to SEQ ID NO: 30563
  chr6:69942843-69943213
  hyper

SEQ ID NO: 51355 - DNA, 38 bp, Homo sapiens; identical to SEQ ID NO: 30564
  chr6:70576959-70576997
  hyper

SEQ ID NO: 51356 - DNA, 30 bp, Homo sapiens; identical to SEQ ID NO: 30565
  chr6:70577378-70577408
  hyper

SEQ ID NO: 51357 - DNA, 86 bp, Homo sapiens; identical to SEQ ID NO: 30566
  chr6:70991963-70992049
  hyper

SEQ ID NO: 51358 - DNA, 55 bp, Homo sapiens
  chr6:70992162-70992217
  hyper
ctggactcggggttagtgcagctacggcgggctggaggagcgggagagggagcgt

SEQ ID NO: 51359 - DNA, 270 bp, Homo sapiens
  chr6:70992560-70992830
  hyper
tgcgcttgaaaaatgcaaacactccctgcccccaacttacctcgtcggtggtctggctgggctggagaagaaaagatggggagaaagtgagaaaagcacccctcaaactcgatcgcaacttacttgagccgcgcacaagcagagccccaacagcagcagccccagggccccgcggtcccgcgcagtccaggccatgcccgccgcccgccgctaatcccttggcccggctctgcagcctggttcccctctaggcttccagacccgccacta

SEQ ID NO: 51360 - DNA, 45 bp, Homo sapiens; identical to SEQ ID NO: 19293
  chr6:70993015-70993060
  hyper

SEQ ID NO: 51361 - DNA, 32 bp, Homo sapiens; identical to SEQ ID NO: 30569
  chr6:71665985-71666017
  hyper

SEQ ID NO: 51362 - DNA, 190 bp, Homo sapiens; identical to SEQ ID NO: 8524
  chr6:71666491-71666681
  hyper

SEQ ID NO: 51363 - DNA, 90 bp, Homo sapiens; identical to SEQ ID NO: 19295
  chr6:71666698-71666788
  hyper

SEQ ID NO: 51364 - DNA, 57 bp, Homo sapiens
  chr6:72129732-72129789
  hyper
aaccacttgagcccacggcgcctaaagccgactcacccgcagcccgaggtgcgggag

SEQ ID NO: 51365 - DNA, 21 bp, Homo sapiens
  chr6:72129829-72129850
  hyper
ccgcgctgcggccccggctga

SEQ ID NO: 51366 - DNA, 119 bp, Homo sapiens; identical to SEQ ID NO: 30573
  chr6:72129926-72130045
  hyper

SEQ ID NO: 51367 - DNA, 64 bp, Homo sapiens
  chr6:72596056-72596120
  hyper
cgactgtaggggtagcggccggggcacgcgtggctcggacccggggagtgggcgggtgggtgcc

SEQ ID NO: 51368 - DNA, 107 bp, Homo sapiens; identical to SEQ ID NO: 30577
  chr6:72596541-72596648
  hyper

SEQ ID NO: 51369 - DNA, 45 bp, Homo sapiens
  chr6:72596980-72597025
  hyper
ggaaggggctgccagggtgctgggtgcggacggaggcgcccgcct

SEQ ID NO: 51370 - DNA, 214 bp, Homo sapiens
  chr6:73330620-73330834
  hyper
gaaggccagaggctgcggccagtggcaccgtggcctctctctccgccaagggcgcataggctttgggccacccgggtgccaggggtggtggaagacccagtcagttgttccttgcaacaggtctctaagcttgtatgttacaacataaggtgggtggggtcggaaccccgaaaagccggcgtcctggacaccccatcctccaggtgttctttcc

SEQ ID NO: 51371 - DNA, 211 bp, Homo sapiens; identical to SEQ ID NO: 19301
  chr6:73331304-73331515
  hyper

SEQ ID NO: 51372 - DNA, 30 bp, Homo sapiens; identical to SEQ ID NO: 30584
  chr6:73972965-73972995
  hyper

SEQ ID NO: 51373 - DNA, 681 bp, Homo sapiens; identical to SEQ ID NO: 8540
  chr6:74019413-74020094
  hyper

SEQ ID NO: 51374 - DNA, 84 bp, Homo sapiens; identical to SEQ ID NO: 30586
  chr6:74161237-74161321
  hyper

SEQ ID NO: 51375 - DNA, 114 bp, Homo sapiens; identical to SEQ ID NO: 30587
  chr6:74161684-74161798
  hyper

SEQ ID NO: 51376 - DNA, 209 bp, Homo sapiens; identical to SEQ ID NO: 30588
  chr6:74161830-74162039
  hyper

SEQ ID NO: 51377 - DNA, 38 bp, Homo sapiens; identical to SEQ ID NO: 30589
  chr6:74405585-74405623
  hyper

SEQ ID NO: 51378 - DNA, 63 bp, Homo sapiens; identical to SEQ ID NO: 8541
  chr6:74405916-74405979
  hyper

SEQ ID NO: 51379 - DNA, 52 bp, Homo sapiens; identical to SEQ ID NO: 30591
  chr6:75914106-75914158
  hyper

SEQ ID NO: 51380 - DNA, 138 bp, Homo sapiens; identical to SEQ ID NO: 30592
  chr6:75914461-75914599
  hyper

SEQ ID NO: 51381 - DNA, 72 bp, Homo sapiens; identical to SEQ ID NO: 8543
  chr6:75915049-75915121
  hyper

SEQ ID NO: 51382 - DNA, 36 bp, Homo sapiens; identical to SEQ ID NO: 8544
  chr6:75915170-75915206
  hyper

SEQ ID NO: 51383 - DNA, 327 bp, Homo sapiens; identical to SEQ ID NO: 30595
  chr6:75915601-75915928
  hyper

SEQ ID NO: 51384 - DNA, 153 bp, Homo sapiens; identical to SEQ ID NO: 8546
  chr6:75916306-75916459
  hyper

SEQ ID NO: 51385 - DNA, 1 bp, Homo sapiens
  chr6:78172176-78172177
  hyper
g

SEQ ID NO: 51386 - DNA, 588 bp, Homo sapiens
  chr6:78172572-78173160
  hyper
ggcagcgagatagagatggagaagacccacaccagcgcgatcatgaccgccgccctcttgggagtccttttagctgagtactccacggcgtccgtgatggcccagtagcggtccagggcgatgacacagaggtgcaggatggaggcagtgcaacaagtgatgtccgacgacagccagaagtcacagaccacctggcccagtgtccagcggccggtgacagtgtacatggtgctgatgggcatcaccaggatggacacaagcaggtcggtgaccgccagagaggcgatcaggtagttagccggggtgtgcagtttccgggtccggtacactgtggcaatcacaaaggcattggagagcgtggtggccaaggtgatgagcgccaatagcataaccagcagtactttccagggtagggagatggagtcctggtaaatgtagtccttggcgctgcagttttgggagggagcagaggataagttggcttgaggaacccaggtctcggagcccgcgggcggcggtggagcgcactgagcacccggttcctccatggctctcctcgccccagctccggagcgcagctcttgggca

SEQ ID NO: 51387 - DNA, 234 bp, Homo sapiens; identical to SEQ ID NO: 30600
  chr6:78175915-78176149
  hyper

SEQ ID NO: 51388 - DNA, 13 bp, Homo sapiens
  chr6:78176445-78176458
  hyper
cctgggtcacccc

SEQ ID NO: 51389 - DNA, 14 bp, Homo sapiens
  chr6:78176820-78176834
  hyper
ggaggaaccaaaga

SEQ ID NO: 51390 - DNA, 27 bp, Homo sapiens
  chr6:79620315-79620342
  hyper
aagtgatatcaagcccgggcagaaggg

SEQ ID NO: 51391 - DNA, 178 bp, Homo sapiens
  chr6:79620699-79620877
  hyper
ttatcttgtgcggtgacgcccatgcctaggtcttgacacttccctcctatgccctttattgccaagggtcgggatggccttcgtgtcctctgcagcctccgccttccttctgctgccagcagctgtagattttacctctttcccctaacttcctctcaggctcctactccattcctat

SEQ ID NO: 51392 - DNA, 257 bp, Homo sapiens; identical to SEQ ID NO: 19312
  chr6:80656673-80656930
  hyper

SEQ ID NO: 51393 - DNA, 420 bp, Homo sapiens
  chr6:80657180-80657600
  hyper
ccaagcggaaggcgtcgtcaaggttcccgggagaaagacgaggaggtggaggaggcccagccgccagcacagtgcgctgcaccagtctgcagcctcgcgcagccgcccctccaatctcctcagccggcgtcacgtggccgcgcgcgggggcggggggccggccgcccctcctccctccctccctccctagtattgggactcgctggcgtagggatgctgcgctcaagggtgcgacgccaactgggctcgcgcaggcgcgcgccgtcgagcgggagcgggacacctgggctcctccttggcccctccccgcacaagtcgcctcattagccttccccgcccctgtcccgggcatcggcccctgcggaggagttcaccgcctccccacgggtgatttcttatccgccccggatacgtcctggg

SEQ ID NO: 51394 - DNA, 111 bp, Homo sapiens; identical to SEQ ID NO: 30607
  chr6:82461362-82461473
  hyper

SEQ ID NO: 51395 - DNA, 7 bp, Homo sapiens
  chr6:84417429-84417436
  hyper
attatgg

SEQ ID NO: 51396 - DNA, 23 bp, Homo sapiens
  chr6:84417908-84417931
  hyper
cgtgacaccgtccccattctccc

SEQ ID NO: 51397 - DNA, 363 bp, Homo sapiens
  chr6:84418281-84418644
  hyper
gccgaggcccatcgcccgggccccttccccccggttccaaatccctgccgcaggggccgcccgggagctctgcggaggcgccggagtcttggggcgcctcacccttcctggctttggagaggagccgggctgacagcgaagcccagtcccccgcccgccctggagcgctccgcggagctgtcactcggccgctgcccttctccgcaccctgggattatcctctgcggatccccgcgagaccctggcgcggggagggggccgagtacggccgcgggtactcaccccgcccctgagcggcgccgcccgccgcaggatgagcggagcccgggccgccgagggaagccgcgccggtggatgtgtgcg

SEQ ID NO: 51398 - DNA, 86 bp, Homo sapiens
  chr6:84419071-84419157
  hyper
gggccgcccctccgctgctggcgccgcacccggcacgcactgggctcgcgcaccacgcacacctgcccgccgactgcggggggagc

SEQ ID NO: 51399 - DNA, 101 bp, Homo sapiens
  chr6:84562772-84562873
  hyper
caaaacgtgtagactcgcttaattccatctcctcctggcctcttcacacggaaattggctgctcgggcgaatgttgtttttctccgcagccatgtgtcgaa

SEQ ID NO: 51400 - DNA, 43 bp, Homo sapiens; identical to SEQ ID NO: 19320
  chr6:84563242-84563285
  hyper

SEQ ID NO: 51401 - DNA, 73 bp, Homo sapiens; identical to SEQ ID NO: 19321
  chr6:84563416-84563489
  hyper

SEQ ID NO: 51402 - DNA, 311 bp, Homo sapiens; identical to SEQ ID NO: 19322
  chr6:84563542-84563853
  hyper

SEQ ID NO: 51403 - DNA, 39 bp, Homo sapiens; identical to SEQ ID NO: 30618
  chr6:85471957-85471996
  hyper

SEQ ID NO: 51404 - DNA, 52 bp, Homo sapiens
  chr6:85472355-85472407
  hyper
agggcagaggggtcccgggccgggccagggagcgcgccggagaccccttggg

SEQ ID NO: 51405 - DNA, 225 bp, Homo sapiens; identical to SEQ ID NO: 19325
  chr6:85473703-85473928
  hyper

SEQ ID NO: 51406 - DNA, 216 bp, Homo sapiens
  chr6:85474378-85474594
  hyper
cacccagacggccggccaatcaggaggcgccgactccgcgcagcccgcgcccacttccttacaaggtagcgaaaaaccaggagtgaaaagcgccgctgtctggcttggatgtgccagccacacggacgctgaactctgtctctctgacgtccgtagctgagtccagccccgtagtctccagctttcctcaccaggacctggaaaggcggaagttcc

SEQ ID NO: 51407 - DNA, 139 bp, Homo sapiens
  chr6:85477028-85477167
  hyper
gggcgtcgaatctctcttgggcatgggagggaaagacattccgagttggctgggcggagtggcagccttgagagtgacgagtgacagcaaagcctcgtcctagcaaggccttttaccaacagcgcggcatgccctttcg

SEQ ID NO: 51408 - DNA, 129 bp, Homo sapiens
  chr6:85482401-85482530
  hyper
agccaaattattccccgacggctccaatattgtgccagagtcccagagtcagttatttttatgtctgactgtatttcacatgtgcagggtgataaataaaatccgtctcaagctacaaactatctgagt

SEQ ID NO: 51409 - DNA, 36 bp, Homo sapiens
  chr6:85483309-85483345
  hyper
cggggagtcagggagcgcggaacgcgggtttctgtt

SEQ ID NO: 51410 - DNA, 149 bp, Homo sapiens
  chr6:85483375-85483524
  hyper
taagtgcacagtaagtgcgaagaataaatacatcatctcccggggcggctgtctcgaaaacgcctctcagctgcctgcgtttcagagcccgtcaagggttatagcttagtgtgggcgtccgcgccgcgcctgcgcctccgagcgccggc

SEQ ID NO: 51411 - DNA, 13 bp, Homo sapiens
  chr6:85484920-85484933
  hyper
agatagactaagt

SEQ ID NO: 51412 - DNA, 125 bp, Homo sapiens; identical to SEQ ID NO: 30627
  chr6:86159778-86159903
  hyper

SEQ ID NO: 51413 - DNA, 56 bp, Homo sapiens; identical to SEQ ID NO: 30628
  chr6:86160189-86160245
  hyper

SEQ ID NO: 51414 - DNA, 92 bp, Homo sapiens; identical to SEQ ID NO: 30629
  chr6:87647217-87647309
  hyper

SEQ ID NO: 51415 - DNA, 54 bp, Homo sapiens; identical to SEQ ID NO: 30630
  chr6:87647316-87647370
  hyper

SEQ ID NO: 51416 - DNA, 170 bp, Homo sapiens; identical to SEQ ID NO: 30631
  chr6:87647371-87647541
  hyper

SEQ ID NO: 51417 - DNA, 544 bp, Homo sapiens
  chr6:87861548-87862092
  hyper
agactccagcatccccggggtgggtttccggaggccccgctccccgccgcgccctggaaaggctccagaatctctcggcctggaggcccctggcggcctctgctcccaagcggggagtcgcagccaggctacagcgggcttgatcctcagtgctgggtggaaaaaccgcggcggcaaacgccgggcctgcaactgctgggtgtcggcgttgctggttcgcgggcggcggcggcggcggctccgcgacaacagaggacgcgagcaaccggcgcagcgcccagcagggccttggcggggtggaggggcgcaggctgggttagcggagcagagcggaccgatctggtgccctccgtggcccgaggcctgcggaccttctccgttctccggcccagggcgagagcggggcaagagacagcgccccgatagtggcgcacgctctccgccatccccgggcctcgcgctttcacctcgcgtgctggggcgagggcggggctgcggggtgtactgggtcgggggtaggaaggacctgccaggccttagccct

SEQ ID NO: 51418 - DNA, 133 bp, Homo sapiens; identical to SEQ ID NO: 30633
  chr6:88875382-88875515
  hyper

SEQ ID NO: 51419 - DNA, 509 bp, Homo sapiens; identical to SEQ ID NO: 30634
  chr6:88875729-88876238
  hyper

SEQ ID NO: 51420 - DNA, 193 bp, Homo sapiens; identical to SEQ ID NO: 30635
  chr6:88876284-88876477
  hyper

SEQ ID NO: 51421 - DNA, 111 bp, Homo sapiens; identical to SEQ ID NO: 2853
  chr6:88876630-88876741
  hyper

SEQ ID NO: 51422 - DNA, 221 bp, Homo sapiens; identical to SEQ ID NO: 19336
  chr6:88876742-88876963
  hyper

SEQ ID NO: 51423 - DNA, 46 bp, Homo sapiens; identical to SEQ ID NO: 30639
  chr6:88877474-88877520
  hyper

SEQ ID NO: 51424 - DNA, 30 bp, Homo sapiens; identical to SEQ ID NO: 30640
  chr6:90120876-90120906
  hyper

SEQ ID NO: 51425 - DNA, 340 bp, Homo sapiens; identical to SEQ ID NO: 30641
  chr6:90143378-90143718
  hyper

SEQ ID NO: 51426 - DNA, 399 bp, Homo sapiens; identical to SEQ ID NO: 30642
  chr6:91004780-91005179
  hyper

SEQ ID NO: 51427 - DNA, 106 bp, Homo sapiens; identical to SEQ ID NO: 8585
  chr6:91005208-91005314
  hyper

SEQ ID NO: 51428 - DNA, 631 bp, Homo sapiens
  chr6:91320318-91320949
  hyper
gattatgggggtgggggcggtttcttggggaggcctgggtctatggagtggaaaccaatctttgatgaatttggtcacaataacgaacacgggagaaaaaggagaattgaaaggaaatggattctgcgagagactggggagacaaaaccaagaggaaaaacacagaatcaaaaacgacaggaaacactagagaagagtaggcagaaaatagagaagaggaagaaacgagtcggacggagacggggccgggcactgggagcttgaggctgggtctccatccttcctttcatcctctcgggagcccgcagagacggcggcttcagtctcgctttacgggtgggaaagcagcgaccttgagaggttaggtgactgctcaaggtcaccgagctaagtgccagagccaggattctcaccgctcctcaccccagatcggggctccggccagaccacgctggccgccgggggagaggacgcgcggggcgggcagagcgcggccgggggccgggaaggagccggcgccaggcgcgcgcggaggaggcggccgggcggggagccatttcctccccaagcaacggcgcttttcaggggcgcgaccgggaagcctctcttggcgtcccttccccagccgcag

SEQ ID NO: 51429 - DNA, 247 bp, Homo sapiens; identical to SEQ ID NO: 30645
  chr6:94126366-94126613
  hyper

SEQ ID NO: 51430 - DNA, 331 bp, Homo sapiens
  chr6:94126642-94126973
  hyper
cgccaagcatccattacgcctctgccagacctgggcactccagggagccggtggcgccctcgctcgagaaggagtcgggaagaggagagtggctttcgggaagaggagagtggctttcgggaagcatctcctctgaggaagaggcggcggcggcggcggcatttacggagagaaaaagtaagcagctgcactttgccttcaagcgtcagactctgacacgcgctccctgtagcgatgataactgaccaacccgagagaacgtgcacaaggaaagtgagggaagggggtttcttatcttcctctagccacccccaaatgccccaggaggccc

SEQ ID NO: 51431 - DNA, 2 bp, Homo sapiens
  chr6:94127064-94127066
  hyper
gc

SEQ ID NO: 51432 - DNA, 46 bp, Homo sapiens; identical to SEQ ID NO: 30647
  chr6:94127085-94127131
  hyper

SEQ ID NO: 51433 - DNA, 355 bp, Homo sapiens
  chr6:94127544-94127899
  hyper
gggttcagcatctatacaggttgcagatgtggaaagtggggtcagaaggtcaggctgaaagaaggactagaatttggcgccgggtttgaggggggcttgagcgaactaagaggagtgcacgatgagaataaagaaaaggtgcactaagttttcagaaatagatgaatcaaggacctatatgtaagtcccctcaacaccccgcccgataaccaccatgacctaaatttcataacagattcctctccctctacacatcaggaataagtaattatttctcttctgcttttaacagatcgaaaaatgaaacttagatacacagcctgaaagaccaggggggcgacgggatgaggggggt

SEQ ID NO: 51434 - DNA, 310 bp, Homo sapiens; identical to SEQ ID NO: 30649
  chr6:94128439-94128749
  hyper

SEQ ID NO: 51435 - DNA, 52 bp, Homo sapiens
  chr6:94129167-94129219
  hyper
ccccttctcggtccccgatcggctgctccacgtttagctttttttaatttcc

SEQ ID NO: 51436 - DNA, 149 bp, Homo sapiens; identical to SEQ ID NO: 19348
  chr6:94129257-94129406
  hyper

SEQ ID NO: 51437 - DNA, 32 bp, Homo sapiens; identical to SEQ ID NO: 8594
  chr6:94129782-94129814
  hyper

SEQ ID NO: 51438 - DNA, 395 bp, Homo sapiens; identical to SEQ ID NO: 30652
  chr6:96463220-96463615
  hyper

SEQ ID NO: 51439 - DNA, 18 bp, Homo sapiens
  chr6:96464082-96464100
  hyper
ggaccggtgagtaggcgg

SEQ ID NO: 51440 - DNA, 30 bp, Homo sapiens; identical to SEQ ID NO: 30654
  chr6:96464463-96464493
  hyper

SEQ ID NO: 51441 - DNA, 32 bp, Homo sapiens; identical to SEQ ID NO: 30655
  chr6:99271691-99271723
  hyper

SEQ ID NO: 51442 - DNA, 52 bp, Homo sapiens
  chr6:99272810-99272862
  hyper
cccgccacctcctccaccccccgccccgcattccccccggggcgaccctccc

SEQ ID NO: 51443 - DNA, 189 bp, Homo sapiens
  chr6:99273410-99273599
  hyper
gtgggaggaggtactgctcccccctactcctcccttttccctgctccctctccatcagcaacaggttgtcaagttgaggagacatcccctccaaactctctcactccccacttgtggccgaggcctgccctgtgttcatcccagacagtcaggcagacgctgagctgtccgcgtcggcgtgggcgcctg

SEQ ID NO: 51444 - DNA, 53 bp, Homo sapiens; identical to SEQ ID NO: 30658
  chr6:99273848-99273901
  hyper

SEQ ID NO: 51445 - DNA, 30 bp, Homo sapiens; identical to SEQ ID NO: 30659
  chr6:99275545-99275575
  hyper

SEQ ID NO: 51446 - DNA, 30 bp, Homo sapiens; identical to SEQ ID NO: 30660
  chr6:99276704-99276734
  hyper

SEQ ID NO: 51447 - DNA, 72 bp, Homo sapiens
  chr6:99277330-99277402
  hyper
aagccaccaattgtctcctgttctgtttctgagatttttgttctgtttctgagatttcgtataaacaagcta

SEQ ID NO: 51448 - DNA, 201 bp, Homo sapiens; identical to SEQ ID NO: 30663
  chr6:99278897-99279098
  hyper

SEQ ID NO: 51449 - DNA, 206 bp, Homo sapiens
  chr6:99279350-99279556
  hyper
agaatggcaggcagacgcgcggactctgccctgacagggtcagcccaaagaatgggccccagagcccggggcgggggaggaaccggtggagaggccccagtctggacctaaaaccagcgagagctcaggtttcgggagccccgaagaggtgccgcgctgggaggcagacaaggaagcccagggtgctcggaacccggcgttcgcgc

SEQ ID NO: 51450 - DNA, 183 bp, Homo sapiens
  chr6:99279612-99279795
  hyper
ctcagagccgcggtgcgagcccagcctggcccgcccggtgattggccgcgcttgggggtgggggtggggtgcagagactgaggccccgggtaggctatttctttgtgtactcccggggatttattgggtatattaaaccctgttgggaacgtttcggctccttggccgccagcgaaatgagac

SEQ ID NO: 51451 - DNA, 240 bp, Homo sapiens; identical to SEQ ID NO: 30665
  chr6:99279796-99280036
  hyper

SEQ ID NO: 51452 - DNA, 60 bp, Homo sapiens
  chr6:99280497-99280557
  hyper
ctagcagcccccaggcgcgcggccagagtggccccgcgcttgcgctgggacggagcgaca

SEQ ID NO: 51453 - DNA, 93 bp, Homo sapiens; identical to SEQ ID NO: 19354
  chr6:99281385-99281478
  hyper

SEQ ID NO: 51454 - DNA, 37 bp, Homo sapiens; identical to SEQ ID NO: 30669
  chr6:99281946-99281983
  hyper

SEQ ID NO: 51455 - DNA, 95 bp, Homo sapiens; identical to SEQ ID NO: 8605
  chr6:99282778-99282873
  hyper

SEQ ID NO: 51456 - DNA, 170 bp, Homo sapiens
  chr6:99283342-99283512
  hyper
cggcatgctgggcgccggcgggcagccggccggtctgcaccaccacggcctgcgggacgcgcacgacgagccacaccatgccgaccaccacccgcacccgcactcgcacccacaccagcagccgccgcccccgccgcccccgcagggtccgcctggccacccaggcgcgc

SEQ ID NO: 51457 - DNA, 48 bp, Homo sapiens; identical to SEQ ID NO: 30672
  chr6:99283978-99284026
  hyper

SEQ ID NO: 51458 - DNA, 30 bp, Homo sapiens; identical to SEQ ID NO: 30673
  chr6:99284652-99284682
  hyper

SEQ ID NO: 51459 - DNA, 29 bp, Homo sapiens
  chr6:99290331-99290360
  hyper
gtaccttggccttgccgcgcaccccccac

SEQ ID NO: 51460 - DNA, 75 bp, Homo sapiens; identical to SEQ ID NO: 19357
  chr6:99290398-99290473
  hyper

SEQ ID NO: 51461 - DNA, 15 bp, Homo sapiens
  chr6:99291682-99291697
  hyper
tggcctctgcaggct

SEQ ID NO: 51462 - DNA, 15 bp, Homo sapiens
  chr6:99291729-99291744
  hyper
cgcccgcggccactc

SEQ ID NO: 51463 - DNA, 104 bp, Homo sapiens; identical to SEQ ID NO: 19358
  chr6:99292417-99292521
  hyper

SEQ ID NO: 51464 - DNA, 44 bp, Homo sapiens
  chr6:99296467-99296511
  hyper
gctgtggctgcctgagacctccagggcagcgcacattacgggcg

SEQ ID NO: 51465 - DNA, 30 bp, Homo sapiens; identical to SEQ ID NO: 30682
  chr6:100036662-100036692
  hyper

SEQ ID NO: 51466 - DNA, 110 bp, Homo sapiens; identical to SEQ ID NO: 30683
  chr6:100036959-100037069
  hyper

SEQ ID NO: 51467 - DNA, 42 bp, Homo sapiens
  chr6:100038640-100038682
  hyper
tgccttccttcccctcgtcgccttcctcccactgtgcgagct

SEQ ID NO: 51468 - DNA, 190 bp, Homo sapiens; identical to SEQ ID NO: 19360
  chr6:100038964-100039154
  hyper

SEQ ID NO: 51469 - DNA, 37 bp, Homo sapiens; identical to SEQ ID NO: 30687
  chr6:100050390-100050427
  hyper

SEQ ID NO: 51470 - DNA, 128 bp, Homo sapiens
  chr6:100051971-100052099
  hyper
gataaaaaaaaaaaaaaagccgagtggaatgttttgattgagtctcaacattgtctttgaataaggctgagaccatgtaattaatgtgtctttttaataagggacaatacggccgttcaagctattta

SEQ ID NO: 51471 - DNA, 107 bp, Homo sapiens; identical to SEQ ID NO: 30692
  chr6:100052482-100052589
  hyper

SEQ ID NO: 51472 - DNA, 27 bp, Homo sapiens
  chr6:100054839-100054866
  hyper
tccagctctgtcactcgcgcccttcca

SEQ ID NO: 51473 - DNA, 315 bp, Homo sapiens
  chr6:100054917-100055232
  hyper
gagccgccagagcgccagccaccagcgtgagtgccgactgctgcatcccggccggcttgcgcctcggaccggtgcctggtaccttcaagctgggcaagtacctgtcagaccgcagggagcccgggcctaagaaaaaggtattgaccattcagacctctgcccactgccattcgcctctcagtgccctgacccgggaaaggggtacgagagaaagtggaggaagggagtgattgagtcgttacctgctaattctgccgggtggaaggggactcctattattctgagcaagtagcctctttaactgtgagagctgga

SEQ ID NO: 51474 - DNA, 64 bp, Homo sapiens; identical to SEQ ID NO: 30695
  chr6:100055269-100055333
  hyper

SEQ ID NO: 51475 - DNA, 36 bp, Homo sapiens; identical to SEQ ID NO: 30696
  chr6:100055566-100055602
  hyper

SEQ ID NO: 51476 - DNA, 26 bp, Homo sapiens
  chr6:100060996-100061022
  hyper
cagcggcggtggaggcggcgccttcc

SEQ ID NO: 51477 - DNA, 235 bp, Homo sapiens; identical to SEQ ID NO: 19363
  chr6:100061076-100061311
  hyper

SEQ ID NO: 51478 - DNA, 278 bp, Homo sapiens
  chr6:100061419-100061697
  hyper
ggcggcggccgctcacggcgacccctaccgggaggagagcagcagcaagcaaggagccggcctcgctttgggcaggctgctgggcgggggccgggcgtgcgggcgccccgggagcggggagaactcggcggcgggcggcgcgggtcaccaccatcaccaccacgcgcaccaccaccaccatcccaagtgcctgctcgctggggacccgccgccgccgccgccgcctggcctgccctgctctggggccctgcgcggcttccctctgctctccgtccccc

SEQ ID NO: 51479 - DNA, 190 bp, Homo sapiens; identical to SEQ ID NO: 19365
  chr6:100061988-100062178
  hyper

SEQ ID NO: 51480 - DNA, 84 bp, Homo sapiens; identical to SEQ ID NO: 19366
  chr6:100062586-100062670
  hyper

SEQ ID NO: 51481 - DNA, 42 bp, Homo sapiens
  chr6:100062902-100062944
  hyper
gagctcaccctgaaccgcccaggcggtctgctcttggtgttc

SEQ ID NO: 51482 - DNA, 20 bp, Homo sapiens
  chr6:100063068-100063088
  hyper
tttcacgttagcatttcatt

SEQ ID NO: 51483 - DNA, 196 bp, Homo sapiens; identical to SEQ ID NO: 30700
  chr6:100066823-100067019
  hyper

SEQ ID NO: 51484 - DNA, 283 bp, Homo sapiens; identical to SEQ ID NO: 30701
  chr6:100067144-100067427
  hyper

SEQ ID NO: 51485 - DNA, 2 bp, Homo sapiens
  chr6:100441306-100441308
  hyper
cg

SEQ ID NO: 51486 - DNA, 199 bp, Homo sapiens
  chr6:100441966-100442165
  hyper
caggttgggagccagccccacctccatttccaaagcgggggtccaggcacaggaacagccaaacgcccgaaccagcggggttacctttgccacttcatccaatccgagcatcgggtgcgtcgtgctcttttctaggagcgtggggtgccttcgcgaataaaatctgaaggcatctctgctctcgcggagcttgttcttt

SEQ ID NO: 51487 - DNA, 169 bp, Homo sapiens; identical to SEQ ID NO: 30705
  chr6:100729528-100729697
  hyper

SEQ ID NO: 51488 - DNA, 37 bp, Homo sapiens
  chr6:100903347-100903384
  hyper
caacctattctccttcgtttctgtcacgacctgctct

SEQ ID NO: 51489 - DNA, 150 bp, Homo sapiens
  chr6:100903631-100903781
  hyper
ctcgcgcggttcccgaagggtgcgaagactgcgctgagcattttgaaggcctcccaaagcggctggaagacaccccgaagcggcctcccaaccagaatgatctgaaaatcccccaggctgggctcgggataaatactagttctgaactcc

SEQ ID NO: 51490 - DNA, 382 bp, Homo sapiens
  chr6:100903832-100904214
  hyper
cgcctacgagggaaaatgagacttccccacaggttaataaacaacctgtccggcacaggttaacaggagcctctctcgccctctcctgccccacccccgccaccttttaaggaagcttttgccttcccggaggtttgccttctctttctgttccccgtagaaatcttacgattgtgtctgggttaatgttttataagggactggctactctcgtctacctgccgggctttcccgatctaatatcgaaggaacctccccaagtcctagtaaggggtcccccctccctaaagtctcgaagtggggtagagaccttctccctggagcccctcgcctcctgccttcggtgacgcgctctagcacacccaatttcagttggcgaggg

SEQ ID NO: 51491 - DNA, 167 bp, Homo sapiens
  chr6:100904275-100904442
  hyper
tgtctgtttaaaatgaggaggaaaccagctccctttgcggcgggattacagtgggaacaagatctaaagattctcttgcaattcggcgaggccgagggaacggggttttgcaaaagagaaaaggagctctgtgagggaggcgataactaaatcgggttttagacaaa

SEQ ID NO: 51492 - DNA, 76 bp, Homo sapiens; identical to SEQ ID NO: 30709
  chr6:100905783-100905859
  hyper

SEQ ID NO: 51493 - DNA, 50 bp, Homo sapiens
  chr6:100905919-100905969
  hyper
ctctctctctctctctctctctctctctgccttcgcggagctccagccct

SEQ ID NO: 51494 - DNA, 151 bp, Homo sapiens
  chr6:100906016-100906167
  hyper
gcccgagttggagccagccgcgaaaagacggcagaaacccaaggagggcggggttcggccagactaaaactgggggcgaaattcatgcagcgttcatgagacagtcctgcgtgacggccgaaaaacgtcaatcgatgtcgccctgggactc

SEQ ID NO: 51495 - DNA, 302 bp, Homo sapiens
  chr6:100912119-100912421
  hyper
cgcacgtcccaggaaagcaggtttccgcaaatcagaattcctccaaggcgaggcaggggcctttcagctccctaccttggcagatctggaccttggctacctctttaacttgggtctcaagtctgagggattcctcaaaaagtgacacttacacaccaagtctctcgggactcccaaggcgacccagcgctctggctgcccagcaggggctgcaacaagcggggcccagcagcgccaggttaacaggtggcgcgctcgcgacagcccctcgcaggctcccccgggggtgggaggcgccgcgg

SEQ ID NO: 51496 - DNA, 109 bp, Homo sapiens
  chr6:100912480-100912589
  hyper
ttcacctaccttcagtccccacaagcggcagaggtttcgggggcgcccatctcttaactgttctcatgcctaccgtccaacccagcgacaccgccggcctctccgcttc

SEQ ID NO: 51497 - DNA, 29 bp, Homo sapiens
  chr6:100912890-100912919
  hyper
cggccaggggcgaggcgctcattggccaa

SEQ ID NO: 51498 - DNA, 30 bp, Homo sapiens; identical to SEQ ID NO: 30714
  chr6:100914823-100914853
  hyper

SEQ ID NO: 51499 - DNA, 30 bp, Homo sapiens; identical to SEQ ID NO: 8634
  chr6:100915720-100915750
  hyper

SEQ ID NO: 51500 - DNA, 100 bp, Homo sapiens; identical to SEQ ID NO: 30716
  chr6:100917210-100917310
  hyper

SEQ ID NO: 51501 - DNA, 1154 bp, Homo sapiens
  chr6:101840820-101841974
  hyper
gagaggggagtctgctatttaaggcgccatacatacacagagacagcccgcccgacctcctaacactcaggaaaagtcaatttccaagcatctgttctcaataatggtggcagggagcagggcactgtgactcccagcatctgagggaatacccgcagcagcgctaccagagcgcatttgctctatgcgctggaggtcggggtgggagggtgcgcagatcaagatctttttttgcgaacctcagggaaatgaccgtagttggactaagaggtccactttggagactaccagcagccctccaagccctggcagtggagaagtttcgttgctatggtttcggagaggcataaaagccatcacccagaagcaaatgtgtttgggctccttatatgtgttgtcaccacccaaggctaggcaaattcctcggcgctttgcatgcatcactcactccctgacagagcatcttggccttagtctccccatcccaggaggcgggtgtgcgctaagggagcgaagtccagccggaggcttcgtaacatccaagtctagggacaccaggaattctctcgctctagctcctgtggtccaggggtgggagatgcccccgagtggccgcggcggccaggagcgtgcaggggccacggggaaaggagcgcggcgcctttaaagcaagaggcgaggaacccccgccaggaggcgtgtctgtctctgccgccgccgccgccgctgctgctcctcggtcaccgtcttcgccgctgccgtcactcgcgctcggcgccggcggctgcgctggtcggtctggtagctggggacttttccgcccgacctcctccggctgctcctccccgaggaccaccccaccccctccccgcccacctcacccctagctccaggtaaggactccccggctgtgggctgcactccgggctccttcacgaggtgtttgttttcaagaggacgggagggactgcgggtgggcgaggggcattttccacctggagagaaggaagaaggcgaacagtagcgctgcggacgtccgtgcgctcggggcgcccgctggacggattcactgcgagtctttgtcgggcttatctcagccaattcccgtcaagcatgcaagtggctctgttggctgcagtcgcctatgttctcca

SEQ ID NO: 51502 - DNA, 162 bp, Homo sapiens
  chr6:101849985-101850147
  hyper
gtgaggggcagcccccgcttagagtgctgaacccttgccacgtccctcgcctcccccgcccgtcttcagcgtgcgcaaccctcttccccgcgcttccctctccctctctgtatggcacacacaataacacacacatacacacacacacattctctcacacac

SEQ ID NO: 51503 - DNA, 15 bp, Homo sapiens
  chr6:101850524-101850539
  hyper
tcctgggtgcccacc

SEQ ID NO: 51504 - DNA, 155 bp, Homo sapiens
  chr6:105401007-105401162
  hyper
agagatcttgccaggggcagagagagatcccgaaaatcgcccccagccttgcgtccagccctttctcgccgacgttttttcttgatcctccgaaggcccagggcgacgtttgccatcgcggcttcccgaaaggacggcgccgggtttgctggaag

SEQ ID NO: 51505 - DNA, 39 bp, Homo sapiens
  chr6:105401581-105401620
  hyper
tggggtctcaggtctcggccgcctggggagcgacctgcc

SEQ ID NO: 51506 - DNA, 55 bp, Homo sapiens; identical to SEQ ID NO: 19379
  chr6:105404519-105404574
  hyper

SEQ ID NO: 51507 - DNA, 30 bp, Homo sapiens; identical to SEQ ID NO: 30724
  chr6:105404921-105404951
  hyper

SEQ ID NO: 51508 - DNA, 80 bp, Homo sapiens
  chr6:105405576-105405656
  hyper
tttcctcctcgtgcccgccggagagaatagtttcgctgaaaatttctctttgtcaatgggatcagtattaaatcagcaat

SEQ ID NO: 51509 - DNA, 326 bp, Homo sapiens
  chr6:105405772-105406098
  hyper
gcttccccctcccccgctttccttttaacccttttcattttaagtattttctgtggagaaaagaaatcaaaccattaaaaaaaattttttttttctgttacccttcccccccaaccccaggcaggcaattttttttttttaatctttgaatgcacattgaatgggaatacagactgacttttttgtcctgttccttctcaggcggggctagcaaaggtggtggagaagagcccgggaagctgccggagccggcagaggaggaatcccaggttttgcgcggaactggccactgtaagtggttcaatgtgcgcatgggatttggattc

SEQ ID NO: 51510 - DNA, 337 bp, Homo sapiens
  chr6:105406128-105406465
  hyper
ttggatattccagtcgatgtatttgtacaccaagtaagccaaacttttttgtccccctcttcatctttttccatgtggaggagctgatcggtagttatgccaatagacgtacgataagatgtccttcggtatattgaaagacaaaatcttccctgaaatcactaggtagtccaacgtttagggtacgtgtatgggccttttcctgggttttctgtctaaagagaaaagaaaatatttgaaatttcactatatatattaaggttgacgttattagcatttccccctgcttcattctacagcgaaatagtgttcttgttgtttccggtattacctatac

SEQ ID NO: 51511 - DNA, 139 bp, Homo sapiens; identical to SEQ ID NO: 30726
  chr6:105584077-105584216
  hyper

SEQ ID NO: 51512 - DNA, 47 bp, Homo sapiens; identical to SEQ ID NO: 19383
  chr6:105584217-105584264
  hyper

SEQ ID NO: 51513 - DNA, 34 bp, Homo sapiens
  chr6:105585554-105585588
  hyper
ggggtcaggcctcctgctgcggaggaagaggggg

SEQ ID NO: 51514 - DNA, 709 bp, Homo sapiens; identical to SEQ ID NO: 30730
  chr6:105627368-105628077
  hyper

SEQ ID NO: 51515 - DNA, 46 bp, Homo sapiens
  chr6:106429003-106429049
  hyper
aaactgctatgaattcggtgactgtgcaatgaaattgtcaattatc

SEQ ID NO: 51516 - DNA, 127 bp, Homo sapiens; identical to SEQ ID NO: 30733
  chr6:106434152-106434279
  hyper

SEQ ID NO: 51517 - DNA, 56 bp, Homo sapiens
  chr6:106441813-106441869
  hyper
aatgaattgcagagtcggatacagctaatttgggggaatgtaagctggatgtcttt

SEQ ID NO: 51518 - DNA, 141 bp, Homo sapiens; identical to SEQ ID NO: 19387
  chr6:106442979-106443120
  hyper

SEQ ID NO: 51519 - DNA, 69 bp, Homo sapiens; identical to SEQ ID NO: 30735
  chr6:106809115-106809184
  hyper

SEQ ID NO: 51520 - DNA, 97 bp, Homo sapiens; identical to SEQ ID NO: 30736
  chr6:106958240-106958337
  hyper

SEQ ID NO: 51521 - DNA, 83 bp, Homo sapiens; identical to SEQ ID NO: 30737
  chr6:106960311-106960394
  hyper

SEQ ID NO: 51522 - DNA, 241 bp, Homo sapiens
  chr6:106960667-106960908
  hyper
gcggggaggaggcggcgcgggccatcccccgcgagctcccggtcaagagcagctcgctgctgccggagatcaagcccgagcacaagaggggcccgctccccaaccacttcaacggccgggcagagggaggtcgaagcagagagctgggcagagcggccggagcgcctggagcttctgacgccgacggcttgaagcccaggaaccatttcggcgtgggcaggtcgacagtgaccactaaagt

SEQ ID NO: 51523 - DNA, 77 bp, Homo sapiens; identical to SEQ ID NO: 30739
  chr6:107809976-107810053
  hyper

SEQ ID NO: 51524 - DNA, 133 bp, Homo sapiens
  chr6:108434942-108435075
  hyper
tggtcagcccaagggcgagatgcgcctcggggtcggagtcgcccgagtggagactggacactccatgggggaggctggaaccccctgtgccacagataaatgctcgttctccaccacatgtgaggcatttgaa

SEQ ID NO: 51525 - DNA, 261 bp, Homo sapiens; identical to SEQ ID NO: 19390
  chr6:108436526-108436787
  hyper

SEQ ID NO: 51526 - DNA, 33 bp, Homo sapiens; identical to SEQ ID NO: 30742
  chr6:108438124-108438157
  hyper

SEQ ID NO: 51527 - DNA, 98 bp, Homo sapiens; identical to SEQ ID NO: 30744
  chr6:108438779-108438877
  hyper

SEQ ID NO: 51528 - DNA, 596 bp, Homo sapiens
  chr6:108439495-108440091
  hyper
gtagcagaaaggaatcgaggcccccgtccataatcgcaggtgtcggcgtggaaaggagccacgcgtgcacactcatgggtctcaccgcgcgggcttccgcggcccggcaagccgctgcgcctgcctcgccggcggcccacggagcccgtccgcgcttgccctgcacacctgcgcccgcgcgaggacccagccgccgaggccgtgcgcccgccgggctgcgggggccgtgggcagggggcgcagggggcgcagggggcggccggcgcggcggctgaacccgggctgacgaggcccagccgcctgcggggcccggagcgggaggtaccggctaggggcgcgtttctttcgcatccacaccccgcccccacccctctctccagggattttttttttttttttttttgtatccaggcacagctgggggctccctcaccacccacccctggcctccccatacagaataaagtcagtctgtatttaatggttatggcggatgtgagggggatttggcagaggcagaagagaggcctttcgctctcaaatatcgtcccttacgtcgtgtgagtctaccaacccaccacgacctcatattcttg

SEQ ID NO: 51529 - DNA, 6 bp, Homo sapiens
  chr6:108440961-108440967
  hyper
ctggtg

SEQ ID NO: 51530 - DNA, 484 bp, Homo sapiens
  chr6:108478806-108479290
  hyper
gtggggaatcttggccgcggccccctcccccgccttataaaaaagaaattgacttttgtttggagtttgtgaaaagtggggctcggggcccagtcaatggggcgccccgcggcgcgggctgagtggagctagcgcgaaccgctcagccgcggccccaattaatccgccctttgtgcggcccgcccggccgcccccgccgcagccgcaccagcggcccattgttcggcctcgccgggccgcgggatttacccttttcaaacagccggttttgtccagggcagttcgagcggaagtttctcactgacaatttgccccaaatagatagatttgtcagaagcgaccttcgggaaggaagcaaaaagccaccggcccgaaggttgggcccaaaacagggactctgcgtcccacccgcggccgcgccgcccccccgcgcccccggccctgcagtcccgaagccccgcgggggtccagaccactgcacctg

SEQ ID NO: 51531 - DNA, 31 bp, Homo sapiens; identical to SEQ ID NO: 19396
  chr6:108479665-108479696
  hyper

SEQ ID NO: 51532 - DNA, 37 bp, Homo sapiens; identical to SEQ ID NO: 19397
  chr6:108484872-108484909
  hyper

SEQ ID NO: 51533 - DNA, 152 bp, Homo sapiens; identical to SEQ ID NO: 19398
  chr6:108485513-108485665
  hyper

SEQ ID NO: 51534 - DNA, 102 bp, Homo sapiens; identical to SEQ ID NO: 19399
  chr6:108485905-108486007
  hyper

SEQ ID NO: 51535 - DNA, 150 bp, Homo sapiens; identical to SEQ ID NO: 19400
  chr6:108486008-108486158
  hyper

SEQ ID NO: 51536 - DNA, 70 bp, Homo sapiens
  chr6:108486394-108486464
  hyper
cagcgccgcgcacagagcaaggcgcgagagagctcaggaatcgcgggaaggcaagcggaatggggagggg

SEQ ID NO: 51537 - DNA, 160 bp, Homo sapiens; identical to SEQ ID NO: 30751
  chr6:108486846-108487006
  hyper

SEQ ID NO: 51538 - DNA, 9 bp, Homo sapiens
  chr6:108487077-108487086
  hyper
cgcctgcat

SEQ ID NO: 51539 - DNA, 63 bp, Homo sapiens; identical to SEQ ID NO: 30753
  chr6:108487419-108487482
  hyper

SEQ ID NO: 51540 - DNA, 110 bp, Homo sapiens
  chr6:108488416-108488526
  hyper
atgctttgcaccccgtttctagctatttcaaataatcctgcaaactgggaagcagaaacaatttaaaagtcacattttccttaatcctaaatccgcgtaggtcataactg

SEQ ID NO: 51541 - DNA, 345 bp, Homo sapiens
  chr6:108490633-108490978
  hyper
gaaaaagagaccccaccactgctcctcccactcactcatcttggcatcttcaacagtgccacagggaagaggacagctggggtgacagtactgctgggccccaaacgtggaccctggagcggtcagagggcgcgtgttaagcagaggatggttgtaagatatggaaaccaagtttaccgcttccagagtgagtgcagtgcagcggagctccagacccggttcctgagcgaccaggaactcccttgggcgcagtgacaggcccgaaggagtggaggacaagacccgctgtgcccttgcctggccctctccagcccctccctcccacagcacaatctcccctcccgc

SEQ ID NO: 51542 - DNA, 19 bp, Homo sapiens
  chr6:108492251-108492270
  hyper
tcaagtttgtctcctcgcg

SEQ ID NO: 51543 - DNA, 90 bp, Homo sapiens; identical to SEQ ID NO: 19405
  chr6:108492451-108492541
  hyper

SEQ ID NO: 51544 - DNA, 42 bp, Homo sapiens
  chr6:108495639-108495681
  hyper
tctctggggccaagtcgctgtcttcggtcctgaagtctcgtc

SEQ ID NO: 51545 - DNA, 257 bp, Homo sapiens; identical to SEQ ID NO: 19406
  chr6:108495951-108496208
  hyper

SEQ ID NO: 51546 - DNA, 173 bp, Homo sapiens; identical to SEQ ID NO: 30763
  chr6:108497294-108497467
  hyper

SEQ ID NO: 51547 - DNA, 185 bp, Homo sapiens; identical to SEQ ID NO: 30764
  chr6:110299509-110299694
  hyper

SEQ ID NO: 51548 - DNA, 30 bp, Homo sapiens; identical to SEQ ID NO: 30765
  chr6:110299948-110299978
  hyper

SEQ ID NO: 51549 - DNA, 232 bp, Homo sapiens
  chr6:110678891-110679123
  hyper
cggagcctagaagggcgcccggccacggcgacccccaagtactggctgaatagtgaatgaactccgcttggccgcacttcagtctatctgggcactgaaagatgcgacccgtggagccgcctaagagagcacagggggaagagaagaagcggaagcctccggaggtcccatcgaggcggcctgcgggacctgagcgccgggctccgtagcgcggtcgggagggggcttctgg

SEQ ID NO: 51550 - DNA, 285 bp, Homo sapiens
  chr6:110679414-110679699
  hyper
ccccgagtagacaccggcgcaggacgccgcagcccctcccgggcggcctctcccgggccatggcgctacactcggggtcccgcgggccgcgcctggccggcagcagggatgtagccccacaggccggagcggccaactgtgggaactcccccgcgggccggggtgcgggctcggacccgcctccctccctcccgaccgaggaagccccggcgtaaccttatcctgccctgccgagcgcgccccgccgctggaacggtggtgggccgaacgcggtcacagggggcc

SEQ ID NO: 51551 - DNA, 188 bp, Homo sapiens
  chr6:110797490-110797678
  hyper
tccgagcgagcccagcgcctctgctcaccatgccaggtcccgctgccagaggcctagaggagaagcccagctaggggccggcgtctggacgcccgtgtcccgactgcgcggggtgaggaggaagtggagatgttttcggatcgcgagcgccgcgcgagaaccccgccgcaacggaaagaaacagaccc

SEQ ID NO: 51552 - DNA, 12 bp, Homo sapiens
  chr6:110797708-110797720
  hyper
ggcccctccccc

SEQ ID NO: 51553 - DNA, 217 bp, Homo sapiens; identical to SEQ ID NO: 30769
  chr6:111409641-111409858
  hyper

SEQ ID NO: 51554 - DNA, 167 bp, Homo sapiens; identical to SEQ ID NO: 30770
  chr6:114663194-114663361
  hyper

SEQ ID NO: 51555 - DNA, 37 bp, Homo sapiens; identical to SEQ ID NO: 30771
  chr6:114663777-114663814
  hyper

SEQ ID NO: 51556 - DNA, 53 bp, Homo sapiens; identical to SEQ ID NO: 30772
  chr6:116783514-116783567
  hyper

SEQ ID NO: 51557 - DNA, 48 bp, Homo sapiens; identical to SEQ ID NO: 30773
  chr6:116937976-116938024
  hyper

SEQ ID NO: 51558 - DNA, 10 bp, Homo sapiens
  chr6:117086239-117086249
  hyper
gaaggtgggt

SEQ ID NO: 51559 - DNA, 32 bp, Homo sapiens; identical to SEQ ID NO: 30776
  chr6:117197673-117197705
  hyper

SEQ ID NO: 51560 - DNA, 4 bp, Homo sapiens
  chr6:117198217-117198221
  hyper
gaaa

SEQ ID NO: 51561 - DNA, 30 bp, Homo sapiens; identical to SEQ ID NO: 30778
  chr6:117198544-117198574
  hyper

SEQ ID NO: 51562 - DNA, 85 bp, Homo sapiens
  chr6:117585882-117585967
  hyper
gaaaagccagacatccgaggccgggtaaagcctcctggactcctcgaaagcagctcacaccgggagcagccggaagcgggcgcga

SEQ ID NO: 51563 - DNA, 194 bp, Homo sapiens
  chr6:117586004-117586198
  hyper
aagagaaaggagcaggatcgaactttagaggggcagaagggcacggcccaagagagcagaattggggtgtgggacaggcggcgggaggaccaggttagagggagcgaaaggaagtggattagaggacagcggttacaggtttcagccactgccatttccccgcagaggtagctcttctgcgccctggaggggta

SEQ ID NO: 51564 - DNA, 243 bp, Homo sapiens; identical to SEQ ID NO: 30780
  chr6:117586401-117586644
  hyper

SEQ ID NO: 51565 - DNA, 121 bp, Homo sapiens
  chr6:117587169-117587290
  hyper
gtgcaattagctaacccctttagctcgcctgtttgctctcgggaagcagctaagccctgctaatgtgagcctaggtcttccctggaataatcagaggaagatggcacgggctggattttct

SEQ ID NO: 51566 - DNA, 71 bp, Homo sapiens
  chr6:117587577-117587648
  hyper
ttttcctttgcgaagttctgggagcattatccggagtgcgaatgacccggcagaggcgagcctgatagaca

SEQ ID NO: 51567 - DNA, 205 bp, Homo sapiens; identical to SEQ ID NO: 19416
  chr6:117591206-117591411
  hyper

SEQ ID NO: 51568 - DNA, 107 bp, Homo sapiens
  chr6:117591743-117591850
  hyper
tccttctggaatagcgcgtaccaggcgccagtgcccccgccgctgggcagccctctggccaccgcgcactcggagctgcccttcgccgccgccgacccctactcgcc

SEQ ID NO: 51569 - DNA, 72 bp, Homo sapiens; identical to SEQ ID NO: 30785
  chr6:117592066-117592138
  hyper

SEQ ID NO: 51570 - DNA, 58 bp, Homo sapiens
  chr6:118228044-118228102
  hyper
tttgggtttctaatccggggccggcacctgtctcggcgtcctgccgctgtcccaggcc

SEQ ID NO: 51571 - DNA, 81 bp, Homo sapiens; identical to SEQ ID NO: 19419
  chr6:118228151-118228232
  hyper

SEQ ID NO: 51572 - DNA, 424 bp, Homo sapiens
  chr6:118228323-118228747
  hyper
cgcccgcgccccgctctgccgccgccgccgccgccgccgccgccgccgccggcgcccccgcccggctctccgggttcaccctcggtctctcactccgtgagacacagacggtagctttccgaccgagcggggcacaggctgaggcggcgccagcacaactgccgccgcgcgccccgaggagacccgggcacgaggaaacaaggagaaatcaggactccttccccggaaccgaccggcagctccgcgcccccgcgcgacacccttcgcagccacttcgcggggcgggccaggacttggggacgcggctcgggaagagccggggcgggcggcggcggcggcggcacgggcgcgagggtgcgcgcactgggactggagaggagtgagtggcgggctgggcggcggcggccgtagccgcgggtgcctc

SEQ ID NO: 51573 - DNA, 41 bp, Homo sapiens; identical to SEQ ID NO: 19421
  chr6:118228828-118228869
  hyper

SEQ ID NO: 51574 - DNA, 284 bp, Homo sapiens; identical to SEQ ID NO: 19422
  chr6:118228870-118229154
  hyper

SEQ ID NO: 51575 - DNA, 7 bp, Homo sapiens
  chr6:118229383-118229390
  hyper
tccctct

SEQ ID NO: 51576 - DNA, 32 bp, Homo sapiens
  chr6:118229818-118229850
  hyper
atgaggacctgggttgacgtgaaaatgggggt

SEQ ID NO: 51577 - DNA, 223 bp, Homo sapiens
  chr6:118241005-118241228
  hyper
tcagcccaggagctccgcggtacctgtggttcctgaaagagagtttgacaggcttcaggaaagggttagtgcctcttgaactggggagattacaaaacgagcgtgggcctaaaaggctccacagaggcaggcagcgggatggatagagcggctcagagggaagggacagagccgctttaatgtgctaatgaggggaagcccagatgccagcgggctcagtgga

SEQ ID NO: 51578 - DNA, 128 bp, Homo sapiens; identical to SEQ ID NO: 30792
  chr6:119399076-119399204
  hyper

SEQ ID NO: 51579 - DNA, 51 bp, Homo sapiens
  chr6:121758621-121758672
  hyper
gttcctgaaacttcccgagaatgaggcggggcggctcaaggggaaagggca

SEQ ID NO: 51580 - DNA, 250 bp, Homo sapiens; identical to SEQ ID NO: 30794
  chr6:122932220-122932470
  hyper

SEQ ID NO: 51581 - DNA, 114 bp, Homo sapiens; identical to SEQ ID NO: 30795
  chr6:123316893-123317007
  hyper

SEQ ID NO: 51582 - DNA, 125 bp, Homo sapiens; identical to SEQ ID NO: 19427
  chr6:123317589-123317714
  hyper

SEQ ID NO: 51583 - DNA, 82 bp, Homo sapiens; identical to SEQ ID NO: 19428
  chr6:123317715-123317797
  hyper

SEQ ID NO: 51584 - DNA, 38 bp, Homo sapiens; identical to SEQ ID NO: 19429
  chr6:123317833-123317871
  hyper

SEQ ID NO: 51585 - DNA, 139 bp, Homo sapiens
  chr6:124124293-124124432
  hyper
gccactcgggctttccggccgctctggatgcctcggttgcacccctgttccatgaccccagcttccttccctaaccctcctcttggtcccttctcccccgagcgcgcgcgcacacacacactcggttcgctcccgcgga

SEQ ID NO: 51586 - DNA, 394 bp, Homo sapiens
  chr6:124124466-124124860
  hyper
aaaccgcggtcatgccgcccagactcctcgccccgaggccccggtccccgccgccgccgctttcgcgccgctcctttccgcctagacaccgccgcctgcggccgcctgggcggcagcccctgcggtcctcaaagttggccccctgggagggggcggcagggagcaggatgaaggatttgttgtaggaggaggattcacacatctgggcgaagggaggggcagcgccgctgctgggacgcggcgcggacccgcatcattgcgcgcagcagccgctgcagcagccgccggggaccgcggagccgggacgcccccgctcggcccgcgccccgctccccgccccacccccgcccgccgggcccagcaacgcagggtgcctaggagccgcgggctgcgc

SEQ ID NO: 51587 - DNA, 61 bp, Homo sapiens; identical to SEQ ID NO: 30799
  chr6:125282732-125282793
  hyper

SEQ ID NO: 51588 - DNA, 269 bp, Homo sapiens; identical to SEQ ID NO: 8704
  chr6:125283133-125283402
  hyper

SEQ ID NO: 51589 - DNA, 206 bp, Homo sapiens; identical to SEQ ID NO: 19434
  chr6:125283925-125284131
  hyper

SEQ ID NO: 51590 - DNA, 200 bp, Homo sapiens; identical to SEQ ID NO: 30802
  chr6:125420809-125421009
  hyper

SEQ ID NO: 51591 - DNA, 43 bp, Homo sapiens; identical to SEQ ID NO: 30803
  chr6:125475547-125475590
  hyper

SEQ ID NO: 51592 - DNA, 168 bp, Homo sapiens; identical to SEQ ID NO: 30804
  chr6:125684529-125684697
  hyper

SEQ ID NO: 51593 - DNA, 15 bp, Homo sapiens
  chr6:126068007-126068022
  hyper
ctaagccttcccttt

SEQ ID NO: 51594 - DNA, 24 bp, Homo sapiens
  chr6:126068068-126068092
  hyper
cgttccctcattctttctcttttc

SEQ ID NO: 51595 - DNA, 782 bp, Homo sapiens; identical to SEQ ID NO: 30807
  chr6:126068793-126069575
  hyper

SEQ ID NO: 51596 - DNA, 137 bp, Homo sapiens; identical to SEQ ID NO: 30808
  chr6:126069805-126069942
  hyper

SEQ ID NO: 51597 - DNA, 86 bp, Homo sapiens; identical to SEQ ID NO: 30809
  chr6:126071232-126071318
  hyper

SEQ ID NO: 51598 - DNA, 83 bp, Homo sapiens; identical to SEQ ID NO: 30810
  chr6:127439190-127439273
  hyper

SEQ ID NO: 51599 - DNA, 58 bp, Homo sapiens; identical to SEQ ID NO: 19443
  chr6:127439321-127439379
  hyper

SEQ ID NO: 51600 - DNA, 34 bp, Homo sapiens; identical to SEQ ID NO: 19444
  chr6:127439453-127439487
  hyper

SEQ ID NO: 51601 - DNA, 202 bp, Homo sapiens
  chr6:127439783-127439985
  hyper
cctatgtggtgctcccgggagcccagcccaacactggagcgtctcctgctcgcgcacgccagaagcagctcggggtctctccgccgccccttggccatggccgctgtgccgacggcgcccgctcccctgcgctccaggggcccccgccgctgcagccgcagccgccgcagcttctgagcccaaggggccgccgctgcagccg

SEQ ID NO: 51602 - DNA, 204 bp, Homo sapiens
  chr6:127440127-127440331
  hyper
ggataatttgaaagtacaatagttggtttccctgtccacccgccccacttcgcttgccatcacagcacgcctatcggatgtgagaggagaagtcccgctgctcgggcactgtctatatacgcctaacacctacatatattttaaaaacattaaatataattaacaatcaaaagaaagaggagaaaggaagggaagcattactgg

SEQ ID NO: 51603 - DNA, 431 bp, Homo sapiens; identical to SEQ ID NO: 19447
  chr6:127441123-127441554
  hyper

SEQ ID NO: 51604 - DNA, 259 bp, Homo sapiens
  chr6:127441762-127442021
  hyper
gtttgtccctgccctgcccctgggcatgagggtcccctgaaagctccctttgtattgctggcctcggccagacaaggtttgattcacctgaaaattgccttttaaaaaggtggcagtgccagagcgacaggggccctggccgggcctcaccgcctttaggatcacctagcagggggcaggagagcccaaactaaatatgtcagggcatccgatttattattcttggcctccgaatggtgtgtactctggtaactcccca

SEQ ID NO: 51605 - DNA, 175 bp, Homo sapiens; identical to SEQ ID NO: 19448
  chr6:127442104-127442279
  hyper

SEQ ID NO: 51606 - DNA, 50 bp, Homo sapiens; identical to SEQ ID NO: 30816
  chr6:127442649-127442699
  hyper

SEQ ID NO: 51607 - DNA, 30 bp, Homo sapiens; identical to SEQ ID NO: 30817
  chr6:127836173-127836203
  hyper

SEQ ID NO: 51608 - DNA, 907 bp, Homo sapiens; identical to SEQ ID NO: 30818
  chr6:127836715-127837622
  hyper

SEQ ID NO: 51609 - DNA, 15 bp, Homo sapiens
  chr6:127839806-127839821
  hyper
tattgtgcctttctg

SEQ ID NO: 51610 - DNA, 68 bp, Homo sapiens; identical to SEQ ID NO: 30820
  chr6:127839929-127839997
  hyper

SEQ ID NO: 51611 - DNA, 145 bp, Homo sapiens
  chr6:127840356-127840501
  hyper
gctttgtcctgggttcggtcattctccatcaattatttacttgagcttcttttccaaggaggcggactagaacagccttccgggcgtgactaacatctcctgatgcagctggctggcggctgctgggagttctctttgttcactc

SEQ ID NO: 51612 - DNA, 12 bp, Homo sapiens
  chr6:127840681-127840693
  hyper
cccacagagatc

SEQ ID NO: 51613 - DNA, 99 bp, Homo sapiens
  chr6:129204360-129204459
  hyper
cgagaagtggatccggtcgcggccactacgatgccgggagccgccggggtcctcctccttctgctgctctccggaggcctcgggggcgtacaggcgcag

SEQ ID NO: 51614 - DNA, 112 bp, Homo sapiens
  chr6:129204524-129204636
  hyper
ggttgcatcctttgccgggaccgagattcctcacttcttccactcttccgagagttgctgtctgtggactgccgtcttgcttcgccttcagagagtgcgctctggggcaaga

SEQ ID NO: 51615 - DNA, 30 bp, Homo sapiens; identical to SEQ ID NO: 30823
  chr6:130088257-130088287
  hyper

SEQ ID NO: 51616 - DNA, 55 bp, Homo sapiens; identical to SEQ ID NO: 30824
  chr6:130339629-130339684
  hyper

SEQ ID NO: 51617 - DNA, 127 bp, Homo sapiens
  chr6:130686407-130686534
  hyper
ttggagtcgaacatccgcactgctcatcgaagacccccgtgcttcagttccctctgtcttccatttcccccgcccatggttctcgcccccccaagccgttctccggaaccccttgccgggccggcgg

SEQ ID NO: 51618 - DNA, 136 bp, Homo sapiens; identical to SEQ ID NO: 19453
  chr6:130687057-130687193
  hyper

SEQ ID NO: 51619 - DNA, 625 bp, Homo sapiens; identical to SEQ ID NO: 30826
  chr6:130687224-130687849
  hyper

SEQ ID NO: 51620 - DNA, 30 bp, Homo sapiens; identical to SEQ ID NO: 30827
  chr6:131602928-131602958
  hyper

SEQ ID NO: 51621 - DNA, 30 bp, Homo sapiens; identical to SEQ ID NO: 30828
  chr6:132271740-132271770
  hyper

SEQ ID NO: 51622 - DNA, 820 bp, Homo sapiens
  chr6:132722196-132723016
  hyper
tgagagagagctgcgggccccggggacgacccgcacctgcgccctctctggggtccggacgggaccgggctcggccgggcgggctccgggaggagacgcgcttacctggaggtagggccgcccgtgggccaccccgcccacgacgatgtcggcggacgccatggccccggtgggcgagaagccgaagcccacgtagcctgcagtgcgcacctggaggcggaaggcgatctggctgccccgctggctccagcccagccagtacttgccctccgagtccaggagggtccggtgcggataggttcggcccgagccccccgccgccgtcccggggagcagcccccacagcaggagcagcggccagcagcacatcctcgggcgcctcctgcccgccggtaccggcctccagccgctggggagtgaggagcagaacgaggagcggcagcggcggcgagcgggagcccagggaccgcccctcgggccggccgcgcgcccgcccgggaggggcaggacccgctctccccgccccgggccgcctgcagggcgcgccgcgtcccgtccggtcccgtcccgttccgtcccgtcgggtcccagccccgccaactctcaccctgcccggcccttccagcggatccacttgcagcccccgacccctgacttggtccccgaggtcggggctcggtgggaaggaaagcgaggggcttcccggaaagaaagggaggaggaggcaggaggaggcagacgccgagagaggagaaaaggaggccagaggcagagggaaaaggaggagggcaagagaatcctagagcgggaagagcgtggg

SEQ ID NO: 51623 - DNA, 198 bp, Homo sapiens
  chr6:133562070-133562268
  hyper
agaagcaggtggggatcgacagtggctctccggcccagggaggagagcgcggtcgcgggtccctcccctcagcctggaggctgcagccgctcgagtcggcccgggtgggggcggggtgggggcggcgcggagggcacggagattacggcggcgccacccgggacatccagggccccgaggccctgggcggtccccacg

SEQ ID NO: 51624 - DNA, 26 bp, Homo sapiens
  chr6:133562348-133562374
  hyper
cgcgtccctggcggcctcccccgagg

SEQ ID NO: 51625 - DNA, 37 bp, Homo sapiens
  chr6:133563058-133563095
  hyper
cttggaggccgggtgccccacgcctgagggcccgggc

SEQ ID NO: 51626 - DNA, 170 bp, Homo sapiens
  chr6:133563157-133563327
  hyper
cgagcctgcctgtcccttccggggtcggcgcggagcctgcgcgtaacggagttcatccagcagtccagcgcgcggcttctacctgcaccccgcctccacctggcagaggcgcgagcatcggggtctcccccacatctttcttatgacgtgtattactttctgatgacccc

SEQ ID NO: 51627 - DNA, 184 bp, Homo sapiens
  chr6:133563918-133564102
  hyper
gtcatctcttccctgcttgggaggatagtgtttcccttcaccaccacccctctttctccttcctatgaagacaacggatttgcgcctggggtgagagtgtgtgcgggagagtggtgtggagactgtcctctctcaccgcgtctcctgcgcctctccccgccatcccgagcgggcctagagagtc

SEQ ID NO: 51628 - DNA, 46 bp, Homo sapiens; identical to SEQ ID NO: 30835
  chr6:134175969-134176015
  hyper

SEQ ID NO: 51629 - DNA, 76 bp, Homo sapiens; identical to SEQ ID NO: 30838
  chr6:134212320-134212396
  hyper

SEQ ID NO: 51630 - DNA, 97 bp, Homo sapiens; identical to SEQ ID NO: 8736
  chr6:134216904-134217001
  hyper

SEQ ID NO: 51631 - DNA, 91 bp, Homo sapiens; identical to SEQ ID NO: 30841
  chr6:134217370-134217461
  hyper

SEQ ID NO: 51632 - DNA, 299 bp, Homo sapiens; identical to SEQ ID NO: 30842
  chr6:134499553-134499852
  hyper

SEQ ID NO: 51633 - DNA, 224 bp, Homo sapiens
  chr6:134638726-134638950
  hyper
gctcagttcttcactcgcgcattctgcagcaccagctactgcagcaacctctccccactttcagttgccaccgacagcggcttttctccttccatcattgctccgaaacatatgcatcaccgctgcaggaccctgggggccggacggtgggatacggccaatctccggggagatgctgtggctcttaccgagcgggagaagggtacgcctccccgcccccagct

SEQ ID NO: 51634 - DNA, 110 bp, Homo sapiens
  chr6:137241818-137241928
  hyper
ctttggctgaagtgtcgcgttcagcacagaggtggaagtaagaggcagaaaacagaagaaccacgagagaaatggatcctgtctattaaggcaacgtgatgcagcgctaa

SEQ ID NO: 51635 - DNA, 395 bp, Homo sapiens
  chr6:137242205-137242600
  hyper
tctccaaaattagaattccctttttctcttagtcatataggaaacacacagttcacaagtcctgtggtgcaaaggtgtgaaccctggcccagggaggtggtgactctccccgccctccgcctgccggttgtcctgcttccgaaagcaacccacgacggtcccgcagggtgagggttccctgggatcagttccctgggatccggagaacgccacgcggagtctccctgcagggtgaggggccccgggttcccgccccctccccctctactctcccattctgcgagcgcagccagcctcccctcccacgcttcgggaagcgtcgcccccgagctcctcggttcctggtggtggctactcgtgttagtgacttcgtttctgcgcgtttgcttattttc

SEQ ID NO: 51636 - DNA, 259 bp, Homo sapiens
  chr6:137242949-137243208
  hyper
gctgcagcgccggggcgagggggctgggggcgccgtcacttgttgcgaccaataaacggcgctcgatcctgatgcgctgtttctaaaatctttagctgtgtcccgatccctccaacccaagcccctcggccaggaggaaggggcaagcgagagccgctggctctgtggggggagaggggcgccgcgccccaagagcccccgtcccgccctgcggcagccgccccggggcgcccagccgcccgcttccctccgcagagcg

SEQ ID NO: 51637 - DNA, 68 bp, Homo sapiens; identical to SEQ ID NO: 30847
  chr6:137243566-137243634
  hyper

SEQ ID NO: 51638 - DNA, 275 bp, Homo sapiens
  chr6:137243839-137244114
  hyper
acgctctggtccctgcgcggcctcagcctgcccatgtacgtggtcttcaagcgctgcctgcccctggtcaccatgctcatcggcgtcctggtgctcaagaacggcgcgccctcgccaggggtgctggcggcggtgctcatcaccacctgcggcgccgccctggcaggtgagcgggcccccgcgccgacccccagccgaccccacccaccccgctccgtcgggcagagaccgcggggatcactgagttcaacgacctcacttccagatggggagac

SEQ ID NO: 51639 - DNA, 67 bp, Homo sapiens; identical to SEQ ID NO: 30850
  chr6:137310875-137310942
  hyper

SEQ ID NO: 51640 - DNA, 126 bp, Homo sapiens; identical to SEQ ID NO: 30852
  chr6:137808768-137808894
  hyper

SEQ ID NO: 51641 - DNA, 141 bp, Homo sapiens
  chr6:137809000-137809141
  hyper
cgaggaaaagaggggtcttactcaagtcagggccggacagaactccaaaacttacgaggacagctatccaacactgcctcacagacccttaggcgctgccccctctttgcccctgtcctcctgcggtgcgagaaacccgac

SEQ ID NO: 51642 - DNA, 36 bp, Homo sapiens
  chr6:137811088-137811124
  hyper
gtgggcttctcaaggtgtctccgcccaggaggattt

SEQ ID NO: 51643 - DNA, 100 bp, Homo sapiens; identical to SEQ ID NO: 30856
  chr6:137813941-137814041
  hyper

SEQ ID NO: 51644 - DNA, 264 bp, Homo sapiens
  chr6:137814340-137814604
  hyper
agatctctcagacagcgtgggaggctgcgggccccggagcctgccctcccgtgggccgagcgtgcagcctccctcttccctcccggcccggcaccgcggcccctcccgccgctctccctcctccttggcagccgggcccgcccgctgctcacttgagcaagtccttggactcggccgacagccgggccatgttggctgtggagagagcggacaggtgcggcggcggcggcatctggcagatggtgcaggggcagggcagaccag

SEQ ID NO: 51645 - DNA, 245 bp, Homo sapiens
  chr6:137814763-137815008
  hyper
gcaccgggtgcacggagttggccgcgtgcgcggggtggccggccgagtggcccacggtcccgcagtgaaaggccgagtggtggcccccatagatctcgccaaccagcctcttcatctcctccagggagctggtgagcatgaggatgtagtttctggcgagcaggagtgtggcgatcttggagagcttgcgcaccgacggcccatgcgcgtagggcatgacttcgcgcagcccgtccatggctagg

SEQ ID NO: 51646 - DNA, 289 bp, Homo sapiens
  chr6:137815662-137815951
  hyper
tttagcaaggattcctattcatattcattgtggggccgccctgggacacctctgctccgaaccgctaggagcccccaggcacaaaaccctctgattgacacactcaccgctccagcttacgccttcctgattttttttttaactttcttccaccccaccccccttcccaatttctctaaccaaatcacacatcaggaacggaaggaaggcaagagaaggtggccaggcggttggtggaggttcctctgagtttggagagaggaattgaaacattcgctctcctttcttt

SEQ ID NO: 51647 - DNA, 13 bp, Homo sapiens
  chr6:137816459-137816472
  hyper
cttcctggacctt

SEQ ID NO: 51648 - DNA, 148 bp, Homo sapiens; identical to SEQ ID NO: 30861
  chr6:137817618-137817766
  hyper

SEQ ID NO: 51649 - DNA, 443 bp, Homo sapiens
  chr6:137818062-137818505
  hyper
gggtagagcagccctcgaaatacaagcttgcggggctggaagtccggggccagggttctgggagtccaaaccagaagccactctccttcagcacagcctttcagccgagagggggctgacgcctgccgcagccggttccgagggggctgcgatgggccgggaaggggcgactgggcctttgcccgaacagaccaggacattcccttccttcttccctaagggttttcagctccagtaacagaggtgcctgaaatgggagatctgcggggaccaggccgggactccctggctccgaggccgggacgtggcgcgccctccgctcctcggtcaccctctgctttttcgaaggtccgtaatgcgtgagtgtgggtggtccaaggttcagggcctccttccagtaagtacttttagaagctagttcccccacttcccatccgttgcgg

SEQ ID NO: 51650 - DNA, 180 bp, Homo sapiens; identical to SEQ ID NO: 19472
  chr6:137819368-137819548
  hyper

SEQ ID NO: 51651 - DNA, 45 bp, Homo sapiens; identical to SEQ ID NO: 30865
  chr6:142409847-142409892
  hyper

SEQ ID NO: 51652 - DNA, 109 bp, Homo sapiens; identical to SEQ ID NO: 30866
  chr6:143247641-143247750
  hyper

SEQ ID NO: 51653 - DNA, 91 bp, Homo sapiens; identical to SEQ ID NO: 30867
  chr6:146349205-146349296
  hyper

SEQ ID NO: 51654 - DNA, 148 bp, Homo sapiens; identical to SEQ ID NO: 8761
  chr6:146349536-146349684
  hyper

SEQ ID NO: 51655 - DNA, 107 bp, Homo sapiens
  chr6:146755460-146755567
  hyper
cagcaacttcagtaccgcgatcccggattttcacgcggtgctggcaggccccggtggtcccgggaacgggctgcggtccctgtacccgcccccgccacctccgcagc

SEQ ID NO: 51656 - DNA, 12 bp, Homo sapiens
  chr6:146755649-146755661
  hyper
gaggtttaagct

SEQ ID NO: 51657 - DNA, 42 bp, Homo sapiens; identical to SEQ ID NO: 30870
  chr6:146864466-146864508
  hyper

SEQ ID NO: 51658 - DNA, 116 bp, Homo sapiens; identical to SEQ ID NO: 30871
  chr6:146864762-146864878
  hyper

SEQ ID NO: 51659 - DNA, 30 bp, Homo sapiens; identical to SEQ ID NO: 30872
  chr6:147829471-147829501
  hyper

SEQ ID NO: 51660 - DNA, 32 bp, Homo sapiens; identical to SEQ ID NO: 30873
  chr6:148663762-148663794
  hyper

SEQ ID NO: 51661 - DNA, 41 bp, Homo sapiens; identical to SEQ ID NO: 30874
  chr6:148664007-148664048
  hyper

SEQ ID NO: 51662 - DNA, 303 bp, Homo sapiens; identical to SEQ ID NO: 30875
  chr6:149069188-149069491
  hyper

SEQ ID NO: 51663 - DNA, 111 bp, Homo sapiens; identical to SEQ ID NO: 30876
  chr6:150284700-150284811
  hyper

SEQ ID NO: 51664 - DNA, 1 bp, Homo sapiens
  chr6:150285055-150285056
  hyper
g

SEQ ID NO: 51665 - DNA, 30 bp, Homo sapiens; identical to SEQ ID NO: 30880
  chr6:150310175-150310205
  hyper

SEQ ID NO: 51666 - DNA, 324 bp, Homo sapiens; identical to SEQ ID NO: 30881
  chr6:150311072-150311396
  hyper

SEQ ID NO: 51667 - DNA, 258 bp, Homo sapiens; identical to SEQ ID NO: 30882
  chr6:150311819-150312077
  hyper

SEQ ID NO: 51668 - DNA, 40 bp, Homo sapiens; identical to SEQ ID NO: 30883
  chr6:150312743-150312783
  hyper

SEQ ID NO: 51669 - DNA, 90 bp, Homo sapiens
  chr6:150358880-150358970
  hyper
cctctccgagttctgcgcgctcctcccagggcgcccgctgtccccgagctctggacccgggtcctgcccagtggagaccgcggagttggt

SEQ ID NO: 51670 - DNA, 15 bp, Homo sapiens
  chr6:150359438-150359453
  hyper
cgggagaaagggaga

SEQ ID NO: 51671 - DNA, 21 bp, Homo sapiens
  chr6:151560995-151561016
  hyper
tccctgctcttgccacgtgag

SEQ ID NO: 51672 - DNA, 135 bp, Homo sapiens; identical to SEQ ID NO: 19482
  chr6:151561857-151561992
  hyper

SEQ ID NO: 51673 - DNA, 10 bp, Homo sapiens
  chr6:151562056-151562066
  hyper
cgcggcgggg

SEQ ID NO: 51674 - DNA, 81 bp, Homo sapiens
  chr6:151814974-151815055
  hyper
tcccaccgggaggaccgaccgttatccccgccgactccccccaggtcgccctggcagtttcggccgctcagttgcaggccc

SEQ ID NO: 51675 - DNA, 522 bp, Homo sapiens
  chr6:151815089-151815611
  hyper
caccccggcctcctgcggccgggccaccctactcgcgcgcagccgcgcgccgccgcgtccccgcggtgtttacccgttgcccgaggagacacccgcgccacccgccggctcccggcgccgccgcttcctcagggccggttccgggtccgagcgcgcccccgggctcgggtcgtcatgagcctggactgcaccagccatatcgcgctgggtgccgcttcgccagcgcccgaggtacggtcccagccgccggccgcgcgcgggggtggccctggggatagacgacccaggaggggccgaggcgcccctgatttgcacccttttcctcccggaggcgtgggcagaatcagagcagctctgtgcccgcgagggctgtggcctgggactgccagggcgctgatttcaggaggggatgggcaggaccggagtttgcggagcgcgtctgaattttaggttgtgccactctgcttctctgaccatttaaaccggtgacattcgaaagactgtggccgggcagttcctccc

SEQ ID NO: 51676 - DNA, 101 bp, Homo sapiens
  chr6:152622914-152623015
  hyper
ccctgaaatcagccacggagagggaacatggagccactcgccaggctccagtcaaagagcaaagccgcggggacccactggatccttaccatgaccacaga

SEQ ID NO: 51677 - DNA, 293 bp, Homo sapiens; identical to SEQ ID NO: 30892
  chr6:152957488-152957781
  hyper

SEQ ID NO: 51678 - DNA, 80 bp, Homo sapiens
  chr6:152957815-152957895
  hyper
cgagcgaacgcttcctcccggctctctgcgcccaggctcggcgggaccccggggatgcgcggctgtccgcccgccctgtc

SEQ ID NO: 51679 - DNA, 409 bp, Homo sapiens
  chr6:152958076-152958485
  hyper
gttcctcctcccggctgctcgctggggggtgaggcctcccccttcgccctcccccacgcatctactgctcctgtcgggaaggaaggtcgcccaggccggttcagcctctgggcagggtccctgcaccgccctggcccgccacaccccctccccggctccgtgccccgcgccccgcgcccggctccgggatgcgccggtgcctggaagagctgggggcggggacccggaggctcgcaggcttccctacctcctggagatgcacggccttgggcgtttctccgcagctgcaaagctgtgctgtgacccacccgctcagcgagcctttataccgggaccacctcccgggggtcgaggtgggaaggaaatgtccctgagagccgggacgcgctgcctccgctgcctggaggag

SEQ ID NO: 51680 - DNA, 259 bp, Homo sapiens; identical to SEQ ID NO: 19488
  chr6:153450977-153451236
  hyper

SEQ ID NO: 51681 - DNA, 390 bp, Homo sapiens
  chr6:153451500-153451890
  hyper
ccccctcggtggctgtggaatccaccccgcgccgcacacgccaggactccctttcctttgactaaggggaggggaaggaacaaaagagaccccccaccccctatacatacatacacatacacacacacacacacacacacacacccctccggtattttactgctggtcaaaggattcattttcgcaacctcttcttcgaacaccttccccacctgagcagtgcattttcccaaaggtaaagagagataagggaggaaacacagcacccaaggtgatcagtcgattggacactgttgatggcacattctcctcgttcccaaccaaccgcacaaaacccgcaacacctcgcgtccccgcggggtctcccgcgcccctggcccggccctcccg

SEQ ID NO: 51682 - DNA, 162 bp, Homo sapiens
  chr6:153451968-153452130
  hyper
cccggttccctgcagcagctgagggcggcgagcggaccgcgtccaggcagcgacgcgggattcaacttcccggacccgcggcgcggcccccgctcccgctcagggcgccgcggccacagctgagaccccagcgccgcgcagccgcccccgccggggcatggg

SEQ ID NO: 51683 - DNA, 145 bp, Homo sapiens
  chr6:153452568-153452713
  hyper
tccccgggcggcccccggccccgcccgacctcgcgcgctcgcctgggcgcggcgcccaccgtgcggaggggctcggccgggactctcggcttcggtgacgcccgtccggagcttcgcgggaggcccggagtcccgagagcttccc

SEQ ID NO: 51684 - DNA, 9 bp, Homo sapiens
  chr6:153452746-153452755
  hyper
aactccact

SEQ ID NO: 51685 - DNA, 66 bp, Homo sapiens; identical to SEQ ID NO: 19492
  chr6:154360584-154360650
  hyper

SEQ ID NO: 51686 - DNA, 106 bp, Homo sapiens; identical to SEQ ID NO: 30898
  chr6:155316115-155316221
  hyper

SEQ ID NO: 51687 - DNA, 87 bp, Homo sapiens
  chr6:155316265-155316352
  hyper
ttgaattgttttatttgtgttgttccaaagaaagcgcgagggacatggtccgggaccagccgggagctggcgcgggggtcctgggcc

SEQ ID NO: 51688 - DNA, 295 bp, Homo sapiens; identical to SEQ ID NO: 30900
  chr6:155317032-155317327
  hyper

SEQ ID NO: 51689 - DNA, 40 bp, Homo sapiens
  chr6:157556724-157556764
  hyper
aggcatgagccaccacgccggaccaaatataaccatttct

SEQ ID NO: 51690 - DNA, 65 bp, Homo sapiens; identical to SEQ ID NO: 30902
  chr6:158430625-158430690
  hyper

SEQ ID NO: 51691 - DNA, 188 bp, Homo sapiens; identical to SEQ ID NO: 30903
  chr6:158957782-158957970
  hyper

SEQ ID NO: 51692 - DNA, 109 bp, Homo sapiens; identical to SEQ ID NO: 30904
  chr6:158958375-158958484
  hyper

SEQ ID NO: 51693 - DNA, 49 bp, Homo sapiens
  chr6:159589999-159590048
  hyper
tgggcgcgccgggtgcgggtagggacgtggaaggactgggctagccaca

SEQ ID NO: 51694 - DNA, 275 bp, Homo sapiens
  chr6:159590986-159591261
  hyper
gtctaagtgtcccgggagattcaggcacagcggggaaaaaaggaaaagaaaggcgactttcagcgtgcggactggggtaatgcctttctttgcccagaatttctcgggagcgtaggtggtcatcctactttctccgcgttcacctctcgcgaggcaggatgacgggcgcactcgggagaccggagggaggcagagcagggctgttctagaaggtcgtgggggaaaggctgcgagctgccgcagggcgtcgggtgcctctgcgctccagaggagaa

SEQ ID NO: 51695 - DNA, 26 bp, Homo sapiens
  chr6:159654897-159654923
  hyper
cgcaggggcaggtggcgaccacaggt

SEQ ID NO: 51696 - DNA, 30 bp, Homo sapiens; identical to SEQ ID NO: 30909
  chr6:160402852-160402882
  hyper

SEQ ID NO: 51697 - DNA, 55 bp, Homo sapiens; identical to SEQ ID NO: 30910
  chr6:160769518-160769573
  hyper

SEQ ID NO: 51698 - DNA, 98 bp, Homo sapiens; identical to SEQ ID NO: 30911
  chr6:160769827-160769925
  hyper

SEQ ID NO: 51699 - DNA, 103 bp, Homo sapiens
  chr6:161188410-161188513
  hyper
cgaccctggattgctctccccattctcagcctcaccccccactccttccaccccatattttgccgcctcgaaggacatgaaccatctgctggctgaaggcgct

SEQ ID NO: 51700 - DNA, 187 bp, Homo sapiens; identical to SEQ ID NO: 8792
  chr6:161351859-161352046
  hyper

SEQ ID NO: 51701 - DNA, 44 bp, Homo sapiens; identical to SEQ ID NO: 30914
  chr6:161352264-161352308
  hyper

SEQ ID NO: 51702 - DNA, 119 bp, Homo sapiens; identical to SEQ ID NO: 30917
  chr6:163834710-163834829
  hyper

SEQ ID NO: 51703 - DNA, 24 bp, Homo sapiens
  chr6:163836544-163836568
  hyper
gggccggggtggacccgccggtgc

SEQ ID NO: 51704 - DNA, 331 bp, Homo sapiens
  chr6:163836900-163837231
  hyper
ggtgcagctgttcaatactaagtggaagtcagtgtggggctcgttagtttaaagaaattccgtaggagaccgaaattatgctggcgtagccgacaaggaggactaagtgacggcgaaaagcacttttttcccttttgtttggggaagcgagaactgttagggagttgaacttcacttttcgggggtggggggggggggggtggagtgcgaaataacgcgatgacagatcggagcgcagcctgagttagaagaacttgggcggagggtttgctcccggggacgcagccgcctgagtttgtaggacagggtttcgagacgtttggaaagggcg

SEQ ID NO: 51705 - DNA, 97 bp, Homo sapiens; identical to SEQ ID NO: 30919
  chr6:163837469-163837566
  hyper

SEQ ID NO: 51706 - DNA, 99 bp, Homo sapiens
  chr6:166074020-166074119
  hyper
aggagcggccgatcccggcgcgaatacgctcgccagcccgggggctgcaccccaaaggtgcctgagcgggcggtgagcccggagcagcttcggccgcag

SEQ ID NO: 51707 - DNA, 713 bp, Homo sapiens
  chr6:166074412-166075125
  hyper
ccggccccgccgcggtcttcccgtcctcaccctgctccccctccatccgcgaccgcgacgcccccctcctctgcgcaccgggcgcctcctctttcctcactgtctcccgcctgcctgcttccttctagcgaacccctgccttgacttttctgctcaatcttgtcccccacccccgtgacatgcctttctgccacctctgcctcagcgcgctctcggccccgcgcccgcgggtggcgaggaggagtggccacgccacagtgggcccgggggcgcatcctgcgagtcggaggcggcggcgcctttctcttccaccctagcgacctattgtccttcccttttctctaccaccccggaccccagagaagcccgggaccaacaggacgcggcccggggtgggggtgcgtcccctgggtggaggtgcaaccgtttccaccccgccagtccatgctctggatgccggtcactgcgcggggtgggaggccgggcgcccactccgagtcctggagaacggcggtgccatcacagttggaagcgcggggttctgaggccctggcctccctcaccccggctacagggacccggtgggctggacccccaagtggaaggaagcgcatctgctccagccaagtggccacaggctcaagagggaggaacctaagtggtcacaaagttgagtataaatacgcgccggacaagtgtggccagaaacggca

SEQ ID NO: 51708 - DNA, 231 bp, Homo sapiens; identical to SEQ ID NO: 30921
  chr6:166075258-166075489
  hyper

SEQ ID NO: 51709 - DNA, 107 bp, Homo sapiens; identical to SEQ ID NO: 30922
  chr6:166076095-166076202
  hyper

SEQ ID NO: 51710 - DNA, 98 bp, Homo sapiens; identical to SEQ ID NO: 30923
  chr6:166076501-166076599
  hyper

SEQ ID NO: 51711 - DNA, 38 bp, Homo sapiens
  chr6:166077021-166077059
  hyper
tcctggtagcgggccagcagctccgacccagctgtgct

SEQ ID NO: 51712 - DNA, 43 bp, Homo sapiens
  chr6:166077335-166077378
  hyper
acccccacccccttccgtagccatgaatccaggcagttgccac

SEQ ID NO: 51713 - DNA, 332 bp, Homo sapiens; identical to SEQ ID NO: 30926
  chr6:166077668-166078000
  hyper

SEQ ID NO: 51714 - DNA, 52 bp, Homo sapiens; identical to SEQ ID NO: 30927
  chr6:166218127-166218179
  hyper

SEQ ID NO: 51715 - DNA, 244 bp, Homo sapiens; identical to SEQ ID NO: 30928
  chr6:166218546-166218790
  hyper

SEQ ID NO: 51716 - DNA, 57 bp, Homo sapiens
  chr6:166267525-166267582
  hyper
gtggtgagcaggctgcgctggacccagacagacgcgcggggtcctagggaagagccc

SEQ ID NO: 51717 - DNA, 30 bp, Homo sapiens; identical to SEQ ID NO: 30930
  chr6:166399418-166399448
  hyper

SEQ ID NO: 51718 - DNA, 349 bp, Homo sapiens; identical to SEQ ID NO: 30931
  chr6:166400601-166400950
  hyper

SEQ ID NO: 51719 - DNA, 193 bp, Homo sapiens
  chr6:166401307-166401500
  hyper
cctccttccctcctttccatctgggggtctcggggaaagctgcacccagcgccttgggcgcccatgaagaccagtccatctcagctcaagctcccagcagcagcaacttcggactcagacctctctctttagaacatgagtgcttgtgtgtgcgtgcgtgtgtgtgtgtgtgtgtgtccgagtgcacttcaca

SEQ ID NO: 51720 - DNA, 291 bp, Homo sapiens
  chr6:166401949-166402240
  hyper
cgccccttgtcactacgtgtcgggctcgctctgcctggagggaggctggggtgcggggaagcagggagtgcaaacagacattggttctctttcctcttcccattcatacatttctgttggagtcctagggccgccgcgccgggagtcgcaatgaatggatggatgcccgcgcgctgggaccaccaggtccgcagagatgtcgccggcgctaggggcgctcctcccgcgtggggacaggcgccctcgcctaggcgcagtgtggggggaccccaaaagacccttaagaggcca

SEQ ID NO: 51721 - DNA, 105 bp, Homo sapiens; identical to SEQ ID NO: 19507
  chr6:166402546-166402651
  hyper

SEQ ID NO: 51722 - DNA, 30 bp, Homo sapiens; identical to SEQ ID NO: 30934
  chr6:166420026-166420056
  hyper

SEQ ID NO: 51723 - DNA, 34 bp, Homo sapiens
  chr6:166422185-166422219
  hyper
gcgccggaggggtgggtcccgggacagaccagtg

SEQ ID NO: 51724 - DNA, 8 bp, Homo sapiens
  chr6:166579715-166579723
  hyper
tttacaag

SEQ ID NO: 51725 - DNA, 200 bp, Homo sapiens; identical to SEQ ID NO: 19509
  chr6:166580144-166580344
  hyper

SEQ ID NO: 51726 - DNA, 30 bp, Homo sapiens
  chr6:166582797-166582827
  hyper
aagccgaaggagggatccccgcccgggact

SEQ ID NO: 51727 - DNA, 155 bp, Homo sapiens; identical to SEQ ID NO: 30939
  chr6:166582941-166583096
  hyper

SEQ ID NO: 51728 - DNA, 88 bp, Homo sapiens; identical to SEQ ID NO: 8811
  chr6:166583152-166583240
  hyper

SEQ ID NO: 51729 - DNA, 114 bp, Homo sapiens; identical to SEQ ID NO: 30941
  chr6:166666746-166666860
  hyper

SEQ ID NO: 51730 - DNA, 184 bp, Homo sapiens; identical to SEQ ID NO: 30942
  chr6:166666879-166667063
  hyper

SEQ ID NO: 51731 - DNA, 83 bp, Homo sapiens; identical to SEQ ID NO: 30943
  chr6:166721361-166721444
  hyper

SEQ ID NO: 51732 - DNA, 442 bp, Homo sapiens; identical to SEQ ID NO: 30944
  chr6:166721677-166722119
  hyper

SEQ ID NO: 51733 - DNA, 165 bp, Homo sapiens; identical to SEQ ID NO: 30945
  chr6:167040127-167040292
  hyper

SEQ ID NO: 51734 - DNA, 88 bp, Homo sapiens; identical to SEQ ID NO: 30946
  chr6:167041866-167041954
  hyper

SEQ ID NO: 51735 - DNA, 291 bp, Homo sapiens; identical to SEQ ID NO: 30947
  chr6:167275668-167275959
  hyper

SEQ ID NO: 51736 - DNA, 149 bp, Homo sapiens; identical to SEQ ID NO: 30948
  chr6:167276322-167276471
  hyper

SEQ ID NO: 51737 - DNA, 124 bp, Homo sapiens; identical to SEQ ID NO: 30949
  chr6:167764978-167765102
  hyper

SEQ ID NO: 51738 - DNA, 19 bp, Homo sapiens
  chr6:168719889-168719908
  hyper
cgcgcggggcctccatgtc

SEQ ID NO: 51739 - DNA, 59 bp, Homo sapiens; identical to SEQ ID NO: 30951
  chr6:168841594-168841653
  hyper

SEQ ID NO: 51740 - DNA, 490 bp, Homo sapiens; identical to SEQ ID NO: 30952
  chr6:168842028-168842518
  hyper

SEQ ID NO: 51741 - DNA, 1 bp, Homo sapiens
  chr6:168843060-168843061
  hyper
c

SEQ ID NO: 51742 - DNA, 164 bp, Homo sapiens; identical to SEQ ID NO: 30954
  chr6:168843080-168843244
  hyper

SEQ ID NO: 51743 - DNA, 124 bp, Homo sapiens; identical to SEQ ID NO: 30955
  chr6:169653925-169654049
  hyper

SEQ ID NO: 51744 - DNA, 30 bp, Homo sapiens; identical to SEQ ID NO: 30956
  chr6:170598584-170598614
  hyper

SEQ ID NO: 51745 - DNA, 262 bp, Homo sapiens; identical to SEQ ID NO: 30957
  chr6:170605558-170605820
  hyper

SEQ ID NO: 51746 - DNA, 32 bp, Homo sapiens; identical to SEQ ID NO: 30958
  chr6:170921693-170921725
  hyper

SEQ ID NO: 51747 - DNA, 30 bp, Homo sapiens; identical to SEQ ID NO: 30959
  chr7:191863-191893
  hyper

SEQ ID NO: 51748 - DNA, 71 bp, Homo sapiens; identical to SEQ ID NO: 30960
  chr7:192430-192501
  hyper

SEQ ID NO: 51749 - DNA, 52 bp, Homo sapiens; identical to SEQ ID NO: 30961
  chr7:192976-193028
  hyper

SEQ ID NO: 51750 - DNA, 72 bp, Homo sapiens; identical to SEQ ID NO: 30962
  chr7:193612-193684
  hyper

SEQ ID NO: 51751 - DNA, 17 bp, Homo sapiens
  chr7:329838-329855
  hyper
gccgcctcctcctccct

SEQ ID NO: 51752 - DNA, 253 bp, Homo sapiens; identical to SEQ ID NO: 30964
  chr7:330425-330678
  hyper

SEQ ID NO: 51753 - DNA, 27 bp, Homo sapiens
  chr7:330720-330747
  hyper
cgccaaccagcgcgcctggcagaactc

SEQ ID NO: 51754 - DNA, 30 bp, Homo sapiens; identical to SEQ ID NO: 30966
  chr7:560245-560275
  hyper

SEQ ID NO: 51755 - DNA, 134 bp, Homo sapiens; identical to SEQ ID NO: 19518
  chr7:751986-752120
  hyper

SEQ ID NO: 51756 - DNA, 85 bp, Homo sapiens
  chr7:752221-752306
  hyper
cccgtctccccccgaccgcctccccgcggggcccccaaccccggcccccacccccggctctccccgcccccgccccatcccccac

SEQ ID NO: 51757 - DNA, 78 bp, Homo sapiens; identical to SEQ ID NO: 30969
  chr7:752350-752428
  hyper

SEQ ID NO: 51758 - DNA, 104 bp, Homo sapiens; identical to SEQ ID NO: 30970
  chr7:1126563-1126667
  hyper

SEQ ID NO: 51759 - DNA, 54 bp, Homo sapiens
  chr7:1263707-1263761
  hyper
cccaggttcggttcccggcttcctggtctttgtttaccaggctccgaggaggac

SEQ ID NO: 51760 - DNA, 313 bp, Homo sapiens
  chr7:1263960-1264273
  hyper
ccagctccgttcccgccccatcgggccgggccgggccgagctgagcggggcgcggagaccgcggcggacggtggggagagcgcgcgcgcgtccatccgatttcaggcctttgttgccggagcctcgtgccgatgggttaatggggcagaagagatcggtgaagggcgacagaagcggcctttgaaagagggtgtcagcgcggggcagcgagacaaaggccaaaacacacacgggcggagagggacagatggggacgggcgagggaaaacaattaggccgcaagtgcgggggcggggcgcggctccatcgtttt

SEQ ID NO: 51761 - DNA, 321 bp, Homo sapiens; identical to SEQ ID NO: 30972
  chr7:1265151-1265472
  hyper

SEQ ID NO: 51762 - DNA, 108 bp, Homo sapiens
  chr7:1269197-1269305
  hyper
cgctccggccgcccccgacccggacccggactccgggcccccagctgggcccaagcgcaggaggccggtcctcacggtgcgcccgggaagggaagggccgagcggcct

SEQ ID NO: 51763 - DNA, 244 bp, Homo sapiens
  chr7:1270162-1270406
  hyper
aggaggttttcggagcgcgagccggcccgacagcatgaaaaacacagggcgattgaaatgcgagcattgggacgcacggagccgccgcggcgcggactcgctcttgaggtcaagtgacggacggattgtatgcttcttcataataatattaattaaacaatttgcatgctaataaggtaacaattatcagggcctctgttgaaagattcgggttattacaacacgccaatctgaaggccagggg

SEQ ID NO: 51764 - DNA, 177 bp, Homo sapiens
  chr7:1270440-1270617
  hyper
aattaacattctgtcagctccagaaaatgggataaataaagtcgaattaattcattataataaagagagatgggcgagggagctcggccggcgcgcgcccctcctctgccctccccccgggccgaatagattacagctctgtattcagaaacacgcgccgcgcgcattcctcctcgc

SEQ ID NO: 51765 - DNA, 82 bp, Homo sapiens; identical to SEQ ID NO: 30976
  chr7:1271057-1271139
  hyper

SEQ ID NO: 51766 - DNA, 30 bp, Homo sapiens; identical to SEQ ID NO: 30977
  chr7:1272309-1272339
  hyper

SEQ ID NO: 51767 - DNA, 443 bp, Homo sapiens; identical to SEQ ID NO: 30978
  chr7:1272543-1272986
  hyper

SEQ ID NO: 51768 - DNA, 366 bp, Homo sapiens; identical to SEQ ID NO: 30980
  chr7:1273589-1273955
  hyper

SEQ ID NO: 51769 - DNA, 168 bp, Homo sapiens
  chr7:1274473-1274641
  hyper
ggacaaggctccctgcgacaaggctgggcctgctattgtgcaagtctctgtgtggccgcgacaaagaatccgtattaacgcgccctcctggggagggcaggactgcccgagcttccgcggggctcagacggatttgactgtgtgtgtttggtggctggcggttgagtg

SEQ ID NO: 51770 - DNA, 248 bp, Homo sapiens
  chr7:1274677-1274925
  hyper
gctccccaggacaaggactgcagagaggatggaagagacgcgatgggcccagcctctccttccggcctggtggtcgcctcttgcctccccacctgccttggccggtggcccaggccaaggaccgcaggtttgggaaggctccgttggcgccctggcccagggtttgcggaaagaaggctgtgttagctgtgccctgggagggaggctgcagaggcccacccaagtacggctccccaggcccttccgga

SEQ ID NO: 51771 - DNA, 12 bp, Homo sapiens
  chr7:1275567-1275579
  hyper
gcgagcccatgg

SEQ ID NO: 51772 - DNA, 8 bp, Homo sapiens
  chr7:1275909-1275917
  hyper
gcccaggt

SEQ ID NO: 51773 - DNA, 104 bp, Homo sapiens; identical to SEQ ID NO: 30984
  chr7:1276436-1276540
  hyper

SEQ ID NO: 51774 - DNA, 382 bp, Homo sapiens; identical to SEQ ID NO: 30985
  chr7:1277174-1277556
  hyper

SEQ ID NO: 51775 - DNA, 111 bp, Homo sapiens
  chr7:1277865-1277976
  hyper
ccaaagtgaaccgccacccgtcctccatctccccccacccccccaaaaaccccaacccactggcctcaattttcctgggccctgggtcctcgttgccgcaaaagccaccaa

SEQ ID NO: 51776 - DNA, 431 bp, Homo sapiens; identical to SEQ ID NO: 30987
  chr7:1280395-1280826
  hyper

SEQ ID NO: 51777 - DNA, 56 bp, Homo sapiens
  chr7:1281075-1281131
  hyper
gtttatctcacttagcggtggagggactggagggaaggggcggcccgaagggaggc

SEQ ID NO: 51778 - DNA, 22 bp, Homo sapiens
  chr7:1281471-1281493
  hyper
cgcccctcgcccagccgtgact

SEQ ID NO: 51779 - DNA, 166 bp, Homo sapiens
  chr7:1281876-1282042
  hyper
tcggaaagtttgcagcgtttcccgagcagcgcgggcaaggccggacctgcggtggagccggcacctgccgctccgcccgggattagggagctcccggcttgtggggggtgcgggcggccggtggtccagctcgcccgccccggccgagacgctgggcccggccccc

SEQ ID NO: 51780 - DNA, 37 bp, Homo sapiens; identical to SEQ ID NO: 19531
  chr7:1282644-1282681
  hyper

SEQ ID NO: 51781 - DNA, 170 bp, Homo sapiens; identical to SEQ ID NO: 30992
  chr7:1283626-1283796
  hyper

SEQ ID NO: 51782 - DNA, 30 bp, Homo sapiens; identical to SEQ ID NO: 30993
  chr7:1284194-1284224
  hyper

SEQ ID NO: 51783 - DNA, 104 bp, Homo sapiens; identical to SEQ ID NO: 30994
  chr7:1286007-1286111
  hyper

SEQ ID NO: 51784 - DNA, 287 bp, Homo sapiens; identical to SEQ ID NO: 30995
  chr7:1286886-1287173
  hyper

SEQ ID NO: 51785 - DNA, 30 bp, Homo sapiens; identical to SEQ ID NO: 30996
  chr7:1288109-1288139
  hyper

SEQ ID NO: 51786 - DNA, 30 bp, Homo sapiens; identical to SEQ ID NO: 19534
  chr7:1288552-1288582
  hyper

SEQ ID NO: 51787 - DNA, 82 bp, Homo sapiens
  chr7:1288753-1288835
  hyper
gtgcggtggagtcgggactgctgggggcacctgctgatgaggtgggagggtaaagccacgggggatgcgggtttctggactt

SEQ ID NO: 51788 - DNA, 122 bp, Homo sapiens; identical to SEQ ID NO: 8836
  chr7:1289414-1289536
  hyper

SEQ ID NO: 51789 - DNA, 270 bp, Homo sapiens; identical to SEQ ID NO: 30999
  chr7:1408501-1408771
  hyper

SEQ ID NO: 51790 - DNA, 201 bp, Homo sapiens; identical to SEQ ID NO: 31000
  chr7:1408874-1409075
  hyper

SEQ ID NO: 51791 - DNA, 144 bp, Homo sapiens; identical to SEQ ID NO: 31001
  chr7:1443541-1443685
  hyper

SEQ ID NO: 51792 - DNA, 15 bp, Homo sapiens
  chr7:1443733-1443748
  hyper
cggctggtctctttc

SEQ ID NO: 51793 - DNA, 616 bp, Homo sapiens; identical to SEQ ID NO: 31003
  chr7:1704139-1704755
  hyper

SEQ ID NO: 51794 - DNA, 138 bp, Homo sapiens; identical to SEQ ID NO: 31004
  chr7:1704984-1705122
  hyper

SEQ ID NO: 51795 - DNA, 198 bp, Homo sapiens; identical to SEQ ID NO: 31005
  chr7:1705412-1705610
  hyper

SEQ ID NO: 51796 - DNA, 183 bp, Homo sapiens; identical to SEQ ID NO: 31006
  chr7:1706209-1706392
  hyper

SEQ ID NO: 51797 - DNA, 82 bp, Homo sapiens; identical to SEQ ID NO: 31007
  chr7:1706634-1706716
  hyper

SEQ ID NO: 51798 - DNA, 274 bp, Homo sapiens; identical to SEQ ID NO: 31008
  chr7:1706985-1707259
  hyper

SEQ ID NO: 51799 - DNA, 64 bp, Homo sapiens
  chr7:1709074-1709138
  hyper
ccgccggggcctgcccggcccgagcgtggagtcccgaggctcctgccgggggtccaggctgccc

SEQ ID NO: 51800 - DNA, 239 bp, Homo sapiens
  chr7:1709235-1709474
  hyper
aggcaggttgtcagggtgaaactgagccgaagagtgctccagaaccccctgaagtcctcacagaggttggggtgaatgaaggaaggaagcggggccagggctgggcagaggaggcccggcctgcgccctgcgttctccgcccctaggtccctgccctcccggataaggggcggaccgacgggaggacctgagaacgccttggctttgcttgaggtggtgggagtcgcgggtagcttgtt

SEQ ID NO: 51801 - DNA, 306 bp, Homo sapiens; identical to SEQ ID NO: 31010
  chr7:1709617-1709923
  hyper

SEQ ID NO: 51802 - DNA, 289 bp, Homo sapiens; identical to SEQ ID NO: 8844
  chr7:1709955-1710244
  hyper

SEQ ID NO: 51803 - DNA, 46 bp, Homo sapiens; identical to SEQ ID NO: 31012
  chr7:1710324-1710370
  hyper

SEQ ID NO: 51804 - DNA, 202 bp, Homo sapiens
  chr7:2727866-2728068
  hyper
ctgctgcccggggctcggtgcccggcgcggcctctgccggctccggcgggcgcgggactgcgaggtaggggggcgcgcggggaagactcgggggcgcagggaccgagagggacctccgtgccggggcgggtgggtaggggcagctccgggtccagcccggcccgcgcaccaagtcccgagggcgcccgggcggcggcggcta

SEQ ID NO: 51805 - DNA, 87 bp, Homo sapiens
  chr7:2728165-2728252
  hyper
agggaaggccgggccagggaagggccacgcgccccctccccgccatcctctcccaggccagggcgacctgcgcgcttcccgatggga

SEQ ID NO: 51806 - DNA, 45 bp, Homo sapiens; identical to SEQ ID NO: 31014
  chr7:3083160-3083205
  hyper

SEQ ID NO: 51807 - DNA, 34 bp, Homo sapiens; identical to SEQ ID NO: 31015
  chr7:3083407-3083441
  hyper

SEQ ID NO: 51808 - DNA, 213 bp, Homo sapiens
  chr7:3340231-3340444
  hyper
cccgccctcctccagcgccggccaaaagtgaccttggacgcttctacaatgccatatccactcctctgaacaggaggcgagtttgcacccagtggtgcctttggttgctagaaattaaaaacccgattgcgcgtgtttgcaattacggtaacttggcgcgtcacccccaagcactgagctagctggtggtagccgggcgcctctcggggcgcg

SEQ ID NO: 51809 - DNA, 342 bp, Homo sapiens
  chr7:3340473-3340815
  hyper
gcacgatctgcgcgtcctgctgcacctgagcccttcccactcgggcgcccgcaccgctgcggggccgggcgaggatgcaccacccccgcccgcgagcccgccacgggagcgcgtgccgaatcgacgccgcctgcagtccccactacgggtccctagggggcgcagccggcgcgggaagccgcccgagccaggcgccgcggccggcacaaaattgcaggcgggcgggcgccgcgactttgaaaacaagcgagggcctggggggcgggccctgggagcgggcgccgcctccctcggccaatcaacggcgggcggcgggcggcgggcgcgggcggcgcgtgcggc

SEQ ID NO: 51810 - DNA, 123 bp, Homo sapiens; identical to SEQ ID NO: 31017
  chr7:3341286-3341409
  hyper

SEQ ID NO: 51811 - DNA, 389 bp, Homo sapiens
  chr7:3341597-3341986
  hyper
ggtccccccgcttcccggcccgggtcgggatgcgccttgctgggggctctagggagcccaggggctcctccacgccagactcggaggagagggaaacggagccccgtagagcctgcaccccgtctgctactttgcgttttattttttttataccgcagtagcacaaacaaaaatttttaagttgaggacccatttctcagctccttaaaaggatgcccgagtccccttcccattgcatggatgaaaaaggggctggtctgtacctgagtcttcgcaccgcagggtctggtttccggtgagtgacatccagaagacttggaaatatcaagtgccagtcgctgtgaaaagccttttccagcccctccccagggcctcgtcctctccccagc

SEQ ID NO: 51812 - DNA, 68 bp, Homo sapiens; identical to SEQ ID NO: 31019
  chr7:4785735-4785803
  hyper

SEQ ID NO: 51813 - DNA, 112 bp, Homo sapiens; identical to SEQ ID NO: 31020
  chr7:4837872-4837984
  hyper

SEQ ID NO: 51814 - DNA, 135 bp, Homo sapiens; identical to SEQ ID NO: 31022
  chr7:4922839-4922974
  hyper

SEQ ID NO: 51815 - DNA, 232 bp, Homo sapiens
  chr7:4923397-4923629
  hyper
gggctggagctgggcctcggcgcccaataggcagaaagaaagcctcgaggaggcggggtctccaggagaggggcggggccaacctgctagaaaaggcgggctgtgctctggcgcctcctgccggccgcccaatggacggggatgcagcctcgagggggcggggcctcaccggagaggcggggttttgaagaaaggggtggggctggttgtggagaggcgggacttgcagccc

SEQ ID NO: 51816 - DNA, 199 bp, Homo sapiens; identical to SEQ ID NO: 19550
  chr7:4998388-4998587
  hyper

SEQ ID NO: 51817 - DNA, 121 bp, Homo sapiens; identical to SEQ ID NO: 31025
  chr7:4998770-4998891
  hyper

SEQ ID NO: 51818 - DNA, 30 bp, Homo sapiens; identical to SEQ ID NO: 31026
  chr7:5459075-5459105
  hyper

SEQ ID NO: 51819 - DNA, 30 bp, Homo sapiens; identical to SEQ ID NO: 31027
  chr7:5467207-5467237
  hyper

SEQ ID NO: 51820 - DNA, 400 bp, Homo sapiens; identical to SEQ ID NO: 31028
  chr7:5467505-5467905
  hyper

SEQ ID NO: 51821 - DNA, 105 bp, Homo sapiens; identical to SEQ ID NO: 31029
  chr7:5526299-5526404
  hyper

SEQ ID NO: 51822 - DNA, 22 bp, Homo sapiens
  chr7:5632917-5632939
  hyper
ccgcctgtcctgcttcgcgcag

SEQ ID NO: 51823 - DNA, 35 bp, Homo sapiens; identical to SEQ ID NO: 31031
  chr7:5635640-5635675
  hyper

SEQ ID NO: 51824 - DNA, 6 bp, Homo sapiens
  chr7:6543216-6543222
  hyper
gcagct

SEQ ID NO: 51825 - DNA, 107 bp, Homo sapiens; identical to SEQ ID NO: 31033
  chr7:6566129-6566236
  hyper

SEQ ID NO: 51826 - DNA, 167 bp, Homo sapiens
  chr7:6566246-6566413
  hyper
cgtggacaccaggaggcgctccggccgctcctcgctgcggctccggcgcagtcgctgcgcgccctgggcccggcgtgcgcggcacagcttgcccaggaggccctgagacaccacctcgtcgaagcgcgcccggtgcttcttggggatgaagatcctgccggcgagga

SEQ ID NO: 51827 - DNA, 409 bp, Homo sapiens; identical to SEQ ID NO: 31035
  chr7:6570454-6570863
  hyper

SEQ ID NO: 51828 - DNA, 59 bp, Homo sapiens
  chr7:6570900-6570959
  hyper
cgccccctccaggtagccccgcctctgccctgctgggacccttttggtcgctctggggt

SEQ ID NO: 51829 - DNA, 47 bp, Homo sapiens; identical to SEQ ID NO: 19554
  chr7:6571130-6571177
  hyper

SEQ ID NO: 51830 - DNA, 48 bp, Homo sapiens; identical to SEQ ID NO: 31037
  chr7:6576049-6576097
  hyper

SEQ ID NO: 51831 - DNA, 357 bp, Homo sapiens; identical to SEQ ID NO: 31038
  chr7:6654798-6655155
  hyper

SEQ ID NO: 51832 - DNA, 30 bp, Homo sapiens; identical to SEQ ID NO: 31039
  chr7:6655418-6655448
  hyper

SEQ ID NO: 51833 - DNA, 30 bp, Homo sapiens; identical to SEQ ID NO: 31040
  chr7:6655736-6655766
  hyper

SEQ ID NO: 51834 - DNA, 129 bp, Homo sapiens; identical to SEQ ID NO: 19556
  chr7:6703959-6704088
  hyper

SEQ ID NO: 51835 - DNA, 282 bp, Homo sapiens; identical to SEQ ID NO: 19557
  chr7:8473674-8473956
  hyper

SEQ ID NO: 51836 - DNA, 53 bp, Homo sapiens
  chr7:8475057-8475110
  hyper
ggaccgcgcgcttgctggtctcaggcgctggatttactcgcttttcaattttt

SEQ ID NO: 51837 - DNA, 119 bp, Homo sapiens; identical to SEQ ID NO: 31049
  chr7:8475321-8475440
  hyper

SEQ ID NO: 51838 - DNA, 107 bp, Homo sapiens; identical to SEQ ID NO: 31050
  chr7:8476614-8476721
  hyper

SEQ ID NO: 51839 - DNA, 303 bp, Homo sapiens
  chr7:8481339-8481642
  hyper
gataatatattttggcggcttcttcaaacccctccgcgcgcccaagagcgcgtttgcgcattttccaagtttgccctgccctcgcgggttggtggctgttgtttaaacttctgatgagcgcgctgcgtttctgctacgggatgaaaacctaattacctcctctgcaaagagctttccctagtatattttattgattgcggaggtgggagccggcagggggtctgtgggggtgggcggggaggggattctcttgctccggtgccctctgttgccgaaagttccttaggcgtctagtcaggggtt

SEQ ID NO: 51840 - DNA, 223 bp, Homo sapiens
  chr7:8481833-8482056
  hyper
gacacaggccgcatccagagcgcatcgcctcatctgcatgagaatggagaaccgggaggcttttcttgtactgtttctttctcccacaataagacaaattgctgcttagaaaaactgagtgtttccttagaaactggcttgcgggagctctgcgcgtccccgctgaacctgcctctggccgcgcctcgccatcacccccgccgccctaatggattctgaagcg

SEQ ID NO: 51841 - DNA, 226 bp, Homo sapiens
  chr7:8482921-8483147
  hyper
cccaacttctccccctacccagtctcccattctttcacagttcattaaatctacccctcccccgaaacagaaacgtgaaggctgtaacgaagagctagaagtgtctctagtaatgtaaaagtctcaactgacagacaaggaaactgaggcaaccaacttattcgcaagagtaaaaccctatggggagaagcgattcctgcccctcttcccccggcgaggaacacgg

SEQ ID NO: 51842 - DNA, 41 bp, Homo sapiens
  chr7:8483950-8483991
  hyper
gaagagaaggtttaggcgcaacgcctcggaggtattctctg

SEQ ID NO: 51843 - DNA, 465 bp, Homo sapiens; identical to SEQ ID NO: 31055
  chr7:11871392-11871857
  hyper

SEQ ID NO: 51844 - DNA, 270 bp, Homo sapiens
  chr7:12151170-12151440
  hyper
gggatctgggcagagcgtgggagggcctgtggggcctggggttctctctgcgcacgaaatccggggcgggcactatgtgattcgagcccgctgcgccctgggctcctcgtgtcgcccgcggggaaaggaggagggagactgctcacatggcccacttcgcggcctgagatggagtgcgcgcagggcgtcagggcagagggaggcggggattcaggataaagagcggcctgatgcccagagccgggtgcccggacctcctgcctcctgctt

SEQ ID NO: 51845 - DNA, 30 bp, Homo sapiens
  chr7:12151678-12151708
  hyper
ccccatgtcccattgcgagggtcccacaga

SEQ ID NO: 51846 - DNA, 23 bp, Homo sapiens
  chr7:12443294-12443317
  hyper
ggccaggaacatcagcgcgatca

SEQ ID NO: 51847 - DNA, 315 bp, Homo sapiens
  chr7:12443403-12443718
  hyper
tggggccacagcagcccctcgggcctcctttcttggattttctcagtctgttgctgcttggaacagggaagctccgcgtcctcgttctggggtgcacccagtcctttcgtgggatagagccttcgcgtaatccgtctgcgactcctcccttcccattttggctgctggctgacctgaaagccacgcccaacctgtccccatagcccagcgtgtaccggcagtggctccgccgccttggatgtcaccgtgcagtcgcacagccaggagtcaagctacagggatgtagctctccgcccgctgcgtcttgctgttcta

SEQ ID NO: 51848 - DNA, 30 bp, Homo sapiens; identical to SEQ ID NO: 31059
  chr7:12610212-12610242
  hyper

SEQ ID NO: 51849 - DNA, 34 bp, Homo sapiens; identical to SEQ ID NO: 31060
  chr7:14029885-14029919
  hyper

SEQ ID NO: 51850 - DNA, 261 bp, Homo sapiens; identical to SEQ ID NO: 31061
  chr7:15725085-15725346
  hyper

SEQ ID NO: 51851 - DNA, 34 bp, Homo sapiens; identical to SEQ ID NO: 19568
  chr7:15725949-15725983
  hyper

SEQ ID NO: 51852 - DNA, 109 bp, Homo sapiens
  chr7:15726081-15726190
  hyper
ccaccctctgtcactttttcactggaaaccgtgtgattttttttttaacctcccaaagcaatagcggtgcacttctgcagagctcggataatcccggtcctgagcccca

SEQ ID NO: 51853 - DNA, 24 bp, Homo sapiens
  chr7:15727320-15727344
  hyper
ttcactcaccgtgggcacttggtt

SEQ ID NO: 51854 - DNA, 30 bp, Homo sapiens; identical to SEQ ID NO: 31065
  chr7:16460326-16460356
  hyper

SEQ ID NO: 51855 - DNA, 33 bp, Homo sapiens; identical to SEQ ID NO: 31066
  chr7:16461245-16461278
  hyper

SEQ ID NO: 51856 - DNA, 82 bp, Homo sapiens; identical to SEQ ID NO: 8881
  chr7:18125980-18126062
  hyper

SEQ ID NO: 51857 - DNA, 76 bp, Homo sapiens; identical to SEQ ID NO: 31068
  chr7:18126082-18126158
  hyper

SEQ ID NO: 51858 - DNA, 549 bp, Homo sapiens; identical to SEQ ID NO: 31069
  chr7:18126466-18127015
  hyper

SEQ ID NO: 51859 - DNA, 253 bp, Homo sapiens; identical to SEQ ID NO: 19572
  chr7:19146249-19146502
  hyper

SEQ ID NO: 51860 - DNA, 24 bp, Homo sapiens
  chr7:19146558-19146582
  hyper
ttaggcgcgcgggctcccatcctc

SEQ ID NO: 51861 - DNA, 180 bp, Homo sapiens; identical to SEQ ID NO: 19574
  chr7:19146942-19147122
  hyper

SEQ ID NO: 51862 - DNA, 101 bp, Homo sapiens
  chr7:19147798-19147899
  hyper
tgctcccccccttcccaaatgctgttgctttttctctggcggtccccaccccctgcttcttcgttctccttccctacccccaaccccgtttgctgtcttag

SEQ ID NO: 51863 - DNA, 62 bp, Homo sapiens; identical to SEQ ID NO: 31074
  chr7:19156000-19156062
  hyper

SEQ ID NO: 51864 - DNA, 89 bp, Homo sapiens; identical to SEQ ID NO: 19576
  chr7:19157055-19157144
  hyper

SEQ ID NO: 51865 - DNA, 30 bp, Homo sapiens; identical to SEQ ID NO: 8895
  chr7:19183647-19183677
  hyper

SEQ ID NO: 51866 - DNA, 171 bp, Homo sapiens
  chr7:19184255-19184426
  hyper
ccgctcgcccctgaccccgacttcacttagggcggtcgcgtagatatgaactctacagcagccactctgctcagcgcatgtggggatcttacaatctcgaccccgacctccagaagaccagacgttctgtcttggggcctccctcccggccctttagcctcacccagtgcc

SEQ ID NO: 51867 - DNA, 166 bp, Homo sapiens; identical to SEQ ID NO: 31083
  chr7:19184669-19184835
  hyper

SEQ ID NO: 51868 - DNA, 129 bp, Homo sapiens
  chr7:20816447-20816576
  hyper
ccccactgtgggggattggggtcagtggagcccgtggatttagccacgaggggacatgactggagccctgtcacgcgcaggtgtgcgtctccgagagctctttcaatataagtgcgggagaagatttat

SEQ ID NO: 51869 - DNA, 83 bp, Homo sapiens; identical to SEQ ID NO: 31085
  chr7:20817170-20817253
  hyper

SEQ ID NO: 51870 - DNA, 309 bp, Homo sapiens; identical to SEQ ID NO: 31086
  chr7:20817648-20817957
  hyper

SEQ ID NO: 51871 - DNA, 148 bp, Homo sapiens; identical to SEQ ID NO: 19582
  chr7:20817982-20818130
  hyper

SEQ ID NO: 51872 - DNA, 31 bp, Homo sapiens; identical to SEQ ID NO: 19583
  chr7:20823261-20823292
  hyper

SEQ ID NO: 51873 - DNA, 447 bp, Homo sapiens; identical to SEQ ID NO: 19584
  chr7:20823432-20823879
  hyper

SEQ ID NO: 51874 - DNA, 20 bp, Homo sapiens
  chr7:20824946-20824966
  hyper
gccgccgcccccgccgccgc

SEQ ID NO: 51875 - DNA, 227 bp, Homo sapiens; identical to SEQ ID NO: 31093
  chr7:20826611-20826838
  hyper

SEQ ID NO: 51876 - DNA, 99 bp, Homo sapiens; identical to SEQ ID NO: 31094
  chr7:20827355-20827454
  hyper

SEQ ID NO: 51877 - DNA, 93 bp, Homo sapiens; identical to SEQ ID NO: 31095
  chr7:20828502-20828595
  hyper

SEQ ID NO: 51878 - DNA, 235 bp, Homo sapiens
  chr7:20830700-20830935
  hyper
gcgtccctggcctgcgcctctcccagaatgggaagacgacccccaaccccttgactagtgtgcggggtcctcgcacgcggacgtgttggctactaaataaagcgtgaagagggatcgctgggtagctgagcgccgccggcggccgccgggagcagcgagctgagccaggttgggtgggggtgtttcctcgtcgagagctctctggtcaaagtttccttcccgctggaaaacaaaa

SEQ ID NO: 51879 - DNA, 30 bp, Homo sapiens; identical to SEQ ID NO: 31097
  chr7:20831186-20831216
  hyper

SEQ ID NO: 51880 - DNA, 78 bp, Homo sapiens
  chr7:20833089-20833167
  hyper
tgctttagaatcattcgactctgagtccaggaaaagcagggggtgtggtggcagtgggggtggctagggaggggtgta

SEQ ID NO: 51881 - DNA, 30 bp, Homo sapiens; identical to SEQ ID NO: 31099
  chr7:20833492-20833522
  hyper

SEQ ID NO: 51882 - DNA, 30 bp, Homo sapiens; identical to SEQ ID NO: 31100
  chr7:20834600-20834630
  hyper

SEQ ID NO: 51883 - DNA, 30 bp, Homo sapiens; identical to SEQ ID NO: 8910
  chr7:20836099-20836129
  hyper

SEQ ID NO: 51884 - DNA, 208 bp, Homo sapiens; identical to SEQ ID NO: 31102
  chr7:20836779-20836987
  hyper

SEQ ID NO: 51885 - DNA, 50 bp, Homo sapiens; identical to SEQ ID NO: 8912
  chr7:20838460-20838510
  hyper

SEQ ID NO: 51886 - DNA, 57 bp, Homo sapiens
  chr7:21582536-21582593
  hyper
gagggcctctcccctcggccttggccttggcgtatactgggcggtggcgcggtgcgc

SEQ ID NO: 51887 - DNA, 84 bp, Homo sapiens
  chr7:21582868-21582952
  hyper
agcccaggtggcagcccgggaggcgcgagacttcagagaagccccgacccttcgcctaacctcgggggccggcctggaggcagt

SEQ ID NO: 51888 - DNA, 61 bp, Homo sapiens
  chr7:21583326-21583387
  hyper
acttggcttgaagtccccatcctgaggcccgcaggactcctccccacgtgcacccactctg

SEQ ID NO: 51889 - DNA, 4 bp, Homo sapiens
  chr7:22539909-22539913
  hyper
ggaa

SEQ ID NO: 51890 - DNA, 58 bp, Homo sapiens
  chr7:22589298-22589356
  hyper
ctcaaactatctcgacggtcaggcccctttcccaggtggtgccgtggtggccgtgggg

SEQ ID NO: 51891 - DNA, 25 bp, Homo sapiens
  chr7:23287228-23287253
  hyper
ggaagagagctgagccgctgtaacc

SEQ ID NO: 51892 - DNA, 1569 bp, Homo sapiens; identical to SEQ ID NO: 31112
  chr7:23508102-23509671
  hyper

SEQ ID NO: 51893 - DNA, 108 bp, Homo sapiens; identical to SEQ ID NO: 31113
  chr7:23510878-23510986
  hyper

SEQ ID NO: 51894 - DNA, 906 bp, Homo sapiens; identical to SEQ ID NO: 31114
  chr7:23513519-23514425
  hyper

SEQ ID NO: 51895 - DNA, 36 bp, Homo sapiens; identical to SEQ ID NO: 8922
  chr7:23514666-23514702
  hyper

SEQ ID NO: 51896 - DNA, 67 bp, Homo sapiens
  chr7:24796567-24796634
  hyper
tgcacacacgcccccgagccgggagagcctccgcagcacccagagaagagaccggaacacaaaggat

SEQ ID NO: 51897 - DNA, 15 bp, Homo sapiens
  chr7:24797022-24797037
  hyper
ccgctgctgggtccc

SEQ ID NO: 51898 - DNA, 543 bp, Homo sapiens; identical to SEQ ID NO: 31118
  chr7:24797067-24797610
  hyper

SEQ ID NO: 51899 - DNA, 297 bp, Homo sapiens; identical to SEQ ID NO: 31119
  chr7:25891946-25892243
  hyper

SEQ ID NO: 51900 - DNA, 101 bp, Homo sapiens
  chr7:25896420-25896521
  hyper
aaattccttccagatcgacctcagtgtgggtgagagcgcagtctgtgaccaccagcgcttctgactcagcggaaaacgccggcaaacaggactacacctca

SEQ ID NO: 51901 - DNA, 74 bp, Homo sapiens; identical to SEQ ID NO: 19602
  chr7:25896864-25896938
  hyper

SEQ ID NO: 51902 - DNA, 304 bp, Homo sapiens; identical to SEQ ID NO: 31122
  chr7:25902345-25902649
  hyper

SEQ ID NO: 51903 - DNA, 36 bp, Homo sapiens; identical to SEQ ID NO: 31123
  chr7:25990174-25990210
  hyper

SEQ ID NO: 51904 - DNA, 41 bp, Homo sapiens; identical to SEQ ID NO: 31124
  chr7:26192685-26192726
  hyper

SEQ ID NO: 51905 - DNA, 310 bp, Homo sapiens; identical to SEQ ID NO: 31125
  chr7:26415774-26416084
  hyper

SEQ ID NO: 51906 - DNA, 138 bp, Homo sapiens; identical to SEQ ID NO: 31126
  chr7:26416380-26416518
  hyper

SEQ ID NO: 51907 - DNA, 34 bp, Homo sapiens; identical to SEQ ID NO: 31127
  chr7:27128016-27128050
  hyper

SEQ ID NO: 51908 - DNA, 61 bp, Homo sapiens; identical to SEQ ID NO: 19605
  chr7:27135266-27135327
  hyper

SEQ ID NO: 51909 - DNA, 34 bp, Homo sapiens; identical to SEQ ID NO: 19606
  chr7:27135979-27136013
  hyper

SEQ ID NO: 51910 - DNA, 372 bp, Homo sapiens
  chr7:27190219-27190591
  hyper
tacaggtagtctctccgattgcagaatcccaaagccagagtgttccctgaaccagcgtgcgcccccagaacgccttgggacgcgcagtttggacagaagcagccatgacgtgccaggcggcctgtgcaaccagtctccatggtgctggagtgggggtgggggaggacccgagtctataacggcgtccagctccggtcaggggtagccgaggcggggagatttcccggccatataggctctgggtgatcgccccccaggtccccttgcgtccccctctaccctgcttgctgggaaatctctgaggggccagtacagcagtcgcgccaggctgcaagaggcgggctgcagctggcgccggtcccggcgacggcc

SEQ ID NO: 51911 - DNA, 47 bp, Homo sapiens; identical to SEQ ID NO: 31132
  chr7:27191507-27191554
  hyper

SEQ ID NO: 51912 - DNA, 85 bp, Homo sapiens
  chr7:27204402-27204487
  hyper
ggacgaaggcaggctcgagagaaacctggcgggccagcagatccgggaggccggcgtggaggcggcggcggatttgaagggagga

SEQ ID NO: 51913 - DNA, 36 bp, Homo sapiens
  chr7:27205642-27205678
  hyper
agccacacaggctggcgggaagtcggaaacgaccaa

SEQ ID NO: 51914 - DNA, 91 bp, Homo sapiens
  chr7:27209582-27209673
  hyper
ggctccctgtctggccccggcctcccgcctctcgctctccccctctccctcctagctgcccgcccgccggggcgcgcgctcctgcgccccc

SEQ ID NO: 51915 - DNA, 85 bp, Homo sapiens; identical to SEQ ID NO: 19610
  chr7:27212899-27212984
  hyper

SEQ ID NO: 51916 - DNA, 37 bp, Homo sapiens; identical to SEQ ID NO: 31146
  chr7:27214329-27214366
  hyper

SEQ ID NO: 51917 - DNA, 448 bp, Homo sapiens; identical to SEQ ID NO: 8945
  chr7:27219396-27219844
  hyper

SEQ ID NO: 51918 - DNA, 42 bp, Homo sapiens
  chr7:27223151-27223193
  hyper
ctgagtcctggccaccagcttctgcctccccggccagccttc

SEQ ID NO: 51919 - DNA, 59 bp, Homo sapiens; identical to SEQ ID NO: 8947
  chr7:27223221-27223280
  hyper

SEQ ID NO: 51920 - DNA, 27 bp, Homo sapiens
  chr7:27223574-27223601
  hyper
actttatctgttaaacgcgctcctagc

SEQ ID NO: 51921 - DNA, 373 bp, Homo sapiens
  chr7:27223696-27224069
  hyper
tcaaaagctcccgaagcccttgcagggggaatttacaggcgcccacctccggctccccagcctggagctggccccgagcggggtcgagctgctgggcttgggagctgagaagggaaaaaagggaaaaggggagttgtttttttttgcaggcatgccttggccggtgggtatttcacggccaatttcagcactcgccacgtgatcccgccttttataacaaagttttgttgggggaaacctaaaggcccttcataaaccttatatgcttataaaacagcatataaaaatttaacagcggtgctgcgctagatttccaactcccctttcataaagcgcagggcgctgcctttatacgtactggagccgccggcct

SEQ ID NO: 51922 - DNA, 129 bp, Homo sapiens
  chr7:27224906-27225035
  hyper
gctggtcatgtgacccgatgttgaaattgacaagctgctagctagtccgggccttttccccccccctttccttttttttttttcctcctctcccctccctcccggcttcctttctttgtagccacctca

SEQ ID NO: 51923 - DNA, 98 bp, Homo sapiens; identical to SEQ ID NO: 31152
  chr7:27227776-27227874
  hyper

SEQ ID NO: 51924 - DNA, 30 bp, Homo sapiens; identical to SEQ ID NO: 31153
  chr7:27228676-27228706
  hyper

SEQ ID NO: 51925 - DNA, 33 bp, Homo sapiens
  chr7:27232256-27232289
  hyper
gcctcgggctgcgggcggcttcggggcctacag

SEQ ID NO: 51926 - DNA, 18 bp, Homo sapiens
  chr7:27232962-27232980
  hyper
ctccgagttcacacccca

SEQ ID NO: 51927 - DNA, 30 bp, Homo sapiens; identical to SEQ ID NO: 31155
  chr7:27237273-27237303
  hyper

SEQ ID NO: 51928 - DNA, 88 bp, Homo sapiens; identical to SEQ ID NO: 31156
  chr7:27238082-27238170
  hyper

SEQ ID NO: 51929 - DNA, 78 bp, Homo sapiens; identical to SEQ ID NO: 31157
  chr7:27238793-27238871
  hyper

SEQ ID NO: 51930 - DNA, 32 bp, Homo sapiens; identical to SEQ ID NO: 8952
  chr7:27239141-27239173
  hyper

SEQ ID NO: 51931 - DNA, 609 bp, Homo sapiens
  chr7:27239234-27239843
  hyper
gctgcattgcttggcggcctctgcgcccgccgggcccgccgggccgggacctcccgaggacgacgcggcggcggcggcggcggctgcagcggcagccgcggcagcagcggcggcagccgacgggggcgcctccccgggggcgctgctgtaggcggacgcggctcctggcgccaagggcgccgggtgcgccatcaggttgcggcactggttggccgcggccgccgccgcagccgcggccgccgccgccaccgagaagttgccccctgccgccgcagccgccgggtgggggaagcccccgcccccggccccggcagccgccgccgctgcagccgctgctgcagccgccgccgccccttccatgttcttgttgagctcgtcggccaccaggccgccgccgttgtcgtagagaaacatgacggtgggctcgatccagcgggggtggaggagcacggaggctgtcatagcccgagccgcatggagaagaccccagtggcgctgttttaaaaagcccccaagaagtgaagagcgcgcggcgcggggccggggcccgagcgaggggggcggatcgcgccccgcggggtcgcgccaggcggccgcccattggcccgg

SEQ ID NO: 51932 - DNA, 181 bp, Homo sapiens; identical to SEQ ID NO: 31161
  chr7:27240992-27241173
  hyper

SEQ ID NO: 51933 - DNA, 64 bp, Homo sapiens; identical to SEQ ID NO: 31164
  chr7:27245526-27245590
  hyper

SEQ ID NO: 51934 - DNA, 165 bp, Homo sapiens; identical to SEQ ID NO: 31165
  chr7:27250066-27250231
  hyper

SEQ ID NO: 51935 - DNA, 145 bp, Homo sapiens
  chr7:27252410-27252555
  hyper
cttctgcccctccgaggtggggtgggggtgttctgaaataacggtggctgcagttagatggctgaggacatagaaagcggttgttatttattccaggcaccatcacaaaaggcttccaaaaatatcgagccgagatattttattg

SEQ ID NO: 51936 - DNA, 24 bp, Homo sapiens
  chr7:27252795-27252819
  hyper
tttttctttctctcccggattgtt

SEQ ID NO: 51937 - DNA, 284 bp, Homo sapiens; identical to SEQ ID NO: 31168
  chr7:27252895-27253179
  hyper

SEQ ID NO: 51938 - DNA, 78 bp, Homo sapiens
  chr7:27264797-27264875
  hyper
agttcttttacacaacgtgaattatattgaaattgggctacttcatagagcttcgcctcagtggaggacagcctggaa

SEQ ID NO: 51939 - DNA, 213 bp, Homo sapiens
  chr7:27265325-27265538
  hyper
tcggcctctacttcctcggatctgagccagcgccgctaatccgcaggctgcagcagaacctgtcgccagcttggagagtccctcgcgctgccctggcttcccggtccgcgggcgactcgcgctgctcccgggtttgtcgggaccccaggagggcgctcaagcctgtcggcccctacttgtgtgtagagaataggcccgggtacaccacctcag

SEQ ID NO: 51940 - DNA, 57 bp, Homo sapiens; identical to SEQ ID NO: 31170
  chr7:27275040-27275097
  hyper

SEQ ID NO: 51941 - DNA, 62 bp, Homo sapiens; identical to SEQ ID NO: 31172
  chr7:27279453-27279515
  hyper

SEQ ID NO: 51942 - DNA, 282 bp, Homo sapiens; identical to SEQ ID NO: 19624
  chr7:27283013-27283295
  hyper

SEQ ID NO: 51943 - DNA, 15 bp, Homo sapiens
  chr7:27284655-27284670
  hyper
tcgctgtgcagggtc

SEQ ID NO: 51944 - DNA, 84 bp, Homo sapiens; identical to SEQ ID NO: 31176
  chr7:27289482-27289566
  hyper

SEQ ID NO: 51945 - DNA, 55 bp, Homo sapiens; identical to SEQ ID NO: 31177
  chr7:27289813-27289868
  hyper

SEQ ID NO: 51946 - DNA, 173 bp, Homo sapiens; identical to SEQ ID NO: 667
  chr7:27290946-27291119
  hyper

SEQ ID NO: 51947 - DNA, 340 bp, Homo sapiens
  chr7:27291851-27292191
  hyper
aggcgacaggtgcctccccaggtgtctacttgccctccctcaacctgtttagggaaagaccagaacgatgtgcgcggggaggtggttttgtttctcccgaaactggcgctcttgggtaaaaccgcgtgccgcgtctacgcgggctctgttagtgtgcgtgtcccagaagagtgggccttctaggcggcactctttggagaagtaagtgaggtgaactcagaacagagaagcgggaacgatcgtttgatgtgccgagccggaaaaagagaggagagggagaggctcccagcgagcgcggagacagaggagcccacgcggcacagcacgagccctactcttg

SEQ ID NO: 51948 - DNA, 356 bp, Homo sapiens
  chr7:28448920-28449276
  hyper
cccacgtgacgtcaccgggggggtgatgtaatgcactctaaatagaatgtattgtaatctttgctcagtccaacgtggtcccttcacccgggctccgctcttgccttctccacacttgtttggtaagttcctaaaaatacggctcggccacttctggggcttttgcatttagccacttttgttgcacttgccgcaggagccatctcgggagtgtacttgtttgcaggggttggttctcggcagcagccgcgaggttacttggtccagtgggcaggtcacagggcaaggagtagggaagatgcgatgcatttttttctggagggtgatctgtgtttgtaaacattttggcggaccag

SEQ ID NO: 51949 - DNA, 26 bp, Homo sapiens
  chr7:28450015-28450041
  hyper
cggcagattctcggcagaatcacttg

SEQ ID NO: 51950 - DNA, 221 bp, Homo sapiens; identical to SEQ ID NO: 31183
  chr7:28893380-28893601
  hyper

SEQ ID NO: 51951 - DNA, 14 bp, Homo sapiens
  chr7:28995978-28995992
  hyper
gctcctggtgctcc

SEQ ID NO: 51952 - DNA, 56 bp, Homo sapiens; identical to SEQ ID NO: 31185
  chr7:28996341-28996397
  hyper

SEQ ID NO: 51953 - DNA, 217 bp, Homo sapiens; identical to SEQ ID NO: 19630
  chr7:28996623-28996840
  hyper

SEQ ID NO: 51954 - DNA, 220 bp, Homo sapiens
  chr7:28996916-28997136
  hyper
aagatgcgcggcccgaggtgctgcaggttgttggccgagaggatgagggaggagagggagcgcagcggtgcgaaggtggccgcgtggcgcagggagggctgtagctcgttggcagagaggttgaggaagcgcagcttgcctagctgggcgaaggcgttcttgcccagaaagcggatccggttggactccagatgtaggtagagcaggttgcccaagggag

SEQ ID NO: 51955 - DNA, 21 bp, Homo sapiens
  chr7:28997625-28997646
  hyper
ccacgagcaggaggcgcaagg

SEQ ID NO: 51956 - DNA, 377 bp, Homo sapiens; identical to SEQ ID NO: 19633
  chr7:28997676-28998053
  hyper

SEQ ID NO: 51957 - DNA, 68 bp, Homo sapiens
  chr7:28998119-28998187
  hyper
gcaccttctcgctcgcggtcccggacggggagggcggctccagtgcaatagctcggggagcacgcggg

SEQ ID NO: 51958 - DNA, 382 bp, Homo sapiens; identical to SEQ ID NO: 31189
  chr7:29185815-29186197
  hyper

SEQ ID NO: 51959 - DNA, 141 bp, Homo sapiens; identical to SEQ ID NO: 31190
  chr7:29603652-29603793
  hyper

SEQ ID NO: 51960 - DNA, 441 bp, Homo sapiens; identical to SEQ ID NO: 31191
  chr7:29604285-29604726
  hyper

SEQ ID NO: 51961 - DNA, 495 bp, Homo sapiens; identical to SEQ ID NO: 31192
  chr7:29846202-29846697
  hyper

SEQ ID NO: 51962 - DNA, 78 bp, Homo sapiens; identical to SEQ ID NO: 19638
  chr7:30721202-30721280
  hyper

SEQ ID NO: 51963 - DNA, 41 bp, Homo sapiens
  chr7:30721902-30721943
  hyper
ccgcagccgcgtgcggagagggagtgggagtgcgcgcccgg

SEQ ID NO: 51964 - DNA, 96 bp, Homo sapiens; identical to SEQ ID NO: 31194
  chr7:30722018-30722114
  hyper

SEQ ID NO: 51965 - DNA, 175 bp, Homo sapiens; identical to SEQ ID NO: 19640
  chr7:30722115-30722290
  hyper

SEQ ID NO: 51966 - DNA, 72 bp, Homo sapiens
  chr7:30722375-30722447
  hyper
ctgcccgaggagaacaccgcagctctgctaatcgagggacagccgcaacccaaagttcggcagctttccgcc

SEQ ID NO: 51967 - DNA, 222 bp, Homo sapiens; identical to SEQ ID NO: 31196
  chr7:31091945-31092167
  hyper

SEQ ID NO: 51968 - DNA, 458 bp, Homo sapiens; identical to SEQ ID NO: 31197
  chr7:31092241-31092699
  hyper

SEQ ID NO: 51969 - DNA, 167 bp, Homo sapiens; identical to SEQ ID NO: 8988
  chr7:31092713-31092880
  hyper

SEQ ID NO: 51970 - DNA, 109 bp, Homo sapiens; identical to SEQ ID NO: 19644
  chr7:31092894-31093003
  hyper

SEQ ID NO: 51971 - DNA, 57 bp, Homo sapiens; identical to SEQ ID NO: 19645
  chr7:31093133-31093190
  hyper

SEQ ID NO: 51972 - DNA, 30 bp, Homo sapiens; identical to SEQ ID NO: 31200
  chr7:31232688-31232718
  hyper

SEQ ID NO: 51973 - DNA, 83 bp, Homo sapiens
  chr7:31376135-31376218
  hyper
ccccctttctccctctccgagcgagtgcggggcagagcctccaggcccgcgcgcggcggtgcgctcgccgctctccatgccac

SEQ ID NO: 51974 - DNA, 128 bp, Homo sapiens; identical to SEQ ID NO: 31202
  chr7:31528357-31528485
  hyper

SEQ ID NO: 51975 - DNA, 143 bp, Homo sapiens; identical to SEQ ID NO: 31203
  chr7:32110353-32110496
  hyper

SEQ ID NO: 51976 - DNA, 30 bp, Homo sapiens
  chr7:32110772-32110802
  hyper
gccaccaccgacctgcggagctgcgtgggc

SEQ ID NO: 51977 - DNA, 146 bp, Homo sapiens
  chr7:32337837-32337983
  hyper
ctgccgctctgtctgtgtgtctctatcatgtccacatcttcctgtcgctttctgtctccctctctcggcactatcttcatctctccatcgcagcgtctccagccctatttccacccctcctttcccccggcctgccttattaaaat

SEQ ID NO: 51978 - DNA, 45 bp, Homo sapiens
  chr7:32338043-32338088
  hyper
cgccgggtcggagcccgcgaggggtgccgggggggacagcccagg

SEQ ID NO: 51979 - DNA, 276 bp, Homo sapiens
  chr7:32338410-32338686
  hyper
cggagtgagcagcccggggctcggcggcgaatcctcccccggccgcgccgcgctgtcactctcagccccgccgcgcgctggcagctgagcgcctggagacaacagcggggacccaatgtcaacagctaaagcgctaggagctcggcggaggcaggagccgtcgcgactgccccatctccaagccgagttccagaggcggcgagaggagtgtcaggaagggaggacgcgcgcccgagcgcgtggacggggctgaccggtgggcgcggagatccctgc

SEQ ID NO: 51980 - DNA, 138 bp, Homo sapiens
  chr7:32338930-32339068
  hyper
acaaggaagtcgggaaaatcgccacgcccacttccttctagccactgcccccagcactggcctggagccccgatagtgtttcttctccactgtccctgccaggaaggtaattgtcaaagtcaccggaggctctatgat

SEQ ID NO: 51981 - DNA, 30 bp, Homo sapiens; identical to SEQ ID NO: 31209
  chr7:32467165-32467195
  hyper

SEQ ID NO: 51982 - DNA, 42 bp, Homo sapiens; identical to SEQ ID NO: 19650
  chr7:32467419-32467461
  hyper

SEQ ID NO: 51983 - DNA, 30 bp, Homo sapiens; identical to SEQ ID NO: 8997
  chr7:32468472-32468502
  hyper

SEQ ID NO: 51984 - DNA, 36 bp, Homo sapiens; identical to SEQ ID NO: 31213
  chr7:32801612-32801648
  hyper

SEQ ID NO: 51985 - DNA, 690 bp, Homo sapiens
  chr7:33943759-33944449
  hyper
cttgccaagcgtccctcactcccacctcgcgccttcgtactttggttacaaaaatcatctctctgcgattgcaccccttttgagtagagggtgccactgcgtggggaggaggcggcgattcagcagggggatcacaggagctgactccccgacacccagtgctgcagaggcgagagggcgcagccgggctgagagagcgacggagctccgagctgcagaggccgccgcgcggcggcccccgccagagatgagcggtggggcgggggttcctccctcttttcgggtgaatgaatgattagtcaaacaccacctccccgccccggtccgcccgagattggaagggaggagtctcggagcgactgttcattttttaaggacgaaaggcgtttgcctcggtacgtttttaaatcgaccttgtgtgtgtttcaacttcggtcatccctagtgtcaggacgcgcagacagctaagcacagaacacatctctaaggccacttgcccctctgtccgctcagccccctgagttcgctgtcgcgcccccgccagagggaagcaaagcagggcatgaaaagttgcgggggccctactgccccgggtgtgtcgctccttcccaaaggtggggcacccgggagcgagcagggtggtggggcgcccctgcgtcccgtttgctgctccctcgctggattggggca

SEQ ID NO: 51986 - DNA, 497 bp, Homo sapiens; identical to SEQ ID NO: 31216
  chr7:33944650-33945147
  hyper

SEQ ID NO: 51987 - DNA, 198 bp, Homo sapiens; identical to SEQ ID NO: 31217
  chr7:33945356-33945554
  hyper

SEQ ID NO: 51988 - DNA, 536 bp, Homo sapiens
  chr7:35225273-35225809
  hyper
aagactcaagaaaagcgccatgcggctccctcctagggctctcctgccctctccttaccgatgctgagagtggttctgctggggaaccaccgcgcctgcagttcgtgcacctcttcccggagctgcgccagggaattacggacgaactggaaggggtcgagaagggtcttggccaccacctttagctccaagccttttcgctttttcagatttgggatcctccccggggaggacctcctggcgccccctggcagtttcccgccgcctagggccgacttttccacctccagctcccgggcgggggaggccccgtacggccgcttagacgggctggggcgggaagattgcagcggctttgggtttactccttgtttcttcataatccctagtggagctgggtcaatttcaggcacagcccatccgagtcaggcgaggtccagaaaggcctgactcgcctggcagcctcaacggacttgtccccgcagccgttgactagccgttgacgagcggacctcccggtcgtcatggcgactgtg

SEQ ID NO: 51989 - DNA, 149 bp, Homo sapiens; identical to SEQ ID NO: 19657
  chr7:35226044-35226193
  hyper

SEQ ID NO: 51990 - DNA, 93 bp, Homo sapiens
  chr7:35292877-35292970
  hyper
gacaacttaggagaccgacgggcccagatataagatgcacattcacagcattcaacagactgaagcctccaaagaaaacttggacccaaaaga

SEQ ID NO: 51991 - DNA, 185 bp, Homo sapiens; identical to SEQ ID NO: 19658
  chr7:35293293-35293478
  hyper

SEQ ID NO: 51992 - DNA, 361 bp, Homo sapiens
  chr7:35294141-35294502
  hyper
aagaaagtagggaagcgctcagtagaatccggcgcctctgagccggcgccaactggccaggtccatactcggggcagatcccagggctgggactctcattcgatggtcccaaatttgatctctttgacagtggggctgagcaaatgcagccctgaaaaagataagcttagcgagagctgcgggcatttggcaaaggatgctgctctcagaaccgtggcttctgctcctcaccagtgcgtctctagcctggggctcctattttccctagagggaccctggaaaatgggacggctgccgaagagaaggcgaaggtcagggcgcggagctctacggtaaccacgcgacgcgtagtgggagagtg

SEQ ID NO: 51993 - DNA, 136 bp, Homo sapiens
  chr7:35294536-35294672
  hyper
cagacccctctggttttacaaaggcggctgtgacgaggacttcccacggccttgttggagggcgtcctgttagccctgctcagcctgaataactcaaattctccgaattcgcagggtaatccgcttcgcttggagc

SEQ ID NO: 51994 - DNA, 27 bp, Homo sapiens
  chr7:35295077-35295104
  hyper
gctggaaggaatttacgctgtcttcta

SEQ ID NO: 51995 - DNA, 196 bp, Homo sapiens
  chr7:35296739-35296935
  hyper
ccgtttaaactttggcgcctaagaatgtaaaattttgttatacatctgagtttgtttatatggaatttgattatatggaagactggaagatgtctccttatatacaccactctttcaaattctcatttgtagctcccggaactcagaagacagtcgacccccaaaactgtccaggaagtaatcggtttccggcttt

SEQ ID NO: 51996 - DNA, 27 bp, Homo sapiens
  chr7:35298121-35298148
  hyper
cgagctcactaccgcagggaccggccc

SEQ ID NO: 51997 - DNA, 164 bp, Homo sapiens
  chr7:35300787-35300951
  hyper
gccgcacgtggacaacgggcccgggcggcctttgtaatgttattttttcttttctgaagataattacctagtattctgcaggttcctctggtgcaacagagactgccgcggggcgggggagaaggtggtgaggggggtcgcgcatcgctcagtgcaggtctgtg

SEQ ID NO: 51998 - DNA, 87 bp, Homo sapiens; identical to SEQ ID NO: 31232
  chr7:35839940-35840027
  hyper

SEQ ID NO: 51999 - DNA, 51 bp, Homo sapiens; identical to SEQ ID NO: 19660
  chr7:37487113-37487164
  hyper

SEQ ID NO: 52000 - DNA, 140 bp, Homo sapiens
  chr7:37487826-37487966
  hyper
ataggaatcttgactccaagatcccagccccacatcccccgtccccagtaaccccgcgccagcgtcgcaaccctcccgcgccccccctcccgcagaccctggtcgaaatgtctcggcgggctcccgggccccgggccctg

SEQ ID NO: 52001 - DNA, 273 bp, Homo sapiens
  chr7:37487984-37488257
  hyper
cgcacctccagcgccccctccctccgctcccactcccactcccgccatccccggagctcagacttccccaactgcagagcgccccgacgcgcccgcagccctcaccctgccgagcgcggcggccacccccgcccgagccgcggcgcccccagggaggaaacaaaagtgtctccgcggcgcccggagtcccccggagcaggacgcctcctcccggccccagtcccggccccctcccctgccgcgccgaggtcagcgagtcggggcgcggcgcca

SEQ ID NO: 52002 - DNA, 342 bp, Homo sapiens; identical to SEQ ID NO: 19662
  chr7:37488578-37488920
  hyper

SEQ ID NO: 52003 - DNA, 27 bp, Homo sapiens
  chr7:37488992-37489019
  hyper
tgtttgttttgacgctgtgcctctacc

SEQ ID NO: 52004 - DNA, 133 bp, Homo sapiens; identical to SEQ ID NO: 19664
  chr7:37955745-37955878
  hyper

SEQ ID NO: 52005 - DNA, 55 bp, Homo sapiens
  chr7:37955979-37956034
  hyper
cgttctcctgcgtgctgtggtgcaggtggttgggcatccgcgtgatgttccaggg

SEQ ID NO: 52006 - DNA, 11 bp, Homo sapiens
  chr7:37956260-37956271
  hyper
cccccaaactc

SEQ ID NO: 52007 - DNA, 129 bp, Homo sapiens
  chr7:37956439-37956568
  hyper
cctatttatcccgacacctcccctgacgtgggctcggaacgctcccttggcagctgcagccgcggcgcgggctccccctcggccgccccacccccaggcccgtcggtgcagaagcggtgacatcacccc

SEQ ID NO: 52008 - DNA, 66 bp, Homo sapiens
  chr7:37960235-37960301
  hyper
gtgagcagtgaaaaccgaagcggcagaaggcagtggcagcaggcagtggcagcaggcagtggccca

SEQ ID NO: 52009 - DNA, 202 bp, Homo sapiens
  chr7:37960335-37960537
  hyper
ttccccgggccctggtcccggctaccgggactcgcgcgtccggatctcaaaagcggcagaggccaccgaagggacaggaagcactttggtccagaccacactcccggcacagtgcggaaagagccggcgggagccactctgatcccggacgcctcagcgcccccttgggcttgggcttgccctcgggccggggaaggctgac

SEQ ID NO: 52010 - DNA, 396 bp, Homo sapiens; identical to SEQ ID NO: 9019
  chr7:37960562-37960958
  hyper

SEQ ID NO: 52011 - DNA, 51 bp, Homo sapiens
  chr7:38670306-38670357
  hyper
agcactgtgtgatcacgatcctaccctattggtcctgggagatttttggtg

SEQ ID NO: 52012 - DNA, 149 bp, Homo sapiens
  chr7:38671015-38671164
  hyper
gcgggaggaggagcgggaggaggaggagagggccgagcaagggaggagcgggagaagcggcggggagccgcggagcgcggaggggtgagggcggggcgcggcggcgggaccagcttaaagcgacagagcgggggcgggatgcgtcggga

SEQ ID NO: 52013 - DNA, 748 bp, Homo sapiens; identical to SEQ ID NO: 31245
  chr7:39453541-39454289
  hyper

SEQ ID NO: 52014 - DNA, 38 bp, Homo sapiens; identical to SEQ ID NO: 31246
  chr7:39873278-39873316
  hyper

SEQ ID NO: 52015 - DNA, 19 bp, Homo sapiens
  chr7:42267628-42267647
  hyper
ttcaccacttttgcccgcg

SEQ ID NO: 52016 - DNA, 35 bp, Homo sapiens; identical to SEQ ID NO: 19671
  chr7:42267677-42267712
  hyper

SEQ ID NO: 52017 - DNA, 89 bp, Homo sapiens; identical to SEQ ID NO: 31248
  chr7:42275797-42275886
  hyper

SEQ ID NO: 52018 - DNA, 250 bp, Homo sapiens
  chr7:42276096-42276346
  hyper
cgcggcggaggtccccgcgcgcacccaccatgcctcccgcctccttccgcccatcccgagcgccgtgcgcgcccgaagcccgagccgtagagcgccaccgcgcaaaggaaggagccaggcgcgtgcggggctcgcggagttcttctgaaccctttggatgggggcggaggcgaggggcgccgccaccactgcggcaaacttcgtcccccctccgggaggtgaaattctccaatccgtctccggccggtcc

SEQ ID NO: 52019 - DNA, 261 bp, Homo sapiens; identical to SEQ ID NO: 19674
  chr7:42276634-42276895
  hyper

SEQ ID NO: 52020 - DNA, 141 bp, Homo sapiens; identical to SEQ ID NO: 31250
  chr7:42277420-42277561
  hyper

SEQ ID NO: 52021 - DNA, 200 bp, Homo sapiens; identical to SEQ ID NO: 31251
  chr7:42277621-42277821
  hyper

SEQ ID NO: 52022 - DNA, 20 bp, Homo sapiens
  chr7:42533061-42533081
  hyper
ggaaagggaggaggccggga

SEQ ID NO: 52023 - DNA, 30 bp, Homo sapiens; identical to SEQ ID NO: 31253
  chr7:42927875-42927905
  hyper

SEQ ID NO: 52024 - DNA, 30 bp, Homo sapiens; identical to SEQ ID NO: 31254
  chr7:42928140-42928170
  hyper

SEQ ID NO: 52025 - DNA, 139 bp, Homo sapiens
  chr7:43151970-43152109
  hyper
cacacacaaaagggccgaggagccagggttggtgttggatatgcccagtacgcgtgctgggtgttggaaggatggggccggcggtaacaagaatcgatatatatttaccgcgggggcgggggtgggggtgcgcggaggc

SEQ ID NO: 52026 - DNA, 215 bp, Homo sapiens; identical to SEQ ID NO: 19677
  chr7:43152700-43152915
  hyper

SEQ ID NO: 52027 - DNA, 307 bp, Homo sapiens
  chr7:43153237-43153544
  hyper
agacaggcagggagggagctgccggggcggggagggggggggaatgcgtccggtccatttttggctggaggtgcgcttcctgctacccccacgttcccgggcggtgacaatgcagcaaaatccgagggctcaaacaatgtggcccctccatccccggctccagggcattctgattgctctgccgctttgacgtcccggccacttggctgattttcagagccatgatgcgcggtgtctctgtcttgcacacagaggctgggcaccataacttcttccctgccgaatttcagcgcgtagggggagctgg

SEQ ID NO: 52028 - DNA, 27 bp, Homo sapiens
  chr7:44143915-44143942
  hyper
aagccccggcgcccccgccccgggccc

SEQ ID NO: 52029 - DNA, 405 bp, Homo sapiens; identical to SEQ ID NO: 31259
  chr7:44144029-44144434
  hyper

SEQ ID NO: 52030 - DNA, 33 bp, Homo sapiens; identical to SEQ ID NO: 31260
  chr7:44349574-44349607
  hyper

SEQ ID NO: 52031 - DNA, 44 bp, Homo sapiens; identical to SEQ ID NO: 31261
  chr7:44349655-44349699
  hyper

SEQ ID NO: 52032 - DNA, 194 bp, Homo sapiens; identical to SEQ ID NO: 31262
  chr7:44364485-44364679
  hyper

SEQ ID NO: 52033 - DNA, 140 bp, Homo sapiens
  chr7:44364698-44364838
  hyper
cgcgagcccggagccccggcccggcagccgcgctgggcagagctgggcagggccgcgcgcgctgaggtcaggcagccaggcccggggccgggggctcgcgggtcggggccgcgcggggccgtgcgcttgggcccggagcc

SEQ ID NO: 52034 - DNA, 179 bp, Homo sapiens; identical to SEQ ID NO: 19681
  chr7:44364903-44365082
  hyper

SEQ ID NO: 52035 - DNA, 119 bp, Homo sapiens; identical to SEQ ID NO: 31264
  chr7:44365117-44365236
  hyper

SEQ ID NO: 52036 - DNA, 30 bp, Homo sapiens; identical to SEQ ID NO: 31265
  chr7:44924253-44924283
  hyper

SEQ ID NO: 52037 - DNA, 292 bp, Homo sapiens; identical to SEQ ID NO: 31266
  chr7:45128841-45129133
  hyper

SEQ ID NO: 52038 - DNA, 51 bp, Homo sapiens; identical to SEQ ID NO: 31267
  chr7:45197382-45197433
  hyper

SEQ ID NO: 52039 - DNA, 298 bp, Homo sapiens
  chr7:45613487-45613785
  hyper
tgcgcatggaagggacgtacgccccaggcctccaccttcctcctgaccccggggattcttggacgtcgattctccgtctcgtaggggcgagggccctgggttcgcagtcagacgcgggcccctctcaaatctagtggcctggttttattgagtgggggaaggcacatattttccaagattaactgccccgcaacagggaatttcgcaggatttcagtattttcgactccccaggtgacgccaagagggtgggttccactgtgcacggtggggaaactgaggctcggaggggacaagga

SEQ ID NO: 52040 - DNA, 443 bp, Homo sapiens; identical to SEQ ID NO: 19684
  chr7:45613898-45614341
  hyper

SEQ ID NO: 52041 - DNA, 263 bp, Homo sapiens; identical to SEQ ID NO: 19685
  chr7:45614474-45614737
  hyper

SEQ ID NO: 52042 - DNA, 87 bp, Homo sapiens; identical to SEQ ID NO: 9039
  chr7:45928490-45928577
  hyper

SEQ ID NO: 52043 - DNA, 51 bp, Homo sapiens; identical to SEQ ID NO: 31271
  chr7:45959968-45960019
  hyper

SEQ ID NO: 52044 - DNA, 267 bp, Homo sapiens; identical to SEQ ID NO: 31272
  chr7:45960227-45960494
  hyper

SEQ ID NO: 52045 - DNA, 322 bp, Homo sapiens; identical to SEQ ID NO: 19687
  chr7:45960794-45961116
  hyper

SEQ ID NO: 52046 - DNA, 77 bp, Homo sapiens
  chr7:45961756-45961833
  hyper
gtcattttttgaaggcgacttcgtattactgtattctcgatgcgttgggattctagcttatctctgcaatctaaaca

SEQ ID NO: 52047 - DNA, 69 bp, Homo sapiens; identical to SEQ ID NO: 19689
  chr7:45961888-45961957
  hyper

SEQ ID NO: 52048 - DNA, 962 bp, Homo sapiens; identical to SEQ ID NO: 31276
  chr7:48074917-48075879
  hyper

SEQ ID NO: 52049 - DNA, 129 bp, Homo sapiens
  chr7:49812691-49812820
  hyper
agaggaagatgggagcggggagagattggcagagattcagaaagttcgcgcttgagatttttacgtttcttactcgtaaacgtctatttctctgggtttctgaatgcaaagacgagaaagtctcaacag

SEQ ID NO: 52050 - DNA, 99 bp, Homo sapiens
  chr7:49813994-49814093
  hyper
agagaggctggattgccggtgtcctgcggcgtctcgggctctcccagcccctttgggcggcagaaactttggaatccagaaaggctggccgggatccag

SEQ ID NO: 52051 - DNA, 410 bp, Homo sapiens
  chr7:49814121-49814531
  hyper
cgccctggggccccagcctcccgcactgcacaccttggtgctgcccgggcgcttctgctccgcagccaggacactacaagactgagcgctgcggccggcgacctggctcccaaggctcggaggggcgggccggcagaggagctgaagccccgggaatccccgacccggccctctggcaaggggccgagggcatcctttcatgcagcggggcttagagagcggggagggggcgtctgctcccgagacgggagtcttttaagaagttgttagaaatgaatcgtggagtcctaggagaagctttgtttaacctccccgcattttcccagcacaaccccctaaagcaaatgaggaagagtttccctcttatcttcctgtacattcgtccgtctctaactccactgctgaattct

SEQ ID NO: 52052 - DNA, 42 bp, Homo sapiens
  chr7:50343221-50343263
  hyper
ctcgcatcctggggccggagcctgaacccgggagccaagggg

SEQ ID NO: 52053 - DNA, 89 bp, Homo sapiens; identical to SEQ ID NO: 19693
  chr7:50343401-50343490
  hyper

SEQ ID NO: 52054 - DNA, 232 bp, Homo sapiens; identical to SEQ ID NO: 19694
  chr7:50343994-50344226
  hyper

SEQ ID NO: 52055 - DNA, 247 bp, Homo sapiens; identical to SEQ ID NO: 19695
  chr7:50344491-50344738
  hyper

SEQ ID NO: 52056 - DNA, 40 bp, Homo sapiens; identical to SEQ ID NO: 31286
  chr7:51383352-51383392
  hyper

SEQ ID NO: 52057 - DNA, 46 bp, Homo sapiens; identical to SEQ ID NO: 31287
  chr7:51384251-51384297
  hyper

SEQ ID NO: 52058 - DNA, 66 bp, Homo sapiens
  chr7:54609786-54609852
  hyper
tgtcctcctcggcaccgagcgatctgatccgccgagccagaaagacacccgatgggggagagaagc

SEQ ID NO: 52059 - DNA, 55 bp, Homo sapiens
  chr7:54612363-54612418
  hyper
tgtggagatgtcctgcgccttccagagcggctccgcctcggtgtatctggagatc

SEQ ID NO: 52060 - DNA, 67 bp, Homo sapiens
  chr7:54612730-54612797
  hyper
gttctggtacttaggcagatgcccgccttgcccctaccacgctgccacatcccgggacatccgggag

SEQ ID NO: 52061 - DNA, 99 bp, Homo sapiens; identical to SEQ ID NO: 31292
  chr7:54614009-54614108
  hyper

SEQ ID NO: 52062 - DNA, 50 bp, Homo sapiens; identical to SEQ ID NO: 31293
  chr7:54614391-54614441
  hyper

SEQ ID NO: 52063 - DNA, 30 bp, Homo sapiens; identical to SEQ ID NO: 31294
  chr7:54614739-54614769
  hyper

SEQ ID NO: 52064 - DNA, 510 bp, Homo sapiens; identical to SEQ ID NO: 31295
  chr7:54732044-54732554
  hyper

SEQ ID NO: 52065 - DNA, 65 bp, Homo sapiens; identical to SEQ ID NO: 31296
  chr7:55086624-55086689
  hyper

SEQ ID NO: 52066 - DNA, 270 bp, Homo sapiens
  chr7:55087533-55087803
  hyper
tagggaagctgaggaaggaacccaaaaatacagcctcccctcggaccccgcgggacaggcggctttctgagaggacctccccgcctccgccctccgcgcaggtctcaaactgaagccggcgcccgccagcctggccccggcccctctccaggtccccgcgatcctcgttccccagtgtggagtcgcagcctcgacctgggagctgggagaactcgtctaccaccacctgcggctcccggggaggggtggtgctggcggcggttagtttcc

SEQ ID NO: 52067 - DNA, 290 bp, Homo sapiens; identical to SEQ ID NO: 31298
  chr7:56183846-56184136
  hyper

SEQ ID NO: 52068 - DNA, 44 bp, Homo sapiens; identical to SEQ ID NO: 31299
  chr7:56355700-56355744
  hyper

SEQ ID NO: 52069 - DNA, 443 bp, Homo sapiens; identical to SEQ ID NO: 31300
  chr7:63767561-63768004
  hyper

SEQ ID NO: 52070 - DNA, 83 bp, Homo sapiens
  chr7:64349056-64349139
  hyper
gtcttcggggtgagaggtccggctcctggaggacagcgggatgggagagtcccgttcacacccagccccgcagagccggatag

SEQ ID NO: 52071 - DNA, 30 bp, Homo sapiens; identical to SEQ ID NO: 31302
  chr7:64350006-64350036
  hyper

SEQ ID NO: 52072 - DNA, 289 bp, Homo sapiens; identical to SEQ ID NO: 31303
  chr7:64407780-64408069
  hyper

SEQ ID NO: 52073 - DNA, 333 bp, Homo sapiens
  chr7:64700329-64700662
  hyper
gctggcgtggccgggctcctgctcccctattctccgacccccgccacctagcccgcgccacccagggctcctggatcgtctggctcggggcctcctccccgctgcgttccctccctggcggctgcagagccctcctgggcagcggaaacaaacttccccgagcaggaagcccgtgccccagcctcctctcggcaaggaccagcccgcggaacaccccggcccctcggcgcctgccctgtccttctggctacgggtccaggagggctggcatgagaccaatcgcgaccctgcggttccagagcctgcgtcccgcactgccgagaccacacagtc

SEQ ID NO: 52074 - DNA, 86 bp, Homo sapiens
  chr7:64712278-64712364
  hyper
ttctggctgtcccaccggcgatgctgcgcttccacaccacccggcgcacaggcgttggtagatgtggaaggtaccaagagcggcag

SEQ ID NO: 52075 - DNA, 494 bp, Homo sapiens
  chr7:64712510-64713004
  hyper
cgcccatcccaatccgcacccgccgcccaggaaccggggctcaccctccgcctgacaattgtctcggggtgccgagggtccgtggcccgttgcccgggaggtgaccactgaggagtcgcgctgggtatcggaccaggaactcactgctttcattggctgcggaggtcagaccgtcccaccctcttctccccgccgccgcggcaaggccagggcgaaagggacaagtgcgctgctggggtcctctgcgctgtgcgggtccgggactcagggttcccggctgctaacaaggctgcgtagcttccccctcccctcctccttaggtggcaacttgtggacacacccattaagcggtcaggcgtcaggtttcctcccgagaggtgggaggcgccctggccttgattcatcgtgaagctaggcaggagatttcccagccacggagggtggaaagcttgccttgacctcagcaggtcatgtcactccgtgtgcacaaggcc

SEQ ID NO: 52076 - DNA, 299 bp, Homo sapiens; identical to SEQ ID NO: 31306
  chr7:64734473-64734772
  hyper

SEQ ID NO: 52077 - DNA, 112 bp, Homo sapiens; identical to SEQ ID NO: 19703
  chr7:64974270-64974382
  hyper

SEQ ID NO: 52078 - DNA, 28 bp, Homo sapiens
  chr7:64974422-64974450
  hyper
aaagccgcggtggcaaaaatgcgcggcg

SEQ ID NO: 52079 - DNA, 480 bp, Homo sapiens; identical to SEQ ID NO: 3051
  chr7:64974510-64974990
  hyper

SEQ ID NO: 52080 - DNA, 79 bp, Homo sapiens; identical to SEQ ID NO: 31310
  chr7:65446028-65446107
  hyper

SEQ ID NO: 52081 - DNA, 65 bp, Homo sapiens
  chr7:65508930-65508995
  hyper
cacctactttcagggcggacagactcaggcctttacagcctgctaagtcccgggtcggataccag

SEQ ID NO: 52082 - DNA, 144 bp, Homo sapiens; identical to SEQ ID NO: 19708
  chr7:69062375-69062519
  hyper

SEQ ID NO: 52083 - DNA, 395 bp, Homo sapiens
  chr7:69062635-69063030
  hyper
tccaactctgccagttggtgctcccactgcgcccaggcggagcaaaggcccgcgctttggcacccgctccccgttctgtctcctccagtcgcgccccctcccagggacgccccccttgtaccccttctctgaattcccttctctcctcgcagcgcaggtagccaagggaaaacacccttgggggctggtggggcttcccgagaaggcggcctcgggccggccaggggtagaggatccagggacaagtgtcccgaggaggatgtggggggcgcgcgcgcgaagtggcctgggagcaggggcccacacgcgtccccgctgcgacaggcgggatcctccggcggcttccacgccctggcgcgccaactctgcccggccgcggccgaccccacgcgggc

SEQ ID NO: 52084 - DNA, 344 bp, Homo sapiens
  chr7:69064246-69064590
  hyper
ttgatcaaagcattccgctattctgatttattgcttgcttggtgagttatttttttttcctctaaaggagacctgtgtgttcagccattactttgctcggcgctgctcccaggcatctccgaccctcggtgctgtggggagccccacacttgggctcctcgcctctcgccctcgctccccgtccctcctcccctctctccgccccttcccccttttctttctcctctctttcttcccctctctcccttctttcggccgccgtctcccccgcgccctcctcggggcggagggaagccgtgaagggggagggagggctcggtgtcaatttttttttgtgtggctgc

SEQ ID NO: 52085 - DNA, 116 bp, Homo sapiens
  chr7:69065045-69065161
  hyper
gtctgtctgtctgtctgtctgtctgtctaggctgaggtcttattgttggtggggggagctgggggcgcgggcagacaggcagcaggagggagtcgcaaagccgtgcctggtctcgt

SEQ ID NO: 52086 - DNA, 269 bp, Homo sapiens; identical to SEQ ID NO: 31315
  chr7:70596147-70596416
  hyper

SEQ ID NO: 52087 - DNA, 23 bp, Homo sapiens
  chr7:70596688-70596711
  hyper
cggggctgtgtggctctcggtgc

SEQ ID NO: 52088 - DNA, 128 bp, Homo sapiens
  chr7:70598387-70598515
  hyper
gaggaaatagtcttagagcccagcgtttggtggggtaccagtagggaacctgggagattggagggcttggatgtctgcagacaaagtcaaggccccaggtcgcggagctaatgcgcttaggtagtata

SEQ ID NO: 52089 - DNA, 75 bp, Homo sapiens
  chr7:71217033-71217108
  hyper
atgcagaagataaaacgtttcgcagcaccgggtccaaggaagtgcaatacaacagcaaaatgcaatggccgcagc

SEQ ID NO: 52090 - DNA, 45 bp, Homo sapiens; identical to SEQ ID NO: 19713
  chr7:71800631-71800676
  hyper

SEQ ID NO: 52091 - DNA, 141 bp, Homo sapiens; identical to SEQ ID NO: 31322
  chr7:71802206-71802347
  hyper

SEQ ID NO: 52092 - DNA, 130 bp, Homo sapiens
  chr7:71802637-71802767
  hyper
ccagggggaaggcggggcgccgaagtggaggggccaatggccgaaactgcggggaccagcattccgcgtgaccgcccctggagacgtccagggaggcacggctgccgcagggcatcgcccacccaccagc

SEQ ID NO: 52093 - DNA, 165 bp, Homo sapiens; identical to SEQ ID NO: 31325
  chr7:76145381-76145546
  hyper

SEQ ID NO: 52094 - DNA, 17 bp, Homo sapiens
  chr7:79081775-79081792
  hyper
gtcccttcttttcttcg

SEQ ID NO: 52095 - DNA, 71 bp, Homo sapiens
  chr7:79081821-79081892
  hyper
cagctggggacccaggcgcccccagcccagccccagaaacgctggacgcagttctccgctcaccccaccac

SEQ ID NO: 52096 - DNA, 361 bp, Homo sapiens
  chr7:79082218-79082579
  hyper
ccccaccccatcatcgcgcaacacacccccttcaacatgcgcggccaccctttcattgccctgcgccccgagcggtcccaccgcccggcaaaacactgagcaagccgctgctctcaccttgcttgacacacttgagccggagggggtccttgcagtgtttgatcacggccagcacgtccctgatggtgagccccgccacgggggtctcgttcacctccagcagcagctcctccgacaccaatttgctgccgctctcataggccaccttgccgggcttcacctcccccaggtaggggaactgtccattctcggcgccccccttcagttcaaagcccagctggccctccgggttcctgccaat

SEQ ID NO: 52097 - DNA, 202 bp, Homo sapiens; identical to SEQ ID NO: 19717
  chr7:79083190-79083392
  hyper

SEQ ID NO: 52098 - DNA, 53 bp, Homo sapiens; identical to SEQ ID NO: 31329
  chr7:79764160-79764213
  hyper

SEQ ID NO: 52099 - DNA, 220 bp, Homo sapiens; identical to SEQ ID NO: 31330
  chr7:79764492-79764712
  hyper

SEQ ID NO: 52100 - DNA, 61 bp, Homo sapiens; identical to SEQ ID NO: 31331
  chr7:79765016-79765077
  hyper

SEQ ID NO: 52101 - DNA, 344 bp, Homo sapiens
  chr7:82072006-82072350
  hyper
ttgaagaacagggaccgcgtgtctgccgacacttagatgtttcaaataatgggttggggaggttggatcgcgtggtcccagtacctgcgagccccctgcgtggacagcacgctcggccgcggggagccagcacgcgtctaatcggaaggctgtcaagtgcatccagtaacgtgggataaaacgagtttgggcactacagcaattaaagagcatctccgaggccaagtgcgggggaagtccacgctacctcggcaagcctgaaattacctgtttgtaaattacccaaccaaaacataactttttattgaactgggttgaatcagagcgggtgagctggctggaaa

SEQ ID NO: 52102 - DNA, 59 bp, Homo sapiens
  chr7:82072503-82072562
  hyper
tccagcggcgagcggcgcgcaccgcctgcccggcgtctccgcatccgagcctggctccc

SEQ ID NO: 52103 - DNA, 53 bp, Homo sapiens; identical to SEQ ID NO: 31333
  chr7:82072646-82072699
  hyper

SEQ ID NO: 52104 - DNA, 59 bp, Homo sapiens; identical to SEQ ID NO: 31334
  chr7:82791978-82792037
  hyper

SEQ ID NO: 52105 - DNA, 34 bp, Homo sapiens; identical to SEQ ID NO: 31335
  chr7:83277925-83277959
  hyper

SEQ ID NO: 52106 - DNA, 45 bp, Homo sapiens; identical to SEQ ID NO: 9081
  chr7:83278225-83278270
  hyper

SEQ ID NO: 52107 - DNA, 71 bp, Homo sapiens; identical to SEQ ID NO: 31337
  chr7:83824239-83824310
  hyper

SEQ ID NO: 52108 - DNA, 59 bp, Homo sapiens; identical to SEQ ID NO: 31338
  chr7:84814638-84814697
  hyper

SEQ ID NO: 52109 - DNA, 35 bp, Homo sapiens; identical to SEQ ID NO: 31339
  chr7:84815396-84815431
  hyper

SEQ ID NO: 52110 - DNA, 127 bp, Homo sapiens; identical to SEQ ID NO: 31341
  chr7:84816225-84816352
  hyper

SEQ ID NO: 52111 - DNA, 177 bp, Homo sapiens; identical to SEQ ID NO: 19722
  chr7:86273541-86273718
  hyper

SEQ ID NO: 52112 - DNA, 13 bp, Homo sapiens
  chr7:86273719-86273732
  hyper
gcttcagcctggt

SEQ ID NO: 52113 - DNA, 47 bp, Homo sapiens; identical to SEQ ID NO: 31344
  chr7:86274070-86274117
  hyper

SEQ ID NO: 52114 - DNA, 39 bp, Homo sapiens; identical to SEQ ID NO: 31346
  chr7:86688488-86688527
  hyper

SEQ ID NO: 52115 - DNA, 3 bp, Homo sapiens
  chr7:87104813-87104816
  hyper
caa

SEQ ID NO: 52116 - DNA, 1 bp, Homo sapiens
  chr7:87229536-87229537
  hyper
t

SEQ ID NO: 52117 - DNA, 90 bp, Homo sapiens; identical to SEQ ID NO: 19725
  chr7:87230433-87230523
  hyper

SEQ ID NO: 52118 - DNA, 100 bp, Homo sapiens
  chr7:87256912-87257012
  hyper
ctcctgcaggtaaaacggtgggtagtgagaagctctaggaagggggcgcttccgaacacgcgcgtcgaggagggcgttccaggactctgagggagcagcc

SEQ ID NO: 52119 - DNA, 413 bp, Homo sapiens; identical to SEQ ID NO: 31352
  chr7:87257327-87257740
  hyper

SEQ ID NO: 52120 - DNA, 115 bp, Homo sapiens; identical to SEQ ID NO: 31353
  chr7:87258283-87258398
  hyper

SEQ ID NO: 52121 - DNA, 64 bp, Homo sapiens; identical to SEQ ID NO: 31354
  chr7:87936120-87936184
  hyper

SEQ ID NO: 52122 - DNA, 50 bp, Homo sapiens; identical to SEQ ID NO: 31355
  chr7:88387737-88387787
  hyper

SEQ ID NO: 52123 - DNA, 30 bp, Homo sapiens; identical to SEQ ID NO: 31357
  chr7:88388282-88388312
  hyper

SEQ ID NO: 52124 - DNA, 219 bp, Homo sapiens; identical to SEQ ID NO: 19729
  chr7:88388660-88388879
  hyper

SEQ ID NO: 52125 - DNA, 223 bp, Homo sapiens
  chr7:89748340-89748563
  hyper
gcaggcgctggggagagtgtggagaggctgcgtggagctgcgcgctcggggtgggggctgcactcccaatgaagcgcgtgaagggcaagcggtgatgggttctgcgccagtggggctgggagcgtgtcgggggctgtacgtggggctgcgcgcaaggtgagaactgcgcatctaggcttggggactgcgcgcaccaaaggcttgcaggcgctggggagggtgg

SEQ ID NO: 52126 - DNA, 20 bp, Homo sapiens
  chr7:89841213-89841233
  hyper
cgccgcggcagccaccctgc

SEQ ID NO: 52127 - DNA, 1 bp, Homo sapiens
  chr7:90226268-90226269
  hyper
g

SEQ ID NO: 52128 - DNA, 99 bp, Homo sapiens
  chr7:90226464-90226563
  hyper
tggtattgtttaacgtatccaacctaaagggaagtgggacagttaccttgggacctattgttcggtacttcgggtcctggaaagcgagatttgggtgtt

SEQ ID NO: 52129 - DNA, 74 bp, Homo sapiens
  chr7:90894938-90895012
  hyper
cagcaaccctcagcacggcggcggagggcaccgtggcggcttcccggggggcgccggcgcgtcggagcgaggca

SEQ ID NO: 52130 - DNA, 17 bp, Homo sapiens
  chr7:90895097-90895114
  hyper
gccgaccaaggtgtatg

SEQ ID NO: 52131 - DNA, 43 bp, Homo sapiens; identical to SEQ ID NO: 31369
  chr7:91510048-91510091
  hyper

SEQ ID NO: 52132 - DNA, 329 bp, Homo sapiens; identical to SEQ ID NO: 9101
  chr7:91808202-91808531
  hyper

SEQ ID NO: 52133 - DNA, 81 bp, Homo sapiens
  chr7:92466400-92466481
  hyper
cagggtcgcccagagttggggttttgacagggtgaagcggggggcatcctcactgtgtgacgtggacggatgggaaaaaca

SEQ ID NO: 52134 - DNA, 19 bp, Homo sapiens
  chr7:93203756-93203775
  hyper
aacccgggaaggtccgcca

SEQ ID NO: 52135 - DNA, 34 bp, Homo sapiens; identical to SEQ ID NO: 19734
  chr7:93204298-93204332
  hyper

SEQ ID NO: 52136 - DNA, 107 bp, Homo sapiens
  chr7:93204492-93204599
  hyper
ttccacaagaaccttatcccagagacattgtgaccctggcttcttcagccgccactccggggacagcactagggagcctgtggagggagggtcggtagtgggctagg

SEQ ID NO: 52137 - DNA, 30 bp, Homo sapiens; identical to SEQ ID NO: 31374
  chr7:93205084-93205114
  hyper

SEQ ID NO: 52138 - DNA, 147 bp, Homo sapiens
  chr7:93519204-93519351
  hyper
atctttccctgagtccgcacaggcactgaattatgatcaatgtcagttgggagacaggaaatgtgttagtggttgtaaatttgtgattacttttaagaaactgaaaaccatgaggtttgcttaacacttgagaaaacccaggctaaa

SEQ ID NO: 52139 - DNA, 322 bp, Homo sapiens
  chr7:93520137-93520459
  hyper
ggggtggctgattcatgcacggggactgtcaccccgccgcccccgcgctgcaaactgtgtaagagggagaggaattccccgccaagttgaaaagttgaacctgcctcccaaactttctcctgtagtccagacggggacgccctgagggagcgtttgtgtcagtaatgggaaatctgcaagctagacggaaatgacctgctagtgattgcgctgtaaagaagccggaatccacctcttgaaggcatgaagttcaggtatttgaaaggctggtggagagaaagtgcggagttcttgggtcagagcggagcgggattcgttgcaa

SEQ ID NO: 52140 - DNA, 270 bp, Homo sapiens
  chr7:93551053-93551323
  hyper
cagccccagcccagccgtcccccgcgggcgtggcaggtcctgagtcagggcctgtccgtggccagcatccctgctgggcgattgagcagcgggaagctgcttggacccagtctcaaacttaaccctcatctagcacccgggcaggcctcctgggttgcagggacttgagaaaaggcagagttctcaggtcctaggaagctggggcacgctggcgtgacaagcgtcccggagaaagccaagccctcggggagctggggaccgcagcagggc

SEQ ID NO: 52141 - DNA, 105 bp, Homo sapiens
  chr7:93551425-93551530
  hyper
cccgagcccggttctggggcgaaaatgcctgcccttcacatcgaagatttgccagagaaggaaaaactgaaaatggaagttgagcagcttcgcaaagaagtgaag

SEQ ID NO: 52142 - DNA, 30 bp, Homo sapiens; identical to SEQ ID NO: 31379
  chr7:94024050-94024080
  hyper

SEQ ID NO: 52143 - DNA, 223 bp, Homo sapiens; identical to SEQ ID NO: 19737
  chr7:94284873-94285096
  hyper

SEQ ID NO: 52144 - DNA, 153 bp, Homo sapiens; identical to SEQ ID NO: 31381
  chr7:94536847-94537000
  hyper

SEQ ID NO: 52145 - DNA, 131 bp, Homo sapiens; identical to SEQ ID NO: 31382
  chr7:95225822-95225953
  hyper

SEQ ID NO: 52146 - DNA, 30 bp, Homo sapiens; identical to SEQ ID NO: 31383
  chr7:95226177-95226207
  hyper

SEQ ID NO: 52147 - DNA, 30 bp, Homo sapiens; identical to SEQ ID NO: 31384
  chr7:95402081-95402111
  hyper

SEQ ID NO: 52148 - DNA, 49 bp, Homo sapiens; identical to SEQ ID NO: 31385
  chr7:95402319-95402368
  hyper

SEQ ID NO: 52149 - DNA, 88 bp, Homo sapiens
  chr7:96621811-96621899
  hyper
gaggcttcgaatataaccttgcctatttctcgcctactgagatttctttccagaaaaggacattctcctgctccgaggagatggatcc

SEQ ID NO: 52150 - DNA, 53 bp, Homo sapiens
  chr7:96625720-96625773
  hyper
cttgtcaagtatggttttaattaaacatcttccggcctcgaaagattacatgt

SEQ ID NO: 52151 - DNA, 24 bp, Homo sapiens
  chr7:96625974-96625998
  hyper
gagcctgacaggtcccgggtccca

SEQ ID NO: 52152 - DNA, 161 bp, Homo sapiens
  chr7:96626051-96626212
  hyper
taagtaactcaaacccgacccggcaagcgtggcccaagctgcttttgcagttggggacaattgagcggacacacaagttaatcccgcactgatttgtttcggatccatctgcaggacgcctgatgcctcccccttggctgctgcagcggacacctgcctcc

SEQ ID NO: 52153 - DNA, 118 bp, Homo sapiens; identical to SEQ ID NO: 9114
  chr7:96627308-96627426
  hyper

SEQ ID NO: 52154 - DNA, 267 bp, Homo sapiens; identical to SEQ ID NO: 31391
  chr7:96633233-96633500
  hyper

SEQ ID NO: 52155 - DNA, 50 bp, Homo sapiens; identical to SEQ ID NO: 31392
  chr7:96634276-96634326
  hyper

SEQ ID NO: 52156 - DNA, 141 bp, Homo sapiens
  chr7:96635204-96635345
  hyper
ctgcagaggggagagcggcgcgagccaagtgggggagggtggaggaaacccgggagaaggctttctccagcccccaaagtttttgatgatgaccatgactacgatggctgacggcttggaaggccaggactcgtccaaatc

SEQ ID NO: 52157 - DNA, 104 bp, Homo sapiens; identical to SEQ ID NO: 9117
  chr7:96635486-96635590
  hyper

SEQ ID NO: 52158 - DNA, 114 bp, Homo sapiens; identical to SEQ ID NO: 19744
  chr7:96635619-96635733
  hyper

SEQ ID NO: 52159 - DNA, 162 bp, Homo sapiens
  chr7:96636645-96636807
  hyper
cgcaccccagagagcctccggcaccgcctccgctgcggcaaagcgggctgtttgtctgagggcctctggcgctcccttggcccagacgctgcacattgttcgggccagggactgggtcaaggagattacgcagacgctgggagcacacgggcagagtggacc

SEQ ID NO: 52160 - DNA, 82 bp, Homo sapiens; identical to SEQ ID NO: 31398
  chr7:96642045-96642127
  hyper

SEQ ID NO: 52161 - DNA, 809 bp, Homo sapiens; identical to SEQ ID NO: 31399
  chr7:96645617-96646426
  hyper

SEQ ID NO: 52162 - DNA, 10 bp, Homo sapiens
  chr7:96646652-96646662
  hyper
gcacccacag

SEQ ID NO: 52163 - DNA, 206 bp, Homo sapiens
  chr7:96647131-96647337
  hyper
ggagaggaagagaaggtggaagggagggcaagggagagaaacatcacatagatatttttagactttgctgaagatctgttatttttacatccttgggctcgggacggcagggagttaaattcccctgagagaatccccatggggccagggaaagcccgctgcagactggtttaccagaatatttttgtccacggctcccagaccaa

SEQ ID NO: 52164 - DNA, 49 bp, Homo sapiens
  chr7:96647760-96647809
  hyper
ggtgtgcagtgggtgcgccctcacccccaaccttcccaaacacgcaccc

SEQ ID NO: 52165 - DNA, 13 bp, Homo sapiens
  chr7:96648219-96648232
  hyper
gagccaggctgcg

SEQ ID NO: 52166 - DNA, 16 bp, Homo sapiens
  chr7:96650421-96650437
  hyper
tcgcccgcgccttccc

SEQ ID NO: 52167 - DNA, 124 bp, Homo sapiens
  chr7:96651151-96651275
  hyper
ttgttaagaaaaccagatagctgctctgggctgcctaggccgccctagaaataaccctccgcttgctttcaacccgcgaaattggccccacagctccggaggcccgctacggggtgggggcggg

SEQ ID NO: 52168 - DNA, 118 bp, Homo sapiens; identical to SEQ ID NO: 31404
  chr7:96651845-96651963
  hyper

SEQ ID NO: 52169 - DNA, 127 bp, Homo sapiens
  chr7:96652017-96652144
  hyper
cgtttccgcccctccccaggcttcaagaacaccagcccctccccaggcttcaaggaggtggccctgggccgtgaccctacttctgtcggcgtctgttcgggcgcccgcagaagccagactcttgggc

SEQ ID NO: 52170 - DNA, 55 bp, Homo sapiens
  chr7:96653452-96653507
  hyper
cctactcccttctgccgcgtgcgcccccactgccgtgaaccgctgtgacccccaa

SEQ ID NO: 52171 - DNA, 60 bp, Homo sapiens
  chr7:96653993-96654053
  hyper
ttggctgtggggctgctctggtctaagcagacatggctgtgggagcgagggaggaggagg

SEQ ID NO: 52172 - DNA, 83 bp, Homo sapiens; identical to SEQ ID NO: 31408
  chr7:96656775-96656858
  hyper

SEQ ID NO: 52173 - DNA, 93 bp, Homo sapiens
  chr7:97361005-97361098
  hyper
tgcaacttatcctgacgtctcgagggacggaaaagttaccgaagtccaaggaatgagtcactttgctcaaatttgatgagtaatatcaggtgt

SEQ ID NO: 52174 - DNA, 105 bp, Homo sapiens
  chr7:97362187-97362292
  hyper
aggggcactatttcccgggttccccacgggattttgtgcccacgattcaagtttcttcccgagggctgcaccgtccggcccaggaactccctgcagtagggatgc

SEQ ID NO: 52175 - DNA, 98 bp, Homo sapiens; identical to SEQ ID NO: 19752
  chr7:97362607-97362705
  hyper

SEQ ID NO: 52176 - DNA, 586 bp, Homo sapiens; identical to SEQ ID NO: 31412
  chr7:97362706-97363292
  hyper

SEQ ID NO: 52177 - DNA, 75 bp, Homo sapiens; identical to SEQ ID NO: 31413
  chr7:97680670-97680745
  hyper

SEQ ID NO: 52178 - DNA, 29 bp, Homo sapiens
  chr7:98245856-98245885
  hyper
cgtgactttgtccctaactccgggtgtcc

SEQ ID NO: 52179 - DNA, 258 bp, Homo sapiens; identical to SEQ ID NO: 19755
  chr7:98246868-98247126
  hyper

SEQ ID NO: 52180 - DNA, 192 bp, Homo sapiens
  chr7:98247656-98247848
  hyper
tctttctttaaatcaggtcaggctgagctagagggggcggaagtctgggggcggaggtcgcagggaggcgagcgcagggggtcaccggcgaccccagagcgcgcattagaggggcaacctctggttaacttcaaagactcccgtgtctgcaagttggaccattttaaggtgctcttccggattgcttcaggg

SEQ ID NO: 52181 - DNA, 199 bp, Homo sapiens; identical to SEQ ID NO: 31417
  chr7:99149223-99149422
  hyper

SEQ ID NO: 52182 - DNA, 15 bp, Homo sapiens
  chr7:99155799-99155814
  hyper
aggccccgcaatcct

SEQ ID NO: 52183 - DNA, 195 bp, Homo sapiens; identical to SEQ ID NO: 9139
  chr7:99155931-99156126
  hyper

SEQ ID NO: 52184 - DNA, 82 bp, Homo sapiens; identical to SEQ ID NO: 31420
  chr7:99156127-99156209
  hyper

SEQ ID NO: 52185 - DNA, 128 bp, Homo sapiens; identical to SEQ ID NO: 31421
  chr7:99156472-99156600
  hyper

SEQ ID NO: 52186 - DNA, 100 bp, Homo sapiens; identical to SEQ ID NO: 9141
  chr7:99156815-99156915
  hyper

SEQ ID NO: 52187 - DNA, 48 bp, Homo sapiens; identical to SEQ ID NO: 19761
  chr7:99177694-99177742
  hyper

SEQ ID NO: 52188 - DNA, 413 bp, Homo sapiens
  chr7:99177870-99178283
  hyper
ctccgaagtgcgcgcagcggaccacgcggtttccatgcgccccctagggtgggtgggctagctgtgcgccccagtgcggagaacggaggaggggtcggccccgtagcggctggaaacgcagttggcggcggggcccagcttgcggggcttctgatcgcaggggcggggcccgccgccggtttctaagggcctggcagagttcctgcagtcacggtcaggggtctttgctttcgtccatcccctcctggagaaagaacgcagcttctaacgccttctcggttgggcacccttcttgggaaagctccgcctaccattgcccttgtacctgccctctctctccctttcctgaagtgactgcccgtctctagcatcgtgttgtgaatgtgtcgagattttggcgctgcagcagcatc

SEQ ID NO: 52189 - DNA, 15 bp, Homo sapiens
  chr7:99595179-99595194
  hyper
ctcccttttgactca

SEQ ID NO: 52190 - DNA, 30 bp, Homo sapiens; identical to SEQ ID NO: 31425
  chr7:99595608-99595638
  hyper

SEQ ID NO: 52191 - DNA, 54 bp, Homo sapiens; identical to SEQ ID NO: 31426
  chr7:100091127-100091181
  hyper

SEQ ID NO: 52192 - DNA, 236 bp, Homo sapiens; identical to SEQ ID NO: 31427
  chr7:100167379-100167615
  hyper

SEQ ID NO: 52193 - DNA, 113 bp, Homo sapiens; identical to SEQ ID NO: 31428
  chr7:100167860-100167973
  hyper

SEQ ID NO: 52194 - DNA, 39 bp, Homo sapiens; identical to SEQ ID NO: 31429
  chr7:100254093-100254132
  hyper

SEQ ID NO: 52195 - DNA, 39 bp, Homo sapiens
  chr7:100318466-100318505
  hyper
cgcgccccctggacagccgccctctcctccaggcccgtg

SEQ ID NO: 52196 - DNA, 160 bp, Homo sapiens
  chr7:100318575-100318735
  hyper
cgctgagggaccccggccaggcgcggagatgggggtgcacggtgagtactcgcgggctgggcgctcccgcccgcccgggtccctgtttgagcggggatttagcgccccggctattggccaggaggtggctgggttcaaggaccggcgacttgtcaaggac

SEQ ID NO: 52197 - DNA, 30 bp, Homo sapiens; identical to SEQ ID NO: 31431
  chr7:100770176-100770206
  hyper

SEQ ID NO: 52198 - DNA, 169 bp, Homo sapiens; identical to SEQ ID NO: 31432
  chr7:100807589-100807758
  hyper

SEQ ID NO: 52199 - DNA, 77 bp, Homo sapiens
  chr7:100808389-100808466
  hyper
ccatctcactgccatcgcccacgtactaagcagcagcaatatgggggaaaaaaaaatctctgctccctccccgtagg

SEQ ID NO: 52200 - DNA, 73 bp, Homo sapiens
  chr7:100809363-100809436
  hyper
ccgggttccccaccccgagaccacgcgcccaaggacggcgtgaacctgagtgcagagggacagatctgcacgc

SEQ ID NO: 52201 - DNA, 18 bp, Homo sapiens
  chr7:100809521-100809539
  hyper
catcgggaagggtccgag

SEQ ID NO: 52202 - DNA, 30 bp, Homo sapiens; identical to SEQ ID NO: 31435
  chr7:100817707-100817737
  hyper

SEQ ID NO: 52203 - DNA, 30 bp, Homo sapiens; identical to SEQ ID NO: 31436
  chr7:100822573-100822603
  hyper

SEQ ID NO: 52204 - DNA, 259 bp, Homo sapiens; identical to SEQ ID NO: 31437
  chr7:100823092-100823351
  hyper

SEQ ID NO: 52205 - DNA, 56 bp, Homo sapiens; identical to SEQ ID NO: 19768
  chr7:100823380-100823436
  hyper

SEQ ID NO: 52206 - DNA, 203 bp, Homo sapiens
  chr7:100823497-100823700
  hyper
tcagcgctggggcagcgccgcagctccgttggcgacgcgggccggggcgcccatcggttcaggggttcgggtggcacgcgtggctcccccggcgacgctccggcggcagcttcgaggggcggagaccccggcgacgcggaagaaacccgggacggatccggagcggactcgtgccctgctggcggggccgggggtcggggtgc

SEQ ID NO: 52207 - DNA, 30 bp, Homo sapiens; identical to SEQ ID NO: 9151
  chr7:100845392-100845422
  hyper

SEQ ID NO: 52208 - DNA, 210 bp, Homo sapiens; identical to SEQ ID NO: 31440
  chr7:100943301-100943511
  hyper

SEQ ID NO: 52209 - DNA, 30 bp, Homo sapiens; identical to SEQ ID NO: 31441
  chr7:100946628-100946658
  hyper

SEQ ID NO: 52210 - DNA, 30 bp, Homo sapiens; identical to SEQ ID NO: 31442
  chr7:100951829-100951859
  hyper

SEQ ID NO: 52211 - DNA, 434 bp, Homo sapiens; identical to SEQ ID NO: 31443
  chr7:101006050-101006484
  hyper

SEQ ID NO: 52212 - DNA, 34 bp, Homo sapiens; identical to SEQ ID NO: 19773
  chr7:103085842-103085876
  hyper

SEQ ID NO: 52213 - DNA, 260 bp, Homo sapiens
  chr7:103086474-103086734
  hyper
gcgggcctcagctcagtcccctcccgagggaccgcgacccccggccccgcggccgcccgcgcgcactcaccagcccgggctgccctgggcggagccgccccgccgcgctccacagccgctgcctcttcgacgcgcgcgctgcctccaggtgcggctctaggaggaggcgccgcgggcagtgccggccgcgccccgcgactcccggtaacccgagcccgccccgccccgctagggccaggccccgccgccaccctccgcgc

SEQ ID NO: 52214 - DNA, 109 bp, Homo sapiens; identical to SEQ ID NO: 9157
  chr7:103630363-103630472
  hyper

SEQ ID NO: 52215 - DNA, 194 bp, Homo sapiens
  chr7:103630824-103631018
  hyper
gtaaggcaggaagggctggcggagctaagatccgacaggctctcttcgccggactgttctgttattcattgcttctgggctcttcaggcagagatgggtgttgtaattttttaaatcagtgtttatttcctttaaatgtcggttatgaccaatggccctgaaatcgggggagggaaaaacgttcaggggagatg

SEQ ID NO: 52216 - DNA, 251 bp, Homo sapiens; identical to SEQ ID NO: 3084
  chr7:103968915-103969166
  hyper

SEQ ID NO: 52217 - DNA, 50 bp, Homo sapiens; identical to SEQ ID NO: 19777
  chr7:103969167-103969217
  hyper

SEQ ID NO: 52218 - DNA, 181 bp, Homo sapiens; identical to SEQ ID NO: 19778
  chr7:103969341-103969522
  hyper

SEQ ID NO: 52219 - DNA, 15 bp, Homo sapiens
  chr7:103969562-103969577
  hyper
cggcctctccatgat

SEQ ID NO: 52220 - DNA, 115 bp, Homo sapiens; identical to SEQ ID NO: 31452
  chr7:103969892-103970007
  hyper

SEQ ID NO: 52221 - DNA, 82 bp, Homo sapiens; identical to SEQ ID NO: 31453
  chr7:106684832-106684914
  hyper

SEQ ID NO: 52222 - DNA, 433 bp, Homo sapiens; identical to SEQ ID NO: 31454
  chr7:106685345-106685778
  hyper

SEQ ID NO: 52223 - DNA, 512 bp, Homo sapiens
  chr7:107300982-107301494
  hyper
ccacagggcctggcccgcccctgacctcgcaacccttgagattagtaacgggatgagtgaggatccgggtggcccctgcgtggcagccagtaagagtctcagccttcccggttcgggaaaggggaagaatgcaggaggggtaggatttctttcctgataggatcggttgggaaagaccgcagcctgtgtgtgtctttcccttcgaccaaggtgtctgttgctccgtaaataaaacgtcccactgccttctgagagcgctataaaggcagcggaagggtagtccgcggggcattccgggcggggcgcgagcagagacaggtgagttcgccctgaagatgcccacaccgcccggcccgggctccactcccggggaggcctcgagggttgcggatgggactcttaagtggtcacggatcaggtgggcagggggcagtacagctttctttctgagacgccgagagcgaacaggctgctcggaaaacaggacgaggggagagacttgctcaataagc

SEQ ID NO: 52224 - DNA, 141 bp, Homo sapiens; identical to SEQ ID NO: 19781
  chr7:107301640-107301781
  hyper

SEQ ID NO: 52225 - DNA, 50 bp, Homo sapiens; identical to SEQ ID NO: 31456
  chr7:107642639-107642689
  hyper

SEQ ID NO: 52226 - DNA, 72 bp, Homo sapiens; identical to SEQ ID NO: 31457
  chr7:107643722-107643794
  hyper

SEQ ID NO: 52227 - DNA, 216 bp, Homo sapiens
  chr7:108095362-108095578
  hyper
gctggagcccctgatgcgaagaaaagggaaggagagaggcggggtgcgaaagaaacgccaccgctcggcgccctccctcggtgcccgcggcgcaggggccacccgccagcgtacgggggacgaagatgtggccgcgggcgcgggcgggaggggaggcgatccggggaaggaagcggcctgttcgccagccccggggcccggggagccctccagcag

SEQ ID NO: 52228 - DNA, 833 bp, Homo sapiens
  chr7:108096055-108096888
  hyper
ccccgagccctctccaggcagcgactggagaagcgaagtcggcctcgcccccgaactccgtggtcagcacaggtgtacgcacttccgaacaaagcccacgcccagacgtgtccgcaggggcccgaacaggcacacgcccgtgcgctcccggcccggcccccgcgctcctcgccccgccggcactgtggcgtgacgccccgcgcctccgtgtccaagcccgggaagccgccgtgccgggcccgcaggctctccatgcccaactgcccacgagcaagagctctgggcagggcttcccggaaagcgtggggtgcgggcgcggagcagaagttggccacaggctggagggggtggtgggtgccggcgctgctggatttcagctgtgccttcacccaagcgcaggtccccctgctccctctcggcgcccgcgggagtgtcgggggcctgcaggggagaagggagttggagatctgctttgcccctcctgcagcgctgccagcccggtgagcgctcggctgaaccccgcggcggtgtccaagtgacaacgcagcagcctcgcgcgtcctcctccgctccagccgtcacccccgagcaggacccagtgtcaccgccagacgcgcaaggagctacttacgttctcgcgccgcgccctccgctcagctctggcgcgactgcccaggaccctggaccgccggtgtcctccgttctcgacgaagctatcccctctggctgctccagccaggcggcccctgcgccgtcccccgcgcccgcgcgtctgaggctcggactgcggcgcgcgtccgccagcgaccctggcgaagcgaggctggccccgc

SEQ ID NO: 52229 - DNA, 33 bp, Homo sapiens
  chr7:108097139-108097172
  hyper
ccgtcagcctgcgagcgcgtgtggcggcggggg

SEQ ID NO: 52230 - DNA, 17 bp, Homo sapiens
  chr7:108097491-108097508
  hyper
cgcggtagaaactgggt

SEQ ID NO: 52231 - DNA, 57 bp, Homo sapiens; identical to SEQ ID NO: 9167
  chr7:112726853-112726910
  hyper

SEQ ID NO: 52232 - DNA, 114 bp, Homo sapiens
  chr7:113722696-113722810
  hyper
ttctaatttgtcattcgcgtgcgtcgctttccttcatcttggctatacttcctctcatctgcggtgttttatttcgcgcaagatgcgctgacagaggccatttcaaacgaattt

SEQ ID NO: 52233 - DNA, 144 bp, Homo sapiens; identical to SEQ ID NO: 19785
  chr7:113723439-113723583
  hyper

SEQ ID NO: 52234 - DNA, 201 bp, Homo sapiens; identical to SEQ ID NO: 19786
  chr7:113724755-113724956
  hyper

SEQ ID NO: 52235 - DNA, 391 bp, Homo sapiens
  chr7:113725081-113725472
  hyper
gggctggggctccggaggaagcccctcgccaagattccggtcgtgcgtcccctccggggcccgctctctcctccctcggcctttcccctgtcaccgccctgggtcccaagcaggccgcccagccgggtcacacccggtggatagaagccgggacccagggctggcggctgggcccgtgcatcccccacgcgggcgcctcggctttgaagtgcgcgcggagcaggctctgaccgtttcttctttcctttctttccggttacttttgctcccctcagtcactgataggacccttcccgaaaacctcagactctctaagtcccagcttggcggccccttccttccaagccgcgccccggtgacctgggctgcgcgaccacgaggaagcccgaga

SEQ ID NO: 52236 - DNA, 30 bp, Homo sapiens; identical to SEQ ID NO: 31465
  chr7:113725787-113725817
  hyper

SEQ ID NO: 52237 - DNA, 422 bp, Homo sapiens
  chr7:113726087-113726509
  hyper
tatcaacaacaacaacgacaataacaacgcaaagtaaaacaaaacaaacaagtggtccggcggtacttcagaatcctctgcggcgtcctgtcccccaccccgcccctccgaggagaggcagccccgcgagcagtgtgtgtacagttcgcattgccaacaacacgcgcgcgcggccgggtgcgcgcgcctgccagcgcacattcacacacacagacacacagacacacacacacacacacacacacacacagatccgggtggggggagcggctgcgcgagacagcgcgagcctccgagaaagcgcgagacacgccggcgcgtgcagctccgcggccgccgcttcgccctagctctagccccgcgccacccgcagcccgcccgcgaacgcccgccccggttatttatgcggcggccgcgtccgc

SEQ ID NO: 52238 - DNA, 47 bp, Homo sapiens; identical to SEQ ID NO: 9171
  chr7:113726751-113726798
  hyper

SEQ ID NO: 52239 - DNA, 140 bp, Homo sapiens
  chr7:113727486-113727626
  hyper
gggtgggtttggggtgaaatcgcacctcgcggcacttggtgaggggacgtgggaggagcgcagacacctttcggtgatagggagggcttctcacttggctgttacctggaagtccacagtggccccggcgggcaggcggg

SEQ ID NO: 52240 - DNA, 27 bp, Homo sapiens
  chr7:113727781-113727808
  hyper
cgccctgacacccgacctcagtgtgga

SEQ ID NO: 52241 - DNA, 92 bp, Homo sapiens; identical to SEQ ID NO: 31470
  chr7:114562185-114562277
  hyper

SEQ ID NO: 52242 - DNA, 317 bp, Homo sapiens; identical to SEQ ID NO: 31471
  chr7:114562326-114562643
  hyper

SEQ ID NO: 52243 - DNA, 440 bp, Homo sapiens; identical to SEQ ID NO: 31472
  chr7:114562960-114563400
  hyper

SEQ ID NO: 52244 - DNA, 52 bp, Homo sapiens; identical to SEQ ID NO: 19793
  chr7:115117500-115117552
  hyper

SEQ ID NO: 52245 - DNA, 80 bp, Homo sapiens; identical to SEQ ID NO: 19794
  chr7:115117647-115117727
  hyper

SEQ ID NO: 52246 - DNA, 30 bp, Homo sapiens; identical to SEQ ID NO: 31474
  chr7:116140161-116140191
  hyper

SEQ ID NO: 52247 - DNA, 16 bp, Homo sapiens
  chr7:116962550-116962566
  hyper
ctgggatgggggaggc

SEQ ID NO: 52248 - DNA, 267 bp, Homo sapiens
  chr7:116962626-116962893
  hyper
gtctgtgctagagctggagaccaggctagcacgtctctcaacaggataagaaattggctgattttgctgtcgctcagctggatccaaataaaccaaacatcggagctctcatttgagggggaatgtggttttatggagttgtcaaagctgaaatgatcttctgggaaaagagaaggggctcaccatggggcgataagagggcagtagccagggttcgggccagaatccgagactgctgcggccgcgggggaacgcagccaggaaggg

SEQ ID NO: 52249 - DNA, 125 bp, Homo sapiens
  chr7:116963476-116963601
  hyper
atcgctgcatggttacgagcacacgcgaatacaggaacctttagggaagctccaggccaaagagcatccgtgggctctcggagcgtgcgttccggattgccgaggccatccgctggcaaacaagt

SEQ ID NO: 52250 - DNA, 337 bp, Homo sapiens; identical to SEQ ID NO: 31478
  chr7:116963872-116964209
  hyper

SEQ ID NO: 52251 - DNA, 154 bp, Homo sapiens; identical to SEQ ID NO: 31479
  chr7:116964456-116964610
  hyper

SEQ ID NO: 52252 - DNA, 39 bp, Homo sapiens; identical to SEQ ID NO: 31481
  chr7:117512371-117512410
  hyper

SEQ ID NO: 52253 - DNA, 46 bp, Homo sapiens; identical to SEQ ID NO: 31482
  chr7:117512808-117512854
  hyper

SEQ ID NO: 52254 - DNA, 35 bp, Homo sapiens; identical to SEQ ID NO: 31483
  chr7:117513436-117513471
  hyper

SEQ ID NO: 52255 - DNA, 126 bp, Homo sapiens; identical to SEQ ID NO: 31484
  chr7:119912968-119913094
  hyper

SEQ ID NO: 52256 - DNA, 41 bp, Homo sapiens; identical to SEQ ID NO: 31485
  chr7:119913455-119913496
  hyper

SEQ ID NO: 52257 - DNA, 53 bp, Homo sapiens; identical to SEQ ID NO: 31486
  chr7:120969300-120969353
  hyper

SEQ ID NO: 52258 - DNA, 22 bp, Homo sapiens
  chr7:120969650-120969672
  hyper
agagaagctgggctgcgccaat

SEQ ID NO: 52259 - DNA, 51 bp, Homo sapiens
  chr7:120969800-120969851
  hyper
catgatcaccgccgccgccactaccgccccgatgggcgccagccccctctt

SEQ ID NO: 52260 - DNA, 600 bp, Homo sapiens; identical to SEQ ID NO: 31488
  chr7:120970100-120970700
  hyper

SEQ ID NO: 52261 - DNA, 215 bp, Homo sapiens
  chr7:121513709-121513924
  hyper
ctagccaggaggaaaaagggacagccaactgggctcccacggagcgggcggccgcgcggtgcaggcagctgcgtgggatttgcgcgccccctccccgccccgcgccctcgccccttccatcggcccgcgggcattcgtgccccgggccccaggagacggagctactggagacggagggctactcggatccctgccgccaccgttcttctctcctc

SEQ ID NO: 52262 - DNA, 258 bp, Homo sapiens; identical to SEQ ID NO: 31490
  chr7:121783508-121783766
  hyper

SEQ ID NO: 52263 - DNA, 67 bp, Homo sapiens; identical to SEQ ID NO: 31491
  chr7:121784215-121784282
  hyper

SEQ ID NO: 52264 - DNA, 176 bp, Homo sapiens
  chr7:121940448-121940624
  hyper
gtggattctccgcgacaacagccctggagggagagagtgggccgggggaggggccacggggcccctgaggcctgcggggctggccgcactggccccgggcctggcggggtggtggagtccgaagcggcgaggcgaggaccccggggcccgctccccccagtcgccctcccgggatg

SEQ ID NO: 52265 - DNA, 32 bp, Homo sapiens; identical to SEQ ID NO: 19804
  chr7:121940903-121940935
  hyper

SEQ ID NO: 52266 - DNA, 38 bp, Homo sapiens
  chr7:121941052-121941090
  hyper
acattgcatacagctactggatacgttgttcccattta

SEQ ID NO: 52267 - DNA, 31 bp, Homo sapiens
  chr7:121942170-121942201
  hyper
ttcgccagctggcgtgcgggccagccccagg

SEQ ID NO: 52268 - DNA, 15 bp, Homo sapiens
  chr7:121943974-121943989
  hyper
ccgggtggcatgggc

SEQ ID NO: 52269 - DNA, 123 bp, Homo sapiens; identical to SEQ ID NO: 706
  chr7:121944176-121944299
  hyper

SEQ ID NO: 52270 - DNA, 30 bp, Homo sapiens; identical to SEQ ID NO: 31498
  chr7:121944621-121944651
  hyper

SEQ ID NO: 52271 - DNA, 142 bp, Homo sapiens; identical to SEQ ID NO: 31499
  chr7:121945611-121945753
  hyper

SEQ ID NO: 52272 - DNA, 46 bp, Homo sapiens; identical to SEQ ID NO: 9197
  chr7:121946080-121946126
  hyper

SEQ ID NO: 52273 - DNA, 35 bp, Homo sapiens
  chr7:121950102-121950137
  hyper
ccatgaaataaaagtcgataatagaaattaaaaca

SEQ ID NO: 52274 - DNA, 14 bp, Homo sapiens
  chr7:121951863-121951877
  hyper
ggctcctggaaaca

SEQ ID NO: 52275 - DNA, 40 bp, Homo sapiens; identical to SEQ ID NO: 31507
  chr7:121955281-121955321
  hyper

SEQ ID NO: 52276 - DNA, 459 bp, Homo sapiens; identical to SEQ ID NO: 31508
  chr7:121955381-121955840
  hyper

SEQ ID NO: 52277 - DNA, 30 bp, Homo sapiens; identical to SEQ ID NO: 31509
  chr7:121956177-121956207
  hyper

SEQ ID NO: 52278 - DNA, 28 bp, Homo sapiens
  chr7:121956458-121956486
  hyper
tccccatcttcaatccgaagctggggta

SEQ ID NO: 52279 - DNA, 15 bp, Homo sapiens
  chr7:121956567-121956582
  hyper
ctctccgctactgcc

SEQ ID NO: 52280 - DNA, 211 bp, Homo sapiens
  chr7:123172939-123173150
  hyper
gcttggcgcggaaggcgccgccagtgaccggctgcggctgggggcggaggccggcagttgctcggagctccggcgggtcaggaggtgacgggaggaggaggaggcaggaggaagaaaggggggttgggaggtagcgtccggtaggtctgcgcagacagcgctgccagacctctgactcccccagtcctgccgccgccgatagccccacaag

SEQ ID NO: 52281 - DNA, 32 bp, Homo sapiens
  chr7:123672016-123672048
  hyper
gcccataaaattgagcgggtagtgagaatagt

SEQ ID NO: 52282 - DNA, 435 bp, Homo sapiens
  chr7:123672086-123672521
  hyper
caggacagctcccacacgtagatgaagatcacgtagatgggcacccgcttccaagtgccccaaccgcggctgtagtggaggtggaagtagagcttttccaccacgaaactgcagctgccgtacataaagaaggaccagagcgacgtgtggccgctggttgtcccgtccccctgccccagtacgttgaagaagaaggtgaagaagatctcatccagaaagccgtgcattccgaagaaaagaaagcggggtaggtcgggcagcccctggctgggggctcccccggcgcccctggggccacggggtcgtcgccgccgggctccggccgcagtagggacccgggcgccgggagggacggggagcgcgcccctccgctgctgctgctgctgctgctgctgctgttgctgctgccgccgcctctgtcgcccgtaccgcaag

SEQ ID NO: 52283 - DNA, 56 bp, Homo sapiens; identical to SEQ ID NO: 9209
  chr7:123672928-123672984
  hyper

SEQ ID NO: 52284 - DNA, 157 bp, Homo sapiens; identical to SEQ ID NO: 31517
  chr7:123673226-123673383
  hyper

SEQ ID NO: 52285 - DNA, 54 bp, Homo sapiens
  chr7:124404361-124404415
  hyper
tccattctgggccagcgcccggcccgggagtgcaattgtccacccttcgtgccc

SEQ ID NO: 52286 - DNA, 226 bp, Homo sapiens; identical to SEQ ID NO: 31519
  chr7:124404734-124404960
  hyper

SEQ ID NO: 52287 - DNA, 30 bp, Homo sapiens; identical to SEQ ID NO: 31520
  chr7:124405187-124405217
  hyper

SEQ ID NO: 52288 - DNA, 671 bp, Homo sapiens; identical to SEQ ID NO: 31521
  chr7:124405556-124406227
  hyper

SEQ ID NO: 52289 - DNA, 14 bp, Homo sapiens
  chr7:126891206-126891220
  hyper
gtctgttttcaccc

SEQ ID NO: 52290 - DNA, 1020 bp, Homo sapiens
  chr7:126891593-126892613
  hyper
cttctcagttccttgggctgttgaagccgggttctgggtagatagagactggggccgtggggagagcgccaggctgcttttgcctttcccgcgccccggggcattccggcgcgctggggatgcagcctccgcccccgccgcacctggccgcccgagcgcccgcgcccacgccccgcgcggggccgcccgaaactggggccgcgccagccgcgggagctaccgaggagctgttggggtgcgtttgcctttgctttttaaacaagatccccgagaccttttctccatccccccaacccccagcaggacacggaactccggcgtttctcgaaagccacaaaagaggggcacggaaatcccaagctcgccgtgctaactcggagaacgcaaactcgaggcagagcgtgcgccgtgcggggatgtgggtgtcgaggaccccgaagcgcccggcttcccccgcgacccccatcctccctagatcctggttagacatccatccagcccacgctcagagggcgggggttaccccgactcatcccggaagccgctaacttcagaaatccctcctgttaggttcgcgaaacgaaggtacctcgtcatctcggcggggcaagtccggattccaccagggcaggtccgggaggtcacccagggcagacgatccgaggcagagcgctttaaaatcctgccgccgcacgcccagtcagagcgccgagcgcgcctgcccccttcccgtcacccttcagtctcccattcgccgactaaacttttgggggatcacatctccaagccttgggagttccgggtaaagtctccctcttttctgaacctctttactgtaatgtaatcatgggcagacaagaggggtggctgccttgttctttgcaacgtaaaatcaacagacacccaatcaagctccaatgcccggccagcccctcgccccctggtgcccactctccttctccccccattcccgtcacctccgcccgctatttctctcacagactacggacatgcagggcc

SEQ ID NO: 52291 - DNA, 212 bp, Homo sapiens; identical to SEQ ID NO: 31524
  chr7:126892895-126893107
  hyper

SEQ ID NO: 52292 - DNA, 69 bp, Homo sapiens; identical to SEQ ID NO: 31525
  chr7:126987771-126987840
  hyper

SEQ ID NO: 52293 - DNA, 43 bp, Homo sapiens; identical to SEQ ID NO: 31526
  chr7:126988163-126988206
  hyper

SEQ ID NO: 52294 - DNA, 47 bp, Homo sapiens; identical to SEQ ID NO: 31527
  chr7:127260538-127260585
  hyper

SEQ ID NO: 52295 - DNA, 65 bp, Homo sapiens; identical to SEQ ID NO: 19824
  chr7:127744057-127744122
  hyper

SEQ ID NO: 52296 - DNA, 39 bp, Homo sapiens; identical to SEQ ID NO: 19825
  chr7:127744631-127744670
  hyper

SEQ ID NO: 52297 - DNA, 46 bp, Homo sapiens; identical to SEQ ID NO: 31530
  chr7:127806561-127806607
  hyper

SEQ ID NO: 52298 - DNA, 50 bp, Homo sapiens; identical to SEQ ID NO: 31531
  chr7:127807004-127807054
  hyper

SEQ ID NO: 52299 - DNA, 131 bp, Homo sapiens; identical to SEQ ID NO: 31532
  chr7:127807478-127807609
  hyper

SEQ ID NO: 52300 - DNA, 1 bp, Homo sapiens
  chr7:127807816-127807817
  hyper
g

SEQ ID NO: 52301 - DNA, 201 bp, Homo sapiens; identical to SEQ ID NO: 19827
  chr7:127807846-127808047
  hyper

SEQ ID NO: 52302 - DNA, 159 bp, Homo sapiens; identical to SEQ ID NO: 3109
  chr7:127841338-127841497
  hyper

SEQ ID NO: 52303 - DNA, 113 bp, Homo sapiens
  chr7:127841704-127841817
  hyper
gtcctacactttgagagcagaaaacgaccccgtacgtggtgggtctccgacatctgtttattacgttggaccgcatgctgcatatgatccagccacctcgctctactcctgtg

SEQ ID NO: 52304 - DNA, 34 bp, Homo sapiens; identical to SEQ ID NO: 31536
  chr7:127991709-127991743
  hyper

SEQ ID NO: 52305 - DNA, 39 bp, Homo sapiens
  chr7:127991787-127991826
  hyper
cgcccaggcgcaggcctagctggaaggcccaccagggcc

SEQ ID NO: 52306 - DNA, 184 bp, Homo sapiens
  chr7:127992135-127992319
  hyper
gcagcgggcgatgcgcggcgctcccgagggcggcggcggccgccagccccagccccaggagcagcagcgcagccaggccggtggggcaccgcggcgggcgcggccgggccagcagcaggcaggccagccccaggccggcagccaagcagggcagcggaaggtcctgcagcagcagccaggcgag

SEQ ID NO: 52307 - DNA, 154 bp, Homo sapiens; identical to SEQ ID NO: 31539
  chr7:127992371-127992525
  hyper

SEQ ID NO: 52308 - DNA, 115 bp, Homo sapiens; identical to SEQ ID NO: 31540
  chr7:128002255-128002370
  hyper

SEQ ID NO: 52309 - DNA, 62 bp, Homo sapiens
  chr7:128337405-128337467
  hyper
ctcaatttcttcacccggccatgtaagcagagcggacaactctgagggcgtggctgggcggg

SEQ ID NO: 52310 - DNA, 142 bp, Homo sapiens; identical to SEQ ID NO: 31543
  chr7:128430740-128430882
  hyper

SEQ ID NO: 52311 - DNA, 19 bp, Homo sapiens
  chr7:128430922-128430941
  hyper
cgttcgcccatccgggcct

SEQ ID NO: 52312 - DNA, 404 bp, Homo sapiens
  chr7:128470493-128470897
  hyper
gagagagccagagagcggccgagcgcctaggaggcccgccgagcctcgccgagccccgccagccccggcgcgagagaagttggagaggagagcagcgcagcgcagcgagtcccgtggtcgcgccccaacagcgcccgacagcccccgatagcccaaaccgcggccctagccccggccgcacccccagcccgcgccagcatgatgaacaacagcggctactcagacgccggcctcggcctgggcgatgagacagacgagatgccgtccacggagaaggacctggcggaggacgcgccgtggaagaagatccagcagaacacattcacgcgctggtgcaatgagcacctcaagtgcgtgggcaagcgcctgaccgacctgcagcgcgacctcagcgacgggctccg

SEQ ID NO: 52313 - DNA, 25 bp, Homo sapiens
  chr7:128471032-128471057
  hyper
cgtgtccataggtcagtgccggggg

SEQ ID NO: 52314 - DNA, 134 bp, Homo sapiens; identical to SEQ ID NO: 31546
  chr7:128471125-128471259
  hyper

SEQ ID NO: 52315 - DNA, 101 bp, Homo sapiens; identical to SEQ ID NO: 31547
  chr7:128510097-128510198
  hyper

SEQ ID NO: 52316 - DNA, 65 bp, Homo sapiens; identical to SEQ ID NO: 19836
  chr7:128828130-128828195
  hyper

SEQ ID NO: 52317 - DNA, 232 bp, Homo sapiens
  chr7:128828272-128828504
  hyper
actcatctctttcccccgggcgcggggcggcggcaggcggggtcaccagatccccctagcccgggcccctccaggcgccagggacgctgacgctcgcgctcttcctctctcgcctcccctccccacctctccgctccttcgtccagtccctcccccagcctcggcgcaggggggccgggcttggctccgcgaggcccgtgcattccagagagcccagcgagctagagcaaca

SEQ ID NO: 52318 - DNA, 475 bp, Homo sapiens; identical to SEQ ID NO: 31549
  chr7:128828904-128829379
  hyper

SEQ ID NO: 52319 - DNA, 30 bp, Homo sapiens; identical to SEQ ID NO: 31550
  chr7:129142850-129142880
  hyper

SEQ ID NO: 52320 - DNA, 143 bp, Homo sapiens
  chr7:129418428-129418571
  hyper
tcgaggctgagagctgggcttggggcaggttcctttgcgttcgctcaggccacgatgaggccactaggacagatttctccgaaggctcggcctcggatcagagatccgccgactcggtgcccatcggtcgggctcactgggtg

SEQ ID NO: 52321 - DNA, 79 bp, Homo sapiens; identical to SEQ ID NO: 31552
  chr7:129421630-129421709
  hyper

SEQ ID NO: 52322 - DNA, 45 bp, Homo sapiens; identical to SEQ ID NO: 19840
  chr7:129422115-129422160
  hyper

SEQ ID NO: 52323 - DNA, 6 bp, Homo sapiens
  chr7:129423418-129423424
  hyper
tcttta

SEQ ID NO: 52324 - DNA, 100 bp, Homo sapiens
  chr7:129424555-129424655
  hyper
taccaggcgacaccccggtcgactttgacccccgagcaggtgaaacataagcgtccaccccagaggggtcccctacccaagtcagaggagaaggtggcct

SEQ ID NO: 52325 - DNA, 59 bp, Homo sapiens; identical to SEQ ID NO: 19843
  chr7:129425887-129425946
  hyper

SEQ ID NO: 52326 - DNA, 140 bp, Homo sapiens
  chr7:131242824-131242964
  hyper
ggagtctatctgccagatggggctgggtggaggggttttctccaggatctagccgcgtcccgggcacaggggactccgtgagcccctcaagtcggctgcaagcaggcgatgcctgcagggcactgcgtccctggagccgc

SEQ ID NO: 52327 - DNA, 85 bp, Homo sapiens
  chr7:131514739-131514824
  hyper
cctgggcttggatcccgctgtgaggccgggggcaggtgatcatggcaggcggtaggactcctctcactctctgccccagaccccg

SEQ ID NO: 52328 - DNA, 80 bp, Homo sapiens
  chr7:131514854-131514934
  hyper
cagcaggcaaggccaggaagccgggagtgcttgctgtcaatatcacatgtggagctgcttgtggccggccaggactctca

SEQ ID NO: 52329 - DNA, 286 bp, Homo sapiens; identical to SEQ ID NO: 31558
  chr7:132260280-132260566
  hyper

SEQ ID NO: 52330 - DNA, 89 bp, Homo sapiens; identical to SEQ ID NO: 9241
  chr7:132260852-132260941
  hyper

SEQ ID NO: 52331 - DNA, 62 bp, Homo sapiens; identical to SEQ ID NO: 31560
  chr7:132261146-132261208
  hyper

SEQ ID NO: 52332 - DNA, 16 bp, Homo sapiens
  chr7:132261256-132261272
  hyper
cgccctcctctgaacg

SEQ ID NO: 52333 - DNA, 73 bp, Homo sapiens
  chr7:132261432-132261505
  hyper
taatgtccaacaaaaaggtcggaaaatggggatcgattccgaacacccctttcctccacccagccccggagcc

SEQ ID NO: 52334 - DNA, 27 bp, Homo sapiens
  chr7:132261534-132261561
  hyper
cggtggcgacgccgggctgcccccctt

SEQ ID NO: 52335 - DNA, 151 bp, Homo sapiens; identical to SEQ ID NO: 31563
  chr7:132261835-132261986
  hyper

SEQ ID NO: 52336 - DNA, 168 bp, Homo sapiens; identical to SEQ ID NO: 31564
  chr7:132262214-132262382
  hyper

SEQ ID NO: 52337 - DNA, 30 bp, Homo sapiens; identical to SEQ ID NO: 31565
  chr7:132299615-132299645
  hyper

SEQ ID NO: 52338 - DNA, 52 bp, Homo sapiens; identical to SEQ ID NO: 31566
  chr7:133812094-133812146
  hyper

SEQ ID NO: 52339 - DNA, 178 bp, Homo sapiens
  chr7:134142986-134143164
  hyper
ggcacttctcggggacgctgtgtggtgttgaggttttacagggaaaatgctaaccttggcgcctcctgaattatcaactagctacggggtgcccagatttttctcccgagttccagacccagggcaccccgaggcggcgcctggccgaggagctccgcactgcgccttgttaacagct

SEQ ID NO: 52340 - DNA, 112 bp, Homo sapiens; identical to SEQ ID NO: 19848
  chr7:134143475-134143587
  hyper

SEQ ID NO: 52341 - DNA, 107 bp, Homo sapiens
  chr7:134143700-134143807
  hyper
cggagagtgtgaggcgagccccgggcccgcgcccccacgagcacctaccttccaggtacccaaccccaggatgggcatcttggcgccgttgttgagcaggagacggc

SEQ ID NO: 52342 - DNA, 48 bp, Homo sapiens
  chr7:136554366-136554414
  hyper
ggtctgaaaggaaggggcaaacgaggcacagcgcgaggcgaggtaccc

SEQ ID NO: 52343 - DNA, 11 bp, Homo sapiens
  chr7:136554966-136554977
  hyper
gtcgtagactg

SEQ ID NO: 52344 - DNA, 38 bp, Homo sapiens
  chr7:136555197-136555235
  hyper
aattattgacacacacggcggcacaccctttgcctccg

SEQ ID NO: 52345 - DNA, 269 bp, Homo sapiens
  chr7:136555412-136555681
  hyper
ggctggaggagaacagagaattggaggtaaacgcgtaaagccagcagaactgtcggtggacatttcacccaggccgccctcccgcgtctttaagtcagttcaccgccacagcacgtctgtgactgcggccacccagggctccaagtctgccagcccaggcgccgcgagccaagaagagcgcggcgcctcccactcctcaagctccggaatcccccacatcgactttctatttccctgtcttcttttcttttttgtttgttttgcttttc

SEQ ID NO: 52346 - DNA, 11 bp, Homo sapiens
  chr7:137028524-137028535
  hyper
ggagggagagc

SEQ ID NO: 52347 - DNA, 68 bp, Homo sapiens; identical to SEQ ID NO: 31579
  chr7:137532373-137532441
  hyper

SEQ ID NO: 52348 - DNA, 71 bp, Homo sapiens
  chr7:139167546-139167617
  hyper
cggtccagggctgggcgggtgtgggggtttcggctacgtccacccgacctggcggcgtcggctgccggcgc

SEQ ID NO: 52349 - DNA, 83 bp, Homo sapiens; identical to SEQ ID NO: 19849
  chr7:139167744-139167827
  hyper

SEQ ID NO: 52350 - DNA, 235 bp, Homo sapiens
  chr7:139168379-139168614
  hyper
ctcctccatcccgcgcgccccgccacccggagacgctgaggagcgcacctgggcccagtgcagaggagcttcgctctcctccgtccggattggtccagccgcgtcgccgaagttgtcaggccacgcccctccccgaaggaccccgctgtgattggctgtggctgaggttctgctgccccgacccccttcgggacacagccccggcctccaccaggcactgggagggagctgagaa

SEQ ID NO: 52351 - DNA, 37 bp, Homo sapiens; identical to SEQ ID NO: 31582
  chr7:139168658-139168695
  hyper

SEQ ID NO: 52352 - DNA, 325 bp, Homo sapiens; identical to SEQ ID NO: 31583
  chr7:139208245-139208570
  hyper

SEQ ID NO: 52353 - DNA, 158 bp, Homo sapiens
  chr7:139208614-139208772
  hyper
cgggctgggccccgcaccccggtgcaggagcgcgggcgcggcgcggcggagcgccccgcatggagccggcccgggagcccccctcgcgggcccggccgccgccgcccctcgccgcgcgccccgcgcccgcccccgccgcccccaggccgcgttcgccc

SEQ ID NO: 52354 - DNA, 6 bp, Homo sapiens
  chr7:139930270-139930276
  hyper
cctctg

SEQ ID NO: 52355 - DNA, 43 bp, Homo sapiens; identical to SEQ ID NO: 31586
  chr7:140339825-140339868
  hyper

SEQ ID NO: 52356 - DNA, 187 bp, Homo sapiens
  chr7:140339982-140340169
  hyper
acacacactcacactcgcgccccgagggacccagcacggcgcagggcgggggtctaccggctttctgcaggtccccgaggcgcgagacggcggcgtccgggctcagtcctgggagtcagcccgagcccgggaggaacgcctggatcgcgctctgcacagtcccgggaccaggcgggaactcagactc

SEQ ID NO: 52357 - DNA, 38 bp, Homo sapiens; identical to SEQ ID NO: 31588
  chr7:140340747-140340785
  hyper

SEQ ID NO: 52358 - DNA, 203 bp, Homo sapiens; identical to SEQ ID NO: 31589
  chr7:140771347-140771550
  hyper

SEQ ID NO: 52359 - DNA, 72 bp, Homo sapiens; identical to SEQ ID NO: 31590
  chr7:140771769-140771841
  hyper

SEQ ID NO: 52360 - DNA, 308 bp, Homo sapiens; identical to SEQ ID NO: 31591
  chr7:140772281-140772589
  hyper

SEQ ID NO: 52361 - DNA, 335 bp, Homo sapiens; identical to SEQ ID NO: 19856
  chr7:140773228-140773563
  hyper

SEQ ID NO: 52362 - DNA, 659 bp, Homo sapiens
  chr7:140773750-140774409
  hyper
ggcgcccgaagccgggctgggagccgaggcggctgcttcggggcagtcgcttcctgcggggcggggagggggcgggaggcggccgcgctgggttcgccgccgccggaggctgcacctgcctcagaggatgcccaggagcccgcgggagcctctccggatcagaactttttaggccgcccgcccccatccccgcagtccccgggccgtgctccggtaggcgggggccgagggggcgccgcggcgcgagtccctctcctgccccctcccccagctcggccgcccgccgctttgttccgggtgcggcgagggaaggcgaggctgcggcggatcatgcccatggtgtagccgccaagcggaggcatggctgccggaaggttactgctctacactggcctctcgctagcgctctgcgccctcggcatgctggccgtggccatctgctcggaccactggtacgagacggacgccaggaagcacagggacaggtgcaaggccttcaacacccgccgggtcgaccccggcttcatttacaacaataacaacaacttgccgctccgggcgagccgctcgcgcctggaccgctgggagggcaaactcctccgggcccggaatcgccggcagctgttcgccatgagccccgcggacgagtgcagccggca

SEQ ID NO: 52363 - DNA, 60 bp, Homo sapiens; identical to SEQ ID NO: 31593
  chr7:141211539-141211599
  hyper

SEQ ID NO: 52364 - DNA, 15 bp, Homo sapiens
  chr7:143042619-143042634
  hyper
tgatcctgctgggct

SEQ ID NO: 52365 - DNA, 16 bp, Homo sapiens
  chr7:143579649-143579665
  hyper
gggattctctgtcccc

SEQ ID NO: 52366 - DNA, 73 bp, Homo sapiens
  chr7:143579666-143579739
  hyper
atgatttctgatttcggcacacccagacccacggcgcacccatcgcgccccgcacccccgccccggcctcccg

SEQ ID NO: 52367 - DNA, 26 bp, Homo sapiens
  chr7:143580069-143580095
  hyper
ctttgtgtcgccggccctggtggctt

SEQ ID NO: 52368 - DNA, 274 bp, Homo sapiens
  chr7:145812718-145812992
  hyper
gaattaattacatatcgaaaacatgtgcattaacggcatctgcagtcctccctccctgctccagtcagtcgggatgtttagcaccgtcacttggtgttaggaccactcggaagacctgcctgtcggacgcctgactgtggttcccggggggccggagctccaggagcctgtaccatctttatctgaaggggaggagagaaggaaaggagaaggcatccgagcgagggtgttctccttcctgcagccgggtagggggcagccaggtttggagcag

SEQ ID NO: 52369 - DNA, 309 bp, Homo sapiens
  chr7:145813082-145813391
  hyper
cccccgccccagctgatggaccccggccggtcggctcagtctcccttttgctttcaaacgaggccagggcagggcagaagggttttgacagccagaggggtacggtaaggaggaggaagaggaggaggaggcggaggaggaggaggagccgaggagggaaccgagaagggaagagaagggagggcttccctccgcctcgctcgccgcccgggctcacaggagctggcggcggcggcggcggcggcggcgtctcctgctctccgcggctgttgctgctgctcgcgctccgccgcccgggagatgcttcct

SEQ ID NO: 52370 - DNA, 9 bp, Homo sapiens
  chr7:145813403-145813412
  hyper
cgctgaggc

SEQ ID NO: 52371 - DNA, 186 bp, Homo sapiens
  chr7:145813494-145813680
  hyper
gagtcacgctgcccggcggcggagggagcgctcgcccgcagtggcaacagctgcaccaccgtccccgtcgctctgccttcctcttctgcagcctctgctcttctgattacctccctcccccgtcctttggtgatttttttttttcaagaaggagagggcggggtaggtgtccgttccctcccctct

SEQ ID NO: 52372 - DNA, 46 bp, Homo sapiens
  chr7:149112012-149112058
  hyper
gtgtgaaggtaaagacggtcctatatttcagttccagtggggctgc

SEQ ID NO: 52373 - DNA, 32 bp, Homo sapiens
  chr7:149119916-149119948
  hyper
gccccatcccacaggcgccaaatggagggcgc

SEQ ID NO: 52374 - DNA, 180 bp, Homo sapiens
  chr7:149411361-149411541
  hyper
ccttcccgcatcacacgtttatttgaggcctactatgtgccaggaacaactggggttaccaccccagcaaacaggcacgcaaaatgtgacacgaaggtaggtcatggctgcggcgagcgggggcgcgggcgaaagacgtgaggatgtacgggggcctggcagctgctctgtcccacccac

SEQ ID NO: 52375 - DNA, 105 bp, Homo sapiens
  chr7:149412304-149412409
  hyper
aggtcctcggacaacctctctccagctctccgccgccggtacccacggcccagtctccacctggggaaacccccttggcgtggcttgtttcgttacaagttatcc

SEQ ID NO: 52376 - DNA, 44 bp, Homo sapiens
  chr7:149744461-149744505
  hyper
cgctctctccagccaccaactcccggccgccgcggctgcagaca

SEQ ID NO: 52377 - DNA, 239 bp, Homo sapiens
  chr7:149744560-149744799
  hyper
ctgggggcgcccggagagtcgtgggctgggggagggcgcctgattcccccccccacagatgcccccggccgacgcgtctcgctgcgcgctcagcccggagcccccgccgccgtcccccgcccccgagaagctcttacgtcctccttgtcaccatcgctccgcgcctggtactggaaccggggccggccatccgcgccgccgccgccgccgccgccgcgctcccggggcgccgccgcctg

SEQ ID NO: 52378 - DNA, 137 bp, Homo sapiens; identical to SEQ ID NO: 31607
  chr7:149744950-149745087
  hyper

SEQ ID NO: 52379 - DNA, 15 bp, Homo sapiens
  chr7:149745575-149745590
  hyper
gcggtgggggagtcc

SEQ ID NO: 52380 - DNA, 35 bp, Homo sapiens; identical to SEQ ID NO: 31609
  chr7:149917112-149917147
  hyper

SEQ ID NO: 52381 - DNA, 59 bp, Homo sapiens
  chr7:149917336-149917395
  hyper
gtggcctttccccgggggatacctgacgctattggagactcctgcggtttgattcatgt

SEQ ID NO: 52382 - DNA, 42 bp, Homo sapiens
  chr7:149918149-149918191
  hyper
gacggcacccgggctcgttagcccaggctgcacgagctacag

SEQ ID NO: 52383 - DNA, 30 bp, Homo sapiens; identical to SEQ ID NO: 31612
  chr7:150715080-150715110
  hyper

SEQ ID NO: 52384 - DNA, 252 bp, Homo sapiens
  chr7:150715917-150716169
  hyper
ggcgcgcgcgcagctcgtgcggcagctcgttgaagtggcgcagctgcaagcgcgccaggcgggaccagccgcgcgcccccagcgcgccaggctcgcgccgcagcagctccacgtggctatagaagacgtgcagaacctgccaggccagcaccagcgggctcagcgccaggttcagggcggccagcagcagcactgtgcgcccccagcgcgctgctagggcgccccgctggtcgctgcgcttgtaggcgtgcg

SEQ ID NO: 52385 - DNA, 55 bp, Homo sapiens
  chr7:150716305-150716360
  hyper
gttggccagcgccacctggtagttggtgtagcgcaggatgcggtggtggatgtcc

SEQ ID NO: 52386 - DNA, 94 bp, Homo sapiens
  chr7:150748098-150748192
  hyper
ctaaagccatctccccggtacccgcaggcgacgtgccagtgtgcagcccccagcagtacaagaactgtgcccacccggccataggtaagggcga

SEQ ID NO: 52387 - DNA, 151 bp, Homo sapiens
  chr7:150748406-150748557
  hyper
gtgagctgcgcggggcgggcgggctcctccgagccgggggctcccgacggggcggaacggggcaggccaggccgtagccctagtgcgcacagcccgggcggaggcagcctccgcagcctcactggctctggggctccgtgctggttgctta

SEQ ID NO: 52388 - DNA, 165 bp, Homo sapiens; identical to SEQ ID NO: 9276
  chr7:150864232-150864397
  hyper

SEQ ID NO: 52389 - DNA, 68 bp, Homo sapiens; identical to SEQ ID NO: 31616
  chr7:150864610-150864678
  hyper

SEQ ID NO: 52390 - DNA, 33 bp, Homo sapiens; identical to SEQ ID NO: 19871
  chr7:151106418-151106451
  hyper

SEQ ID NO: 52391 - DNA, 91 bp, Homo sapiens; identical to SEQ ID NO: 19872
  chr7:151107395-151107486
  hyper

SEQ ID NO: 52392 - DNA, 192 bp, Homo sapiens
  chr7:151107651-151107843
  hyper
tcggtggagccgggatgtcaagttcaccttccagccgccgcgggctccctcggcctggggcgcctctaatggaccccggggtcggcctgagccctcccggagcgcccggcggctggtttccattagggcagttccggcgccgacttcgctggggacggggaaggtgacccccctactcggatcccccaggtc

SEQ ID NO: 52393 - DNA, 348 bp, Homo sapiens; identical to SEQ ID NO: 31621
  chr7:151145538-151145886
  hyper

SEQ ID NO: 52394 - DNA, 61 bp, Homo sapiens; identical to SEQ ID NO: 31622
  chr7:151574953-151575014
  hyper

SEQ ID NO: 52395 - DNA, 18 bp, Homo sapiens
  chr7:152622496-152622514
  hyper
gggaacggtggaggccgc

SEQ ID NO: 52396 - DNA, 76 bp, Homo sapiens
  chr7:152622545-152622621
  hyper
cggcggggatcgcagggccgaggggccgggcgcgcgcgggggagggacccaggccaggggccgctcgcctcggggc

SEQ ID NO: 52397 - DNA, 64 bp, Homo sapiens
  chr7:152622697-152622761
  hyper
ccttcgccaaggccgggccaggcgagtaggggcgcggcctgagcccctgcggtgattccccagg

SEQ ID NO: 52398 - DNA, 30 bp, Homo sapiens; identical to SEQ ID NO: 31625
  chr7:153445126-153445156
  hyper

SEQ ID NO: 52399 - DNA, 117 bp, Homo sapiens; identical to SEQ ID NO: 9283
  chr7:153446175-153446292
  hyper

SEQ ID NO: 52400 - DNA, 181 bp, Homo sapiens; identical to SEQ ID NO: 31627
  chr7:153583349-153583530
  hyper

SEQ ID NO: 52401 - DNA, 88 bp, Homo sapiens
  chr7:153584301-153584389
  hyper
tgctggaggagcccccggagccggggccgagccgccggcgtccccgagtgcgccccctgtgcgtgccgccgcgctgttgctcgcagtg

SEQ ID NO: 52402 - DNA, 51 bp, Homo sapiens
  chr7:153584797-153584848
  hyper
taagatgcaggggaacgtgatggtgagtgccacggacagggcgcgcgctgg

SEQ ID NO: 52403 - DNA, 17 bp, Homo sapiens
  chr7:153749703-153749720
  hyper
aggcagagtcgccagcg

SEQ ID NO: 52404 - DNA, 76 bp, Homo sapiens; identical to SEQ ID NO: 31632
  chr7:153750249-153750325
  hyper

SEQ ID NO: 52405 - DNA, 10 bp, Homo sapiens
  chr7:154002083-154002093
  hyper
cgctgcctcc

SEQ ID NO: 52406 - DNA, 318 bp, Homo sapiens; identical to SEQ ID NO: 31634
  chr7:154861712-154862030
  hyper

SEQ ID NO: 52407 - DNA, 15 bp, Homo sapiens
  chr7:154862031-154862046
  hyper
ccagcattcgctctc

SEQ ID NO: 52408 - DNA, 124 bp, Homo sapiens
  chr7:154862266-154862390
  hyper
cgatctgggagatgctcggctctgggcggccaaacagcctttccaccaaggcgaggagccctgggctcctgacagcttaggcgggccctggctgcgacacgcagcccctcgcctctgcttcctt

SEQ ID NO: 52409 - DNA, 9 bp, Homo sapiens
  chr7:155164445-155164454
  hyper
ttccctgtt

SEQ ID NO: 52410 - DNA, 313 bp, Homo sapiens; identical to SEQ ID NO: 19883
  chr7:155165562-155165875
  hyper

SEQ ID NO: 52411 - DNA, 250 bp, Homo sapiens; identical to SEQ ID NO: 19884
  chr7:155166784-155167034
  hyper

SEQ ID NO: 52412 - DNA, 85 bp, Homo sapiens; identical to SEQ ID NO: 31641
  chr7:155168529-155168614
  hyper

SEQ ID NO: 52413 - DNA, 743 bp, Homo sapiens; identical to SEQ ID NO: 31642
  chr7:155170182-155170925
  hyper

SEQ ID NO: 52414 - DNA, 98 bp, Homo sapiens; identical to SEQ ID NO: 31643
  chr7:155173869-155173967
  hyper

SEQ ID NO: 52415 - DNA, 432 bp, Homo sapiens; identical to SEQ ID NO: 19889
  chr7:155174224-155174656
  hyper

SEQ ID NO: 52416 - DNA, 192 bp, Homo sapiens
  chr7:155174788-155174980
  hyper
acatgtacacgaatgtgagtgtgagtgtgcatgagcgtgagcgtgcgtgtgcgtgcgagtgtgcacgagcgtgactgtgagtgtgcgtgcgtggaagcgcggcggggagcctggctgaaggcctgctgcctgcatggctgtcagagaaaaacagaagtgggagcctgctgcgggctccgagaggacttgatg

SEQ ID NO: 52417 - DNA, 260 bp, Homo sapiens
  chr7:155242049-155242309
  hyper
ggcccctcccgggcacacatgggtgtccgctccttcctccccctcccctcccctcgcacggagagcggagagcggagagcggagagcgacagggaggcagccgaagacttgaattttgaaaggggagctggcggcgaatggtgaatgagacagctacttaggaagcgagtccagccagcccgggaggcggtggagacccacgcccggaagtaaccggattaggtctcagaatgtgatcgccccccgggtcccgggggaga

SEQ ID NO: 52418 - DNA, 140 bp, Homo sapiens; identical to SEQ ID NO: 31647
  chr7:155242379-155242519
  hyper

SEQ ID NO: 52419 - DNA, 30 bp, Homo sapiens; identical to SEQ ID NO: 19892
  chr7:155242699-155242729
  hyper

SEQ ID NO: 52420 - DNA, 244 bp, Homo sapiens; identical to SEQ ID NO: 19893
  chr7:155243102-155243346
  hyper

SEQ ID NO: 52421 - DNA, 70 bp, Homo sapiens
  chr7:155243755-155243825
  hyper
cggttttgttttccaggggtagtttctgcagaaaggagattctcctccgggccgaagggctaccagcctg

SEQ ID NO: 52422 - DNA, 285 bp, Homo sapiens
  chr7:155243895-155244180
  hyper
ccgcccactgcggagagtgtcctcgtagagaggttttcaatcgaaggagcctgggctccacattttgtcttcaagcctgagctttcagggctgctttgcacgaggtgcagatgaacttgtgtctgcaaacaagacagaaaaccctaagtgccgcccgaccttcctcttttggggaacccgcactttgtcctgggagcgtgcccagcgccttagtaccaaactttctggccggggctggcagagctcagagtcccgcttccccctaggcgcggccccctaacatct

SEQ ID NO: 52423 - DNA, 119 bp, Homo sapiens; identical to SEQ ID NO: 31650
  chr7:155246406-155246525
  hyper

SEQ ID NO: 52424 - DNA, 372 bp, Homo sapiens; identical to SEQ ID NO: 31652
  chr7:155247839-155248211
  hyper

SEQ ID NO: 52425 - DNA, 121 bp, Homo sapiens
  chr7:155248792-155248913
  hyper
ctggggaaggagcttcgcaaggccagggtgcaaccttcaggccccaggtggcctggcaggccacgctgcctcggagatgcttgccagactccccaagttcactcagggcctggcagcaacc

SEQ ID NO: 52426 - DNA, 569 bp, Homo sapiens
  chr7:155248943-155249512
  hyper
ctgagcacggtgcagctgcccagggccaatcagccctagggtgtccgtgccaggctgcggcctccccgcctcccccgcactgagggtactcatggcgtgcaaatgctcccgcacccccagagctgccctatcggatgtttccaggaattcacacatttccataaaaatgcattttaaatgatggacaggcgagcctggggtaacaacgggtgtttggtgggtagacaagagcaaatgggaaggagcccgagggaggagggggaagagaagaggaaacagaacttccagttggacattctgacaacagctggaaggaaagtctagaaaagatgaagagagaggaggggagaaaccaactggggctcccacccttgccgttggattcctaattctcgtttcaaatgggccctgctctccggcaaaattagtttaaaggattttaaaacaaagaaaacgagatgaccggtctgggagctcctcaatcagagtagagaagttagaggggggcgggcgacttggttttgaagtcttagctgaacagtcacccctcctctccttggcaaaaagga

SEQ ID NO: 52427 - DNA, 62 bp, Homo sapiens
  chr7:155249863-155249925
  hyper
ggaattgtgggatttcgccccacggtaaacaatatggaaatcttaaaaatagcgatcttcct

SEQ ID NO: 52428 - DNA, 42 bp, Homo sapiens
  chr7:155250011-155250053
  hyper
agcgcgggcgagcgcaggagacgcggtcgggggtctctccgg

SEQ ID NO: 52429 - DNA, 432 bp, Homo sapiens
  chr7:155250355-155250787
  hyper
gcccagcccggcccggccgggccctggcctcgcgtctctcacccatgcgactcgggccgcggagctctgcggggctcggcgggggcgcggccgcacgccggtggggcgccccggcccgcagcggggcggcggccgcgaggagggggcctccatgtgcgtgcgggcggtggcgggcgcgctgaccgcgggcgcccggcaccctcgagggccggctagggcgtgcgggcggggacggccgggcggcggcggcggccggagccggcccgggcgggcgtgagcgccggggaacgcgctgcctgcatgcgcgcagctctcgccccgggcggcccaggcggcggcgccggagcccgaggcggccggacgcggagaggagcggggagcccgggaggcggcccgcgtccccgccggaccactgcgactgtctagaccccg

SEQ ID NO: 52430 - DNA, 89 bp, Homo sapiens; identical to SEQ ID NO: 31657
  chr7:155251170-155251259
  hyper

SEQ ID NO: 52431 - DNA, 204 bp, Homo sapiens; identical to SEQ ID NO: 31658
  chr7:155251346-155251550
  hyper

SEQ ID NO: 52432 - DNA, 40 bp, Homo sapiens
  chr7:155251661-155251701
  hyper
cggacagctcgcaagccggcgccaacctgggcgcgcagcc

SEQ ID NO: 52433 - DNA, 85 bp, Homo sapiens; identical to SEQ ID NO: 19901
  chr7:155252162-155252247
  hyper

SEQ ID NO: 52434 - DNA, 372 bp, Homo sapiens
  chr7:155252490-155252862
  hyper
ccaaatagaaaggaccttctctcagggtttcctgggggctgctgatgggaaagaggcagcattcgcaggggccctgcagagatgctggatatattttttcatagatctgcgattttaaaaaactaagtccatgtccttgtagaaatcatcaactgcattccatgcgggtctgcggctgggaaccgccattagaagtggactgtttgaccccgagctggcagcggatccccgctgcccccaaaccctcaactattttgcgggggtcatttgcccagatcacagcaggagtgagccaacccttgggccgccatcccgcagaactatgcgtgcatatttctgatgaaattcagatttctcagctagatctgaaat

SEQ ID NO: 52435 - DNA, 87 bp, Homo sapiens
  chr7:155253041-155253128
  hyper
cagcccaagtcgcctatcttcatgggctttaaaatatccctgcaagataatgtttctgttctttggtttctccgaaagaaaggggag

SEQ ID NO: 52436 - DNA, 75 bp, Homo sapiens
  chr7:155255324-155255399
  hyper
acagggcttgtacaaccactccaccacagccaaggagggcaagtcggacagcgagtagggcggggggcatggagg

SEQ ID NO: 52437 - DNA, 15 bp, Homo sapiens
  chr7:155256218-155256233
  hyper
caccaagggcccaac

SEQ ID NO: 52438 - DNA, 107 bp, Homo sapiens
  chr7:155256312-155256419
  hyper
cctgccctgggcactgcctccatgcagaagcgcttcgaggttctggggctaaaggcctggggtgtgtggcctaaagcccaagagcggtggggcgaccctccttttgg

SEQ ID NO: 52439 - DNA, 337 bp, Homo sapiens
  chr7:155257856-155258193
  hyper
ccacccgtgctggaccgaggcgctttcccctggggacaggaactttttactccactgagacaaagagactctccttttcaaagtgtcatttttgtttaccttttgttgtttcccccccaaaacaaaagactttgtacaacttcctaagcaggattgggggagggatcagcttcgcctgtgctgaccgcgcctctggattccgctcatcaggaagtgtttggggtctttgagcgagtgatctacgcgttgaattgctgtttttccaaactttcatggcttaaaaattttttttcttctccctgtaaaagaaactcagagactggtgatctgttaccga

SEQ ID NO: 52440 - DNA, 377 bp, Homo sapiens; identical to SEQ ID NO: 19905
  chr7:155258487-155258864
  hyper

SEQ ID NO: 52441 - DNA, 35 bp, Homo sapiens; identical to SEQ ID NO: 19906
  chr7:155258914-155258949
  hyper

SEQ ID NO: 52442 - DNA, 116 bp, Homo sapiens; identical to SEQ ID NO: 31671
  chr7:155260458-155260574
  hyper

SEQ ID NO: 52443 - DNA, 95 bp, Homo sapiens; identical to SEQ ID NO: 19907
  chr7:155260785-155260880
  hyper

SEQ ID NO: 52444 - DNA, 167 bp, Homo sapiens
  chr7:155261210-155261377
  hyper
tttccccagcctctaccccctccaactaactttcctttcttcccttctcttttcttccctctctggatgggtaatcacaggctccgctgccaagcgcgctgcgaggagccgctgcccgttcccgtcggtgcccctccccgcggcagcctggccgagtccgcccagcc

SEQ ID NO: 52445 - DNA, 125 bp, Homo sapiens; identical to SEQ ID NO: 31674
  chr7:155262418-155262543
  hyper

SEQ ID NO: 52446 - DNA, 215 bp, Homo sapiens; identical to SEQ ID NO: 9326
  chr7:155264127-155264342
  hyper

SEQ ID NO: 52447 - DNA, 85 bp, Homo sapiens; identical to SEQ ID NO: 19909
  chr7:155301753-155301838
  hyper

SEQ ID NO: 52448 - DNA, 74 bp, Homo sapiens
  chr7:155301931-155302005
  hyper
gtaccgcagattgttattacaatgtaacaacgacctgctttacatcattacggggctagcgtaaattccagttt

SEQ ID NO: 52449 - DNA, 2 bp, Homo sapiens
  chr7:155302326-155302328
  hyper
gg

SEQ ID NO: 52450 - DNA, 28 bp, Homo sapiens
  chr7:155303335-155303363
  hyper
tgaatgttttaatcgctaaaaatgtcta

SEQ ID NO: 52451 - DNA, 297 bp, Homo sapiens
  chr7:155325872-155326169
  hyper
tcccaaacggcgcggcctcgctcaccctcaaaacccactccgcgcccgacgggaacggctggagggaggaaagagccaggcacctctcgttcggggtctgacattgtcacctggcagataagtgagtctgctcggatgtgccggctcggaacatgcccgttcgtcaaagagggaggggaaacaaaacgagcttgtgcctcattcccggtggctctccacgcaaagttaacgtttgtttactctaagcatatgcccaggtgaggcctgcacagccacctcgccgcgggtgcagggcgc

SEQ ID NO: 52452 - DNA, 14 bp, Homo sapiens
  chr7:155326527-155326541
  hyper
ggcattgtttcagc

SEQ ID NO: 52453 - DNA, 25 bp, Homo sapiens
  chr7:155579904-155579929
  hyper
ccccaaggtaagccccgaggcgtcc

SEQ ID NO: 52454 - DNA, 63 bp, Homo sapiens
  chr7:155580211-155580274
  hyper
cgcccgcccgctgcaggccaggactgcgctctgtctgcccacggcccccgcctggcacacacg

SEQ ID NO: 52455 - DNA, 62 bp, Homo sapiens
  chr7:155600567-155600629
  hyper
ttggagtctggttgtcgccatggagggacagcttctatccagggccctaactgtagcgtggg

SEQ ID NO: 52456 - DNA, 257 bp, Homo sapiens; identical to SEQ ID NO: 31683
  chr7:155601133-155601390
  hyper

SEQ ID NO: 52457 - DNA, 30 bp, Homo sapiens; identical to SEQ ID NO: 31684
  chr7:155601921-155601951
  hyper

SEQ ID NO: 52458 - DNA, 322 bp, Homo sapiens
  chr7:155602805-155603127
  hyper
gccgcgggggatcgataacccgggagtaagtggggctgcaggcgtctgcctcgctgcgcggctctgtgcgcttgcagctttgcagcagggctgcaaggcccaagccctgggaaggtgtgcgagcccaggaccccttctgcggtattggcctcccgcagagcagggcagaagctgacccactctggctctgggacctcgggtatccacgcccccgccgctctctccgcagtgcctccctcctctcgggttccgagggaccctggcaaggcccctcctccgcggggagtgagggtgacgagaggatgggcgcctcgggctagcc

SEQ ID NO: 52459 - DNA, 41 bp, Homo sapiens; identical to SEQ ID NO: 31686
  chr7:155604978-155605019
  hyper

SEQ ID NO: 52460 - DNA, 166 bp, Homo sapiens
  chr7:156409347-156409513
  hyper
tcccctttccccgctggaaccactttctccaaggagctccgccccgcgctctccccgaccccgtgcgcccccagacctcgcgtcccccgcgctctcccccgccgcgccctcctgccccgcgcccctcctcgccccgaccccgcgcccctgcgcccgggctccagcc

SEQ ID NO: 52461 - DNA, 33 bp, Homo sapiens
  chr7:156409802-156409835
  hyper
tagttcaaggaataaacacggatccccactggc

SEQ ID NO: 52462 - DNA, 237 bp, Homo sapiens; identical to SEQ ID NO: 31689
  chr7:156432918-156433155
  hyper

SEQ ID NO: 52463 - DNA, 81 bp, Homo sapiens
  chr7:156794072-156794153
  hyper
gtgctgcaatgaactcgggtgtgcaaatgtctctttgagatctttttgttttttccaattcttttggatatatacccagaa

SEQ ID NO: 52464 - DNA, 190 bp, Homo sapiens
  chr7:156795914-156796104
  hyper
gcaggggccggcgcaggtccggggcctggctctgctggaggacgggggaggggcggccctattaacagcgtcttcctttgatgtcgctcttccccgcgtcccagaggaagcgcctgtcccctgggggtagagggacagaccctccgcggaggcctggggcaccccagctccaggccgagcccccactctt

SEQ ID NO: 52465 - DNA, 40 bp, Homo sapiens; identical to SEQ ID NO: 19915
  chr7:156796494-156796534
  hyper

SEQ ID NO: 52466 - DNA, 43 bp, Homo sapiens
  chr7:156799467-156799510
  hyper
actatcagtgcccactccccaaggaatgcggactcaggaccac

SEQ ID NO: 52467 - DNA, 66 bp, Homo sapiens; identical to SEQ ID NO: 19916
  chr7:156800933-156800999
  hyper

SEQ ID NO: 52468 - DNA, 49 bp, Homo sapiens
  chr7:156801029-156801078
  hyper
aagcccaggctggcaggggattcgcagacgcagacgtgtctgaggtgag

SEQ ID NO: 52469 - DNA, 271 bp, Homo sapiens; identical to SEQ ID NO: 19918
  chr7:156801601-156801872
  hyper

SEQ ID NO: 52470 - DNA, 24 bp, Homo sapiens
  chr7:156809199-156809223
  hyper
gtccatgttcgataatggcaggaa

SEQ ID NO: 52471 - DNA, 281 bp, Homo sapiens
  chr7:156811436-156811717
  hyper
ctgcgagagggtcttcttactctaatcagcctgcctgagctaatggacgagggggtcaggctgagagttattgacacgcccgtgcccttaacctgtttcccaataaagctgattagtttttgtcaattcatcagctaaccactcttgctggaactgcatcaaagccttatttgctcaggggaaatcaacaagtcacagatcagctccattaaggggcccggcccggcaaggacagtcctggagccgagggacgccccgacggacctcgggcctcccccgag

SEQ ID NO: 52472 - DNA, 105 bp, Homo sapiens; identical to SEQ ID NO: 31705
  chr7:156811921-156812026
  hyper

SEQ ID NO: 52473 - DNA, 37 bp, Homo sapiens; identical to SEQ ID NO: 31706
  chr7:156812242-156812279
  hyper

SEQ ID NO: 52474 - DNA, 64 bp, Homo sapiens
  chr7:156812788-156812852
  hyper
taaggatattgtatacgcggggggtatgctttattgacaatttcattttccaattagtaatttt

SEQ ID NO: 52475 - DNA, 114 bp, Homo sapiens; identical to SEQ ID NO: 31709
  chr7:156871039-156871153
  hyper

SEQ ID NO: 52476 - DNA, 13 bp, Homo sapiens
  chr7:156871297-156871310
  hyper
ggggatctgaaca

SEQ ID NO: 52477 - DNA, 138 bp, Homo sapiens; identical to SEQ ID NO: 31711
  chr7:157129147-157129285
  hyper

SEQ ID NO: 52478 - DNA, 49 bp, Homo sapiens; identical to SEQ ID NO: 31712
  chr7:157130967-157131016
  hyper

SEQ ID NO: 52479 - DNA, 34 bp, Homo sapiens; identical to SEQ ID NO: 31713
  chr7:157476555-157476589
  hyper

SEQ ID NO: 52480 - DNA, 201 bp, Homo sapiens
  chr7:157477272-157477473
  hyper
ctcctcccctcccctcccctccgcccccctccctccggcccacacagcctcttccagaaagaagtcactctagagccgcgcgacccagccccagagtccgccggggtccgcccaccgggtctcctgcgcgcccctccccgcccctccccgggcacagcccgttcacgaaacctaaggcgccggccacgcgccacctccccc

SEQ ID NO: 52481 - DNA, 210 bp, Homo sapiens
  chr7:157481759-157481969
  hyper
ggcgctcgcagcccccgggcggcgcagccgccaccgccgccgtcttctctggagcgcagaggggtgtgcttgggagggggcgggagggcactttcctctgtgtcggtgaaaggaagagcttccagctccctcctccgcacaaaccttcacttcctctcttgttcgatcgcgtcctaaaatctgggatcggcgacgcaaggacagcctggt

SEQ ID NO: 52482 - DNA, 131 bp, Homo sapiens; identical to SEQ ID NO: 31719
  chr7:157482200-157482331
  hyper

SEQ ID NO: 52483 - DNA, 134 bp, Homo sapiens
  chr7:157482667-157482801
  hyper
gctgctcgccccttccctcctcctttcccacacgcctcccatctccgtgcctgcacccccccacccccagcaccctgcaatggtcggaactgcagggagtggggagcaacgcgaaaggccgagagaagagcgct

SEQ ID NO: 52484 - DNA, 265 bp, Homo sapiens
  chr7:157483055-157483320
  hyper
gttagagcccccatgcgcgccctccagccttcgaaagctctcttcctcgccccaccacctacgcgcctggtgatgctctcgtgggcccttcctgctccctccgcccccatcccagcctctctcgcctcttccagggcccacccaaccgcactacgagcgcccgcgccccgcccggcacccctggttacctgcagctgggccggcgcccagcgcccgcgcgggaggaggtgggggcgtgcgccgggccgagcggcctcggggcgca

SEQ ID NO: 52485 - DNA, 705 bp, Homo sapiens
  chr7:157483538-157484243
  hyper
cgcgtgctccgccccggcccggcccccgggctaggcacgctgggccggggcgcggcgcgggcgggctcagggcgggctccggacggtcccggtagggccgccggccgcgcgcgtagcaccaaccagcgcggccgccgcgccccgccttatatccggcccggcgcgcacccggccggcggcggcgcggctcgcggcccagccaccggttgctatagcgatgtccccccccccccccacatgttgctgacagcaattggctaaggggccgcggctctccaaacaccctctcccgcccgagactatgaatggacatcagctttgtcagtcattggtacaacgccgaagccagggccttcgccttttctttcttttcagtgtttctccctttcatcgttcatactgggcaagttcagggtagcaccgaggggagagagacctcggccagaaaagtcaaggcgcgcggctctgctgtgacctttgtcctgggaggggtgggtggggtgcgtcgccactcttggcaagagaaaattgcacggcatatcgttcttcccagttaccttttccagtgttgccgttcgggcctttttgctccctttccaaatggaagcaggccaatgattcagggcgagtagacgagagcccctctgctcactttaccagggtcctcccgagtgtttaggtcccgatgcgcgtagaaagtgtctt

SEQ ID NO: 52486 - DNA, 25 bp, Homo sapiens
  chr7:157484461-157484486
  hyper
tgcccacataacccccggcccctgg

SEQ ID NO: 52487 - DNA, 370 bp, Homo sapiens
  chr7:157484507-157484877
  hyper
cgagaagagctagggtctcggggcgactaggaccactgagcacctcccccccgcgcctcccgcccatgctctctctccccaggccctggaccccgggccacagccacaggttggggcaccccggtgcgcggcgcccccgcggagctggcgagagccggagagctgaaacccaacatctgtgtgtacaatgcgctctccgaggcccacagctgcaggaacaaggagaagaaaggaagaggggggcgcagatcttgtcacacgcagatgacagtctgcggagggctctttagtttctccttttctggaaaccccagcggccccctcctaggcccccctctcccaccgcctggccattgttccctgcgcccgg

SEQ ID NO: 52488 - DNA, 24 bp, Homo sapiens
  chr7:157485503-157485527
  hyper
gcccagggcaaggcccgcaaaaac

SEQ ID NO: 52489 - DNA, 271 bp, Homo sapiens
  chr7:157485705-157485976
  hyper
tccagggcgaccccaggcccggccctgggcagagacagaggaggggaggggaggtggcgctggggggcggggggccggagacggcgggaggaggactcgggagccggggcgggaagaggggaagacagcggagagaagggacggggaggggagggggctcggaggaggggacctgctgccctcagcctggctggtaaccggcctctccatagcaacggccagcgcgcgcgtctgtgtgtgcgcgcgtgtctgatgtgtgtgtgcccgtggt

SEQ ID NO: 52490 - DNA, 100 bp, Homo sapiens
  chr7:157486503-157486603
  hyper
gctggggtctccagcaggcggccgggagctctccgaggtggccaggagtggccggtagccgtctccctcggccaggccgtgtccagcccctcagtctcca

SEQ ID NO: 52491 - DNA, 144 bp, Homo sapiens; identical to SEQ ID NO: 31728
  chr7:158379278-158379422
  hyper

SEQ ID NO: 52492 - DNA, 36 bp, Homo sapiens; identical to SEQ ID NO: 31729
  chr7:158380360-158380396
  hyper

SEQ ID NO: 52493 - DNA, 236 bp, Homo sapiens; identical to SEQ ID NO: 31730
  chr7:158380974-158381210
  hyper

SEQ ID NO: 52494 - DNA, 336 bp, Homo sapiens; identical to SEQ ID NO: 31731
  chr7:158823329-158823665
  hyper

SEQ ID NO: 52495 - DNA, 40 bp, Homo sapiens; identical to SEQ ID NO: 31734
  chr7:158937902-158937942
  hyper

SEQ ID NO: 52496 - DNA, 19 bp, Homo sapiens
  chr7:158938399-158938418
  hyper
cacgcggtgccactggggc

SEQ ID NO: 52497 - DNA, 143 bp, Homo sapiens; identical to SEQ ID NO: 31736
  chr8:495720-495863
  hyper

SEQ ID NO: 52498 - DNA, 156 bp, Homo sapiens
  chr8:686714-686870
  hyper
tatgcggtttgttttcgcatcttttacctcatttaaatgccgtagccatgcaggtggaaagcagaaatccatttctgcgtttatgttaaactggggctgagagacttgcccagggtcggtgaccgcccagggatccccataccagcgcgtctagct

SEQ ID NO: 52499 - DNA, 129 bp, Homo sapiens; identical to SEQ ID NO: 3193
  chr8:687513-687642
  hyper

SEQ ID NO: 52500 - DNA, 43 bp, Homo sapiens; identical to SEQ ID NO: 31741
  chr8:688697-688740
  hyper

SEQ ID NO: 52501 - DNA, 35 bp, Homo sapiens; identical to SEQ ID NO: 31742
  chr8:1772635-1772670
  hyper

SEQ ID NO: 52502 - DNA, 86 bp, Homo sapiens
  chr8:4849177-4849263
  hyper
cgcgctgccgagccccggggcccagcgccgacgcccccggggggaggcccgaccttggtcacccgggctttgctaggcaaggggaa

SEQ ID NO: 52503 - DNA, 170 bp, Homo sapiens
  chr8:4849296-4849466
  hyper
cggcgactccggcgctggcgtcaccagcccccttcctgcctgcagccccttcccaggccggtacaggagctcgcacttgaccccgcaggcgtggaggagacacggtccctggtccctgtggggttaatgaaggagctccacggacccactgcctcgtgggccagacaata

SEQ ID NO: 52504 - DNA, 291 bp, Homo sapiens
  chr8:4849500-4849791
  hyper
ccctccgcgcgcacacacttgcgcacagcacctctccagctccatgcacgccaggggcctgggaccctgggctccacttctcggcttctacagccaggttctgggacctgcagcgcgcaagaggagctctcttccacggggctgccccgcagggcccgaggcgcccaggactttgcaacccctgccctgttcgccccagaatcatccagagcagcccccgcccactacctggccctccacaccctccctcccgcctccgcctcagcctcatcctagcgctgcagcccaccc

SEQ ID NO: 52505 - DNA, 15 bp, Homo sapiens
  chr8:4850232-4850247
  hyper
gccctgctcagcagg

SEQ ID NO: 52506 - DNA, 183 bp, Homo sapiens
  chr8:4850516-4850699
  hyper
agggaggggaagcccaggcggcacgtctctcccccgctctccaggcagatctggagtttcctaatgaaccagatacagtcctccttcgccctgccaatcactcttccatctggaccactggaggaaaaggaaatgggtggaaaagaagatggaagaatctagagaggacggggaaatattatg

SEQ ID NO: 52507 - DNA, 33 bp, Homo sapiens; identical to SEQ ID NO: 31747
  chr8:4851342-4851375
  hyper

SEQ ID NO: 52508 - DNA, 30 bp, Homo sapiens; identical to SEQ ID NO: 31748
  chr8:4851581-4851611
  hyper

SEQ ID NO: 52509 - DNA, 159 bp, Homo sapiens
  chr8:4851862-4852021
  hyper
cagtgaggagcctcgcgcacagcaccagcagcccgagaagcaggagcagcgactggaatctcctccacgcagtcatgtctgcagatactccacacgcacgcgacaccgatggctcctccgaggaaggcagggctatgagcggagccaaataatcacccg

SEQ ID NO: 52510 - DNA, 80 bp, Homo sapiens
  chr8:4852118-4852198
  hyper
gcatcgggtcccgagccactgcagggctgagctgctccgagcgcggagacccgggctggcggggccggggccggggacga

SEQ ID NO: 52511 - DNA, 77 bp, Homo sapiens; identical to SEQ ID NO: 31750
  chr8:4852501-4852578
  hyper

SEQ ID NO: 52512 - DNA, 182 bp, Homo sapiens; identical to SEQ ID NO: 31751
  chr8:6692272-6692454
  hyper

SEQ ID NO: 52513 - DNA, 468 bp, Homo sapiens; identical to SEQ ID NO: 31752
  chr8:6692702-6693170
  hyper

SEQ ID NO: 52514 - DNA, 29 bp, Homo sapiens
  chr8:9756486-9756515
  hyper
cgctagagtgaaatcgatgtgcatggaaa

SEQ ID NO: 52515 - DNA, 272 bp, Homo sapiens; identical to SEQ ID NO: 31756
  chr8:9761450-9761722
  hyper

SEQ ID NO: 52516 - DNA, 42 bp, Homo sapiens; identical to SEQ ID NO: 31757
  chr8:9761782-9761824
  hyper

SEQ ID NO: 52517 - DNA, 253 bp, Homo sapiens; identical to SEQ ID NO: 31758
  chr8:9762041-9762294
  hyper

SEQ ID NO: 52518 - DNA, 279 bp, Homo sapiens; identical to SEQ ID NO: 19935
  chr8:9762864-9763143
  hyper

SEQ ID NO: 52519 - DNA, 42 bp, Homo sapiens
  chr8:9763275-9763317
  hyper
gcggagccgcctggaaatccagcccttcgcgtgaactcgcgt

SEQ ID NO: 52520 - DNA, 226 bp, Homo sapiens; identical to SEQ ID NO: 31761
  chr8:9763536-9763762
  hyper

SEQ ID NO: 52521 - DNA, 108 bp, Homo sapiens; identical to SEQ ID NO: 19938
  chr8:9763787-9763895
  hyper

SEQ ID NO: 52522 - DNA, 220 bp, Homo sapiens; identical to SEQ ID NO: 19939
  chr8:9764214-9764434
  hyper

SEQ ID NO: 52523 - DNA, 401 bp, Homo sapiens
  chr8:9764551-9764952
  hyper
tccgggagcacagggtgagcttggccttcaggaatgactcagaatgaatccgcctataagagccaaactaaagacgaccccccgccccagccccccaaccataacccaacgcctgccatgagaaaccttcggactttccaaggggtcagtgcctcagccacgaggggcagccctgacccgcgcggttcacgcacacgcagggcccatctgcttcccctactccggcttttcttctctgatgacttaaaagagagtgagtgagggagagagggagagagagagagaggtctaagtgtttcttgggcactgctggattcagggcaactagagatggggagaacaagccccgccagctaaaagcagccctgctgaaaccacacagcccgcgagggtcgcagcag

SEQ ID NO: 52524 - DNA, 167 bp, Homo sapiens
  chr8:10587422-10587589
  hyper
ccccgccccctggggcgccgatctccgctcctgtcccagcagaggagcctccctgcccgccgcgcggtttcactttggaccgcgccaagtgcccccgctctgaatcctgggcaccgcgagcacccacgctcgcgcagatggccagccacgcgggcacgaagagggcc

SEQ ID NO: 52525 - DNA, 115 bp, Homo sapiens; identical to SEQ ID NO: 31765
  chr8:10587893-10588008
  hyper

SEQ ID NO: 52526 - DNA, 109 bp, Homo sapiens; identical to SEQ ID NO: 31766
  chr8:10588184-10588293
  hyper

SEQ ID NO: 52527 - DNA, 30 bp, Homo sapiens; identical to SEQ ID NO: 31767
  chr8:10590903-10590933
  hyper

SEQ ID NO: 52528 - DNA, 39 bp, Homo sapiens; identical to SEQ ID NO: 31768
  chr8:10916999-10917038
  hyper

SEQ ID NO: 52529 - DNA, 283 bp, Homo sapiens; identical to SEQ ID NO: 31769
  chr8:11058266-11058549
  hyper

SEQ ID NO: 52530 - DNA, 35 bp, Homo sapiens; identical to SEQ ID NO: 31770
  chr8:11058764-11058799
  hyper

SEQ ID NO: 52531 - DNA, 17 bp, Homo sapiens
  chr8:11204509-11204526
  hyper
agcgccttggacccagc

SEQ ID NO: 52532 - DNA, 27 bp, Homo sapiens
  chr8:11204783-11204810
  hyper
ctgggccagctacaccgcaaacctttc

SEQ ID NO: 52533 - DNA, 261 bp, Homo sapiens
  chr8:11204905-11205166
  hyper
gatttcggtcgcgtgcggctctgaccgcgtcgccccatccctggcggggccacgcacggacgccatggctggcgccgcggagccgggcgatgcgcgcggactctcccggggccctgactgtccctgagtcctccctgcggggggcgtgcgcggcccgccccccgcggcgccacgcggcccctcctcggccggggattggtgcgccgggcggggcggggcggggcgggataaaggcgcggggtctggctgcgcggggtctgc

SEQ ID NO: 52534 - DNA, 255 bp, Homo sapiens; identical to SEQ ID NO: 31773
  chr8:11205167-11205422
  hyper

SEQ ID NO: 52535 - DNA, 257 bp, Homo sapiens; identical to SEQ ID NO: 31774
  chr8:11205445-11205702
  hyper

SEQ ID NO: 52536 - DNA, 61 bp, Homo sapiens; identical to SEQ ID NO: 9392
  chr8:11206007-11206068
  hyper

SEQ ID NO: 52537 - DNA, 22 bp, Homo sapiens
  chr8:11536805-11536827
  hyper
gaaggttctcagactcggggat

SEQ ID NO: 52538 - DNA, 69 bp, Homo sapiens
  chr8:11537156-11537225
  hyper
cgcggccttaaaagtatcccggcgagccctgagtgggccgggtgctgggcgaacagtcctagccctgca

SEQ ID NO: 52539 - DNA, 24 bp, Homo sapiens
  chr8:11537259-11537283
  hyper
ttacaggggcgaggttgggatcgg

SEQ ID NO: 52540 - DNA, 30 bp, Homo sapiens; identical to SEQ ID NO: 31778
  chr8:11540426-11540456
  hyper

SEQ ID NO: 52541 - DNA, 46 bp, Homo sapiens; identical to SEQ ID NO: 31779
  chr8:11550050-11550096
  hyper

SEQ ID NO: 52542 - DNA, 50 bp, Homo sapiens; identical to SEQ ID NO: 9395
  chr8:11550672-11550722
  hyper

SEQ ID NO: 52543 - DNA, 43 bp, Homo sapiens; identical to SEQ ID NO: 31784
  chr8:11560468-11560511
  hyper

SEQ ID NO: 52544 - DNA, 102 bp, Homo sapiens
  chr8:11560793-11560895
  hyper
ctgtgattgctctattaacctttagacctgtctgagggactctccggctcgcagccccgctgcgctggggcctccaggctctgacgccgactcccaactcag

SEQ ID NO: 52545 - DNA, 30 bp, Homo sapiens; identical to SEQ ID NO: 9400
  chr8:11561116-11561146
  hyper

SEQ ID NO: 52546 - DNA, 51 bp, Homo sapiens
  chr8:11561391-11561442
  hyper
cacaggaagggggggcggggagggagaaagggaactcattaataaagctga

SEQ ID NO: 52547 - DNA, 27 bp, Homo sapiens
  chr8:11562169-11562196
  hyper
ggactgacgggcccgggacaggctgca

SEQ ID NO: 52548 - DNA, 187 bp, Homo sapiens
  chr8:11562235-11562422
  hyper
cgcccaccagcgactccggggacgcagggtggcagtgccaggcagctccgctgggcctcaggggcccccgggagccgctctgaggtgcggagaggctgctgagtggcggaactattcatgccctttctggccggcctcctcgccctcggggctggggtccagggactgaatgctcctctggaagctc

SEQ ID NO: 52549 - DNA, 216 bp, Homo sapiens
  chr8:11562485-11562701
  hyper
gccgtgacttccctccgccggccacggggctgcccggatccgccgggttatgtcgcttggctttgggctcaggggtcaccgtgggcagaggggggtgccggggtcgcggactgccaccaggttgaggaaaggaggggccttttggctggggaaagagcgtggtgggggacccgcggccgatggaatccctggggcagcgcggcccgcaccgtggag

SEQ ID NO: 52550 - DNA, 53 bp, Homo sapiens; identical to SEQ ID NO: 31790
  chr8:12808858-12808911
  hyper

SEQ ID NO: 52551 - DNA, 59 bp, Homo sapiens; identical to SEQ ID NO: 31791
  chr8:12809671-12809730
  hyper

SEQ ID NO: 52552 - DNA, 267 bp, Homo sapiens; identical to SEQ ID NO: 31792
  chr8:12989381-12989648
  hyper

SEQ ID NO: 52553 - DNA, 73 bp, Homo sapiens; identical to SEQ ID NO: 31793
  chr8:12990075-12990148
  hyper

SEQ ID NO: 52554 - DNA, 5 bp, Homo sapiens
  chr8:12990659-12990664
  hyper
gggtt

SEQ ID NO: 52555 - DNA, 51 bp, Homo sapiens
  chr8:12990784-12990835
  hyper
agtcggagcgaactgtctcccgcgcgctccgccagccgggccctcccgctg

SEQ ID NO: 52556 - DNA, 262 bp, Homo sapiens; identical to SEQ ID NO: 31795
  chr8:12991064-12991326
  hyper

SEQ ID NO: 52557 - DNA, 67 bp, Homo sapiens; identical to SEQ ID NO: 31796
  chr8:13133827-13133894
  hyper

SEQ ID NO: 52558 - DNA, 42 bp, Homo sapiens; identical to SEQ ID NO: 31797
  chr8:13134283-13134325
  hyper

SEQ ID NO: 52559 - DNA, 85 bp, Homo sapiens; identical to SEQ ID NO: 31798
  chr8:13424168-13424253
  hyper

SEQ ID NO: 52560 - DNA, 8 bp, Homo sapiens
  chr8:13424344-13424352
  hyper
cgttgcca

SEQ ID NO: 52561 - DNA, 139 bp, Homo sapiens
  chr8:15094366-15094505
  hyper
cggccggagcctccgcagatgccgcccctaccagcccggctcccgcctccccgccccctgcccgagtccccggacctgctcccgcgcctggggctagggcaggctagccgtccccggcagcgggggtacctctccagcc

SEQ ID NO: 52562 - DNA, 42 bp, Homo sapiens; identical to SEQ ID NO: 31801
  chr8:15094645-15094687
  hyper

SEQ ID NO: 52563 - DNA, 51 bp, Homo sapiens; identical to SEQ ID NO: 31802
  chr8:15095356-15095407
  hyper

SEQ ID NO: 52564 - DNA, 102 bp, Homo sapiens; identical to SEQ ID NO: 31803
  chr8:16859352-16859454
  hyper

SEQ ID NO: 52565 - DNA, 41 bp, Homo sapiens; identical to SEQ ID NO: 31804
  chr8:16884323-16884364
  hyper

SEQ ID NO: 52566 - DNA, 322 bp, Homo sapiens; identical to SEQ ID NO: 31805
  chr8:16884365-16884687
  hyper

SEQ ID NO: 52567 - DNA, 81 bp, Homo sapiens; identical to SEQ ID NO: 31806
  chr8:16884908-16884989
  hyper

SEQ ID NO: 52568 - DNA, 30 bp, Homo sapiens; identical to SEQ ID NO: 31807
  chr8:16885322-16885352
  hyper

SEQ ID NO: 52569 - DNA, 450 bp, Homo sapiens; identical to SEQ ID NO: 31808
  chr8:19614007-19614457
  hyper

SEQ ID NO: 52570 - DNA, 277 bp, Homo sapiens; identical to SEQ ID NO: 31809
  chr8:19614987-19615264
  hyper

SEQ ID NO: 52571 - DNA, 34 bp, Homo sapiens; identical to SEQ ID NO: 31810
  chr8:19797566-19797600
  hyper

SEQ ID NO: 52572 - DNA, 133 bp, Homo sapiens
  chr8:19797806-19797939
  hyper
ctgtggtcgccgactcggggggttgccaggtctgcgtttggccaccctttctgtcctgggggctgaggtcagctccgggcgcccggccccgccgcgcggctgcgagcacgtggggttgacgggcgccgcgtgg

SEQ ID NO: 52573 - DNA, 661 bp, Homo sapiens; identical to SEQ ID NO: 31812
  chr8:20160990-20161651
  hyper

SEQ ID NO: 52574 - DNA, 32 bp, Homo sapiens; identical to SEQ ID NO: 9415
  chr8:20161666-20161698
  hyper

SEQ ID NO: 52575 - DNA, 260 bp, Homo sapiens; identical to SEQ ID NO: 31814
  chr8:21881767-21882027
  hyper

SEQ ID NO: 52576 - DNA, 30 bp, Homo sapiens; identical to SEQ ID NO: 9416
  chr8:22613837-22613867
  hyper

SEQ ID NO: 52577 - DNA, 208 bp, Homo sapiens; identical to SEQ ID NO: 31816
  chr8:22722223-22722431
  hyper

SEQ ID NO: 52578 - DNA, 36 bp, Homo sapiens; identical to SEQ ID NO: 31817
  chr8:22723325-22723361
  hyper

SEQ ID NO: 52579 - DNA, 65 bp, Homo sapiens
  chr8:22960583-22960648
  hyper
ggccgaggcagggtgcgacccaggacccaggacggcgtcgggaaccataccatggcccggatccc

SEQ ID NO: 52580 - DNA, 123 bp, Homo sapiens
  chr8:22960723-22960846
  hyper
gaagagcgcacctggcgccgggagggggcagggagacggggacacggcagggatgcctggccctggtcacctgcggccgggcatgtccgggcaggacgaactcgccgtcggagtcaggggaag

SEQ ID NO: 52581 - DNA, 323 bp, Homo sapiens; identical to SEQ ID NO: 31819
  chr8:23021267-23021590
  hyper

SEQ ID NO: 52582 - DNA, 134 bp, Homo sapiens
  chr8:23260870-23261004
  hyper
aggactcacggcgctcccgcgctcccaacagcctttcgagcaggctgggggttgaaccgggttcaagcagtggacgctacagctcccgggcgcagcccccggggtccccgcccccactccgtcccagcccagca

SEQ ID NO: 52583 - DNA, 415 bp, Homo sapiens; identical to SEQ ID NO: 31821
  chr8:23261393-23261808
  hyper

SEQ ID NO: 52584 - DNA, 378 bp, Homo sapiens
  chr8:23560525-23560903
  hyper
ctgttgccaacgccgcgctctggcaccctggtcccgccgccgaggggcgaggccgcgttcaggccgggctctaaaagcacaggaagggacacatcagcgcccagcctaaggctcacctgagcggttcctacttagttttcaagactttcctctccctggcagccttcactctgcgcaggctcctcctccctcctactgcccccgaaccctgtcccaggacgaaccctgtcccaggactgtctccatgttttttccctccaagctctgtcacctttatatgttactgctggaacataaattgtgacaacctatggtccctcgtgtgtgcgtccttttcctaaaggtagactctagataaagagttaaggcagctccatt

SEQ ID NO: 52585 - DNA, 50 bp, Homo sapiens
  chr8:23565024-23565074
  hyper
tctcctttatcctccttaaagcggattgcctggagcgtgccagcttgtgt

SEQ ID NO: 52586 - DNA, 91 bp, Homo sapiens
  chr8:23567492-23567583
  hyper
tccctcctccctcctcctacttcagcgccagaagcattgaaagccgcccgcccgccgagagtggaaccggtacctcgaatctcgctcattc

SEQ ID NO: 52587 - DNA, 58 bp, Homo sapiens; identical to SEQ ID NO: 31830
  chr8:23567657-23567715
  hyper

SEQ ID NO: 52588 - DNA, 38 bp, Homo sapiens
  chr8:23571643-23571681
  hyper
attaaggatctgatacgatcttttcctaaattgctatg

SEQ ID NO: 52589 - DNA, 23 bp, Homo sapiens
  chr8:23571973-23571996
  hyper
cagaccgtcgggggctgactccg

SEQ ID NO: 52590 - DNA, 108 bp, Homo sapiens
  chr8:23572554-23572662
  hyper
acacacattgctgaccttgagggtcagacagaccctttctcgtctagtttttagcatcagatgtaacctcagcttgggcttctatgatctcatcgatgtccttttgag

SEQ ID NO: 52591 - DNA, 46 bp, Homo sapiens; identical to SEQ ID NO: 3213
  chr8:23583971-23584017
  hyper

SEQ ID NO: 52592 - DNA, 57 bp, Homo sapiens
  chr8:23584760-23584817
  hyper
gcccaccctgagcactttacctgcatggtggccaagacccttcgtccggaccctact

SEQ ID NO: 52593 - DNA, 41 bp, Homo sapiens; identical to SEQ ID NO: 31836
  chr8:23585244-23585285
  hyper

SEQ ID NO: 52594 - DNA, 21 bp, Homo sapiens
  chr8:24770293-24770314
  hyper
gggtgacaagccccccgggtg

SEQ ID NO: 52595 - DNA, 232 bp, Homo sapiens; identical to SEQ ID NO: 31839
  chr8:24770893-24771125
  hyper

SEQ ID NO: 52596 - DNA, 82 bp, Homo sapiens; identical to SEQ ID NO: 19977
  chr8:24771349-24771431
  hyper

SEQ ID NO: 52597 - DNA, 13 bp, Homo sapiens
  chr8:24771562-24771575
  hyper
gcggctccggacc

SEQ ID NO: 52598 - DNA, 41 bp, Homo sapiens; identical to SEQ ID NO: 31841
  chr8:24799514-24799555
  hyper

SEQ ID NO: 52599 - DNA, 48 bp, Homo sapiens
  chr8:24813140-24813188
  hyper
cgtcggtgttcttggcggcgctctcggtcagcacggtgaagcggctct

SEQ ID NO: 52600 - DNA, 177 bp, Homo sapiens; identical to SEQ ID NO: 19978
  chr8:24813287-24813464
  hyper

SEQ ID NO: 52601 - DNA, 132 bp, Homo sapiens; identical to SEQ ID NO: 19979
  chr8:24813618-24813750
  hyper

SEQ ID NO: 52602 - DNA, 21 bp, Homo sapiens
  chr8:24814407-24814428
  hyper
agaccccgtgacacttggatc

SEQ ID NO: 52603 - DNA, 353 bp, Homo sapiens; identical to SEQ ID NO: 31845
  chr8:24815060-24815413
  hyper

SEQ ID NO: 52604 - DNA, 16 bp, Homo sapiens
  chr8:24816379-24816395
  hyper
gcggctcctccctgaa

SEQ ID NO: 52605 - DNA, 15 bp, Homo sapiens
  chr8:24816694-24816709
  hyper
cgaatccagccgggg

SEQ ID NO: 52606 - DNA, 345 bp, Homo sapiens
  chr8:24857431-24857776
  hyper
cgagaaacagctacacgtctccagggcctttcttctggaaaaacttttctggtcccctcttccctgaactggtgcaggcgtgcaaagaaagctccgtgccacgcccggcagcctccattctttggtagaacgcagcgcagcaatagccgccaagtcccctcctgggtacagtacagctccacagcgcccctgctggtggcttgggaagggcgcgcaagcagagaaagcaagtgtcagagccgggactggcctcccagggcatcgcctacagcttgtgctctgagagtcggggtcatcatagctgcgctcttcgatggacactaaatgcgggacatctgttttaca

SEQ ID NO: 52607 - DNA, 232 bp, Homo sapiens; identical to SEQ ID NO: 19983
  chr8:24857808-24858040
  hyper

SEQ ID NO: 52608 - DNA, 50 bp, Homo sapiens
  chr8:24858286-24858336
  hyper
ctgctgagtcactcccgcctgagccacggccgcccccagccagccacgcg

SEQ ID NO: 52609 - DNA, 416 bp, Homo sapiens
  chr8:24858440-24858856
  hyper
tggtaggaaccccctaaaaatgcgccccacttgtgcattcgtgcatgggcgcattttgggagtaaacaatacataaccttcttcgcattcaaagggtctggactcaaaagagggctcagccttgctcctcgggagcaacccctgttttaaatctgggaaatggtgatgccagtggggaaagggcttctccgggcccggggctcccgagctcctggtgccagccgtgttgctctggcttttgtattttaactccgtgggcttctgtccccatccccatgtaaggccagtgcccccttccgcgttttgccgaaagtatcttcaatgcccgtttaaaaaactatgtctgcgatttctccatctctgctctttcccagttcctctcttttctcttcttcaggccccctcctgtccttcct

SEQ ID NO: 52610 - DNA, 335 bp, Homo sapiens
  chr8:24859161-24859496
  hyper
gtggagaagccagttcccaagtggctcgtcgcgggtgttagagtccctcgttactaaggacgccgccgcccgcgcgccaggcttggggaccagggtgactctgccctttctgggcggaatacgggtgaaggctgtctttggggatccacaggtgatctgtgccgttctcattgtattctcaactctcatcccttccaggttagcccgatccctttaatgcaaggatcggtgccgggaggaaagagagcgtgggccactctggaacggaggctggtgttttgggggagcggggagagcctgtagcccacacatctccacggctctggcccaatttc

SEQ ID NO: 52611 - DNA, 57 bp, Homo sapiens
  chr8:25041864-25041921
  hyper
gcccgcatccctcgcccaccggccgcccggcctgggcgtgcccggctcctccagcgc

SEQ ID NO: 52612 - DNA, 43 bp, Homo sapiens; identical to SEQ ID NO: 31851
  chr8:25042737-25042780
  hyper

SEQ ID NO: 52613 - DNA, 100 bp, Homo sapiens; identical to SEQ ID NO: 31852
  chr8:25899320-25899420
  hyper

SEQ ID NO: 52614 - DNA, 381 bp, Homo sapiens
  chr8:25901765-25902146
  hyper
gccggcctcccaggctccaggaatcgcccagcaagatgcgggaggtaggcgctcgcaggcggcgtggcgaagccaagagtggccaggaagccggctttcctcccgcgccgccactgccagcgccggtgttcacgctccgttcggggccaggccggctcggcttgcaggactaggggctgagctgggagatgttgggggctactttatttttccttgcaaagagtggactgtggtaaaggagagggagagaaacgcctacgacccaggcagttcaggaactcgagtgccggctgccgggtgagcgttcgcctgactgcagcgatctgcttgcccgagggcgagccccagcgcgcagggcctgggcgacagatggggggacag

SEQ ID NO: 52615 - DNA, 9 bp, Homo sapiens
  chr8:25902176-25902185
  hyper
gggtgcaca

SEQ ID NO: 52616 - DNA, 50 bp, Homo sapiens; identical to SEQ ID NO: 31857
  chr8:25902919-25902969
  hyper

SEQ ID NO: 52617 - DNA, 31 bp, Homo sapiens
  chr8:25903631-25903662
  hyper
gccggggagtattcccgcgggtcctccggtt

SEQ ID NO: 52618 - DNA, 12 bp, Homo sapiens
  chr8:25903854-25903866
  hyper
tgcctattaaac

SEQ ID NO: 52619 - DNA, 176 bp, Homo sapiens
  chr8:25904191-25904367
  hyper
agagtttgccgctagaggacacagcgccttgcaactggtttgcctaggctgacaggaagcttgcacttcaagaaaactcggctctctcgagaaagggaccggtgcgcgcctccacctccccaagggacaaaccgcggcaccacgctgcgtgcgcgggattgcgactaggaagtgct

SEQ ID NO: 52620 - DNA, 122 bp, Homo sapiens; identical to SEQ ID NO: 31860
  chr8:25904898-25905020
  hyper

SEQ ID NO: 52621 - DNA, 378 bp, Homo sapiens; identical to SEQ ID NO: 31861
  chr8:25905251-25905629
  hyper

SEQ ID NO: 52622 - DNA, 67 bp, Homo sapiens; identical to SEQ ID NO: 19989
  chr8:25905695-25905762
  hyper

SEQ ID NO: 52623 - DNA, 14 bp, Homo sapiens
  chr8:25905811-25905825
  hyper
ggccaactagctcg

SEQ ID NO: 52624 - DNA, 57 bp, Homo sapiens; identical to SEQ ID NO: 31863
  chr8:25907271-25907328
  hyper

SEQ ID NO: 52625 - DNA, 10 bp, Homo sapiens
  chr8:25908415-25908425
  hyper
gcaatcattt

SEQ ID NO: 52626 - DNA, 2 bp, Homo sapiens
  chr8:25909597-25909599
  hyper
ac

SEQ ID NO: 52627 - DNA, 47 bp, Homo sapiens; identical to SEQ ID NO: 31866
  chr8:25909600-25909647
  hyper

SEQ ID NO: 52628 - DNA, 36 bp, Homo sapiens; identical to SEQ ID NO: 31867
  chr8:26306055-26306091
  hyper

SEQ ID NO: 52629 - DNA, 145 bp, Homo sapiens; identical to SEQ ID NO: 31868
  chr8:26370760-26370905
  hyper

SEQ ID NO: 52630 - DNA, 102 bp, Homo sapiens
  chr8:26372761-26372863
  hyper
cccttgactcctgctcgcagcgtgagaagagccaggaaggctgtggagtcacccgaggaaaccgagacgctcctaaatagcctatgtggggaacaaagttcc

SEQ ID NO: 52631 - DNA, 27 bp, Homo sapiens
  chr8:26372893-26372920
  hyper
cgctccccaaaccgctatgtgggaggc

SEQ ID NO: 52632 - DNA, 74 bp, Homo sapiens; identical to SEQ ID NO: 31870
  chr8:26723005-26723079
  hyper

SEQ ID NO: 52633 - DNA, 264 bp, Homo sapiens; identical to SEQ ID NO: 31871
  chr8:26723320-26723584
  hyper

SEQ ID NO: 52634 - DNA, 400 bp, Homo sapiens
  chr8:26723585-26723985
  hyper
ttagaacaggttgcctcgcagtcacctggagggggcggcctgggagagggaacagctgcgacccagggacctcagggccaggaccacgagcacgctcactctcacgccggtggaattcgcactcgggtgtgcagagcgcaccggtctgtccaccagccaagctggcttgagagccaggtcccgagcgaagccgggagggacccgaagacagaaagcgacccaggtctgtccacgacgcctttccaagcctcactgttggccacccgaggggctccagctgccagccgtagcgggactggcgggggacggggtggggaggacgtccctctgcagagggagctttgcaagtgacagtcactgcggattttgcaggcgtaaacattaagccggcatgccagcg

SEQ ID NO: 52635 - DNA, 360 bp, Homo sapiens
  chr8:26724080-26724440
  hyper
ggacagcgcggcgtgaggaagtgcccaccttgccttctggggttgggccctgaggtgggacctcgggcaaagactcttgttaaaatcgcaagttggagacctcacaggtggtattaaaaacgtgccactgcagaaacccttttcctcctacctcgagggtgataaacacagggttaaaaagacacttgttcagtagaaggcaacttcgcagaagatgtaagggaatcgggggtggggtagaggggccggtataaaacctggtggaaaaagcgggaggcgctgggaaaagtgggggttccgtctcaccagacggcgggggaggtctgccctcacccactcggccctgcgggacgccggccc

SEQ ID NO: 52636 - DNA, 169 bp, Homo sapiens; identical to SEQ ID NO: 31873
  chr8:26724484-26724653
  hyper

SEQ ID NO: 52637 - DNA, 77 bp, Homo sapiens; identical to SEQ ID NO: 31874
  chr8:29209803-29209880
  hyper

SEQ ID NO: 52638 - DNA, 33 bp, Homo sapiens; identical to SEQ ID NO: 31875
  chr8:29387334-29387367
  hyper

SEQ ID NO: 52639 - DNA, 30 bp, Homo sapiens; identical to SEQ ID NO: 31876
  chr8:29387658-29387688
  hyper

SEQ ID NO: 52640 - DNA, 81 bp, Homo sapiens
  chr8:30769168-30769249
  hyper
aaacttgaagggaaccgtggtatcttcaaagtctccgagttgccagcgacctcagcctctccactttctcgaacatcatcc

SEQ ID NO: 52641 - DNA, 329 bp, Homo sapiens
  chr8:30769411-30769740
  hyper
agtctcttcctgcacccgcaccacgccgggacccgaggggtttcactcccttcactgagccgagccaggaagccaagagccaccagggcgaagcagccctgcaaaacctccactcagccttacaacagccacagcgccgggacacgcggcaccgcatcccgggcgcgccagtcctcctgcagtcgggggacgctcccctcaggcgcccgcgtcggagcccagctacccccgcgccgccctcacctaccgaggctcccccgcgtccaccggctcctgcagcgagacagccggcgcaggcgggcatggtccgagcgcgggctctgcagggg

SEQ ID NO: 52642 - DNA, 59 bp, Homo sapiens; identical to SEQ ID NO: 31879
  chr8:30769987-30770046
  hyper

SEQ ID NO: 52643 - DNA, 129 bp, Homo sapiens; identical to SEQ ID NO: 31880
  chr8:30890252-30890381
  hyper

SEQ ID NO: 52644 - DNA, 48 bp, Homo sapiens
  chr8:31496433-31496481
  hyper
cagtaaaagaaaaggcgggggtcatgaagaccgaaggatcaaaggagc

SEQ ID NO: 52645 - DNA, 87 bp, Homo sapiens
  chr8:31496757-31496844
  hyper
cccagtaagcctccgcagcccactcggactgcagcctgtttgccgcccgtcctcccattgcagcactcggggcgacagagagggagg

SEQ ID NO: 52646 - DNA, 51 bp, Homo sapiens
  chr8:31497448-31497499
  hyper
gagccgggcagagtccgaaccgacagccagaagcccgcacgcacctcgcac

SEQ ID NO: 52647 - DNA, 322 bp, Homo sapiens
  chr8:31497639-31497961
  hyper
gggcggcggccggcaacgaggcggctcccgcgggggcctcggtgtgctactcgtccccgcccagcgtgggatcggtgcaggagctagctcagcgcgccgcggtggtgatcgagggaaaggtgcacccgcagcggcggcagcagggggcactcgacaggaaggcggcggcggcggcgggcgaggcaggggcgtggggcggcgatcgcgagccgccagccgcgggcccacgggcgctggggccgcccgccgaggagccgctgctcgccgccaacgggaccgtgccctcttggcccaccgccccggtgcccagcgccggcgagcc

SEQ ID NO: 52648 - DNA, 158 bp, Homo sapiens; identical to SEQ ID NO: 31883
  chr8:32404798-32404956
  hyper

SEQ ID NO: 52649 - DNA, 60 bp, Homo sapiens; identical to SEQ ID NO: 31884
  chr8:32405453-32405513
  hyper

SEQ ID NO: 52650 - DNA, 30 bp, Homo sapiens; identical to SEQ ID NO: 31885
  chr8:32405729-32405759
  hyper

SEQ ID NO: 52651 - DNA, 217 bp, Homo sapiens; identical to SEQ ID NO: 31886
  chr8:32406020-32406237
  hyper

SEQ ID NO: 52652 - DNA, 89 bp, Homo sapiens
  chr8:32406509-32406598
  hyper
cgccgctcacctgggcgccgagtcctaccgggcgcctacgcccagagctcagggcaagggacagcagtcccggccgcaccctcccagag

SEQ ID NO: 52653 - DNA, 14 bp, Homo sapiens
  chr8:32406914-32406928
  hyper
cagtcctgtgctac

SEQ ID NO: 52654 - DNA, 53 bp, Homo sapiens; identical to SEQ ID NO: 9466
  chr8:32406929-32406982
  hyper

SEQ ID NO: 52655 - DNA, 213 bp, Homo sapiens; identical to SEQ ID NO: 31889
  chr8:33371806-33372019
  hyper

SEQ ID NO: 52656 - DNA, 35 bp, Homo sapiens
  chr8:33457107-33457142
  hyper
tcgcccctagctgggcgcctctccccagcgtggag

SEQ ID NO: 52657 - DNA, 30 bp, Homo sapiens; identical to SEQ ID NO: 31891
  chr8:35092643-35092673
  hyper

SEQ ID NO: 52658 - DNA, 106 bp, Homo sapiens
  chr8:35093054-35093160
  hyper
actccggcatccgcgctggcggcagcggtcgccgcgccgtgggaagctatggggacgcgccctttctcggggtgcccattcagcggcggctcggagctccctgccc

SEQ ID NO: 52659 - DNA, 79 bp, Homo sapiens; identical to SEQ ID NO: 31893
  chr8:35093225-35093304
  hyper

SEQ ID NO: 52660 - DNA, 278 bp, Homo sapiens; identical to SEQ ID NO: 31895
  chr8:37552317-37552595
  hyper

SEQ ID NO: 52661 - DNA, 63 bp, Homo sapiens; identical to SEQ ID NO: 31896
  chr8:37655313-37655376
  hyper

SEQ ID NO: 52662 - DNA, 293 bp, Homo sapiens
  chr8:37655517-37655810
  hyper
ggccttgtcccttcaattggggtcatcccatccttgccccctggcctgccagcgccgcttccagccggtctccttagggcaaggggaggctgggctcagaaaagtcggcccttggaataccggcgctcctgggctgcaggagaccctggcgtccccatccctctagaggcccctctcccacggcgccgtttgtgcagtgagctctgtgctgggtcccgcgtccttgcctctcctttgcctctcctggaagtaactcgagctttggctgtttctccattgacttcgcgcaaaga

SEQ ID NO: 52663 - DNA, 133 bp, Homo sapiens
  chr8:37656081-37656214
  hyper
cgggcccccgcggccgccgcttcctttcctgtcccaaatccagcctaagagccgcttccctttccctgtcctcctgaccccagtggcaaccgtttctccaccgccccttgcccgcagtcggggctggcccagt

SEQ ID NO: 52664 - DNA, 79 bp, Homo sapiens
  chr8:37822717-37822796
  hyper
gacccacggacacatcgcatgcttcccgaccctgagccgccggtccctctgccccggttacctacccgtcgagccgttg

SEQ ID NO: 52665 - DNA, 52 bp, Homo sapiens
  chr8:37823423-37823475
  hyper
gcgctgcgcctcggcgtcggcccctacgcgccaccactggctcatgatgggc

SEQ ID NO: 52666 - DNA, 56 bp, Homo sapiens; identical to SEQ ID NO: 31901
  chr8:37823476-37823532
  hyper

SEQ ID NO: 52667 - DNA, 25 bp, Homo sapiens
  chr8:38008209-38008234
  hyper
ggcctgagcctcatccgctgagagc

SEQ ID NO: 52668 - DNA, 41 bp, Homo sapiens; identical to SEQ ID NO: 20009
  chr8:38008557-38008598
  hyper

SEQ ID NO: 52669 - DNA, 328 bp, Homo sapiens; identical to SEQ ID NO: 31903
  chr8:38323407-38323735
  hyper

SEQ ID NO: 52670 - DNA, 156 bp, Homo sapiens
  chr8:38323755-38323911
  hyper
cgcaccgggcttgctccgggaggggcgcgtgacgccaccgcggggcagccgagaggggaccgcgggctccgggcagggcaggcgctcccgcagctccagctataacacaagggagagaaagcaacgctttggttccagaaacttccatcgtcaagg

SEQ ID NO: 52671 - DNA, 214 bp, Homo sapiens; identical to SEQ ID NO: 20012
  chr8:38323941-38324155
  hyper

SEQ ID NO: 52672 - DNA, 61 bp, Homo sapiens; identical to SEQ ID NO: 31905
  chr8:38324661-38324722
  hyper

SEQ ID NO: 52673 - DNA, 279 bp, Homo sapiens; identical to SEQ ID NO: 31906
  chr8:38325771-38326050
  hyper

SEQ ID NO: 52674 - DNA, 33 bp, Homo sapiens; identical to SEQ ID NO: 31907
  chr8:38326276-38326309
  hyper

SEQ ID NO: 52675 - DNA, 45 bp, Homo sapiens; identical to SEQ ID NO: 31908
  chr8:38614816-38614861
  hyper

SEQ ID NO: 52676 - DNA, 229 bp, Homo sapiens; identical to SEQ ID NO: 20013
  chr8:41166745-41166974
  hyper

SEQ ID NO: 52677 - DNA, 322 bp, Homo sapiens
  chr8:41167035-41167357
  hyper
atcagctcccggcggggcgagccgcactcgttaccacgtccgtcaccggcgcgggagccaatcgcctccctcgcgagcgggttcggtttactagaaccagacgcggctcaacaccccttaaaaaacaaaaccaaaaatacataaataaaagggggaggaggaaagagacaaggggagaaaaagaaggggaatggatcacggcgtggggtggagagagaccagggcggacgctgtaattaactcgcattggcttgcagagaagcggggagcctggatcatacttgcaaacccatgaaattatgaagactttttttttttgaga

SEQ ID NO: 52678 - DNA, 91 bp, Homo sapiens
  chr8:41424669-41424760
  hyper
ctacctctgctgcagcgtacctcttccgcagccctagcggcctccccgaggggcgccgcggcctcggctgtccctcccctgcctggcacga

SEQ ID NO: 52679 - DNA, 24 bp, Homo sapiens
  chr8:41424842-41424866
  hyper
aagccactgcgggcacagcctgaa

SEQ ID NO: 52680 - DNA, 467 bp, Homo sapiens; identical to SEQ ID NO: 31915
  chr8:41503858-41504325
  hyper

SEQ ID NO: 52681 - DNA, 55 bp, Homo sapiens; identical to SEQ ID NO: 31916
  chr8:41511052-41511107
  hyper

SEQ ID NO: 52682 - DNA, 84 bp, Homo sapiens; identical to SEQ ID NO: 31917
  chr8:41511147-41511231
  hyper

SEQ ID NO: 52683 - DNA, 63 bp, Homo sapiens; identical to SEQ ID NO: 31918
  chr8:41511489-41511552
  hyper

SEQ ID NO: 52684 - DNA, 15 bp, Homo sapiens
  chr8:41624546-41624561
  hyper
gcggctccacgctcc

SEQ ID NO: 52685 - DNA, 193 bp, Homo sapiens
  chr8:41624633-41624826
  hyper
cgcagccttcaggccagaggaattttcctctggatcctgctagaagcctcggcagcagaagggcagccccagcgcgcgcacccgcacccgccggggaaagttggcgccgggcagccgggcgcggagccacaacccgcaggacggacgcagagccccggccccggccccggccccgatccccgcgccccggccc

SEQ ID NO: 52686 - DNA, 229 bp, Homo sapiens
  chr8:41624855-41625084
  hyper
tcaccgcagggtctggcccggacctgccctgtcgcgctgccatcgtccggcgcccgcgctgaaatccgagcccggctcccgctccccctcccggttatctgctgggcggcgcggggagcgccagcaagttacgcggcatctggctaaaaatacaggcgccctccactcgccccggcccggccctggccctgcgctctcccgcccgccagcctgccgctaatgggatctc

SEQ ID NO: 52687 - DNA, 30 bp, Homo sapiens; identical to SEQ ID NO: 31921
  chr8:41625311-41625341
  hyper

SEQ ID NO: 52688 - DNA, 30 bp, Homo sapiens; identical to SEQ ID NO: 31922
  chr8:41655464-41655494
  hyper

SEQ ID NO: 52689 - DNA, 144 bp, Homo sapiens; identical to SEQ ID NO: 9488
  chr8:41686308-41686452
  hyper

SEQ ID NO: 52690 - DNA, 90 bp, Homo sapiens
  chr8:41733415-41733505
  hyper
ttgccttcatttctccggctgcatccgaggctccccagaggggccggcgcgcgcccgggcgcacactcgcacacctgcccgcgcgcacac

SEQ ID NO: 52691 - DNA, 14 bp, Homo sapiens
  chr8:41733640-41733654
  hyper
agagctcggagcgg

SEQ ID NO: 52692 - DNA, 92 bp, Homo sapiens; identical to SEQ ID NO: 9490
  chr8:41733684-41733776
  hyper

SEQ ID NO: 52693 - DNA, 268 bp, Homo sapiens; identical to SEQ ID NO: 20023
  chr8:41753325-41753593
  hyper

SEQ ID NO: 52694 - DNA, 382 bp, Homo sapiens; identical to SEQ ID NO: 20024
  chr8:41753770-41754152
  hyper

SEQ ID NO: 52695 - DNA, 293 bp, Homo sapiens; identical to SEQ ID NO: 20025
  chr8:41754885-41755178
  hyper

SEQ ID NO: 52696 - DNA, 30 bp, Homo sapiens; identical to SEQ ID NO: 31929
  chr8:41755524-41755554
  hyper

SEQ ID NO: 52697 - DNA, 129 bp, Homo sapiens; identical to SEQ ID NO: 31930
  chr8:42009878-42010007
  hyper

SEQ ID NO: 52698 - DNA, 88 bp, Homo sapiens; identical to SEQ ID NO: 31931
  chr8:43102486-43102574
  hyper

SEQ ID NO: 52699 - DNA, 254 bp, Homo sapiens
  chr8:48100443-48100697
  hyper
ccagaagcctccatctcccgggagccgccatcgctgggagccgccacctccaggagccgccacggccaccgggagccgtcaccgcagggaacctccatctcctggagccaccaccgctgggagctgccacctcaggagcagcggcagcactgggacccgccgggccccctcgcacccagcggctctgcaggtgccctacacccgggaggggccgagggagcccacgccgccggcgggaccgcagggatttgctg

SEQ ID NO: 52700 - DNA, 498 bp, Homo sapiens
  chr8:49292866-49293364
  hyper
aaaggttgacaagagcggggctgggctccggcatgggcgcaaaaacaccagtgcggaggagttctcgggaccccccggggctgcggggccttgcggggacagccccaggcccggagctgcagaaacacccagaccccgcgcctcccggaaccacgcgtctctgtgcacagacattcctgggggcaggctcctgtcctttaacacagtctcaaaggagtcttcaaaaacaaaaagtttacaagcactgatagggaaaacagaaggatgataacaccaagagggactttcccgggagaggacggcttccagggactgagaaaggatgggcaagtgggcggggcccggcgccgtgcgggcagggctggcgccgggagtccccagactcccccgcagtgggaagcacctctcccattcacgccgggcaggacacctggccgggcgggggaggcagcgcaagggccggccggggagtacgggactcgagccggggacctgagg

SEQ ID NO: 52701 - DNA, 3 bp, Homo sapiens
  chr8:49293614-49293617
  hyper
atc

SEQ ID NO: 52702 - DNA, 99 bp, Homo sapiens; identical to SEQ ID NO: 31935
  chr8:49309361-49309460
  hyper

SEQ ID NO: 52703 - DNA, 1 bp, Homo sapiens
  chr8:49468668-49468669
  hyper
t

SEQ ID NO: 52704 - DNA, 64 bp, Homo sapiens; identical to SEQ ID NO: 20030
  chr8:49469127-49469191
  hyper

SEQ ID NO: 52705 - DNA, 36 bp, Homo sapiens; identical to SEQ ID NO: 31938
  chr8:49647817-49647853
  hyper

SEQ ID NO: 52706 - DNA, 189 bp, Homo sapiens; identical to SEQ ID NO: 9502
  chr8:49782697-49782886
  hyper

SEQ ID NO: 52707 - DNA, 119 bp, Homo sapiens
  chr8:49782922-49783041
  hyper
cgacgggcatcctgccctgcggaacacccacccgagccctgcgcgggaggggcggccgggaggcgcgcgggcatgcggaggggaaacagggctgcagcttcaagcccaggcaggacgcc

SEQ ID NO: 52708 - DNA, 185 bp, Homo sapiens; identical to SEQ ID NO: 31941
  chr8:49833801-49833986
  hyper

SEQ ID NO: 52709 - DNA, 49 bp, Homo sapiens; identical to SEQ ID NO: 31942
  chr8:49834319-49834368
  hyper

SEQ ID NO: 52710 - DNA, 88 bp, Homo sapiens; identical to SEQ ID NO: 31943
  chr8:49834627-49834715
  hyper

SEQ ID NO: 52711 - DNA, 113 bp, Homo sapiens
  chr8:50822066-50822179
  hyper
cataaccttaagcaacgttttcacatggactgaaaagcaaaagacccccttaaaaattagcctcaagcagcagatactctctttttaggtttgtgtgtctccgtgaggtcaga

SEQ ID NO: 52712 - DNA, 39 bp, Homo sapiens
  chr8:50822308-50822347
  hyper
acagcgaccgcggcctgcaatgtgcggagcacagcgcgg

SEQ ID NO: 52713 - DNA, 30 bp, Homo sapiens; identical to SEQ ID NO: 9506
  chr8:50822561-50822591
  hyper

SEQ ID NO: 52714 - DNA, 323 bp, Homo sapiens; identical to SEQ ID NO: 31946
  chr8:50822821-50823144
  hyper

SEQ ID NO: 52715 - DNA, 91 bp, Homo sapiens
  chr8:50823361-50823452
  hyper
aaaggcagagattgtcgagccctctgactgtctttgtgccttctttatcccgtcctttgtgaaataagccgttttctgcccccactgcagg

SEQ ID NO: 52716 - DNA, 174 bp, Homo sapiens; identical to SEQ ID NO: 31948
  chr8:50824134-50824308
  hyper

SEQ ID NO: 52717 - DNA, 20 bp, Homo sapiens
  chr8:50824352-50824372
  hyper
cgccacgggcagctgggcta

SEQ ID NO: 52718 - DNA, 49 bp, Homo sapiens; identical to SEQ ID NO: 9511
  chr8:53477121-53477170
  hyper

SEQ ID NO: 52719 - DNA, 64 bp, Homo sapiens
  chr8:53477944-53478008
  hyper
cgcgcctgcccttgtctacgtcccgggggtcggctggagctgcactgggactcggtcctcagtg

SEQ ID NO: 52720 - DNA, 5 bp, Homo sapiens
  chr8:53478449-53478454
  hyper
ggtgc

SEQ ID NO: 52721 - DNA, 25 bp, Homo sapiens
  chr8:53478455-53478480
  hyper
ctctgctgccgagcccctgctcgct

SEQ ID NO: 52722 - DNA, 48 bp, Homo sapiens; identical to SEQ ID NO: 31955
  chr8:53852136-53852184
  hyper

SEQ ID NO: 52723 - DNA, 67 bp, Homo sapiens
  chr8:53853744-53853811
  hyper
ggtattgctgggaaccgccccctccctgccctgctccctgctgccccacccgagccctggcagtctg

SEQ ID NO: 52724 - DNA, 30 bp, Homo sapiens; identical to SEQ ID NO: 31960
  chr8:54164557-54164587
  hyper

SEQ ID NO: 52725 - DNA, 39 bp, Homo sapiens; identical to SEQ ID NO: 31961
  chr8:54570523-54570562
  hyper

SEQ ID NO: 52726 - DNA, 179 bp, Homo sapiens
  chr8:54789099-54789278
  hyper
tgaagtgcagcccttcgggcagctgaaggtctttctgcagataacttttctcagatcgaattttttggctacattgatactcttcggctctgtccttgccagaagttcggaaggattccagcgccccacaccttgcttgattcaccctcatcccctcccctaactggagaagccgctgg

SEQ ID NO: 52727 - DNA, 66 bp, Homo sapiens
  chr8:54789566-54789632
  hyper
ggagaaaggaggttacgagttcgcacgttctcacaaaaccatttgaaaacatgagctggagacgcc

SEQ ID NO: 52728 - DNA, 214 bp, Homo sapiens; identical to SEQ ID NO: 20044
  chr8:54790077-54790291
  hyper

SEQ ID NO: 52729 - DNA, 15 bp, Homo sapiens
  chr8:54791767-54791782
  hyper
ggacaccacagtaac

SEQ ID NO: 52730 - DNA, 397 bp, Homo sapiens; identical to SEQ ID NO: 20045
  chr8:54792237-54792634
  hyper

SEQ ID NO: 52731 - DNA, 368 bp, Homo sapiens; identical to SEQ ID NO: 20046
  chr8:54792760-54793128
  hyper

SEQ ID NO: 52732 - DNA, 868 bp, Homo sapiens
  chr8:54793349-54794217
  hyper
ggtggagtgcgccgccgctggagggaggcgagacgtgggattgcccggccgggtaaaaggagtgagggggcggggaggaggcagagcaaggggaggaagaggccgggagaagagggctagagcaaagaccgagagccggagaaaggcgaaaggcgcggtgagcaatcgccgacgtagagagggcagccctccgcgctgcaatattgagaaggcacccgcgggacgcatgcgcacggcggacggaggcgagccggccggggcttcctccccggccggcagggtggacggtgggctcgtgagtatcccagttcctcgaactctctttcttcgtctcgggctcgccctgaggcttcgtgctggaaagtggccgaggctgggaggggcgcgccgctcgtccggacctcagggtgtcgccgttgctgcggggcgggagccggtgcgagtcgggggttccttcccgcagtgcgagtttgggggagtggggctgcgagtgcgtccgcgtgcgaagaggggcatcgcgccaccaggatcaatatgtcccgggcctgccagggcgtccgcgattccacctctgcggcttcgcgtcggtgtcttggtggggaacgcgggagtctagtctttagaccctagaaatcgcattgaccacccgaagcgtatttcggaaagaccaggcgggtggaagcgtcggctttctcacgggatagggagaggacaaggaaggggttgggcgcccggggctggtggtttgagcgccgctgggaagggtaaggagacagagcctcctggaatcgtagcgcctccttttaggagaagtgcaaccagggcaggggcaccgaggggcagggtgaggaagtggacgccccacgcg

SEQ ID NO: 52733 - DNA, 386 bp, Homo sapiens
  chr8:54794327-54794713
  hyper
agttaacgtgcaggcgccgccgggattttcctggaacaaacccgggcacttgatcttccgcaccctcggagctgccctgggaagtcgaaacaagtctgggcgcccggactgcggagactggaaagcagggggcggagggcgggagactgggggcgggaagtggaggtgcaggctgcagctggggaccgcggtgggcgttggaggggagggtctgtgtgcgcggctgtcctccagcgctgggggagcggacgggccaggggcctctagggaagcggcgctccgggaccggggtggctttcccgtctctgtgtgcgcggcgatccccacacccagctcgggcggaggagccctgagagaagcggctagctgagagtggggtgggcgtt

SEQ ID NO: 52734 - DNA, 52 bp, Homo sapiens
  chr8:55366136-55366188
  hyper
ctaagaaacactccacggatgagtttctgaagagggaagtggaccgggaaca

SEQ ID NO: 52735 - DNA, 175 bp, Homo sapiens
  chr8:55370858-55371033
  hyper
caccggccggggccgcgggccgagccaagggcgagtcccgtatccggcggccgatgaacgctttcatggtgtgggctaaggacgagcgcaagcggctggcgcagcagaatccagacctgcacaacgccgagttgagcaagatgctgggtgagtccgagtcgcagacccaggcggc

SEQ ID NO: 52736 - DNA, 6 bp, Homo sapiens
  chr8:55371172-55371178
  hyper
cgaccc

SEQ ID NO: 52737 - DNA, 29 bp, Homo sapiens
  chr8:55379202-55379231
  hyper
ctcttagcttggtgccggggcccgcccgg

SEQ ID NO: 52738 - DNA, 108 bp, Homo sapiens; identical to SEQ ID NO: 3262
  chr8:55380036-55380144
  hyper

SEQ ID NO: 52739 - DNA, 24 bp, Homo sapiens
  chr8:55380175-55380199
  hyper
cgtgtttagcgattctcatattta

SEQ ID NO: 52740 - DNA, 30 bp, Homo sapiens
  chr8:56014127-56014157
  hyper
gcctccgagcccgggcgcccgagttacacc

SEQ ID NO: 52741 - DNA, 247 bp, Homo sapiens; identical to SEQ ID NO: 20057
  chr8:56014376-56014623
  hyper

SEQ ID NO: 52742 - DNA, 4 bp, Homo sapiens
  chr8:56015034-56015038
  hyper
ggtg

SEQ ID NO: 52743 - DNA, 43 bp, Homo sapiens
  chr8:56015619-56015662
  hyper
attgcaagacggtggtcggcggtgggtctgcagccggggaagg

SEQ ID NO: 52744 - DNA, 50 bp, Homo sapiens; identical to SEQ ID NO: 31994
  chr8:56015749-56015799
  hyper

SEQ ID NO: 52745 - DNA, 30 bp, Homo sapiens; identical to SEQ ID NO: 31995
  chr8:56792024-56792054
  hyper

SEQ ID NO: 52746 - DNA, 22 bp, Homo sapiens
  chr8:57025598-57025620
  hyper
ccccaaggcgctgcccggggag

SEQ ID NO: 52747 - DNA, 225 bp, Homo sapiens
  chr8:57025943-57026168
  hyper
agtgcacaatgctttgcgagtggaggaagagcaggccgttcacaacatctagtgagtacttgagacactttcccaaacttaactgtcctccagtgcggcagtgaggctcccctgcgtccccctcagggtggccggcggcgccatagatgacttggtgtaaagtgacgttgccaccgaactccatgatgatggtccctaggctattggaccctgcgggcgtgcgcg

SEQ ID NO: 52748 - DNA, 109 bp, Homo sapiens; identical to SEQ ID NO: 20061
  chr8:57026213-57026322
  hyper

SEQ ID NO: 52749 - DNA, 2 bp, Homo sapiens
  chr8:57026501-57026503
  hyper
cg

SEQ ID NO: 52750 - DNA, 9 bp, Homo sapiens
  chr8:57026547-57026556
  hyper
ttgcagggg

SEQ ID NO: 52751 - DNA, 275 bp, Homo sapiens; identical to SEQ ID NO: 32002
  chr8:57232591-57232866
  hyper

SEQ ID NO: 52752 - DNA, 70 bp, Homo sapiens; identical to SEQ ID NO: 32003
  chr8:57358077-57358147
  hyper

SEQ ID NO: 52753 - DNA, 31 bp, Homo sapiens
  chr8:57359636-57359667
  hyper
ccccctcgcgggtccccgtgggcaccaagca

SEQ ID NO: 52754 - DNA, 30 bp, Homo sapiens; identical to SEQ ID NO: 20066
  chr8:57360540-57360570
  hyper

SEQ ID NO: 52755 - DNA, 15 bp, Homo sapiens
  chr8:57360791-57360806
  hyper
cggggcatcacggta

SEQ ID NO: 52756 - DNA, 270 bp, Homo sapiens; identical to SEQ ID NO: 32009
  chr8:58907149-58907419
  hyper

SEQ ID NO: 52757 - DNA, 215 bp, Homo sapiens; identical to SEQ ID NO: 20069
  chr8:58907483-58907698
  hyper

SEQ ID NO: 52758 - DNA, 106 bp, Homo sapiens; identical to SEQ ID NO: 20070
  chr8:58907835-58907941
  hyper

SEQ ID NO: 52759 - DNA, 561 bp, Homo sapiens; identical to SEQ ID NO: 32012
  chr8:60030202-60030763
  hyper

SEQ ID NO: 52760 - DNA, 144 bp, Homo sapiens; identical to SEQ ID NO: 32013
  chr8:60030764-60030908
  hyper

SEQ ID NO: 52761 - DNA, 548 bp, Homo sapiens; identical to SEQ ID NO: 32014
  chr8:60031146-60031694
  hyper

SEQ ID NO: 52762 - DNA, 125 bp, Homo sapiens; identical to SEQ ID NO: 32015
  chr8:60032140-60032265
  hyper

SEQ ID NO: 52763 - DNA, 190 bp, Homo sapiens; identical to SEQ ID NO: 20077
  chr8:60032490-60032680
  hyper

SEQ ID NO: 52764 - DNA, 21 bp, Homo sapiens
  chr8:60032738-60032759
  hyper
ggtttgcgaaggctgaggctg

SEQ ID NO: 52765 - DNA, 512 bp, Homo sapiens; identical to SEQ ID NO: 32017
  chr8:61193203-61193715
  hyper

SEQ ID NO: 52766 - DNA, 49 bp, Homo sapiens; identical to SEQ ID NO: 32018
  chr8:61193716-61193765
  hyper

SEQ ID NO: 52767 - DNA, 44 bp, Homo sapiens; identical to SEQ ID NO: 32019
  chr8:61573279-61573323
  hyper

SEQ ID NO: 52768 - DNA, 292 bp, Homo sapiens; identical to SEQ ID NO: 32020
  chr8:61822378-61822670
  hyper

SEQ ID NO: 52769 - DNA, 208 bp, Homo sapiens
  chr8:62200776-62200984
  hyper
ggcgtttcagcacttcggtatgtggacagctcccatctgcaatccctctgcactccatccctcccgcaccgcaccccgctccccgccgcctccgcggtccatcctcctcccggcgcccgctcagcctgcgcccccttacacatcagcacccccatctccaccatcaccgtcatcatagccaccatcaccagcgcggtaactatagtca

SEQ ID NO: 52770 - DNA, 793 bp, Homo sapiens; identical to SEQ ID NO: 32022
  chr8:63160462-63161255
  hyper

SEQ ID NO: 52771 - DNA, 27 bp, Homo sapiens
  chr8:63161631-63161658
  hyper
catgggctgctgcaccggacgctgctc

SEQ ID NO: 52772 - DNA, 89 bp, Homo sapiens
  chr8:63161800-63161889
  hyper
ctccgcccgcctcccaccctccccaccgcctggctgggctcgcactgctctccagccgcgggcactcgccaggtcgcccctgccctgca

SEQ ID NO: 52773 - DNA, 51 bp, Homo sapiens; identical to SEQ ID NO: 32024
  chr8:63998517-63998568
  hyper

SEQ ID NO: 52774 - DNA, 287 bp, Homo sapiens
  chr8:65281329-65281616
  hyper
ggggcctctggtcagcgctgattaataagtgttttttgttgtgaagtgttgaataatagaggatggccggtgacccagtaaggactaaaccttgcgctggtttattgtggcaagctgagaaaggggctttaggcccgggaccccaggcactgacccgcacacatcccgcggatcgcctattcattcgcacagccctccagtcgcccaggctcccattgtttgctgagcaacaatggagatttcgcagggaaagtaaagctcttttcagattcctctctgatgttttg

SEQ ID NO: 52775 - DNA, 17 bp, Homo sapiens
  chr8:65281760-65281777
  hyper
aaggagagccccagaga

SEQ ID NO: 52776 - DNA, 147 bp, Homo sapiens
  chr8:65281837-65281984
  hyper
tttagaggacgggagctgcctctagggagaaaggggaggggggaggggagaagaaaaaggaaagagcgcgtttcctcgccggggttaccggggtggcgcgggcttcgcggccgaggggctgccggcccggcccgcagctcctcgcgg

SEQ ID NO: 52777 - DNA, 312 bp, Homo sapiens
  chr8:65286370-65286682
  hyper
cgtcgcgagcatgcttgagagccgccggctcagctccgggctgtaaggttggttcctggcaatggatggaaatcaggtcacagagatccctaagcttgccaggctctcagacacgcttgggagacagaatggaattggaaggagggatctgaagaggagggaggggatccgtgttcccccaccccgggcctagaatggagccccggccagccgcgggccgggccccttggttttcaggacttattcttgccggggttggctcgcacgccagcatcgcgccttcggtgcgtcttttatctccatctcaaatat

SEQ ID NO: 52778 - DNA, 210 bp, Homo sapiens
  chr8:65286753-65286963
  hyper
aattgtggttctgagaaggtattttttggcctcttgaaaatgtgcaagaattccgcgggcccaggctttctttgtgtggcgggcagcgccaagcgctttgtgcttcacaaggagaaaatggcgagtcctattgtgtttaggccattttcttccggtactaggattttcccaagttcgaaatacttcttgagaaagtagccttctcgtgcc

SEQ ID NO: 52779 - DNA, 74 bp, Homo sapiens; identical to SEQ ID NO: 20086
  chr8:65289049-65289123
  hyper

SEQ ID NO: 52780 - DNA, 112 bp, Homo sapiens; identical to SEQ ID NO: 20087
  chr8:65289241-65289353
  hyper

SEQ ID NO: 52781 - DNA, 22 bp, Homo sapiens
  chr8:65289592-65289614
  hyper
gagaggctggaagctcgacgtc

SEQ ID NO: 52782 - DNA, 137 bp, Homo sapiens
  chr8:65290897-65291034
  hyper
cgctgccctgagcctaatccctcttccgggcccagacccgaggtccgcgctcctgggcagtggggaagctttagtgagcaggcttttctctccgcagcaaacttgtagccagaccagatgggccgcccagctctctc

SEQ ID NO: 52783 - DNA, 33 bp, Homo sapiens; identical to SEQ ID NO: 32034
  chr8:65291410-65291443
  hyper

SEQ ID NO: 52784 - DNA, 254 bp, Homo sapiens; identical to SEQ ID NO: 32035
  chr8:65291758-65292012
  hyper

SEQ ID NO: 52785 - DNA, 149 bp, Homo sapiens
  chr8:65292727-65292876
  hyper
gaagagtaggatattaggtaatttgaaaaataacatttaaaaagagaaaaaggtcacatacagcaaaacaatattttactgaaatcgttccctcaagctggttgctacccttgcctgacactttttggtcttcacgtaggaatgcacac

SEQ ID NO: 52786 - DNA, 15 bp, Homo sapiens
  chr8:65293179-65293194
  hyper
ccaggccttgcagcc

SEQ ID NO: 52787 - DNA, 108 bp, Homo sapiens; identical to SEQ ID NO: 32038
  chr8:65293265-65293373
  hyper

SEQ ID NO: 52788 - DNA, 54 bp, Homo sapiens
  chr8:65488217-65488271
  hyper
agtggggaaagaccacgcaggagccaggtgagaccctcgcggtgggctcgggga

SEQ ID NO: 52789 - DNA, 47 bp, Homo sapiens
  chr8:65488322-65488369
  hyper
gtcttcaaggtctgttcaaatttaggctaactcgtccccaaacagta

SEQ ID NO: 52790 - DNA, 43 bp, Homo sapiens; identical to SEQ ID NO: 32040
  chr8:65488704-65488747
  hyper

SEQ ID NO: 52791 - DNA, 16 bp, Homo sapiens
  chr8:65489049-65489065
  hyper
ggttggattcttcctc

SEQ ID NO: 52792 - DNA, 33 bp, Homo sapiens
  chr8:65489066-65489099
  hyper
gttggggaagcacagctggcggagaattcccac

SEQ ID NO: 52793 - DNA, 30 bp, Homo sapiens; identical to SEQ ID NO: 32043
  chr8:65490463-65490493
  hyper

SEQ ID NO: 52794 - DNA, 216 bp, Homo sapiens
  chr8:65492979-65493195
  hyper
ggtgaatccaagcaagataaacggtgcggagaggaggcgcggggctgggctcagagcggcggcggcggcggctccactccctccgcgcccaccctcccaccatgcggggccgcggcccatggtgagccccagcagccagcaccatcggctggagacgaagaagaagaagaagaggaggcggcgagcgcgggggaaggcgaaaaagaaaaagaaaga

SEQ ID NO: 52795 - DNA, 146 bp, Homo sapiens; identical to SEQ ID NO: 20090
  chr8:65493433-65493579
  hyper

SEQ ID NO: 52796 - DNA, 149 bp, Homo sapiens; identical to SEQ ID NO: 3283
  chr8:65493806-65493955
  hyper

SEQ ID NO: 52797 - DNA, 58 bp, Homo sapiens
  chr8:65494193-65494251
  hyper
atcgccacgctgctgctcgccaagaactacatcctcatgcaggcgcaggccctggagg

SEQ ID NO: 52798 - DNA, 87 bp, Homo sapiens; identical to SEQ ID NO: 32048
  chr8:65498465-65498552
  hyper

SEQ ID NO: 52799 - DNA, 18 bp, Homo sapiens
  chr8:65499739-65499757
  hyper
accaaatgacgtccacgc

SEQ ID NO: 52800 - DNA, 129 bp, Homo sapiens
  chr8:67024934-67025063
  hyper
ctgtctacagaaccccgggcttcagtggcgtcttcctaacccggcttgcctgccgggggcgttccgagaccctcggggccttcccttcaccccgcgggagttggaccggtggcgctggtaaggcctccc

SEQ ID NO: 52801 - DNA, 492 bp, Homo sapiens; identical to SEQ ID NO: 32052
  chr8:67089544-67090036
  hyper

SEQ ID NO: 52802 - DNA, 29 bp, Homo sapiens
  chr8:67344509-67344538
  hyper
agcagttaccttctacggcaatttcaagg

SEQ ID NO: 52803 - DNA, 15 bp, Homo sapiens
  chr8:67875682-67875697
  hyper
ctgtttttgtgtttg

SEQ ID NO: 52804 - DNA, 135 bp, Homo sapiens
  chr8:67940875-67941010
  hyper
ccccggtgggtccttcccctgtgaggcggcggccgggcgctgatgggcactgacggtggtcactaggccgactccgactagagtcctgttagcttgaagaggccgtgaggcatcggtcaccgcattgttttagtg

SEQ ID NO: 52805 - DNA, 33 bp, Homo sapiens; identical to SEQ ID NO: 20097
  chr8:68864545-68864578
  hyper

SEQ ID NO: 52806 - DNA, 86 bp, Homo sapiens
  chr8:68864765-68864851
  hyper
tgtcggtgagtgtccccggcagacgcagggggacgtccgggcggcgcggggcgcgggtcccggagtggctgcgggaaggacgcgcg

SEQ ID NO: 52807 - DNA, 42 bp, Homo sapiens; identical to SEQ ID NO: 32065
  chr8:68865398-68865440
  hyper

SEQ ID NO: 52808 - DNA, 10 bp, Homo sapiens
  chr8:69244500-69244510
  hyper
aggcccttgc

SEQ ID NO: 52809 - DNA, 125 bp, Homo sapiens; identical to SEQ ID NO: 9614
  chr8:69244511-69244636
  hyper

SEQ ID NO: 52810 - DNA, 84 bp, Homo sapiens; identical to SEQ ID NO: 32071
  chr8:70404780-70404864
  hyper

SEQ ID NO: 52811 - DNA, 49 bp, Homo sapiens; identical to SEQ ID NO: 32072
  chr8:70405100-70405149
  hyper

SEQ ID NO: 52812 - DNA, 21 bp, Homo sapiens
  chr8:70744839-70744860
  hyper
agcttctgcagtggccggcgc

SEQ ID NO: 52813 - DNA, 320 bp, Homo sapiens
  chr8:70744925-70745245
  hyper
tttgatagctgatggcacccaagcactccggcacgtttcatccaccggcacgaggggccgaagccgggcccagtcagtcttgcccacctgggactggggctgggggcgcagggccgcgcagcagggcatcctcaccagctgcgaggcgcccagtgcatcctgatcacagacacggcttcaaggctccgcagccgcgtgccacagggggcaggggtccgcgcggtactgcgatgagccctactcggcgtccctctccgggcggtagcttgaggcaggcgcctcgcgcgtcccgggctcatcccctccgccgccgccgccgc

SEQ ID NO: 52814 - DNA, 30 bp, Homo sapiens; identical to SEQ ID NO: 9617
  chr8:70945287-70945317
  hyper

SEQ ID NO: 52815 - DNA, 74 bp, Homo sapiens
  chr8:70946686-70946760
  hyper
tgaaaagagaaaacacgtagacataatctggatggcggagactgaagagtgattatctctaggtggctggatgc

SEQ ID NO: 52816 - DNA, 166 bp, Homo sapiens; identical to SEQ ID NO: 32077
  chr8:70981714-70981880
  hyper

SEQ ID NO: 52817 - DNA, 278 bp, Homo sapiens
  chr8:70983226-70983504
  hyper
ctcctccgacctcagggatctgcaacttgggattcaaagcccccgagagggcagaacgaccatccaaaacgaactgcgccagcgagtgctgccgccctccccaacggccctggaagaccaccgccccgggccccaggcgcgtcctgtcccgtgcctacctccgacaccacctccaagagcgccaccgcggagcgggcgcctcctggacgctgcggggccactcgggctcggtaggccactcgggctcggtagacttcgggcgggccctgagggctgag

SEQ ID NO: 52818 - DNA, 16 bp, Homo sapiens
  chr8:70984978-70984994
  hyper
tcgcctcttgtcccaa

SEQ ID NO: 52819 - DNA, 90 bp, Homo sapiens
  chr8:72273908-72273998
  hyper
tttaatgtgttccttcgaattttctgggttagcaaacctccattcctgacatagttttgctcctggatgggtacgcgcgggggctctcag

SEQ ID NO: 52820 - DNA, 101 bp, Homo sapiens; identical to SEQ ID NO: 20109
  chr8:72274033-72274134
  hyper

SEQ ID NO: 52821 - DNA, 103 bp, Homo sapiens; identical to SEQ ID NO: 32085
  chr8:72460433-72460536
  hyper

SEQ ID NO: 52822 - DNA, 192 bp, Homo sapiens; identical to SEQ ID NO: 32088
  chr8:72470594-72470786
  hyper

SEQ ID NO: 52823 - DNA, 30 bp, Homo sapiens; identical to SEQ ID NO: 32089
  chr8:72471116-72471146
  hyper

SEQ ID NO: 52824 - DNA, 212 bp, Homo sapiens
  chr8:72754609-72754821
  hyper
agagctagggcccgagggtggacctgcgtccgcgtctcgtcacgaaaggaagctctttttggagaggcaaaacgtggtcgcccagatccggcgcagctgtagccgtgggcgctgtgcagtgacagccacacccgccacctgtcacgatcacagttccagggaaaggggaagggtcaaggagaatccagcggaaacttcttcccatctcacga

SEQ ID NO: 52825 - DNA, 89 bp, Homo sapiens
  chr8:72755176-72755265
  hyper
ccgttcacgcttcttcctggactttgcccgcaggataatttggtgaaactcatctgactttgaggttctgtcgtttagttcccttcccc

SEQ ID NO: 52826 - DNA, 341 bp, Homo sapiens
  chr8:72755325-72755666
  hyper
ctccaagctccaagtaggaactgggcttggacaggatttttcccaagccgggagagctggcagatcagagagggactttccagataaatcccatctggggaaacgttactatcttccacaagcaatttttctaaaaatgcaaatgctcttttatagagctcggccttccctcctttaagaaagggcttgccgattcaaacctgcccgactcagctggattaagttgggcaagggagatttgccgtcagtctgcaacctggtggcagatggagatggaaccaagatttaccctggaagtaggatattagtcaatggctgtcactggggtacaatgttcagaa

SEQ ID NO: 52827 - DNA, 19 bp, Homo sapiens
  chr8:72756896-72756915
  hyper
ctttcggggagtgaagggg

SEQ ID NO: 52828 - DNA, 164 bp, Homo sapiens; identical to SEQ ID NO: 32097
  chr8:73163497-73163661
  hyper

SEQ ID NO: 52829 - DNA, 46 bp, Homo sapiens; identical to SEQ ID NO: 9640
  chr8:73448786-73448832
  hyper

SEQ ID NO: 52830 - DNA, 30 bp, Homo sapiens; identical to SEQ ID NO: 32100
  chr8:73449084-73449114
  hyper

SEQ ID NO: 52831 - DNA, 38 bp, Homo sapiens; identical to SEQ ID NO: 32101
  chr8:73449394-73449432
  hyper

SEQ ID NO: 52832 - DNA, 292 bp, Homo sapiens; identical to SEQ ID NO: 32102
  chr8:73449663-73449955
  hyper

SEQ ID NO: 52833 - DNA, 38 bp, Homo sapiens; identical to SEQ ID NO: 20116
  chr8:73450026-73450064
  hyper

SEQ ID NO: 52834 - DNA, 62 bp, Homo sapiens
  chr8:73450100-73450162
  hyper
gcggggtctgtgggagctaggtaagtggcgggggcattgctgctccccgaagggggtcttcc

SEQ ID NO: 52835 - DNA, 12 bp, Homo sapiens
  chr8:73450559-73450571
  hyper
ttcctgagaggg

SEQ ID NO: 52836 - DNA, 30 bp, Homo sapiens; identical to SEQ ID NO: 32105
  chr8:75232938-75232968
  hyper

SEQ ID NO: 52837 - DNA, 104 bp, Homo sapiens
  chr8:76316452-76316556
  hyper
tcgctttgggctgcgccagggagcaaaaaacctctgcttttttgaaagaggccggggcaacaaggtagagagccgcggccagaagcagccccgggccataaacc

SEQ ID NO: 52838 - DNA, 276 bp, Homo sapiens; identical to SEQ ID NO: 32110
  chr8:76316614-76316890
  hyper

SEQ ID NO: 52839 - DNA, 146 bp, Homo sapiens
  chr8:77585073-77585219
  hyper
gccactctgctcttccgcccagcccactcctgcctgcagtgttgctgctgtcacgccagccggtgatttgataggcttgtcgggttgccatggtgttgacttcttgcctctgaggagctgcccaatgactggaggtctgggattaa

SEQ ID NO: 52840 - DNA, 142 bp, Homo sapiens
  chr8:77585698-77585840
  hyper
agaaaatagttgccttggacggaggctggcggggcggggggagcgggggcggggaagtcagagagtgcatgtgcaatgcacaaccccagacggaaattgtaaactaggaaatgaaagggaaagaaaccgcttctgttataaa

SEQ ID NO: 52841 - DNA, 75 bp, Homo sapiens
  chr8:77586100-77586175
  hyper
aggaaagaaatagtccgcgattcacccaagggactgggagattcagagagattccaggagaaggaaaggaacata

SEQ ID NO: 52842 - DNA, 285 bp, Homo sapiens
  chr8:77586278-77586563
  hyper
acagtcaattggaaggagcccgagtcagggagcaattgctaggacttcggacagagagggcagaagattgtgtagacaggcggtcaaccagagcagcgcggggcaggacccacgagcgcgaagccaggtgccgcgcggtccgcgccccggctccgggcgacgcagggactttgctggcaatgagaaggctgctcgaccagcctgccggagtcacgattccccgcgagtcccaaacacacgcttcactaactactttacagccacttccattgattttctttaaca

SEQ ID NO: 52843 - DNA, 141 bp, Homo sapiens
  chr8:77590098-77590239
  hyper
tctagggaaagttctcggagcggcagggaaacctctactcctttcactttgaaataaaaagtggcccaacgttccgtgagggcggcggcgggttcgcgcagagtttagggacagtggaatgggggtggggcagggagtggg

SEQ ID NO: 52844 - DNA, 66 bp, Homo sapiens; identical to SEQ ID NO: 20120
  chr8:77590466-77590532
  hyper

SEQ ID NO: 52845 - DNA, 359 bp, Homo sapiens
  chr8:77593376-77593735
  hyper
ggggaatgttgatcacctcactaattacacctctctctcccccctctccctctccctctccctcgctctcctctctcattcccagagtgcatatcgggaatagacacacaaagacatgcgcactcaacttaatcagccatttttttaaacagggctaaaacgataataattagcagaataaagacatatcggattttcatttcctttcctccttttcccaaccccttcacaaccaaacagcgagaccgcggtcggcacatgctttaactcctcccggacccccgaggaccgctccatgccccccactttctgctccagcgtttttattttcacccaataaagttcgaggattatttttt

SEQ ID NO: 52846 - DNA, 471 bp, Homo sapiens
  chr8:77594124-77594595
  hyper
ggggcactgagggacctgattttccactttctttaggggggctgcgtttttccggatttaacttttggattaagtggcggaggatcatctacgtttgcttgggcagttttctctccttttccctgtcttttcgggttttgccttccccgcgagccccgggcattctagtggctgggggaagctgtcagctccgcaacggcgcgggcactgccaggggtctccgctcgccccgcgcccctgcaccccgatcgggatgactggtcctccgcactcatcctctgaaagtttggacgttggtcggtggggctgggagcccctctctccctgctctttccctgctttaccctccaccccccaccccaccttattcagcctcgtttttcttcctccttttaccacccgcccctcttccccttctcaagttccccgaaggtcgcttagtgtgcggggctggcggaggcccgggggttc

SEQ ID NO: 52847 - DNA, 52 bp, Homo sapiens
  chr8:77594596-77594648
  hyper
tgagctctggggaggggattccaagaggctggggtgaacgctggggctgggg

SEQ ID NO: 52848 - DNA, 150 bp, Homo sapiens
  chr8:77595189-77595339
  hyper
ataaagtttctctgccgatgtccaagttacagaaggttccctattctaatccccttcccctagaagacggtgcactggtttctatttcttttgttacctgtgatccgggcggggggctcctttcggccgctcgggctggggtccggccca

SEQ ID NO: 52849 - DNA, 8 bp, Homo sapiens
  chr8:79428289-79428297
  hyper
aacagtcc

SEQ ID NO: 52850 - DNA, 546 bp, Homo sapiens
  chr8:79428401-79428947
  hyper
aaaagcattaatagaaaatcaatccacaacctcgcggggcagcgatcgtcgagcgccgtttccaggctgccttccctggggtcgggagcggccccgctccccccgtggctggcgcggaatgtggtgatccgtcccggggcggggatgacttcatgcagccggagctccgcggcgggagcggaggctgctgctggcaggtggggcgcgggccggcgcgagctgaccgagcactcggcgggcgcggcgggactgcggcccgtggcggcgtgcgcggggacctgcgctgactaggtccggggaaggtaagcagcccggcaccggtgcgccctggccgcactgcgtggagctttccgcttggttaataatggggtttgcagcacggagggaagaaggggagaaccccgctgcattctgcaatgagaaaaggagcaacaactaggatggaaatgttgggcggccaagtgcagaggttggaggagcagtgttactgggcaaacaaagaaggcgttcttgcctctatactcttttgaacgtgatctaccattt

SEQ ID NO: 52851 - DNA, 94 bp, Homo sapiens
  chr8:80523889-80523983
  hyper
attgcaaagtcaaagcggtcccatcccgctgtttgaaagatgggtggagacggggggaggggatggagagaactgggcacattttacggtattg

SEQ ID NO: 52852 - DNA, 224 bp, Homo sapiens; identical to SEQ ID NO: 20125
  chr8:80524029-80524253
  hyper

SEQ ID NO: 52853 - DNA, 149 bp, Homo sapiens
  chr8:80524318-80524467
  hyper
tgctgcatcttcattcgaaagggggtcgggtggggagcgcagcgtgacacccaggagcccaaccctgcggggacagcggcgccacgccccgcgctccccgctcccgactccccgccgcggcttccaagagagacctgaccactgacccc

SEQ ID NO: 52854 - DNA, 13 bp, Homo sapiens
  chr8:80524468-80524481
  hyper
ccctccccacgct

SEQ ID NO: 52855 - DNA, 101 bp, Homo sapiens; identical to SEQ ID NO: 20127
  chr8:80524845-80524946
  hyper

SEQ ID NO: 52856 - DNA, 584 bp, Homo sapiens
  chr8:80525020-80525604
  hyper
tccccgcggagccggggagacctcaggctccgagactggcggggaagaggaatatgggaggggcagttgagctgtatgcagtcctggaacctcttttttcagccccgcagtccacaacggcccgagcaccccttgatgtgcgcagacccccggcgtggctctcagccccagcaccgagcccctcccagccaagcgggtggctctgcagaaaagctggctcgagccccgcccggccacacaaaggcgcggccccacccagcccgggcgcgagaccgcagaggtgacccccttcccagggattcagggagggctgtctcttctcgcccacccacggtccgcggagctcggggctttttttcccccagcccaagccccccgcccaccctctgttctctatgattttccagaatggagaccccgcgaggggcttctctaagggagaccctcgctcctccagcggggcgcggctcggccccacccctcccagctgaggcccagagccgcctaccgctggccgggtgggggcgcacgtggcgactgggtgtgtggagcgcagccagccctgcagagccccgcgccgcgcc

SEQ ID NO: 52857 - DNA, 40 bp, Homo sapiens
  chr8:80525733-80525773
  hyper
tgagaatgggtggtgggggcgatctcgcctcgctttctgc

SEQ ID NO: 52858 - DNA, 125 bp, Homo sapiens
  chr8:80803548-80803673
  hyper
gacagaaaaccgagccctatttgttattagtatttttttttttatactctcaaatgccaccggcacattcttttaaaaaaaaatgaaaggaaagaaagaaagaaaaagaaaataagagaggaaaa

SEQ ID NO: 52859 - DNA, 21 bp, Homo sapiens
  chr8:80803872-80803893
  hyper
gaaggccgccccccgctccac

SEQ ID NO: 52860 - DNA, 101 bp, Homo sapiens; identical to SEQ ID NO: 32125
  chr8:81400332-81400433
  hyper

SEQ ID NO: 52861 - DNA, 44 bp, Homo sapiens
  chr8:81478141-81478185
  hyper
ctgcgtgggtgttctcgtctttcctcctatcgtatgttacggtt

SEQ ID NO: 52862 - DNA, 115 bp, Homo sapiens
  chr8:81478350-81478465
  hyper
cacaaataccagggcacccatgtttctgccctgggaaactctcacgtcagccggccccccaattctgctaaaggagaaaacaaaatttccctcccatggacgcagctgggcactt

SEQ ID NO: 52863 - DNA, 672 bp, Homo sapiens; identical to SEQ ID NO: 32127
  chr8:82192624-82193296
  hyper

SEQ ID NO: 52864 - DNA, 165 bp, Homo sapiens; identical to SEQ ID NO: 32128
  chr8:82193521-82193686
  hyper

SEQ ID NO: 52865 - DNA, 42 bp, Homo sapiens; identical to SEQ ID NO: 32129
  chr8:85094795-85094837
  hyper

SEQ ID NO: 52866 - DNA, 175 bp, Homo sapiens
  chr8:85095307-85095482
  hyper
cacacactcccaatgcgaggcggcggcggcagcaacagaggcagcagcagcaatcgcggcagcagcggcagaggcggcggcagctgcgcgcctcgggcccaaccccgctcggctccccctctcgccggcgccctgcctgtcttgcgtgtgcgtgtgcgtgtgctcagcctcagcg

SEQ ID NO: 52867 - DNA, 11 bp, Homo sapiens
  chr8:85095668-85095679
  hyper
gcctgcaagtc

SEQ ID NO: 52868 - DNA, 117 bp, Homo sapiens; identical to SEQ ID NO: 32132
  chr8:85095999-85096116
  hyper

SEQ ID NO: 52869 - DNA, 151 bp, Homo sapiens; identical to SEQ ID NO: 32134
  chr8:85096852-85097003
  hyper

SEQ ID NO: 52870 - DNA, 53 bp, Homo sapiens; identical to SEQ ID NO: 32136
  chr8:87081803-87081856
  hyper

SEQ ID NO: 52871 - DNA, 347 bp, Homo sapiens
  chr8:89339042-89339389
  hyper
gtgaaaagcatggaccggctacaattgtgtctttgagcgcgcagcatcgtgctttgtgctgccggggataacggattctgggtctcacacgcatccgtcacctaaaacacccttaaactgaaccagggtctccacagctggaagggaaacaacgtgctgggacccaggctgctctgagctacaaggatcccaggagtgaaggaaatgtttcagggagcagcccaggcagcggggggaggaagaaagccctcgcactcttacctccacattgaaatactgctccgttccgcagactgtagcacataaaatccaaagcaaggtttgcaagaaaaacacccccgaatgat

SEQ ID NO: 52872 - DNA, 238 bp, Homo sapiens
  chr8:89339745-89339983
  hyper
cgccgccgccgccgccgcctccagcccgtgcgtcctcctcctgcactgcctactcctcctcctcctccgccgccgccgccgcccccagctcctgcgggaagggcctccgccgctcctcactctctcgcctctgcttctccttccctcctctcctcgctcccctccagaatgttcatccgtaatctacataactcctccttcccggggtctgcctggctctcggggcccttggcgcgcg

SEQ ID NO: 52873 - DNA, 10 bp, Homo sapiens
  chr8:89340043-89340053
  hyper
cacacacgcg

SEQ ID NO: 52874 - DNA, 156 bp, Homo sapiens; identical to SEQ ID NO: 32139
  chr8:89340081-89340237
  hyper

SEQ ID NO: 52875 - DNA, 639 bp, Homo sapiens
  chr8:89340345-89340984
  hyper
cctggggagcggcccaaccctggtcctggagagcggtcggcattcctgaggaagcggccctggaagaataggggcgctgggaatcagaggagcgcctggtcactgagcgcccctgggtggctcgggtcggtggccggggctgaccaagtttgggaagactgagatagcaaatcccgaacgtccaaaactttgttggggtcccgagcctgtggcctggtgtcttcctgaatcccctctaccatagctacattccgccttccaggcttgaggagtaggcacagggttttggtggcggactagacaaatacagaagcgggatgaaaacgctcactttccaagtgaacggtggacacacgcgcacagtgggacccgggagagatggtcctgggtgttaacaaaacatccgatgagagggatgggggcgctggaaagaaaccggctgcgggagccaggggaagggttggggaaagaaggagaagaagcagcctgaggaaaggcgagtaaagcagctggcaagggcgggaggaagaggctgctcgcagaccgagcgggggagaggctggcgggagctaggagagctgcaggcaagagggggaggcggctggcaagaagcacgggcgaacgcgggcagggaacttc

SEQ ID NO: 52876 - DNA, 32 bp, Homo sapiens; identical to SEQ ID NO: 9668
  chr8:91094254-91094286
  hyper

SEQ ID NO: 52877 - DNA, 33 bp, Homo sapiens; identical to SEQ ID NO: 32142
  chr8:91095051-91095084
  hyper

SEQ ID NO: 52878 - DNA, 15 bp, Homo sapiens
  chr8:91095141-91095156
  hyper
cggccccaagccggg

SEQ ID NO: 52879 - DNA, 59 bp, Homo sapiens; identical to SEQ ID NO: 20140
  chr8:91997947-91998006
  hyper

SEQ ID NO: 52880 - DNA, 179 bp, Homo sapiens
  chr8:93114528-93114707
  hyper
aagcaaacccccaccctagttgcagccgggtcccaaagttaagatcccgcctctttactccttagggctaagttttccaccatcaaaacaagtctttgcttccagtttacagaaaaagaaaagaaaaaaaaaaaaaagaaaggaaaagaaaaaaacccacgatgcgggcatagggccac

SEQ ID NO: 52881 - DNA, 30 bp, Homo sapiens; identical to SEQ ID NO: 9673
  chr8:93115382-93115412
  hyper

SEQ ID NO: 52882 - DNA, 167 bp, Homo sapiens; identical to SEQ ID NO: 32149
  chr8:93115692-93115859
  hyper

SEQ ID NO: 52883 - DNA, 30 bp, Homo sapiens; identical to SEQ ID NO: 32150
  chr8:94712418-94712448
  hyper

SEQ ID NO: 52884 - DNA, 300 bp, Homo sapiens; identical to SEQ ID NO: 32151
  chr8:94713129-94713429
  hyper

SEQ ID NO: 52885 - DNA, 30 bp, Homo sapiens; identical to SEQ ID NO: 32152
  chr8:95246973-95247003
  hyper

SEQ ID NO: 52886 - DNA, 30 bp, Homo sapiens; identical to SEQ ID NO: 32153
  chr8:95651480-95651510
  hyper

SEQ ID NO: 52887 - DNA, 104 bp, Homo sapiens
  chr8:97156981-97157085
  hyper
agcgcagcgggaagtcgcatacaccctcgcagtgataggcctcgtactccaggggcgcgataatccagtcgtcccagcccagctccttgaagttcacgtgcagg

SEQ ID NO: 52888 - DNA, 89 bp, Homo sapiens
  chr8:97158066-97158155
  hyper
gccctttgtggtctcaagcctgggccgcgtttcccctagacctcctctgggctgggctggctcgttctcgttgacgtctcaaatgtcac

SEQ ID NO: 52889 - DNA, 11 bp, Homo sapiens
  chr8:97165633-97165644
  hyper
ccaaaccgaag

SEQ ID NO: 52890 - DNA, 120 bp, Homo sapiens
  chr8:97165676-97165796
  hyper
ccccatctcactgaggcgcgcacgcggcctgcccttcccctggggccgggacctggggggttggctaggggcggccttccctgcactgtcgaccggtaagtcacccgggagcccagggga

SEQ ID NO: 52891 - DNA, 130 bp, Homo sapiens
  chr8:97169708-97169838
  hyper
cgctcctccccttgggggacccccggctccaccgagccaggccagccccactcgacggcgatttaaacatcccttaggcaaggcgccaagttagcgctgctggcccagctctaggcgggccgctgctctt

SEQ ID NO: 52892 - DNA, 4 bp, Homo sapiens
  chr8:97170334-97170338
  hyper
tgtc

SEQ ID NO: 52893 - DNA, 490 bp, Homo sapiens
  chr8:97170377-97170867
  hyper
cgcatccccagccctccaccgcattccggggttgtagcggtacttgtggatctcggtcctgctagtctggaggccttggctcgggaacagaggcctccccagactgggtgcacatgcaatccctcctctatctccaggatcgggggcatacagcgcagtggcggggatgggggtggggaggctacagggcaaaccagggtaaagtgatttcgcgtctacgccggattggggcccccaagacttttccccaacccttgtctgaatgccacaggcttccggagacacctccgaacagcccgcagggtcttttggtcctgtgccaaattcacagggcgcagcgaaccagttatggtgcccacttgggggaggggcagagattcttgccacttcattcccgggcaaagaaaatccgcgcccaaccgccggccagcctaggcctctgggacttcttctcttgaggaagggcctcttgagcagtcttctctgagct

SEQ ID NO: 52894 - DNA, 232 bp, Homo sapiens
  chr8:97170897-97171129
  hyper
gaaagtgcacgattaacagaggactttgagggacagaaacaactgtagcaaggcgtgcgtcgtggggagggttggcgagctgcacgggcagcacggaggccagggactcagttgcactactacgaagaagccacatgtctttgcaaaggtgactttagtagccctaaaatcatcataaaatacctggcgttaatttgccctctggacctttcagcagctcatgaacctcgct

SEQ ID NO: 52895 - DNA, 233 bp, Homo sapiens; identical to SEQ ID NO: 20149
  chr8:97172200-97172433
  hyper

SEQ ID NO: 52896 - DNA, 68 bp, Homo sapiens; identical to SEQ ID NO: 20150
  chr8:97173458-97173526
  hyper

SEQ ID NO: 52897 - DNA, 32 bp, Homo sapiens; identical to SEQ ID NO: 32168
  chr8:97173527-97173559
  hyper

SEQ ID NO: 52898 - DNA, 30 bp, Homo sapiens; identical to SEQ ID NO: 9688
  chr8:97505645-97505675
  hyper

SEQ ID NO: 52899 - DNA, 80 bp, Homo sapiens
  chr8:97506524-97506604
  hyper
ccttgggcttggtggcctgcgtgtcggcggagtcggtgagtgggccaggcggaggatgcgcgcgccgtttagggtgtttg

SEQ ID NO: 52900 - DNA, 46 bp, Homo sapiens; identical to SEQ ID NO: 32173
  chr8:97506848-97506894
  hyper

SEQ ID NO: 52901 - DNA, 262 bp, Homo sapiens; identical to SEQ ID NO: 20153
  chr8:97507284-97507546
  hyper

SEQ ID NO: 52902 - DNA, 15 bp, Homo sapiens
  chr8:97507680-97507695
  hyper
cgggccaggtggaag

SEQ ID NO: 52903 - DNA, 219 bp, Homo sapiens; identical to SEQ ID NO: 32175
  chr8:97657861-97658080
  hyper

SEQ ID NO: 52904 - DNA, 7 bp, Homo sapiens
  chr8:98289818-98289825
  hyper
cagtcca

SEQ ID NO: 52905 - DNA, 117 bp, Homo sapiens
  chr8:98290260-98290377
  hyper
ccgcgggcgctcccacccccatctcgcgcggactcgctttaggtctcggcgagtttctctgatatgcgctcgcgggggtgctgccatttcatctcttccgcgcgggctcatcgtgct

SEQ ID NO: 52906 - DNA, 129 bp, Homo sapiens; identical to SEQ ID NO: 32178
  chr8:98788308-98788437
  hyper

SEQ ID NO: 52907 - DNA, 30 bp, Homo sapiens; identical to SEQ ID NO: 32179
  chr8:98788975-98789005
  hyper

SEQ ID NO: 52908 - DNA, 94 bp, Homo sapiens; identical to SEQ ID NO: 9694
  chr8:99076589-99076683
  hyper

SEQ ID NO: 52909 - DNA, 253 bp, Homo sapiens; identical to SEQ ID NO: 32181
  chr8:99076759-99077012
  hyper

SEQ ID NO: 52910 - DNA, 40 bp, Homo sapiens; identical to SEQ ID NO: 32182
  chr8:99077254-99077294
  hyper

SEQ ID NO: 52911 - DNA, 291 bp, Homo sapiens
  chr8:99438813-99439104
  hyper
caacaaccccacccccgggcttcgggaaacttttcttcaggtccctaaaaggggacacctggagttcctccggtcccgccctgtccccggacacgcgcaagccgccctttatttcccagcccagctcccgccagacccagcggggaaaggtcaccgtaggcagccccctgcctgcgccctgggggtggtgataataacagctgtcaccgggggatggtcggggggaagggagaggtgtcggccccgcgccgagccgggggcgcaaggtggtcgcggtgacgcgccggggaa

SEQ ID NO: 52912 - DNA, 241 bp, Homo sapiens
  chr8:99439133-99439374
  hyper
cgccttccgagcccgggcggcggccgaggcacgcggagctgtccgttcagcaccaccgcgccgcgccccgcgcagggcgggcgccccgtcacacccgctctgctcccgccccggctcacggggcgaatgcggcgcgggttcctgcctctctgggtgggtgaggggcgcgcggatccggagagggggctccgggagcggcgggaccacgcagccacctgtgagccttcggcagctgcgggcg

SEQ ID NO: 52913 - DNA, 23 bp, Homo sapiens
  chr8:99440354-99440377
  hyper
cactcgcgcgaggccattctgga

SEQ ID NO: 52914 - DNA, 29 bp, Homo sapiens
  chr8:99951434-99951463
  hyper
ggaagaggtagggacggaggaggagagag

SEQ ID NO: 52915 - DNA, 118 bp, Homo sapiens
  chr8:99952815-99952933
  hyper
gcagacgcgggaaggcccccgcgccatccgtgggagtggggcagcctgtctgcacgcggtcccctgggaaacccctctgcatctcccgcccggacaaggtccccggccttggaatctg

SEQ ID NO: 52916 - DNA, 96 bp, Homo sapiens; identical to SEQ ID NO: 32189
  chr8:99952968-99953064
  hyper

SEQ ID NO: 52917 - DNA, 262 bp, Homo sapiens
  chr8:99954228-99954490
  hyper
ccctctccgcacacccgaaacccacaactcgcccgtgggccgcgtggcctttctgcgccgagggctgctgggggcgggcggcgagcctggcgggtgacctgctcttgggtgggccccgcaatgcctgcgccctagacgccggccgggacgaggggctggctgggtctgagcctggagaaacacaagggtcagcccccagtgggcgcagaggtggcccaggagggcccgcggacggtgctgcgctgcgctcagcctccgggcc

SEQ ID NO: 52918 - DNA, 35 bp, Homo sapiens
  chr8:99954727-99954762
  hyper
tgcggaaagagggagcagctcgtggggttggaaat

SEQ ID NO: 52919 - DNA, 30 bp, Homo sapiens; identical to SEQ ID NO: 32193
  chr8:99955993-99956023
  hyper

SEQ ID NO: 52920 - DNA, 30 bp, Homo sapiens; identical to SEQ ID NO: 32194
  chr8:99957393-99957423
  hyper

SEQ ID NO: 52921 - DNA, 30 bp, Homo sapiens; identical to SEQ ID NO: 32195
  chr8:99957679-99957709
  hyper

SEQ ID NO: 52922 - DNA, 281 bp, Homo sapiens
  chr8:99960048-99960329
  hyper
tttcctctccctccccggagcgctctcctctctcctctcccctctcttctctctcctctctcgtctcctggggcatcccgggtggagggatgtaggggtcgctcctcggtgccaggccgggaagcagctcaggcctcccaagagcttggcgctcagtctgggaaaaggggttcctctggcctcagggacgttctccgcccccaccccaccccctgggagcctgaaccatctggaagggatcttagtcgggggttgggaggagagcccgtggataggaggag

SEQ ID NO: 52923 - DNA, 15 bp, Homo sapiens
  chr8:99961568-99961583
  hyper
cgcctaagatgggag

SEQ ID NO: 52924 - DNA, 35 bp, Homo sapiens
  chr8:99961822-99961857
  hyper
ctgcgggatcacaggtgaggcgggcaaggaggatg

SEQ ID NO: 52925 - DNA, 21 bp, Homo sapiens
  chr8:99985845-99985866
  hyper
ggcctaggcctagttcgtgtc

SEQ ID NO: 52926 - DNA, 236 bp, Homo sapiens
  chr8:101118005-101118241
  hyper
tctcatgtctgggagcggggataccgctaggagggcaggaggtaaagtccagaggctggcgcgtggtgcggccccgacgccgcgggctgatcctctgtccctgtggggccgccacctacccgcggtgagcctcttctcgggcatgccgtccccgctgcccgcgcctggagcccgcgcgggccgtcagggccctagcgcgcgggtccagcgcgggtcagggcctgagcgacgcggcg

SEQ ID NO: 52927 - DNA, 79 bp, Homo sapiens; identical to SEQ ID NO: 32204
  chr8:101661840-101661919
  hyper

SEQ ID NO: 52928 - DNA, 99 bp, Homo sapiens
  chr8:101822047-101822146
  hyper
ctacgacagcgaggggcccgggaagcccgcggaaacgcaggaggcggccaggagaggcagcgctacgcacatcccccccaccttcggagccctgtccta

SEQ ID NO: 52929 - DNA, 241 bp, Homo sapiens
  chr8:102505556-102505797
  hyper
gcccgcgtgtggccccgatgggaggcgaggcgctgggaggccggggggcgcgggggcggccggcgccgtcccccactccctcgacatcccgccttcctcccccctcccccgcctccctcccccgggtccgcccccgcattgtttggccaccttcctcaggtgcccggggggaaaggacggttcgcgaactgggggaactcatgtgaggcctcgagttagggcctcggcggggcgcgaaggg

SEQ ID NO: 52930 - DNA, 276 bp, Homo sapiens; identical to SEQ ID NO: 32207
  chr8:104152711-104152987
  hyper

SEQ ID NO: 52931 - DNA, 182 bp, Homo sapiens; identical to SEQ ID NO: 20167
  chr8:104153267-104153449
  hyper

SEQ ID NO: 52932 - DNA, 30 bp, Homo sapiens; identical to SEQ ID NO: 32209
  chr8:104310870-104310900
  hyper

SEQ ID NO: 52933 - DNA, 355 bp, Homo sapiens; identical to SEQ ID NO: 32210
  chr8:104511157-104511512
  hyper

SEQ ID NO: 52934 - DNA, 140 bp, Homo sapiens
  chr8:104511983-104512123
  hyper
ctccccgcccggccccggacccagcctggagatcgcgctcgggaggggcggctgccgcccgcggggcgcccgcggtgcccgggcctgggcagcgaggaggtgacgccgcccccgcgggatgagcccgggaggcggagggg

SEQ ID NO: 52935 - DNA, 80 bp, Homo sapiens
  chr8:104513382-104513462
  hyper
cctccctcccgctggcggcgcccaggccacgagggctgcggccagcgccggccgcccgggctgttttaggggtgtctgag

SEQ ID NO: 52936 - DNA, 120 bp, Homo sapiens; identical to SEQ ID NO: 20171
  chr8:105235249-105235369
  hyper

SEQ ID NO: 52937 - DNA, 157 bp, Homo sapiens
  chr8:105479247-105479404
  hyper
cgacagcccccgagctctgcctcaggctgcaaatccggagcccggcggcctgacgggtttatgacctggccgcatatgcggctcctccccccgggaaggctgggctggagcccaaaggccgggattgaacaggtccgcatggtccttgcacactcag

SEQ ID NO: 52938 - DNA, 155 bp, Homo sapiens; identical to SEQ ID NO: 9720
  chr8:105600526-105600681
  hyper

SEQ ID NO: 52939 - DNA, 266 bp, Homo sapiens; identical to SEQ ID NO: 32219
  chr8:105601010-105601276
  hyper

SEQ ID NO: 52940 - DNA, 58 bp, Homo sapiens; identical to SEQ ID NO: 32220
  chr8:105601510-105601568
  hyper

SEQ ID NO: 52941 - DNA, 115 bp, Homo sapiens; identical to SEQ ID NO: 32221
  chr8:105601944-105602059
  hyper

SEQ ID NO: 52942 - DNA, 38 bp, Homo sapiens; identical to SEQ ID NO: 32222
  chr8:106330435-106330473
  hyper

SEQ ID NO: 52943 - DNA, 63 bp, Homo sapiens; identical to SEQ ID NO: 9724
  chr8:106331011-106331074
  hyper

SEQ ID NO: 52944 - DNA, 77 bp, Homo sapiens; identical to SEQ ID NO: 20177
  chr8:106331083-106331160
  hyper

SEQ ID NO: 52945 - DNA, 20 bp, Homo sapiens
  chr8:106331237-106331257
  hyper
gtgggattattgcccaggag

SEQ ID NO: 52946 - DNA, 114 bp, Homo sapiens; identical to SEQ ID NO: 32225
  chr8:106331860-106331974
  hyper

SEQ ID NO: 52947 - DNA, 30 bp, Homo sapiens; identical to SEQ ID NO: 32226
  chr8:107281960-107281990
  hyper

SEQ ID NO: 52948 - DNA, 196 bp, Homo sapiens; identical to SEQ ID NO: 32227
  chr8:107282301-107282497
  hyper

SEQ ID NO: 52949 - DNA, 57 bp, Homo sapiens; identical to SEQ ID NO: 32228
  chr8:107282838-107282895
  hyper

SEQ ID NO: 52950 - DNA, 720 bp, Homo sapiens; identical to SEQ ID NO: 32229
  chr8:107283112-107283832
  hyper

SEQ ID NO: 52951 - DNA, 6 bp, Homo sapiens
  chr8:107284032-107284038
  hyper
ggagga

SEQ ID NO: 52952 - DNA, 147 bp, Homo sapiens
  chr8:107284075-107284222
  hyper
tggaagggaatcctgggagtcccggccgtcagaggggttcccaaatccaaagggtccatctccaaggcgtcactccaggggtccgcggttcactttgctgccccttgcaggtgatgctgtgattgttgcctgcggactgggaagcac

SEQ ID NO: 52953 - DNA, 88 bp, Homo sapiens
  chr8:109094397-109094485
  hyper
cagagagaagaacaacgacgacaaaaaaaaaatgcatgtcagataagaaatacgtcctaaagagacaagtttagatgaggaggtgggg

SEQ ID NO: 52954 - DNA, 245 bp, Homo sapiens; identical to SEQ ID NO: 20180
  chr8:109094595-109094840
  hyper

SEQ ID NO: 52955 - DNA, 42 bp, Homo sapiens
  chr8:109095932-109095974
  hyper
ctaaagccagaaacgtcccggtttccctgaggtcctaaagaa

SEQ ID NO: 52956 - DNA, 18 bp, Homo sapiens
  chr8:109799570-109799588
  hyper
aggtacggatgtgtccgc

SEQ ID NO: 52957 - DNA, 15 bp, Homo sapiens
  chr8:109799888-109799903
  hyper
cgggagttgtaggcc

SEQ ID NO: 52958 - DNA, 345 bp, Homo sapiens; identical to SEQ ID NO: 32238
  chr8:110703537-110703882
  hyper

SEQ ID NO: 52959 - DNA, 65 bp, Homo sapiens; identical to SEQ ID NO: 32239
  chr8:110704189-110704254
  hyper

SEQ ID NO: 52960 - DNA, 52 bp, Homo sapiens; identical to SEQ ID NO: 9735
  chr8:110986212-110986264
  hyper

SEQ ID NO: 52961 - DNA, 115 bp, Homo sapiens; identical to SEQ ID NO: 20184
  chr8:110986328-110986443
  hyper

SEQ ID NO: 52962 - DNA, 337 bp, Homo sapiens
  chr8:110986682-110987019
  hyper
cgcgagggcggtggcacggcccctggtggcggccgggattccccgggctcccgaaggggttacctctccttggcgcaccctctccacccgctgtgcgccttcctcctcctgccgctagggagccgggagtgcgcggaagcagcgcacaagtggcagaaagaggagacagggagcagaggaagggtcgcgctaagagagaggatcaggtgaggtccaagcccgacacagtccctgtgcacactgccggtcgccctggcccttcccaaacgttgtcaccccgcctcccaacttcgcaattgcgattcccagcccaggaggtgtacagattgaatgactc

SEQ ID NO: 52963 - DNA, 202 bp, Homo sapiens; identical to SEQ ID NO: 9738
  chr8:110987020-110987222
  hyper

SEQ ID NO: 52964 - DNA, 146 bp, Homo sapiens; identical to SEQ ID NO: 9739
  chr8:110987765-110987911
  hyper

SEQ ID NO: 52965 - DNA, 15 bp, Homo sapiens
  chr8:114444379-114444394
  hyper
ccaaccagatgattc

SEQ ID NO: 52966 - DNA, 34 bp, Homo sapiens; identical to SEQ ID NO: 32245
  chr8:114444481-114444515
  hyper

SEQ ID NO: 52967 - DNA, 242 bp, Homo sapiens
  chr8:114445521-114445763
  hyper
gttgggaaagactgtcgccttatgggcgaggactgtgggtgtcagtccccgggacacacgcggggctgaaagctccggacatggccacctgggcgggcgtctgtaaaaggtgctaatgagtgcctctggcagctcttccccctcataagacacccgcgcccctctccagtagcaactaactgcgggagaggatgcgatttccacttttccaaaagacctctgtggcaggagtagtatctcct

SEQ ID NO: 52968 - DNA, 80 bp, Homo sapiens
  chr8:114447368-114447448
  hyper
gtaagcaacctgagccgtgctttgtacatttggcagtgtagttgtgccacttaggacaagcttttcggctcagagctgct

SEQ ID NO: 52969 - DNA, 32 bp, Homo sapiens; identical to SEQ ID NO: 32250
  chr8:114447789-114447821
  hyper

SEQ ID NO: 52970 - DNA, 73 bp, Homo sapiens; identical to SEQ ID NO: 32251
  chr8:114448753-114448826
  hyper

SEQ ID NO: 52971 - DNA, 148 bp, Homo sapiens
  chr8:114449402-114449550
  hyper
cttgctttttttccccgaatagatcaattctgcctgtaaaagcagcccaagaaataatgttagtgagctctccgttgcaggctgcgaatacagaagcatgtcaaaggaatattttaatcggaggatctgtgttgcttttggggaaacc

SEQ ID NO: 52972 - DNA, 119 bp, Homo sapiens
  chr8:117950319-117950438
  hyper
ctgggagcaaaggagcgtctctgaatggcggggcagttgcagcatcccacttggcaagggtccttgaattacctccgcccccgccctgaccccgccctaaacatcaaacttagaaactc

SEQ ID NO: 52973 - DNA, 315 bp, Homo sapiens
  chr8:117950468-117950783
  hyper
caggcgtctccgcgatgggccccggggacttccgccgctgcagagagagaatttcccaggggctccagggactcccaggtagagcggagctttggttcccacctcgtcccgcgtgcgacttcttcggggacggcaggagcacggacatccaggaggaggccctcgccgccagcccgctgctggaggacctcagacgacggctgacgcgcgccttccagtgggcggtgcagcgcgcgatctcgaggcgcgtgcaggaggcggcggcggcggcggcggcgcgggaggagcagagctggacgggcgttgaggccaccc

SEQ ID NO: 52974 - DNA, 44 bp, Homo sapiens
  chr8:117950914-117950958
  hyper
ctcaggtctggacacggcgttgacgcccccgcctccccagcatc

SEQ ID NO: 52975 - DNA, 107 bp, Homo sapiens; identical to SEQ ID NO: 32257
  chr8:120428615-120428722
  hyper

SEQ ID NO: 52976 - DNA, 39 bp, Homo sapiens; identical to SEQ ID NO: 32258
  chr8:120429017-120429056
  hyper

SEQ ID NO: 52977 - DNA, 30 bp, Homo sapiens; identical to SEQ ID NO: 32259
  chr8:121135998-121136028
  hyper

SEQ ID NO: 52978 - DNA, 53 bp, Homo sapiens
  chr8:121136826-121136879
  hyper
gcatcgctgctttggcgttttagagcccttggacttgttcacaagaggaagag

SEQ ID NO: 52979 - DNA, 42 bp, Homo sapiens; identical to SEQ ID NO: 32262
  chr8:122651743-122651785
  hyper

SEQ ID NO: 52980 - DNA, 373 bp, Homo sapiens; identical to SEQ ID NO: 32263
  chr8:122652029-122652402
  hyper

SEQ ID NO: 52981 - DNA, 151 bp, Homo sapiens; identical to SEQ ID NO: 20196
  chr8:124173095-124173246
  hyper

SEQ ID NO: 52982 - DNA, 30 bp, Homo sapiens; identical to SEQ ID NO: 32265
  chr8:124934797-124934827
  hyper

SEQ ID NO: 52983 - DNA, 30 bp, Homo sapiens; identical to SEQ ID NO: 32266
  chr8:126400946-126400976
  hyper

SEQ ID NO: 52984 - DNA, 164 bp, Homo sapiens; identical to SEQ ID NO: 32267
  chr8:131455233-131455397
  hyper

SEQ ID NO: 52985 - DNA, 476 bp, Homo sapiens; identical to SEQ ID NO: 32268
  chr8:131455603-131456079
  hyper

SEQ ID NO: 52986 - DNA, 213 bp, Homo sapiens
  chr8:132051934-132052147
  hyper
caggatgcccttgagcgggtccatgggggccgaggccaggctcaagtgtaggaccaagagagtgagtttggtcagcacgtccagcacgttcatcaccacttccgatttgcgcctttggcccaagaaatagcgctggtagaggcgttccaaatcccgagatttgaaggagttgcgcagggtggggaaaatgacccctcggtagctatagccccc

SEQ ID NO: 52987 - DNA, 324 bp, Homo sapiens; identical to SEQ ID NO: 32272
  chr8:132053217-132053541
  hyper

SEQ ID NO: 52988 - DNA, 13 bp, Homo sapiens
  chr8:132054785-132054798
  hyper
ccccctcagtccc

SEQ ID NO: 52989 - DNA, 312 bp, Homo sapiens; identical to SEQ ID NO: 32275
  chr8:133492319-133492631
  hyper

SEQ ID NO: 52990 - DNA, 182 bp, Homo sapiens; identical to SEQ ID NO: 32276
  chr8:133492712-133492894
  hyper

SEQ ID NO: 52991 - DNA, 135 bp, Homo sapiens; identical to SEQ ID NO: 32277
  chr8:133493617-133493752
  hyper

SEQ ID NO: 52992 - DNA, 30 bp, Homo sapiens; identical to SEQ ID NO: 32278
  chr8:134581243-134581273
  hyper

SEQ ID NO: 52993 - DNA, 48 bp, Homo sapiens
  chr8:139509693-139509741
  hyper
cggggctcccctctcgagccaagaccccaggcctcgggcaggaaaagg

SEQ ID NO: 52994 - DNA, 30 bp, Homo sapiens; identical to SEQ ID NO: 9766
  chr8:139926700-139926730
  hyper

SEQ ID NO: 52995 - DNA, 65 bp, Homo sapiens; identical to SEQ ID NO: 32282
  chr8:140643383-140643448
  hyper

SEQ ID NO: 52996 - DNA, 250 bp, Homo sapiens; identical to SEQ ID NO: 20204
  chr8:140715219-140715469
  hyper

SEQ ID NO: 52997 - DNA, 266 bp, Homo sapiens
  chr8:140715699-140715965
  hyper
cgggaaccggagccagaaagcggccggagggcggccgcggggcccggtacccctgtgggtccagctcgcgggtggcggtgcccagcaaggagcctgcaggtccgcgcgcccagcggaacctgcttccccttttacccctcctcgccccctctcggtggtggggaggaaaagtttgcgaagtggcggtgtctctggagtcccctgcaagcggggagggggccgagcaggtgcagcgggaggggcagcccgctccccaaaggtccgcg

SEQ ID NO: 52998 - DNA, 498 bp, Homo sapiens; identical to SEQ ID NO: 32287
  chr8:140716681-140717179
  hyper

SEQ ID NO: 52999 - DNA, 137 bp, Homo sapiens; identical to SEQ ID NO: 32288
  chr8:140717239-140717376
  hyper

SEQ ID NO: 53000 - DNA, 153 bp, Homo sapiens; identical to SEQ ID NO: 32289
  chr8:140717707-140717860
  hyper

SEQ ID NO: 53001 - DNA, 188 bp, Homo sapiens
  chr8:142528212-142528400
  hyper
ctggccacctctcttcgcgcccggcctcctggtctcccgcctgcgcgggccgctcccggccctccccgccctgccgggcgttcactgtcccctccgcccgcaggtcccgcggcgcccccggagcccgccttcccggacatctacggcggggacgcgcagctctgggaggcgcatttccgcggcatcgg

SEQ ID NO: 53002 - DNA, 15 bp, Homo sapiens
  chr8:142529027-142529042
  hyper
cggaggcaggccctc

SEQ ID NO: 53003 - DNA, 235 bp, Homo sapiens; identical to SEQ ID NO: 32295
  chr8:143530528-143530763
  hyper

SEQ ID NO: 53004 - DNA, 751 bp, Homo sapiens; identical to SEQ ID NO: 32296
  chr8:143531020-143531771
  hyper

SEQ ID NO: 53005 - DNA, 126 bp, Homo sapiens
  chr8:143531996-143532122
  hyper
gacgtcctccccccacgcacagagctcggggcaggcaggagaaaaccccagactccttctcgaagccctcgctcgtagaagccctcgcctgtagacctggcattggcagtggagactccctggagg

SEQ ID NO: 53006 - DNA, 653 bp, Homo sapiens; identical to SEQ ID NO: 20213
  chr8:143532846-143533499
  hyper

SEQ ID NO: 53007 - DNA, 111 bp, Homo sapiens; identical to SEQ ID NO: 20214
  chr8:143533500-143533611
  hyper

SEQ ID NO: 53008 - DNA, 299 bp, Homo sapiens
  chr8:143533906-143534205
  hyper
cgggctctgctctcggatcccttccagcccccgaccctccgcacttgtcccgagatccaacgtgcccggtccgcagcgtgctgggtctgcggcgtcagggtggcccgagtcccgagaccatctgcgcttgcggacacagccgcggggcctggcatgaagggccccagggagggcctagcaagcgcccggggtccgagcagcctcctgcggcgtcctccgcccccggtcggcccgaccccgcctccgggagtgggtcgtggggcgcggagcccgtcctccggggacgccgcggggctcca

SEQ ID NO: 53009 - DNA, 304 bp, Homo sapiens; identical to SEQ ID NO: 32301
  chr8:143534453-143534757
  hyper

SEQ ID NO: 53010 - DNA, 255 bp, Homo sapiens; identical to SEQ ID NO: 32302
  chr8:143591552-143591807
  hyper

SEQ ID NO: 53011 - DNA, 156 bp, Homo sapiens; identical to SEQ ID NO: 32303
  chr8:143591888-143592044
  hyper

SEQ ID NO: 53012 - DNA, 178 bp, Homo sapiens; identical to SEQ ID NO: 32304
  chr8:143592101-143592279
  hyper

SEQ ID NO: 53013 - DNA, 221 bp, Homo sapiens; identical to SEQ ID NO: 32305
  chr8:143592358-143592579
  hyper

SEQ ID NO: 53014 - DNA, 200 bp, Homo sapiens; identical to SEQ ID NO: 32307
  chr8:143695463-143695663
  hyper

SEQ ID NO: 53015 - DNA, 37 bp, Homo sapiens
  chr8:143858699-143858736
  hyper
agcgcgagctcaccgcaggccccgccccaggcctgcc

SEQ ID NO: 53016 - DNA, 45 bp, Homo sapiens; identical to SEQ ID NO: 9788
  chr8:143859143-143859188
  hyper

SEQ ID NO: 53017 - DNA, 56 bp, Homo sapiens; identical to SEQ ID NO: 32310
  chr8:144099611-144099667
  hyper

SEQ ID NO: 53018 - DNA, 147 bp, Homo sapiens; identical to SEQ ID NO: 20220
  chr8:144241287-144241434
  hyper

SEQ ID NO: 53019 - DNA, 87 bp, Homo sapiens; identical to SEQ ID NO: 3378
  chr8:144241435-144241522
  hyper

SEQ ID NO: 53020 - DNA, 120 bp, Homo sapiens; identical to SEQ ID NO: 32313
  chr8:144241583-144241703
  hyper

SEQ ID NO: 53021 - DNA, 114 bp, Homo sapiens
  chr8:144241757-144241871
  hyper
cggggcggagccggggcgggggccgcgcggggggcgggggcggctgggagacgcgcggggcggggggcgcccggggctcgcggcccccacgcaggtagctggcccgggccctcc

SEQ ID NO: 53022 - DNA, 131 bp, Homo sapiens
  chr8:144328190-144328321
  hyper
gctgggagcacatcccggaggggctgcctgcggcgggaggagcggcaggggccacgtggtgggggacggctcgccagggcgcgcacgcggtggcggcggcggtggaggcgttgcccgcctagctaggggcc

SEQ ID NO: 53023 - DNA, 31 bp, Homo sapiens
  chr8:144328565-144328596
  hyper
tggtgggcgcagcctacgtgacagggtcggc

SEQ ID NO: 53024 - DNA, 49 bp, Homo sapiens; identical to SEQ ID NO: 32316
  chr8:144490051-144490100
  hyper

SEQ ID NO: 53025 - DNA, 112 bp, Homo sapiens; identical to SEQ ID NO: 32317
  chr8:144503380-144503492
  hyper

SEQ ID NO: 53026 - DNA, 50 bp, Homo sapiens; identical to SEQ ID NO: 32318
  chr8:144509068-144509118
  hyper

SEQ ID NO: 53027 - DNA, 696 bp, Homo sapiens
  chr8:144510529-144511225
  hyper
agattccacaaacaaaacgaaacacaatttaaattaaaataaaaacactttctccacccgccccatgccagaaggctctggcccaagcctcctcttaaaaaaaaaaattttctgctagaaatactgtgcattacttttttctttcacttctcttgaaggttaaaacaagatgtatttccccaggagttacagatatgttctggtgcatagagagacagcagctcgggatccgggccagcccccacccgactgagcacaggactcacccccctccccccacccccggttgagcatagtaggacagcaggcctggacacagcacgggtgacgtccctggcttcgacctccaaggaacgccggtagcagggtcgggggcaagcggggagggggcaggcaggggccgggcccctcctggcgagcgactcatgctgtgactcgcgactgagggcggaccccggctggggaaagaaggggcttcctccaaggttttcttttctaatcaccaagcataataattataaatacttcgaaaataagaccgattttaaaacggggaggggaagttaaaaaaggcaaggaaagggaggctgagaagagaacgaaggagggcgggggcaggcaggggccacccgggaagggacggcagcgcggtccctctaggctggcagggcgaaggtgggaacggagaaccacgtt

SEQ ID NO: 53028 - DNA, 617 bp, Homo sapiens; identical to SEQ ID NO: 20229
  chr8:144511424-144512041
  hyper

SEQ ID NO: 53029 - DNA, 180 bp, Homo sapiens
  chr8:144512192-144512372
  hyper
ggggttgaggtgatgctggtagccgctcatccagtacagatcctccagcgccggcttccccgaggtgcccccgacggcgccggggcccccgctcggcggcccgggggcgcccccggcctgagacgagccgccgccgccccccgcgccgccgccgccgccggtgcccgggctgggcgcgca

SEQ ID NO: 53030 - DNA, 226 bp, Homo sapiens; identical to SEQ ID NO: 32320
  chr8:144650887-144651113
  hyper

SEQ ID NO: 53031 - DNA, 210 bp, Homo sapiens; identical to SEQ ID NO: 32321
  chr8:144651759-144651969
  hyper

SEQ ID NO: 53032 - DNA, 154 bp, Homo sapiens; identical to SEQ ID NO: 32322
  chr8:145700252-145700406
  hyper

SEQ ID NO: 53033 - DNA, 194 bp, Homo sapiens; identical to SEQ ID NO: 32323
  chr8:145700607-145700801
  hyper

SEQ ID NO: 53034 - DNA, 62 bp, Homo sapiens; identical to SEQ ID NO: 32324
  chr8:145806186-145806248
  hyper

SEQ ID NO: 53035 - DNA, 131 bp, Homo sapiens; identical to SEQ ID NO: 32325
  chr8:145925298-145925429
  hyper

SEQ ID NO: 53036 - DNA, 3 bp, Homo sapiens
  chr8:145925458-145925461
  hyper
cgc

SEQ ID NO: 53037 - DNA, 154 bp, Homo sapiens
  chr8:145925491-145925645
  hyper
ctcctacgaaggcgcgaacgttccagactctcgccggtcctcgacagcactcattcagtctcccccctggagatcccaggctgtactctgggacagaaaagaaggcgggtacgaccgcggtgtcgggtcctaccttagccgctccttctcctga

SEQ ID NO: 53038 - DNA, 83 bp, Homo sapiens; identical to SEQ ID NO: 32327
  chr9:73223-73306
  hyper

SEQ ID NO: 53039 - DNA, 31 bp, Homo sapiens
  chr9:113402-113433
  hyper
accttcgccccaggccggcgcagcccagctt

SEQ ID NO: 53040 - DNA, 294 bp, Homo sapiens
  chr9:113556-113850
  hyper
cccaactccgccgcctcgggaaggcggcttcgggcccgcagggagccccggggagggttcccggttccgccggcagcggcgtcgaggggtgcctgggctcctggggaccgcgagaggaaaaagaacggaaatcgcaccggggaggaaggacgcgcagaacgcccccgtgaagcggggtgctccggtcaggcgtgcgcgggagcgcggtccgggggagtccggcggcgccgtcgcgcgcactcggcagaggcttcgcgggagaacgcgcagcccggggcgtggggcggggaactg

SEQ ID NO: 53041 - DNA, 269 bp, Homo sapiens; identical to SEQ ID NO: 20236
  chr9:113885-114154
  hyper

SEQ ID NO: 53042 - DNA, 130 bp, Homo sapiens; identical to SEQ ID NO: 32330
  chr9:114722-114852
  hyper

SEQ ID NO: 53043 - DNA, 12 bp, Homo sapiens
  chr9:117872-117884
  hyper
caaactctgagg

SEQ ID NO: 53044 - DNA, 277 bp, Homo sapiens; identical to SEQ ID NO: 32332
  chr9:214944-215221
  hyper

SEQ ID NO: 53045 - DNA, 39 bp, Homo sapiens; identical to SEQ ID NO: 32333
  chr9:841367-841406
  hyper

SEQ ID NO: 53046 - DNA, 242 bp, Homo sapiens
  chr9:841449-841691
  hyper
cgctctgtatctctcggtgcgcttgcagggaccctgcagcaaagccctggatgcttgcagccggtgcaagtttgcaagcagctggagagcggtggctggagtcggggggcggtgggcgtggccacgctccctcccaggcagtcccgggaatgttctgaaaagtatccgaaagttctgagtcgcgcgcgcgccaaaagaaaaggcacaaccccccaccactccgggcgtggcgtgcccagacc

SEQ ID NO: 53047 - DNA, 7 bp, Homo sapiens
  chr9:842526-842533
  hyper
ctcccgg

SEQ ID NO: 53048 - DNA, 75 bp, Homo sapiens
  chr9:842673-842748
  hyper
ctgggagcgccggagacgcgtctgatcccgcccgccgggcagagttgcgggcttcgctcggctcggggttcccca

SEQ ID NO: 53049 - DNA, 186 bp, Homo sapiens; identical to SEQ ID NO: 32339
  chr9:842779-842965
  hyper

SEQ ID NO: 53050 - DNA, 518 bp, Homo sapiens; identical to SEQ ID NO: 32340
  chr9:843202-843720
  hyper

SEQ ID NO: 53051 - DNA, 29 bp, Homo sapiens
  chr9:969586-969615
  hyper
ctgcggccgcgcggggaatggagccggac

SEQ ID NO: 53052 - DNA, 121 bp, Homo sapiens
  chr9:969667-969788
  hyper
cgcgcccaccttgccggcgtgttcgcgggcccctgcccactgccccccctctttctttaggtctggcttttgaggatcccggagtcttgcagctcccgccattccgcagataacctccgca

SEQ ID NO: 53053 - DNA, 250 bp, Homo sapiens
  chr9:969846-970096
  hyper
agtgtcccctctcagcactgcccccttcagtccccctgcatttctggaaagtcaggcaaggcccaggtaggctgccagtgcactctcagccttgactgagcacctttcgggcctctggtgagccccgagagccaggtttggctcggcagagcgggcttgggctgcgcaagcaatgcgcatcgtggccgcctgcaccctgggaactaggcctgtccagtgggcagcatcctcatttttgaaaaggcccttc

SEQ ID NO: 53054 - DNA, 372 bp, Homo sapiens
  chr9:970525-970897
  hyper
gtgcagtgtaagagtgcgcagaacgcgtgtgttcaagtgtgggcgtggcaggcgtcgtgtgctcgccccgcgcactgtgcggatcgcccagacagccttgacaggtttttgcagatgtttgggtgctacggtgtggggaaacccaggcaggagcgccaggcctaattctcctggactcttggtgagcggccgctactccacgaggggctagaagcaaagggggcacgcgcttttccccaggccgcctcttgctgccgcagtggctgagggcgctgatgacccctccccgcttccagcggacttgacccgcgggctgacaacccaccgcgacaagcaggcggctgggttcgcgccgccgccccggggcccttg

SEQ ID NO: 53055 - DNA, 142 bp, Homo sapiens; identical to SEQ ID NO: 32346
  chr9:971939-972081
  hyper

SEQ ID NO: 53056 - DNA, 262 bp, Homo sapiens
  chr9:972759-973021
  hyper
cctccaggaaccgcggcccagcggggagcgccccaggctagcgcttttccagttcccttcgaaagcgcggggctgaggtcgcggcgctgggccctcggatgaagccgtgctgtagctacacctgaaccccgcgaaaggctggcgcggtcgtgtatccaggctgggtctgaggaatccgcaagcgggagagcgctaactcctaggcgtgagccgctgctggcttcgagagttcgagaacatgaaggacctggcttctcccgcc

SEQ ID NO: 53057 - DNA, 43 bp, Homo sapiens; identical to SEQ ID NO: 32349
  chr9:973762-973805
  hyper

SEQ ID NO: 53058 - DNA, 297 bp, Homo sapiens
  chr9:976321-976618
  hyper
cttacaggcacccccaccctcactcccgctggtcctccccttctccgccccgcgagcaccgccgcgttctggagcgccgcagtctccagccgcgggctggggtagcggagagggcttggaggagggggccgcgagcgcccccgcgagagtggcctggctgcaggtggcaaggaaggtgaagtgcaggcacccgaggggcgcaaaggaggaggaaggcgtggggcggggagtgcaaggagacagggaccccaggggcgggggtggcggtgggaaggaggaggggttgggggagggcgg

SEQ ID NO: 53059 - DNA, 34 bp, Homo sapiens; identical to SEQ ID NO: 32352
  chr9:977171-977205
  hyper

SEQ ID NO: 53060 - DNA, 159 bp, Homo sapiens; identical to SEQ ID NO: 32353
  chr9:977422-977581
  hyper

SEQ ID NO: 53061 - DNA, 13 bp, Homo sapiens
  chr9:981830-981843
  hyper
gctctttccttgg

SEQ ID NO: 53062 - DNA, 76 bp, Homo sapiens; identical to SEQ ID NO: 20247
  chr9:1042326-1042402
  hyper

SEQ ID NO: 53063 - DNA, 76 bp, Homo sapiens; identical to SEQ ID NO: 32357
  chr9:1051563-1051639
  hyper

SEQ ID NO: 53064 - DNA, 152 bp, Homo sapiens; identical to SEQ ID NO: 20248
  chr9:1052166-1052318
  hyper

SEQ ID NO: 53065 - DNA, 380 bp, Homo sapiens; identical to SEQ ID NO: 32359
  chr9:2621312-2621692
  hyper

SEQ ID NO: 53066 - DNA, 44 bp, Homo sapiens; identical to SEQ ID NO: 32360
  chr9:2622978-2623022
  hyper

SEQ ID NO: 53067 - DNA, 30 bp, Homo sapiens; identical to SEQ ID NO: 32361
  chr9:3181153-3181183
  hyper

SEQ ID NO: 53068 - DNA, 179 bp, Homo sapiens; identical to SEQ ID NO: 20249
  chr9:3181573-3181752
  hyper

SEQ ID NO: 53069 - DNA, 11 bp, Homo sapiens
  chr9:3181869-3181880
  hyper
ctttgcctgag

SEQ ID NO: 53070 - DNA, 30 bp, Homo sapiens; identical to SEQ ID NO: 9829
  chr9:4299034-4299064
  hyper

SEQ ID NO: 53071 - DNA, 58 bp, Homo sapiens; identical to SEQ ID NO: 9830
  chr9:4299348-4299406
  hyper

SEQ ID NO: 53072 - DNA, 58 bp, Homo sapiens; identical to SEQ ID NO: 32365
  chr9:4299639-4299697
  hyper

SEQ ID NO: 53073 - DNA, 189 bp, Homo sapiens; identical to SEQ ID NO: 32366
  chr9:4299943-4300132
  hyper

SEQ ID NO: 53074 - DNA, 91 bp, Homo sapiens
  chr9:6412809-6412900
  hyper
cccctttccaggattatacaagtgcacgccagggtttcttatttttggtgtgtttttgagaccaaagaaccatatccgctaagcctgagga

SEQ ID NO: 53075 - DNA, 118 bp, Homo sapiens
  chr9:6644899-6645017
  hyper
gatttcagttgcaaccggagctaaccggtaagcccactcttaatcagggggtcttcctcctcttgcaaagtttaggtccatccacagggccacttgggctgggggtggtttaaaaatg

SEQ ID NO: 53076 - DNA, 292 bp, Homo sapiens
  chr9:6645333-6645625
  hyper
ggcgctccaggaggcgcgaggccccagccgcggcgctgtccccgccgccactgctgctgtcccggctccgcggcgcccagcacggccccgatcccccagccaggcggcggccgcccccgaccccgcggcccaggcgcagcccccacgccctggcacaggactgcatggccgcggccaccgtcccctgccccggcccgcaagggtcagccgcgctcttggcccctctcctggcctcggtcccccgggtggcggctgcgcccggcctggagcccctttcgctggacagtcggcc

SEQ ID NO: 53077 - DNA, 451 bp, Homo sapiens
  chr9:6645700-6646151
  hyper
ccacccaaggcacctgctccgcacactttaagcggcgccctggaggcgggaggtgggttggggccaggaagcccttggccaatgaaagtagacagagggggagggggcggaacagttcccgcccccgccccctcttcctaccctcttcccagcccttccgtggagtcccgcttcccctggaccggaggctgccatctccagtcctacccactccgacgctggctggtgccgggggccgggacgctccgtacgccgcccgccagggtgtggagccgcactggggcaagatcaggtgggacagcccaaagactccgggccaagttcctgggggactcggcggagatggaagatgattctcgaagctctccatttccttaattttgaggtatctttctctgtcacatttcatctcagggaaattaatatgggcagatggcggttcttttatctt

SEQ ID NO: 53078 - DNA, 37 bp, Homo sapiens; identical to SEQ ID NO: 32371
  chr9:6704532-6704569
  hyper

SEQ ID NO: 53079 - DNA, 43 bp, Homo sapiens; identical to SEQ ID NO: 32372
  chr9:8857443-8857486
  hyper

SEQ ID NO: 53080 - DNA, 147 bp, Homo sapiens; identical to SEQ ID NO: 32373
  chr9:8857685-8857832
  hyper

SEQ ID NO: 53081 - DNA, 363 bp, Homo sapiens; identical to SEQ ID NO: 32374
  chr9:8858327-8858690
  hyper

SEQ ID NO: 53082 - DNA, 123 bp, Homo sapiens; identical to SEQ ID NO: 32375
  chr9:10612684-10612807
  hyper

SEQ ID NO: 53083 - DNA, 7 bp, Homo sapiens
  chr9:10613046-10613053
  hyper
cgcactc

SEQ ID NO: 53084 - DNA, 100 bp, Homo sapiens; identical to SEQ ID NO: 32377
  chr9:12775664-12775764
  hyper

SEQ ID NO: 53085 - DNA, 70 bp, Homo sapiens; identical to SEQ ID NO: 20260
  chr9:13278748-13278818
  hyper

SEQ ID NO: 53086 - DNA, 92 bp, Homo sapiens
  chr9:13278864-13278956
  hyper
gcggatggggcgtccgggagcggcccctgcaggggagagcaacaggctcccgcgccctggaggcctggtctgcgctccgggcccccaggcta

SEQ ID NO: 53087 - DNA, 44 bp, Homo sapiens; identical to SEQ ID NO: 32379
  chr9:13279362-13279406
  hyper

SEQ ID NO: 53088 - DNA, 116 bp, Homo sapiens; identical to SEQ ID NO: 32380
  chr9:13279633-13279749
  hyper

SEQ ID NO: 53089 - DNA, 207 bp, Homo sapiens; identical to SEQ ID NO: 20263
  chr9:14348107-14348314
  hyper

SEQ ID NO: 53090 - DNA, 5 bp, Homo sapiens
  chr9:16154666-16154671
  hyper
ctgag

SEQ ID NO: 53091 - DNA, 26 bp, Homo sapiens
  chr9:16154745-16154771
  hyper
cggcccggggacggcagggggcggct

SEQ ID NO: 53092 - DNA, 52 bp, Homo sapiens; identical to SEQ ID NO: 32385
  chr9:16870273-16870325
  hyper

SEQ ID NO: 53093 - DNA, 463 bp, Homo sapiens; identical to SEQ ID NO: 32386
  chr9:16870661-16871124
  hyper

SEQ ID NO: 53094 - DNA, 236 bp, Homo sapiens; identical to SEQ ID NO: 32387
  chr9:16871415-16871651
  hyper

SEQ ID NO: 53095 - DNA, 30 bp, Homo sapiens; identical to SEQ ID NO: 32388
  chr9:16872003-16872033
  hyper

SEQ ID NO: 53096 - DNA, 341 bp, Homo sapiens; identical to SEQ ID NO: 32389
  chr9:17135041-17135382
  hyper

SEQ ID NO: 53097 - DNA, 87 bp, Homo sapiens; identical to SEQ ID NO: 32390
  chr9:17135632-17135719
  hyper

SEQ ID NO: 53098 - DNA, 586 bp, Homo sapiens; identical to SEQ ID NO: 32391
  chr9:17578706-17579292
  hyper

SEQ ID NO: 53099 - DNA, 297 bp, Homo sapiens; identical to SEQ ID NO: 32392
  chr9:17579402-17579699
  hyper

SEQ ID NO: 53100 - DNA, 91 bp, Homo sapiens; identical to SEQ ID NO: 32393
  chr9:17906058-17906149
  hyper

SEQ ID NO: 53101 - DNA, 22 bp, Homo sapiens
  chr9:17907061-17907083
  hyper
caagtggcgcggggttggggct

SEQ ID NO: 53102 - DNA, 25 bp, Homo sapiens
  chr9:17907346-17907371
  hyper
actcctccacacttccgcccttctg

SEQ ID NO: 53103 - DNA, 29 bp, Homo sapiens
  chr9:17907472-17907501
  hyper
ccctggtgcctccgcggtctagaggtggc

SEQ ID NO: 53104 - DNA, 130 bp, Homo sapiens; identical to SEQ ID NO: 32399
  chr9:19127231-19127361
  hyper

SEQ ID NO: 53105 - DNA, 547 bp, Homo sapiens; identical to SEQ ID NO: 32400
  chr9:19788355-19788902
  hyper

SEQ ID NO: 53106 - DNA, 173 bp, Homo sapiens
  chr9:19788934-19789107
  hyper
cgctccagtccgccggccctccgcctacccgctctgaggcccgggctctggctcgcactggctgccgctctcgccagccgggctgggttcgggaggagactgagccgctgtgagcccggcgctccgagtctggcgctgcccggcccccgccggcccctccctctgggctgtgc

SEQ ID NO: 53107 - DNA, 322 bp, Homo sapiens
  chr9:21031412-21031734
  hyper
aggggtgcctgggcacggtagcgctgcgccttgctggcgggcggggggtgccgcccgcccgcccgccgcagaggggagctcccgcctccaggccctccacccgcgccccctcccctcgggattcggccgagcgccctacctgggctgcagccaggcgggcagcgccaagggccccatgggccgccgccgccagggcttccagcgcggtccaggaaggagtaccggggaggaggcaggggcggccccgcggctgggcgcggaagggcggggcctctccacactcagcagtttacaaaaagaaaaagcccgaggtcgtgcgttg

SEQ ID NO: 53108 - DNA, 315 bp, Homo sapiens; identical to SEQ ID NO: 32403
  chr9:21395999-21396314
  hyper

SEQ ID NO: 53109 - DNA, 46 bp, Homo sapiens
  chr9:21402571-21402617
  hyper
cgccccagggtccagcgtgtccccttccccaagacgtccccgccct

SEQ ID NO: 53110 - DNA, 125 bp, Homo sapiens; identical to SEQ ID NO: 20276
  chr9:21403021-21403146
  hyper

SEQ ID NO: 53111 - DNA, 134 bp, Homo sapiens; identical to SEQ ID NO: 32405
  chr9:21559984-21560118
  hyper

SEQ ID NO: 53112 - DNA, 114 bp, Homo sapiens
  chr9:21964943-21965057
  hyper
tgagacacgtgagatctggaaggaggtggaggtgaagaccctcccacctggcctgcatccagagtacttggggtgtggcactggcgtgggccccaggaaggatcccagccagtt

SEQ ID NO: 53113 - DNA, 3 bp, Homo sapiens
  chr9:21965757-21965760
  hyper
gaa

SEQ ID NO: 53114 - DNA, 35 bp, Homo sapiens; identical to SEQ ID NO: 32408
  chr9:21967367-21967402
  hyper

SEQ ID NO: 53115 - DNA, 220 bp, Homo sapiens
  chr9:21968475-21968695
  hyper
ggtccacccggcggagggcagagaaagcgcgaccgcgcggcccgcagggttgcaagaagaaaacgagtgttatataatgagtctcagtggttgctcacaatgccaggcgcgaaggcgtgaagatgtggcctttcccttcccgcatccccaggcatcttttgcacctggtgcggagtgagccagccagcttgcgataaccaaagggcgcctcaggctctgg

SEQ ID NO: 53116 - DNA, 92 bp, Homo sapiens; identical to SEQ ID NO: 32411
  chr9:21969169-21969261
  hyper

SEQ ID NO: 53117 - DNA, 141 bp, Homo sapiens; identical to SEQ ID NO: 32412
  chr9:21969747-21969888
  hyper

SEQ ID NO: 53118 - DNA, 19 bp, Homo sapiens
  chr9:21970940-21970959
  hyper
gcctctggtgccccccgca

SEQ ID NO: 53119 - DNA, 262 bp, Homo sapiens; identical to SEQ ID NO: 20280
  chr9:21974237-21974499
  hyper

SEQ ID NO: 53120 - DNA, 323 bp, Homo sapiens; identical to SEQ ID NO: 20281
  chr9:21974794-21975117
  hyper

SEQ ID NO: 53121 - DNA, 446 bp, Homo sapiens; identical to SEQ ID NO: 32415
  chr9:21975190-21975636
  hyper

SEQ ID NO: 53122 - DNA, 32 bp, Homo sapiens; identical to SEQ ID NO: 32416
  chr9:22011013-22011045
  hyper

SEQ ID NO: 53123 - DNA, 351 bp, Homo sapiens; identical to SEQ ID NO: 32417
  chr9:22446925-22447276
  hyper

SEQ ID NO: 53124 - DNA, 122 bp, Homo sapiens; identical to SEQ ID NO: 32418
  chr9:23821297-23821419
  hyper

SEQ ID NO: 53125 - DNA, 30 bp, Homo sapiens; identical to SEQ ID NO: 32419
  chr9:23822239-23822269
  hyper

SEQ ID NO: 53126 - DNA, 33 bp, Homo sapiens
  chr9:23822606-23822639
  hyper
acccaccccggagccacgcggctggagcacgtt

SEQ ID NO: 53127 - DNA, 549 bp, Homo sapiens
  chr9:23824012-23824561
  hyper
ggaagggacagaatccgtgcatttcggggagaaagtacagagacctccatccctgtccagcagtgttaacagtaaatactaaatggttggctatttctctcaccctcgccataataaaaccagacctgcagccggtaattacgagaaaatacccagtctcgccatcagttttgctaaccggtacttgaaaatgggaaacggggaacttatccaacctccaatttgtcacagttgtatagctttcgtattaattctgtacagacgtgaaataggtgggtacgtagcaacgtgctgggcataaattaagcaacaatggccacgcgaggtctcgtccgccgcggagctccagtggtgggcactgccaccttgccatccctagcccccaccgcccttcgcagagtccagtccgggaggctgacggtgcgctggctttcccagccggtagagtgggtggggtgaggagcaacgagacgttaaccccagccggctttgtagctttttcccatcctctgcctctcgagcaccacatgagcgctctcacgcacacac

SEQ ID NO: 53128 - DNA, 61 bp, Homo sapiens; identical to SEQ ID NO: 32422
  chr9:23826326-23826387
  hyper

SEQ ID NO: 53129 - DNA, 40 bp, Homo sapiens; identical to SEQ ID NO: 32423
  chr9:23829874-23829914
  hyper

SEQ ID NO: 53130 - DNA, 30 bp, Homo sapiens; identical to SEQ ID NO: 32424
  chr9:23830739-23830769
  hyper

SEQ ID NO: 53131 - DNA, 15 bp, Homo sapiens
  chr9:23831450-23831465
  hyper
cgggccacggtgaca

SEQ ID NO: 53132 - DNA, 30 bp, Homo sapiens; identical to SEQ ID NO: 32427
  chr9:23831747-23831777
  hyper

SEQ ID NO: 53133 - DNA, 38 bp, Homo sapiens; identical to SEQ ID NO: 32428
  chr9:23849841-23849879
  hyper

SEQ ID NO: 53134 - DNA, 45 bp, Homo sapiens; identical to SEQ ID NO: 32429
  chr9:23850410-23850455
  hyper

SEQ ID NO: 53135 - DNA, 30 bp, Homo sapiens; identical to SEQ ID NO: 32430
  chr9:23850946-23850976
  hyper

SEQ ID NO: 53136 - DNA, 30 bp, Homo sapiens; identical to SEQ ID NO: 32431
  chr9:25678053-25678083
  hyper

SEQ ID NO: 53137 - DNA, 131 bp, Homo sapiens
  chr9:29212039-29212170
  hyper
cagagaaccaagaggcgaaaggagagtggaggagaaagagggcattacctcccggggctgccctcagggtgcgggtcaggatctcatccccgaagtggctccagttcaaggcacagctttccagagctcag

SEQ ID NO: 53138 - DNA, 488 bp, Homo sapiens
  chr9:29212294-29212782
  hyper
ctcaccccgccgcctcctggcgcccccacacccacccgctccgcggcgcccgctgggagcctctagcggaggcgaagggaacagcaggcgacctgcggcgcccaggttccgacgccggttgcagggagccggccaagcggcagcgtgggcttcgcgcgcccccgagtccgcaggccgggtgccgccgccgcccccacctgcccacctgcgccaggctcacctgccaccgcgtcctagttgcgttcaccggtgcccacagctctctatggcaattgggggtgggtctgcggtgctaataaaaatttaaaaaaaaaacctctctggtaaaaaaacgaaaacccaaaacccaaatccacgctgtatatcaacctccacagagaacccagtccgaaatcgttttccaataggtttcagaaagtgtgaggacaggacactcctctggcttcctgcctcgcagctgggcagcgccgcaccggctactccctgac

SEQ ID NO: 53139 - DNA, 46 bp, Homo sapiens; identical to SEQ ID NO: 32434
  chr9:29213181-29213227
  hyper

SEQ ID NO: 53140 - DNA, 32 bp, Homo sapiens
  chr9:29213476-29213508
  hyper
tgggcgggcggcgggcggcggcgccaggtgag

SEQ ID NO: 53141 - DNA, 379 bp, Homo sapiens
  chr9:29213651-29214030
  hyper
ccgcggcccccggccagtggcgagcgaaaagtcgggagtcctgaggaggggtaggggttccaaggatgctgatgacagaaagagtcaatcaatcctcactagttagcggattgccggcaggcagttcctcgccgcacgccgttaagtccgttgggccacctctccgttctctgccctgtctggcatttcaactccctagctcttttcttgaagccagttacaccccctcgacacccagcgagaggccaccagactaaagatgagccccgttcccatcgccaccctccaggggccacctccgccccttctgtagtggagaattgaagtggctgcagcagctctcctgggagctgaggggctccccgaggtccttcgaata

SEQ ID NO: 53142 - DNA, 216 bp, Homo sapiens
  chr9:29214144-29214360
  hyper
aaaatgaatttcttagggaattgtagtgcctagcttttggaactgggttaatttaggtgctacgcttatattgtaaactggacggtagcaggtgaacggctcagctggagaaaggggagggattaggagtctggagacccaacccctttagcagccatttccaaggttttgcaccaggagtagctgtccgggtctctggctagctcctgtcccaac

SEQ ID NO: 53143 - DNA, 39 bp, Homo sapiens
  chr9:29214430-29214469
  hyper
agacttcgctctcagaagcgcccccgtgtcatccacaac

SEQ ID NO: 53144 - DNA, 48 bp, Homo sapiens
  chr9:29215086-29215134
  hyper
cagggatgaacctgctttggattctgtttgagccgactcagtgcagag

SEQ ID NO: 53145 - DNA, 100 bp, Homo sapiens; identical to SEQ ID NO: 20290
  chr9:32783121-32783221
  hyper

SEQ ID NO: 53146 - DNA, 87 bp, Homo sapiens; identical to SEQ ID NO: 20291
  chr9:32783259-32783346
  hyper

SEQ ID NO: 53147 - DNA, 79 bp, Homo sapiens
  chr9:32783657-32783736
  hyper
cacctccccgatgcagagtccgtgggggaaaccaggctttcctcccagaaccaagggagcgagccgagggggcagctgc

SEQ ID NO: 53148 - DNA, 300 bp, Homo sapiens; identical to SEQ ID NO: 32441
  chr9:33523982-33524282
  hyper

SEQ ID NO: 53149 - DNA, 267 bp, Homo sapiens
  chr9:33524342-33524609
  hyper
cgggtttgggggtgcatcttggatttaggggtggatcgctgggtggggagggggatctcgaatttggagctgggtgggggtggaaaggccacgaggagccgcggcgtctcaggagcgggtggtgggcatctgagaagtcgccaccatgaggaagctcctcagttttgggagacgcctgggccaggcgctcctgagctccatggaccaagagtatgcgggtcgggggtaccacattcgggactgggaactgcggaagatccacagggc

SEQ ID NO: 53150 - DNA, 154 bp, Homo sapiens
  chr9:33524687-33524841
  hyper
agacaggtagcgggggctcagccctcggtgggagggggcccccaggcccggtttccccgcaccgcctgaggcggggtcgtcggagttcgccgggaccctgggagccgcggagccaaatggagcctcagctgctttccatcgctgggaatttccc

SEQ ID NO: 53151 - DNA, 559 bp, Homo sapiens; identical to SEQ ID NO: 20295
  chr9:33676801-33677360
  hyper

SEQ ID NO: 53152 - DNA, 42 bp, Homo sapiens
  chr9:34589020-34589062
  hyper
agaaaaccatggggacgccgaccgacacacacatgcacacac

SEQ ID NO: 53153 - DNA, 147 bp, Homo sapiens
  chr9:34589156-34589303
  hyper
atttctgcccgagaaagaagccacctttgggcgcgcaaaggccactacgaacctccccaaacccaggaatttttccagaccccgcgcgtgcagctgaggggtggggagaacagggacactaggacaaaccgccggagccacctccct

SEQ ID NO: 53154 - DNA, 152 bp, Homo sapiens; identical to SEQ ID NO: 32445
  chr9:34590071-34590223
  hyper

SEQ ID NO: 53155 - DNA, 177 bp, Homo sapiens; identical to SEQ ID NO: 32446
  chr9:34591455-34591632
  hyper

SEQ ID NO: 53156 - DNA, 148 bp, Homo sapiens; identical to SEQ ID NO: 32447
  chr9:34665047-34665195
  hyper

SEQ ID NO: 53157 - DNA, 187 bp, Homo sapiens; identical to SEQ ID NO: 32448
  chr9:34701358-34701545
  hyper

SEQ ID NO: 53158 - DNA, 135 bp, Homo sapiens; identical to SEQ ID NO: 32449
  chr9:35162260-35162395
  hyper

SEQ ID NO: 53159 - DNA, 369 bp, Homo sapiens
  chr9:35616922-35617291
  hyper
gaaggaaatatcagacggagagaggggaaggggggcaggtaggtgaattgggaccatccgcaggggggcggtgcacgtcggattcaggcgcaccggatgaaggtgaatgtggcacggcagcccgggcgtcggaaggactgcgcccgggtttatcccggaaggagctgcaccccgcggggcccagcgccatccgcagccgggacaggcgcgagcacttggccccgcggctgccccgcacaggcacactcacaggggagaatccgcccgacagctggtgacgtcacggctctccaggacgcagttggctgctccgacttgaccgctgtcgaggggagcatccagtgtgagaccggaagccccgagtgttgc

SEQ ID NO: 53160 - DNA, 45 bp, Homo sapiens; identical to SEQ ID NO: 20298
  chr9:35675494-35675539
  hyper

SEQ ID NO: 53161 - DNA, 65 bp, Homo sapiens; identical to SEQ ID NO: 9890
  chr9:35728859-35728924
  hyper

SEQ ID NO: 53162 - DNA, 285 bp, Homo sapiens
  chr9:36036783-36037068
  hyper
caaagagccctggtacggggcacgttcccgcccccgggaggttttggaaacactgtgaggcagggggcggggcttgagcgggccgcagccagtcaccaaagggccgggcgctgggggcggggcctcgcgcgagcggcggcggtagcggcggcagcggctgcggccaagctgggtccgagcatcccgcggctctggagccgcccggcccggacatggcgaccgtccgggcctctctgcgaggtgcgctgctccttctgctggccgtggcgggggtcgcggaggtgg

SEQ ID NO: 53163 - DNA, 497 bp, Homo sapiens
  chr9:36037098-36037595
  hyper
agtaacctccagagcaacggttcgaagctgtcgggagcggccgccacagcgctccaagatggcgcggggcagggggcgggggtgcgcgcgacccccagaccctgcccacgtccggcgaccccgggaccccaggtctcagcgctccagaggctggtgccgaggcggggcgagtgaggaactctctccgccccaagatcttctgggcggtgactcgggtttgaggccttggtctgtcacccaccgacacgggccccctcttcggcactgaccccttcgcttgcctctgctgcttgtcagaaaagggtgcgatgcccccgcccaggatcgtcgcgaggtttagatgggatttcggatacgcagccgccctaccgcggccctagttagttattgttacttgttacttgacccgcacttggttcataacgaccttggtggcggtgagcactgacggtccccacagcccgcgtggtgggtcctggactcgggcaggagacatt

SEQ ID NO: 53164 - DNA, 151 bp, Homo sapiens; identical to SEQ ID NO: 32455
  chr9:36257863-36258014
  hyper

SEQ ID NO: 53165 - DNA, 364 bp, Homo sapiens; identical to SEQ ID NO: 32456
  chr9:36258282-36258646
  hyper

SEQ ID NO: 53166 - DNA, 321 bp, Homo sapiens; identical to SEQ ID NO: 9893
  chr9:36258697-36259018
  hyper

SEQ ID NO: 53167 - DNA, 20 bp, Homo sapiens
  chr9:36739980-36740000
  hyper
tgctccggagccagggtaca

SEQ ID NO: 53168 - DNA, 35 bp, Homo sapiens
  chr9:37003077-37003112
  hyper
ctatccatggatgcaggaagcaggggatggagagg

SEQ ID NO: 53169 - DNA, 258 bp, Homo sapiens; identical to SEQ ID NO: 20304
  chr9:37025306-37025564
  hyper

SEQ ID NO: 53170 - DNA, 363 bp, Homo sapiens; identical to SEQ ID NO: 20305
  chr9:37025783-37026146
  hyper

SEQ ID NO: 53171 - DNA, 209 bp, Homo sapiens; identical to SEQ ID NO: 20306
  chr9:37026622-37026831
  hyper

SEQ ID NO: 53172 - DNA, 388 bp, Homo sapiens; identical to SEQ ID NO: 20307
  chr9:37027412-37027800
  hyper

SEQ ID NO: 53173 - DNA, 198 bp, Homo sapiens
  chr9:37027829-37028027
  hyper
gcagcccacaggctccgcctgattagcggacacctgggcaatgggagagaatggggggcggggcccaggcggcggcgccacgttcattgacaaacgcgctggactaaggcctagtggatcgcggctgtggggaggggaaaggggcccacgcagtgcctggagagtcccgctgcgggtcccacgcgggctggacctccc

SEQ ID NO: 53174 - DNA, 40 bp, Homo sapiens; identical to SEQ ID NO: 32465
  chr9:37028470-37028510
  hyper

SEQ ID NO: 53175 - DNA, 186 bp, Homo sapiens
  chr9:37029348-37029534
  hyper
cagtagacaagtttccggcgctgacacccgtccccaccccccaccagggcacagctgcggaaaacggccccaggcgggactctggggacccaggaggctgcagtgcgcgccggggtggagtggcggcgttatctcttctttgtctggaaccccgcctgtccggatcttcccctttcacccccggcc

SEQ ID NO: 53176 - DNA, 122 bp, Homo sapiens
  chr9:37030655-37030777
  hyper
agttttagtactgaaagacagcccattgagaataatgtgtgagaagccagagacctcgtttcactggggacacaccccctcccggcttccctttccacgcctcccagcgcactgcattaccg

SEQ ID NO: 53177 - DNA, 369 bp, Homo sapiens; identical to SEQ ID NO: 20311
  chr9:37034247-37034616
  hyper

SEQ ID NO: 53178 - DNA, 216 bp, Homo sapiens
  chr9:37034731-37034947
  hyper
gaagaaattaactgctcggccaagcaggtgcttttgaaaggggttgcaaaggctggcagtgttgccaggcaccgaggcgacgttccggtttactccgattcacccctagggcggcgcccgaccccagggttcccagccatccaacccccaccccaatttgttggggtcctgactattgctgggcccctgaccctagggcagcgccagatccctaaa

SEQ ID NO: 53179 - DNA, 86 bp, Homo sapiens
  chr9:37035734-37035820
  hyper
ggccatctccgagtgctcgactctttccctccgcagcccagccccagcccaggcttcccgccctcccgcctcgcccgcgccgggag

SEQ ID NO: 53180 - DNA, 298 bp, Homo sapiens
  chr9:37036127-37036425
  hyper
tgtctttttgtgtgtcgtttgtaaggcttttccttctccgcggtgtttagatgtgttttgatttggtgtgagtgggtgtcgtctgtgtgtgtgttgccttagggaatttcgtgttgtgtgtgttttgtttccttcgatttgaattttatttttttgaactgtacgttttggtgggggatcgggttatattttcatgtgttgtctttagtttttgtgtttgtgagatgcgctggtgagagtttgcgtgtgtattttggcttttgtggggctttgggattagggaggggacatcagccgc

SEQ ID NO: 53181 - DNA, 483 bp, Homo sapiens
  chr9:37036647-37037130
  hyper
cagccgccgtccccttgcccaccctctcccctgtgagtcggtctccccttgcgcctggccagcatgcttcggaccgtccggactcccgcagcgttggcccaaggggcggctcccctcggcggagcaggtgacgaaccacttcggaggacacggaattgacactgcggccctagagatacgggacaaggggccagaacgcggggagtctaggctcagatcggagtcgggatcccgggaaaatcccccatctcccttgcccgcagccctagaatcccagaaacccaactccgcgcagctttcggtttggagagcccgccctggtttgcaagcacagatacatgtgcccacacccgaacacacgcagacaccgccagagagcgagacagcgagcgggcgcctccgtagcagcggcctgcggggcggaaccggagctggcgccgcctcaaggggaaaccgaactgtagtgaccggaaatgtccccag

SEQ ID NO: 53182 - DNA, 241 bp, Homo sapiens
  chr9:37037430-37037671
  hyper
ggaaaagaaaagagacgcagaaggggttggcctaggcacgctgcgagctgccctccagctaagacgctgcgggcaagggagggggaggccgacatcgccaggcgaggggccaaggtcgggctctttaactcagccaggaaacatcgttgggggctccagggctcgtggagcccgaactggggctcatttccggcccgatgcccctcttccccagacccctagcccggaatccagcaaaggc

SEQ ID NO: 53183 - DNA, 88 bp, Homo sapiens; identical to SEQ ID NO: 32473
  chr9:37576058-37576146
  hyper

SEQ ID NO: 53184 - DNA, 290 bp, Homo sapiens; identical to SEQ ID NO: 32474
  chr9:38424315-38424605
  hyper

SEQ ID NO: 53185 - DNA, 124 bp, Homo sapiens; identical to SEQ ID NO: 32475
  chr9:38620225-38620349
  hyper

SEQ ID NO: 53186 - DNA, 257 bp, Homo sapiens; identical to SEQ ID NO: 32476
  chr9:38620735-38620992
  hyper

SEQ ID NO: 53187 - DNA, 508 bp, Homo sapiens; identical to SEQ ID NO: 32477
  chr9:38621429-38621937
  hyper

SEQ ID NO: 53188 - DNA, 55 bp, Homo sapiens; identical to SEQ ID NO: 32478
  chr9:38622559-38622614
  hyper

SEQ ID NO: 53189 - DNA, 72 bp, Homo sapiens; identical to SEQ ID NO: 32479
  chr9:66455725-66455797
  hyper

SEQ ID NO: 53190 - DNA, 300 bp, Homo sapiens; identical to SEQ ID NO: 32480
  chr9:66458276-66458576
  hyper

SEQ ID NO: 53191 - DNA, 180 bp, Homo sapiens; identical to SEQ ID NO: 32481
  chr9:66494102-66494282
  hyper

SEQ ID NO: 53192 - DNA, 30 bp, Homo sapiens; identical to SEQ ID NO: 32484
  chr9:71939754-71939784
  hyper

SEQ ID NO: 53193 - DNA, 87 bp, Homo sapiens; identical to SEQ ID NO: 32485
  chr9:74061672-74061759
  hyper

SEQ ID NO: 53194 - DNA, 51 bp, Homo sapiens; identical to SEQ ID NO: 20322
  chr9:74061787-74061838
  hyper

SEQ ID NO: 53195 - DNA, 40 bp, Homo sapiens
  chr9:74062070-74062110
  hyper
atgcgccgcagggtagcgctcccagcggtcacctcaccct

SEQ ID NO: 53196 - DNA, 250 bp, Homo sapiens
  chr9:74764297-74764547
  hyper
gagccagcccctgggcgcggcctgcagggtaccggcaaccgcccgggtaagcgggggcaggacaaggccggagcctgtgtccgcccggcagccgcccgcagctgcagagagtcccgctgcgtctccgccgcgtgcgccctcctcgaccagcagacccgcgctgcgctccgccgctgacatgtgtgccgctcagatgccgcccctggcgcacatcttccgagggacgttcgtccactccacctggacctgc

SEQ ID NO: 53197 - DNA, 215 bp, Homo sapiens
  chr9:74764648-74764863
  hyper
aaggaacctggcgcggtgcttcgcgtagcccggggttcgctcggtgcgcagtgagcgccgcggctccggagttgaacttgagtctttggctcttgggcaacgcagagagaaccctggcgctaggttcgtgggctggctggggagttcccagaagtcgggagcagtggcgtgctaacgccacaactggctcgacagcagtccgggctgcggtagag

SEQ ID NO: 53198 - DNA, 577 bp, Homo sapiens; identical to SEQ ID NO: 32488
  chr9:77111763-77112340
  hyper

SEQ ID NO: 53199 - DNA, 167 bp, Homo sapiens; identical to SEQ ID NO: 32489
  chr9:77112729-77112896
  hyper

SEQ ID NO: 53200 - DNA, 96 bp, Homo sapiens; identical to SEQ ID NO: 20327
  chr9:77112897-77112993
  hyper

SEQ ID NO: 53201 - DNA, 237 bp, Homo sapiens
  chr9:77113825-77114062
  hyper
gactctgggcctctcgaagggctggagggtgggtttcggggagtcacttggtctcctctcctgccttgccggagacctcaggtttccttcgcgctgtgctcggcctttcttcactcttttactgaagagccaggcgggtgtccgcttgacatggggatctgtgcaagctctgggcacccacccccactcccagtccctcttcctggccacacagcggttaatcgggggctcttctct

SEQ ID NO: 53202 - DNA, 301 bp, Homo sapiens
  chr9:77114444-77114745
  hyper
atggtcttgattggccggctcgctgggagtggggcacccgtgtgtgtgcgcgctggctccagctgattgtcccggttgggggttggttacacgctccactgtctaaattctttcaagaaactatacttgggcaattggagagtagagaaccttggcttagtaagagacgcccggtcttttgtttttctttttctagcccatctcaccatcccatccattctttcggtttcccccgtcccagtccagagctgccagttcgtccctccccttcttcccttctaactttccccctgtggctggg

SEQ ID NO: 53203 - DNA, 18 bp, Homo sapiens
  chr9:77114851-77114869
  hyper
gcgcggggtggggatggg

SEQ ID NO: 53204 - DNA, 209 bp, Homo sapiens; identical to SEQ ID NO: 32495
  chr9:77502024-77502233
  hyper

SEQ ID NO: 53205 - DNA, 96 bp, Homo sapiens; identical to SEQ ID NO: 32496
  chr9:77502613-77502709
  hyper

SEQ ID NO: 53206 - DNA, 20 bp, Homo sapiens
  chr9:78506416-78506436
  hyper
atgctctgtctcctgcgcgc

SEQ ID NO: 53207 - DNA, 47 bp, Homo sapiens
  chr9:79627370-79627417
  hyper
ggaggccaacagccgcttaggagagcccgaaacgagcaggctggagg

SEQ ID NO: 53208 - DNA, 35 bp, Homo sapiens; identical to SEQ ID NO: 9925
  chr9:79628238-79628273
  hyper

SEQ ID NO: 53209 - DNA, 230 bp, Homo sapiens; identical to SEQ ID NO: 32500
  chr9:79628711-79628941
  hyper

SEQ ID NO: 53210 - DNA, 176 bp, Homo sapiens
  chr9:79631016-79631192
  hyper
gtcggaattaacctccggggaagtaggggaagaggagagcgcgcccccctccccaccgcggccccagctctgcaccccggcccagtgccgcgcttggaatcccccaggatcctccgcggcggccgcagcccgccactctccaaaacagacacgcgacccgagctccctgtctgcgc

SEQ ID NO: 53211 - DNA, 220 bp, Homo sapiens
  chr9:79631335-79631555
  hyper
ccaggttgcgtggaacctggctcgccgaggccgaagacactggccaagcccctggcgtcccctggcgctgaacctgaggttgtggcggcgggtctgcgggctgtagcgagctcacccagtgagggcctggctcattttttgtgctcagggttcgcgttatgcgcccaagatttgtcccgggagtccctgaagggcccctcccctcgatcggttcccagga

SEQ ID NO: 53212 - DNA, 37 bp, Homo sapiens
  chr9:79632823-79632860
  hyper
ccccagctcagacatcgccatcccagagaaacctcat

SEQ ID NO: 53213 - DNA, 147 bp, Homo sapiens
  chr9:79633250-79633397
  hyper
gtaaaaggaagggggcggaagagggagatgccagagagaagagaagcaagaaggcagtgtcctgttccccctccaccgtgcttggtggcccgggtggggcgcagctgcgggaaatgcacccggagctgtgccccctcccggcgaaca

SEQ ID NO: 53214 - DNA, 266 bp, Homo sapiens
  chr9:79633904-79634170
  hyper
cggcgacgctgcgagcctcggagaaaagagaggcgccctagaagccaatcttctctctccttaccctgatttttcactccaggaaaaggagaactccagcgcggtctggctaagtgcctggccaggggcctgcgtccagggcactggaagtcctgctgtcactggcctccaggacagcaggcgcaaactcagatttaaagggccagagtctctactgcccagaccttcctcccagccatcttggtctgggtttccctcggacctag

SEQ ID NO: 53215 - DNA, 80 bp, Homo sapiens
  chr9:79637274-79637354
  hyper
aagcttctctctggatatctatgctagccccgtgtgaaggtgtttcagttctccaaggatgaggccgtggtttgagtgcc

SEQ ID NO: 53216 - DNA, 151 bp, Homo sapiens; identical to SEQ ID NO: 32514
  chr9:80263366-80263517
  hyper

SEQ ID NO: 53217 - DNA, 41 bp, Homo sapiens; identical to SEQ ID NO: 32515
  chr9:80646329-80646370
  hyper

SEQ ID NO: 53218 - DNA, 30 bp, Homo sapiens; identical to SEQ ID NO: 32516
  chr9:82185353-82185383
  hyper

SEQ ID NO: 53219 - DNA, 40 bp, Homo sapiens; identical to SEQ ID NO: 32517
  chr9:82185643-82185683
  hyper

SEQ ID NO: 53220 - DNA, 348 bp, Homo sapiens
  chr9:86152417-86152765
  hyper
ggcctctctcactctggggaaacttcgccaccgccccacgcggagaactaaagaccaccggcggagggtgagggggaccgacacggagcggaaagcaggttccgggactgagggcgtctccggagcctgggcgcgggagacagaaatgagtgaacccagctgatgcatgccttctccacgtggaagaagggaggaaataccagtgggcgacatgcaggtgcccctctcagccctcggagctcccatctcctggcggagtagggcccagaggggccagagtccctccggaggcagctgccccgcgcccctagcccgggcgcagtgagacgcgcgcgcagggtgcacgcg

SEQ ID NO: 53221 - DNA, 35 bp, Homo sapiens; identical to SEQ ID NO: 32519
  chr9:86153332-86153367
  hyper

SEQ ID NO: 53222 - DNA, 161 bp, Homo sapiens
  chr9:86755952-86756113
  hyper
ggaagattttgaaaacctgtatttatccgcccttcgcaaaaaatcagcttctctagggcgagcctttccaaccttttccgtcagggcacacagaaaatgacctgatttcaagagcatttggggtaaaactggaggggatttcagagcgtctctgtgaggtt

SEQ ID NO: 53223 - DNA, 628 bp, Homo sapiens
  chr9:87283038-87283666
  hyper
ttggcctagatccgagcattcactctaacgttcggtttcttgatccttcccatccccaaactctgcgggtagatcagtgactattactatattttgaacgagactccaacccattgctctctcgagagagaaggattgcccgcctttttcccccgggcaggagctcggcgaggccaggagagccgcgcaccggccgggcagggacgcgcaggcgtcgggcgccgctggttgcgcatctggcgccagagcgcgcccccagcgctgtgcccgccgcgacccgggccatgggctggtgctccggagcgtgccgggcgctctctccccgcgcgggggcaccagagccctcggaagtgtcaggcactgcggtgtattttccccgttctcttttaaatgactgcggaaaaacagattccgagccgcaaaagggaagacggattctcagacaaggcttgcaaatgccccgcagccatcatttaactgcacccgcagaatagttacggtttgtcacccgaccctcccggatcgcctaatttgtccctagtgagaccccgaggctctgcccgcgcctggcttcttcgtagctggatgcatatcgtgctccgggcagcgcgggcgcagggcacgcgtt

SEQ ID NO: 53224 - DNA, 30 bp, Homo sapiens; identical to SEQ ID NO: 9945
  chr9:87284009-87284039
  hyper

SEQ ID NO: 53225 - DNA, 151 bp, Homo sapiens; identical to SEQ ID NO: 20339
  chr9:87284555-87284706
  hyper

SEQ ID NO: 53226 - DNA, 196 bp, Homo sapiens; identical to SEQ ID NO: 20340
  chr9:87284798-87284994
  hyper

SEQ ID NO: 53227 - DNA, 61 bp, Homo sapiens; identical to SEQ ID NO: 20341
  chr9:87285472-87285533
  hyper

SEQ ID NO: 53228 - DNA, 85 bp, Homo sapiens; identical to SEQ ID NO: 32526
  chr9:87285748-87285833
  hyper

SEQ ID NO: 53229 - DNA, 116 bp, Homo sapiens; identical to SEQ ID NO: 20342
  chr9:88137998-88138114
  hyper

SEQ ID NO: 53230 - DNA, 66 bp, Homo sapiens
  chr9:89560694-89560760
  hyper
cgagtggggtccaggcgccccggggcgccaagcggccgccgccgccgctgctcctgcgcccaggcc

SEQ ID NO: 53231 - DNA, 236 bp, Homo sapiens
  chr9:89560827-89561063
  hyper
gccgtcgtcgtcgtccagcggctgctcaccacccgcgcccccggtgcgctgctcgtcatcgtagtcctcatcgtagtagtcgtccaggcccccgtccgagccgctgctgccggggccgttgcccagctcggcgccgaagcacaggcgggccatgttctccttgaccgactcgcagatgggccgctcgaggccgtcgcacacgcagtcgttgagcagcgccgccttgggcatagcca

SEQ ID NO: 53232 - DNA, 65 bp, Homo sapiens; identical to SEQ ID NO: 32530
  chr9:89763321-89763386
  hyper

SEQ ID NO: 53233 - DNA, 53 bp, Homo sapiens; identical to SEQ ID NO: 32531
  chr9:90112803-90112856
  hyper

SEQ ID NO: 53234 - DNA, 2 bp, Homo sapiens
  chr9:90113746-90113748
  hyper
tg

SEQ ID NO: 53235 - DNA, 93 bp, Homo sapiens; identical to SEQ ID NO: 32533
  chr9:90589194-90589287
  hyper

SEQ ID NO: 53236 - DNA, 108 bp, Homo sapiens; identical to SEQ ID NO: 32534
  chr9:91149171-91149279
  hyper

SEQ ID NO: 53237 - DNA, 52 bp, Homo sapiens; identical to SEQ ID NO: 20346
  chr9:91150170-91150222
  hyper

SEQ ID NO: 53238 - DNA, 25 bp, Homo sapiens
  chr9:91150335-91150360
  hyper
tgcgtgtctgcgccatggttgacat

SEQ ID NO: 53239 - DNA, 40 bp, Homo sapiens; identical to SEQ ID NO: 32536
  chr9:91150621-91150661
  hyper

SEQ ID NO: 53240 - DNA, 39 bp, Homo sapiens
  chr9:91605965-91606004
  hyper
gcccaaacaaaccctcgctgtcagggcgacaggcgcccg

SEQ ID NO: 53241 - DNA, 305 bp, Homo sapiens
  chr9:91606058-91606363
  hyper
cgcccggtttctgcacctggagctcgcccgatgaggacaaggtctggaggccggcctgggaacaggggccgaagggcgagccggaccctaggggattggtagggtcggggagaaggggtccaggctaggggcgggcggggcgcacggagaccaggcggcttgagcgggaggtggggagctggaggagtgccgggttcgcgggcgggggacggggagaggggggcggggagaggggcgggagtcgggggcggcgaggggaggggcggagcgcgggtcccgccccggcgggccgctggaaaagttta

SEQ ID NO: 53242 - DNA, 30 bp, Homo sapiens; identical to SEQ ID NO: 32538
  chr9:91606806-91606836
  hyper

SEQ ID NO: 53243 - DNA, 61 bp, Homo sapiens
  chr9:91792387-91792448
  hyper
agcacagcatttggcctgctctgcaaggagctgggaattcttgctgcggggggcaacaaga

SEQ ID NO: 53244 - DNA, 179 bp, Homo sapiens
  chr9:91792907-91793086
  hyper
cacgtaggtgactccgggccccagcacctggtcgctggcgtgcggcgccccccgagggggcctgggcagcggctcgtcgccgggccggcccttcctggcggcgctcatggccggggcgcggggcgccgagggcgcactgccgtccggggcggccaggctgggcgcgctgcagctgcccg

SEQ ID NO: 53245 - DNA, 73 bp, Homo sapiens
  chr9:91793526-91793599
  hyper
aggatggtgccctcccaccgttaaaagccagcacagcggcggccgcgcagccccggcccgggagaccgctgct

SEQ ID NO: 53246 - DNA, 193 bp, Homo sapiens; identical to SEQ ID NO: 32542
  chr9:91849616-91849809
  hyper

SEQ ID NO: 53247 - DNA, 206 bp, Homo sapiens; identical to SEQ ID NO: 32543
  chr9:93405037-93405243
  hyper

SEQ ID NO: 53248 - DNA, 84 bp, Homo sapiens; identical to SEQ ID NO: 32544
  chr9:93956485-93956569
  hyper

SEQ ID NO: 53249 - DNA, 49 bp, Homo sapiens
  chr9:94183821-94183870
  hyper
cgccactaccagacccgcccccagccccggattctcgcagaccccaccg

SEQ ID NO: 53250 - DNA, 539 bp, Homo sapiens; identical to SEQ ID NO: 32546
  chr9:94711379-94711918
  hyper

SEQ ID NO: 53251 - DNA, 794 bp, Homo sapiens; identical to SEQ ID NO: 32547
  chr9:94712294-94713088
  hyper

SEQ ID NO: 53252 - DNA, 425 bp, Homo sapiens
  chr9:95569822-95570247
  hyper
gcagtgccgaaatcaaggacgcctggatgcttttcgttgcagagtgacaaaggttcaacaacaggaagaggatcaggggccaagacaagaagctgaagttcggcctgccaggaaccccgggccccagcatcccacccaaggcgctgctgcaggagttccagctgctgctgaaaggtgcggtgccgcagggccagagtgcgggatcctgagccctgcatgccagtccttgcgggggccgatcgctgtgagccttactcaggtccagccgcctccagggaggacaatgtagacgaggtgcggggcgtgagggcggtgctggccgcacccctggtcctgaggccacgggagccgcgcgaggaggccgccttccactgacgcctgcaccgggaccggttgctgcagcggtgccagctgcaggagctccg

SEQ ID NO: 53253 - DNA, 324 bp, Homo sapiens
  chr9:95570434-95570758
  hyper
ccagacaaggcaaccgaagttcatcctctctgagttgacttcgtgcgggcagcgggccggcgcccaggatgctggggagccctgcgcgccggaggccgacaagccgtggggctcagaggcgcctcagggcgagaaggcacccgtctcccagcgctttcaccccctggcctgcccggcccgcgtggtgtcccagtggctgcggccacgccaggcattctgccccgcggcggctgcacagggacgagaactgagaacccctgctcaaccccatccggggtgactgccaaatgcctatgccagcggccccgatctccctccggtgga

SEQ ID NO: 53254 - DNA, 39 bp, Homo sapiens; identical to SEQ ID NO: 32549
  chr9:95570878-95570917
  hyper

SEQ ID NO: 53255 - DNA, 94 bp, Homo sapiens
  chr9:95571523-95571617
  hyper
gccccctgcaggccacgcgggctcgggagcggtttccggagtccgagctggcgctgagctgcaggcgcgagcctaaaggcttagccggggccca

SEQ ID NO: 53256 - DNA, 171 bp, Homo sapiens; identical to SEQ ID NO: 20357
  chr9:95571760-95571931
  hyper

SEQ ID NO: 53257 - DNA, 127 bp, Homo sapiens; identical to SEQ ID NO: 32552
  chr9:95572141-95572268
  hyper

SEQ ID NO: 53258 - DNA, 132 bp, Homo sapiens; identical to SEQ ID NO: 32553
  chr9:95821259-95821391
  hyper

SEQ ID NO: 53259 - DNA, 253 bp, Homo sapiens; identical to SEQ ID NO: 32554
  chr9:95946216-95946469
  hyper

SEQ ID NO: 53260 - DNA, 113 bp, Homo sapiens; identical to SEQ ID NO: 32555
  chr9:96588627-96588740
  hyper

SEQ ID NO: 53261 - DNA, 87 bp, Homo sapiens
  chr9:96588885-96588972
  hyper
tacgggcggaggcaggggcgggcgggggctttcagcagctcgtccgcggaacatttgcatgtaatttgggagcgggtcacatgtggg

SEQ ID NO: 53262 - DNA, 259 bp, Homo sapiens; identical to SEQ ID NO: 32557
  chr9:96708199-96708458
  hyper

SEQ ID NO: 53263 - DNA, 30 bp, Homo sapiens; identical to SEQ ID NO: 32558
  chr9:96710135-96710165
  hyper

SEQ ID NO: 53264 - DNA, 267 bp, Homo sapiens; identical to SEQ ID NO: 20361
  chr9:96710991-96711258
  hyper

SEQ ID NO: 53265 - DNA, 113 bp, Homo sapiens
  chr9:96717466-96717579
  hyper
ggcggcgacggcttggctccggcgcggggcccgcgcggggctctaggccggcccgcagctcggggcggcgcgcgggcgccggctcatgccccctcccccgccggccggccggg

SEQ ID NO: 53266 - DNA, 122 bp, Homo sapiens
  chr9:96717857-96717979
  hyper
gagagccggagagttcgggaggcaagacccccagagacgagagtcggagggatcaaacgacacaggtgagagaaggggcagaggcagacggcgtgggccaaacaagattccagacagtgatg

SEQ ID NO: 53267 - DNA, 50 bp, Homo sapiens; identical to SEQ ID NO: 20363
  chr9:96718149-96718199
  hyper

SEQ ID NO: 53268 - DNA, 30 bp, Homo sapiens; identical to SEQ ID NO: 32569
  chr9:96722011-96722041
  hyper

SEQ ID NO: 53269 - DNA, 57 bp, Homo sapiens; identical to SEQ ID NO: 32572
  chr9:97402023-97402080
  hyper

SEQ ID NO: 53270 - DNA, 16 bp, Homo sapiens
  chr9:98111349-98111365
  hyper
ctaccaggacacatgc

SEQ ID NO: 53271 - DNA, 355 bp, Homo sapiens; identical to SEQ ID NO: 32576
  chr9:98277959-98278314
  hyper

SEQ ID NO: 53272 - DNA, 30 bp, Homo sapiens; identical to SEQ ID NO: 32577
  chr9:98315763-98315793
  hyper

SEQ ID NO: 53273 - DNA, 315 bp, Homo sapiens; identical to SEQ ID NO: 32578
  chr9:98783210-98783525
  hyper

SEQ ID NO: 53274 - DNA, 252 bp, Homo sapiens; identical to SEQ ID NO: 32579
  chr9:98784084-98784336
  hyper

SEQ ID NO: 53275 - DNA, 40 bp, Homo sapiens; identical to SEQ ID NO: 32580
  chr9:98784337-98784377
  hyper

SEQ ID NO: 53276 - DNA, 118 bp, Homo sapiens
  chr9:98784802-98784920
  hyper
ggagtaattcagagcccgtcagccccacgccgagtttattcaccctggcaggggcttccgcgggagccatgacccttcctaactggggtggaaggacccgcagcgccagccgggtccg

SEQ ID NO: 53277 - DNA, 13 bp, Homo sapiens
  chr9:98790000-98790013
  hyper
cctccaaggcccc

SEQ ID NO: 53278 - DNA, 97 bp, Homo sapiens; identical to SEQ ID NO: 32583
  chr9:99381503-99381600
  hyper

SEQ ID NO: 53279 - DNA, 30 bp, Homo sapiens; identical to SEQ ID NO: 32585
  chr9:99539965-99539995
  hyper

SEQ ID NO: 53280 - DNA, 41 bp, Homo sapiens
  chr9:99639580-99639621
  hyper
cctgggggccgcgggcgaaggaacacccccagatgccgctg

SEQ ID NO: 53281 - DNA, 115 bp, Homo sapiens
  chr9:99639942-99640057
  hyper
gcggtcttgaagcaatttcccggcaaagtcccgggacagcgggaaagaaactggtctccctgcctggggtcgttcccggtggatgtgcctcttcatcagacggaattttccgtct

SEQ ID NO: 53282 - DNA, 241 bp, Homo sapiens
  chr9:99983170-99983411
  hyper
attgccagggatggaaagcagctgaggctccatttggcttcgcggctccagggcccggcgacctccaaggcccccgcctcaggcgctgcgggcaaacagggcctgggggccccctcccaccgcgggctgagcccccgctacctgtcctttctgtcgcgggcatccaagtcccggaacctgcgagtcaggcagcgctccacctccgcggcgtcgcccttgatggccaccctgtggatcttcc

SEQ ID NO: 53283 - DNA, 187 bp, Homo sapiens
  chr9:99983824-99984011
  hyper
gcgctccgacctctcagaccgcgtgagcccagcaaagcggttaggcgcgcgcctgcagctcggcgctagcccggactccgggagccgctctcgagctcgcgtggacggcagagggcggctgcagctcgggcgcaggcgccgctggcttgcgggttctcctgggctcgcgcaggacatcccggaatcg

SEQ ID NO: 53284 - DNA, 30 bp, Homo sapiens; identical to SEQ ID NO: 32589
  chr9:100000368-100000398
  hyper

SEQ ID NO: 53285 - DNA, 30 bp, Homo sapiens; identical to SEQ ID NO: 32590
  chr9:100000837-100000867
  hyper

SEQ ID NO: 53286 - DNA, 30 bp, Homo sapiens; identical to SEQ ID NO: 32591
  chr9:100264785-100264815
  hyper

SEQ ID NO: 53287 - DNA, 174 bp, Homo sapiens
  chr9:100503451-100503625
  hyper
aaggttccaggagggcgcctgcctgcctagagtccccttgccggtctcaccctggaaaggtaggcggaactagaacaggcgggccccactgcctgcagcctgcgaggagacgccagggctgcaagcccccccgccctcctccgcccctgccgggacagtcagccgctaggggat

SEQ ID NO: 53288 - DNA, 23 bp, Homo sapiens
  chr9:100503937-100503960
  hyper
gcgacgggcgccatcccttccag

SEQ ID NO: 53289 - DNA, 103 bp, Homo sapiens; identical to SEQ ID NO: 20372
  chr9:100610218-100610321
  hyper

SEQ ID NO: 53290 - DNA, 141 bp, Homo sapiens
  chr9:100613687-100613828
  hyper
cgttaggacaacggtcgtccagaatttaaaatctagatatctgaatctcagaatcttgaaagttactgagagccacgaaatcccgtattaaaaggtgcctataatataatccagttaaaaattttaaaatttgaagttttt

SEQ ID NO: 53291 - DNA, 97 bp, Homo sapiens
  chr9:100614325-100614422
  hyper
gccctccagctgctatttaacagagtagaacactgaggccctgcgaggggacaaggacaggccctggatctcccagtgaatggccagggaacgaacc

SEQ ID NO: 53292 - DNA, 100 bp, Homo sapiens
  chr9:100614441-100614541
  hyper
cgcgaggatctcaggttaggaccaagttccggctcagggacagcaggaaaggaactcagaaattggacacccatgaagcaaacgtgtcccgactgcccgc

SEQ ID NO: 53293 - DNA, 8 bp, Homo sapiens
  chr9:100617285-100617293
  hyper
ggtgggat

SEQ ID NO: 53294 - DNA, 317 bp, Homo sapiens
  chr9:100617365-100617682
  hyper
tccccgcaatctgagaacgaacaggaatggagagaggactcaactgggacccacgtggaaaagaccgagcaggccacagaggctcggtctccccgcgcacagcgtaggcacccggtgtactctgtaaacgggaggaggtggggcgaggcagccagagcccttggactggcacagggaccctcgatggagcgaagccctcaaacgggatgctttctggtattctatcggggagggtccttggcggtaaccagagggcagcgtagtgtcaacaccagagaccaggatccaaattgtggggaatcagtttcagccttcca

SEQ ID NO: 53295 - DNA, 102 bp, Homo sapiens
  chr9:100619620-100619722
  hyper
agtcccttctcctctcgggtcgtcatttgtgaaatgggaatttgtgactgctacctcagataattttcctgaagttaaacgagaggagaggtgaaaagcgct

SEQ ID NO: 53296 - DNA, 261 bp, Homo sapiens
  chr9:100620069-100620330
  hyper
ctcgcgcaccggccgggccaggtgggaatgggcgccgcgcaggggagcgagtacctcggagacagtgcgcgccgcccggggcctcatccacagcggggtcgcgggcggcccccttagcccgcgtgactgtgggatcctgagaacattccgctgtatgtcttggaaccttctaaccctaggaatttgcaaacccctcccagtccctcatctgggggctcagagactggaggtgccttttttatttttttcttcttcacttta

SEQ ID NO: 53297 - DNA, 88 bp, Homo sapiens
  chr9:101469181-101469269
  hyper
atgctcaggcaaagacgagggcgataggaatgtcattcggaaatgatttcacaccgggttagccctgcacagccagccagcttgcatc

SEQ ID NO: 53298 - DNA, 76 bp, Homo sapiens; identical to SEQ ID NO: 20377
  chr9:101469527-101469603
  hyper

SEQ ID NO: 53299 - DNA, 320 bp, Homo sapiens
  chr9:101469796-101470116
  hyper
ctggggcttcaggcagaacccaaaccgagggcgtggggaggggtcttgggatggaaagcccttggctctctggctccgctccggactgctctccaagtctgtgctccggctgctaggtcggatgcttcaagcctgagccgtgagaaactgcctgcagccgcccggccaacagcagcggcgcggccggacaccactgcacgtccgggacgagaactgccagggcactttctgagcaactaacccgaggcaggggtctcctgaaatcgctctggccacaggcagcgccgggcacgtccaggcagaagcgctgcagagccggt

SEQ ID NO: 53300 - DNA, 30 bp, Homo sapiens; identical to SEQ ID NO: 32606
  chr9:101470607-101470637
  hyper

SEQ ID NO: 53301 - DNA, 90 bp, Homo sapiens; identical to SEQ ID NO: 32607
  chr9:101470839-101470929
  hyper

SEQ ID NO: 53302 - DNA, 482 bp, Homo sapiens
  chr9:101471071-101471553
  hyper
ggcccgccgccccgcgccaaggtcttcccgcggcgcccgcgcaatggcgccggcccgggccccggctccgtctcgggctagggttccggctcggctcagaacggccgcggcggcggcggcggcagcggcggcgcccgtgacggatcaatcacgccgggaaggggtgggagcgagcggagtgcgggaggcggggagcaagcgagcaaacgcggagaggggggccggcgtctccgcgcgcgcctctctccagcgcggccgccccgcaccgggccgcctccgcccgcccccgtgcgcgctctgaaccgctctcccgccgggagctgctaggcggcagcccctggagctcggccgggggagggcggacggcaggaaacgcgggaggcgaaggcgaggctgctcaggggcggctcgggccgcctccagggacggggacgagccgtgcgcgccgggggagggggaggcgctggcgctgcggcggccgc

SEQ ID NO: 53303 - DNA, 16 bp, Homo sapiens
  chr9:101471554-101471570
  hyper
gggagggccaccttcc

SEQ ID NO: 53304 - DNA, 239 bp, Homo sapiens
  chr9:101471621-101471860
  hyper
cccgccgaccgctgacctccaggcaccagagcgcccggggacagcgatctgggaaccgggaccgcgcgctggcacacgcagtggccgccgccgctccgccgagcgctgcctgtagcacctgcacggtggtttggaaccgcttctcggaggtctggccgggaaggtctgggcaggagaatgttccacgaaggcgtcccagaggcatctgcagcctacgctctcccgttcttttctggcgc

SEQ ID NO: 53305 - DNA, 20 bp, Homo sapiens
  chr9:101705976-101705996
  hyper
gcgcggggctttcctcgcag

SEQ ID NO: 53306 - DNA, 84 bp, Homo sapiens; identical to SEQ ID NO: 20382
  chr9:101706695-101706779
  hyper

SEQ ID NO: 53307 - DNA, 109 bp, Homo sapiens; identical to SEQ ID NO: 32613
  chr9:102586680-102586789
  hyper

SEQ ID NO: 53308 - DNA, 8 bp, Homo sapiens
  chr9:103235250-103235258
  hyper
cccaaccc

SEQ ID NO: 53309 - DNA, 146 bp, Homo sapiens; identical to SEQ ID NO: 32615
  chr9:103235748-103235894
  hyper

SEQ ID NO: 53310 - DNA, 137 bp, Homo sapiens; identical to SEQ ID NO: 32616
  chr9:103790552-103790689
  hyper

SEQ ID NO: 53311 - DNA, 212 bp, Homo sapiens; identical to SEQ ID NO: 32617
  chr9:103791492-103791704
  hyper

SEQ ID NO: 53312 - DNA, 113 bp, Homo sapiens; identical to SEQ ID NO: 32618
  chr9:103791967-103792080
  hyper

SEQ ID NO: 53313 - DNA, 39 bp, Homo sapiens
  chr9:104248540-104248579
  hyper
gggcagtccctgccacgcttgagcctcagtttcccaccc

SEQ ID NO: 53314 - DNA, 101 bp, Homo sapiens; identical to SEQ ID NO: 32620
  chr9:104248845-104248946
  hyper

SEQ ID NO: 53315 - DNA, 1 bp, Homo sapiens
  chr9:104249474-104249475
  hyper
c

SEQ ID NO: 53316 - DNA, 30 bp, Homo sapiens; identical to SEQ ID NO: 32622
  chr9:104499932-104499962
  hyper

SEQ ID NO: 53317 - DNA, 15 bp, Homo sapiens
  chr9:104500167-104500182
  hyper
aggagctgggcaccc

SEQ ID NO: 53318 - DNA, 418 bp, Homo sapiens
  chr9:104500207-104500625
  hyper
cggcaacagcagacagaccctgctcagcagccaccacaaactcagtctcctcattactgagacccgcagggagaaagcgcgccccctcctgcgcccggctcgcccctctgcagccgctgcctgaggtctccgcctccaggtcccgcgcgcagcttcactccactcggtgaagcggtcccaggagctggagcggtctctaggccatgcaagttggagcgtagcgcgcctccggcagtctcagatcccgctcccaggtccctccgcctggcatcctctgcccgcccggtcactgcgctgagcaggcaggcgggcgggccggcgcctgtcacccgcagctggagcgcccgttccctgcccgccccatctgcagggcgcctcgggcactgcgtccggccccgcgaggcggccgggatgagaa

SEQ ID NO: 53319 - DNA, 174 bp, Homo sapiens; identical to SEQ ID NO: 10015
  chr9:104500856-104501030
  hyper

SEQ ID NO: 53320 - DNA, 193 bp, Homo sapiens; identical to SEQ ID NO: 10016
  chr9:104501031-104501224
  hyper

SEQ ID NO: 53321 - DNA, 476 bp, Homo sapiens; identical to SEQ ID NO: 32627
  chr9:108418471-108418947
  hyper

SEQ ID NO: 53322 - DNA, 30 bp, Homo sapiens; identical to SEQ ID NO: 32628
  chr9:109622797-109622827
  hyper

SEQ ID NO: 53323 - DNA, 168 bp, Homo sapiens; identical to SEQ ID NO: 32629
  chr9:109623048-109623216
  hyper

SEQ ID NO: 53324 - DNA, 145 bp, Homo sapiens; identical to SEQ ID NO: 32630
  chr9:109623464-109623609
  hyper

SEQ ID NO: 53325 - DNA, 60 bp, Homo sapiens; identical to SEQ ID NO: 32631
  chr9:109624462-109624522
  hyper

SEQ ID NO: 53326 - DNA, 385 bp, Homo sapiens
  chr9:110227815-110228200
  hyper
tcccgtctattttcacgttagccaaagggaagcctagaagtccacagtccccgggagctggaagccaggcagtgacagcgccagcgtattctccttgacttgattgtaaatttcacaactttggtagcttcaacagggaggaagaggaggggcgccggctccctccagcaaaggcggcgcggagcgggtagccaggtccggagccgtcctgtgccgggccgtccggtggggggcactgcagaccgcgcgggcgctgcgcccgcctctagctccgggcgcagaggggtggccacgctctcctgagtccctcgcgcccctagccgcgcctgggagagcggactggcctcccagagaggatgcgggggaagccgcacaggggcccact

SEQ ID NO: 53327 - DNA, 42 bp, Homo sapiens
  chr9:110228602-110228644
  hyper
gccacagccagcgggcgctctggccctcgcagaagccgccgc

SEQ ID NO: 53328 - DNA, 81 bp, Homo sapiens; identical to SEQ ID NO: 32633
  chr9:110251955-110252036
  hyper

SEQ ID NO: 53329 - DNA, 45 bp, Homo sapiens; identical to SEQ ID NO: 32634
  chr9:110253522-110253567
  hyper

SEQ ID NO: 53330 - DNA, 52 bp, Homo sapiens; identical to SEQ ID NO: 32635
  chr9:110400388-110400440
  hyper

SEQ ID NO: 53331 - DNA, 182 bp, Homo sapiens; identical to SEQ ID NO: 32636
  chr9:111929136-111929318
  hyper

SEQ ID NO: 53332 - DNA, 189 bp, Homo sapiens; identical to SEQ ID NO: 32637
  chr9:111929339-111929528
  hyper

SEQ ID NO: 53333 - DNA, 15 bp, Homo sapiens
  chr9:111929585-111929600
  hyper
cgcagcctccccctt

SEQ ID NO: 53334 - DNA, 80 bp, Homo sapiens; identical to SEQ ID NO: 32639
  chr9:112081693-112081773
  hyper

SEQ ID NO: 53335 - DNA, 547 bp, Homo sapiens
  chr9:112402623-112403170
  hyper
cttgcagaggccagacgcttcttgcaacttctaagcggcgagagctgccaccttgccaatgactcaaccgtttgcctatgccctctgggctgtgccaccagccgcagccgccctgctcccccacccacccttctccccaggctccgcgccgcgccgccagtcccaggggagccgccggcgcacctggcgcctagggcgcacggcactgcgcgctggtgggcacctcacccgacgccagctgccagcgcgctccctccccgaaaccctgaagtggggtgtcttgtctagcgcccagcgaacaacattatccaattgcttcccgttttattcgcaggctgggagctgagagagcctgagcattcactttcaaccctccaggggaggagggggtgcgggtggggaggggagacggctcccagctccacctcgcgcgcggcgcggccagtgcactcggctccgggagaggcgagcagcgccggtgagccccgcagcagcgcacccggccgcggagccccgcgatggagtgagtatccccgagccgcgccgc

SEQ ID NO: 53336 - DNA, 101 bp, Homo sapiens
  chr9:112403200-112403301
  hyper
gtgaccgcggcggcaggcagatcccgctcgggtccgcgtccaggatgggtgtttaatttcagccccgtgtgtacgcctggtgtttctatagcagccgccgc

SEQ ID NO: 53337 - DNA, 62 bp, Homo sapiens
  chr9:112403302-112403364
  hyper
gcggcaggaggcaaggggtgggagccccgggtggcgtggtttttgcggctgccccttggcta

SEQ ID NO: 53338 - DNA, 74 bp, Homo sapiens
  chr9:112403394-112403468
  hyper
gatgatgttgctaaggacggaggcatattctaggctttcctatctctgccccaagcttccgcttatcggggagt

SEQ ID NO: 53339 - DNA, 157 bp, Homo sapiens; identical to SEQ ID NO: 32642
  chr9:112542235-112542392
  hyper

SEQ ID NO: 53340 - DNA, 30 bp, Homo sapiens; identical to SEQ ID NO: 32643
  chr9:112542670-112542700
  hyper

SEQ ID NO: 53341 - DNA, 257 bp, Homo sapiens
  chr9:113341265-113341522
  hyper
ccgggtcgggaggggcgggcgccttaccgcggcttgctggaaggcgcccttggtgtaggtgccgccacctcggtaggagatggcagggatctcttggaggagcagcgcgcacttgtgctggcgcgcgcggcgggtggagatgtaatcgacgcgcggcaccacgtagttcttggacgagaaggtcacgatggccacgcgcgtggccgtgggcaccacggggaagtcggacagcagcttgcggacgaacatgagctcgc

SEQ ID NO: 53342 - DNA, 334 bp, Homo sapiens
  chr9:113341965-113342299
  hyper
cactggggacagacacaatccagactcctcagcagctcgggaactccggagggaacggcgcgcgctctctacccctctcgctctcctctttttttcttccctctctcctcctcctctctctccctgaagcctataaaatgtttgaaggaaagggggcagtcaagaaaaatctcccgcttccctccttctctccctctctccctctccccgctcctgtctactttctgtatctgtgactctatctccctcctccccctctcattctcctcccgggatcaagccaaaggctcggagattccatgacaccagaaccccgcgtctgtcaggctgtcaa

SEQ ID NO: 53343 - DNA, 30 bp, Homo sapiens; identical to SEQ ID NO: 32647
  chr9:113800111-113800141
  hyper

SEQ ID NO: 53344 - DNA, 64 bp, Homo sapiens; identical to SEQ ID NO: 32648
  chr9:113800385-113800449
  hyper

SEQ ID NO: 53345 - DNA, 300 bp, Homo sapiens; identical to SEQ ID NO: 32649
  chr9:113801080-113801380
  hyper

SEQ ID NO: 53346 - DNA, 136 bp, Homo sapiens; identical to SEQ ID NO: 10028
  chr9:114287491-114287627
  hyper

SEQ ID NO: 53347 - DNA, 138 bp, Homo sapiens; identical to SEQ ID NO: 32651
  chr9:114287962-114288100
  hyper

SEQ ID NO: 53348 - DNA, 30 bp, Homo sapiens; identical to SEQ ID NO: 32652
  chr9:114361785-114361815
  hyper

SEQ ID NO: 53349 - DNA, 50 bp, Homo sapiens; identical to SEQ ID NO: 32653
  chr9:114362053-114362103
  hyper

SEQ ID NO: 53350 - DNA, 30 bp, Homo sapiens
  chr9:115652936-115652966
  hyper
gcgggcaggtgacctcggggctcatgtgac

SEQ ID NO: 53351 - DNA, 132 bp, Homo sapiens; identical to SEQ ID NO: 20400
  chr9:115653425-115653557
  hyper

SEQ ID NO: 53352 - DNA, 30 bp, Homo sapiens; identical to SEQ ID NO: 32655
  chr9:116756509-116756539
  hyper

SEQ ID NO: 53353 - DNA, 43 bp, Homo sapiens; identical to SEQ ID NO: 32656
  chr9:116916374-116916417
  hyper

SEQ ID NO: 53354 - DNA, 127 bp, Homo sapiens; identical to SEQ ID NO: 32657
  chr9:117267169-117267296
  hyper

SEQ ID NO: 53355 - DNA, 59 bp, Homo sapiens; identical to SEQ ID NO: 32658
  chr9:117880343-117880402
  hyper

SEQ ID NO: 53356 - DNA, 212 bp, Homo sapiens; identical to SEQ ID NO: 32659
  chr9:118916583-118916795
  hyper

SEQ ID NO: 53357 - DNA, 30 bp, Homo sapiens; identical to SEQ ID NO: 10032
  chr9:118917350-118917380
  hyper

SEQ ID NO: 53358 - DNA, 45 bp, Homo sapiens; identical to SEQ ID NO: 32661
  chr9:118917733-118917778
  hyper

SEQ ID NO: 53359 - DNA, 30 bp, Homo sapiens; identical to SEQ ID NO: 32662
  chr9:118919318-118919348
  hyper

SEQ ID NO: 53360 - DNA, 246 bp, Homo sapiens
  chr9:120175549-120175795
  hyper
gcaaggagttaacctcggaagttcagggatcgtaaaggttctcacctggaaggcccctcacctgcggtgcccgaggcggatcccgccgaggaaaagacccggggaagaagagctccgggtctgggcgagcccctggcgcctcacgggcgctgttgttggccagactccgacaaccaataaggccccgcgcccccaagaggggaggggagagcgagcaagcagcgagcgcgggagagctaaggggaa

SEQ ID NO: 53361 - DNA, 272 bp, Homo sapiens
  chr9:120175832-120176104
  hyper
atcaattacccgggtgggaaatcagctgcgcttcccacagctccactgaagggccgactcctccgggattcgcgcagggaaccagcaggcagcaagctgctggcgaacttttctgattaacttttccgttggagccccccacccacacccatctcctctcctctcctttttcttgcctttaagtaattattattagcccagggagtgagctgcaaggacaaaccggctctctgcctggaggtgggtagaaagggaaggcggtaacgggggta

SEQ ID NO: 53362 - DNA, 147 bp, Homo sapiens
  chr9:120176151-120176298
  hyper
cagcaaccactcaagtctctccagccctatttcacagatggccagaactgaggctcagagaagggaagcgacttggccaaggtcactcagcccatgcggaagccacgcttttgcgggttgagcgattccacacggaactactccatt

SEQ ID NO: 53363 - DNA, 50 bp, Homo sapiens
  chr9:120176817-120176867
  hyper
caccgcgatgcgccccggcagctcgttacgcacaaagagcaggaggcgcg

SEQ ID NO: 53364 - DNA, 612 bp, Homo sapiens
  chr9:120176897-120177509
  hyper
agcccggggacgcggcggcggcggcggctccggccccggtcccagccccggccccggcgcgggcgccgctccagccgatgtcgctctcccgcagggcgggcagtgtggacaccgtgacggtcttcagccggcacgggctgtcgggctcccgcgaggcagcggcggtggcgccggccagcagcggcggcggcggcagcaggagcaggaacagcagcagcagcggcagcagtggcggcggccccgggtggaagcagagcctcggccgcccccggagccccgagccggggccggggctgagccgggcgccggcggcggccatggcgggaggggctgcggtgctgcgggcggcggcggcggtggcggcggtggcgaaggaggaagaggaggcagctgcggagacggcggacgccgaagcgaaccaggacgcccgagctaaggagcggagagagccgctcgccagcagcccccagctccgggctccgcctcccgatcggccctggaccgcccccccgcgccgcctcccggggcccagccgcccgtccccgatctccggctccccccgcagaccccgagcgtttcggaggctccgcccggcctcgtgcaagtcccagt

SEQ ID NO: 53365 - DNA, 140 bp, Homo sapiens; identical to SEQ ID NO: 32665
  chr9:120177898-120178038
  hyper

SEQ ID NO: 53366 - DNA, 211 bp, Homo sapiens; identical to SEQ ID NO: 32666
  chr9:122131005-122131216
  hyper

SEQ ID NO: 53367 - DNA, 42 bp, Homo sapiens; identical to SEQ ID NO: 20409
  chr9:122131838-122131880
  hyper

SEQ ID NO: 53368 - DNA, 42 bp, Homo sapiens; identical to SEQ ID NO: 32670
  chr9:124361888-124361930
  hyper

SEQ ID NO: 53369 - DNA, 231 bp, Homo sapiens; identical to SEQ ID NO: 32671
  chr9:124990555-124990786
  hyper

SEQ ID NO: 53370 - DNA, 114 bp, Homo sapiens; identical to SEQ ID NO: 32672
  chr9:124990828-124990942
  hyper

SEQ ID NO: 53371 - DNA, 63 bp, Homo sapiens; identical to SEQ ID NO: 32673
  chr9:126138079-126138142
  hyper

SEQ ID NO: 53372 - DNA, 189 bp, Homo sapiens; identical to SEQ ID NO: 32674
  chr9:126760259-126760448
  hyper

SEQ ID NO: 53373 - DNA, 127 bp, Homo sapiens; identical to SEQ ID NO: 32675
  chr9:126761476-126761603
  hyper

SEQ ID NO: 53374 - DNA, 1042 bp, Homo sapiens
  chr9:126770490-126771532
  hyper
acacacacttctgaacgtcttcattttgatttaatggtatatcagcgtcaactatcgcttcctctgctggtacacacggcctgatgccgcgggaggagggtgcccatgtttatcaccgagtgagatgactaattacaccttgtcaatcaccggctatgaagacataaaaccagcgcgcacaatgaagtagttgcctgcagcgtcaattagttggcgattctgaggttattgcgtggccctgctttggccgcctctaataacgggacagagcgccgggcaccgcgcactgatcaatcaccctccttccgcggccgcccggctccctcccctctcccccgccgggtctggcctcactttctccgggcggcttgcgcttcctccctccgcggccccggctccgtggcgccggcagccccgggagccccgggaagtttgcgcgcggcagctccgcagccggcagccgggagccccgcagccttcggggagcgccggggctggtggcccctttgttggaggaggcgtggagggagcgcttttgttctgagttagtcacggtggccggctggaggctgctacctcattatgcgccgggtctgcttgtctgcgaggaagcagatggtggggaggtaggcagcggcgagagtggccagacctgaattccgttcacctgtcacctcccacaaaaggcaggttcgggggacttaggcattcgttgccactttctgggggagggggaggtcgaggggccgccgtttccggcgcctgcgaaggttccgtacctgtcggtgcccgctccccccaccccttgcctttcccttggctgcagcttctcgcaccgcgtaaatgtcactcacgtgtcaggatgtgtgtttacagcctgttcctctgcttgtttagtctcggcggacagggctcagcggttgcgcgacgttccccgccgctgggggagattagcaaagttacccgcctctggaccccggggcctgggcccctagatcccgccccgcggcgggagatgcgtttgagccttttacagacggag

SEQ ID NO: 53375 - DNA, 103 bp, Homo sapiens
  chr9:126771705-126771808
  hyper
cacgtttcttgagcagcccgcggcaagagttgctgagtaccccaccccccgcccccagatcctaaggcagcccctcgagctttccaaacgtattgtatccagc

SEQ ID NO: 53376 - DNA, 528 bp, Homo sapiens; identical to SEQ ID NO: 32677
  chr9:126773252-126773780
  hyper

SEQ ID NO: 53377 - DNA, 339 bp, Homo sapiens; identical to SEQ ID NO: 32678
  chr9:126773939-126774278
  hyper

SEQ ID NO: 53378 - DNA, 96 bp, Homo sapiens; identical to SEQ ID NO: 32680
  chr9:126775412-126775508
  hyper

SEQ ID NO: 53379 - DNA, 17 bp, Homo sapiens
  chr9:126778496-126778513
  hyper
ctcgcgccggggtgggg

SEQ ID NO: 53380 - DNA, 15 bp, Homo sapiens
  chr9:126779147-126779162
  hyper
aaaccgagttcagac

SEQ ID NO: 53381 - DNA, 247 bp, Homo sapiens
  chr9:126780564-126780811
  hyper
aggagagagaaagcccgggtcctccccctcccctcggcccctcgctcctccccggatccgatcctggggaatctcgacccgcccccgggcactgggggcgggagtgagggggttcggggcgccggccaaacctgggccccacggctgcctcccccgccgccgccccctgcccttgcctctggccggcctcggcctcgctacttagggccggctcctttccctttttctccactccccttctttcccc

SEQ ID NO: 53382 - DNA, 110 bp, Homo sapiens; identical to SEQ ID NO: 32688
  chr9:126781196-126781306
  hyper

SEQ ID NO: 53383 - DNA, 30 bp, Homo sapiens; identical to SEQ ID NO: 32689
  chr9:126782415-126782445
  hyper

SEQ ID NO: 53384 - DNA, 41 bp, Homo sapiens
  chr9:126783499-126783540
  hyper
tactttgccattaaccacaaccccgacgccaaggacttgaa

SEQ ID NO: 53385 - DNA, 294 bp, Homo sapiens; identical to SEQ ID NO: 32691
  chr9:126785057-126785351
  hyper

SEQ ID NO: 53386 - DNA, 36 bp, Homo sapiens; identical to SEQ ID NO: 32692
  chr9:126872665-126872701
  hyper

SEQ ID NO: 53387 - DNA, 197 bp, Homo sapiens
  chr9:127212654-127212851
  hyper
aggggcggggtctcccgggccgaggggcgggatctcctggtatctgccagagcccgccgctgcctccccgacttcagtccccgcagatgcctcgcagacggtgaacggccacaggcgccaggccagccatagcgggtgaggaactggagctgggaacaggggagggaccagcggatgaaggggaggcccctgactca

SEQ ID NO: 53388 - DNA, 64 bp, Homo sapiens; identical to SEQ ID NO: 32694
  chr9:127215890-127215954
  hyper

SEQ ID NO: 53389 - DNA, 172 bp, Homo sapiens; identical to SEQ ID NO: 32695
  chr9:127239776-127239948
  hyper

SEQ ID NO: 53390 - DNA, 66 bp, Homo sapiens
  chr9:127266025-127266091
  hyper
gagatgggctcagccgcggggaagacgccaggggacccaggagcgctggggcgcccggcccgggtg

SEQ ID NO: 53391 - DNA, 56 bp, Homo sapiens
  chr9:127266331-127266387
  hyper
gagagagagagagagagagagaaacgaggggtgggggattggatcagagactcgga

SEQ ID NO: 53392 - DNA, 54 bp, Homo sapiens; identical to SEQ ID NO: 20419
  chr9:127266534-127266588
  hyper

SEQ ID NO: 53393 - DNA, 219 bp, Homo sapiens; identical to SEQ ID NO: 10058
  chr9:127266628-127266847
  hyper

SEQ ID NO: 53394 - DNA, 201 bp, Homo sapiens; identical to SEQ ID NO: 32699
  chr9:127266865-127267066
  hyper

SEQ ID NO: 53395 - DNA, 158 bp, Homo sapiens; identical to SEQ ID NO: 32700
  chr9:127267338-127267496
  hyper

SEQ ID NO: 53396 - DNA, 59 bp, Homo sapiens; identical to SEQ ID NO: 32701
  chr9:127421470-127421529
  hyper

SEQ ID NO: 53397 - DNA, 274 bp, Homo sapiens; identical to SEQ ID NO: 20423
  chr9:128651926-128652200
  hyper

SEQ ID NO: 53398 - DNA, 182 bp, Homo sapiens
  chr9:128652232-128652414
  hyper
ctgcgccccgctgtagcagctgaccttagccggctgcggccgagagaacgcgcgttgcccgccgaccttgtgccctggggtcagcacccactgcaagtcagaacctctccgtggtcccaaagttagtgcttttccaatccaaaccagaaacttgatttgaggcctggcgatggtagaggatg

SEQ ID NO: 53399 - DNA, 169 bp, Homo sapiens; identical to SEQ ID NO: 32703
  chr9:128984848-128985017
  hyper

SEQ ID NO: 53400 - DNA, 94 bp, Homo sapiens
  chr9:129276624-129276718
  hyper
ctccgcccccaaacacgggttctcacgcggtccggccgcgcgggggcgcccggctccccggccctcgctgggccctgcgggaacgccccggccg

SEQ ID NO: 53401 - DNA, 112 bp, Homo sapiens
  chr9:129276820-129276932
  hyper
aggctagcccgccgcgcaagtccccgcagcgccccgccggcctcccaccccctgcggcgtccggacctcgtggacctggggtggctcccatagactgcggggccgggcccag

SEQ ID NO: 53402 - DNA, 207 bp, Homo sapiens
  chr9:129372722-129372929
  hyper
ggcagctcatagagccgtgctcgagggaggcgggtagcgcagaggagagggtgcaaggccctaagaagaggagcggggggactagggcggggctcaatggagctggggcgtccgcagactggaaggagccgggacccccgctccagagcctccctttccattctcgcttcttccagtgattccgagcccccgactcagtctttcccc

SEQ ID NO: 53403 - DNA, 51 bp, Homo sapiens; identical to SEQ ID NO: 32706
  chr9:129373250-129373301
  hyper

SEQ ID NO: 53404 - DNA, 30 bp, Homo sapiens; identical to SEQ ID NO: 32707
  chr9:129374814-129374844
  hyper

SEQ ID NO: 53405 - DNA, 256 bp, Homo sapiens; identical to SEQ ID NO: 32708
  chr9:129375725-129375981
  hyper

SEQ ID NO: 53406 - DNA, 119 bp, Homo sapiens
  chr9:129376199-129376318
  hyper
cgccgccagccccagctctaaacccggcggctcagcgggcgcaccatggcactggagtagcgcggggagcgcgcccggagccccgcggcccgctgcgccccgcccgggaccccgctgcg

SEQ ID NO: 53407 - DNA, 131 bp, Homo sapiens; identical to SEQ ID NO: 32710
  chr9:129376549-129376680
  hyper

SEQ ID NO: 53408 - DNA, 110 bp, Homo sapiens
  chr9:129377104-129377214
  hyper
ctagagctgccactccgatgtggtaggtggcgggtggcaggggtgatggaggacctagcaatcaccttggcgagcttgggagaggcgcaaggtcacctggggtgggggag

SEQ ID NO: 53409 - DNA, 36 bp, Homo sapiens
  chr9:129377316-129377352
  hyper
gcgccccagcctcacctcgcctgtcttggtcccagc

SEQ ID NO: 53410 - DNA, 12 bp, Homo sapiens
  chr9:129377592-129377604
  hyper
ggtgcgaccggg

SEQ ID NO: 53411 - DNA, 30 bp, Homo sapiens; identical to SEQ ID NO: 32714
  chr9:129380664-129380694
  hyper

SEQ ID NO: 53412 - DNA, 137 bp, Homo sapiens; identical to SEQ ID NO: 32715
  chr9:129386060-129386197
  hyper

SEQ ID NO: 53413 - DNA, 193 bp, Homo sapiens; identical to SEQ ID NO: 32716
  chr9:129386429-129386622
  hyper

SEQ ID NO: 53414 - DNA, 121 bp, Homo sapiens
  chr9:129388200-129388321
  hyper
cgggcgtcggagaagcggccgcgctgttccgggtcactgcaccggctgaaaaaaccaaaagcaaaaccaacacccagaaacgaagcctgcgtgcccccgggggctccgttttgctcccctc

SEQ ID NO: 53415 - DNA, 104 bp, Homo sapiens
  chr9:129388892-129388996
  hyper
agagactttctccctcgaaacacttgataccaactttgtttttttggcaagaaaaataagccttgtttggaaaggggtgggtggggggcgtcgagcgagcgagg

SEQ ID NO: 53416 - DNA, 52 bp, Homo sapiens
  chr9:129389192-129389244
  hyper
tcagcccggccgggcccgcagcgtccgccggtccgtccgggctcctctgcag

SEQ ID NO: 53417 - DNA, 138 bp, Homo sapiens
  chr9:129400848-129400986
  hyper
agtgattgccaggcccgcttggcagtttttaatcattttatctctgttctcggctctcgggggagacagccagtgcttagcagtctgctcagaaagacctcggggcgcgtggcgcagcggcggctcggagctcccatt

SEQ ID NO: 53418 - DNA, 93 bp, Homo sapiens; identical to SEQ ID NO: 32720
  chr9:129414430-129414523
  hyper

SEQ ID NO: 53419 - DNA, 217 bp, Homo sapiens
  chr9:129445566-129445783
  hyper
cggctcccgccgccgcccgcccggcccgcggccgccgcatcaaagcagatgtttgcagctggtttgagttggatccccatcaacaggcccttttttgtctcaaaataaaaaacagctacgcccggaatgataaggacgcggcaggcacgtgggggagatgtcagcgagtccggcagggaggaggccgggcggctccctctctaagtgacaggctgac

SEQ ID NO: 53420 - DNA, 82 bp, Homo sapiens
  chr9:129445813-129445895
  hyper
gtctagggtcctgtcgcctagctcctgtgaactgcagctcatccttcagccggcatcatcagagccccgtcccgcccacaac

SEQ ID NO: 53421 - DNA, 92 bp, Homo sapiens; identical to SEQ ID NO: 32722
  chr9:129485680-129485772
  hyper

SEQ ID NO: 53422 - DNA, 189 bp, Homo sapiens; identical to SEQ ID NO: 20437
  chr9:130461742-130461931
  hyper

SEQ ID NO: 53423 - DNA, 30 bp, Homo sapiens; identical to SEQ ID NO: 32724
  chr9:130689420-130689450
  hyper

SEQ ID NO: 53424 - DNA, 115 bp, Homo sapiens; identical to SEQ ID NO: 32725
  chr9:131127226-131127341
  hyper

SEQ ID NO: 53425 - DNA, 193 bp, Homo sapiens; identical to SEQ ID NO: 32726
  chr9:131159439-131159632
  hyper

SEQ ID NO: 53426 - DNA, 345 bp, Homo sapiens; identical to SEQ ID NO: 32727
  chr9:131872500-131872845
  hyper

SEQ ID NO: 53427 - DNA, 64 bp, Homo sapiens; identical to SEQ ID NO: 32728
  chr9:131872856-131872920
  hyper

SEQ ID NO: 53428 - DNA, 164 bp, Homo sapiens; identical to SEQ ID NO: 32729
  chr9:132020946-132021110
  hyper

SEQ ID NO: 53429 - DNA, 95 bp, Homo sapiens; identical to SEQ ID NO: 32730
  chr9:132382260-132382355
  hyper

SEQ ID NO: 53430 - DNA, 71 bp, Homo sapiens; identical to SEQ ID NO: 32732
  chr9:132428052-132428123
  hyper

SEQ ID NO: 53431 - DNA, 256 bp, Homo sapiens; identical to SEQ ID NO: 32733
  chr9:132428401-132428657
  hyper

SEQ ID NO: 53432 - DNA, 30 bp, Homo sapiens; identical to SEQ ID NO: 32734
  chr9:132459828-132459858
  hyper

SEQ ID NO: 53433 - DNA, 26 bp, Homo sapiens
  chr9:133308867-133308893
  hyper
ggcgtccccgccaaccgcaccgagct

SEQ ID NO: 53434 - DNA, 100 bp, Homo sapiens
  chr9:133308941-133309041
  hyper
gcgcgcgggccttggcgcggtctacacccgtcgcgcgctcacccgcgccggcctctaccggctcaccgtgcgtgctgcggcaccgcgccaccaaagcgtc

SEQ ID NO: 53435 - DNA, 112 bp, Homo sapiens; identical to SEQ ID NO: 32737
  chr9:133320662-133320774
  hyper

SEQ ID NO: 53436 - DNA, 103 bp, Homo sapiens
  chr9:133534580-133534683
  hyper
cgagtctttgtacccctgcgtctccgactcggcctttcatctgctccctccacctcggcatcgccttgcctcagtctcccccgacccctgtctcgccccctct

SEQ ID NO: 53437 - DNA, 257 bp, Homo sapiens
  chr9:133534713-133534970
  hyper
caccgcccggtctcctggtgtccccggcgtctctcccgtcgttcccgccgccttgatcagcctgggctgtggcgctggcatcgctggcctggggaccggggtgtgggcgatggaagggggttcgagaggcgcaggggaggggcttcccctcctccgcccctgggcgcctggggagactcgcgtgccagtcacctgccggtcggggcgccgacttcgcgcctacgcactccacgtgggcgccccggggcgcgcctttg

SEQ ID NO: 53438 - DNA, 189 bp, Homo sapiens; identical to SEQ ID NO: 32739
  chr9:133535296-133535485
  hyper

SEQ ID NO: 53439 - DNA, 95 bp, Homo sapiens; identical to SEQ ID NO: 20447
  chr9:133535839-133535934
  hyper

SEQ ID NO: 53440 - DNA, 126 bp, Homo sapiens; identical to SEQ ID NO: 20448
  chr9:133535971-133536097
  hyper

SEQ ID NO: 53441 - DNA, 1 bp, Homo sapiens
  chr9:133536344-133536345
  hyper
c

SEQ ID NO: 53442 - DNA, 184 bp, Homo sapiens; identical to SEQ ID NO: 32743
  chr9:133536346-133536530
  hyper

SEQ ID NO: 53443 - DNA, 1 bp, Homo sapiens
  chr9:133536777-133536778
  hyper
t

SEQ ID NO: 53444 - DNA, 313 bp, Homo sapiens
  chr9:133536869-133537182
  hyper
agcgggcgaggggggcgacggagcctgagagctccggcccggccgaggggagggggcttttgcgcgagcacattccgcgcctgggccccgcggaaaatgacaaaataacacgggtcatccgctgggaaagcccggaatgtttcccctcgaaatctcctcccggggagatgtgagcacagggtcttgctccctatttcaatgcaccttgagactgggcgctacctacgggctcctttttccccgggcgggggtccaggtgggttttgccgctagactagaagcacaaaatgtgagcgcggtggagatttgggcg

SEQ ID NO: 53445 - DNA, 569 bp, Homo sapiens
  chr9:133537600-133538169
  hyper
tggaggaactgaggtcgctttcggggcttgggagctgccgcagcgcttggctcctggcagcgctccccgacgtcgtctccctcgctcctagcactttgtcctctccacctaggtcttcccagaagccaagaagtaggccccggtgaggctcccctgcaggagccatcggactccatacgccccctcagactcgagctctggccagggagccgatgcgacccacaagctgcgtcgaaaaatgagtggagggttcggcgaccctaacccacctccctcctcagcagcgctgccctctgctggcgccctgcccaacggtcctgccttctgccaggtgtgcccttccttgggctccagcctcgggcggacccggacgcagggtctgaaggccagctaccgccgccttcctccctttgcgtcccaacggggacgggggatgccggagactactggcaggaactggggaccaggggtctggagtctggacgccaggtgtgagaccctcttagccaaggcgcgtccgggtggtggaggggcgtctatgccaacaggcgtttggacagggtctcgct

SEQ ID NO: 53446 - DNA, 492 bp, Homo sapiens
  chr9:133538728-133539220
  hyper
tttctgagggacttcgctctcaggcacgcctgctcccacctaggaagggtctcgggacccctttcaatccccctatatcccgtaggaaattcttttcccagagacaggctgccagggcgattcctgtccgcccatctcgacccccgacctggccccgcaagggccgggagcctggccttccatgaagctgtctcaggccgggaccagccccagccccgacggccgctgcggccccgcctcggcagccccgtgagcccgcggaggagtttcgcacccgaccgtgcacagcgaccgagttggcgcggcccgtatgaagcgaagcgccggcttcagcagcgcagtctgagcaggggatccgcgtggcaactagggctgcgcgcgagctcggggcgactgtggcggcccggggagtgcagggccggagagggaagaggacgcgggctctggccggggagggagagcggtgcagggctgggccggccagccggggca

SEQ ID NO: 53447 - DNA, 523 bp, Homo sapiens
  chr9:133539709-133540232
  hyper
ctgccgcttccctgcaaccacccgcctctcacccaccctgcaccccccgcacccgcctccgcctccacccgcgtctctccaccctccgcgccgcctttgccatctctacagatttcaccatctctcttcccctctccccctcgttcgctttcctcccagtcgccccctcacctcccgctccctcctgcgtcctcctcctctccgtcctccccctgctctggttccttctccatcgcagcgctctcctctcgccccttgggctcccctctcgcccgcccacctcccccgtcggcccggccgtcccccggcgccggggagctccgggccgcccatgatgggctccgtgctcccggctgaggccctggtgctcaagaccgggctgaaggcgccgggactggcgctggccgaggttatcacctccgacatcctgcacagcttcctgtacggccgctggcgcaacgtgctcggggagcagctcttcgaggacaagagccaccacgccagccccaagacagccttcacc

SEQ ID NO: 53448 - DNA, 37 bp, Homo sapiens; identical to SEQ ID NO: 10093
  chr9:133540453-133540490
  hyper

SEQ ID NO: 53449 - DNA, 273 bp, Homo sapiens; identical to SEQ ID NO: 20456
  chr9:133541192-133541465
  hyper

SEQ ID NO: 53450 - DNA, 24 bp, Homo sapiens
  chr9:133541665-133541689
  hyper
attcttaaacttatccggggcaga

SEQ ID NO: 53451 - DNA, 85 bp, Homo sapiens
  chr9:133542337-133542422
  hyper
cccgagcctggagctcaccccgcctctaggctcctcccaacccgtgccgaaaatccgaccctccttcccccggacaccctggcag

SEQ ID NO: 53452 - DNA, 42 bp, Homo sapiens; identical to SEQ ID NO: 32750
  chr9:133884491-133884533
  hyper

SEQ ID NO: 53453 - DNA, 30 bp, Homo sapiens; identical to SEQ ID NO: 32751
  chr9:133884902-133884932
  hyper

SEQ ID NO: 53454 - DNA, 546 bp, Homo sapiens; identical to SEQ ID NO: 32752
  chr9:134151976-134152522
  hyper

SEQ ID NO: 53455 - DNA, 225 bp, Homo sapiens; identical to SEQ ID NO: 32753
  chr9:134158243-134158468
  hyper

SEQ ID NO: 53456 - DNA, 32 bp, Homo sapiens; identical to SEQ ID NO: 32754
  chr9:134421906-134421938
  hyper

SEQ ID NO: 53457 - DNA, 84 bp, Homo sapiens; identical to SEQ ID NO: 32755
  chr9:135036830-135036914
  hyper

SEQ ID NO: 53458 - DNA, 111 bp, Homo sapiens; identical to SEQ ID NO: 32758
  chr9:135038352-135038463
  hyper

SEQ ID NO: 53459 - DNA, 153 bp, Homo sapiens; identical to SEQ ID NO: 32759
  chr9:135116312-135116465
  hyper

SEQ ID NO: 53460 - DNA, 30 bp, Homo sapiens; identical to SEQ ID NO: 32760
  chr9:135118020-135118050
  hyper

SEQ ID NO: 53461 - DNA, 47 bp, Homo sapiens; identical to SEQ ID NO: 32761
  chr9:135285476-135285523
  hyper

SEQ ID NO: 53462 - DNA, 134 bp, Homo sapiens; identical to SEQ ID NO: 32762
  chr9:135285731-135285865
  hyper

SEQ ID NO: 53463 - DNA, 169 bp, Homo sapiens; identical to SEQ ID NO: 10098
  chr9:135285880-135286049
  hyper

SEQ ID NO: 53464 - DNA, 41 bp, Homo sapiens; identical to SEQ ID NO: 32764
  chr9:135286274-135286315
  hyper

SEQ ID NO: 53465 - DNA, 30 bp, Homo sapiens; identical to SEQ ID NO: 32765
  chr9:135287745-135287775
  hyper

SEQ ID NO: 53466 - DNA, 253 bp, Homo sapiens; identical to SEQ ID NO: 32766
  chr9:135454991-135455244
  hyper

SEQ ID NO: 53467 - DNA, 120 bp, Homo sapiens
  chr9:135455287-135455407
  hyper
cgctttcgctgggtccgggatccaaatcccaacccaagagccaaaggccagaaaaggccctggcgttgccagctgcttgtcgccctggggaggggcggctccggacccgcccggggcaga

SEQ ID NO: 53468 - DNA, 411 bp, Homo sapiens; identical to SEQ ID NO: 20463
  chr9:135455585-135455996
  hyper

SEQ ID NO: 53469 - DNA, 126 bp, Homo sapiens; identical to SEQ ID NO: 32768
  chr9:135456079-135456205
  hyper

SEQ ID NO: 53470 - DNA, 140 bp, Homo sapiens; identical to SEQ ID NO: 32769
  chr9:135456234-135456374
  hyper

SEQ ID NO: 53471 - DNA, 137 bp, Homo sapiens
  chr9:135456760-135456897
  hyper
ggctttccccactcccgccaggcccacagggtcccaagaggccagagagacaggactgcaaattgtcctacatgggaaacaccgagagcccaacagaaatgccgcaaacaacataacttgaattttcttccccacac

SEQ ID NO: 53472 - DNA, 738 bp, Homo sapiens; identical to SEQ ID NO: 32771
  chr9:135456959-135457697
  hyper

SEQ ID NO: 53473 - DNA, 102 bp, Homo sapiens; identical to SEQ ID NO: 32772
  chr9:135457946-135458048
  hyper

SEQ ID NO: 53474 - DNA, 32 bp, Homo sapiens; identical to SEQ ID NO: 32773
  chr9:135458408-135458440
  hyper

SEQ ID NO: 53475 - DNA, 21 bp, Homo sapiens
  chr9:135458456-135458477
  hyper
cgtcacctcctcctttctgat

SEQ ID NO: 53476 - DNA, 50 bp, Homo sapiens
  chr9:135458597-135458647
  hyper
agacaagctggacaaaagtggcagcaacgcctcatcggactctgagtata

SEQ ID NO: 53477 - DNA, 27 bp, Homo sapiens
  chr9:135460176-135460203
  hyper
ttgctcctcccccggggggcctgctta

SEQ ID NO: 53478 - DNA, 30 bp, Homo sapiens; identical to SEQ ID NO: 32776
  chr9:135461292-135461322
  hyper

SEQ ID NO: 53479 - DNA, 275 bp, Homo sapiens
  chr9:135461773-135462048
  hyper
aggagggtgagcattgagcttgttcgattaagtgttttctgtgcagtcaaagccgaacgaaagtgtctgggataaagaaactacctgtgccaggtctatccttcgacctcaggagctgggcccccggtgtaattctgtcccgactgtggggtgtaaacacacgatgccacgcaggtgtagcaggagccatcgttagcgggcaatgtaatgacaacggaacgcagacctgggcaatgcgcgctgcgcccaaggggcaagcgagtggcagggtcgct

SEQ ID NO: 53480 - DNA, 175 bp, Homo sapiens; identical to SEQ ID NO: 32779
  chr9:135464001-135464176
  hyper

SEQ ID NO: 53481 - DNA, 48 bp, Homo sapiens
  chr9:135464750-135464798
  hyper
gcgctctacctgtaccgcggccccagcgcgccgccgcctgctctccag

SEQ ID NO: 53482 - DNA, 21 bp, Homo sapiens
  chr9:135464918-135464939
  hyper
cggctccggggcctcctcccg

SEQ ID NO: 53483 - DNA, 717 bp, Homo sapiens
  chr9:135465231-135465948
  hyper
ccccaggagcgggtgcggctgattcccaggcttcgctctctcccacgccccttctacgctccaggtggagaacagcccctctccccgcgcccccgccagggagagaaggggagtgcggagccccgtctccctacccctcgagcacctgggccagcggctgagctgtacataccgtgtgcaaagtgtatatgaagttatttattcgtgacccatgagcccgtgaccgtgtccgtggattagtgagtctgtggcctgtgccctccccactcccaggcggggcaggaaggggccaagggggcttgcccacccaccccgaccccagcccccagcctcagccccggtccgggggcagccaggcctctcgggttctctcttttttaaatgtcgaaataaacttcttacaaatgaccaggcgcctgtccgcgctcgcgtcgctgggtccgcactcaacccctctcccatccctctcctggggactcggtttccttccatcctcaataacgaaacatttttgtcccccttctcttccccggtgctgtggacatgcgcgggggccccgacgggactcgctggggcccgggtctcccctccctggcctcagtcttcccatctctacagcgaggccagctcgttgttcccctcctcctcctctgtctccatctggttcctagcggctcccagacggtcccgagggccggggcgggggtccgtgccgga

SEQ ID NO: 53484 - DNA, 212 bp, Homo sapiens
  chr9:135466132-135466344
  hyper
cgcgctcgggctcccgacgctcgcgggcgccaaggcggcccgggcctcccggcctcccgcaccaggcaggactccgcgcgccttcgctgcgaaccagacgccacatcgggtaaacccccactcccacatcttctcacctcccctttaccccgggaggaggttggaaatgagacccagaggggagccaaatcccagcgtctgccccatctctt

SEQ ID NO: 53485 - DNA, 280 bp, Homo sapiens; identical to SEQ ID NO: 32783
  chr9:135645863-135646143
  hyper

SEQ ID NO: 53486 - DNA, 456 bp, Homo sapiens; identical to SEQ ID NO: 32784
  chr9:136038991-136039447
  hyper

SEQ ID NO: 53487 - DNA, 55 bp, Homo sapiens; identical to SEQ ID NO: 32785
  chr9:136400112-136400167
  hyper

SEQ ID NO: 53488 - DNA, 131 bp, Homo sapiens; identical to SEQ ID NO: 32786
  chr9:136474260-136474391
  hyper

SEQ ID NO: 53489 - DNA, 59 bp, Homo sapiens
  chr9:136474431-136474490
  hyper
cgcgactccggacgccccggctggctccctgcgagctgcacgcgcggctccagcctggt

SEQ ID NO: 53490 - DNA, 30 bp, Homo sapiens; identical to SEQ ID NO: 32788
  chr9:136603602-136603632
  hyper

SEQ ID NO: 53491 - DNA, 30 bp, Homo sapiens; identical to SEQ ID NO: 32789
  chr9:136658309-136658339
  hyper

SEQ ID NO: 53492 - DNA, 90 bp, Homo sapiens; identical to SEQ ID NO: 32790
  chr9:136931060-136931150
  hyper

SEQ ID NO: 53493 - DNA, 39 bp, Homo sapiens; identical to SEQ ID NO: 32791
  chr9:137295661-137295700
  hyper

SEQ ID NO: 53494 - DNA, 30 bp, Homo sapiens; identical to SEQ ID NO: 32793
  chr9:137533003-137533033
  hyper

SEQ ID NO: 53495 - DNA, 42 bp, Homo sapiens; identical to SEQ ID NO: 32794
  chr9:137533555-137533597
  hyper

SEQ ID NO: 53496 - DNA, 148 bp, Homo sapiens; identical to SEQ ID NO: 32795
  chr9:137533819-137533967
  hyper

SEQ ID NO: 53497 - DNA, 320 bp, Homo sapiens
  chr9:137534238-137534558
  hyper
ccttggcctgtggaatgcacgggccaagaccacgaatgccatttgctgggggcccccccgagatgacgacacgcagacacaatgcccgcgggcgcgccgccgccccctccccagacgggcgggtcgggtggggctgtcgcgcgagccgaggaaggaccgagggctggatcagcaggaggggttgtccacgaggcgggcaaacttttgtcccaaaaaccttccttctctgtcccacatcacaggcgcccagcttgggccctcacagccctacagcagaacttcctctgctccaaaccgggcagggccgccccctagagtta

SEQ ID NO: 53498 - DNA, 170 bp, Homo sapiens; identical to SEQ ID NO: 32797
  chr9:137967194-137967364
  hyper

SEQ ID NO: 53499 - DNA, 179 bp, Homo sapiens; identical to SEQ ID NO: 32798
  chr9:137967472-137967651
  hyper

SEQ ID NO: 53500 - DNA, 243 bp, Homo sapiens; identical to SEQ ID NO: 32799
  chr9:137967688-137967931
  hyper

SEQ ID NO: 53501 - DNA, 180 bp, Homo sapiens; identical to SEQ ID NO: 32800
  chr9:137979493-137979673
  hyper

SEQ ID NO: 53502 - DNA, 133 bp, Homo sapiens
  chr9:137980011-137980144
  hyper
cgcggctcctcctcctcctcctcctccccctcctcggtccggagccccgggctgggcgggcgccgcgcgggacccgagtcgcccagggaggcggcggggagcagggcgggcaagggcaggcgtcgcgggccgg

SEQ ID NO: 53503 - DNA, 42 bp, Homo sapiens
  chr9:137980216-137980258
  hyper
cggcgtttccttcgtctgggcccctcgccgcggggccggggg

SEQ ID NO: 53504 - DNA, 592 bp, Homo sapiens
  chr9:137980288-137980880
  hyper
ctgggtcagtaatcatgagccccccattgaaaaggttaggaaactaaggctggggacttggggacttgtccaaggtcacactcagcgagtgaggggtggagccgccgctagaccctagtctgggctcggtccagcggggactgagcccgccctagtttgtaaaagccagactggccggaccgggctgggagtggggccccagccggtgggctccggagctcctgcccgcgcctgcattcccaaagtcccaaggcgccctttcctccccagtccataggagggtttgttccttctcctccgaggacggtgccgaggggcttgggtggggcccctgggagcctgcccttgggcgctcaccccctcgcctttgccttcgtcttctgcgcgcacccctccctcctggcctctgaaattgaaatcgcgtctccctctcgagcctagcgggaggggaaccgtggccggggctgcttctgggcagagctgacttagatggctgagcgaggctgagctgaaaccgccacccggagggccgcgcggggaaggggccgctgccgggaaggcgcgccccagaccactggccctttaggctgaa

SEQ ID NO: 53505 - DNA, 62 bp, Homo sapiens
  chr9:137980910-137980972
  hyper
ctctctctttttgctgccaggggtttagtgccctgcgaagagggctccgtggtgtggctccc

SEQ ID NO: 53506 - DNA, 95 bp, Homo sapiens; identical to SEQ ID NO: 3486
  chr9:138606154-138606249
  hyper

SEQ ID NO: 53507 - DNA, 72 bp, Homo sapiens; identical to SEQ ID NO: 32804
  chr9:138606523-138606595
  hyper

SEQ ID NO: 53508 - DNA, 30 bp, Homo sapiens; identical to SEQ ID NO: 32805
  chr9:138607023-138607053
  hyper

SEQ ID NO: 53509 - DNA, 30 bp, Homo sapiens; identical to SEQ ID NO: 32806
  chr9:138628067-138628097
  hyper

SEQ ID NO: 53510 - DNA, 404 bp, Homo sapiens; identical to SEQ ID NO: 32807
  chr9:138628339-138628743
  hyper

SEQ ID NO: 53511 - DNA, 69 bp, Homo sapiens; identical to SEQ ID NO: 32808
  chr9:139024452-139024521
  hyper

SEQ ID NO: 53512 - DNA, 122 bp, Homo sapiens
  chr9:139024782-139024904
  hyper
cctgttcgtggggtccctggggtgcaggggtggaggacataggagtgtgggggtcgtgggcagacccaggcgggacgctgtgccagtgccgccccgaaggcccagtgcgcagggtcccccgc

SEQ ID NO: 53513 - DNA, 54 bp, Homo sapiens; identical to SEQ ID NO: 10123
  chr9:139025663-139025717
  hyper

SEQ ID NO: 53514 - DNA, 594 bp, Homo sapiens
  chr9:139084634-139085228
  hyper
gggtcgggaccccaacgagcgggaaaaaaaaaaaaagacagaacgcgtgccggggagtatgaccccggccccggctccctgcaccccgggctgcgcagagccctcgccctccgggttccctctgccagcgacgccagcagagccgggcaggtcccatctcggggtctccccgcgcccggacgacccctctcccactgcggccccggccctgcctcacccgccgccccaccagggtccgagaccgggagaccccagccgcggggggggggggacatcagccttcgacctgcccccgcacctcccgctccgcggggagactgggcgccaggaaccccgaattcggggctgacaacccgcaggcgcgcggctaaagcttccaccgtccgcgagaaggcgtctccaccctggaaggaagggggctcggacccagggaggatgaggggtccgccttctccttcccctcacctcgctgcagcccagagcccgcagacagccccgcggcccaaggtctctctccgcccgaggtctgcagctctggctgggcgtcccccggcctggcgggggtccgggtgggggccgcggcccgaagtctga

SEQ ID NO: 53515 - DNA, 211 bp, Homo sapiens; identical to SEQ ID NO: 32812
  chr9:139085372-139085583
  hyper

SEQ ID NO: 53516 - DNA, 36 bp, Homo sapiens; identical to SEQ ID NO: 32813
  chr9:139085792-139085828
  hyper

SEQ ID NO: 53517 - DNA, 174 bp, Homo sapiens; identical to SEQ ID NO: 32814
  chr9:139085985-139086159
  hyper

SEQ ID NO: 53518 - DNA, 336 bp, Homo sapiens; identical to SEQ ID NO: 32815
  chr9:139089123-139089459
  hyper

SEQ ID NO: 53519 - DNA, 95 bp, Homo sapiens
  chr9:139090405-139090500
  hyper
tgggaaattcagatccgcgggctccctgggacccctgcgaccccgccgacgcgcgctcgtccccccccgagctccgcgatccctccgcctaccgg

SEQ ID NO: 53520 - DNA, 156 bp, Homo sapiens; identical to SEQ ID NO: 10130
  chr9:139090586-139090742
  hyper

SEQ ID NO: 53521 - DNA, 156 bp, Homo sapiens; identical to SEQ ID NO: 20486
  chr9:139091369-139091525
  hyper

SEQ ID NO: 53522 - DNA, 33 bp, Homo sapiens; identical to SEQ ID NO: 20487
  chr9:139093890-139093923
  hyper

SEQ ID NO: 53523 - DNA, 178 bp, Homo sapiens; identical to SEQ ID NO: 32820
  chr9:139094021-139094199
  hyper

SEQ ID NO: 53524 - DNA, 70 bp, Homo sapiens
  chr9:139094635-139094705
  hyper
aaatacaggctgaggcgcccaggcgcggacgttccggggtcctcgcgcccactcccgcccagatcctcta

SEQ ID NO: 53525 - DNA, 117 bp, Homo sapiens; identical to SEQ ID NO: 32822
  chr9:139095014-139095131
  hyper

SEQ ID NO: 53526 - DNA, 175 bp, Homo sapiens
  chr9:139095165-139095340
  hyper
cgccccgcgtgcccggcccgagggcgggcaccggtaagggagggcccaggtcagggcttcccgccagcgttcgtcccggccccgcagcttcctgcgccggagcggcccagaggcagaggcctgagctggagcacacgccaggagggctaaggttcccgggagaggggtcgagaag

SEQ ID NO: 53527 - DNA, 66 bp, Homo sapiens
  chr9:139096584-139096650
  hyper
actcttgcaggccagcgtcaggccctccccgccaccctgggatctggaaactcactctctgcagtt

SEQ ID NO: 53528 - DNA, 109 bp, Homo sapiens
  chr9:139097006-139097115
  hyper
cgcccgctgcccgccccgcccgcgcgcccgcccacctcccggggcccctctcgtcgccccggtccccacccccgcctctgccccgtgtcgggcgcgcctccctccctgg

SEQ ID NO: 53529 - DNA, 373 bp, Homo sapiens; identical to SEQ ID NO: 32825
  chr9:139606331-139606704
  hyper

SEQ ID NO: 53530 - DNA, 131 bp, Homo sapiens; identical to SEQ ID NO: 32826
  chr9:139607156-139607287
  hyper

SEQ ID NO: 53531 - DNA, 80 bp, Homo sapiens; identical to SEQ ID NO: 32827
  chr9:139739053-139739133
  hyper

SEQ ID NO: 53532 - DNA, 54 bp, Homo sapiens; identical to SEQ ID NO: 32828
  chr9:139739447-139739501
  hyper

SEQ ID NO: 53533 - DNA, 83 bp, Homo sapiens; identical to SEQ ID NO: 32829
  chr9:139872708-139872791
  hyper

SEQ ID NO: 53534 - DNA, 36 bp, Homo sapiens; identical to SEQ ID NO: 32830
  chr9:139879955-139879991
  hyper

SEQ ID NO: 53535 - DNA, 95 bp, Homo sapiens; identical to SEQ ID NO: 32831
  chr9:139943364-139943459
  hyper

SEQ ID NO: 53536 - DNA, 141 bp, Homo sapiens; identical to SEQ ID NO: 32832
  chr9:139948048-139948189
  hyper

SEQ ID NO: 53537 - DNA, 69 bp, Homo sapiens; identical to SEQ ID NO: 32833
  chr9:139971509-139971578
  hyper

SEQ ID NO: 53538 - DNA, 145 bp, Homo sapiens; identical to SEQ ID NO: 32834
  chr9:140024626-140024771
  hyper

SEQ ID NO: 53539 - DNA, 56 bp, Homo sapiens
  chr9:140024786-140024842
  hyper
cgagcgagggggccaagcggccggctggacccacagtccccgcgccataggcgggt

SEQ ID NO: 53540 - DNA, 67 bp, Homo sapiens
  chr9:140025023-140025090
  hyper
tttcttctggccaggctgccccctgccccttgggcgattctgctgcgtcccacggtcctggctgtgg

SEQ ID NO: 53541 - DNA, 8 bp, Homo sapiens
  chr9:140033418-140033426
  hyper
acccctcc

SEQ ID NO: 53542 - DNA, 147 bp, Homo sapiens; identical to SEQ ID NO: 20495
  chr9:140033762-140033909
  hyper

SEQ ID NO: 53543 - DNA, 83 bp, Homo sapiens
  chr9:140034079-140034162
  hyper
caggccaacaagcggcacggctcctggaagattcagctcaatgccacctccgtcacgcacaagcccaacgccatccagatggc

SEQ ID NO: 53544 - DNA, 13 bp, Homo sapiens
  chr9:140050956-140050969
  hyper
tcctgggttctgg

SEQ ID NO: 53545 - DNA, 137 bp, Homo sapiens; identical to SEQ ID NO: 20498
  chr9:140051354-140051491
  hyper

SEQ ID NO: 53546 - DNA, 78 bp, Homo sapiens
  chr9:140773301-140773379
  hyper
aggccccgcctcgcggccgcccctagggatgggggcagggagtgagggagaccaggccgcttccgccaggagaggggc

SEQ ID NO: 53547 - DNA, 33 bp, Homo sapiens; identical to SEQ ID NO: 32846
  chr9:141044732-141044765
  hyper

SEQ ID NO: 53548 - DNA, 30 bp, Homo sapiens; identical to SEQ ID NO: 32847
  chr10:735019-735049
  hyper

SEQ ID NO: 53549 - DNA, 30 bp, Homo sapiens; identical to SEQ ID NO: 32848
  chr10:830880-830910
  hyper

SEQ ID NO: 53550 - DNA, 40 bp, Homo sapiens; identical to SEQ ID NO: 10147
  chr10:1778568-1778608
  hyper

SEQ ID NO: 53551 - DNA, 257 bp, Homo sapiens; identical to SEQ ID NO: 32850
  chr10:1778826-1779083
  hyper

SEQ ID NO: 53552 - DNA, 306 bp, Homo sapiens
  chr10:1779111-1779417
  hyper
cggagcagccatcccgccagcaccccaaagtgaagctgctcacaacggacaagcccggagaccccatgagaggccggggtggagaagccgggggtgaaggggggcaggggccggcgcgccacgcggtccttacctttccgcttggacctccgcctcctcctcctcttggacttgcatttgagttgactgctcagccctccagaccctctgccgctccccaggaccgaggccatggccgagacccaggcgcggagcccagagccgcctccctcctgcacctgcacctgcctccttcccggcagccgc

SEQ ID NO: 53553 - DNA, 91 bp, Homo sapiens; identical to SEQ ID NO: 20502
  chr10:1779744-1779835
  hyper

SEQ ID NO: 53554 - DNA, 220 bp, Homo sapiens; identical to SEQ ID NO: 32852
  chr10:1779836-1780056
  hyper

SEQ ID NO: 53555 - DNA, 94 bp, Homo sapiens; identical to SEQ ID NO: 32853
  chr10:3108959-3109053
  hyper

SEQ ID NO: 53556 - DNA, 114 bp, Homo sapiens; identical to SEQ ID NO: 32854
  chr10:3109054-3109168
  hyper

SEQ ID NO: 53557 - DNA, 30 bp, Homo sapiens; identical to SEQ ID NO: 32855
  chr10:4698935-4698965
  hyper

SEQ ID NO: 53558 - DNA, 837 bp, Homo sapiens; identical to SEQ ID NO: 20505
  chr10:7451390-7452227
  hyper

SEQ ID NO: 53559 - DNA, 241 bp, Homo sapiens
  chr10:7452777-7453018
  hyper
cggccagcctgggcgccggggacagcagccggcgcggcgtcctacctggtgaagttcgtcctgccctcggcgtggacccaggccccggtcgccgcccgggagggcaccggcctcgctcgcttgctcgctcgcccgcccttgcccgctcgctccccgcccgccgcctccctcgcgcgcccgctccggtcctccggctcccactacagctcattccaatatggcatcctctctgtgcgcatgc

SEQ ID NO: 53560 - DNA, 235 bp, Homo sapiens
  chr10:7453078-7453313
  hyper
tgtgtgcgtgcgcgtgcagcgaactccttcaacgaccttttccagcgcttgcaaaatttcttaagccaattagcctgcgggacgtgatcggctccttccccagccagctccgcgccattccctgcgcctaagcaggcgggcacccccaggaccctgggaccttccacgcccacgcggcctcctccccaccgcgctccccttcctcctttttgtgagctccctccatacatgatct

SEQ ID NO: 53561 - DNA, 70 bp, Homo sapiens
  chr10:7453930-7454000
  hyper
gcggaaaagccggtgacgccctggtagcaagaccaagagcttccgaagaacgctgcgcccttaactaggg

SEQ ID NO: 53562 - DNA, 158 bp, Homo sapiens; identical to SEQ ID NO: 32860
  chr10:7454448-7454606
  hyper

SEQ ID NO: 53563 - DNA, 319 bp, Homo sapiens
  chr10:7708471-7708790
  hyper
ctcagaaattaacaacgacgaacagaaatctgcgcaatcaacaggagccaagaagaaaaactcggctccgcaggacaagtcccgggcacagttctgcaggaagcctcaggccagatcaggcaccgcggctcacacagaggtgacgcacgagtgacccacagagagggacccctgggcctctggtgggggcctgggagacggtcgaagggggcccgggcagaagctccgcggccgggccggcggagggaagggggcggccgcgcccgggacccggctcccctcggctccacttacctgctccgaagagtggccccagctc

SEQ ID NO: 53564 - DNA, 124 bp, Homo sapiens; identical to SEQ ID NO: 3501
  chr10:8076053-8076177
  hyper

SEQ ID NO: 53565 - DNA, 317 bp, Homo sapiens
  chr10:8076487-8076804
  hyper
gaaagaaattgaaaagggagtgcgggcgactgagggaagctggaggggaaataggggcctcggccaccagtggcctatgtccataactgccctttggttttggtggccttgcaggccgggaatcgagtctgccatgttcgctttcagacgggcctcctggcaagctcttggttgactgtccccagatgttccgggaacccacccctcccccacaccctcccgccccaaccctccgcagagaagccgaggaccacatccatccgcttcctaggaacctgcccgcaccagcaggccctgtttcctggacaaactgggca

SEQ ID NO: 53566 - DNA, 25 bp, Homo sapiens
  chr10:8078218-8078243
  hyper
actttgcacacgtgacatgggggtc

SEQ ID NO: 53567 - DNA, 30 bp, Homo sapiens; identical to SEQ ID NO: 32867
  chr10:8079721-8079751
  hyper

SEQ ID NO: 53568 - DNA, 257 bp, Homo sapiens
  chr10:8085721-8085978
  hyper
ggaaggacttagggactccccagagggcagacagacctggccagcttggcaaatcataaatccctctccctggaccctcggcctaaacctacccccagggtgtgcagcggaggcgcacaggggttggctgacgggctggggtgcgcctgggtggaggctggtttggggttctggcgtctggaggcaggccatggaaccagaggagagggcaggagggcccaccgcgcagagctgcggcccggctcctagagtggcgc

SEQ ID NO: 53569 - DNA, 30 bp, Homo sapiens; identical to SEQ ID NO: 32869
  chr10:8086710-8086740
  hyper

SEQ ID NO: 53570 - DNA, 130 bp, Homo sapiens; identical to SEQ ID NO: 32870
  chr10:8087215-8087345
  hyper

SEQ ID NO: 53571 - DNA, 264 bp, Homo sapiens; identical to SEQ ID NO: 32871
  chr10:8090494-8090758
  hyper

SEQ ID NO: 53572 - DNA, 30 bp, Homo sapiens; identical to SEQ ID NO: 32872
  chr10:8091376-8091406
  hyper

SEQ ID NO: 53573 - DNA, 37 bp, Homo sapiens; identical to SEQ ID NO: 20515
  chr10:8091858-8091895
  hyper

SEQ ID NO: 53574 - DNA, 89 bp, Homo sapiens; identical to SEQ ID NO: 32874
  chr10:8092446-8092535
  hyper

SEQ ID NO: 53575 - DNA, 6 bp, Homo sapiens
  chr10:8093458-8093464
  hyper
aagccc

SEQ ID NO: 53576 - DNA, 20 bp, Homo sapiens
  chr10:8093718-8093738
  hyper
tttccctcccccgcccgcca

SEQ ID NO: 53577 - DNA, 6 bp, Homo sapiens
  chr10:8094252-8094258
  hyper
catccc

SEQ ID NO: 53578 - DNA, 261 bp, Homo sapiens; identical to SEQ ID NO: 32879
  chr10:8095198-8095459
  hyper

SEQ ID NO: 53579 - DNA, 111 bp, Homo sapiens; identical to SEQ ID NO: 20519
  chr10:8095492-8095603
  hyper

SEQ ID NO: 53580 - DNA, 5 bp, Homo sapiens
  chr10:8096155-8096160
  hyper
cacgt

SEQ ID NO: 53581 - DNA, 350 bp, Homo sapiens
  chr10:8096190-8096540
  hyper
cctgcattagatcctaataatgatccatgcgtgcctattttttaaaagtctgaaaaagaaaattctgcccatcgaaatgaacttcatgaatggggcaggctggctgcaccgggacggaatcgtccacccgacccgaatgaattggcaggagccgcggccacatttaaagggccagagcgcgcgttccctcccgtccgcccccaagccccgcgggcctcgcccaccctgcccgccgcccctccgccggcggccgccctctgcggcgcccctttccggtcagtggaggggcgggaggaggggcgggggtgcgcggggcggggggagaagtcctggagcgggtttgggttgca

SEQ ID NO: 53582 - DNA, 88 bp, Homo sapiens; identical to SEQ ID NO: 32882
  chr10:8096747-8096835
  hyper

SEQ ID NO: 53583 - DNA, 277 bp, Homo sapiens
  chr10:8097197-8097474
  hyper
ccactccagcaactcaggggctcatccaggtctcccattctctcccttgcaggtgacccgaggagggactccgcctccgagcggctgaggaccccggtgcagaggagcctggctcgcagaattgcagagtcgtcgcccctttttacaacctggtcccgttttattctgccgtacccagtttttggatttttgtcttccccttcttctctttgctaaacgacccctccaagataatttttaaaaaaccttctcctttgctcacctttgcttcccagcc

SEQ ID NO: 53584 - DNA, 375 bp, Homo sapiens; identical to SEQ ID NO: 32884
  chr10:8374353-8374728
  hyper

SEQ ID NO: 53585 - DNA, 195 bp, Homo sapiens; identical to SEQ ID NO: 32885
  chr10:11059469-11059664
  hyper

SEQ ID NO: 53586 - DNA, 96 bp, Homo sapiens
  chr10:11060062-11060158
  hyper
ccttcaagctggatttcctcccggacatgatggtcgagggccgcctgctcgttcctgacagaatgtgagtggcgccgcgtcccgaggccgggcgag

SEQ ID NO: 53587 - DNA, 121 bp, Homo sapiens; identical to SEQ ID NO: 10180
  chr10:11060314-11060435
  hyper

SEQ ID NO: 53588 - DNA, 117 bp, Homo sapiens; identical to SEQ ID NO: 32888
  chr10:11060512-11060629
  hyper

SEQ ID NO: 53589 - DNA, 37 bp, Homo sapiens; identical to SEQ ID NO: 32890
  chr10:11784349-11784386
  hyper

SEQ ID NO: 53590 - DNA, 211 bp, Homo sapiens
  chr10:13043175-13043386
  hyper
cggcggcgccgccgggctcacctgaggaagaagaaataggagtagtcctggaccacggtgtgggagtggcacgagaagtagcccaggccggtgaggttgagcctggagccggcgggcacctccagcatgctgccccacgcctggtcgcacagcatctcgacctcggccgagtagaagaggcccccctggccggcgtggtactgccagggca

SEQ ID NO: 53591 - DNA, 109 bp, Homo sapiens; identical to SEQ ID NO: 20525
  chr10:13043425-13043534
  hyper

SEQ ID NO: 53592 - DNA, 43 bp, Homo sapiens; identical to SEQ ID NO: 32892
  chr10:13043744-13043787
  hyper

SEQ ID NO: 53593 - DNA, 130 bp, Homo sapiens
  chr10:13934183-13934313
  hyper
gggggacccctggctcccccacaaaacccacccaaagccaccgctcgaggccctctcctaccctgagagcccggagacagcagctcccttggctgaaggcacagctcttacccctcgatctagtccaatt

SEQ ID NO: 53594 - DNA, 165 bp, Homo sapiens; identical to SEQ ID NO: 32898
  chr10:14215748-14215913
  hyper

SEQ ID NO: 53595 - DNA, 106 bp, Homo sapiens; identical to SEQ ID NO: 32899
  chr10:14216190-14216296
  hyper

SEQ ID NO: 53596 - DNA, 329 bp, Homo sapiens
  chr10:15760963-15761292
  hyper
ctgtaacctcctgcccggggacactggggcaggcgtggagggcatgaacgtatttatgatgaggaccgactgtcaaacttgatttcctcttggaaacgggggtccgcaacctggtttgcaagaatgcaaacggtcctgcttctctaggtggagctctgtgggtacagtgagatgagagaagggggtggggtaggaggaagccaaggacagagcccagctgctggtagccgacagctcttgcgcccagacgcaatggttacagactctgcataaacagacctcgctgtggtggcggttttaactggcttgggtcttctgggtcctgttct

SEQ ID NO: 53597 - DNA, 183 bp, Homo sapiens; identical to SEQ ID NO: 20529
  chr10:15761671-15761854
  hyper

SEQ ID NO: 53598 - DNA, 259 bp, Homo sapiens; identical to SEQ ID NO: 32901
  chr10:15761855-15762114
  hyper

SEQ ID NO: 53599 - DNA, 42 bp, Homo sapiens; identical to SEQ ID NO: 20531
  chr10:16563909-16563951
  hyper

SEQ ID NO: 53600 - DNA, 325 bp, Homo sapiens
  chr10:17270666-17270991
  hyper
tccgccaaggcaagtcgatggacagaggcgcgggccggagcagcccccctttccaagcgggcggcgcgcgaggctgcggcgaggcctgagccctgcgttcctgcgctgtgcgcgcccccaccccgcgttccaatctcaggcgctctttgtttctttctccgcgacttcagatctgagggattccttactctttcctcttcccgctcctttgcccgcgggtctccccgcctgaccgcagccccgagaccgccgcgcacctcctcccacgcccctttggcgtggtgccaccggacccctctggttcagtcccaggcggacccccccc

SEQ ID NO: 53601 - DNA, 289 bp, Homo sapiens
  chr10:17271625-17271914
  hyper
cgcctgcggagcagcgtgcccggggtgcggctcctgcaggactcggtggacttctcgctggccgacgccatcaacaccgagttcaagaacacccgcaccaacgagaaggtggagctgcaggagctgaatgaccgcttcgccaactacatcgacaaggtgcgcttcctggagcagcagaataagatcctgctggccgagctcgagcagctcaagggccaaggcaagtcgcgcctgggggacctctacgaggaggagatgcgggagctgcgccggcaggtggaccagctaa

SEQ ID NO: 53602 - DNA, 102 bp, Homo sapiens; identical to SEQ ID NO: 10197
  chr10:17495534-17495636
  hyper

SEQ ID NO: 53603 - DNA, 94 bp, Homo sapiens; identical to SEQ ID NO: 32911
  chr10:17496002-17496096
  hyper

SEQ ID NO: 53604 - DNA, 110 bp, Homo sapiens; identical to SEQ ID NO: 20534
  chr10:17496734-17496844
  hyper

SEQ ID NO: 53605 - DNA, 111 bp, Homo sapiens
  chr10:18429517-18429628
  hyper
ggggcgctgcggggcgctgcgccgagaacggccgggcctgagccctgggcggcccccagagccgatcagagcgcggggaggcgggggcgaggaggaggggacccgccgccg

SEQ ID NO: 53606 - DNA, 79 bp, Homo sapiens
  chr10:18429774-18429853
  hyper
ccgccgcacaggtagcgagagcgcggcgccttctccttcctttgtgagccgccgggcagggcaccgacctcgggttctc

SEQ ID NO: 53607 - DNA, 7 bp, Homo sapiens
  chr10:18430144-18430151
  hyper
gtgagtc

SEQ ID NO: 53608 - DNA, 64 bp, Homo sapiens; identical to SEQ ID NO: 32916
  chr10:18430183-18430247
  hyper

SEQ ID NO: 53609 - DNA, 188 bp, Homo sapiens; identical to SEQ ID NO: 32917
  chr10:20105422-20105610
  hyper

SEQ ID NO: 53610 - DNA, 66 bp, Homo sapiens; identical to SEQ ID NO: 32918
  chr10:20106628-20106694
  hyper

SEQ ID NO: 53611 - DNA, 63 bp, Homo sapiens; identical to SEQ ID NO: 32919
  chr10:21783695-21783758
  hyper

SEQ ID NO: 53612 - DNA, 45 bp, Homo sapiens; identical to SEQ ID NO: 32920
  chr10:21789093-21789138
  hyper

SEQ ID NO: 53613 - DNA, 123 bp, Homo sapiens
  chr10:21805094-21805217
  hyper
tctcagataccctatcgttccttatctcagcgaaacaactccccaggctggccgggcagtacaccggagatgctttgggggcccagctctgcagattccactccgccggcgactccgctttga

SEQ ID NO: 53614 - DNA, 60 bp, Homo sapiens
  chr10:21805277-21805337
  hyper
cggcggcggaggccagatggtacaagaagttggcctgcgcctgcacgctgggaggcttgc

SEQ ID NO: 53615 - DNA, 117 bp, Homo sapiens; identical to SEQ ID NO: 32922
  chr10:22518011-22518128
  hyper

SEQ ID NO: 53616 - DNA, 37 bp, Homo sapiens; identical to SEQ ID NO: 32923
  chr10:22518491-22518528
  hyper

SEQ ID NO: 53617 - DNA, 98 bp, Homo sapiens; identical to SEQ ID NO: 32924
  chr10:22540740-22540838
  hyper

SEQ ID NO: 53618 - DNA, 576 bp, Homo sapiens
  chr10:22541062-22541638
  hyper
aggaagaaggaaaaccgagtaaaggaggttattcataagaacaggaaaggggccgaggggtagagaacacccgaaggaaagcgcaggaggccctcgtgagagggcaagggggaaaagatcgacgaagtaagagcgaaaagaggaaaggaaagaaagactttctagatgcggagtctccattttcagcagcgccatattcgcttttcctctcgccgcttttggctgggttttgtgtgcggcggtggacaggcgccagcacatttctgcagcttcagcagctctgctcagacacctggggagggccgcagggcccgggcgggggacgcgcgctcttggcccaggcccgggcgcggccccctccccggcctggcggttcctgcgcagcgccagccccgcgctcctctaggctgcaaagggggcctccgactcgggcccggcccggaggggacacctcactcggggccccgcggcagcccccaggggacgcgggccctctagtttcgcccacggtgtggctgggcatgcgtgccaaggggatgcgtaaccgagaaccgaaaaagacgaacttaaccttcg

SEQ ID NO: 53619 - DNA, 29 bp, Homo sapiens
  chr10:22542567-22542596
  hyper
ggccccgggataatcggatcctcccagac

SEQ ID NO: 53620 - DNA, 125 bp, Homo sapiens; identical to SEQ ID NO: 20544
  chr10:22625978-22626103
  hyper

SEQ ID NO: 53621 - DNA, 77 bp, Homo sapiens; identical to SEQ ID NO: 20545
  chr10:22634578-22634655
  hyper

SEQ ID NO: 53622 - DNA, 76 bp, Homo sapiens
  chr10:22764573-22764649
  hyper
tgcgtaaataatactcgattaccatgccacctacatctttttgttaaaaatgcctttatgaaggctataatcctta

SEQ ID NO: 53623 - DNA, 30 bp, Homo sapiens; identical to SEQ ID NO: 32937
  chr10:23001954-23001984
  hyper

SEQ ID NO: 53624 - DNA, 18 bp, Homo sapiens
  chr10:23216825-23216843
  hyper
ctggattcaggtaatcgc

SEQ ID NO: 53625 - DNA, 21 bp, Homo sapiens
  chr10:23216844-23216865
  hyper
gacgcacttggctcctcccgc

SEQ ID NO: 53626 - DNA, 185 bp, Homo sapiens; identical to SEQ ID NO: 20547
  chr10:23216945-23217130
  hyper

SEQ ID NO: 53627 - DNA, 66 bp, Homo sapiens
  chr10:23461156-23461222
  hyper
cgatccgcagttcttcgcccctccctctgtcccaattatctagaaacaaaaagagtagaaaatcga

SEQ ID NO: 53628 - DNA, 39 bp, Homo sapiens
  chr10:23462020-23462059
  hyper
ccggaatccctgagtcgactcaccccctctccttttttt

SEQ ID NO: 53629 - DNA, 164 bp, Homo sapiens
  chr10:23462910-23463074
  hyper
catggtccgcaaaagacaggtggcagtggcagtcttgcatgatacttgtccttcttccctgttccccattttggggaaacactggaaacacttttctctttatgcgcattcgcgtctcagcaccgagtgctccaagccctgcgcgcagcgccgggcttggaagg

SEQ ID NO: 53630 - DNA, 18 bp, Homo sapiens
  chr10:23481303-23481321
  hyper
gggcactccagggaggcc

SEQ ID NO: 53631 - DNA, 271 bp, Homo sapiens; identical to SEQ ID NO: 20550
  chr10:23481515-23481786
  hyper

SEQ ID NO: 53632 - DNA, 149 bp, Homo sapiens; identical to SEQ ID NO: 20551
  chr10:23481787-23481936
  hyper

SEQ ID NO: 53633 - DNA, 17 bp, Homo sapiens
  chr10:23482445-23482462
  hyper
cgcgtccccgccagact

SEQ ID NO: 53634 - DNA, 51 bp, Homo sapiens; identical to SEQ ID NO: 20553
  chr10:23483777-23483828
  hyper

SEQ ID NO: 53635 - DNA, 23 bp, Homo sapiens
  chr10:23486241-23486264
  hyper
gaactcctgtgaaatcggctgag

SEQ ID NO: 53636 - DNA, 86 bp, Homo sapiens
  chr10:23486328-23486414
  hyper
aagcctcttaaatccataaactcatcccatttccattaatgggcctttgcggtggcaccgagtaccagctgcgaggttgaacaaac

SEQ ID NO: 53637 - DNA, 177 bp, Homo sapiens; identical to SEQ ID NO: 20555
  chr10:23487978-23488155
  hyper

SEQ ID NO: 53638 - DNA, 11 bp, Homo sapiens
  chr10:23488382-23488393
  hyper
tcttcggagga

SEQ ID NO: 53639 - DNA, 251 bp, Homo sapiens; identical to SEQ ID NO: 20556
  chr10:23489158-23489409
  hyper

SEQ ID NO: 53640 - DNA, 616 bp, Homo sapiens
  chr10:23489439-23490055
  hyper
tgctaattacaaattttaaaacaagccacttctaagcgaaggacgcctggctgcaaccccacaactcacaccggtgcatataataaaatattagggttcaacagttggcatatgtggcaatagcaaatgtgacacctcgaagcgattatctggaagtttttccgtacttttgaaaatacacttgccgcctcatttctctgatggccgctcaatagacactgggagatggtagctgggccacccctcccaagagttcttcttgcgtgcagcgctttcatccagggcttgaattgtgttgtcaaagtttagcagacaagaggagggggcatgagaacgggagggtgtcttgaaaagtcttggaaatcggtgtattttgcaggtgtagaagtgcctaataaccatggctagtgcgcgctccccaatggcgagggtatgacagggacagctggctcagttttcagtgtgaaaacaccccctcggtggaccaaacacaacgacactgacctttcttcggggggaaccagggatgtgcctttgactgaattagccataaagacgtcttgctatgacttttgttccccacgaaagcaaagaaatattgcgtttaatatgagaa

SEQ ID NO: 53641 - DNA, 47 bp, Homo sapiens; identical to SEQ ID NO: 32957
  chr10:23491161-23491208
  hyper

SEQ ID NO: 53642 - DNA, 123 bp, Homo sapiens; identical to SEQ ID NO: 32958
  chr10:23633374-23633497
  hyper

SEQ ID NO: 53643 - DNA, 54 bp, Homo sapiens
  chr10:23982384-23982438
  hyper
ctcgcagttaaaaaccgttgccactcgacggtggcaaaattgctggctgcactg

SEQ ID NO: 53644 - DNA, 374 bp, Homo sapiens; identical to SEQ ID NO: 20560
  chr10:23982820-23983194
  hyper

SEQ ID NO: 53645 - DNA, 33 bp, Homo sapiens; identical to SEQ ID NO: 20561
  chr10:23983247-23983280
  hyper

SEQ ID NO: 53646 - DNA, 107 bp, Homo sapiens; identical to SEQ ID NO: 20562
  chr10:23983700-23983807
  hyper

SEQ ID NO: 53647 - DNA, 40 bp, Homo sapiens
  chr10:23984047-23984087
  hyper
cgcatttcgcagctgcgctggtgtggggcatgagagcgag

SEQ ID NO: 53648 - DNA, 549 bp, Homo sapiens
  chr10:23984226-23984775
  hyper
tctcccctccttggataaggaaaccgaggggagacttacaagggagccttgcgcgggagagcaagtgagcgtttcgagagagggcaaggacccccccaggagggccaggccgggaggggtcccggtgcggtgatggggtgccaaaaggagaagacccccaactgggaggagggactggagaggaaccggaccccggggatctcagaaagggaaggatgtggggagagtgaaggtggaggcagtcacacctatcctggtgaccttggcgtgcccccctggagtggcgagccaggggcttatataggtgcgactaggatgttgcctcgtttttcactcggggctgcgaagagggcattgctctttctgatggctggaagacaggggcaaggagagagagaaccggccccgagacgggctggagggtggggacactggggagtttggagctgggggttcggagtgggaggtttgggtcttctgagacgctccagactctccggaggcggcagaggtcgaggcaggaggcgaatgtgacgcttagggtcgcta

SEQ ID NO: 53649 - DNA, 82 bp, Homo sapiens; identical to SEQ ID NO: 20564
  chr10:23984841-23984923
  hyper

SEQ ID NO: 53650 - DNA, 42 bp, Homo sapiens; identical to SEQ ID NO: 32963
  chr10:25241916-25241958
  hyper

SEQ ID NO: 53651 - DNA, 60 bp, Homo sapiens; identical to SEQ ID NO: 32964
  chr10:25463833-25463893
  hyper

SEQ ID NO: 53652 - DNA, 99 bp, Homo sapiens
  chr10:25464520-25464619
  hyper
tcggctccctggagccgctccaccgatggcaccatcttggcgcagaaactcgccgaggaggtgcccatggacgtggcctcttacctctacaccggggac

SEQ ID NO: 53653 - DNA, 147 bp, Homo sapiens; identical to SEQ ID NO: 3542
  chr10:25465203-25465350
  hyper

SEQ ID NO: 53654 - DNA, 70 bp, Homo sapiens; identical to SEQ ID NO: 20566
  chr10:25465351-25465421
  hyper

SEQ ID NO: 53655 - DNA, 38 bp, Homo sapiens; identical to SEQ ID NO: 20567
  chr10:25465517-25465555
  hyper

SEQ ID NO: 53656 - DNA, 153 bp, Homo sapiens
  chr10:26055841-26055994
  hyper
cctatctgcgcgctgtcaatcatcccccacctgtggatcgcgcagcccagccaaaaaattaattgcttagaaatataaaatcggtggactcagatcggaaaggattaggagaaaaaaggttaagcgaggggaagaagccgtgctgtgccagag

SEQ ID NO: 53657 - DNA, 431 bp, Homo sapiens
  chr10:26223600-26224031
  hyper
gccaggaggagggaacgggaagggtgaacctgaggggtggacttgagggaagatcttgtgggtgaacccgaggagggaacgcgaggggatagtgaggggggatctcgaggagggaacgtgaggaatgaacttgaggagggaacgggaggggtgaacgtgaagtggaaacaggaggagggaacgggaagggtggcgtaaggggtgaaggaagatctttaggggtgaacttgggaaggaaacgtaaggggaggacctcgaagagtaacgaggggcgagaactgagggggccctgcagggagactggagggaggaggcgccgagtctggcgggtgtcgcctcggagacctgtggcgcgcgcgggctttgcggcgccgcccacaggtggcgctgggtcggcccgtccctgagggaactgcgttccgggtgatttc

SEQ ID NO: 53658 - DNA, 27 bp, Homo sapiens
  chr10:26500592-26500619
  hyper
cctgttgagaattatcgcagatacgtt

SEQ ID NO: 53659 - DNA, 136 bp, Homo sapiens; identical to SEQ ID NO: 32973
  chr10:26501026-26501162
  hyper

SEQ ID NO: 53660 - DNA, 39 bp, Homo sapiens; identical to SEQ ID NO: 10249
  chr10:26501446-26501485
  hyper

SEQ ID NO: 53661 - DNA, 383 bp, Homo sapiens
  chr10:26503731-26504114
  hyper
tggaacagacttcacctagcacgctcagtgccagccttcggcaggacgctatcaacgcccgactggtttcctgctctcatcctggcgcctgggcccagttgccatagtgtggatcccatgactcctcagggaacccctggactcaggcacgcgagaagaagacagcgctttgtggagagaattgaccagggacagttatgctcgagcacacaggacttgggcctgtatgcgtccagcatgggccccaggatgtcccttctaagcgagggtcgaggggtgctcgcccagacgggatccccgggtctctgctttgttagcagctttggtggctggttcaggaggtcagagaaataaaacgacttgtgaacacaatggaaatgaca

SEQ ID NO: 53662 - DNA, 301 bp, Homo sapiens; identical to SEQ ID NO: 20574
  chr10:26504190-26504491
  hyper

SEQ ID NO: 53663 - DNA, 9 bp, Homo sapiens
  chr10:26505227-26505236
  hyper
ccgggacag

SEQ ID NO: 53664 - DNA, 344 bp, Homo sapiens
  chr10:26505713-26506057
  hyper
cgacctgctccagtctccaaagccgatggcatctccgggctctggcttttggtctttcgggtcggaagatggctctggggattccgagaatcccggcacaggtaggaaggagaacgggggcctgcggcgggcgagttttgcggtggtctggggtttgcggaactacggagaagacgaaggaggtttttccacctgcaacaggaaacttcttcgggcgcttctccctgcttttgggctaagtccttgacggcccaagagctcaagacctctacagcctcttgtaccctgggaagacgcccaaatagtctcaggcccgttccacagaaggttggaagagcccccca

SEQ ID NO: 53665 - DNA, 190 bp, Homo sapiens
  chr10:26506163-26506353
  hyper
aaaaaatgggaaaggtgagagatttctttatctagaaagacagtctgcgaaaaaatggatagcttcagtgtttaggaaaactcgtccaaggtaggcagggagaggaatttgcctgagccgattggcacctggaagggcagcggtgtgggcttctcctcgggaaacagataaaggaaatgagggctggccc

SEQ ID NO: 53666 - DNA, 19 bp, Homo sapiens
  chr10:26506354-26506373
  hyper
ggccgccagcctcccgctt

SEQ ID NO: 53667 - DNA, 47 bp, Homo sapiens
  chr10:26507400-26507447
  hyper
tgcacttacacaccgtctcccaaatgtacgcgcgcacacacacatgc

SEQ ID NO: 53668 - DNA, 30 bp, Homo sapiens; identical to SEQ ID NO: 32983
  chr10:26680701-26680731
  hyper

SEQ ID NO: 53669 - DNA, 139 bp, Homo sapiens
  chr10:26680960-26681099
  hyper
gggcagactgtacccgggcaacggctccccgcagctccggctttttgcctgaagccccctgcaggcaaattccgcgtcgcgcgggcccgcgggcgcgctgcagtctccgagccccaggaagcagagacccaggtaggca

SEQ ID NO: 53670 - DNA, 2 bp, Homo sapiens
  chr10:26681129-26681131
  hyper
gg

SEQ ID NO: 53671 - DNA, 22 bp, Homo sapiens
  chr10:26727076-26727098
  hyper
tcctccacccccacccgagaga

SEQ ID NO: 53672 - DNA, 236 bp, Homo sapiens
  chr10:26727368-26727604
  hyper
ggcgcgcgcggcacaggtagggggaggcgcaacgtttcccagaattaaaataaaataaaataaaataaaataaaaatcccttcaaggtggttgtgtagtaggggtgggatgggggagagaaaatcaggcgcagactcgatgagttggagaaagcagcccctaactcggagtcctttacgcatatgtttgtctgtcccactgtctctaaccaggggccttccttgcacctcggagca

SEQ ID NO: 53673 - DNA, 183 bp, Homo sapiens; identical to SEQ ID NO: 891
  chr10:26727867-26728050
  hyper

SEQ ID NO: 53674 - DNA, 377 bp, Homo sapiens
  chr10:27547569-27547946
  hyper
caacctttcctaccgcgtggagtgagttgggatgcatactggggagttgtataagagtgtctgagaaagggaaatgcagagttgaatgaaagtgtttcccgggaggggccgagtggaaagcagcaggtggccggcgcgggtggaacccagcgcgggcgcagagcgtctctggcgtgggcattcggtgcagcgagtccgcgggaatcttggatgcgcggaggtccccggaccgcggtgacggacggggctgcgatcgtggccggtgagactgggagcggagggctggggcggcgcccgagggagggcacaaacccgggaggcctcagccgacggcgcagctttacgcggccgtagggcgcccggggttgagtggtgtc

SEQ ID NO: 53675 - DNA, 157 bp, Homo sapiens
  chr10:28030925-28031082
  hyper
aataaagcaaaggagcattgccgccccggctctctttaagctatttcctttgatcttttaggaaaagggggaaactttctaaaggagttggtggtttgtggaggaaagctgcagaacccaaaaacaccgtcgggccgtttcccgactaagggagggt

SEQ ID NO: 53676 - DNA, 324 bp, Homo sapiens; identical to SEQ ID NO: 32990
  chr10:28031314-28031638
  hyper

SEQ ID NO: 53677 - DNA, 881 bp, Homo sapiens; identical to SEQ ID NO: 32991
  chr10:28031863-28032744
  hyper

SEQ ID NO: 53678 - DNA, 14 bp, Homo sapiens
  chr10:28032952-28032966
  hyper
gatttgggggattt

SEQ ID NO: 53679 - DNA, 390 bp, Homo sapiens
  chr10:28033020-28033410
  hyper
ccaaggtcccccggggtgaggttgggttcaaggacaggaaaaagttaagtggcgtcaggacgaaagcaccacttctcccccttctctcccagaatcttcctatcatcccccaacgcgccccgggaagtgcatggtcctaaggtccaaggcgccaggacccaggtccccagagccctcaatcagtgccattctcttccgcagcgcgggtgtcagccgcgagctcgtagcccctcgacacccgcctctctctggggtctccggggaccctttcagaggctgtaaaggtgtcagaagcccaaggcaggaggcagcttggtcggcgcacctcccgggccactgctgccactgtcggggagagccagcagctcacctctggggtcgcggaggccc

SEQ ID NO: 53680 - DNA, 159 bp, Homo sapiens
  chr10:28033481-28033640
  hyper
ccaaggcgcgcggcggacttcgcccgccccatctcctcgcctcgcgcctcgggacagctcccgtttcctccgagcggcctcagcttcgctgccagcgccccctttgcccgtccagccgcggcatgggctgctactccactaacacacgcgcgcgcgcat

SEQ ID NO: 53681 - DNA, 70 bp, Homo sapiens
  chr10:28033700-28033770
  hyper
cgccaacgcccccgccccgcccttcggccaccgcagcagaggccacgcgtgacatttaggaccacgcgtg

SEQ ID NO: 53682 - DNA, 178 bp, Homo sapiens
  chr10:28034341-28034519
  hyper
cacttaccccgattcactccagactgtggccggggaggtcactccctgcagaagtgtccccctcccccaacgccggcgaataattttaaagcaaaggaggcgcggccaggtgggctcccaagctccgcgcagacccttgggccagccttggccgctacccgagcgcctctccaccaga

SEQ ID NO: 53683 - DNA, 315 bp, Homo sapiens
  chr10:28035300-28035615
  hyper
cccaggagcctcttttctgatgtcactgggcttctggggtcctagttgtctcagtcaaagccaggcacacattcacctccggggcaagggctggtgaggctgccctcgccgctgggtatagggatgggggaaagcaaggatgggatgagttcagcccaggtggccaacccgcggtggcccaagtgcagaagaggaagcgcgcccaaagccaaggatctgcacgcagcaaaggagatggaacttagaagaatcacaagctgggacacagggcaaagagagagaatggctaccagattctctgattgatgatacttt

SEQ ID NO: 53684 - DNA, 8 bp, Homo sapiens
  chr10:28287365-28287373
  hyper
cgggaggc

SEQ ID NO: 53685 - DNA, 136 bp, Homo sapiens; identical to SEQ ID NO: 20581
  chr10:28288070-28288206
  hyper

SEQ ID NO: 53686 - DNA, 537 bp, Homo sapiens; identical to SEQ ID NO: 32998
  chr10:28957458-28957995
  hyper

SEQ ID NO: 53687 - DNA, 43 bp, Homo sapiens
  chr10:28958043-28958086
  hyper
cgatctttttggatgttctccctgcctaaaacggatgctaata

SEQ ID NO: 53688 - DNA, 141 bp, Homo sapiens; identical to SEQ ID NO: 33000
  chr10:28965689-28965830
  hyper

SEQ ID NO: 53689 - DNA, 9 bp, Homo sapiens
  chr10:29011038-29011047
  hyper
agctgttta

SEQ ID NO: 53690 - DNA, 118 bp, Homo sapiens; identical to SEQ ID NO: 33002
  chr10:29011504-29011622
  hyper

SEQ ID NO: 53691 - DNA, 67 bp, Homo sapiens
  chr10:30026090-30026157
  hyper
cctgagaggcccctttgagtctccagaccttccagggataaataaaatctggcgacctgtgccaacg

SEQ ID NO: 53692 - DNA, 259 bp, Homo sapiens; identical to SEQ ID NO: 33004
  chr10:30348156-30348415
  hyper

SEQ ID NO: 53693 - DNA, 30 bp, Homo sapiens; identical to SEQ ID NO: 33005
  chr10:31073324-31073354
  hyper

SEQ ID NO: 53694 - DNA, 32 bp, Homo sapiens; identical to SEQ ID NO: 33006
  chr10:31074146-31074178
  hyper

SEQ ID NO: 53695 - DNA, 48 bp, Homo sapiens; identical to SEQ ID NO: 33007
  chr10:31422926-31422974
  hyper

SEQ ID NO: 53696 - DNA, 335 bp, Homo sapiens; identical to SEQ ID NO: 33008
  chr10:31608744-31609079
  hyper

SEQ ID NO: 53697 - DNA, 45 bp, Homo sapiens; identical to SEQ ID NO: 33009
  chr10:31609288-31609333
  hyper

SEQ ID NO: 53698 - DNA, 397 bp, Homo sapiens; identical to SEQ ID NO: 33010
  chr10:31609668-31610065
  hyper

SEQ ID NO: 53699 - DNA, 47 bp, Homo sapiens; identical to SEQ ID NO: 33011
  chr10:33622724-33622771
  hyper

SEQ ID NO: 53700 - DNA, 74 bp, Homo sapiens; identical to SEQ ID NO: 33012
  chr10:33623014-33623088
  hyper

SEQ ID NO: 53701 - DNA, 59 bp, Homo sapiens
  chr10:33624107-33624166
  hyper
ctggccagcccacctcgcgtgctcgctctgcacccctagagggagagctgggcagctcc

SEQ ID NO: 53702 - DNA, 114 bp, Homo sapiens
  chr10:33624230-33624344
  hyper
acttcaaatcccggggcccgcgccctcggcggcgaggaacgcagggtcaccccctgccactcctcatcgcgccatcctgagacctgtggcggggagcagcggggcacccctgga

SEQ ID NO: 53703 - DNA, 98 bp, Homo sapiens; identical to SEQ ID NO: 33014
  chr10:33625772-33625870
  hyper

SEQ ID NO: 53704 - DNA, 158 bp, Homo sapiens; identical to SEQ ID NO: 33015
  chr10:35105055-35105213
  hyper

SEQ ID NO: 53705 - DNA, 153 bp, Homo sapiens
  chr10:35929528-35929681
  hyper
tgaaggcgcgctcgtcctggctgaaaaaggggttgtggcagggcagcgcgcagttagcgatctggcctgtcttgacgcggttgtagagcgggtggcgctcgctggacacgctcaccataggcgcgcggcactggcacccgggctcgcagggag

SEQ ID NO: 53706 - DNA, 335 bp, Homo sapiens; identical to SEQ ID NO: 33017
  chr10:35930004-35930339
  hyper

SEQ ID NO: 53707 - DNA, 43 bp, Homo sapiens; identical to SEQ ID NO: 33018
  chr10:35931819-35931862
  hyper

SEQ ID NO: 53708 - DNA, 197 bp, Homo sapiens; identical to SEQ ID NO: 33019
  chr10:43248578-43248775
  hyper

SEQ ID NO: 53709 - DNA, 30 bp, Homo sapiens; identical to SEQ ID NO: 33020
  chr10:43249043-43249073
  hyper

SEQ ID NO: 53710 - DNA, 526 bp, Homo sapiens
  chr10:43249483-43250009
  hyper
ttcttccttgttttccgggtctcgcgcctctgaagcgaactgggcctggaggggtgctggggatcgagggagcggcgttggtgggtgaccgagggaaaggtggggccagcccctgggcaccggtcggaggaggattacgaggcggagccgctgcctgcccgcgcctcacccgcttggtccacccaatagctccgctgtagactcgcggcggcaggagcggcgggccagatggtgattacaacccggggcgctatccctttggaacctgacccccaactccgctcagtaaccggatttccggaagccgcgacctcgaagcccccagcgtttctccaccgacggcggggccggggctcctggaagcctcggagccgcagctccagcctgcagcgcacgccttggcccccagggagcagagaggcagagtacccccctgcatccggagcatagcaagcatgccccaggctgaggacctgcgacttggtgggacttcggtgcccgcccctccgccactacagggagcaga

SEQ ID NO: 53711 - DNA, 80 bp, Homo sapiens; identical to SEQ ID NO: 20590
  chr10:43250039-43250119
  hyper

SEQ ID NO: 53712 - DNA, 270 bp, Homo sapiens
  chr10:43250136-43250406
  hyper
cggggagggagcgtggccgcctagccgagccccttctctggctccgcccgcttttgcgccgcgaggccgcctggtgagttccagggccctgtggtcccccagccgccggcgctctcgggtgtcttttggccgcggcaggaacggagctgggcgctcagacggcgccggggtcgtttctgtgcccccgcccggtggccggagccgcagccttgccccttccccactggggcagcgcctgcctttctcgcggccggaccgcgccggagtccc

SEQ ID NO: 53713 - DNA, 23 bp, Homo sapiens
  chr10:43250886-43250909
  hyper
ggggcccccggtttatgccaaac

SEQ ID NO: 53714 - DNA, 32 bp, Homo sapiens; identical to SEQ ID NO: 33024
  chr10:43332719-43332751
  hyper

SEQ ID NO: 53715 - DNA, 38 bp, Homo sapiens; identical to SEQ ID NO: 33025
  chr10:43361563-43361601
  hyper

SEQ ID NO: 53716 - DNA, 102 bp, Homo sapiens; identical to SEQ ID NO: 33026
  chr10:43362008-43362110
  hyper

SEQ ID NO: 53717 - DNA, 78 bp, Homo sapiens; identical to SEQ ID NO: 10283
  chr10:43393565-43393643
  hyper

SEQ ID NO: 53718 - DNA, 24 bp, Homo sapiens
  chr10:43428400-43428424
  hyper
ccagccctgtgctcccgcgccccc

SEQ ID NO: 53719 - DNA, 23 bp, Homo sapiens
  chr10:43428954-43428977
  hyper
gggctatggagaccacgctcctc

SEQ ID NO: 53720 - DNA, 97 bp, Homo sapiens
  chr10:43429100-43429197
  hyper
tctgaatggagtgatgcgcctggacttttgttcggaaatcccgcgtggagggcggcctagcggggagaggctggaaacaggcgaggaggagcagggc

SEQ ID NO: 53721 - DNA, 161 bp, Homo sapiens
  chr10:43429215-43429376
  hyper
cgggaaccgggtcttccctcgctaagaaagggaagggtctcagccttactgagaggagcccctgtggaggaagcgggcctgcacctgcggcttccctgcaccccgcacgccgtgcccaggcacttcctccccaacacaagcaaaggtagcccagctgcagc

SEQ ID NO: 53722 - DNA, 27 bp, Homo sapiens
  chr10:43429411-43429438
  hyper
ccccgacagctgcgcaagtctattcct

SEQ ID NO: 53723 - DNA, 229 bp, Homo sapiens; identical to SEQ ID NO: 33032
  chr10:43571989-43572218
  hyper

SEQ ID NO: 53724 - DNA, 190 bp, Homo sapiens
  chr10:43572495-43572685
  hyper
agccggcgcttacctcgcttcagtcccgcgaccgaagcagggcgcgcagcagcgctgagtgccccggaacgtgcgtcgcgcccccagtgtccgtcgcgtccgccgcgccccgggcggggatggggcggccagactgagcgccgcacccgccatccagacccgccggccctagccgcagtccctccagccg

SEQ ID NO: 53725 - DNA, 45 bp, Homo sapiens
  chr10:43572734-43572779
  hyper
ggctgcgtctgctgttgctgctgctgctgccgctgctaggcaaag

SEQ ID NO: 53726 - DNA, 30 bp, Homo sapiens; identical to SEQ ID NO: 33036
  chr10:43698279-43698309
  hyper

SEQ ID NO: 53727 - DNA, 626 bp, Homo sapiens; identical to SEQ ID NO: 33037
  chr10:43724462-43725088
  hyper

SEQ ID NO: 53728 - DNA, 30 bp, Homo sapiens; identical to SEQ ID NO: 33038
  chr10:43725334-43725364
  hyper

SEQ ID NO: 53729 - DNA, 30 bp, Homo sapiens; identical to SEQ ID NO: 33039
  chr10:43762699-43762729
  hyper

SEQ ID NO: 53730 - DNA, 30 bp, Homo sapiens; identical to SEQ ID NO: 33040
  chr10:43818377-43818407
  hyper

SEQ ID NO: 53731 - DNA, 220 bp, Homo sapiens; identical to SEQ ID NO: 33041
  chr10:43857606-43857826
  hyper

SEQ ID NO: 53732 - DNA, 33 bp, Homo sapiens; identical to SEQ ID NO: 33042
  chr10:43892849-43892882
  hyper

SEQ ID NO: 53733 - DNA, 703 bp, Homo sapiens; identical to SEQ ID NO: 33043
  chr10:44185340-44186043
  hyper

SEQ ID NO: 53734 - DNA, 30 bp, Homo sapiens; identical to SEQ ID NO: 33044
  chr10:44788550-44788580
  hyper

SEQ ID NO: 53735 - DNA, 223 bp, Homo sapiens; identical to SEQ ID NO: 33045
  chr10:44806396-44806619
  hyper

SEQ ID NO: 53736 - DNA, 216 bp, Homo sapiens; identical to SEQ ID NO: 33046
  chr10:44879180-44879396
  hyper

SEQ ID NO: 53737 - DNA, 93 bp, Homo sapiens
  chr10:44879851-44879944
  hyper
ggagaggatcggcttcgcagggagcggaggctgcgcggctgcatcggacctcacagcctcaagtcgcggcatgaggcgaactttgcaaagcgc

SEQ ID NO: 53738 - DNA, 227 bp, Homo sapiens
  chr10:44880228-44880455
  hyper
ttgaacgcgacaccgcaccagagcgcccagctaagcgagctgcctccacccccactgtgtcgggcggcgcaaactgcgggcgcaggcagaggagccgcggctctgcgccgggcgggagccgaagcccagagcctcgccagggcctccccgccgagcgcacttaccgtcgctgaggcagagcgcggtcagcacgaggaccagcacgaccacgaccttggcgttcatgg

SEQ ID NO: 53739 - DNA, 26 bp, Homo sapiens
  chr10:44880519-44880545
  hyper
cggctgacggagagtgaaagtgcggc

SEQ ID NO: 53740 - DNA, 99 bp, Homo sapiens; identical to SEQ ID NO: 33049
  chr10:44880546-44880645
  hyper

SEQ ID NO: 53741 - DNA, 196 bp, Homo sapiens
  chr10:44880673-44880869
  hyper
cggcaccccccacccatccccttcgcccctcctccgctccctctgtgctcccgaggcgcagtgcgctccggcctttgaccttctcaggctccgctgggccccgcaccgctggcccggtctgcagtgaggtccgcagcctgagcgacgccggctggagggccgcttattgtccctgtgacagggccccactggagag

SEQ ID NO: 53742 - DNA, 115 bp, Homo sapiens
  chr10:44880915-44881030
  hyper
gacggggcctttcgatggcgggaactgaatgagaaccaatgaaaagcaaacaagttagtcccgggcggagggcctgctggcggtggcggcccaaggcagccgagggggtcctgct

SEQ ID NO: 53743 - DNA, 52 bp, Homo sapiens; identical to SEQ ID NO: 20604
  chr10:49731749-49731801
  hyper

SEQ ID NO: 53744 - DNA, 58 bp, Homo sapiens
  chr10:49732002-49732060
  hyper
cggccctggacaccccgtggcgagtccccgaggcggggctggcagcctctggcggcgg

SEQ ID NO: 53745 - DNA, 57 bp, Homo sapiens
  chr10:49732498-49732555
  hyper
cccaggagccgccagggggcgccacggagccggggctgcctccgcctccctgggagc

SEQ ID NO: 53746 - DNA, 429 bp, Homo sapiens
  chr10:50323258-50323687
  hyper
gctcacgggaggcgtcctctgaaccttggggaggcgccgctgcgcccgccagaccctcggcgagcccaccggagcgcgctggcgacagtgacagcgccgccccccgcccgcgcccggaggtggcagggcctccccaccaggcccggagccccggcctccccggcgcggccgcccggcccccacccttcccgctcccgcctggccccgccgcgcttacccggagccggagcccgcgccagcagcgcggccgccgccagtgccagcagccgcatctccccgccgccgcccggcgctgtgacgcgggagagcgccgccgcctggcccggccgccgccagcccgccccgggcccgcgctcgcgcccgcccccggcccgccccttgggccgcctgccacgcggggccggggctgctgggtcccgaggcccgcac

SEQ ID NO: 53747 - DNA, 228 bp, Homo sapiens; identical to SEQ ID NO: 33056
  chr10:50603003-50603231
  hyper

SEQ ID NO: 53748 - DNA, 130 bp, Homo sapiens
  chr10:50603837-50603967
  hyper
cagaagccctgcacccgggccaccgcagccaggtccggctagcgcgcaaggccatctgcgagctgcagctcaggccaggaaggcagccgagccccaaggcccggcgctcggggcccggcgagtgggtcag

SEQ ID NO: 53749 - DNA, 11 bp, Homo sapiens
  chr10:50604159-50604170
  hyper
tttataatctc

SEQ ID NO: 53750 - DNA, 76 bp, Homo sapiens
  chr10:50604532-50604608
  hyper
gggactctttgcacacggcttccctttccaaacgatcgtacaaaaggaaagtttgattttgttctcagcaaggggt

SEQ ID NO: 53751 - DNA, 196 bp, Homo sapiens
  chr10:50604645-50604841
  hyper
gcggtgggaccctttgcaattacttttaaaatgcatccgaggcagacactcaacggagagagaccgcccttctctctgcctgggtgaaaattaaactctaaagtaccgggctgaaattttcaagtcaggggcgcgggattggatcaaatcacataaactgcaaaaaaagcaagtctaatggcgcataattggttct

SEQ ID NO: 53752 - DNA, 373 bp, Homo sapiens; identical to SEQ ID NO: 20610
  chr10:50605654-50606027
  hyper

SEQ ID NO: 53753 - DNA, 329 bp, Homo sapiens
  chr10:50606433-50606762
  hyper
gctgcagccggaaaccatctcgcggcccccgaggagagtccggccgcctcactgactagataaccagccgagctccctcaacacacccacctcgcgggggctctaagccggcttgggaccctcggcctcgcctcgcccggcgctcctctcccggagccgctaggctgggctccttcccgttggcaaaacagcgagtaaacaaacaaccaaacaaccttagaaacgaaaggctgcaccaaactttgatgacgccagccccctttttttccgaatgtctcgacacccgggagaaggtgactaataggtgttcgctacggtccccctccccc

SEQ ID NO: 53754 - DNA, 30 bp, Homo sapiens; identical to SEQ ID NO: 33060
  chr10:50815067-50815097
  hyper

SEQ ID NO: 53755 - DNA, 522 bp, Homo sapiens
  chr10:50817132-50817654
  hyper
atccagggtcaacgccgctctggggacgcgtcaggcccagcgcacagcctgggcagctcagcctgtcagctgagcacgggcgcctcaaggggtgcggccctctcagaaggaaggtgagtctccctggagcccctgacgacagcgaagcggctgggcgctctccggggagtgggcgcggcacccaagaagggtttcttacagttccaagagaggaccccagccacagtcactccagagcccacccggggcttggaggaggctctggaaaatgagggatgggggagtgtgcagaacagggggcggaggctggcaggagccgagggagggcttggtcgggtgcgaagagtgcctgggaggagttagagtggggagggggtgcggcggcggggagagaagaggcggagctgggggaccagaccgctaaaggagaaagggggattccaggcaaggggaatgtggccaggcagtgcgggagggcggcagcggccaggctaatattcgcgaccccgactggggcgcggc

SEQ ID NO: 53756 - DNA, 230 bp, Homo sapiens; identical to SEQ ID NO: 20613
  chr10:50818152-50818382
  hyper

SEQ ID NO: 53757 - DNA, 200 bp, Homo sapiens
  chr10:50818432-50818632
  hyper
cctcggccagcgcgggcggcctcttagcgcggcgggggctgctctgggcgcgccccgggcgaagtgcgcccagtctccggccccggcccctcggcgcgcccgacttcccggccgcccctgagcccagcagccgcgggtcccgggatcggctaagagtagctgcaacgcctcgccggacggagtcctttcctttcccggga

SEQ ID NO: 53758 - DNA, 178 bp, Homo sapiens; identical to SEQ ID NO: 33065
  chr10:50819747-50819925
  hyper

SEQ ID NO: 53759 - DNA, 127 bp, Homo sapiens; identical to SEQ ID NO: 33066
  chr10:50821077-50821204
  hyper

SEQ ID NO: 53760 - DNA, 52 bp, Homo sapiens; identical to SEQ ID NO: 10308
  chr10:50822142-50822194
  hyper

SEQ ID NO: 53761 - DNA, 67 bp, Homo sapiens; identical to SEQ ID NO: 33069
  chr10:50822825-50822892
  hyper

SEQ ID NO: 53762 - DNA, 160 bp, Homo sapiens; identical to SEQ ID NO: 33070
  chr10:50887456-50887616
  hyper

SEQ ID NO: 53763 - DNA, 38 bp, Homo sapiens
  chr10:50887617-50887655
  hyper
ggaggatcccctagcgccaccccggccccgcccggcgc

SEQ ID NO: 53764 - DNA, 20 bp, Homo sapiens
  chr10:50887816-50887836
  hyper
ccttccgcctgcagggcctg

SEQ ID NO: 53765 - DNA, 516 bp, Homo sapiens; identical to SEQ ID NO: 33073
  chr10:50969896-50970412
  hyper

SEQ ID NO: 53766 - DNA, 30 bp, Homo sapiens; identical to SEQ ID NO: 33074
  chr10:50976382-50976412
  hyper

SEQ ID NO: 53767 - DNA, 88 bp, Homo sapiens; identical to SEQ ID NO: 10312
  chr10:52177735-52177823
  hyper

SEQ ID NO: 53768 - DNA, 135 bp, Homo sapiens; identical to SEQ ID NO: 33077
  chr10:52178170-52178305
  hyper

SEQ ID NO: 53769 - DNA, 160 bp, Homo sapiens; identical to SEQ ID NO: 33078
  chr10:52750888-52751048
  hyper

SEQ ID NO: 53770 - DNA, 179 bp, Homo sapiens; identical to SEQ ID NO: 33079
  chr10:52751383-52751562
  hyper

SEQ ID NO: 53771 - DNA, 41 bp, Homo sapiens; identical to SEQ ID NO: 33080
  chr10:52751795-52751836
  hyper

SEQ ID NO: 53772 - DNA, 88 bp, Homo sapiens; identical to SEQ ID NO: 10315
  chr10:52833568-52833656
  hyper

SEQ ID NO: 53773 - DNA, 113 bp, Homo sapiens; identical to SEQ ID NO: 33082
  chr10:52833864-52833977
  hyper

SEQ ID NO: 53774 - DNA, 395 bp, Homo sapiens; identical to SEQ ID NO: 33083
  chr10:52834361-52834756
  hyper

SEQ ID NO: 53775 - DNA, 305 bp, Homo sapiens
  chr10:54068221-54068526
  hyper
gcctttcccctcacccgcctctaattaagtcagaaaggccctgtatttatttgcccatgaactgacacagcaaaccaacagcagccattgtagtgtgaatggatttgcgaccaggcaaggggcttcagccgggattacccgccccgcagccggatgaatgtgctgagcacaaagtctgctcaaagccgagcaaacggactatttgtgaaaatgccatcctggctcaagtctgattaagaccgggggtccccaggccgtttgatcttcgctcatcaaagagagtctttaaacaagcttcattttac

SEQ ID NO: 53776 - DNA, 78 bp, Homo sapiens
  chr10:54072904-54072982
  hyper
caccaatttcaatgacgtcaaattcactttctaattcactttcagctcttcttctcctcaaggttgtttcttttctcc

SEQ ID NO: 53777 - DNA, 245 bp, Homo sapiens
  chr10:54073020-54073265
  hyper
ttgggagcaaaccctgcattcggaagcgttgcgatgtgatatactaatgaggaagtcaggcgctaagccctaagggtttcttatttctccacattagcccaccactgagaagggagaaccggggaaaggcgactgacctggcacgttggaccctgtccgctttggtcccggccactttgatctcacgcgtctgcctaatcaagttcatctaccgccgcgattgccctgattcaaagaacaacatt

SEQ ID NO: 53778 - DNA, 361 bp, Homo sapiens
  chr10:54073295-54073656
  hyper
ctcttccctccacccctgatctaatttctaaacgccagtctctcgcctccctctctaaacttcccatcaaaagagaattagctcttcttccttcttaccctcgtttgatgtgcaaatttccttctctttgcacatttttctcgcagtggcggggggaggtgggggaggagggcaactgaaggacctcaaagccggggatctaactcagatctgcaaactgcgactctaaagggttaatgagcaacttgcacccgccacctggccctctcagaggcgtcttgctagagccattgaattacagaccggtttgtatttaatactgaatatgacttgtgtgcacagtcagcgagtattggcataa

SEQ ID NO: 53779 - DNA, 36 bp, Homo sapiens
  chr10:54074789-54074825
  hyper
ccgaaaacgctgcatgcgtcacgctatgtgctgccc

SEQ ID NO: 53780 - DNA, 4 bp, Homo sapiens
  chr10:57387425-57387429
  hyper
ctcc

SEQ ID NO: 53781 - DNA, 529 bp, Homo sapiens
  chr10:57387796-57388325
  hyper
ggattaaaaggatagatttttggaagggtaagggagaaaaactttgatgttgtaaccacacacaggactgagaagaaaccaaaacaagttgcagcttcaggagcggggaggacgcttttcggggtaaaaaaaaaatcaccccctaccaaaatcagggggaggaagctccctgctccttgagcgatcacccagagcacctcgcaatctctgatcttcgaacccactgaaaaagcacagggcatggggagtcctgttggttcatgcccagggtacgaataccaaaagcgcctcccgctggagaggctgcggggaactcgaggcaaagacagaggcaaacgcaacgctgggaagagtgaggggagtccgagctgccgcctgcaaaagcagagacgcgtcgcccttcgggcaaagtgactgctacaaagtccgttccctcctgcgcagggacagagacatttaaaggcctgaatggacgtcagcaccagtcgagctcgctgggtgagcgccaggtctccccgccccacggatt

SEQ ID NO: 53782 - DNA, 46 bp, Homo sapiens; identical to SEQ ID NO: 10322
  chr10:57389890-57389936
  hyper

SEQ ID NO: 53783 - DNA, 39 bp, Homo sapiens
  chr10:57390637-57390676
  hyper
gcgcccacccacacatccagtctccgggaacaaaactct

SEQ ID NO: 53784 - DNA, 145 bp, Homo sapiens
  chr10:57391215-57391360
  hyper
ccagtagaaggaggaggtcggcacacctgctgttcctgcttccttcccaggaggccgattctctccatcccaactcgctccgtggctcctgcttgctcctgttccccctcccgactccccgggtaacagtcgaccttagggtcac

SEQ ID NO: 53785 - DNA, 109 bp, Homo sapiens; identical to SEQ ID NO: 33091
  chr10:60272038-60272147
  hyper

SEQ ID NO: 53786 - DNA, 272 bp, Homo sapiens; identical to SEQ ID NO: 33092
  chr10:60272562-60272834
  hyper

SEQ ID NO: 53787 - DNA, 235 bp, Homo sapiens
  chr10:60272895-60273130
  hyper
cgcccaccatggccgcccagggagagcccggctacctggcggcgcagtcggaccccggctccaacagcgagcgcagcaccgactccccagtgcccggctccgaggacgacttggtcgccggggcgaccctgcacagcccggagtggagcgaggagcgcttccgcgtggacaggaagaaacttgaggccatgttacaaggtaggcatccctcgtgttctcggactctccgactgag

SEQ ID NO: 53788 - DNA, 146 bp, Homo sapiens
  chr10:60936378-60936524
  hyper
gcgccgggtcctgctcggtctctcagagccgcacactccgcggagctcctgccacagccgtcgccttcgcggcggctctccagccccgcgcctcagcctcggcgccgcatcaccgcgtcccaggcctccttccctccctctgccac

SEQ ID NO: 53789 - DNA, 32 bp, Homo sapiens
  chr10:60937041-60937073
  hyper
gcagtccggatttcctgggtctctgggcactg

SEQ ID NO: 53790 - DNA, 36 bp, Homo sapiens; identical to SEQ ID NO: 33096
  chr10:61122490-61122526
  hyper

SEQ ID NO: 53791 - DNA, 82 bp, Homo sapiens; identical to SEQ ID NO: 33097
  chr10:61469912-61469994
  hyper

SEQ ID NO: 53792 - DNA, 30 bp, Homo sapiens; identical to SEQ ID NO: 33098
  chr10:62702560-62702590
  hyper

SEQ ID NO: 53793 - DNA, 297 bp, Homo sapiens
  chr10:63212027-63212324
  hyper
gcaagataggcaggccgttagccaagccccaaagccagcaaacccagacacctgaagctggcgctgtgctagagaacgcgcgacgcgcgcggctggagggaagggaagcggatgaaaccacagacgtgcagcgagggtcttctcgtcttaggagggtggccagtgtgctcagctcttgcgaaggtcgctgatgcccagcgaaggacattcccacatgtgcacgcacgcagagtaacccgcgcacactcacacaccccagtttcagaaggcacactacatggcaacctccttgtccca

SEQ ID NO: 53794 - DNA, 189 bp, Homo sapiens
  chr10:63212701-63212890
  hyper
gagcaagaggttgagcagcgcaagcagccagtaccgcggctccttcttcacctcggtcactcgccagaccccgaccagcgagtgcagcaggaacagcaaccgagtggccagggcgttaaggaagaccagtccctccatgctggccggagcactctgcctacgtccccttgcctgcgcccccaggaccct

SEQ ID NO: 53795 - DNA, 92 bp, Homo sapiens; identical to SEQ ID NO: 10332
  chr10:63213120-63213212
  hyper

SEQ ID NO: 53796 - DNA, 520 bp, Homo sapiens; identical to SEQ ID NO: 33101
  chr10:64133867-64134387
  hyper

SEQ ID NO: 53797 - DNA, 478 bp, Homo sapiens; identical to SEQ ID NO: 33102
  chr10:64574590-64575068
  hyper

SEQ ID NO: 53798 - DNA, 399 bp, Homo sapiens; identical to SEQ ID NO: 20636
  chr10:64575127-64575526
  hyper

SEQ ID NO: 53799 - DNA, 174 bp, Homo sapiens
  chr10:64575638-64575812
  hyper
tctggtcaaaggggcctcccagttcggcattgggaaagatggtcaccgacgtggcggcgaggtcctccaccgggtagatgttgtcagacagctggtgcacaaaaccactgagagttactgggattttgtctacggccttggcggtcatcatttgctcctcgcacaacctggaga

SEQ ID NO: 53800 - DNA, 89 bp, Homo sapiens; identical to SEQ ID NO: 20638
  chr10:64578540-64578629
  hyper

SEQ ID NO: 53801 - DNA, 15 bp, Homo sapiens
  chr10:64578651-64578666
  hyper
cgagggggagctcct

SEQ ID NO: 53802 - DNA, 287 bp, Homo sapiens; identical to SEQ ID NO: 33106
  chr10:70320197-70320484
  hyper

SEQ ID NO: 53803 - DNA, 71 bp, Homo sapiens; identical to SEQ ID NO: 33107
  chr10:70320857-70320928
  hyper

SEQ ID NO: 53804 - DNA, 42 bp, Homo sapiens; identical to SEQ ID NO: 33108
  chr10:71267763-71267805
  hyper

SEQ ID NO: 53805 - DNA, 2 bp, Homo sapiens
  chr10:71327764-71327766
  hyper
tg

SEQ ID NO: 53806 - DNA, 181 bp, Homo sapiens
  chr10:71328821-71329002
  hyper
gggggtggggtgggatgggggcagggcaccataaatctacctgcttgtgtgccagcgcggcttgactggaaggaggagcaagattcatgtgcggtttttctggaagccagtcttgggctcagacaaaagcagaagaaggggggagagccattcgacgagagggtctttcctgcccgggttt

SEQ ID NO: 53807 - DNA, 3 bp, Homo sapiens
  chr10:71329076-71329079
  hyper
cgg

SEQ ID NO: 53808 - DNA, 141 bp, Homo sapiens
  chr10:71329118-71329259
  hyper
cccaggactcaaaacgccgcaagaagtggaaggcggggacggtggtgcagagctagttggacaggccacccctagaaatgtttccgagcccttcttgctcaggggttctttggaaagaggcatggacgaggtttcccactc

SEQ ID NO: 53809 - DNA, 30 bp, Homo sapiens; identical to SEQ ID NO: 33112
  chr10:71329503-71329533
  hyper

SEQ ID NO: 53810 - DNA, 299 bp, Homo sapiens; identical to SEQ ID NO: 33113
  chr10:71331434-71331733
  hyper

SEQ ID NO: 53811 - DNA, 101 bp, Homo sapiens
  chr10:71331951-71332052
  hyper
tgcgttggcgcggctcggagggccggggaatgaacccagcctgccgcccccgtggaggcctgggccggccaggggtcagccagggagaagcagaaggaaca

SEQ ID NO: 53812 - DNA, 63 bp, Homo sapiens
  chr10:71333018-71333081
  hyper
gctcagcgggcttctggtcgccaagttcagctgagctgcaggcgcccccgcctgggagttgcc

SEQ ID NO: 53813 - DNA, 22 bp, Homo sapiens
  chr10:71334335-71334357
  hyper
cccaaggcgctgggaagcagag

SEQ ID NO: 53814 - DNA, 103 bp, Homo sapiens; identical to SEQ ID NO: 33117
  chr10:71334853-71334956
  hyper

SEQ ID NO: 53815 - DNA, 30 bp, Homo sapiens; identical to SEQ ID NO: 33118
  chr10:71337383-71337413
  hyper

SEQ ID NO: 53816 - DNA, 103 bp, Homo sapiens; identical to SEQ ID NO: 33119
  chr10:71338223-71338326
  hyper

SEQ ID NO: 53817 - DNA, 37 bp, Homo sapiens; identical to SEQ ID NO: 33120
  chr10:71562106-71562143
  hyper

SEQ ID NO: 53818 - DNA, 84 bp, Homo sapiens; identical to SEQ ID NO: 33121
  chr10:71562530-71562614
  hyper

SEQ ID NO: 53819 - DNA, 95 bp, Homo sapiens; identical to SEQ ID NO: 33122
  chr10:71813377-71813472
  hyper

SEQ ID NO: 53820 - DNA, 92 bp, Homo sapiens; identical to SEQ ID NO: 33123
  chr10:71813702-71813794
  hyper

SEQ ID NO: 53821 - DNA, 56 bp, Homo sapiens
  chr10:72015339-72015395
  hyper
cgagaagagcacagtggtgtagaccctgcgcatgcccttctcgggccaggcctccc

SEQ ID NO: 53822 - DNA, 15 bp, Homo sapiens
  chr10:72200050-72200065
  hyper
gccccctcccatccc

SEQ ID NO: 53823 - DNA, 216 bp, Homo sapiens; identical to SEQ ID NO: 20649
  chr10:72200138-72200354
  hyper

SEQ ID NO: 53824 - DNA, 218 bp, Homo sapiens
  chr10:72201285-72201503
  hyper
gctcagcatgtacgccagaggggatggcgacgagggctgcccccgcgtacgcaggagcgcagtggccaccgtcgcagcacccgcctggagtagggcccaccaggcgtgcagaaggaagggcaggcagtgggcgtgcatggtgggctggccaggcctgaaagcagcacctccagcccttatatcctgggcctcagcagccgccccgcccccacctttcc

SEQ ID NO: 53825 - DNA, 44 bp, Homo sapiens; identical to SEQ ID NO: 33129
  chr10:72218318-72218362
  hyper

SEQ ID NO: 53826 - DNA, 183 bp, Homo sapiens; identical to SEQ ID NO: 33130
  chr10:72238634-72238817
  hyper

SEQ ID NO: 53827 - DNA, 158 bp, Homo sapiens; identical to SEQ ID NO: 33131
  chr10:72431955-72432113
  hyper

SEQ ID NO: 53828 - DNA, 106 bp, Homo sapiens; identical to SEQ ID NO: 33132
  chr10:72432524-72432630
  hyper

SEQ ID NO: 53829 - DNA, 43 bp, Homo sapiens; identical to SEQ ID NO: 33133
  chr10:72432660-72432703
  hyper

SEQ ID NO: 53830 - DNA, 73 bp, Homo sapiens; identical to SEQ ID NO: 33134
  chr10:72973309-72973382
  hyper

SEQ ID NO: 53831 - DNA, 204 bp, Homo sapiens; identical to SEQ ID NO: 33135
  chr10:73156664-73156868
  hyper

SEQ ID NO: 53832 - DNA, 369 bp, Homo sapiens; identical to SEQ ID NO: 33136
  chr10:73156912-73157281
  hyper

SEQ ID NO: 53833 - DNA, 359 bp, Homo sapiens
  chr10:73157508-73157867
  hyper
ggggatggggtggggcgcacccctactgcgggctgggcagaggcgctgaggggaactaaaggcacgtagttctcccctcccctcatcaagtccctgtgcccgcgggagaccccaggggacttacacatcctcccaaattcggtccagctatgggaagacgcgcccctcgaggagccgggagccttttgcggctctcgcttcgccttcctggccctggaactggtccgctacgagcggtgctggctgcccccaggagctggcacccgggagcactgcccctcatctccaccgtaggtcagcccaggactcgagcagagcccgcgtgttccaaggcagtgacggcgccagccggcggggac

SEQ ID NO: 53834 - DNA, 30 bp, Homo sapiens; identical to SEQ ID NO: 33138
  chr10:73723732-73723762
  hyper

SEQ ID NO: 53835 - DNA, 282 bp, Homo sapiens; identical to SEQ ID NO: 33139
  chr10:73724117-73724399
  hyper

SEQ ID NO: 53836 - DNA, 104 bp, Homo sapiens; identical to SEQ ID NO: 33140
  chr10:73847688-73847792
  hyper

SEQ ID NO: 53837 - DNA, 14 bp, Homo sapiens
  chr10:73848208-73848222
  hyper
ggtgactggcggag

SEQ ID NO: 53838 - DNA, 15 bp, Homo sapiens
  chr10:75407398-75407413
  hyper
cagattctgcacccc

SEQ ID NO: 53839 - DNA, 93 bp, Homo sapiens; identical to SEQ ID NO: 20658
  chr10:75407477-75407570
  hyper

SEQ ID NO: 53840 - DNA, 33 bp, Homo sapiens; identical to SEQ ID NO: 33144
  chr10:76803629-76803662
  hyper

SEQ ID NO: 53841 - DNA, 47 bp, Homo sapiens; identical to SEQ ID NO: 33145
  chr10:77161345-77161392
  hyper

SEQ ID NO: 53842 - DNA, 543 bp, Homo sapiens; identical to SEQ ID NO: 33146
  chr10:77162787-77163330
  hyper

SEQ ID NO: 53843 - DNA, 37 bp, Homo sapiens; identical to SEQ ID NO: 33147
  chr10:77163662-77163699
  hyper

SEQ ID NO: 53844 - DNA, 39 bp, Homo sapiens
  chr10:77191185-77191224
  hyper
cgggggagggaggggcgcgggcagtcggggtcaggccgc

SEQ ID NO: 53845 - DNA, 337 bp, Homo sapiens
  chr10:77191368-77191705
  hyper
cagctgactgcccagtgcggaactgtgcgcccgccgcgctcccctgccgcgctccccgctgctgccgccgcgcccccgcgctccgtcccgcgcgcccgcagcgtcctggccgccatggccgggctcgtggtgcgtggaactcaagtaagtcccggccagccccgcctccgcccggggcgcagtccgcgtggggagggacagcggggcacagaggctccccagggcctagacacccctgtccccgcctcagggggctgcgtctgcagggggtgagcttcaggtgctcaggctcgccctagtggggctaggacagacctcgtttcgggcctggcacacc

SEQ ID NO: 53846 - DNA, 235 bp, Homo sapiens; identical to SEQ ID NO: 20660
  chr10:79396686-79396921
  hyper

SEQ ID NO: 53847 - DNA, 176 bp, Homo sapiens
  chr10:79397089-79397265
  hyper
atgaagaggcccccgaagaaagtcaccatggaggaggccaggaaagcccaccacatgcgttggccccggctgtcgcacggcacctccatggtcaccgggatgatgagcgcatccatcttgggctcgtggaccgaggacgaggaggaagaggaggaggaagaagaagaagaggaaga

SEQ ID NO: 53848 - DNA, 1238 bp, Homo sapiens; identical to SEQ ID NO: 33150
  chr10:79397385-79398623
  hyper

SEQ ID NO: 53849 - DNA, 146 bp, Homo sapiens; identical to SEQ ID NO: 33151
  chr10:79470925-79471071
  hyper

SEQ ID NO: 53850 - DNA, 75 bp, Homo sapiens; identical to SEQ ID NO: 33152
  chr10:80909909-80909984
  hyper

SEQ ID NO: 53851 - DNA, 269 bp, Homo sapiens; identical to SEQ ID NO: 20664
  chr10:81664598-81664867
  hyper

SEQ ID NO: 53852 - DNA, 174 bp, Homo sapiens
  chr10:81664899-81665073
  hyper
cggctcatctttgctccccaggagcagcatatttcgcatctgccagaggtgtgcccgggggtcgttgggagagggacggggtgaatccctgcagagagccgggacggggagggaaggtgtcggggagacgtggtttcctggcgacgtggtcccggcaggcgacttagacctgag

SEQ ID NO: 53853 - DNA, 223 bp, Homo sapiens; identical to SEQ ID NO: 33154
  chr10:81741708-81741931
  hyper

SEQ ID NO: 53854 - DNA, 346 bp, Homo sapiens; identical to SEQ ID NO: 33155
  chr10:81892268-81892614
  hyper

SEQ ID NO: 53855 - DNA, 413 bp, Homo sapiens
  chr10:82116661-82117074
  hyper
gcagagtagagggggcgcggcagagtagagggggcgcggcagagtggagggggcgtgcaggagtaggagcccgccgcagagtagagggggcgcggcagagaggagggggcgtgcaggcgcggggcgcccggcagagagaaggggtcgtgcggaagggggcgcgcgccaggggagggggccagagaggagggggcgttcaggagtcgggcctgcggcagagatgaggcggtgtgcaggagggagagcgcgcacgagggggcaacgggcagagaggagagggaatgaaagaaggggagcgtggcagagagaagcgggcgcgctccagggggcggggtccagggaggagggggagcgtaggatcggggcgggaggcagagaggagcgggcacgcgggacgggcgtgtgctcgtgag

SEQ ID NO: 53856 - DNA, 311 bp, Homo sapiens; identical to SEQ ID NO: 33157
  chr10:83633848-83634159
  hyper

SEQ ID NO: 53857 - DNA, 282 bp, Homo sapiens; identical to SEQ ID NO: 10367
  chr10:83634933-83635215
  hyper

SEQ ID NO: 53858 - DNA, 15 bp, Homo sapiens
  chr10:83635484-83635499
  hyper
ctaccacttccacca

SEQ ID NO: 53859 - DNA, 34 bp, Homo sapiens
  chr10:83635545-83635579
  hyper
gcccaaccggattagcactcgcctgaccaccatc

SEQ ID NO: 53860 - DNA, 30 bp, Homo sapiens; identical to SEQ ID NO: 33161
  chr10:83635788-83635818
  hyper

SEQ ID NO: 53861 - DNA, 59 bp, Homo sapiens; identical to SEQ ID NO: 10370
  chr10:83636287-83636346
  hyper

SEQ ID NO: 53862 - DNA, 136 bp, Homo sapiens
  chr10:85954289-85954425
  hyper
gccgctaattggtctcgtcaggcggccggcaggagcagatccgagccgtgtcatcctcttagcgccctcacgccacccgccgctcccgccccgtgccccctcccgccgcggctgcagtcgccgctacccccattgt

SEQ ID NO: 53863 - DNA, 616 bp, Homo sapiens
  chr10:85954457-85955073
  hyper
ctccgtgcccctgcgcccggtctcggcggcggcaggcgacactccgcgccggcggagacatgaggcgctgccggtgggccgccctggccctggggctgctgcgcctctgcttgggtgagtggccgctgggccgcgctggccgcgtggatggcgagggagatgggcgctggcgtcacccaggtggccagagggacatggtcctggaccacttccagagtgggactcgggctggtggacgggagcggagaagtccttccatcttcctggcccattcggtagtggggagtggggtagcggagtagtggggagctccggggcgcttctccagagctggcatcctagggccccagggtttggcgcccggacccccgctgctctccgcttgctgggaaccagagctgtaggcttggtggcagctccgatgctgcgtggggcaggagatagtgccctgactcgcggcttgaccttggctgggctggggcactgcccctctccgagcgcgggtgcaatctgcccattgatgaaggaggggttggattgctacctgggttctaagcgcccacatgctacgtgtccctgacaagcccgagcccaccgggggcggagtgggggtcag

SEQ ID NO: 53864 - DNA, 80 bp, Homo sapiens; identical to SEQ ID NO: 33164
  chr10:88124485-88124565
  hyper

SEQ ID NO: 53865 - DNA, 30 bp, Homo sapiens; identical to SEQ ID NO: 33165
  chr10:88125245-88125275
  hyper

SEQ ID NO: 53866 - DNA, 640 bp, Homo sapiens; identical to SEQ ID NO: 33166
  chr10:88125592-88126232
  hyper

SEQ ID NO: 53867 - DNA, 149 bp, Homo sapiens; identical to SEQ ID NO: 33167
  chr10:88126704-88126853
  hyper

SEQ ID NO: 53868 - DNA, 279 bp, Homo sapiens; identical to SEQ ID NO: 10374
  chr10:88126854-88127133
  hyper

SEQ ID NO: 53869 - DNA, 50 bp, Homo sapiens; identical to SEQ ID NO: 33169
  chr10:88127346-88127396
  hyper

SEQ ID NO: 53870 - DNA, 63 bp, Homo sapiens
  chr10:88149300-88149363
  hyper
ggcgtctctgaccaccgagcctgcgaagacctagctgattacgaccaggaaacaggaggggac

SEQ ID NO: 53871 - DNA, 17 bp, Homo sapiens
  chr10:88149601-88149618
  hyper
ggcgcacctgggtgctg

SEQ ID NO: 53872 - DNA, 147 bp, Homo sapiens; identical to SEQ ID NO: 33171
  chr10:88391908-88392055
  hyper

SEQ ID NO: 53873 - DNA, 33 bp, Homo sapiens; identical to SEQ ID NO: 33172
  chr10:90342630-90342663
  hyper

SEQ ID NO: 53874 - DNA, 50 bp, Homo sapiens; identical to SEQ ID NO: 33173
  chr10:90343138-90343188
  hyper

SEQ ID NO: 53875 - DNA, 187 bp, Homo sapiens
  chr10:90966521-90966708
  hyper
gacgctcatatactgcgttgccagcgcgaacgaggacgagttctggtggtgcaccttgtggaaggtgcggtacagccagggcaccttgtggtgcagcaggtgccacacgaagaactccatgtcgaagagtagcaggcagaacaggatgtggtgcagcagcaggagcagctcgggagcttcgtggggc

SEQ ID NO: 53876 - DNA, 461 bp, Homo sapiens
  chr10:90966865-90967326
  hyper
acaggatatccaggaccacgaagggcaggcaaaagcccacgtatgtggtgatggagaagatgaccgggaagaagggcgactgtaggagggcctcccagctcctcaggtggtcccagaggggctgcaggaacagctgcccggagctgcaaaggacctgggggtcggagcagttgtggcagctcattgcgaggctgtgcaaggcagctgaggctgctgctcgagtcccatcgacttttcacaggactcacggccccgccccgagtgatgtcagctgcctttccatccctttcccggcgatgcgaagcttgaataagctagcaacccggcagagtggcccttcattgctgtaaatgtgctcatctatagccgcatcttaccggcttttagatatgcgtgtatgcagtggcacttcgtacttttcatgtaagttctgatttttcagttgacgtacaattaacacg

SEQ ID NO: 53877 - DNA, 47 bp, Homo sapiens
  chr10:90967624-90967671
  hyper
ctttgcacagggaaccgctggtccccgaacgccggcggtgaccgtca

SEQ ID NO: 53878 - DNA, 116 bp, Homo sapiens; identical to SEQ ID NO: 20683
  chr10:90968040-90968156
  hyper

SEQ ID NO: 53879 - DNA, 279 bp, Homo sapiens
  chr10:91295067-91295346
  hyper
gtcccaggctcccggcgcgggatgggcgctagggcagcggagaatggagggtccccgtcctcctccagctccaacgacagcgccagcgccccgccgtcccgccgcccttccttgaaggatgcccgtgtcacctgagccaccgcgccctctgcacaaccgtgtcagggagagggaagagggggagccgaggaagcttcttggccagggcgctggggatccgggagcgggggccgccggcgagactgagcccgggacagcccagagctccagcgctccagc

SEQ ID NO: 53880 - DNA, 145 bp, Homo sapiens; identical to SEQ ID NO: 10383
  chr10:91295347-91295492
  hyper

SEQ ID NO: 53881 - DNA, 154 bp, Homo sapiens; identical to SEQ ID NO: 20686
  chr10:91295725-91295879
  hyper

SEQ ID NO: 53882 - DNA, 4 bp, Homo sapiens
  chr10:91295923-91295927
  hyper
cggt

SEQ ID NO: 53883 - DNA, 120 bp, Homo sapiens
  chr10:92617122-92617242
  hyper
caccaggcagttgcccgcgatcgtcagcagcgtgatgagcgtcaggatggagccgatcacaactttctcgactctgccgtagttgatctgttccccacagccggaggcattgtccggggg

SEQ ID NO: 53884 - DNA, 227 bp, Homo sapiens
  chr10:92617308-92617535
  hyper
gaccgggtcggcgccaccgtcggggctcaagtcgggcagcccgcgccccacttctggcagaaggaaagagcggaggtgcccgtagaggtccgggcggccgctgctgttaacgtccatcatcgcgccgccgtgtgccgctgcccatggagccggcgccccggccacgcgcctccggctgccggccccggggcttcacctcaccggttccgctccgcccggcccagcca

SEQ ID NO: 53885 - DNA, 179 bp, Homo sapiens
  chr10:93647037-93647216
  hyper
gtaacaccccagggccgcgtgaatagcggggaaggtaacgtgactgcggagctcagggccggcccgggaggggcgcgggcctggccagtgggaaggtcggacgccgaggggcgaaatcaccccaccggcatcagaccaccgcctccattcagcggaggaatgtgggcgggcagaggacg

SEQ ID NO: 53886 - DNA, 262 bp, Homo sapiens; identical to SEQ ID NO: 20690
  chr10:93647300-93647562
  hyper

SEQ ID NO: 53887 - DNA, 2 bp, Homo sapiens
  chr10:93647649-93647651
  hyper
aa

SEQ ID NO: 53888 - DNA, 443 bp, Homo sapiens; identical to SEQ ID NO: 33183
  chr10:94180324-94180767
  hyper

SEQ ID NO: 53889 - DNA, 126 bp, Homo sapiens; identical to SEQ ID NO: 33184
  chr10:94449138-94449264
  hyper

SEQ ID NO: 53890 - DNA, 252 bp, Homo sapiens; identical to SEQ ID NO: 33185
  chr10:94449910-94450162
  hyper

SEQ ID NO: 53891 - DNA, 298 bp, Homo sapiens
  chr10:94450377-94450675
  hyper
ggggtggggctcccttagcgggagggacggggaaaggggcgtcgaggcgcccctggccggcccccgtggggcagggatcgcagccgggcccgggtggctacggggctggacctggttcaacaggcttgtgcagtgaaagagcctgaccctttccgttcatacaggaaatcttgagttctcgataggagtaaatctggtttcagaagctgttaagtgttttcctggctgcatgaagcagacccttcccccggagtagtgcacgctgctgattattttatcgacatcctcaatacagaca

SEQ ID NO: 53892 - DNA, 30 bp, Homo sapiens; identical to SEQ ID NO: 10390
  chr10:94822377-94822407
  hyper

SEQ ID NO: 53893 - DNA, 22 bp, Homo sapiens
  chr10:94828103-94828125
  hyper
gtgatgtatagcatccgggaca

SEQ ID NO: 53894 - DNA, 237 bp, Homo sapiens
  chr10:94828498-94828735
  hyper
gcacgcagcgccacccatctgccgctccccattgtagcgtcgcgcgcccactctttcactcgttcaacaatctttcaacaaatgttcgccaaacgcggatgtgtgccggactcgaggaaggaggagggcgagccaccgctgccgcgccagagaagcatctaagcccatgggaagatgccttctgcgctccgcgcccagaggaaggaaaatgtcgtgggccaagcaggaatggaggga

SEQ ID NO: 53895 - DNA, 66 bp, Homo sapiens; identical to SEQ ID NO: 20695
  chr10:94828828-94828894
  hyper

SEQ ID NO: 53896 - DNA, 320 bp, Homo sapiens; identical to SEQ ID NO: 33191
  chr10:94831610-94831930
  hyper

SEQ ID NO: 53897 - DNA, 38 bp, Homo sapiens; identical to SEQ ID NO: 33192
  chr10:94831980-94832018
  hyper

SEQ ID NO: 53898 - DNA, 166 bp, Homo sapiens; identical to SEQ ID NO: 33193
  chr10:94833026-94833192
  hyper

SEQ ID NO: 53899 - DNA, 69 bp, Homo sapiens; identical to SEQ ID NO: 33194
  chr10:94833580-94833649
  hyper

SEQ ID NO: 53900 - DNA, 380 bp, Homo sapiens; identical to SEQ ID NO: 20698
  chr10:94834033-94834413
  hyper

SEQ ID NO: 53901 - DNA, 81 bp, Homo sapiens; identical to SEQ ID NO: 33196
  chr10:95326983-95327064
  hyper

SEQ ID NO: 53902 - DNA, 193 bp, Homo sapiens; identical to SEQ ID NO: 33197
  chr10:95361207-95361400
  hyper

SEQ ID NO: 53903 - DNA, 137 bp, Homo sapiens; identical to SEQ ID NO: 33198
  chr10:95753607-95753744
  hyper

SEQ ID NO: 53904 - DNA, 30 bp, Homo sapiens; identical to SEQ ID NO: 33199
  chr10:98944811-98944841
  hyper

SEQ ID NO: 53905 - DNA, 33 bp, Homo sapiens; identical to SEQ ID NO: 33200
  chr10:98945047-98945080
  hyper

SEQ ID NO: 53906 - DNA, 267 bp, Homo sapiens; identical to SEQ ID NO: 33201
  chr10:98945472-98945739
  hyper

SEQ ID NO: 53907 - DNA, 268 bp, Homo sapiens; identical to SEQ ID NO: 33202
  chr10:98945799-98946067
  hyper

SEQ ID NO: 53908 - DNA, 92 bp, Homo sapiens; identical to SEQ ID NO: 33203
  chr10:98946094-98946186
  hyper

SEQ ID NO: 53909 - DNA, 24 bp, Homo sapiens
  chr10:99080838-99080862
  hyper
gcacgcactgggttgcgggacaga

SEQ ID NO: 53910 - DNA, 71 bp, Homo sapiens; identical to SEQ ID NO: 20703
  chr10:99531148-99531219
  hyper

SEQ ID NO: 53911 - DNA, 98 bp, Homo sapiens; identical to SEQ ID NO: 10402
  chr10:99531512-99531610
  hyper

SEQ ID NO: 53912 - DNA, 50 bp, Homo sapiens; identical to SEQ ID NO: 33208
  chr10:99531829-99531879
  hyper

SEQ ID NO: 53913 - DNA, 142 bp, Homo sapiens; identical to SEQ ID NO: 33209
  chr10:99531880-99532022
  hyper

SEQ ID NO: 53914 - DNA, 70 bp, Homo sapiens
  chr10:99789105-99789175
  hyper
ttccacttggcttcacgtggaaagtcctgcacccatcccagaagacacctcaagtgcaactcaagaatgt

SEQ ID NO: 53915 - DNA, 15 bp, Homo sapiens
  chr10:99789282-99789297
  hyper
cggcagcagcagcaa

SEQ ID NO: 53916 - DNA, 218 bp, Homo sapiens; identical to SEQ ID NO: 33211
  chr10:99789739-99789957
  hyper

SEQ ID NO: 53917 - DNA, 22 bp, Homo sapiens
  chr10:99790318-99790340
  hyper
agccccggtcccgggctggcct

SEQ ID NO: 53918 - DNA, 153 bp, Homo sapiens; identical to SEQ ID NO: 20710
  chr10:99790437-99790590
  hyper

SEQ ID NO: 53919 - DNA, 96 bp, Homo sapiens; identical to SEQ ID NO: 20711
  chr10:99790664-99790760
  hyper

SEQ ID NO: 53920 - DNA, 30 bp, Homo sapiens; identical to SEQ ID NO: 20712
  chr10:99790917-99790947
  hyper

SEQ ID NO: 53921 - DNA, 16 bp, Homo sapiens
  chr10:99791161-99791177
  hyper
ccgtccccaccagcag

SEQ ID NO: 53922 - DNA, 204 bp, Homo sapiens
  chr10:100992443-100992647
  hyper
tcaccgcccggctctgggggctgtgcctcccgcttccagacgcccgcagcggccccctcccgcagacacccagatcctgatctcctaaaggctacagatagtgtttgttcatagagtgtttgtatggggtgggtgtacgtgctacgagcacggcgctaaagcgcagttgcccggcttctgccactgccaggaaagcgctccggg

SEQ ID NO: 53923 - DNA, 47 bp, Homo sapiens; identical to SEQ ID NO: 33217
  chr10:100992681-100992728
  hyper

SEQ ID NO: 53924 - DNA, 50 bp, Homo sapiens; identical to SEQ ID NO: 20715
  chr10:100993487-100993537
  hyper

SEQ ID NO: 53925 - DNA, 679 bp, Homo sapiens
  chr10:100994016-100994695
  hyper
cacgtggaaggagcgctccacgtggcgcctcccgctacctgccgcgtccgcagacccgacccgggccagggggacaaccccaagagctgagaggcgggcgcacctcaagaagcaaaactcgaatttcgcaaggagtgaaaaatacgaaggacgcacaacggacctggcctcggggcaaagtgggactgagagcgctgagggctcttcgaggggaacccacagctgaggctccaacttgtagggaatttttaaaaactcaacacttggattcgacattgcagaggatttatttcttattttacactgcaactctgtccctgatgggaagggatcgcagttgcctaactgccaaactgcaacaacccgggaagagtgtgagcccaattagattacaagccctagagcaaaggggatcacaaacctccgggtttgctaatctgctggtgcggagttcagatctccgaagcctccctggagtatttctaggactcttaccgcttcccttataacgctgtgaccccagcgaggattttttttttcctttaaagaaaagctaaactgtgcagttaccgcaggagatttaaggaggaggaactggcggggggaggggggcattccgtctataaaaagcgccttacaaagtcctgaagtctggaaatgacagcggaggatataaaat

SEQ ID NO: 53926 - DNA, 320 bp, Homo sapiens
  chr10:100995726-100996046
  hyper
gctcgctcgctcgctcgttttgtttttttcttttttttttttaattttttttaattttttttttcagtgttttggtgctggtggagcgaactcacgcccctagccagccttccccgtgactcttgccaagagaactcgtacaccggcaccgcccctttaagagatttctactgcagacattttttaactttttaaaggtaaggggaggggagcaggcgggaaggaggagaaaagggtggcgttgtaccctcctaatttaaccctctagggtcaggaagcagagggaggaatccaaaccatgccgttgtaccgtctgggta

SEQ ID NO: 53927 - DNA, 234 bp, Homo sapiens
  chr10:100996224-100996458
  hyper
tctggttgaagcagcaataccaagggcggttaagttgcagaggggtcttgaggcggtgattcctgtcaaagcatagagccctgaaggacattccccgaagaggagccctgatctctgtgacgcgttggatagccacaccgaagcatcctctgacctccatagggcaaagagtagcaagaaggaaaaacatagtgacctggtcaagcagcttttccgatccgagggccaaaaggg

SEQ ID NO: 53928 - DNA, 30 bp, Homo sapiens; identical to SEQ ID NO: 33221
  chr10:100996680-100996710
  hyper

SEQ ID NO: 53929 - DNA, 67 bp, Homo sapiens
  chr10:101088928-101088995
  hyper
ccgctacgcacagtgcggtgatgcctggccacctccagcctccagcggggacctcctgcccaggtgg

SEQ ID NO: 53930 - DNA, 73 bp, Homo sapiens
  chr10:101089835-101089908
  hyper
tgctgctagccttgtcggccctgttcagcggcctgcgcctgagcctgctgtcgctggacccggtggagttacg

SEQ ID NO: 53931 - DNA, 5 bp, Homo sapiens
  chr10:101090203-101090208
  hyper
atcgc

SEQ ID NO: 53932 - DNA, 11 bp, Homo sapiens
  chr10:101280193-101280204
  hyper
cacataaatca

SEQ ID NO: 53933 - DNA, 253 bp, Homo sapiens; identical to SEQ ID NO: 10421
  chr10:101283181-101283434
  hyper

SEQ ID NO: 53934 - DNA, 27 bp, Homo sapiens
  chr10:101291230-101291257
  hyper
cgccatcctgaccgccaaaaaatgctt

SEQ ID NO: 53935 - DNA, 89 bp, Homo sapiens
  chr10:101293067-101293156
  hyper
ggaggacgaggaagacgagggcgagaaattgtcctatttgaactcactagccgcagcagacggccacggggattcagggctgtgtcccc

SEQ ID NO: 53936 - DNA, 111 bp, Homo sapiens; identical to SEQ ID NO: 20722
  chr10:101293343-101293454
  hyper

SEQ ID NO: 53937 - DNA, 261 bp, Homo sapiens; identical to SEQ ID NO: 33232
  chr10:101293671-101293932
  hyper

SEQ ID NO: 53938 - DNA, 133 bp, Homo sapiens
  chr10:101294623-101294756
  hyper
ccagccatttactaccgcacgctctgcgcagccaccaaaaagggtcacggtgctccaggacaggagccgcggtgcggccgggaacagctaaggacgctgttgtttgcttcttccgcagaaagctgccagctga

SEQ ID NO: 53939 - DNA, 7 bp, Homo sapiens
  chr10:101296761-101296768
  hyper
ccctccc

SEQ ID NO: 53940 - DNA, 125 bp, Homo sapiens; identical to SEQ ID NO: 33236
  chr10:101300247-101300372
  hyper

SEQ ID NO: 53941 - DNA, 14 bp, Homo sapiens
  chr10:101875138-101875152
  hyper
gatatctgttgatt

SEQ ID NO: 53942 - DNA, 11 bp, Homo sapiens
  chr10:102322219-102322230
  hyper
agagcctgggg

SEQ ID NO: 53943 - DNA, 31 bp, Homo sapiens
  chr10:102322260-102322291
  hyper
tggccgcagcccagctcggctctgtctcgag

SEQ ID NO: 53944 - DNA, 30 bp, Homo sapiens; identical to SEQ ID NO: 10430
  chr10:102414410-102414440
  hyper

SEQ ID NO: 53945 - DNA, 230 bp, Homo sapiens; identical to SEQ ID NO: 33240
  chr10:102414708-102414938
  hyper

SEQ ID NO: 53946 - DNA, 15 bp, Homo sapiens
  chr10:102415092-102415107
  hyper
cgcactgcagcgcgg

SEQ ID NO: 53947 - DNA, 30 bp, Homo sapiens; identical to SEQ ID NO: 33242
  chr10:102415618-102415648
  hyper

SEQ ID NO: 53948 - DNA, 135 bp, Homo sapiens; identical to SEQ ID NO: 33243
  chr10:102419132-102419267
  hyper

SEQ ID NO: 53949 - DNA, 166 bp, Homo sapiens; identical to SEQ ID NO: 20725
  chr10:102419681-102419847
  hyper

SEQ ID NO: 53950 - DNA, 17 bp, Homo sapiens
  chr10:102430682-102430699
  hyper
tactcctgacaggatcg

SEQ ID NO: 53951 - DNA, 209 bp, Homo sapiens
  chr10:102430761-102430970
  hyper
tccaaaggctccgcggccattacgggaaagttagtgtgaaacatgttaaattatccccaaagtggagggagcgggggaggcggcgggggagcgggcgcccgagagagccacgagacccgccgcctccgccggggccgggtgactgcgccgtgcccgacacgccgacgtccaccagggggcggccgcgtgcggcccgagcctcggtctgc

SEQ ID NO: 53952 - DNA, 184 bp, Homo sapiens; identical to SEQ ID NO: 33246
  chr10:102470093-102470277
  hyper

SEQ ID NO: 53953 - DNA, 69 bp, Homo sapiens; identical to SEQ ID NO: 33247
  chr10:102470339-102470408
  hyper

SEQ ID NO: 53954 - DNA, 305 bp, Homo sapiens; identical to SEQ ID NO: 33248
  chr10:102473411-102473716
  hyper

SEQ ID NO: 53955 - DNA, 97 bp, Homo sapiens; identical to SEQ ID NO: 20731
  chr10:102473759-102473856
  hyper

SEQ ID NO: 53956 - DNA, 77 bp, Homo sapiens; identical to SEQ ID NO: 20732
  chr10:102473932-102474009
  hyper

SEQ ID NO: 53957 - DNA, 146 bp, Homo sapiens; identical to SEQ ID NO: 33250
  chr10:102475263-102475409
  hyper

SEQ ID NO: 53958 - DNA, 23 bp, Homo sapiens
  chr10:102475555-102475578
  hyper
ggagcgagaggcagcggagccgc

SEQ ID NO: 53959 - DNA, 366 bp, Homo sapiens; identical to SEQ ID NO: 33252
  chr10:102475579-102475945
  hyper

SEQ ID NO: 53960 - DNA, 46 bp, Homo sapiens; identical to SEQ ID NO: 33253
  chr10:102483750-102483796
  hyper

SEQ ID NO: 53961 - DNA, 123 bp, Homo sapiens
  chr10:102483870-102483993
  hyper
ggagttggagacgatgataaatatgataatttgtataaaatctgaatgggtcttgttttcagggagaatgccttggatgatgaatgggcccggctttcagatagatggctgataaaaagtgta

SEQ ID NO: 53962 - DNA, 30 bp, Homo sapiens; identical to SEQ ID NO: 33257
  chr10:102489083-102489113
  hyper

SEQ ID NO: 53963 - DNA, 336 bp, Homo sapiens; identical to SEQ ID NO: 33258
  chr10:102489328-102489664
  hyper

SEQ ID NO: 53964 - DNA, 164 bp, Homo sapiens; identical to SEQ ID NO: 33259
  chr10:102489700-102489864
  hyper

SEQ ID NO: 53965 - DNA, 40 bp, Homo sapiens; identical to SEQ ID NO: 33260
  chr10:102495101-102495141
  hyper

SEQ ID NO: 53966 - DNA, 67 bp, Homo sapiens; identical to SEQ ID NO: 33261
  chr10:102495142-102495209
  hyper

SEQ ID NO: 53967 - DNA, 71 bp, Homo sapiens
  chr10:102495437-102495508
  hyper
aggacgcggcggccgcggggagcctagcatggaagagcgcgcgggtccggcaggtaagagcggcagagacc

SEQ ID NO: 53968 - DNA, 23 bp, Homo sapiens
  chr10:102497153-102497176
  hyper
acgggttagggcggccgcttacc

SEQ ID NO: 53969 - DNA, 21 bp, Homo sapiens
  chr10:102497252-102497273
  hyper
cgggtgcgggtctcgtgttcc

SEQ ID NO: 53970 - DNA, 101 bp, Homo sapiens
  chr10:102497708-102497809
  hyper
ggggattgaatcagcaactagggcaattgtggtcttcagctatcgctgcctatacccccagaacttacaaaaataagccgtttattcgatgccctcccttt

SEQ ID NO: 53971 - DNA, 104 bp, Homo sapiens
  chr10:102498176-102498280
  hyper
ctcccatctcagccccgcctggaacacagctgtctgcctatactaccttcgccaccccctggcactttttacacaccctcacaacactcaagcacactcctacg

SEQ ID NO: 53972 - DNA, 33 bp, Homo sapiens; identical to SEQ ID NO: 33267
  chr10:102498739-102498772
  hyper

SEQ ID NO: 53973 - DNA, 332 bp, Homo sapiens; identical to SEQ ID NO: 33268
  chr10:102498832-102499164
  hyper

SEQ ID NO: 53974 - DNA, 39 bp, Homo sapiens; identical to SEQ ID NO: 33269
  chr10:102499518-102499557
  hyper

SEQ ID NO: 53975 - DNA, 112 bp, Homo sapiens; identical to SEQ ID NO: 20745
  chr10:102501247-102501359
  hyper

SEQ ID NO: 53976 - DNA, 32 bp, Homo sapiens
  chr10:102501389-102501421
  hyper
tggtcggctctggagttcggttgtcagaagaa

SEQ ID NO: 53977 - DNA, 743 bp, Homo sapiens; identical to SEQ ID NO: 33271
  chr10:102501726-102502469
  hyper

SEQ ID NO: 53978 - DNA, 142 bp, Homo sapiens; identical to SEQ ID NO: 33272
  chr10:102503828-102503970
  hyper

SEQ ID NO: 53979 - DNA, 216 bp, Homo sapiens; identical to SEQ ID NO: 10455
  chr10:102504302-102504518
  hyper

SEQ ID NO: 53980 - DNA, 93 bp, Homo sapiens; identical to SEQ ID NO: 33274
  chr10:102505756-102505849
  hyper

SEQ ID NO: 53981 - DNA, 43 bp, Homo sapiens; identical to SEQ ID NO: 33275
  chr10:102505873-102505916
  hyper

SEQ ID NO: 53982 - DNA, 114 bp, Homo sapiens
  chr10:102507395-102507509
  hyper
taatcatatatttagcgttgcgggggttggggggggcgtttaaaaatacttctgggataaaatatatttttctaagtaatttccaagcgcaggaaagccgcgccgagggcatca

SEQ ID NO: 53983 - DNA, 184 bp, Homo sapiens; identical to SEQ ID NO: 33277
  chr10:102507767-102507951
  hyper

SEQ ID NO: 53984 - DNA, 10 bp, Homo sapiens
  chr10:102508280-102508290
  hyper
cagtccgggc

SEQ ID NO: 53985 - DNA, 655 bp, Homo sapiens
  chr10:102508341-102508996
  hyper
cggctacgggttgatcgctctgggtgcaggatttctagactgctgtaggccagggagaatggggcacaggaagcaccctcaggcctggcacccagtggccgcctcggttccgagatcgggagcccgcgctggagccgggttggaaaccccgtgcccttctcttggccgaaagagcaaaagcccgagccgctcggtttcctgggggggctgccgaggtctgaggggtcaaagggactcgagtcgggtttgggtcggctacacagggcgccccgagagttattaactcgccagcgaggcctatgccgtgccacctgggcgagacggtgggccccaaccaggctctgcgaggcgcggcaggcaggcgagcccaagcagccggcattctctgcctgctgcctggagccgctctgcctccctgtctctgagcgcagcagaccccgggcccctgcctcatccgccttccttgctctacttcagatactaaggaggtgaaagagagatacggtccccctacagataaataacattagaaaaacttcccatcaaaaacaaacaacacaggaaagaggtagaaaaattccgattacaatttaatactttttaaagaagaggcagagagcaaaggggggtgtgtgtgtcaggcacttatcccctg

SEQ ID NO: 53986 - DNA, 257 bp, Homo sapiens
  chr10:102509285-102509542
  hyper
gccctctcgcccagcccccagtcttcagcccagcgtctgtgcttccagtccccactcctccgcgtggtcgtggaggtccaccacctttcttctcaagctcgggaacatgcccttccgccctgcctgcttccttcgcccgtcccgggccgcggaccctgactaatggccggtccctgctgtgtgtggggtgttgtgtttttttcttgtctctccccagcagggcacgggggtgtgaaccagctcgggggggtgtttgt

SEQ ID NO: 53987 - DNA, 33 bp, Homo sapiens; identical to SEQ ID NO: 33280
  chr10:102586113-102586146
  hyper

SEQ ID NO: 53988 - DNA, 39 bp, Homo sapiens; identical to SEQ ID NO: 33281
  chr10:102588299-102588338
  hyper

SEQ ID NO: 53989 - DNA, 175 bp, Homo sapiens; identical to SEQ ID NO: 20753
  chr10:102589250-102589425
  hyper

SEQ ID NO: 53990 - DNA, 293 bp, Homo sapiens; identical to SEQ ID NO: 20754
  chr10:102589493-102589786
  hyper

SEQ ID NO: 53991 - DNA, 237 bp, Homo sapiens; identical to SEQ ID NO: 20755
  chr10:102589915-102590152
  hyper

SEQ ID NO: 53992 - DNA, 241 bp, Homo sapiens; identical to SEQ ID NO: 20756
  chr10:102891582-102891823
  hyper

SEQ ID NO: 53993 - DNA, 159 bp, Homo sapiens; identical to SEQ ID NO: 33285
  chr10:102892090-102892249
  hyper

SEQ ID NO: 53994 - DNA, 41 bp, Homo sapiens; identical to SEQ ID NO: 20757
  chr10:102893583-102893624
  hyper

SEQ ID NO: 53995 - DNA, 33 bp, Homo sapiens
  chr10:102899140-102899173
  hyper
ggagggttcagggtccgaagacagcagccagcc

SEQ ID NO: 53996 - DNA, 206 bp, Homo sapiens; identical to SEQ ID NO: 20758
  chr10:102899601-102899807
  hyper

SEQ ID NO: 53997 - DNA, 107 bp, Homo sapiens
  chr10:102900575-102900682
  hyper
caggaacccaggcagggatggggtcctagaggccctgtgcagtgcggtgggtggcacacagagaatctggctcaacctgttaactataatagcggctttgtgtggcc

SEQ ID NO: 53998 - DNA, 83 bp, Homo sapiens; identical to SEQ ID NO: 33290
  chr10:102905699-102905782
  hyper

SEQ ID NO: 53999 - DNA, 191 bp, Homo sapiens; identical to SEQ ID NO: 33291
  chr10:102975143-102975334
  hyper

SEQ ID NO: 54000 - DNA, 24 bp, Homo sapiens
  chr10:102975595-102975619
  hyper
cgccgtctgggaactcgagatccg

SEQ ID NO: 54001 - DNA, 46 bp, Homo sapiens
  chr10:102975834-102975880
  hyper
tgcccggctccggaggtcttagcagcatcctcggaggttgccaaac

SEQ ID NO: 54002 - DNA, 242 bp, Homo sapiens; identical to SEQ ID NO: 33293
  chr10:102976414-102976656
  hyper

SEQ ID NO: 54003 - DNA, 879 bp, Homo sapiens
  chr10:102977412-102978291
  hyper
cagactaggctctccaggctggggccgcgccgtctggaccccaggcattgcgaccacgcatgtgtgtgcaccaccgagtgggcgcttgtgtgtgtgcacgctcacgtgcgcgcgagtgcacaggagtatggttgctagtgcgcgttcctgagagggcgaaggggcgcgtggaaaacgagctgatcaccatcctccccttccctgcagcccaccggttcccaggacgacgctcaaacgtcagtcctaggccacccacctagggcactgagtttcagagggagactcgggcccctaccttgcctcgaattcccttctacagagccagttccatccagccaaacggcctggagcactcagcgcccagccgggggaactgggaggcccaacacccggctgcagccgagcgcatggctggcctggtaccggtgagaggccgccagagaaagcgcaggcggagccgggggtcactgaacagagactttcagggtcgctggggggcggctggagacgatgaggccacgcgactgaagggattggggggtgaggagtggtggtgggggcggacaaagggacaacgtggcggtggacgaaccagggccagagagggccgctgtggctcccgctcttcgggccgaagcacccaccacgggttcgttattaacgcgctgggaagtccgcaatccgcccaactttcttctctttaatgagcctagaagaggctgccctgaaggggtttgttcattaaagatgtagctggaggaatattgtctcattaattatctggttttaattacactcctaccctttgaatccagagatgggaaaagttgatttggtggcgccgcccccttgagcttaaagggtcggcctggctagggg

SEQ ID NO: 54004 - DNA, 392 bp, Homo sapiens; identical to SEQ ID NO: 33295
  chr10:102978742-102979134
  hyper

SEQ ID NO: 54005 - DNA, 770 bp, Homo sapiens; identical to SEQ ID NO: 33296
  chr10:102982287-102983057
  hyper

SEQ ID NO: 54006 - DNA, 66 bp, Homo sapiens
  chr10:102983087-102983153
  hyper
cgaacttgggatttgaggctctctcacatcgccggtcccagcggcagcgcctgaggcacagccaag

SEQ ID NO: 54007 - DNA, 177 bp, Homo sapiens
  chr10:102983749-102983926
  hyper
agctgcctctcagtgttttgcaactggcacggccctgtccctcggtccgcttctactagcgctgggggtgctgcgagtcttgcccactagactaggagctccttgagggcaggaaccgaatctgattcgtttccattttcccagcccccctgcgcggcctggcgcagaaaagacgcg

SEQ ID NO: 54008 - DNA, 15 bp, Homo sapiens
  chr10:102984356-102984371
  hyper
cggaggtgccagggc

SEQ ID NO: 54009 - DNA, 25 bp, Homo sapiens
  chr10:102984516-102984541
  hyper
gaggcgcgcgcggggacctaatcca

SEQ ID NO: 54010 - DNA, 625 bp, Homo sapiens
  chr10:102985147-102985772
  hyper
ccactccggtgacagcggctactcgccagcccagcgacaacaaaagcccggagagaaacccgctctgtccaggaaagtgaaagcggcctcagcccccgccccagccggccttggggcgccgcagacccgagagagtccttgcaagatccatacctctgcccccagcggtgtgccggggtgtggaggcagaattggttaatgttgccagaaattcacaccagctcccagacgcttgggcttacagttccaggtgcccacattgaaattcagcctggccttgatgcctttagcctttggcccccgactccccaaggatgaggccctcggggctagaatcgaaacttgggaacccaaggctccaccccgcgtctgactgagtgatacctgcagcgctcccggggctcagccctgttttcggggagtgcagggagaatgcccttgggtctggggtgggatgcaggaaatgcagggcaagaccccctcccaccctttgttcaacacaaattaatgttgtactgtggtgtgcccccacatacacaggcattttctcccagcatttcacggctcgttttttaccccgacctggcgaagcccgcttctctcccgatttagcagctgcctcagg

SEQ ID NO: 54011 - DNA, 571 bp, Homo sapiens; identical to SEQ ID NO: 20769
  chr10:102985963-102986534
  hyper

SEQ ID NO: 54012 - DNA, 215 bp, Homo sapiens; identical to SEQ ID NO: 33303
  chr10:102988150-102988365
  hyper

SEQ ID NO: 54013 - DNA, 141 bp, Homo sapiens; identical to SEQ ID NO: 33304
  chr10:102988734-102988875
  hyper

SEQ ID NO: 54014 - DNA, 457 bp, Homo sapiens
  chr10:102989172-102989629
  hyper
tctctccctctccctcgccctctctttcactctctgtctgtccaatgcaggcggctgtaagttgggaagctcattaattagcgggccgggggtaggaggagccggctggaattagcctgcctaatgcgcctgtcagtccgggcgctgcgctgcgttcggcccgagctgtttgtaaattacattagctgctcctttattgcacccgaacctcgggcgactgaaaagccaccgcccccaccccaaactgcgagccgcgctcctggcgcacccgcctcccgccggcctagctgcaatgaccgcaccggcccgaaggtctcggtctctccgacccgggatgtggagcccgaaagagtggtgggaaccccagcccgggagggacgcggccgccgctcgggccaggtaggaccaggagcccgggtgggccccgctgccacccagagtggactttgcggagctg

SEQ ID NO: 54015 - DNA, 638 bp, Homo sapiens
  chr10:102989659-102990297
  hyper
ccctcttgcccctcaccccactgcctgggcgacgcgcctggggagagggaatctgaagccctcctgcgctggcccgcaggaggtcagagccggctgcgcagccttgggtgggcgacgcgggaagggggtggaggaccccaggggttgggggagggggctagtcggagagctcagccttctccacgcggagaggcggaggagggaattgttggcggctctggacgcctctccccggcctgattccgaagcggccgccctacctcctccggcaatcttgctcactttcctccggcagccgctccccaggctggctggggccaccaacggcctgatgatgggcgtctgaagagtagccaggccaggtgccggggctaacggggccggctccgtgcctccctgctgcgctccgcccgggccccggccggggccccgctgccggccccgcctagcccagcgcccggcttgagtgcatggccaggccgactccagctgttccggatgcggggcgggggcccggcgggagccaggccgcggctggggctttgctctcaggaactcgcagggaggccaggcttccagttaggctggggctaaagaccttagggcccgggatctgtgaatatcgggagaacatgttg

SEQ ID NO: 54016 - DNA, 97 bp, Homo sapiens
  chr10:102996019-102996116
  hyper
aggtctcactactgtcggggggcgccgggcgcaggccgggcatggggcctgagcttaggccaggtggaaaggtggaaggacctagtggggacagacg

SEQ ID NO: 54017 - DNA, 81 bp, Homo sapiens; identical to SEQ ID NO: 20773
  chr10:102996638-102996719
  hyper

SEQ ID NO: 54018 - DNA, 251 bp, Homo sapiens; identical to SEQ ID NO: 33308
  chr10:102996977-102997228
  hyper

SEQ ID NO: 54019 - DNA, 48 bp, Homo sapiens; identical to SEQ ID NO: 20775
  chr10:102997281-102997329
  hyper

SEQ ID NO: 54020 - DNA, 178 bp, Homo sapiens; identical to SEQ ID NO: 20776
  chr10:102997406-102997584
  hyper

SEQ ID NO: 54021 - DNA, 298 bp, Homo sapiens
  chr10:102998278-102998576
  hyper
gcctctctctgagatcgggtcctcctcctgcagggcagcagagtggaagccagggcctgggaccctctggctgggcaaggagggactggagtccggctcccggtgaccccgtccccagtgccagcggtggggtcgcctgtggcggcccggacaggccacgggtccctctccccaagtcccattacgttgtatttatgtttcattttatagtttttttttcctcctcccttattattgtctcactctgggggaggcaaaggatataatatattcatctttattataccaaatctgtgtg

SEQ ID NO: 54022 - DNA, 31 bp, Homo sapiens; identical to SEQ ID NO: 20778
  chr10:102998828-102998859
  hyper

SEQ ID NO: 54023 - DNA, 1 bp, Homo sapiens
  chr10:103043864-103043865
  hyper
g

SEQ ID NO: 54024 - DNA, 51 bp, Homo sapiens; identical to SEQ ID NO: 20779
  chr10:103043924-103043975
  hyper

SEQ ID NO: 54025 - DNA, 40 bp, Homo sapiens
  chr10:103044366-103044406
  hyper
ggccagacagagttggggcgggaggcgggtatacggaaag

SEQ ID NO: 54026 - DNA, 79 bp, Homo sapiens; identical to SEQ ID NO: 33314
  chr10:103051188-103051267
  hyper

SEQ ID NO: 54027 - DNA, 55 bp, Homo sapiens; identical to SEQ ID NO: 33315
  chr10:103052659-103052714
  hyper

SEQ ID NO: 54028 - DNA, 80 bp, Homo sapiens; identical to SEQ ID NO: 33316
  chr10:103326534-103326614
  hyper

SEQ ID NO: 54029 - DNA, 15 bp, Homo sapiens
  chr10:103534562-103534577
  hyper
cggctgtagagttgg

SEQ ID NO: 54030 - DNA, 600 bp, Homo sapiens; identical to SEQ ID NO: 33318
  chr10:103534896-103535496
  hyper

SEQ ID NO: 54031 - DNA, 48 bp, Homo sapiens; identical to SEQ ID NO: 33320
  chr10:103535841-103535889
  hyper

SEQ ID NO: 54032 - DNA, 87 bp, Homo sapiens
  chr10:103536140-103536227
  hyper
ggcggccggtctgggcgcctccccctatccccggcctgtcccctcgcgcgctccccggtcccggacgcgcggggatgggggcgccta

SEQ ID NO: 54033 - DNA, 87 bp, Homo sapiens
  chr10:103536416-103536503
  hyper
gaatggctgcgcacccggccctcgcgcagtgcgtgccggtgccacccggaccccgctcccctgtttcggccgcgtgccccgtcctgt

SEQ ID NO: 54034 - DNA, 202 bp, Homo sapiens; identical to SEQ ID NO: 33323
  chr10:103986018-103986220
  hyper

SEQ ID NO: 54035 - DNA, 172 bp, Homo sapiens; identical to SEQ ID NO: 33324
  chr10:104000813-104000985
  hyper

SEQ ID NO: 54036 - DNA, 92 bp, Homo sapiens; identical to SEQ ID NO: 33325
  chr10:104001519-104001611
  hyper

SEQ ID NO: 54037 - DNA, 153 bp, Homo sapiens; identical to SEQ ID NO: 33326
  chr10:104168680-104168833
  hyper

SEQ ID NO: 54038 - DNA, 49 bp, Homo sapiens
  chr10:104170047-104170096
  hyper
gctggcgcctgggaacgggacctgctcacagggagccagaaagcagttt

SEQ ID NO: 54039 - DNA, 69 bp, Homo sapiens; identical to SEQ ID NO: 20786
  chr10:104170732-104170801
  hyper

SEQ ID NO: 54040 - DNA, 78 bp, Homo sapiens; identical to SEQ ID NO: 33330
  chr10:104629270-104629348
  hyper

SEQ ID NO: 54041 - DNA, 92 bp, Homo sapiens; identical to SEQ ID NO: 20787
  chr10:105036450-105036542
  hyper

SEQ ID NO: 54042 - DNA, 19 bp, Homo sapiens
  chr10:105036864-105036883
  hyper
ccttaaaagccgggcgcac

SEQ ID NO: 54043 - DNA, 330 bp, Homo sapiens; identical to SEQ ID NO: 20789
  chr10:105036893-105037223
  hyper

SEQ ID NO: 54044 - DNA, 86 bp, Homo sapiens; identical to SEQ ID NO: 10504
  chr10:105041683-105041769
  hyper

SEQ ID NO: 54045 - DNA, 51 bp, Homo sapiens
  chr10:106398593-106398644
  hyper
tgcacctccccagtgcgcataggacttgggagaccacactcctccgggctg

SEQ ID NO: 54046 - DNA, 275 bp, Homo sapiens
  chr10:106399306-106399581
  hyper
aactctatctactcccgaaggggaggagcagggctggaggctgtctctctctccctaagcctcctccctcctgcctcctcctttcttaatagctcctcctctagctcctctagtctcagacttttcaacccctagaatcccaggggcttctcggaggcggcgagctacaccacatgtcctggggcctgtaaaccgcagctcgaggtcgtctgtgggtttagctcatttcccttcagcccacctgaagtctccttcttcctacggtcacgaaggat

SEQ ID NO: 54047 - DNA, 178 bp, Homo sapiens
  chr10:106400387-106400565
  hyper
ccagggagcggcgagcagagtccagggtgcatcccgcgcttggcttccgtgcgcagcctccccgcgcggaggcacctggctccctctcggctctagaacgcgaacagttggcgttgagcacacaactcctcctccttctcccccgagacccctgtaccctccccgcgcgccatctccc

SEQ ID NO: 54048 - DNA, 136 bp, Homo sapiens; identical to SEQ ID NO: 33339
  chr10:106400566-106400702
  hyper

SEQ ID NO: 54049 - DNA, 215 bp, Homo sapiens; identical to SEQ ID NO: 33340
  chr10:106400703-106400918
  hyper

SEQ ID NO: 54050 - DNA, 387 bp, Homo sapiens
  chr10:106402325-106402712
  hyper
agtccagggagcggccctggaaagccgtagcagaggccgtaaaaaaaagtttaaagcgtgaagcgaaattccacacccatccagcgctcatgccacaccgctcgccctcacgcacgcacaggcacacggaagtcgctcagcagaaaactctcgacttcaccattgcgtcctgcgccacaaacggctccctgagcggagttgggtgcctgagcttcctgcacacctctccacccgcttttccccgccaccgggttctcctggacaaggatgtaccgagaggtggcgtcgttgagcccggtctggcctactccggcattccgaactgggcgcccgactgagcatcgcgcctgcctggcagctgcagcggcccgcagcgcgtgcccggag

SEQ ID NO: 54051 - DNA, 127 bp, Homo sapiens; identical to SEQ ID NO: 33344
  chr10:108923771-108923898
  hyper

SEQ ID NO: 54052 - DNA, 100 bp, Homo sapiens
  chr10:108923945-108924045
  hyper
cgctccgctccgtctcctccggccggagcgtgcagcaaccgccatggatgccccagtgccccgagcccgctccagggatagcgctcggtccccgggggcc

SEQ ID NO: 54053 - DNA, 21 bp, Homo sapiens
  chr10:108924345-108924366
  hyper
cgctggcggctgtggggggcc

SEQ ID NO: 54054 - DNA, 34 bp, Homo sapiens; identical to SEQ ID NO: 33347
  chr10:108924367-108924401
  hyper

SEQ ID NO: 54055 - DNA, 32 bp, Homo sapiens; identical to SEQ ID NO: 33348
  chr10:108924769-108924801
  hyper

SEQ ID NO: 54056 - DNA, 27 bp, Homo sapiens
  chr10:109674181-109674208
  hyper
ttcacactccctccccgcttcgctccc

SEQ ID NO: 54057 - DNA, 29 bp, Homo sapiens
  chr10:109674466-109674495
  hyper
ggagcagcaggagcccggtctcgcagtgc

SEQ ID NO: 54058 - DNA, 1 bp, Homo sapiens
  chr10:109674853-109674854
  hyper
c

SEQ ID NO: 54059 - DNA, 117 bp, Homo sapiens; identical to SEQ ID NO: 33352
  chr10:109674855-109674972
  hyper

SEQ ID NO: 54060 - DNA, 257 bp, Homo sapiens; identical to SEQ ID NO: 10516
  chr10:110225912-110226169
  hyper

SEQ ID NO: 54061 - DNA, 175 bp, Homo sapiens; identical to SEQ ID NO: 33354
  chr10:110671709-110671884
  hyper

SEQ ID NO: 54062 - DNA, 29 bp, Homo sapiens
  chr10:110672245-110672274
  hyper
ggctgcgcgcggatcgcctgcgccactgt

SEQ ID NO: 54063 - DNA, 51 bp, Homo sapiens; identical to SEQ ID NO: 3638
  chr10:111216345-111216396
  hyper

SEQ ID NO: 54064 - DNA, 107 bp, Homo sapiens
  chr10:111216682-111216789
  hyper
caacttttgccatcccgggagccatagcggcagagagggggtcccggacccgaggtggcagcgaggggctctgctttggcagctgtcggggctggagctcaggaccc

SEQ ID NO: 54065 - DNA, 74 bp, Homo sapiens; identical to SEQ ID NO: 33358
  chr10:111217161-111217235
  hyper

SEQ ID NO: 54066 - DNA, 120 bp, Homo sapiens; identical to SEQ ID NO: 33359
  chr10:112257819-112257939
  hyper

SEQ ID NO: 54067 - DNA, 30 bp, Homo sapiens; identical to SEQ ID NO: 33360
  chr10:112258378-112258408
  hyper

SEQ ID NO: 54068 - DNA, 53 bp, Homo sapiens
  chr10:112403098-112403151
  hyper
gcatattcgcacccacgcgccagggcattaagccgaaccttgcttggtggctc

SEQ ID NO: 54069 - DNA, 618 bp, Homo sapiens
  chr10:112403297-112403915
  hyper
tcctttacatttccacggagatttggccaataaataacaagaataaaatgtacgcatggttttgtctttgcgctcgtggggtcgtggcggggtcttttaagtgaagagaaaaagaaaccagaaacccacggtggccccaccggctgcttccggggacacctgaaatcagcagctggaactgacaatttggagagccccggggatggtcatctgagacctgggttacaatacaagtctgacctcggggcgagtccaggctttcttcccctcagggtcgggtgcctcaagagccagtggcgctggccgggctccagccgcgagcagatgccaggcccggcacactttgcacgggcgatgcgcgcggacgtcccgggcgcgctcggtccgcccggcttggcaggagctgcgagaggccgcgcgcaccgtccccagggacagccggaggactcagggctcccgggtggagcgagagcgcggcggccgaccgcgggctgcgtgtgtcgccttcctcacgcggtatgctgcgccgtggaacgctgggctacggaccctgagggtgcactgtggcgggtggcgtacgccgcgctccctccccgcttcctgcgcccagggtcggcg

SEQ ID NO: 54070 - DNA, 168 bp, Homo sapiens; identical to SEQ ID NO: 33362
  chr10:112404226-112404394
  hyper

SEQ ID NO: 54071 - DNA, 253 bp, Homo sapiens; identical to SEQ ID NO: 33363
  chr10:112431872-112432125
  hyper

SEQ ID NO: 54072 - DNA, 79 bp, Homo sapiens; identical to SEQ ID NO: 33364
  chr10:112432360-112432439
  hyper

SEQ ID NO: 54073 - DNA, 41 bp, Homo sapiens; identical to SEQ ID NO: 33365
  chr10:112836758-112836799
  hyper

SEQ ID NO: 54074 - DNA, 61 bp, Homo sapiens; identical to SEQ ID NO: 33366
  chr10:114712100-114712161
  hyper

SEQ ID NO: 54075 - DNA, 116 bp, Homo sapiens; identical to SEQ ID NO: 33367
  chr10:115804051-115804167
  hyper

SEQ ID NO: 54076 - DNA, 9 bp, Homo sapiens
  chr10:115804553-115804562
  hyper
ccgggccta

SEQ ID NO: 54077 - DNA, 205 bp, Homo sapiens
  chr10:115804635-115804840
  hyper
cgcgaggcccagaagcaggtgaagaagatcgacagctgcgagcgccgtttcctcggcggcccagcgcggccgccctcgccctcgccctcgcccgtccccgcgcccgcgccgccgcccggacccccgcgccccgccgccgccgccgccaccgccccgctggccaacgggcgtgcgggtaagcggcggccctcgcgcctcgtggccc

SEQ ID NO: 54078 - DNA, 41 bp, Homo sapiens; identical to SEQ ID NO: 20806
  chr10:115805014-115805055
  hyper

SEQ ID NO: 54079 - DNA, 36 bp, Homo sapiens; identical to SEQ ID NO: 33370
  chr10:116163376-116163412
  hyper

SEQ ID NO: 54080 - DNA, 23 bp, Homo sapiens
  chr10:116164341-116164364
  hyper
ggccgccgcgcccagggtcctcg

SEQ ID NO: 54081 - DNA, 30 bp, Homo sapiens; identical to SEQ ID NO: 33372
  chr10:116164624-116164654
  hyper

SEQ ID NO: 54082 - DNA, 195 bp, Homo sapiens; identical to SEQ ID NO: 33373
  chr10:116852246-116852441
  hyper

SEQ ID NO: 54083 - DNA, 95 bp, Homo sapiens; identical to SEQ ID NO: 33374
  chr10:116853397-116853492
  hyper

SEQ ID NO: 54084 - DNA, 370 bp, Homo sapiens
  chr10:118032547-118032917
  hyper
aaagttgggagacgccagcaaaaagaaaggggtggccggaggaggggggaagaaggagtggggaagagggacgggaagcggcaatgggttcccaaacagaacgaaaaaaactccaaatgccaccaacctggactcaaccgaccgcgtccagctgcggcgaggagccagtttgtttatttacttatttattctttcagggcaatggtgtccccgccccctccttccctttccgggctcactttatctgcgctaggaaaagaaaaaaaagaaaaaaaaatagatgcggtaatcttcgagagctcgaagggccgagttgggccaggacgatttccgagcagagccctcggctcggatgctcgttagggatgtt

SEQ ID NO: 54085 - DNA, 171 bp, Homo sapiens
  chr10:118033542-118033713
  hyper
ttagaaaatttataagctgacctccattttggctgtttcgagagtaaattaacaacaacaaaaaaagcctaacatgtacacagcccttcgccccaacccctgggaccgctggttcccagtcgtgctgctcaccccccgccccccacgcctgacacacgctccccttcccgc

SEQ ID NO: 54086 - DNA, 77 bp, Homo sapiens; identical to SEQ ID NO: 33381
  chr10:118033917-118033994
  hyper

SEQ ID NO: 54087 - DNA, 67 bp, Homo sapiens
  chr10:118890913-118890980
  hyper
tgaactgtctgtgggcggctgctgtgatctcagcaaaaagcggagctcaaggctcagggactccgcc

SEQ ID NO: 54088 - DNA, 22 bp, Homo sapiens
  chr10:118893559-118893581
  hyper
tccgggagtaaggctcgaaggc

SEQ ID NO: 54089 - DNA, 23 bp, Homo sapiens
  chr10:118894477-118894500
  hyper
ggaatttccggtggagggtgtga

SEQ ID NO: 54090 - DNA, 452 bp, Homo sapiens
  chr10:118896177-118896629
  hyper
aggggagatgtcagccgccagaaccctcccgtccccctccacctccttggcccgagctggatttggggacacagtccccagaagcgtgcagttttggggatggggggcggggtgcggagcgcgaccacaaccaggtagcaaagacactgtgtggagggcaaggggcctaactccataccgctgaccgaaggagggaccacactttgtctttttgtagagtcctccagacaggggagagaaaaaaatccaatcaattccacataggcggacgtttcttccggcctgggggggcctcggctgagccttccgggtcccctgtagcctgagggtacccttgtcgccccgcccgggtcctgcgggccccagctctgggcttgccgaccagaccgtgatccagacgtccccacccccaccctcgagtctccttccctccggagtccgcgcggcggaag

SEQ ID NO: 54091 - DNA, 30 bp, Homo sapiens; identical to SEQ ID NO: 10543
  chr10:118897545-118897575
  hyper

SEQ ID NO: 54092 - DNA, 27 bp, Homo sapiens
  chr10:118897820-118897847
  hyper
ctggtggagctgcggcgaggccgcctc

SEQ ID NO: 54093 - DNA, 65 bp, Homo sapiens
  chr10:118897848-118897913
  hyper
tcagcacccgcgtcctctgagcacgtccagtgtccccagcctggcgatcaggtagcgaacagcgc

SEQ ID NO: 54094 - DNA, 187 bp, Homo sapiens; identical to SEQ ID NO: 20815
  chr10:118897968-118898155
  hyper

SEQ ID NO: 54095 - DNA, 174 bp, Homo sapiens; identical to SEQ ID NO: 33397
  chr10:118898864-118899038
  hyper

SEQ ID NO: 54096 - DNA, 16 bp, Homo sapiens
  chr10:118899302-118899318
  hyper
ccgcacctcccgcccc

SEQ ID NO: 54097 - DNA, 209 bp, Homo sapiens; identical to SEQ ID NO: 20816
  chr10:118899957-118900166
  hyper

SEQ ID NO: 54098 - DNA, 513 bp, Homo sapiens
  chr10:118922208-118922721
  hyper
tctagaagcggcaggataagcacacgggtttgggcagtgctcacattttgggtttattggcttgatggggttgtttggggcgctctcagttacaaactgcagaagagtgggggcgggggacaggatggggaggaaagggtgggcgaaggagccgagagtaagacaagccgaagggtggaaactgcgggagggagaggaaacgccgaaggcgatgtagagtcctgcgagggaccgggagaggtagggagggatccgagccgcagtcctgagggagagcgaccgcgcgccccgcagccgagctgggtcccttcgccccgcccggaatcccggcccccgcccgccccacgcaagtccccgtgccccctccgggaggtgggagtcgccgggactctgcgctccgccagcctccgtctgctggccgggtccgggatccgcacccggagaggctgaaccgaggctgaaccgaggcggacgcagccccgggtcggtggctcgcctggccgggtggggtgg

SEQ ID NO: 54099 - DNA, 89 bp, Homo sapiens
  chr10:118923049-118923138
  hyper
cgacggctggggacgcggagaaccctctccgagctggggtccccgcctgctgggcaacctcacctcaacgtctggcctggcctggggcc

SEQ ID NO: 54100 - DNA, 316 bp, Homo sapiens
  chr10:118923259-118923575
  hyper
ggacagcccaagctgtcccgcccgctgcgcccgaggagcatccccttggcgctgcaggctgtcgcctcccccagcacctggcggggcgggtgccaggctgggcctctagacggtttcaccgctgcttatcatttctccttcattttgcaggggcaggggagctgcccctcccttcggagaaaggccgcgcctgcacccaaaggtaaccctcgggtgaccccgggagcggggctgtctggccttggtgcgagaccccgggcggggggtcagaggtttctgttgcatcagagaaacacggcagcgtcaaaaagaaaaa

SEQ ID NO: 54101 - DNA, 173 bp, Homo sapiens; identical to SEQ ID NO: 20820
  chr10:118924431-118924604
  hyper

SEQ ID NO: 54102 - DNA, 1162 bp, Homo sapiens
  chr10:118924896-118926058
  hyper
agaaggttcagccccccttctcatccctgtactttggggatggctcgtacttggacaggggtgggcctccgccttctccgccttctatcggacctttcttcggatggatttctacgtaaactcggaaggcgatcaaatgcaggcggccaacctccagcgcttttttttttcctctcaaaggcggcgcctgcatttttgggggctccagcccaggctgagaaagtcccctcaaacctctactctgaggttgctcacacggcctgcaaaaacccgacggggcaccccgccaccccaccttacgtttccctagggccaagtcagtggtcaaaaaccaacccggtggtagctgcctttaccaaggaaagacagccaggacgcccgcaccgacggcaacgcgcggacagagaggaccgtgccctctttcgcatgttacggggcgagggggctgttggcgtcaggagcgccctgggaggaacttcgtagcggattcgagagacagagggaattcagcaaacttgctgccccgggctgccggctggagcccggcagattcgctgcgcagcactgccccctggtatccagcgccgaaagtgcccccctccgcagctgcaaggctcctccctgggctgcgcgggacagattttttctcctttcctggctacacgcctaacagagaagctatcccgagggacctcaagaagtccccccaagccgtactcaaaagcctttctccctcctcctcaagcgctcacttccccaaagaggacccggacccctgactgcctgagccaggtccccagcatggtccgcaacccttctcgactccggcatccacctccaggctgacgtctacccgggagggggctggggacccaaggagacttcgactacaggcccaggcgaacggaaggaagaggcttgcgttcagagagacacgtttggagctgggactgttcattctttaaggaacaccagcttccagggcatctttcgttggcaccttggctttccagagaagaaaggaagtgggtatcagggccagcccctcctcgcaccccaggctggagaggtgccgaggtgcttagtcactcagtccaagggcacctgagagatgggggcaaacttggcaggagcttgagcacggaggcgtgatccgcggggg

SEQ ID NO: 54103 - DNA, 80 bp, Homo sapiens
  chr10:118927006-118927086
  hyper
agagagccaagctctcgcccttcggtttccattcacgctaccctctctgagccgcaattctctctcctgcgttggcactg

SEQ ID NO: 54104 - DNA, 267 bp, Homo sapiens; identical to SEQ ID NO: 20824
  chr10:118927296-118927563
  hyper

SEQ ID NO: 54105 - DNA, 40 bp, Homo sapiens; identical to SEQ ID NO: 33405
  chr10:118927999-118928039
  hyper

SEQ ID NO: 54106 - DNA, 160 bp, Homo sapiens; identical to SEQ ID NO: 33406
  chr10:118928364-118928524
  hyper

SEQ ID NO: 54107 - DNA, 113 bp, Homo sapiens; identical to SEQ ID NO: 10555
  chr10:119000479-119000592
  hyper

SEQ ID NO: 54108 - DNA, 200 bp, Homo sapiens; identical to SEQ ID NO: 3656
  chr10:119001328-119001528
  hyper

SEQ ID NO: 54109 - DNA, 386 bp, Homo sapiens
  chr10:119294461-119294847
  hyper
cttcccgcgcccagacgccgaggggatgcaaacaggggagccgggcctggtatggccaacctccaggatcgaggggccccagaatgtgcgtgtggccgggggcgggggcagctgcgggggccagaactagagtattccttcgctctcccctgggggccgggcccccacgagttgcagcagagcccgtctgtaattagggcctcctggtccggcaaagctgcggctgctcccagagagagttggggtcttctcagggcccgcgatgggggagtggtcgtggtcagacccccgtgagccccttcggaaggtcccagtccctgtccattcttctgtcccgcagctctctccgcgcaggcggggcagagccggggaagaagacgctggac

SEQ ID NO: 54110 - DNA, 596 bp, Homo sapiens
  chr10:119296788-119297384
  hyper
atctgagagagtcgcaccccgggaccccagctcttcctactccaccccaggcagggcccgcgcaggccgtccaaggcctgttctctgaaccacctgggttgggccgcgaaatatgggacctcaggcatggaattgtggctgcacaggtgatcacggcttcctagtccttcttagagcagaacctgtcccactccagcccacctctgcgcccccttcggaaggaagcctactggagctggaattccagcgtgggtggcgaactctcaagccaagagctggagctgatggaggcaggagggacgcacttccaagccatccgggctcctccgtagccagtgagcctcctttaacccctccactggcctggatgacggcctaggcgagactttggcagtgtggcgcgaccccagcgctcccccgccctcgggctcgggggcgcggtgggtaccgcgcccgcgcccggccctcgccactaggcgccgctgcgctcacgccgatcggggccccgggtcgccgcgcccgcctggcgagaggcctctggggaagacgccagaaagggatttgtcgtaataatttttaaaaaatgtttttagggc

SEQ ID NO: 54111 - DNA, 159 bp, Homo sapiens
  chr10:119297529-119297688
  hyper
aagggctcgcccttcacgggcgtcggtgcggtccgcggcgagccgcgggagcacagggcgggctcagcattctggttcaacgtgaggaccagaacctcggcgatcagggaccaggacgtggcagagtgcagcgggtagcttcgacggcacaaggccatg

SEQ ID NO: 54112 - DNA, 442 bp, Homo sapiens
  chr10:119300923-119301365
  hyper
tgatcataattatgccgccgcgcgagccaatggggacgagggaactcggtcctaaaatcatcccaaaaccgaaggcgagctcgaaaatgcggacacggcccgggaccggagatgcgatccgtagtcgttagttgcactgggtttgcacagcaaccaccacccccccaccaaccccgggacaacagatggcataataataataatagaaataataataataaaataatatcatctataataataataacattgaccacactgacaaaaataattacgacggaaccttaatagtacagtagcaccatatcgggctctcccctgaccttggactgccggtcccagatattccagaaggaattgttttggggaaggaggtgagcaccctcccagacagaaaacgctagagaccgtggggcgagagagggagagagttggaagccca

SEQ ID NO: 54113 - DNA, 96 bp, Homo sapiens; identical to SEQ ID NO: 33414
  chr10:119301759-119301855
  hyper

SEQ ID NO: 54114 - DNA, 32 bp, Homo sapiens; identical to SEQ ID NO: 33415
  chr10:119301915-119301947
  hyper

SEQ ID NO: 54115 - DNA, 86 bp, Homo sapiens
  chr10:119302876-119302962
  hyper
cgcggcactcagctacgctaactccagccccataaatccgttcctcaacggcttccactcggccgccgccgccgccgccggtaggg

SEQ ID NO: 54116 - DNA, 409 bp, Homo sapiens; identical to SEQ ID NO: 10566
  chr10:119303312-119303721
  hyper

SEQ ID NO: 54117 - DNA, 30 bp, Homo sapiens; identical to SEQ ID NO: 33418
  chr10:119304074-119304104
  hyper

SEQ ID NO: 54118 - DNA, 40 bp, Homo sapiens; identical to SEQ ID NO: 33419
  chr10:119304439-119304479
  hyper

SEQ ID NO: 54119 - DNA, 40 bp, Homo sapiens; identical to SEQ ID NO: 33420
  chr10:119304501-119304541
  hyper

SEQ ID NO: 54120 - DNA, 41 bp, Homo sapiens; identical to SEQ ID NO: 33421
  chr10:119304788-119304829
  hyper

SEQ ID NO: 54121 - DNA, 46 bp, Homo sapiens
  chr10:119304850-119304896
  hyper
cgcggcgccagggcggctgcggagccggccgaggtcaggagcctgg

SEQ ID NO: 54122 - DNA, 17 bp, Homo sapiens
  chr10:119307052-119307069
  hyper
cccgccacgaagaggag

SEQ ID NO: 54123 - DNA, 71 bp, Homo sapiens; identical to SEQ ID NO: 33425
  chr10:119311647-119311718
  hyper

SEQ ID NO: 54124 - DNA, 30 bp, Homo sapiens; identical to SEQ ID NO: 33426
  chr10:119312507-119312537
  hyper

SEQ ID NO: 54125 - DNA, 164 bp, Homo sapiens; identical to SEQ ID NO: 33428
  chr10:119313340-119313504
  hyper

SEQ ID NO: 54126 - DNA, 15 bp, Homo sapiens
  chr10:119313528-119313543
  hyper
cgagttcattagtcg

SEQ ID NO: 54127 - DNA, 42 bp, Homo sapiens; identical to SEQ ID NO: 33430
  chr10:119494127-119494169
  hyper

SEQ ID NO: 54128 - DNA, 69 bp, Homo sapiens; identical to SEQ ID NO: 33431
  chr10:119494374-119494443
  hyper

SEQ ID NO: 54129 - DNA, 208 bp, Homo sapiens; identical to SEQ ID NO: 33432
  chr10:119494848-119495056
  hyper

SEQ ID NO: 54130 - DNA, 412 bp, Homo sapiens
  chr10:120353831-120354243
  hyper
cgatggcgtgggggtcgaggtcccgcagcaggttgaagacgtgcagcggcagccagcagacggcgaacaccaccacgatcaccaccagcaagcagaaggtgcgccggcgccgagcgcggtcccagtcggcctggctctgggtcacgcagcccggcaccacgcggttgcggagcttcactgacacccggacgtaagacaggaggatgaccagcagagggagcaggtaggtgaccagcagcagcccccaggcgtagagctggcgctggcgctcctgggagccccagaactcctcgcagaggcgcacgtcgtgcggcttgagctccacgtgataggtgtgcacggcggcgggcagcgccagcaccgcggacagcgcccagatggccagcacagcgtaggcgctgaggcgcagcga

SEQ ID NO: 54131 - DNA, 45 bp, Homo sapiens
  chr10:120354273-120354318
  hyper
gacgtagcggtccactgcgatggtggtgagcgtgaacaccgacac

SEQ ID NO: 54132 - DNA, 166 bp, Homo sapiens; identical to SEQ ID NO: 33434
  chr10:120355260-120355426
  hyper

SEQ ID NO: 54133 - DNA, 87 bp, Homo sapiens
  chr10:120355461-120355548
  hyper
cgtcaggctatcgggaggagccggtgcagtcttaggagggaaggagcggggaaggaagtagcggtgggagattgcaatgcagctggg

SEQ ID NO: 54134 - DNA, 299 bp, Homo sapiens; identical to SEQ ID NO: 33436
  chr10:121301494-121301793
  hyper

SEQ ID NO: 54135 - DNA, 166 bp, Homo sapiens; identical to SEQ ID NO: 33437
  chr10:122216112-122216278
  hyper

SEQ ID NO: 54136 - DNA, 272 bp, Homo sapiens; identical to SEQ ID NO: 33438
  chr10:122216485-122216757
  hyper

SEQ ID NO: 54137 - DNA, 42 bp, Homo sapiens; identical to SEQ ID NO: 10578
  chr10:122216793-122216835
  hyper

SEQ ID NO: 54138 - DNA, 298 bp, Homo sapiens
  chr10:122217083-122217381
  hyper
gcgcgccgaggctgagacctgctcccgggtctcaccgggcccgcgcctgtcgccagccccgcaccacctgcccgggggatccagggctgcacctctaaacagggacgcgcaccctggcccgtgccctcgggaagtttctccttctgtgtgatctttgaggcccacgttggaagtctttacccctggccccgtctccgattcctccccgctgtgcccagggccagactccttccgtgtccctggctttagcgcccgcggtcctggcgagcgttttcccagcgggcgtttgcggcgcttc

SEQ ID NO: 54139 - DNA, 23 bp, Homo sapiens
  chr10:122708691-122708714
  hyper
agggaccgcggggctctctgcct

SEQ ID NO: 54140 - DNA, 352 bp, Homo sapiens; identical to SEQ ID NO: 33442
  chr10:122738898-122739250
  hyper

SEQ ID NO: 54141 - DNA, 118 bp, Homo sapiens; identical to SEQ ID NO: 33443
  chr10:123356872-123356990
  hyper

SEQ ID NO: 54142 - DNA, 30 bp, Homo sapiens; identical to SEQ ID NO: 33444
  chr10:123358301-123358331
  hyper

SEQ ID NO: 54143 - DNA, 34 bp, Homo sapiens; identical to SEQ ID NO: 33445
  chr10:123873006-123873040
  hyper

SEQ ID NO: 54144 - DNA, 29 bp, Homo sapiens
  chr10:123923517-123923546
  hyper
cgcccgggccgccccgagtctcccgggga

SEQ ID NO: 54145 - DNA, 46 bp, Homo sapiens; identical to SEQ ID NO: 33448
  chr10:124221003-124221049
  hyper

SEQ ID NO: 54146 - DNA, 206 bp, Homo sapiens; identical to SEQ ID NO: 33449
  chr10:124221715-124221921
  hyper

SEQ ID NO: 54147 - DNA, 327 bp, Homo sapiens; identical to SEQ ID NO: 33450
  chr10:124639199-124639526
  hyper

SEQ ID NO: 54148 - DNA, 30 bp, Homo sapiens; identical to SEQ ID NO: 33451
  chr10:124892329-124892359
  hyper

SEQ ID NO: 54149 - DNA, 73 bp, Homo sapiens; identical to SEQ ID NO: 33452
  chr10:124892950-124893023
  hyper

SEQ ID NO: 54150 - DNA, 43 bp, Homo sapiens
  chr10:124893350-124893393
  hyper
gacctctgggtatccagcagcgattgggcgacctaggcccagt

SEQ ID NO: 54151 - DNA, 41 bp, Homo sapiens; identical to SEQ ID NO: 20844
  chr10:124893594-124893635
  hyper

SEQ ID NO: 54152 - DNA, 200 bp, Homo sapiens; identical to SEQ ID NO: 20845
  chr10:124893765-124893965
  hyper

SEQ ID NO: 54153 - DNA, 128 bp, Homo sapiens; identical to SEQ ID NO: 20846
  chr10:124894479-124894607
  hyper

SEQ ID NO: 54154 - DNA, 19 bp, Homo sapiens
  chr10:124894870-124894889
  hyper
gggctcgcggccgttagtg

SEQ ID NO: 54155 - DNA, 504 bp, Homo sapiens
  chr10:124894922-124895426
  hyper
cctcgctcgcctcctgcgctcgcaggagcgctccgagtgcctctttagcgggagccaatatccttttgtgctaataggcttgtcctcatttgctgcctaattggactatataaagccaataacgggcgggctcttatagcccgaagccaaagcgccaaaatccgagggaaggcgaggagggggcggtggcggaggcggctgcggggccggggctcggctgagccttcgcctgcctaatcccatttgccattgtacgcgcccaatcgccgtatactccccgcatttaacttggatgacattttgatttcatcattagcatccggcgccggattgacgcagcctcgagccggggactgctcttgctgcctcctccgcgggagccgcagccgcagccgagccgcctcgatccctcggtgccgcggcagggccgctccccgcccctccgcacccctccctcatgcgagcccgcccgtctgggtcctcactccgccctcccgccgttgg

SEQ ID NO: 54156 - DNA, 77 bp, Homo sapiens
  chr10:124896456-124896533
  hyper
ctcatggcctgggacctggaggccggcgcgggttgagcctgccgtccccaggcgccgggcctcgctcaaggctgtgt

SEQ ID NO: 54157 - DNA, 283 bp, Homo sapiens
  chr10:124896937-124897220
  hyper
ggagcgagccggcctggccgcgtccctgcacctcaccgagacgcaggtcaagatctggttccagaaccgccgcaacaagtggaagcggcagctggcggcggagctggaggcggccaacctgagccatgccgcggcgcagcgcatcgtgcgggtgcccatcctctaccacgagaactcggcggccgagggcgcggcggctgcagccgcgggggccccggtgccagtcagccagccgctgctcaccttcccgcaccccgtctactactcgcacccggtggtctct

SEQ ID NO: 54158 - DNA, 33 bp, Homo sapiens; identical to SEQ ID NO: 20849
  chr10:124899116-124899149
  hyper

SEQ ID NO: 54159 - DNA, 83 bp, Homo sapiens
  chr10:124899671-124899754
  hyper
ttctctttcccctggcgcccaacacctcctgggcggcatctctagatccccgaccctgtcctggcagacgccgagaagcgtag

SEQ ID NO: 54160 - DNA, 132 bp, Homo sapiens
  chr10:124899786-124899918
  hyper
ggccgccgcgctcttagtgagcagcctgcggaggcacagcgcgccggaaccgcctggaagggtgggtccgcccgacagaagcaggtgcctgggcgacactcgctggccgggtgtggccgcctgcctttaagc

SEQ ID NO: 54161 - DNA, 30 bp, Homo sapiens; identical to SEQ ID NO: 33461
  chr10:124901599-124901629
  hyper

SEQ ID NO: 54162 - DNA, 90 bp, Homo sapiens
  chr10:124903238-124903328
  hyper
atccctttgggtttaggcctgggagaggtatagagccagcgagagagcgcgttgcgcctatcactgaggcaggagcggtgaggtggagtc

SEQ ID NO: 54163 - DNA, 30 bp, Homo sapiens; identical to SEQ ID NO: 33465
  chr10:124904318-124904348
  hyper

SEQ ID NO: 54164 - DNA, 326 bp, Homo sapiens
  chr10:124904595-124904921
  hyper
tatgctagaaaggggcggcaaggaaggttgtttcttgtccctcccgtccttgcggtgtgacggctataggtgctggaggggcgggaggtccctcgggctatcaatcgaggggagctcaggggaactgcagtcagtcaggctgcagagctgggtctccaccacagccttccttgccccagccccgtgcccaccaccatctcttccctggtaaagtgcacgcactagtaggagctcagtgaacgtttgctgaatgaatgtgtgagtgtgcgcaggcgtttatgcaagtgccttcatgcgaattaatgcgtcctttgccgggtgtggca

SEQ ID NO: 54165 - DNA, 58 bp, Homo sapiens
  chr10:124905119-124905177
  hyper
tcactgtttcagggcctgggagttgcttttccgaggcccacttcgaggtcccctgatc

SEQ ID NO: 54166 - DNA, 30 bp, Homo sapiens; identical to SEQ ID NO: 33467
  chr10:124905596-124905626
  hyper

SEQ ID NO: 54167 - DNA, 15 bp, Homo sapiens
  chr10:124905865-124905880
  hyper
atttgtaatgtgtct

SEQ ID NO: 54168 - DNA, 115 bp, Homo sapiens; identical to SEQ ID NO: 33470
  chr10:124906829-124906944
  hyper

SEQ ID NO: 54169 - DNA, 44 bp, Homo sapiens
  chr10:124907268-124907312
  hyper
caagcccctgggaggcgcggagacccgtcgcctgcggaggcgtc

SEQ ID NO: 54170 - DNA, 557 bp, Homo sapiens
  chr10:124907534-124908091
  hyper
ttttccggggccgctcggcggcgctgcgattggccgcgttcgggtaacctctatgcaaatgaggccgcgccgcctccgcgccgccggagacccggcgagttggcgggcgaggaaggggcatttgcaccggggctgggcgggcgcacccagagccaggcgggcaggaacccctgcgcagccatccggtgcctgcatgtccctggcgcggaagggacgcctcaccagcctcggcgccccctccccctagatttcctccccgcccctccccactgcctgcctgctgcaccaccttccacccagatcacccagatcgtctctaaagggagttcttggtttccttcgatttcttatgaacccaggatgggcagcaaagaagatgcgggcaaggggtgtccggcggccggtggcgtctccagcttcaccatccagtccatcctgggcgggggcccctcggaggcaccgcgggagcccgtcggctggccagccaggaagcgcagcctgtccgtgtcctcggaggaggaggagccggacgacggctggaaggcgcccgcctgctt

SEQ ID NO: 54171 - DNA, 174 bp, Homo sapiens; identical to SEQ ID NO: 20855
  chr10:124908121-124908295
  hyper

SEQ ID NO: 54172 - DNA, 182 bp, Homo sapiens
  chr10:124908904-124909086
  hyper
gtcgcttttaaaggacggggtgctgggtttggggggccagtgagagggataagaggaggggattggtaaggtgggaccaaggctgcaggcgcttgccaaccgcttggtcccagggagagctggcggtctccgaggctccccaaccaactccatggcctttctgtctgttctcgctcctcagg

SEQ ID NO: 54173 - DNA, 175 bp, Homo sapiens
  chr10:124911048-124911223
  hyper
aattgcagattctcgctcccaatagattgcagccacctgttcttggcaaaacctcggaaaaggaagcctgagcttggaggaagccggtggttcagcaccacctggggcgagctcctccggcctctggctgggcagagcggatgcaaaggagcctggagtccgcagcgctgaggcc

SEQ ID NO: 54174 - DNA, 65 bp, Homo sapiens
  chr10:125425547-125425612
  hyper
agcgggaggaagcagaggcagaggcggagcaggggcgcaggtgcctgcaacccaggatcccgggg

SEQ ID NO: 54175 - DNA, 259 bp, Homo sapiens; identical to SEQ ID NO: 33477
  chr10:125425689-125425948
  hyper

SEQ ID NO: 54176 - DNA, 117 bp, Homo sapiens
  chr10:125650749-125650866
  hyper
caacagggagattcccgggactggcccatcccagacacacacaatgggagaagccagttgtcccctggaggcgcgcaaccaccggcgccccctcgggctgcccagcgcagaaagttc

SEQ ID NO: 54177 - DNA, 88 bp, Homo sapiens; identical to SEQ ID NO: 3676
  chr10:125651372-125651460
  hyper

SEQ ID NO: 54178 - DNA, 30 bp, Homo sapiens; identical to SEQ ID NO: 33480
  chr10:125732174-125732204
  hyper

SEQ ID NO: 54179 - DNA, 163 bp, Homo sapiens
  chr10:125851165-125851328
  hyper
gccacacttcattcccgagaactcggtacaattaacttaaccaacgtgaacaaggcgaaggcgcccagctgtcacagcggctccgcgcacgcaggcagacgaagaagggcccccgcccccaggagctggtcccagcctccagcctggcagcctccttcgaaga

SEQ ID NO: 54180 - DNA, 104 bp, Homo sapiens
  chr10:125852195-125852299
  hyper
ccggggagagagtggcggatgcccacttacctgccccgggccgcgcctggaaacttccccaaagtgcgataggggtgtgggggcggagcgcaaggctgggggga

SEQ ID NO: 54181 - DNA, 213 bp, Homo sapiens
  chr10:125852540-125852753
  hyper
cggccgcgtcctctctgcgagggagggggcgtgtgtcgccgctgggtaacccttcccgcggggtcctcaagcgcgcagggcgcccggagcgcggccaggaccaatggcgaagggactcctcccgctggggatcgctgaagcctcggggaggccgggccaaggagcccggggcccaaacctgcctcggctcgtcgagctcgcaagttcattgtc

SEQ ID NO: 54182 - DNA, 140 bp, Homo sapiens; identical to SEQ ID NO: 33484
  chr10:125853707-125853847
  hyper

SEQ ID NO: 54183 - DNA, 15 bp, Homo sapiens
  chr10:126135816-126135831
  hyper
ggacactttgaagga

SEQ ID NO: 54184 - DNA, 50 bp, Homo sapiens; identical to SEQ ID NO: 20859
  chr10:126135877-126135927
  hyper

SEQ ID NO: 54185 - DNA, 441 bp, Homo sapiens
  chr10:126136065-126136506
  hyper
gggcggcagccgtcagcgggaaggaggcggcggacgggaagaggacattggccgcggagtaggaggggaaagtctggaagtgcagagcgccggtgccgggagggccaggactgccccccgagccgccgccgccgccgccccccgccgcccctggctggggcgcgccaccccccacctgcgccgcgccgtcggcacccgggttctgcttcttccacttggtcctgcgattctggaaccagattttgacctgcgtctcggtgaggctgagagacagcgcgaggttcaggcgctcgcacactgacaggtagcgcgtggcccggaacttgttctccaaggccaccagctgctcgtaggtgaaggcggtgcgcgcgcgccgcggcttggcgcagttgggctccaggcgccggcgcctgggacgcggggagccgggggatcccgggg

SEQ ID NO: 54186 - DNA, 1466 bp, Homo sapiens; identical to SEQ ID NO: 33488
  chr10:126137640-126139106
  hyper

SEQ ID NO: 54187 - DNA, 338 bp, Homo sapiens; identical to SEQ ID NO: 33489
  chr10:128075686-128076024
  hyper

SEQ ID NO: 54188 - DNA, 214 bp, Homo sapiens
  chr10:128076347-128076561
  hyper
ccaagagggtgaggacgggggagcggtcccgaggctgtgccctccggggcaggtactggctcctgtggggctgcgggccaagtgtcgcccttccccaaggaattggcacctggggggggggggtcggtctcgccgcgctggaagcgcaagccccggggctccggagatgcgccggggcgcgtcgcccctcggggcagccctggacctcggcgcg

SEQ ID NO: 54189 - DNA, 301 bp, Homo sapiens; identical to SEQ ID NO: 33491
  chr10:128076940-128077241
  hyper

SEQ ID NO: 54190 - DNA, 32 bp, Homo sapiens; identical to SEQ ID NO: 33492
  chr10:128993490-128993522
  hyper

SEQ ID NO: 54191 - DNA, 147 bp, Homo sapiens; identical to SEQ ID NO: 33493
  chr10:128993580-128993727
  hyper

SEQ ID NO: 54192 - DNA, 31 bp, Homo sapiens
  chr10:129535733-129535764
  hyper
cgagctacggggctcccggcccgctcctcgg

SEQ ID NO: 54193 - DNA, 40 bp, Homo sapiens
  chr10:129536040-129536080
  hyper
cgacccaggtaacagcggcgcgccggctcgctccgtccag

SEQ ID NO: 54194 - DNA, 126 bp, Homo sapiens
  chr10:129947985-129948111
  hyper
ggatcaggtcaccttcgcaggcccagactccaccgtcagctgccgccgacggagcccacagaggaggctcgggcgcccgcgccccctgcgcagcggcccctccgcagcggccccagcccgcgtccc

SEQ ID NO: 54195 - DNA, 42 bp, Homo sapiens
  chr10:129948140-129948182
  hyper
gaagcgcccacagcccgcgttcccgcccgcaccccagcccgc

SEQ ID NO: 54196 - DNA, 30 bp, Homo sapiens; identical to SEQ ID NO: 33501
  chr10:129948725-129948755
  hyper

SEQ ID NO: 54197 - DNA, 379 bp, Homo sapiens; identical to SEQ ID NO: 33502
  chr10:130008498-130008877
  hyper

SEQ ID NO: 54198 - DNA, 283 bp, Homo sapiens; identical to SEQ ID NO: 33503
  chr10:130008906-130009189
  hyper

SEQ ID NO: 54199 - DNA, 150 bp, Homo sapiens; identical to SEQ ID NO: 33504
  chr10:130085049-130085199
  hyper

SEQ ID NO: 54200 - DNA, 76 bp, Homo sapiens; identical to SEQ ID NO: 947
  chr10:130085200-130085276
  hyper

SEQ ID NO: 54201 - DNA, 76 bp, Homo sapiens
  chr10:130085362-130085438
  hyper
gtccccgggccgcggcgcgctccccgccacgccgcacatcaaggcccggccggccggcgggcgccttcattagcag

SEQ ID NO: 54202 - DNA, 30 bp, Homo sapiens; identical to SEQ ID NO: 33508
  chr10:130339387-130339417
  hyper

SEQ ID NO: 54203 - DNA, 56 bp, Homo sapiens; identical to SEQ ID NO: 33509
  chr10:130339734-130339790
  hyper

SEQ ID NO: 54204 - DNA, 30 bp, Homo sapiens; identical to SEQ ID NO: 33510
  chr10:130830055-130830085
  hyper

SEQ ID NO: 54205 - DNA, 38 bp, Homo sapiens; identical to SEQ ID NO: 33511
  chr10:131265287-131265325
  hyper

SEQ ID NO: 54206 - DNA, 8 bp, Homo sapiens
  chr10:131757043-131757051
  hyper
ccgcggcc

SEQ ID NO: 54207 - DNA, 136 bp, Homo sapiens; identical to SEQ ID NO: 33513
  chr10:131757717-131757853
  hyper

SEQ ID NO: 54208 - DNA, 46 bp, Homo sapiens; identical to SEQ ID NO: 33514
  chr10:131758276-131758322
  hyper

SEQ ID NO: 54209 - DNA, 244 bp, Homo sapiens
  chr10:131761134-131761378
  hyper
atgtcctttcaccagcgcagaaaaggagagccagccgctgcaggggcggcgagcacgcagcaggcacttaccgttgctgtacaataactggagtttatagtggatgccgttgttggttttctcgttgtttggctcctgaaagtaacgataaataattgcatttagtgcgatcggtgtcaggcgcggccaccacgctcggtccccctccgcgaccgaggctctcggcctcacacatggcaggatt

SEQ ID NO: 54210 - DNA, 246 bp, Homo sapiens
  chr10:131761441-131761687
  hyper
gagtaagtccgagggcgcagagaagttgcccagccctcggcggtcccgggcggccgcacgtggcggcggcggggtggcctggcggagccgagcccgccgcctaggggggcactcgaacccccgcgcaccggcaccgcctgcctcccgcttctagaaagagagagggtgtgatcgtgtgtttgcacttactttctctttctccacaaagtccacaaaagcggtcctttcaatctccaccggctgccc

SEQ ID NO: 54211 - DNA, 362 bp, Homo sapiens
  chr10:131761725-131762087
  hyper
tggatttccggaggttggaaggcggctgcttctcgaagtgcgcccgcgccagccccacgccgctgcgggaggaaagagacagcggcccggtgaggagcgcggcgccggccggcggagggggccgggccgggccggggccggggccagggcgcgcgggggcggccggtacgtacctctgggcggccgtgttggcgtccaccacgcccgccgtgtgcatccacgagcgcaccgggttcatgccgctgcccagcggctcctccttcatggtcgtccccccgcgcggaatattctcctgaatcccaaacatgaaaactgctggcggcggccgcagctcccggccgaaagcgtttcctcgagcagcg

SEQ ID NO: 54212 - DNA, 468 bp, Homo sapiens
  chr10:131762124-131762592
  hyper
ccctcgccctgctcggcgcctgcggtccggccccgccgccggcttcagcccgtcccgggcaggcgcgacatacaccagcggccgggcgctccggacggccaggggcgcggaggcggctccaccggcggcggcggcgcttcgaaggagcaggacgcggtggccgcggcggcgcttgttgttgttgttgtttgcaggcgcgctcaacgtggtgtcatcctagccaggcggcgtccgcggctgcaggacactgcgggatcgcccgcttctggcgcggcccgcctgctccaaagacaaataaacggggcagtgagtgctgcggcgcagtcccgggcgcaggcggggcgcggcggggcctggagcggcgcgcgcagcggacggaggcgcacaaaactcagccctctctccccgaggaatggaccctttcccgggagccaaaactcgaagcccccgggagcggcgctgtcagag

SEQ ID NO: 54213 - DNA, 273 bp, Homo sapiens
  chr10:131762631-131762904
  hyper
cggccgcccctcgccgcgcccctcgccgccgccgccgccgcgctcgccgactgactgcctgacggcgccgcgagccggcccgagccccgcgagccccgcgagccccgccgccgccgagcgccaccgagcgccgccgccgccccccgccacgcaccgcggctcctcgcgtccagccgcggccaaggaagttactactcgcccaaataaatcttgaaaagaaacaaacgcagccactgcacaattgcagtttggccccttaatacctccctgcaa

SEQ ID NO: 54214 - DNA, 397 bp, Homo sapiens; identical to SEQ ID NO: 20878
  chr10:131762940-131763337
  hyper

SEQ ID NO: 54215 - DNA, 207 bp, Homo sapiens
  chr10:131763717-131763924
  hyper
ctaggcacttccctgccaagagaaatcaggcccttttgattaaaagaaaaaaaaaaaaaagattgcagggcgcaagtgtgttgcagggcagcctcctcccgccgggtctggggcagcactcccttttcccgtgaattggcagcgtgtgtacgttaatattttaattaatcgggaaagtcgaagtccgattcacgttgtctggggacc

SEQ ID NO: 54216 - DNA, 39 bp, Homo sapiens
  chr10:131768685-131768724
  hyper
cttctggaagctaaccgcgcacaaaagtttgccaataaa

SEQ ID NO: 54217 - DNA, 105 bp, Homo sapiens
  chr10:131769428-131769533
  hyper
tgctgggcggcaaggcggcccagggcatagctaggggccatgtagaaataaaaacagataaagaaaagaagaaagaaagaaaccggcttctcttctagactatta

SEQ ID NO: 54218 - DNA, 39 bp, Homo sapiens; identical to SEQ ID NO: 20880
  chr10:131770237-131770276
  hyper

SEQ ID NO: 54219 - DNA, 54 bp, Homo sapiens; identical to SEQ ID NO: 20881
  chr10:131770603-131770657
  hyper

SEQ ID NO: 54220 - DNA, 301 bp, Homo sapiens; identical to SEQ ID NO: 20882
  chr10:131770687-131770988
  hyper

SEQ ID NO: 54221 - DNA, 21 bp, Homo sapiens
  chr10:131771281-131771302
  hyper
gggagagcccacgggcccggc

SEQ ID NO: 54222 - DNA, 68 bp, Homo sapiens
  chr10:133109124-133109192
  hyper
agctgaaacagctatcgatttccagcttgctttcaagtctggcagagactgtgaaagtcctaacttct

SEQ ID NO: 54223 - DNA, 121 bp, Homo sapiens; identical to SEQ ID NO: 3684
  chr10:133110064-133110185
  hyper

SEQ ID NO: 54224 - DNA, 171 bp, Homo sapiens
  chr10:133110704-133110875
  hyper
ggggcaggaccacccctctgtgaattcgtcctggatgcccccaggcacagtctgtactcctccctcccccagcacacgcggcctctgacgctgcacgccgagcttcctgggacccaggacgaaccgggctccaaggaccctcgctccgcccggaccacacgcaggcagcgc

SEQ ID NO: 54225 - DNA, 156 bp, Homo sapiens
  chr10:133794727-133794883
  hyper
gccatattttaaaaacgctgtaaccccctcccatctccgcgttcacccttgaggaaatcctaacagtcaccatggatataaacattaataacaaaattaaagctcataacaggccacttgccacgccttggtgtttggtcattaaaaccaatactg

SEQ ID NO: 54226 - DNA, 252 bp, Homo sapiens; identical to SEQ ID NO: 20886
  chr10:133795430-133795682
  hyper

SEQ ID NO: 54227 - DNA, 127 bp, Homo sapiens; identical to SEQ ID NO: 20887
  chr10:133850008-133850135
  hyper

SEQ ID NO: 54228 - DNA, 373 bp, Homo sapiens
  chr10:133850156-133850529
  hyper
cggtgacgcgcgcccccgcccgccgcctctgccatggccgatccggtccgtcggacgccgcccagagtcgctcgcggggagcctcggtgagcagcggccggggtggggccgcgaccgggggccgggcctctgcgctgcgtctggcacggtgcgtccgggacgcgggcgccctggcggccgtggggcgggcggggggcgacgtcccgagggagggggtcccgcggcagagacgcccctgtctggggcggggtcctccttgcctctcccggcggtccccccgtgggcgggtcctctccacggcaccccctgccctgcacaggcctcggcgctggcgtgacgcggccgctgggtggggcccgcgcaggtgctgggc

SEQ ID NO: 54229 - DNA, 65 bp, Homo sapiens
  chr10:133850774-133850839
  hyper
ttgcctctcgtggaaagccgctgggagttggagcggctccctcctgcccccgtctgaggtctggc

SEQ ID NO: 54230 - DNA, 161 bp, Homo sapiens
  chr10:133999847-134000008
  hyper
tctctctgtcctattcgggcccctcctgccctccgtctctcgcggccagcgtggaacagcctcgcggggtcacagcctggcgctcggaccctggcccgggtcatctgcgaaggagccggctttggccaaggtgccttcctggacgggtgtggttcccagag

SEQ ID NO: 54231 - DNA, 57 bp, Homo sapiens; identical to SEQ ID NO: 33532
  chr10:134000125-134000182
  hyper

SEQ ID NO: 54232 - DNA, 211 bp, Homo sapiens; identical to SEQ ID NO: 33533
  chr10:134000529-134000740
  hyper

SEQ ID NO: 54233 - DNA, 99 bp, Homo sapiens; identical to SEQ ID NO: 33534
  chr10:134000798-134000897
  hyper

SEQ ID NO: 54234 - DNA, 165 bp, Homo sapiens
  chr10:134001260-134001425
  hyper
cccctgaaccttcgagagcagagacccctccccaacacccacacgcaccggcgcgggaggtcccgctctgccagaaacaaagcctccccgctcgggcggggggagatgggggtgggaggaaggaggcttcgggacccggcaggacctgggcgggggagtccatgg

SEQ ID NO: 54235 - DNA, 254 bp, Homo sapiens; identical to SEQ ID NO: 33536
  chr10:134120760-134121014
  hyper

SEQ ID NO: 54236 - DNA, 42 bp, Homo sapiens; identical to SEQ ID NO: 33537
  chr10:134122233-134122275
  hyper

SEQ ID NO: 54237 - DNA, 64 bp, Homo sapiens
  chr10:134599482-134599546
  hyper
tccgggccccgccgccgccgcccctgcccgccggcccgggaagtttgcgcgcggcccgggcggg

SEQ ID NO: 54238 - DNA, 83 bp, Homo sapiens; identical to SEQ ID NO: 33541
  chr10:134599708-134599791
  hyper

SEQ ID NO: 54239 - DNA, 30 bp, Homo sapiens; identical to SEQ ID NO: 33544
  chr10:134601246-134601276
  hyper

SEQ ID NO: 54240 - DNA, 63 bp, Homo sapiens; identical to SEQ ID NO: 33546
  chr10:134602327-134602390
  hyper

SEQ ID NO: 54241 - DNA, 85 bp, Homo sapiens; identical to SEQ ID NO: 33547
  chr10:134676528-134676613
  hyper

SEQ ID NO: 54242 - DNA, 10 bp, Homo sapiens
  chr10:134901183-134901193
  hyper
ggaataacac

SEQ ID NO: 54243 - DNA, 194 bp, Homo sapiens
  chr10:134901511-134901705
  hyper
tgttgataactcggtcccagctcggccgctgccctcgcgaatggagagcgggtccccggcggggggagcgcagcgcgtctgtctccgggagcgcggcccggccgccccggcagccgcttcggccacagcaggtgggaaggacgcgcgggtctgggcggcgggagggacgcgcggggccgcggctcggcagaaaa

SEQ ID NO: 54244 - DNA, 66 bp, Homo sapiens
  chr10:134901942-134902008
  hyper
ggttgagtttggctccggagccgggagtggggcgcagattgatttttaaatatggagaaggagacg

SEQ ID NO: 54245 - DNA, 61 bp, Homo sapiens; identical to SEQ ID NO: 33553
  chr10:134973919-134973980
  hyper

SEQ ID NO: 54246 - DNA, 48 bp, Homo sapiens; identical to SEQ ID NO: 33554
  chr10:134974224-134974272
  hyper

SEQ ID NO: 54247 - DNA, 96 bp, Homo sapiens; identical to SEQ ID NO: 33555
  chr10:134974307-134974403
  hyper

SEQ ID NO: 54248 - DNA, 88 bp, Homo sapiens; identical to SEQ ID NO: 20901
  chr10:135043538-135043626
  hyper

SEQ ID NO: 54249 - DNA, 142 bp, Homo sapiens; identical to SEQ ID NO: 20902
  chr10:135043826-135043968
  hyper

SEQ ID NO: 54250 - DNA, 263 bp, Homo sapiens
  chr10:135044128-135044391
  hyper
cagtgccgccgccgctacaagttccttaaagacaagtttcgcgaggcgcacggccagccgcccgggcccttcgacgagcagatccggaagctcatggggctgctgggcgacaacgggcgcaaacggcctcgccgccgctccccggggtccgggcgcccccagcgcgcccgccgcccggtccccaacgcgcacgcgccggctcccagcgaaccaggtaggcgggggactggggggccaggtggggccgaggactgcggaggaac

SEQ ID NO: 54251 - DNA, 173 bp, Homo sapiens
  chr10:135044573-135044746
  hyper
cggctccccgccagctcccgccccgaccgccctcgccacctgcatccccgaggaccgcgcgcccgtccgcggccccgggtccccgccgccacccccggcccgcgaagaccccgactcgccgcccggccgccccgaggactgcgcgccccctccggccgcgcccccgtcgctga

SEQ ID NO: 54252 - DNA, 349 bp, Homo sapiens
  chr10:135048939-135049288
  hyper
gggagtgacgcgggacttcctgcccagcgcaacccggcctggcccccgagggtgggggacagggcgacgcccgcggggaccacgctctggggcgtgcggggcgcaattcacggggctgggctgccccaggggctgggaggaaggaggcaggggggcgcccaagtctcctacccatggcagcgcatcagggcgcgtcccagagccgggggtggacggaggcttggaggcggaggctttggggacccccaagcctgggctagagcagcctcggcgggctctagagggagggtggagggaggggcccgggctgcaggaggcggggaggcctgagccacggtggtggggccgc

SEQ ID NO: 54253 - DNA, 584 bp, Homo sapiens
  chr10:135049727-135050311
  hyper
aggcatctgggccctcgctgcccctggccgggacacactgccggtcctgtgcagtggctcaaagcccctctaccgggggtgacccggtctctccggagatgaagtgcagcgggggtctaggccggcttcctggccccccacccctcctggctttacccccgaggccacgtccaaagcccccagcgccccacccccgccagcctcccccttgagggcccagtgacctaactgggccggcagggtccgaggaagaccagggtcagcggcggcacggtccgttccgcgacccctctcctgtgaccccaggtaggccgccgatcggttcccggctgaggtcccgccccagcgcccgcctcccgggctccaacctctttgctcagcccgggaggctcggctggctggggcgggcgtaaccgtggggcgaggcccgccggtctttctgatttccgcgggcggcgtgggcgctgaggcagccgcggtcaggacctggccgggagtcggggctgctccgtggaccccgcgtctgcgccgaaaccccgcatggcttcgggggccggacctgcgcctccgcctaactccggccg

SEQ ID NO: 54254 - DNA, 188 bp, Homo sapiens
  chr10:135050679-135050867
  hyper
gggatggagtcagggagccgcccgcgcccgaatgcagaggctcctgcgatggccccggagtgagtcccccagaggagccggattagggctggaggcggccgagtcccccgagaggcccctcccgacattcccgcccccgcgcgccgctccccgggtcctccgcgtctctttcccgggaaagcctccct

SEQ ID NO: 54255 - DNA, 635 bp, Homo sapiens
  chr10:135138920-135139555
  hyper
gaagcctccggtggacgtgaaatctttacttagagaaaagcgacagagtcagagacccacgggggcggggctgcagcgagggcgcctggggacacgaacacggcggagagcatcgggagacgcgctggtcacaggagctggcggaggacgctgcggagacagagcccgagggttgagagcggcgacgcggccaggggctccccgcggaccccgcgtcacccggcgggctcggattcgcaacccccaaccccgaggttctggcgggccgggtcggagggaagaggaagggaagggtggcgggggtctttggctcagaagcggtggcgggaggccaggaagagacctgggcagagccggccggagccccgcggcgcgcacctaccccgggccgggctgcggggctggagacgtcactgcgcgggcgggggcgccgcgctcccggccgccttccgcgccgcctccttctccgccttggccgacggcttcccggggggttcggtggccgccgccgccgccccagcctgggtgggccccttgcgctcctccttggctgcgcggtagccgtccccccaggccgccggcgtctccgtgccgtgcttgcggctcagcgggtaggccccgatggccgccaggat

SEQ ID NO: 54256 - DNA, 243 bp, Homo sapiens; identical to SEQ ID NO: 33563
  chr10:135148859-135149102
  hyper

SEQ ID NO: 54257 - DNA, 176 bp, Homo sapiens; identical to SEQ ID NO: 33564
  chr10:135150325-135150501
  hyper

SEQ ID NO: 54258 - DNA, 100 bp, Homo sapiens; identical to SEQ ID NO: 33565
  chr10:135170736-135170836
  hyper

SEQ ID NO: 54259 - DNA, 345 bp, Homo sapiens; identical to SEQ ID NO: 33566
  chr10:135236927-135237272
  hyper

SEQ ID NO: 54260 - DNA, 32 bp, Homo sapiens; identical to SEQ ID NO: 33567
  chr11:279473-279505
  hyper

SEQ ID NO: 54261 - DNA, 90 bp, Homo sapiens; identical to SEQ ID NO: 33568
  chr11:280129-280219
  hyper

SEQ ID NO: 54262 - DNA, 56 bp, Homo sapiens; identical to SEQ ID NO: 33569
  chr11:308110-308166
  hyper

SEQ ID NO: 54263 - DNA, 32 bp, Homo sapiens; identical to SEQ ID NO: 33570
  chr11:308230-308262
  hyper

SEQ ID NO: 54264 - DNA, 31 bp, Homo sapiens; identical to SEQ ID NO: 33571
  chr11:308322-308353
  hyper

SEQ ID NO: 54265 - DNA, 44 bp, Homo sapiens; identical to SEQ ID NO: 33572
  chr11:327148-327192
  hyper

SEQ ID NO: 54266 - DNA, 35 bp, Homo sapiens; identical to SEQ ID NO: 33573
  chr11:369448-369483
  hyper

SEQ ID NO: 54267 - DNA, 43 bp, Homo sapiens; identical to SEQ ID NO: 33574
  chr11:370169-370212
  hyper

SEQ ID NO: 54268 - DNA, 154 bp, Homo sapiens
  chr11:406722-406876
  hyper
ggcccattcacaaagcgtggtgccgcagagctccccacggaggggtcccagcctggagcccgggcaccgcccatctctaacccgccgctagccccggaccctcccgcgcctgctccgcaccacggagccgggcctccagagcagcaaggtcacc

SEQ ID NO: 54269 - DNA, 103 bp, Homo sapiens; identical to SEQ ID NO: 20910
  chr11:406939-407042
  hyper

SEQ ID NO: 54270 - DNA, 26 bp, Homo sapiens
  chr11:407401-407427
  hyper
gcacggggtggggcccgggataccag

SEQ ID NO: 54271 - DNA, 66 bp, Homo sapiens; identical to SEQ ID NO: 33577
  chr11:507716-507782
  hyper

SEQ ID NO: 54272 - DNA, 6 bp, Homo sapiens
  chr11:536871-536877
  hyper
cggtcc

SEQ ID NO: 54273 - DNA, 70 bp, Homo sapiens; identical to SEQ ID NO: 33579
  chr11:537026-537096
  hyper

SEQ ID NO: 54274 - DNA, 45 bp, Homo sapiens
  chr11:637441-637486
  hyper
cgcggtgctcgcggggaactcgctcgtgtgcgtgagcgtggccac

SEQ ID NO: 54275 - DNA, 110 bp, Homo sapiens
  chr11:726307-726417
  hyper
catgcagcacatggacgaggtcaacgacgagctcatccggaaaatcagcaacatcagggcgcagccacagaggcacttccgcgtggagcgcagccagcccgtgagccagc

SEQ ID NO: 54276 - DNA, 44 bp, Homo sapiens
  chr11:726466-726510
  hyper
caaggccttcagcccgcggtgagcgggggcgggggatgagctgg

SEQ ID NO: 54277 - DNA, 250 bp, Homo sapiens; identical to SEQ ID NO: 33583
  chr11:1410104-1410354
  hyper

SEQ ID NO: 54278 - DNA, 34 bp, Homo sapiens; identical to SEQ ID NO: 10675
  chr11:1411655-1411689
  hyper

SEQ ID NO: 54279 - DNA, 452 bp, Homo sapiens; identical to SEQ ID NO: 33585
  chr11:1411907-1412359
  hyper

SEQ ID NO: 54280 - DNA, 426 bp, Homo sapiens; identical to SEQ ID NO: 33586
  chr11:1770262-1770688
  hyper

SEQ ID NO: 54281 - DNA, 52 bp, Homo sapiens; identical to SEQ ID NO: 33587
  chr11:2291148-2291200
  hyper

SEQ ID NO: 54282 - DNA, 129 bp, Homo sapiens
  chr11:2292636-2292765
  hyper
ggggtgggaggttcaggttcccggggcgccttccccaacccgccccgctttccccgtccctccacgcgcaccctgcctgtggtttccgtgcgcccccggcctgagggctctgggcggcaccttaacccg

SEQ ID NO: 54283 - DNA, 107 bp, Homo sapiens; identical to SEQ ID NO: 33592
  chr11:2398287-2398394
  hyper

SEQ ID NO: 54284 - DNA, 29 bp, Homo sapiens
  chr11:2465491-2465520
  hyper
gctcacagtgatcgcggggccagcacacc

SEQ ID NO: 54285 - DNA, 43 bp, Homo sapiens
  chr11:2466788-2466831
  hyper
gccacctgccccgtcggagctgcgaccccggagcagaggaggg

SEQ ID NO: 54286 - DNA, 30 bp, Homo sapiens; identical to SEQ ID NO: 33596
  chr11:2554518-2554548
  hyper

SEQ ID NO: 54287 - DNA, 394 bp, Homo sapiens; identical to SEQ ID NO: 33597
  chr11:2883606-2884000
  hyper

SEQ ID NO: 54288 - DNA, 49 bp, Homo sapiens; identical to SEQ ID NO: 33598
  chr11:2905392-2905441
  hyper

SEQ ID NO: 54289 - DNA, 145 bp, Homo sapiens; identical to SEQ ID NO: 33599
  chr11:2905874-2906019
  hyper

SEQ ID NO: 54290 - DNA, 258 bp, Homo sapiens; identical to SEQ ID NO: 33600
  chr11:2906322-2906580
  hyper

SEQ ID NO: 54291 - DNA, 49 bp, Homo sapiens; identical to SEQ ID NO: 33601
  chr11:3224699-3224748
  hyper

SEQ ID NO: 54292 - DNA, 258 bp, Homo sapiens; identical to SEQ ID NO: 33602
  chr11:6280415-6280673
  hyper

SEQ ID NO: 54293 - DNA, 61 bp, Homo sapiens; identical to SEQ ID NO: 33603
  chr11:6281259-6281320
  hyper

SEQ ID NO: 54294 - DNA, 15 bp, Homo sapiens
  chr11:6676538-6676553
  hyper
cgcaccccacacccc

SEQ ID NO: 54295 - DNA, 203 bp, Homo sapiens; identical to SEQ ID NO: 33605
  chr11:6676627-6676830
  hyper

SEQ ID NO: 54296 - DNA, 109 bp, Homo sapiens; identical to SEQ ID NO: 33606
  chr11:6677219-6677328
  hyper

SEQ ID NO: 54297 - DNA, 673 bp, Homo sapiens; identical to SEQ ID NO: 33607
  chr11:6947606-6948279
  hyper

SEQ ID NO: 54298 - DNA, 66 bp, Homo sapiens; identical to SEQ ID NO: 33608
  chr11:7273082-7273148
  hyper

SEQ ID NO: 54299 - DNA, 111 bp, Homo sapiens; identical to SEQ ID NO: 33609
  chr11:7273149-7273260
  hyper

SEQ ID NO: 54300 - DNA, 220 bp, Homo sapiens; identical to SEQ ID NO: 33610
  chr11:7273679-7273899
  hyper

SEQ ID NO: 54301 - DNA, 140 bp, Homo sapiens
  chr11:7274075-7274215
  hyper
cgcgatccggcgttgggccggggacagggtgcttctggccttgggcagacgggcctgaacccgttcccggcgggtcgcacggcatggaggtggcctgggcctgggcgctaggctcgaccagcgactaccgccggccacga

SEQ ID NO: 54302 - DNA, 3 bp, Homo sapiens
  chr11:7274245-7274248
  hyper
gtg

SEQ ID NO: 54303 - DNA, 126 bp, Homo sapiens; identical to SEQ ID NO: 33612
  chr11:8040298-8040424
  hyper

SEQ ID NO: 54304 - DNA, 6 bp, Homo sapiens
  chr11:8040770-8040776
  hyper
cgggcc

SEQ ID NO: 54305 - DNA, 100 bp, Homo sapiens; identical to SEQ ID NO: 33614
  chr11:8040960-8041060
  hyper

SEQ ID NO: 54306 - DNA, 67 bp, Homo sapiens; identical to SEQ ID NO: 10692
  chr11:8041504-8041571
  hyper

SEQ ID NO: 54307 - DNA, 386 bp, Homo sapiens
  chr11:8102616-8103002
  hyper
gcatggagcgtggatcgcgacgatttcgggggagggggcaagggcgctccgcaggccctgagccggccggggggtggggtctctgcggggcggggcggggcggggcgagggagaaggggcaggccgccgctgccacgcagtactcccgccttggcgccagaggggcgcgggacggtgcggtcggcctccccgcctccacgcgcgcgcacgacccgcgcactcccggagcttcgcccatctcgcctcgccgcgccgcgcaggcagccgctcgcagagccagcagccggggccctggcgtgcagcgcgggcctcggcggggcccagcgccccggcccgggaggatgcggcccggggcggcccgggagctgagcagggcccccgcgccg

SEQ ID NO: 54308 - DNA, 41 bp, Homo sapiens; identical to SEQ ID NO: 20931
  chr11:8189946-8189987
  hyper

SEQ ID NO: 54309 - DNA, 56 bp, Homo sapiens; identical to SEQ ID NO: 33618
  chr11:8284256-8284312
  hyper

SEQ ID NO: 54310 - DNA, 13 bp, Homo sapiens
  chr11:8284313-8284326
  hyper
ctcatgcagatgt

SEQ ID NO: 54311 - DNA, 201 bp, Homo sapiens
  chr11:8284760-8284961
  hyper
cgcccgccccgcaatccccgcacagcccagcaggtgtgcgcccgtgtccccgcgtgtgtgtgcctgcgcgccgcggcagggggcgagggggtgaggggcgtcgagaccccggcccgccacctaccgtcctccttgtccagcaccatcatctcgggcgctccgtgtccagccgcagctaggctcggccgggagaagggcgcc

SEQ ID NO: 54312 - DNA, 27 bp, Homo sapiens
  chr11:8289745-8289772
  hyper
tcccgccgccgccgaagcccgggcgct

SEQ ID NO: 54313 - DNA, 138 bp, Homo sapiens; identical to SEQ ID NO: 20935
  chr11:8290057-8290195
  hyper

SEQ ID NO: 54314 - DNA, 130 bp, Homo sapiens; identical to SEQ ID NO: 33623
  chr11:8615288-8615418
  hyper

SEQ ID NO: 54315 - DNA, 125 bp, Homo sapiens; identical to SEQ ID NO: 33624
  chr11:8615762-8615887
  hyper

SEQ ID NO: 54316 - DNA, 890 bp, Homo sapiens; identical to SEQ ID NO: 20937
  chr11:9025080-9025970
  hyper

SEQ ID NO: 54317 - DNA, 579 bp, Homo sapiens
  chr11:9112741-9113320
  hyper
gccgaaggactcagggccccagcggtcgtggcgccttggcccggccggcgggtgaggtcccggggggagcagaggcccccgcggagctgcagccgccagccccgagccccgcgcgcccggctctggactccgccggggacctaaacactcttcctggccctgcctgctgtgccaggtgcgcccccgcggccggacactcaccctcctgcggccccgcggcacggccccgacccggcgggacggcccccgccagcagcagcagtggcggcagcagcagcagcagcagcagcaccgcccaggccgccccgggacggttgcggcccgcgacccccatggatggctcagcggttgcgggcagaggcggcggagtgcgggcggtggcggcggcggcgcggggaggtgtgcgcggacgccctgcccgctgccgctgccacccccggcccggccccgcccgccccccgagccccggcctcattttcacacggtccctcccgggccggggcgggaagcgcaggcgggagcagtgccgccccgcccggcctcctcccgtcccctccccggcctcgggtggagggggcg

SEQ ID NO: 54318 - DNA, 64 bp, Homo sapiens; identical to SEQ ID NO: 33628
  chr11:10472083-10472147
  hyper

SEQ ID NO: 54319 - DNA, 60 bp, Homo sapiens; identical to SEQ ID NO: 33629
  chr11:10472462-10472522
  hyper

SEQ ID NO: 54320 - DNA, 46 bp, Homo sapiens; identical to SEQ ID NO: 33630
  chr11:10472557-10472603
  hyper

SEQ ID NO: 54321 - DNA, 66 bp, Homo sapiens; identical to SEQ ID NO: 33631
  chr11:11642602-11642668
  hyper

SEQ ID NO: 54322 - DNA, 96 bp, Homo sapiens; identical to SEQ ID NO: 33632
  chr11:11643016-11643112
  hyper

SEQ ID NO: 54323 - DNA, 47 bp, Homo sapiens
  chr11:12029910-12029957
  hyper
acccacctcttccaccgcgctgcgcaatttgtgctgcgtgtcctcca

SEQ ID NO: 54324 - DNA, 288 bp, Homo sapiens; identical to SEQ ID NO: 33634
  chr11:12030273-12030561
  hyper

SEQ ID NO: 54325 - DNA, 56 bp, Homo sapiens
  chr11:12030852-12030908
  hyper
cagcgccggtacccgagggagcccgcaagacgcgccccgcccgcccaccaggctcc

SEQ ID NO: 54326 - DNA, 25 bp, Homo sapiens
  chr11:12132499-12132524
  hyper
ataaaagcctcccaccggcacgccg

SEQ ID NO: 54327 - DNA, 30 bp, Homo sapiens; identical to SEQ ID NO: 33637
  chr11:12398995-12399025
  hyper

SEQ ID NO: 54328 - DNA, 92 bp, Homo sapiens; identical to SEQ ID NO: 33638
  chr11:12399277-12399369
  hyper

SEQ ID NO: 54329 - DNA, 258 bp, Homo sapiens; identical to SEQ ID NO: 33640
  chr11:12695888-12696146
  hyper

SEQ ID NO: 54330 - DNA, 30 bp, Homo sapiens; identical to SEQ ID NO: 33642
  chr11:12715647-12715677
  hyper

SEQ ID NO: 54331 - DNA, 173 bp, Homo sapiens; identical to SEQ ID NO: 33643
  chr11:13030315-13030488
  hyper

SEQ ID NO: 54332 - DNA, 380 bp, Homo sapiens; identical to SEQ ID NO: 33644
  chr11:13031244-13031624
  hyper

SEQ ID NO: 54333 - DNA, 15 bp, Homo sapiens
  chr11:13032000-13032015
  hyper
agccagaagaggtgg

SEQ ID NO: 54334 - DNA, 219 bp, Homo sapiens; identical to SEQ ID NO: 33646
  chr11:13032093-13032312
  hyper

SEQ ID NO: 54335 - DNA, 83 bp, Homo sapiens; identical to SEQ ID NO: 33647
  chr11:13032656-13032739
  hyper

SEQ ID NO: 54336 - DNA, 216 bp, Homo sapiens; identical to SEQ ID NO: 33648
  chr11:13300474-13300690
  hyper

SEQ ID NO: 54337 - DNA, 30 bp, Homo sapiens; identical to SEQ ID NO: 33649
  chr11:14665073-14665103
  hyper

SEQ ID NO: 54338 - DNA, 36 bp, Homo sapiens
  chr11:15136049-15136085
  hyper
caagggaaacgatcgcggcacattcccttcccctct

SEQ ID NO: 54339 - DNA, 62 bp, Homo sapiens
  chr11:15136394-15136456
  hyper
gggcgggggagaacggggcggggggtggggcgggggccaggggcggcctctcgggctgggcc

SEQ ID NO: 54340 - DNA, 101 bp, Homo sapiens; identical to SEQ ID NO: 33651
  chr11:15136457-15136558
  hyper

SEQ ID NO: 54341 - DNA, 206 bp, Homo sapiens; identical to SEQ ID NO: 33652
  chr11:16625964-16626170
  hyper

SEQ ID NO: 54342 - DNA, 44 bp, Homo sapiens; identical to SEQ ID NO: 33653
  chr11:16628305-16628349
  hyper

SEQ ID NO: 54343 - DNA, 156 bp, Homo sapiens; identical to SEQ ID NO: 33655
  chr11:16629373-16629529
  hyper

SEQ ID NO: 54344 - DNA, 178 bp, Homo sapiens; identical to SEQ ID NO: 33657
  chr11:16634274-16634452
  hyper

SEQ ID NO: 54345 - DNA, 132 bp, Homo sapiens; identical to SEQ ID NO: 33658
  chr11:16635795-16635927
  hyper

SEQ ID NO: 54346 - DNA, 44 bp, Homo sapiens
  chr11:17497448-17497492
  hyper
ctcagtggagaggcacgcacgattgtcccggccgtggcgcccaa

SEQ ID NO: 54347 - DNA, 230 bp, Homo sapiens; identical to SEQ ID NO: 33661
  chr11:17497951-17498181
  hyper

SEQ ID NO: 54348 - DNA, 93 bp, Homo sapiens; identical to SEQ ID NO: 33662
  chr11:17565890-17565983
  hyper

SEQ ID NO: 54349 - DNA, 440 bp, Homo sapiens; identical to SEQ ID NO: 33663
  chr11:17717334-17717774
  hyper

SEQ ID NO: 54350 - DNA, 79 bp, Homo sapiens; identical to SEQ ID NO: 20947
  chr11:17740414-17740493
  hyper

SEQ ID NO: 54351 - DNA, 20 bp, Homo sapiens
  chr11:17740570-17740590
  hyper
tcgtgcgtttctctgcccct

SEQ ID NO: 54352 - DNA, 327 bp, Homo sapiens; identical to SEQ ID NO: 33665
  chr11:17740835-17741162
  hyper

SEQ ID NO: 54353 - DNA, 41 bp, Homo sapiens; identical to SEQ ID NO: 33666
  chr11:17741528-17741569
  hyper

SEQ ID NO: 54354 - DNA, 39 bp, Homo sapiens
  chr11:17742445-17742484
  hyper
cagatggactacagcggccccccgagcggcgcccggcgg

SEQ ID NO: 54355 - DNA, 17 bp, Homo sapiens
  chr11:17743775-17743792
  hyper
ggcggattgcaaggagg

SEQ ID NO: 54356 - DNA, 49 bp, Homo sapiens; identical to SEQ ID NO: 33670
  chr11:17756617-17756666
  hyper

SEQ ID NO: 54357 - DNA, 86 bp, Homo sapiens; identical to SEQ ID NO: 33671
  chr11:17756886-17756972
  hyper

SEQ ID NO: 54358 - DNA, 15 bp, Homo sapiens
  chr11:17756993-17757008
  hyper
cgaccacctcacaga

SEQ ID NO: 54359 - DNA, 77 bp, Homo sapiens; identical to SEQ ID NO: 33673
  chr11:17757704-17757781
  hyper

SEQ ID NO: 54360 - DNA, 494 bp, Homo sapiens; identical to SEQ ID NO: 33674
  chr11:18742646-18743140
  hyper

SEQ ID NO: 54361 - DNA, 57 bp, Homo sapiens; identical to SEQ ID NO: 20953
  chr11:18812557-18812614
  hyper

SEQ ID NO: 54362 - DNA, 379 bp, Homo sapiens
  chr11:18812653-18813032
  hyper
gctgggagccgcgctttagaggccagaaggctagcggcgatttccaatctccctcaggggcttcaggctccggagaggcgatgcagcccagagccgcgcaccagcctccgccggccgcagaggctcagaccccaaaccactatcccgattcctccccggaaccgcgcacgggcttcgtggggagtggctgccgctccctcccggctaccaagcgacaagccccctcctctgcatgggggacccctcccccagcatgcgggcgcccagagccccacgggggcgtggcgggggcgggcgccggctcctcggccgggagggctggagaaggtgtcagttgcggggccgcccgaaggagggacccgcgccctccaccttccgg

SEQ ID NO: 54363 - DNA, 80 bp, Homo sapiens; identical to SEQ ID NO: 20955
  chr11:18813086-18813166
  hyper

SEQ ID NO: 54364 - DNA, 75 bp, Homo sapiens; identical to SEQ ID NO: 20956
  chr11:18813376-18813451
  hyper

SEQ ID NO: 54365 - DNA, 183 bp, Homo sapiens
  chr11:18813609-18813792
  hyper
cggaggagtgggagcagcgcatccatttcattcatgattttttctcctcttgggagccccgggtcgggccgcgcggctacggcaactgccagagggaccccggcagggccgtgcgcgctgaacctgggacgggacagacaggcagacagaaggagtaggggccagcgagacaaagggggcaga

SEQ ID NO: 54366 - DNA, 104 bp, Homo sapiens
  chr11:18813947-18814051
  hyper
ttctccctgttcagcctctggggagctagagcgagtggacagcccctccctccactgagtcttgccctcctgacgtgcggcgcggggcacgcacctgttttggt

SEQ ID NO: 54367 - DNA, 30 bp, Homo sapiens; identical to SEQ ID NO: 33678
  chr11:19263461-19263491
  hyper

SEQ ID NO: 54368 - DNA, 404 bp, Homo sapiens
  chr11:19366698-19367102
  hyper
gcactggttggctggcgggagggaggaggaggcggtttcccgggtaacgggagggcaaggagcggctgcagcggcagcggccgcggctgagaagcgcgggccggagtgcagtgcgagaccggctggaggaggcggctccgcgaagccggtgtgggcgcaggtaggaaccccctatgctgcctcccccaggtcgggtctggctggactgcccggcggcgggaccggcctgggaaagtttgcggtgcaactgggtgggcaaggaggagaggacttggggatgctctgtgctgagctccggggtccagagcagggtggggactgccgttggggagagggccggcccctcattgagaggctcgggggccacacctctgctgcgggactctgaccgagggccagggcct

SEQ ID NO: 54369 - DNA, 29 bp, Homo sapiens
  chr11:19367330-19367359
  hyper
tccctctgggcgtacgtgcctgaggctgt

SEQ ID NO: 54370 - DNA, 91 bp, Homo sapiens; identical to SEQ ID NO: 33682
  chr11:19367846-19367937
  hyper

SEQ ID NO: 54371 - DNA, 39 bp, Homo sapiens; identical to SEQ ID NO: 10733
  chr11:19367938-19367977
  hyper

SEQ ID NO: 54372 - DNA, 120 bp, Homo sapiens; identical to SEQ ID NO: 33684
  chr11:19368011-19368131
  hyper

SEQ ID NO: 54373 - DNA, 90 bp, Homo sapiens; identical to SEQ ID NO: 33685
  chr11:19734976-19735066
  hyper

SEQ ID NO: 54374 - DNA, 30 bp, Homo sapiens; identical to SEQ ID NO: 10734
  chr11:19735404-19735434
  hyper

SEQ ID NO: 54375 - DNA, 19 bp, Homo sapiens
  chr11:20153699-20153718
  hyper
ccgcccatccacattcggc

SEQ ID NO: 54376 - DNA, 127 bp, Homo sapiens; identical to SEQ ID NO: 20965
  chr11:20153764-20153891
  hyper

SEQ ID NO: 54377 - DNA, 90 bp, Homo sapiens; identical to SEQ ID NO: 33689
  chr11:20154109-20154199
  hyper

SEQ ID NO: 54378 - DNA, 145 bp, Homo sapiens; identical to SEQ ID NO: 33690
  chr11:20177698-20177843
  hyper

SEQ ID NO: 54379 - DNA, 688 bp, Homo sapiens
  chr11:20178305-20178993
  hyper
ttccgtttgcctcatccgctgccaccctgccccgaagggcggggttgggggccggtgaggccgggagagaaggcggggagtcggggtggggagagaagagggctatcctgcggagcttcgagggtagtggcccgtgtactcactccctctctaggcctcggttttcccatctgtacagtgggacctaagccgtttccgaacccttgcaattgacgggtgcgccggggaggggtgaagggcgggggcggggggggtgctgtggaggaaatgcgctcacctgcgagtctttcaggcccagcttggccgccagcttcttgcggtcgggcttgctgatgtacttctgcttctggaacatcttctccagcgccttccgctgcacgtcggagaagactgctcgacgcagcatgccccgccgaggcttcccgcgcgcggccagcggccaggagaaggtcccggggatgggcaccacgctggaggaagctgcagggtggggggaggtggcgagtgagtgggcgtacgccccccagtcccaacacggctctccctggctttttgctctgatcccttcatctctttaaaacgctcctttttctccccctggagaataggccacgaacctacaaacctgcgagagtgaaaggcgctttccgcccaaacaactttccctttcaaccgtgcaaacccggat

SEQ ID NO: 54380 - DNA, 33 bp, Homo sapiens; identical to SEQ ID NO: 20969
  chr11:20180793-20180826
  hyper

SEQ ID NO: 54381 - DNA, 28 bp, Homo sapiens
  chr11:20181185-20181213
  hyper
tgtctcctagaagctcgaaggcagaaac

SEQ ID NO: 54382 - DNA, 390 bp, Homo sapiens
  chr11:20181254-20181644
  hyper
tgactgcgcacagtctccgactgcgtgtgctcaagttcactccgaggatggggcgagcctggaggcttttcttccccggaattgactggactattctcacattgcctgacgtagggtctcagagttcgtgcgtattgtgtgtgcaccgatgtgtgtgtgggggcccgctcgctagaggaaactgaggccaggatgactccgcgcatgcctagtacctgaatgggcccttagggttctgacctcgcttacctgttctgggccccgaggagaggatggcgttcactccaaacttcagaaacgtcgtctcgctggcaggggagaaggcagtcggcggagagccgccccgtcggctgccgggacccggggagcccaggtccgaggcccccgtgt

SEQ ID NO: 54383 - DNA, 10 bp, Homo sapiens
  chr11:20182854-20182864
  hyper
accttgcggg

SEQ ID NO: 54384 - DNA, 32 bp, Homo sapiens; identical to SEQ ID NO: 10745
  chr11:20184112-20184144
  hyper

SEQ ID NO: 54385 - DNA, 69 bp, Homo sapiens; identical to SEQ ID NO: 20973
  chr11:20184500-20184569
  hyper

SEQ ID NO: 54386 - DNA, 77 bp, Homo sapiens
  chr11:20185410-20185487
  hyper
cccgacgcctggctttggggtggggggtgtggggagggggggcagggagctaacgggcgaggcgaaggaggagggct

SEQ ID NO: 54387 - DNA, 17 bp, Homo sapiens
  chr11:20229550-20229567
  hyper
gacgctcccttaggacc

SEQ ID NO: 54388 - DNA, 46 bp, Homo sapiens
  chr11:20230464-20230510
  hyper
ggttgctgcttttgagccggttgcttcgggccggcagcccttctta

SEQ ID NO: 54389 - DNA, 498 bp, Homo sapiens
  chr11:20619219-20619717
  hyper
cgtcccccaagatgccaagagcctgcggggtgcttctcagcgccagccggaacttgagcaggcacccctgcggaattctcagtcccacccactcagacgaccctcctccagccagagtccaccacagcccaccctaccctcttaaccctcgttcccgacctctccctacgagcgggccccggggagagagcgactgaccctagcgacagcccggcgggaggtggttgggatcttctccagggttcaaaagcgactttctgagccccaatttcctcagctttgcaattggtatagtttctgaaaggccattgctaaatctaaccgagataattcatggatatcccttgcacaatggttgagtattgagatctcaatagacgttagctcaaaactgcaataaaaagcgacctgaaatcctcaaggcgtctcaaaagaaagatctcctcctcctgcccccaccaaaggcaatgcagaccgtgtgtccccagccagctgccc

SEQ ID NO: 54390 - DNA, 9 bp, Homo sapiens
  chr11:20621644-20621653
  hyper
taataggat

SEQ ID NO: 54391 - DNA, 127 bp, Homo sapiens
  chr11:20622578-20622705
  hyper
tctggacctgagttgcgaacgtctccatatctagatacaggtattttaaaagctgttgtgactttgttttgcacgaacttgacattgtgtttgcaggattgcagtgctcccaaggaaatgaataaac

SEQ ID NO: 54392 - DNA, 38 bp, Homo sapiens
  chr11:20623359-20623397
  hyper
ggaagctcgcactgcgctggggtcggcagttcagggcg

SEQ ID NO: 54393 - DNA, 30 bp, Homo sapiens; identical to SEQ ID NO: 33709
  chr11:20623598-20623628
  hyper

SEQ ID NO: 54394 - DNA, 265 bp, Homo sapiens
  chr11:20690388-20690653
  hyper
accccaaccacagctcgctccgcctcgaggaccccttttctgcacccccacctcagcgccctcttcctgcacccacaaagagagtactcagtcataggggttcaacaggagagaggagacagaaggtacaggcggtgagcagggactcagccatcatccccctcaggtccctccccacccagttgacagagcgaatcccgagtaattgttttccgagggggtccgtgcgcgctcggtggcgccgcctcggtctgggttcccccga

SEQ ID NO: 54395 - DNA, 104 bp, Homo sapiens; identical to SEQ ID NO: 33711
  chr11:20690982-20691086
  hyper

SEQ ID NO: 54396 - DNA, 40 bp, Homo sapiens; identical to SEQ ID NO: 956
  chr11:20691121-20691161
  hyper

SEQ ID NO: 54397 - DNA, 57 bp, Homo sapiens; identical to SEQ ID NO: 20981
  chr11:20691162-20691219
  hyper

SEQ ID NO: 54398 - DNA, 164 bp, Homo sapiens; identical to SEQ ID NO: 20982
  chr11:20691452-20691616
  hyper

SEQ ID NO: 54399 - DNA, 377 bp, Homo sapiens
  chr11:20692076-20692453
  hyper
ttctgcctccggagacgcagttgtgaggactctcagcgcatcttcttccttctgcttccaccggctcccttgcccaaaagtcccctggggttcggagactggcttgcagccgccttcttcaaagagctagtagtagatgcggggagactggggtgaggtgaggtggggtgagatgtaggaaattggcaaaaatagggcctgtcaactggggggagtgtcggaggtttgcaatcctacccagccatcctccgtacgcgctgcaccccagaatctgtgtggtcattccctttccctttattctcccccctttaccatccttatttccttctttagaggcgtggccttctctctaggccaaagagcaagttcatctggag

SEQ ID NO: 54400 - DNA, 37 bp, Homo sapiens
  chr11:20692529-20692566
  hyper
gttagcccgctggaagatctagcgtctaggagctttc

SEQ ID NO: 54401 - DNA, 182 bp, Homo sapiens; identical to SEQ ID NO: 33717
  chr11:20692775-20692957
  hyper

SEQ ID NO: 54402 - DNA, 763 bp, Homo sapiens
  chr11:22214360-22215123
  hyper
gccggccaacagggccggggggcggcgggtcccgaggagggacgggaggctgcatgtccggaggaggtgcgggaggcggcagagcagggacctggggacggcttgagcggagaggagggggccagcgtggagccagccgggccggggggcggggagatggcggtctccgagggtggggcgccggccggtcttgcggtctggaggcggggaaagaggcgtggaaacagggacgcagcgaaggggaaaggaaagctgccagagggcaggagtggaaaggatcctggcgagcaccgggaggagtggcggctgcgggatcagctgccgagcaggcacagggacaggtgcctggagaagtactgggagagcgcccaggagcgctaccggctgagggtggggaagcgcagggccaagcgcgcgaagcaggttgtgggggaccgggtcgagtggaagtacccgccggagaggaaggccggctggctgtggcgcccagagacggtggagtccgaggaggaggagaaggaggcctgcagaaggaagagcaggcccttagaagtccagcagcagcaactccggcggcccacagtcagattcagcacctgcctcagatctccacgtctgtctcagctgcccctctcctgctgcctctcaggcaccagtgccattaacgagctggcgaagatgggcgacccggatctcctggaagtgttggcggaggaaggtaggaccgcgccaagaggcgtcaagggagagccaggctggctgc

SEQ ID NO: 54403 - DNA, 46 bp, Homo sapiens
  chr11:22215287-22215333
  hyper
ttctctgctgctcctgcgcgccagggacctgcgacctgtgacccct

SEQ ID NO: 54404 - DNA, 15 bp, Homo sapiens
  chr11:22359403-22359418
  hyper
tcttttatttactca

SEQ ID NO: 54405 - DNA, 136 bp, Homo sapiens; identical to SEQ ID NO: 33720
  chr11:22359746-22359882
  hyper

SEQ ID NO: 54406 - DNA, 401 bp, Homo sapiens
  chr11:22362533-22362934
  hyper
tcaacttgctagaaacggaaaaggcagcgcgggtgggaaaggctctctagttgggcccgcctgcagcggagcagctctctggtgctgtgttgcaggaggacaccgcggtagtcagggtaaagccctgctgggcgcgtgtaggagtgggaggcgcctactcaggtgcagaggaggcgctggtaacccctgccctcacaaaatgcagaccctgcagatcctgcaagaaagttaggcccaagcggcctgtgtatctcaatcagagcgcccaggggtggatcccgagatggggactcgctaccttaggcctaaaggtgttaaagttgaagagacgccgccgccgcggccaagggcacctgcagaatgtgagagagcctgggaggtcttgcagcttggtgtcaccc

SEQ ID NO: 54407 - DNA, 432 bp, Homo sapiens
  chr11:22364975-22365407
  hyper
agctggagcagagacaacagcccagaggggtttgaggactcccgggcgaagtcttctagtcccttgacacaccctctcagggctggagctgctggtgactccttcctgaattagtcgcctaaacgaatgtaggctctctgggaccagcgcacgcggcctccttccctctgctgtggctgaacttgcttttggcgaaataatcgacgtgctgtatggcctgacaggagctgagggcagaccgggagcaggcagagcagggacagtgcgcctgagtgcacaaaggggtgtagaacggcagatgctgcgctctctcctgcactccccgcaggctcccaggctccccgagggtctgacctcctggcaaggcgcctcgaagacctggccccgtcccccgcccagttggtgctctgggtatgaagtatttgtttctag

SEQ ID NO: 54408 - DNA, 70 bp, Homo sapiens; identical to SEQ ID NO: 20990
  chr11:22365477-22365547
  hyper

SEQ ID NO: 54409 - DNA, 408 bp, Homo sapiens; identical to SEQ ID NO: 33723
  chr11:22688123-22688531
  hyper

SEQ ID NO: 54410 - DNA, 30 bp, Homo sapiens; identical to SEQ ID NO: 33724
  chr11:24518383-24518413
  hyper

SEQ ID NO: 54411 - DNA, 30 bp, Homo sapiens; identical to SEQ ID NO: 33725
  chr11:26353691-26353721
  hyper

SEQ ID NO: 54412 - DNA, 30 bp, Homo sapiens; identical to SEQ ID NO: 33726
  chr11:27720990-27721020
  hyper

SEQ ID NO: 54413 - DNA, 15 bp, Homo sapiens
  chr11:27740193-27740208
  hyper
gctgcaggcttgctc

SEQ ID NO: 54414 - DNA, 53 bp, Homo sapiens; identical to SEQ ID NO: 33728
  chr11:27740933-27740986
  hyper

SEQ ID NO: 54415 - DNA, 67 bp, Homo sapiens
  chr11:27743048-27743115
  hyper
atcatgtgagaagttcggctttgctcagtggatcgcccaccacttggtgtgacttatgaatctaata

SEQ ID NO: 54416 - DNA, 17 bp, Homo sapiens
  chr11:27743419-27743436
  hyper
actcagcctgcacaccg

SEQ ID NO: 54417 - DNA, 85 bp, Homo sapiens
  chr11:27743608-27743693
  hyper
accagaaaagcgcagcagggagggggtggggggcggcaacggcgacgactaacctcgctgtttacgtgaccgactcactgtgact

SEQ ID NO: 54418 - DNA, 250 bp, Homo sapiens; identical to SEQ ID NO: 20993
  chr11:27743897-27744147
  hyper

SEQ ID NO: 54419 - DNA, 53 bp, Homo sapiens
  chr11:27744504-27744557
  hyper
cgggaaataggcaataactcgagctttggcaacgtcccccagcctagggaggc

SEQ ID NO: 54420 - DNA, 153 bp, Homo sapiens
  chr11:27744558-27744711
  hyper
ctaacgcaaggtatctttccactgaagctgccctttgcctaccctcagccatcgctagcacagcagagcagaagaaccagggatgaatgtagaccagttgttatggagatgtccgtcgctctgaggagcgctagtgccctgggaagtccccag

SEQ ID NO: 54421 - DNA, 9 bp, Homo sapiens
  chr11:30037743-30037752
  hyper
gaagggaac

SEQ ID NO: 54422 - DNA, 395 bp, Homo sapiens
  chr11:30038294-30038689
  hyper
ttctgttgcctggcccgaggggtgcacagagtcctcgcggctggagcctgggggtgggggttggggctgccccagagaagaccccaagactcctggttcctctggagttcagcacaggagggattgcctgggaaaggaagtcaaggttcccccgaaaagaaacaaaatcctagacagcagcgatcacttgttaagcccgaattcctcctccaacatccatccctctctcgctctcgctggctgcgggagcagcacacgcctcccctggccgcgaacgcgctctgggcgggggcggggccagggccgaaccgagggtgtggcgttcgcgacggtcgccaggggcgcctcccggcgcggcggggcgggtgcagtcacgacgccgcgactccccgcac

SEQ ID NO: 54423 - DNA, 391 bp, Homo sapiens
  chr11:30038739-30039130
  hyper
ttggctgtggtccccacaggcgaggagcaaatcctggagaagtgtccccgttggggccggaataggggtttcgacggcagcgcgggagtccccagagggcttgggagcggggagctccaatgggaggtgcagtcccgaaaatggggtcctctgggacatctcctctacctaacttgctttctctatatctcccctcgagccccgagccccgtcttcttttccccaccccatcccctcccaaagcgggtttgttgggttgggagccgggtgcatctccggcgaggccacgggcggggagccctcctgtgcctgccagagcgcccagatccctcagtctccgtctcctttgcacacaggagttgggaggcttcagcgccggggttgggcctca

SEQ ID NO: 54424 - DNA, 106 bp, Homo sapiens; identical to SEQ ID NO: 33735
  chr11:30040131-30040237
  hyper

SEQ ID NO: 54425 - DNA, 41 bp, Homo sapiens; identical to SEQ ID NO: 33736
  chr11:30605841-30605882
  hyper

SEQ ID NO: 54426 - DNA, 62 bp, Homo sapiens; identical to SEQ ID NO: 33739
  chr11:30606323-30606385
  hyper

SEQ ID NO: 54427 - DNA, 57 bp, Homo sapiens; identical to SEQ ID NO: 33740
  chr11:30606698-30606755
  hyper

SEQ ID NO: 54428 - DNA, 242 bp, Homo sapiens
  chr11:30606864-30607106
  hyper
cggcggagagtgaggttggggcgcggggacggggtgagaaagagccccgagcgagagcggcgcgcgcgggcggccccgggggcggccgcggggcgcagccggagcacaaagctgcgcggtgccttcccctcgtcactgcacctggcctcgggccgccgcgggagcccggggatcgggccaacacaatgcacccaggcctaggccggggcggctcgaacacatcaccccgggactttctagta

SEQ ID NO: 54429 - DNA, 51 bp, Homo sapiens
  chr11:30607316-30607367
  hyper
aaaagaatttgctttcgctcaggggttgaaaatcagccctccccgagcgcc

SEQ ID NO: 54430 - DNA, 341 bp, Homo sapiens
  chr11:30607409-30607750
  hyper
ccggggcagcccgggtccgcagcctccgagcccctcgcacgcgcctctgacaaggcacctctcacccgggctccgctttgtgtgtgcatttttttcccttcctctagtgctcggcaccgggctcccggccgcctcctccccctcccccgccctccgcctcccttcccggggcggattacctttcccgggctgcgctccggatcccggggatgccttcagcgcccggcgagcaggcgatccatagccgagcggcccgagccggctggaggagcgctgggggcgcgcgggggcggcgaggggcgcgagcgggccagaaccttcgaccccggaggtcccgccgc

SEQ ID NO: 54431 - DNA, 212 bp, Homo sapiens; identical to SEQ ID NO: 21004
  chr11:31819833-31820045
  hyper

SEQ ID NO: 54432 - DNA, 272 bp, Homo sapiens
  chr11:31821025-31821297
  hyper
cttgtggaacatttctacagctgtctccttcaactagacgcttattcatgtcgccttaatgagaaacaaaacgttctctaatgagcaattacagagcgacaggattgttcccataacaaattcttgcgagtgacagaagcatcctttgtaccagatatttcgcatactgttaccgattttcccttccctcgcccgactccatggaggcgccgggcatccggagccggtccgagagctcacggatgcgccggcagcctcctcgcagtcccgcg

SEQ ID NO: 54433 - DNA, 107 bp, Homo sapiens; identical to SEQ ID NO: 33748
  chr11:31822002-31822109
  hyper

SEQ ID NO: 54434 - DNA, 315 bp, Homo sapiens
  chr11:31822393-31822708
  hyper
attgatgacacctgcaaatcaaaccaaaatcaaaccaaatggtagtgtctcctgaagacacagtcacccatctcagctcacccacaaccttaaaaagcaactctcaacccgttaaaaagctcccagccaccccgggacagtgggtggatttgcagatacaccgtggaaaaaatgatagctatcactttgggcatggaaatttagttggatagagaattgggcggagggggtccttcaccattgcttggtgtctctggtgacctaactcacacggttgctttgctttgttaaaagactgcccgaaaataaaaacta

SEQ ID NO: 54435 - DNA, 40 bp, Homo sapiens; identical to SEQ ID NO: 33750
  chr11:31823165-31823205
  hyper

SEQ ID NO: 54436 - DNA, 146 bp, Homo sapiens
  chr11:31824154-31824300
  hyper
gtccataattagcatcgtttacagtaagaaatgaagagagggcgttgagagtggagggccgcgggggcggcgagtggggcggcgccgggaggatcacctgcagaattcgggaaatgtcgcacggccgggccccgctgtgagctagc

SEQ ID NO: 54437 - DNA, 209 bp, Homo sapiens; identical to SEQ ID NO: 21008
  chr11:31824355-31824564
  hyper

SEQ ID NO: 54438 - DNA, 284 bp, Homo sapiens; identical to SEQ ID NO: 21009
  chr11:31824680-31824964
  hyper

SEQ ID NO: 54439 - DNA, 234 bp, Homo sapiens
  chr11:31827204-31827438
  hyper
gtgggaccccacggggtctgggcagaggaaagcagggaggtacaagggccataagtatcaaaagcgctctgggcctgggactatcaggacccaagcaattgcagttgccagggcagggattttccaattcctgggcacctccttaccagacccagtaaaccgtgctctctcccgcgccctgtaacagcgagtttaccacccctaccctgctgcaggcctgggggctcctctccc

SEQ ID NO: 54440 - DNA, 329 bp, Homo sapiens; identical to SEQ ID NO: 10798
  chr11:31829116-31829445
  hyper

SEQ ID NO: 54441 - DNA, 80 bp, Homo sapiens; identical to SEQ ID NO: 33758
  chr11:31830319-31830399
  hyper

SEQ ID NO: 54442 - DNA, 278 bp, Homo sapiens; identical to SEQ ID NO: 33759
  chr11:31831502-31831780
  hyper

SEQ ID NO: 54443 - DNA, 138 bp, Homo sapiens; identical to SEQ ID NO: 33760
  chr11:31832001-31832139
  hyper

SEQ ID NO: 54444 - DNA, 50 bp, Homo sapiens; identical to SEQ ID NO: 10801
  chr11:31832795-31832845
  hyper

SEQ ID NO: 54445 - DNA, 49 bp, Homo sapiens; identical to SEQ ID NO: 10802
  chr11:31833553-31833602
  hyper

SEQ ID NO: 54446 - DNA, 149 bp, Homo sapiens; identical to SEQ ID NO: 10803
  chr11:31834086-31834235
  hyper

SEQ ID NO: 54447 - DNA, 293 bp, Homo sapiens; identical to SEQ ID NO: 33764
  chr11:31834502-31834795
  hyper

SEQ ID NO: 54448 - DNA, 162 bp, Homo sapiens; identical to SEQ ID NO: 33765
  chr11:31835180-31835342
  hyper

SEQ ID NO: 54449 - DNA, 116 bp, Homo sapiens; identical to SEQ ID NO: 21018
  chr11:31835591-31835707
  hyper

SEQ ID NO: 54450 - DNA, 249 bp, Homo sapiens
  chr11:31835797-31836046
  hyper
gctgggggaccgtggctcgccagagcctgcccagagcttctagccagtattgatgcgtcaacatgaggtgaggcaagcatctcacccgcaccgatccctggcattcccctgtgcccaccccatcaggccttcggggaggcaaagaagtgcccacttctggggggaagtgcctccagctcccagcttcagaaccaagagcctcccatccggagttctgacagttctgacacctccaaactctctctttcc

SEQ ID NO: 54451 - DNA, 63 bp, Homo sapiens
  chr11:31836470-31836533
  hyper
ggccagtgctaggggctccctgggttcagtcctcagtcctcttccgttcgctctgggaggcca

SEQ ID NO: 54452 - DNA, 30 bp, Homo sapiens; identical to SEQ ID NO: 33767
  chr11:31836824-31836854
  hyper

SEQ ID NO: 54453 - DNA, 94 bp, Homo sapiens
  chr11:31838584-31838678
  hyper
ccgcagggtggtgggcgcttctctttcccgggcttggcggcccggctcccatggcgcccgcgcgcttcccgccgaggcagccagcgcagcgccc

SEQ ID NO: 54454 - DNA, 256 bp, Homo sapiens; identical to SEQ ID NO: 21021
  chr11:31839051-31839307
  hyper

SEQ ID NO: 54455 - DNA, 93 bp, Homo sapiens; identical to SEQ ID NO: 21022
  chr11:31840080-31840173
  hyper

SEQ ID NO: 54456 - DNA, 195 bp, Homo sapiens; identical to SEQ ID NO: 33774
  chr11:31845092-31845287
  hyper

SEQ ID NO: 54457 - DNA, 58 bp, Homo sapiens; identical to SEQ ID NO: 33775
  chr11:31845842-31845900
  hyper

SEQ ID NO: 54458 - DNA, 204 bp, Homo sapiens
  chr11:31846230-31846434
  hyper
atgagaagtggggtgcagggtgctatttgcccagcaaaagctcatttcctcccaaatgagtataatgaaaacccgagaggcgatattagtgtaaagatcgggattagtccaaataggagccgcggacttgggcttcaaaggcgacccctactctttttgcccagtctgggggcggagggcgctcgaagggatacttcaaggaca

SEQ ID NO: 54459 - DNA, 265 bp, Homo sapiens
  chr11:31846985-31847250
  hyper
tttttttttatccttgacaacttgtgtcctaaagaaagtgtattgaagataattgaaatgattacaattcattgctgcctgactttgaatatgaacagtcacataatgacatccccgccacacaacaacagtttaatttccattatccgacttcgggatcctagcgccagccgccggggcaacgtggcgctaatgcagaaatcttggctcctgcctgcattattcatttcggggacgtggggatgggataggagtggagagtggg

SEQ ID NO: 54460 - DNA, 46 bp, Homo sapiens; identical to SEQ ID NO: 21023
  chr11:31847925-31847971
  hyper

SEQ ID NO: 54461 - DNA, 149 bp, Homo sapiens
  chr11:31848323-31848472
  hyper
tggcataactcgaaccggagaagcgaggggagcctgagtgactggggcgcacatgacccccctcctggggcctttgggctcaacccttacttttaacttgttctaacaggaataatggagtagtactactaatgcatggtcagaagggg

SEQ ID NO: 54462 - DNA, 1 bp, Homo sapiens
  chr11:32009269-32009270
  hyper
c

SEQ ID NO: 54463 - DNA, 117 bp, Homo sapiens
  chr11:32355197-32355314
  hyper
tatccaggcggaagggaagcagccaggccgccgcggatctgaacttgaatcccgggtggaccggacgccccggccggcgctcctgacgcgcggaggagctggcgagaacctgcagat

SEQ ID NO: 54464 - DNA, 59 bp, Homo sapiens
  chr11:32448524-32448583
  hyper
acctccttcccttgacgtcagccccgggtccccgcgcggaggggagggaggatggggat

SEQ ID NO: 54465 - DNA, 120 bp, Homo sapiens
  chr11:32455482-32455602
  hyper
tccttccactgcctgcggtagaacctggtcccgcatagcttggactcggataagtcaagttctcttccatccccagaacctgcgtggccgccgcctgagcgaagcccagtgaagatccac

SEQ ID NO: 54466 - DNA, 207 bp, Homo sapiens
  chr11:32455634-32455841
  hyper
gacacgacgctgttccagaaagccatttagttactggaggtgcatgtgctcattctagttctctacgatacttaatgtgcacctaagtgtgtgccaacaccgtattataagggctggaggtgctcctggacattttagcgctgcggaggcagcacagcacaggcgctcacccccgcgctggtcccactccgaatccagagtccagac

SEQ ID NO: 54467 - DNA, 254 bp, Homo sapiens
  chr11:32456025-32456279
  hyper
ctagctctgcctggctttggaggatgtcgggggccagtgcctgcgtgcactcccactctccggcctcctccccagccgccgcttccgctatcctcacggcccttgggaagcagctgggtaagagctgcggtcaaaaggggtaggagaggggggtgtcctagagcggagagtccctggcgccactgccccgcgcgtagggggcgctccccggcctacttaccctgattgcgaatagcgggctggctctcgaggca

SEQ ID NO: 54468 - DNA, 23 bp, Homo sapiens
  chr11:32457176-32457199
  hyper
gcagcccaagcccggccaggcag

SEQ ID NO: 54469 - DNA, 218 bp, Homo sapiens; identical to SEQ ID NO: 33790
  chr11:32457219-32457437
  hyper

SEQ ID NO: 54470 - DNA, 28 bp, Homo sapiens
  chr11:32457684-32457712
  hyper
cctcagttgggtggccgggagttgcacc

SEQ ID NO: 54471 - DNA, 214 bp, Homo sapiens; identical to SEQ ID NO: 21025
  chr11:32458175-32458389
  hyper

SEQ ID NO: 54472 - DNA, 30 bp, Homo sapiens; identical to SEQ ID NO: 33793
  chr11:32460192-32460222
  hyper

SEQ ID NO: 54473 - DNA, 25 bp, Homo sapiens
  chr11:32460864-32460889
  hyper
gagccccacgcgcaagacagcccaa

SEQ ID NO: 54474 - DNA, 84 bp, Homo sapiens
  chr11:33037556-33037640
  hyper
ccgcgcacaggcctccgggtaggtgccgaggactgccgcctgggatggcgcggggcgggctggggtgcgcgggctgggtcccgg

SEQ ID NO: 54475 - DNA, 30 bp, Homo sapiens; identical to SEQ ID NO: 33797
  chr11:33850927-33850957
  hyper

SEQ ID NO: 54476 - DNA, 61 bp, Homo sapiens
  chr11:33890236-33890297
  hyper
tggtgcattaactttcgaggttcacatgtccccatcggtggaccccgaggaggggtacacc

SEQ ID NO: 54477 - DNA, 281 bp, Homo sapiens
  chr11:33890334-33890615
  hyper
ccctggaggcccagagccagctccgaggtggacggtcggacccctcacccgcccgttatccgcaaggctggcagcggctccacctgcggaccgggaaggcggccgttggggaccccggaggccgccacttggaatgttcccctttccaagaccaaatggacaaagagaaaggaccgagaaggagagggaagaagggagcagagtcaagcccagaacgctctccggactgcacctgcgcgcctccaggctctcctcgtgcctgctcccgtgcaaactttctg

SEQ ID NO: 54478 - DNA, 30 bp, Homo sapiens; identical to SEQ ID NO: 33799
  chr11:33892097-33892127
  hyper

SEQ ID NO: 54479 - DNA, 208 bp, Homo sapiens; identical to SEQ ID NO: 33800
  chr11:35440486-35440694
  hyper

SEQ ID NO: 54480 - DNA, 93 bp, Homo sapiens; identical to SEQ ID NO: 33801
  chr11:35440936-35441029
  hyper

SEQ ID NO: 54481 - DNA, 342 bp, Homo sapiens; identical to SEQ ID NO: 33802
  chr11:35441295-35441637
  hyper

SEQ ID NO: 54482 - DNA, 13 bp, Homo sapiens
  chr11:35547562-35547575
  hyper
ggagctggctttg

SEQ ID NO: 54483 - DNA, 42 bp, Homo sapiens; identical to SEQ ID NO: 33804
  chr11:35639614-35639656
  hyper

SEQ ID NO: 54484 - DNA, 79 bp, Homo sapiens; identical to SEQ ID NO: 33805
  chr11:35639657-35639736
  hyper

SEQ ID NO: 54485 - DNA, 915 bp, Homo sapiens; identical to SEQ ID NO: 33806
  chr11:35640687-35641602
  hyper

SEQ ID NO: 54486 - DNA, 263 bp, Homo sapiens; identical to SEQ ID NO: 33807
  chr11:36398106-36398369
  hyper

SEQ ID NO: 54487 - DNA, 32 bp, Homo sapiens; identical to SEQ ID NO: 33808
  chr11:36398880-36398912
  hyper

SEQ ID NO: 54488 - DNA, 162 bp, Homo sapiens; identical to SEQ ID NO: 33809
  chr11:36399187-36399349
  hyper

SEQ ID NO: 54489 - DNA, 207 bp, Homo sapiens; identical to SEQ ID NO: 33810
  chr11:40314716-40314923
  hyper

SEQ ID NO: 54490 - DNA, 135 bp, Homo sapiens; identical to SEQ ID NO: 33811
  chr11:40315465-40315600
  hyper

SEQ ID NO: 54491 - DNA, 115 bp, Homo sapiens; identical to SEQ ID NO: 33812
  chr11:43568960-43569075
  hyper

SEQ ID NO: 54492 - DNA, 187 bp, Homo sapiens; identical to SEQ ID NO: 33813
  chr11:43569128-43569315
  hyper

SEQ ID NO: 54493 - DNA, 32 bp, Homo sapiens; identical to SEQ ID NO: 33814
  chr11:43569580-43569612
  hyper

SEQ ID NO: 54494 - DNA, 24 bp, Homo sapiens
  chr11:43596489-43596513
  hyper
ggtgagtttcctcttcgggtggag

SEQ ID NO: 54495 - DNA, 360 bp, Homo sapiens; identical to SEQ ID NO: 33816
  chr11:43596850-43597210
  hyper

SEQ ID NO: 54496 - DNA, 45 bp, Homo sapiens; identical to SEQ ID NO: 33817
  chr11:43598418-43598463
  hyper

SEQ ID NO: 54497 - DNA, 30 bp, Homo sapiens; identical to SEQ ID NO: 10840
  chr11:43599075-43599105
  hyper

SEQ ID NO: 54498 - DNA, 114 bp, Homo sapiens; identical to SEQ ID NO: 33819
  chr11:43600016-43600130
  hyper

SEQ ID NO: 54499 - DNA, 537 bp, Homo sapiens
  chr11:43600557-43601094
  hyper
cacagttcattccgaactgagaaggaatcgtgacttcgcctggagacgtcccctacatgggagatggggggcgggggggcaccaaatcagtggggacgggggtgggggggaagacctatccaatgaaaaccgctgccaggggggcatttgaactccgtcgcttgctgtctcgctgtcccctctctgccccgcgcacctcgctccccctcccggccggcgctcgcagtggcgcgcctgctcgctctcccgctaagcgacgagtcttcaacaagttggaggaaggcaggaacgcaggggttaagctcggaaagccgcaattaccaagatcgtgaccctcccacacagtacagtaacttatatacttacctggaagaacccgctttgccgccgggcaaacacccgtggggggcggggaggggccggagggagcgggccggcaggagaggggctgcttccagctggctgcagtgcggacgggaccggcgcgctcccgtggcccccagaccgaggtaaggagcagggagtcggcgcccgggt

SEQ ID NO: 54500 - DNA, 75 bp, Homo sapiens; identical to SEQ ID NO: 21040
  chr11:43602393-43602468
  hyper

SEQ ID NO: 54501 - DNA, 40 bp, Homo sapiens; identical to SEQ ID NO: 3747
  chr11:43603446-43603486
  hyper

SEQ ID NO: 54502 - DNA, 73 bp, Homo sapiens; identical to SEQ ID NO: 33826
  chr11:43604791-43604864
  hyper

SEQ ID NO: 54503 - DNA, 31 bp, Homo sapiens; identical to SEQ ID NO: 10848
  chr11:43963534-43963565
  hyper

SEQ ID NO: 54504 - DNA, 390 bp, Homo sapiens; identical to SEQ ID NO: 33828
  chr11:43963625-43964015
  hyper

SEQ ID NO: 54505 - DNA, 207 bp, Homo sapiens; identical to SEQ ID NO: 33829
  chr11:43964444-43964651
  hyper

SEQ ID NO: 54506 - DNA, 404 bp, Homo sapiens; identical to SEQ ID NO: 33830
  chr11:43964895-43965299
  hyper

SEQ ID NO: 54507 - DNA, 371 bp, Homo sapiens; identical to SEQ ID NO: 33831
  chr11:43965690-43966061
  hyper

SEQ ID NO: 54508 - DNA, 33 bp, Homo sapiens; identical to SEQ ID NO: 33832
  chr11:44324942-44324975
  hyper

SEQ ID NO: 54509 - DNA, 75 bp, Homo sapiens
  chr11:44326062-44326137
  hyper
ccaaggcctctgagccgcgggggctccgggcaactatccccctcctctcctggcctcaggcaccccagtccaggg

SEQ ID NO: 54510 - DNA, 7 bp, Homo sapiens
  chr11:44326184-44326191
  hyper
acctctc

SEQ ID NO: 54511 - DNA, 48 bp, Homo sapiens; identical to SEQ ID NO: 33838
  chr11:44332524-44332572
  hyper

SEQ ID NO: 54512 - DNA, 122 bp, Homo sapiens; identical to SEQ ID NO: 10857
  chr11:44332922-44333044
  hyper

SEQ ID NO: 54513 - DNA, 45 bp, Homo sapiens; identical to SEQ ID NO: 33840
  chr11:44333583-44333628
  hyper

SEQ ID NO: 54514 - DNA, 249 bp, Homo sapiens
  chr11:44338086-44338335
  hyper
cgctgggacttgcaccccgagtttaggggcttagccatttccggaactcgggctagtggactctggggaatcaggcgctgggagaggccttcgcagctgcgtctctcctgcccagcatattgtgttgaatgaggcaagggagtgagggggtcgtaaaggaaacccgcactcaggggcacaccttcatttatctgggaacagcgcggatcccagaggtgcgggataaaccaggcgttccagctgctcaca

SEQ ID NO: 54515 - DNA, 159 bp, Homo sapiens
  chr11:44338367-44338526
  hyper
aagcaggagcggattggaggttttacaaactgaccaaccccgccgcccgcgcccgctggagggagacgcacacctttgccctgcatattcgcttccaggctctgcatctctgctcttggggagccggccacccgcttttccgcgcgggggctggggttc

SEQ ID NO: 54516 - DNA, 52 bp, Homo sapiens; identical to SEQ ID NO: 33844
  chr11:44341230-44341282
  hyper

SEQ ID NO: 54517 - DNA, 117 bp, Homo sapiens; identical to SEQ ID NO: 33846
  chr11:44748226-44748343
  hyper

SEQ ID NO: 54518 - DNA, 106 bp, Homo sapiens; identical to SEQ ID NO: 33847
  chr11:44748708-44748814
  hyper

SEQ ID NO: 54519 - DNA, 220 bp, Homo sapiens; identical to SEQ ID NO: 33848
  chr11:45376858-45377078
  hyper

SEQ ID NO: 54520 - DNA, 75 bp, Homo sapiens; identical to SEQ ID NO: 33849
  chr11:45377121-45377196
  hyper

SEQ ID NO: 54521 - DNA, 187 bp, Homo sapiens; identical to SEQ ID NO: 33850
  chr11:45686237-45686424
  hyper

SEQ ID NO: 54522 - DNA, 20 bp, Homo sapiens
  chr11:45686449-45686469
  hyper
cgcctcgggggccaccgcgc

SEQ ID NO: 54523 - DNA, 66 bp, Homo sapiens; identical to SEQ ID NO: 33852
  chr11:45686717-45686783
  hyper

SEQ ID NO: 54524 - DNA, 119 bp, Homo sapiens; identical to SEQ ID NO: 33853
  chr11:46259315-46259434
  hyper

SEQ ID NO: 54525 - DNA, 67 bp, Homo sapiens; identical to SEQ ID NO: 33854
  chr11:46299747-46299814
  hyper

SEQ ID NO: 54526 - DNA, 15 bp, Homo sapiens
  chr11:46316818-46316833
  hyper
gtaccattactgccc

SEQ ID NO: 54527 - DNA, 17 bp, Homo sapiens
  chr11:46317680-46317697
  hyper
gccgaccccttgctctt

SEQ ID NO: 54528 - DNA, 128 bp, Homo sapiens; identical to SEQ ID NO: 33858
  chr11:46354365-46354493
  hyper

SEQ ID NO: 54529 - DNA, 165 bp, Homo sapiens; identical to SEQ ID NO: 33859
  chr11:46354770-46354935
  hyper

SEQ ID NO: 54530 - DNA, 30 bp, Homo sapiens; identical to SEQ ID NO: 33860
  chr11:46404027-46404057
  hyper

SEQ ID NO: 54531 - DNA, 137 bp, Homo sapiens; identical to SEQ ID NO: 10866
  chr11:46414563-46414700
  hyper

SEQ ID NO: 54532 - DNA, 635 bp, Homo sapiens; identical to SEQ ID NO: 33862
  chr11:46938439-46939074
  hyper

SEQ ID NO: 54533 - DNA, 369 bp, Homo sapiens
  chr11:47208675-47209044
  hyper
tacatttttccatatcgccacgatgccaccccacgctaaataaatcccttctccctcctctctccctacttccctctccccgctttcccccgggggtgagattttgcagagcggctccgtctgttatttatatccactggagcggtccaagaatgttccgaagctgacctaatcgccacctgctcggcctctccgcccctcccactctctcctgggcccggtgacccagcggcggtgccctgagccttgaagaccagggggagcgcggaccaacggggtcgaacgcccgggcgcagaaggtcccggacgcagaaggtcccgggcgcgcagaatcgcagcgggtcggagagccccggcgctctcagagga

SEQ ID NO: 54534 - DNA, 91 bp, Homo sapiens
  chr11:47209189-47209280
  hyper
tagcaaaattatgttgtttctaaatccaggaggaatcactgacgcgttctttacgcagatgaatccgctcacaaaacgggaaagggacctg

SEQ ID NO: 54535 - DNA, 174 bp, Homo sapiens; identical to SEQ ID NO: 33864
  chr11:47615713-47615887
  hyper

SEQ ID NO: 54536 - DNA, 60 bp, Homo sapiens; identical to SEQ ID NO: 33865
  chr11:49229810-49229870
  hyper

SEQ ID NO: 54537 - DNA, 177 bp, Homo sapiens; identical to SEQ ID NO: 21057
  chr11:57194178-57194355
  hyper

SEQ ID NO: 54538 - DNA, 225 bp, Homo sapiens
  chr11:57194509-57194734
  hyper
cccgaaaggggacccttcgccctacccgcctgctccgcgccggggctctccgcgccctttccgcacgggccaggttcgcattcgcgcctctcgcagcccctcccagtcccctgctcgcctccgccccctcctgcccgcccggaaggggctggggcagacctcccactctccatcacttccttcttcttttcccttgctcacagcctcccgcgccctttttacctc

SEQ ID NO: 54539 - DNA, 30 bp, Homo sapiens; identical to SEQ ID NO: 33867
  chr11:57243673-57243703
  hyper

SEQ ID NO: 54540 - DNA, 150 bp, Homo sapiens; identical to SEQ ID NO: 33868
  chr11:58668329-58668479
  hyper

SEQ ID NO: 54541 - DNA, 46 bp, Homo sapiens
  chr11:58672700-58672746
  hyper
tcgccagcccctccacgaagttggatcatttgcggagcaggccaag

SEQ ID NO: 54542 - DNA, 103 bp, Homo sapiens; identical to SEQ ID NO: 21060
  chr11:58673064-58673167
  hyper

SEQ ID NO: 54543 - DNA, 80 bp, Homo sapiens; identical to SEQ ID NO: 3759
  chr11:58673168-58673248
  hyper

SEQ ID NO: 54544 - DNA, 53 bp, Homo sapiens; identical to SEQ ID NO: 33871
  chr11:59318986-59319039
  hyper

SEQ ID NO: 54545 - DNA, 69 bp, Homo sapiens
  chr11:59333336-59333405
  hyper
ccccggtccttgttacggtttaaaaagctggacaaagcccgtgcgccgaacgctttcgaggacttcttt

SEQ ID NO: 54546 - DNA, 36 bp, Homo sapiens
  chr11:59333541-59333577
  hyper
cgaaagaagaggagcggggtgcggggacacagggtt

SEQ ID NO: 54547 - DNA, 5 bp, Homo sapiens
  chr11:60718663-60718668
  hyper
ggcgg

SEQ ID NO: 54548 - DNA, 84 bp, Homo sapiens
  chr11:61062738-61062822
  hyper
aacacacaaaggcaacgccgcccgcctgctgatgcctctccgagaggcgcggagcccggggcgggggcaaagatcagggacccc

SEQ ID NO: 54549 - DNA, 20 bp, Homo sapiens
  chr11:61063138-61063158
  hyper
ccaaccgctccctggcctgg

SEQ ID NO: 54550 - DNA, 73 bp, Homo sapiens; identical to SEQ ID NO: 33877
  chr11:61276431-61276504
  hyper

SEQ ID NO: 54551 - DNA, 467 bp, Homo sapiens
  chr11:61276535-61277002
  hyper
cgaccagcagctggagctgagcgggcggcggttgcggcggctgcccagcgcagtgtgcgcgctgagccgcctgcagaagctgtatgtgagcggcacggggctgcgcgagctgccggaggagatcgaggagctgcgcgagctgcgcatcctggcgctggacttcaacaagctcgagcgactgcctgacggcctgtgccgcctgccgcgcctcacgcgcctctatctgggcggcaaccggctgctggcgctgcccgccgacttcgcgcagttgcagagcctgcgctgcctctggatcgagggcaacttcttgcggcgcttcccgcggccgctgctgcgcctggtggcgctgcagtcgctccagatgggcgacaaccggctgcgcgcgctgccggccgagctgccgcgcatgacgggcttgcgcggcctctggctctacggcaaccgcttcgaggagttcccgcccgcgc

SEQ ID NO: 54552 - DNA, 15 bp, Homo sapiens
  chr11:61277327-61277342
  hyper
cgctccaggactggg

SEQ ID NO: 54553 - DNA, 38 bp, Homo sapiens; identical to SEQ ID NO: 33880
  chr11:61334835-61334873
  hyper

SEQ ID NO: 54554 - DNA, 213 bp, Homo sapiens; identical to SEQ ID NO: 33881
  chr11:61335097-61335310
  hyper

SEQ ID NO: 54555 - DNA, 72 bp, Homo sapiens; identical to SEQ ID NO: 33882
  chr11:61582570-61582642
  hyper

SEQ ID NO: 54556 - DNA, 310 bp, Homo sapiens; identical to SEQ ID NO: 33883
  chr11:61583252-61583562
  hyper

SEQ ID NO: 54557 - DNA, 105 bp, Homo sapiens
  chr11:61594981-61595086
  hyper
gaggttgcagaaaggcgccagaatgtggatggcgcggacaatgtgggatactggagtctcgactgccgcgcgccaaggaagggcgtcacctagccaagccggccc

SEQ ID NO: 54558 - DNA, 217 bp, Homo sapiens
  chr11:61595262-61595479
  hyper
gatctcctccggcgcccggggccggagagtgggggagggaggaggtcggacacgtagcctgcctcgcagcagggctcgactccacgcgggagggcgggggagccggggacccgccgctccagcccgctggccttcgaaagatcctcctgggccaatggcaggcggggcgacgcgaccggattggtgcaggcgctctgctgatcgctgtggaaactcg

SEQ ID NO: 54559 - DNA, 300 bp, Homo sapiens; identical to SEQ ID NO: 21070
  chr11:61596120-61596420
  hyper

SEQ ID NO: 54560 - DNA, 137 bp, Homo sapiens; identical to SEQ ID NO: 33886
  chr11:61722850-61722987
  hyper

SEQ ID NO: 54561 - DNA, 34 bp, Homo sapiens; identical to SEQ ID NO: 33887
  chr11:61793162-61793196
  hyper

SEQ ID NO: 54562 - DNA, 77 bp, Homo sapiens; identical to SEQ ID NO: 33888
  chr11:63258635-63258712
  hyper

SEQ ID NO: 54563 - DNA, 30 bp, Homo sapiens; identical to SEQ ID NO: 33889
  chr11:63537177-63537207
  hyper

SEQ ID NO: 54564 - DNA, 14 bp, Homo sapiens
  chr11:63768254-63768268
  hyper
gggcctcagcgtcg

SEQ ID NO: 54565 - DNA, 180 bp, Homo sapiens; identical to SEQ ID NO: 33891
  chr11:63803518-63803698
  hyper

SEQ ID NO: 54566 - DNA, 60 bp, Homo sapiens; identical to SEQ ID NO: 33892
  chr11:64058891-64058951
  hyper

SEQ ID NO: 54567 - DNA, 216 bp, Homo sapiens; identical to SEQ ID NO: 33893
  chr11:64059895-64060111
  hyper

SEQ ID NO: 54568 - DNA, 33 bp, Homo sapiens; identical to SEQ ID NO: 33894
  chr11:64060160-64060193
  hyper

SEQ ID NO: 54569 - DNA, 363 bp, Homo sapiens; identical to SEQ ID NO: 33895
  chr11:64066842-64067205
  hyper

SEQ ID NO: 54570 - DNA, 229 bp, Homo sapiens; identical to SEQ ID NO: 33896
  chr11:64409956-64410185
  hyper

SEQ ID NO: 54571 - DNA, 233 bp, Homo sapiens; identical to SEQ ID NO: 33897
  chr11:64410203-64410436
  hyper

SEQ ID NO: 54572 - DNA, 45 bp, Homo sapiens
  chr11:64410678-64410723
  hyper
agctggggagcggggcggtgcgggctggaggagagaagagggacg

SEQ ID NO: 54573 - DNA, 196 bp, Homo sapiens; identical to SEQ ID NO: 33899
  chr11:64478789-64478985
  hyper

SEQ ID NO: 54574 - DNA, 78 bp, Homo sapiens; identical to SEQ ID NO: 33900
  chr11:64480253-64480331
  hyper

SEQ ID NO: 54575 - DNA, 50 bp, Homo sapiens; identical to SEQ ID NO: 21077
  chr11:64480379-64480429
  hyper

SEQ ID NO: 54576 - DNA, 231 bp, Homo sapiens; identical to SEQ ID NO: 21078
  chr11:64480593-64480824
  hyper

SEQ ID NO: 54577 - DNA, 182 bp, Homo sapiens
  chr11:64481042-64481224
  hyper
gcgcgcgtagcgagcccactgcccggggccgccgccgaactccaggccgtccgcgcgcgccgccagcgccagcagcagcagcaacagcagcggcggcggtgtcggccgccaccggctcccggacgccatgcctacggcggccccggccccgcccggcccccggcccccgctcaggcttcaga

SEQ ID NO: 54578 - DNA, 129 bp, Homo sapiens; identical to SEQ ID NO: 33902
  chr11:64511955-64512084
  hyper

SEQ ID NO: 54579 - DNA, 405 bp, Homo sapiens; identical to SEQ ID NO: 33903
  chr11:64512898-64513303
  hyper

SEQ ID NO: 54580 - DNA, 233 bp, Homo sapiens; identical to SEQ ID NO: 33904
  chr11:64513515-64513748
  hyper

SEQ ID NO: 54581 - DNA, 180 bp, Homo sapiens
  chr11:64739288-64739468
  hyper
agaaataaacagaaacgcaaagacaacttcccgagggcccgggccgtcgtgtgccgttacctcagccccaggtggttcccaggctcggccaggctatgtctcacacactgactaggggtccttcggcctcagaaaagtggccccggacggaatacccactaagaagtgctctctgaaaaa

SEQ ID NO: 54582 - DNA, 255 bp, Homo sapiens
  chr11:64739508-64739763
  hyper
gctcgccagctcctaagcaacttcggggctcgtgccgcgcacccaccaggccttctgcgcacgcgcaagtgcgcttcccaccgccccttcgggcgcagctccaaggcctggccgcggtctgcgcgtgcgcatttcattgtcgacaccgagaggacgccttggcgccttcaggtccctcctggatttaccagcccattgtttatttcgcgcctgctttagcgtggtgtcgtcgggaactagcgactgcagagtcct

SEQ ID NO: 54583 - DNA, 30 bp, Homo sapiens; identical to SEQ ID NO: 10894
  chr11:65185213-65185243
  hyper

SEQ ID NO: 54584 - DNA, 81 bp, Homo sapiens
  chr11:65185467-65185548
  hyper
gagtgctcaggaggacgggggaccaaggcctggggtaaggggcaggtgcccaggcactctagcatggcacggaacagggga

SEQ ID NO: 54585 - DNA, 190 bp, Homo sapiens; identical to SEQ ID NO: 33908
  chr11:65197700-65197890
  hyper

SEQ ID NO: 54586 - DNA, 61 bp, Homo sapiens
  chr11:65600749-65600810
  hyper
ccccaggttttctctcgcagcatcggcacccccttgcagccccgctccagtggcgaccgtt

SEQ ID NO: 54587 - DNA, 17 bp, Homo sapiens
  chr11:65601640-65601657
  hyper
tgcggtggtgtgtgtgt

SEQ ID NO: 54588 - DNA, 34 bp, Homo sapiens; identical to SEQ ID NO: 33911
  chr11:65640238-65640272
  hyper

SEQ ID NO: 54589 - DNA, 138 bp, Homo sapiens
  chr11:65816564-65816702
  hyper
gtccgagggtgcccggggccctgcgcgccgagtgccggtggcttgcctctcagcgcctggatgggatcaggtggcagcgtccgctaggctcgctcctcccggctctgcccgccccccgccccccgccccccatcgcac

SEQ ID NO: 54590 - DNA, 44 bp, Homo sapiens; identical to SEQ ID NO: 33914
  chr11:66186333-66186377
  hyper

SEQ ID NO: 54591 - DNA, 93 bp, Homo sapiens; identical to SEQ ID NO: 33915
  chr11:66187374-66187467
  hyper

SEQ ID NO: 54592 - DNA, 20 bp, Homo sapiens
  chr11:66188095-66188115
  hyper
aattagtgtcagtgccggcc

SEQ ID NO: 54593 - DNA, 328 bp, Homo sapiens
  chr11:66188145-66188473
  hyper
ggcttcaggccgccctaaacctggccctgtcgcttccctcaactgaacgcattcagacgccagggtccccacactccattcaagctttcctaacgcagcgccttcctctccgctcagctcccgccaggcttggccccctccgcagcctcctgctcccccctcgcccgcctccctccctctctcattctacgtcatgagatgacgtcggaagccgggcgggaggaggagcccccctccccagtcagcggctcccgctgcagcttgcttagcccagcctcccgctctcccgcccccccggctctaaaacgagccccccacgcctggcagg

SEQ ID NO: 54594 - DNA, 135 bp, Homo sapiens; identical to SEQ ID NO: 21089
  chr11:66188974-66189109
  hyper

SEQ ID NO: 54595 - DNA, 51 bp, Homo sapiens; identical to SEQ ID NO: 33919
  chr11:66726274-66726325
  hyper

SEQ ID NO: 54596 - DNA, 211 bp, Homo sapiens; identical to SEQ ID NO: 33920
  chr11:66790706-66790917
  hyper

SEQ ID NO: 54597 - DNA, 30 bp, Homo sapiens; identical to SEQ ID NO: 33921
  chr11:66791312-66791342
  hyper

SEQ ID NO: 54598 - DNA, 32 bp, Homo sapiens; identical to SEQ ID NO: 33922
  chr11:67232123-67232155
  hyper

SEQ ID NO: 54599 - DNA, 468 bp, Homo sapiens; identical to SEQ ID NO: 33923
  chr11:67478815-67479283
  hyper

SEQ ID NO: 54600 - DNA, 373 bp, Homo sapiens; identical to SEQ ID NO: 33924
  chr11:67895795-67896168
  hyper

SEQ ID NO: 54601 - DNA, 371 bp, Homo sapiens; identical to SEQ ID NO: 33925
  chr11:68451833-68452204
  hyper

SEQ ID NO: 54602 - DNA, 38 bp, Homo sapiens; identical to SEQ ID NO: 33926
  chr11:68452502-68452540
  hyper

SEQ ID NO: 54603 - DNA, 41 bp, Homo sapiens; identical to SEQ ID NO: 33927
  chr11:68607302-68607343
  hyper

SEQ ID NO: 54604 - DNA, 43 bp, Homo sapiens; identical to SEQ ID NO: 33928
  chr11:69452211-69452254
  hyper

SEQ ID NO: 54605 - DNA, 30 bp, Homo sapiens; identical to SEQ ID NO: 33929
  chr11:69452718-69452748
  hyper

SEQ ID NO: 54606 - DNA, 59 bp, Homo sapiens; identical to SEQ ID NO: 33930
  chr11:69453263-69453322
  hyper

SEQ ID NO: 54607 - DNA, 262 bp, Homo sapiens
  chr11:69517174-69517436
  hyper
tccgccagggagtccggggctgcgtgtgaggcctgcgcgggccgagacctcacacagcctcctctgcgcgcggggccgcgggaggggcgcgggttcgttcctttgaactcccagcctttgttcccggccaccagagccccagcgctcgtacacttccggccccgggacctctgcggttacctgggccttccctgccagcccccaccccctgcccccaccagaaagcgtttacaggacaggtgaggcccgcaggaggaaaagc

SEQ ID NO: 54608 - DNA, 55 bp, Homo sapiens; identical to SEQ ID NO: 33932
  chr11:69517954-69518009
  hyper

SEQ ID NO: 54609 - DNA, 319 bp, Homo sapiens
  chr11:69518211-69518530
  hyper
tgcttctccctagcgtcccgcgctgtttggggactaacggagggatcctaacgtccaggtgccaaaacctggggttcccaggagttgaggggtccgcaggagcctaagggtggcaaaggaaggaagggcgctggggtggggcgcgcgcagcggggtggggtgcgcgcggcggggcgggcgggggtgctggcgggcactcactgtgcgcgctctggccccgcgcgcagtccacgacgccgtcggcacggatgcgcaggaagcagctggagagcccgtgggggccggaggtgtacaggtgccgcaggcggatggggtcgcc

SEQ ID NO: 54610 - DNA, 37 bp, Homo sapiens; identical to SEQ ID NO: 33934
  chr11:69519059-69519096
  hyper

SEQ ID NO: 54611 - DNA, 243 bp, Homo sapiens; identical to SEQ ID NO: 33935
  chr11:69519374-69519617
  hyper

SEQ ID NO: 54612 - DNA, 43 bp, Homo sapiens
  chr11:69588887-69588930
  hyper
cagcaggcctgggggcggggcgcaggtcattgcggggcaggtg

SEQ ID NO: 54613 - DNA, 100 bp, Homo sapiens; identical to SEQ ID NO: 10910
  chr11:69589407-69589507
  hyper

SEQ ID NO: 54614 - DNA, 259 bp, Homo sapiens; identical to SEQ ID NO: 21098
  chr11:69589854-69590113
  hyper

SEQ ID NO: 54615 - DNA, 35 bp, Homo sapiens; identical to SEQ ID NO: 21099
  chr11:69590114-69590149
  hyper

SEQ ID NO: 54616 - DNA, 413 bp, Homo sapiens
  chr11:69590222-69590635
  hyper
ggctggtcgcaggccgcctgccaatcagggccgggggaagggaggaggctggggactagcgccgcgagtgccacctggagggaccccggcccccacccttggctccgcccggcccacggacctgttcgtcccgccccttggcggctcctacacttctgcttttcagccagttttgcctcttgcactttgtccctgcctgtccccgtccccgtctccctctctgctccggccgccttggcgcagccctaactcgggcatccgaagctcctagtgggcgcagaagccagcggctgctgcctgcccttcgcctttcggaggctcacgggaacttggttcctttgctggggccttgaggaccggcctgggaaggaggggtggataagagcagtaagcgacaccggggcctggctggg

SEQ ID NO: 54617 - DNA, 54 bp, Homo sapiens; identical to SEQ ID NO: 33940
  chr11:71274712-71274766
  hyper

SEQ ID NO: 54618 - DNA, 58 bp, Homo sapiens
  chr11:71318274-71318332
  hyper
taggcggggaaggtgcggggcgaggcggccgcggctccctggcatccctctccttacc

SEQ ID NO: 54619 - DNA, 51 bp, Homo sapiens; identical to SEQ ID NO: 21102
  chr11:71318967-71319018
  hyper

SEQ ID NO: 54620 - DNA, 88 bp, Homo sapiens; identical to SEQ ID NO: 33943
  chr11:71951172-71951260
  hyper

SEQ ID NO: 54621 - DNA, 56 bp, Homo sapiens; identical to SEQ ID NO: 21103
  chr11:71951583-71951639
  hyper

SEQ ID NO: 54622 - DNA, 205 bp, Homo sapiens
  chr11:71952135-71952340
  hyper
atacacgcacctgcacgcgagcctcagtgaggtcgatcttgagcgccagctcctcacgcgtgtaaatgtcggggtagtgggtctcagcgaaaacgcgctccagctccttgagctgcgcgctggtgaacgtggtgcggatgcgccgctgcttgcgcttctcgtgcaggccggatggctctgggaagaacttgtagggcactgcggg

SEQ ID NO: 54623 - DNA, 19 bp, Homo sapiens
  chr11:71954593-71954612
  hyper
ttgacctgaagggcacgag

SEQ ID NO: 54624 - DNA, 182 bp, Homo sapiens
  chr11:71954642-71954824
  hyper
ggagagatgagagggtgaggctcattcctgcggaggagaacctcgtattctgggggtctctcggggcattggagggtctggccaaggcaggaatgggggcggctgagggggacagtcgcattcacttggcgagcgggcccagggattctgcaggaattggagggagggttgggccggggctg

SEQ ID NO: 54625 - DNA, 57 bp, Homo sapiens; identical to SEQ ID NO: 33948
  chr11:71955068-71955125
  hyper

SEQ ID NO: 54626 - DNA, 155 bp, Homo sapiens
  chr11:71955189-71955344
  hyper
cggccgcactcagcccgggtgcaacgcaagtgcagccagcccggcccgcgcgccttttaacgcgcaggaccccgcggaggggggcggggcggggcgagctccgaaggggcggggcctaggaggcccagacaccgcccaaagccgccccgaccccc

SEQ ID NO: 54627 - DNA, 76 bp, Homo sapiens
  chr11:71955377-71955453
  hyper
cagaggtgtggagctgggatgcgcgggaccctatccccggagtccctatcctgccccaatccggaccagaccttcg

SEQ ID NO: 54628 - DNA, 56 bp, Homo sapiens; identical to SEQ ID NO: 33950
  chr11:71955705-71955761
  hyper

SEQ ID NO: 54629 - DNA, 37 bp, Homo sapiens; identical to SEQ ID NO: 21107
  chr11:71956340-71956377
  hyper

SEQ ID NO: 54630 - DNA, 30 bp, Homo sapiens; identical to SEQ ID NO: 33952
  chr11:72388069-72388099
  hyper

SEQ ID NO: 54631 - DNA, 243 bp, Homo sapiens
  chr11:72432916-72433159
  hyper
ggggctgaggactcccacagctccggccaggcgggctgcgtatgcccaagaatgtcgtgtacctgcccgtgcaagcctgggtcccgcctgggctggtctcgcaaacagcctggcccctggcccctgggtgggtctgaggctgcgttctcttggaggtttttgagcccaggtatggctttgcacctgtgatttatgtctttaagtgtttgtgaatcacttctctacgtgcgtgtgtgtttgttt

SEQ ID NO: 54632 - DNA, 30 bp, Homo sapiens; identical to SEQ ID NO: 33954
  chr11:72929613-72929643
  hyper

SEQ ID NO: 54633 - DNA, 109 bp, Homo sapiens; identical to SEQ ID NO: 33955
  chr11:73019882-73019991
  hyper

SEQ ID NO: 54634 - DNA, 36 bp, Homo sapiens; identical to SEQ ID NO: 33956
  chr11:74178590-74178626
  hyper

SEQ ID NO: 54635 - DNA, 96 bp, Homo sapiens
  chr11:74394395-74394491
  hyper
ggtggccctgggtagcgagcgcggccgggcgggcgccgtggcctcaggggccctccccgggctgggcacccccacgccgcccgggcactgctcgcg

SEQ ID NO: 54636 - DNA, 167 bp, Homo sapiens; identical to SEQ ID NO: 33958
  chr11:74441835-74442002
  hyper

SEQ ID NO: 54637 - DNA, 388 bp, Homo sapiens; identical to SEQ ID NO: 10923
  chr11:74442255-74442643
  hyper

SEQ ID NO: 54638 - DNA, 136 bp, Homo sapiens; identical to SEQ ID NO: 33960
  chr11:74442705-74442841
  hyper

SEQ ID NO: 54639 - DNA, 103 bp, Homo sapiens; identical to SEQ ID NO: 33961
  chr11:74951674-74951777
  hyper

SEQ ID NO: 54640 - DNA, 303 bp, Homo sapiens; identical to SEQ ID NO: 33962
  chr11:74952123-74952426
  hyper

SEQ ID NO: 54641 - DNA, 5 bp, Homo sapiens
  chr11:74952724-74952729
  hyper
gaccc

SEQ ID NO: 54642 - DNA, 242 bp, Homo sapiens; identical to SEQ ID NO: 33964
  chr11:74952948-74953190
  hyper

SEQ ID NO: 54643 - DNA, 313 bp, Homo sapiens; identical to SEQ ID NO: 33965
  chr11:75141346-75141659
  hyper

SEQ ID NO: 54644 - DNA, 247 bp, Homo sapiens; identical to SEQ ID NO: 33966
  chr11:75294375-75294622
  hyper

SEQ ID NO: 54645 - DNA, 75 bp, Homo sapiens; identical to SEQ ID NO: 33967
  chr11:75294662-75294737
  hyper

SEQ ID NO: 54646 - DNA, 848 bp, Homo sapiens; identical to SEQ ID NO: 33968
  chr11:75378401-75379249
  hyper

SEQ ID NO: 54647 - DNA, 190 bp, Homo sapiens
  chr11:75379895-75380085
  hyper
gctgggaggccatcacctccagcggagaccgagcattgctgcctccgccgctgcccgcgaggatgccgcagccgccgccgccaccgcctcttctcctgggaagcgaccccacccttttctgcagctctcggtctccgccgctgcccgcgaatgatgctgcagccgctgccgccgccgcctctgcctctgc

SEQ ID NO: 54648 - DNA, 358 bp, Homo sapiens; identical to SEQ ID NO: 33970
  chr11:75863301-75863659
  hyper

SEQ ID NO: 54649 - DNA, 218 bp, Homo sapiens; identical to SEQ ID NO: 33971
  chr11:76032896-76033114
  hyper

SEQ ID NO: 54650 - DNA, 127 bp, Homo sapiens; identical to SEQ ID NO: 33972
  chr11:76382096-76382223
  hyper

SEQ ID NO: 54651 - DNA, 26 bp, Homo sapiens
  chr11:78672891-78672917
  hyper
ctgatgtttccttctcgtgatgtctg

SEQ ID NO: 54652 - DNA, 354 bp, Homo sapiens
  chr11:78672964-78673318
  hyper
gggttggggacagaagcagccctccaactcttgcacactccagcggcgccgcggggcaagagcggggctgcctgagcccgcggagccacgtcaggcccccagctcccccggatcccaccacgcaccaggcccctccgcccggcaagtggcccaagcaggcatccgcaacggaaggacaattttaaaaacaaaccctcaaaagtaggaagagagagggacttaccgttcgccgcgacccccaggctggcggagccacttttaactaagaatgaattagggacaaactcttcctcagagtctgagtccggggttggctgggccacaccgttgcctagcaaccgcctctggctctca

SEQ ID NO: 54653 - DNA, 66 bp, Homo sapiens; identical to SEQ ID NO: 33974
  chr11:79148413-79148479
  hyper

SEQ ID NO: 54654 - DNA, 142 bp, Homo sapiens; identical to SEQ ID NO: 10935
  chr11:79148873-79149015
  hyper

SEQ ID NO: 54655 - DNA, 479 bp, Homo sapiens; identical to SEQ ID NO: 33976
  chr11:79149239-79149718
  hyper

SEQ ID NO: 54656 - DNA, 141 bp, Homo sapiens; identical to SEQ ID NO: 33977
  chr11:79149929-79150070
  hyper

SEQ ID NO: 54657 - DNA, 47 bp, Homo sapiens; identical to SEQ ID NO: 33978
  chr11:79150289-79150336
  hyper

SEQ ID NO: 54658 - DNA, 180 bp, Homo sapiens; identical to SEQ ID NO: 33979
  chr11:79150890-79151070
  hyper

SEQ ID NO: 54659 - DNA, 40 bp, Homo sapiens; identical to SEQ ID NO: 33980
  chr11:79151349-79151389
  hyper

SEQ ID NO: 54660 - DNA, 205 bp, Homo sapiens; identical to SEQ ID NO: 33981
  chr11:79151681-79151886
  hyper

SEQ ID NO: 54661 - DNA, 264 bp, Homo sapiens; identical to SEQ ID NO: 33982
  chr11:79152006-79152270
  hyper

SEQ ID NO: 54662 - DNA, 30 bp, Homo sapiens; identical to SEQ ID NO: 33983
  chr11:79152805-79152835
  hyper

SEQ ID NO: 54663 - DNA, 149 bp, Homo sapiens; identical to SEQ ID NO: 33984
  chr11:82443420-82443569
  hyper

SEQ ID NO: 54664 - DNA, 69 bp, Homo sapiens; identical to SEQ ID NO: 10941
  chr11:82443651-82443720
  hyper

SEQ ID NO: 54665 - DNA, 153 bp, Homo sapiens; identical to SEQ ID NO: 33986
  chr11:82444032-82444185
  hyper

SEQ ID NO: 54666 - DNA, 91 bp, Homo sapiens
  chr11:82445101-82445192
  hyper
gactcctctaaccgcaaggggtgaggaagagatggctggtctcaaactccagttcaggcccatgaggccgctgcagcgcttgataggcttc

SEQ ID NO: 54667 - DNA, 83 bp, Homo sapiens; identical to SEQ ID NO: 33988
  chr11:84431452-84431535
  hyper

SEQ ID NO: 54668 - DNA, 164 bp, Homo sapiens; identical to SEQ ID NO: 33989
  chr11:84431536-84431700
  hyper

SEQ ID NO: 54669 - DNA, 316 bp, Homo sapiens; identical to SEQ ID NO: 33990
  chr11:84431954-84432270
  hyper

SEQ ID NO: 54670 - DNA, 23 bp, Homo sapiens
  chr11:86085968-86085991
  hyper
gagctgcccgagagccagagcag

SEQ ID NO: 54671 - DNA, 257 bp, Homo sapiens; identical to SEQ ID NO: 33993
  chr11:86382846-86383103
  hyper

SEQ ID NO: 54672 - DNA, 190 bp, Homo sapiens; identical to SEQ ID NO: 33994
  chr11:87908294-87908484
  hyper

SEQ ID NO: 54673 - DNA, 6 bp, Homo sapiens
  chr11:88242618-88242624
  hyper
tgcccc

SEQ ID NO: 54674 - DNA, 185 bp, Homo sapiens; identical to SEQ ID NO: 33998
  chr11:88798746-88798931
  hyper

SEQ ID NO: 54675 - DNA, 117 bp, Homo sapiens; identical to SEQ ID NO: 21137
  chr11:88798965-88799082
  hyper

SEQ ID NO: 54676 - DNA, 3 bp, Homo sapiens
  chr11:88799209-88799212
  hyper
gaa

SEQ ID NO: 54677 - DNA, 124 bp, Homo sapiens; identical to SEQ ID NO: 34000
  chr11:89224502-89224626
  hyper

SEQ ID NO: 54678 - DNA, 185 bp, Homo sapiens; identical to SEQ ID NO: 21139
  chr11:91957315-91957500
  hyper

SEQ ID NO: 54679 - DNA, 210 bp, Homo sapiens
  chr11:91957674-91957884
  hyper
agagccccagagggctgagggaagactcgagctctaaaattagccgcttccaggcccggcgccgggaatgccctccagttcgccgcgcctcctccgccgccccctcccgcgcgccccctctcccctgcgccacgctcctagatcgctagtcatccccgccgccgaggctcctctccccctcgcccttttcgctcgcggtttgggaggagg

SEQ ID NO: 54680 - DNA, 33 bp, Homo sapiens
  chr11:91958230-91958263
  hyper
cggcagcagccgggggaccggctcgcccggagc

SEQ ID NO: 54681 - DNA, 165 bp, Homo sapiens
  chr11:91958569-91958734
  hyper
ccccgcggcgggagccgggaggtttacacggagagttggccaagtttggggctgaggatctggggaggggttgcgaggggggttgcggatcagtgcacccatccccggctcccagccgcccctgcaggtggatgagaaggttcaggtggcgagcctgcttggcag

SEQ ID NO: 54682 - DNA, 120 bp, Homo sapiens; identical to SEQ ID NO: 34004
  chr11:91959509-91959629
  hyper

SEQ ID NO: 54683 - DNA, 58 bp, Homo sapiens; identical to SEQ ID NO: 34005
  chr11:91960056-91960114
  hyper

SEQ ID NO: 54684 - DNA, 101 bp, Homo sapiens; identical to SEQ ID NO: 34006
  chr11:91960369-91960470
  hyper

SEQ ID NO: 54685 - DNA, 73 bp, Homo sapiens; identical to SEQ ID NO: 34007
  chr11:92675236-92675309
  hyper

SEQ ID NO: 54686 - DNA, 225 bp, Homo sapiens
  chr11:93063645-93063870
  hyper
gaggcagccgaggagccgcacagggcagcgcctgccgccgccgccgcgcccatcccccactccgacggccacgagttcgggccgcgacgtccccatggcaacacgcggcggcgccgcgcgcggggagggagaggcccaactgcctcgttggtcgcgcggcgggagggcccaggcggcgggagcgcggcggcgggtggcggggccccttggggcgggcctggcggg

SEQ ID NO: 54687 - DNA, 37 bp, Homo sapiens
  chr11:94134049-94134086
  hyper
gcgtgatcattatgtcggcaactgccaggttgacgat

SEQ ID NO: 54688 - DNA, 52 bp, Homo sapiens; identical to SEQ ID NO: 34011
  chr11:94277933-94277985
  hyper

SEQ ID NO: 54689 - DNA, 177 bp, Homo sapiens
  chr11:94473423-94473600
  hyper
agcccacagaacaaacgatttcccaagcatcagaggagggcagacataacataacagagcagggaatcgggttagaacgggttatgctctgattttttggaaaatgggcaaacggggcggggactagggaggattccgccagccgggagttgggaggccgcgcgcgcctctgcggag

SEQ ID NO: 54690 - DNA, 58 bp, Homo sapiens; identical to SEQ ID NO: 34015
  chr11:94474489-94474547
  hyper

SEQ ID NO: 54691 - DNA, 577 bp, Homo sapiens; identical to SEQ ID NO: 34016
  chr11:94501445-94502022
  hyper

SEQ ID NO: 54692 - DNA, 15 bp, Homo sapiens
  chr11:94502757-94502772
  hyper
cgaagatttttgcct

SEQ ID NO: 54693 - DNA, 34 bp, Homo sapiens; identical to SEQ ID NO: 34018
  chr11:94884262-94884296
  hyper

SEQ ID NO: 54694 - DNA, 110 bp, Homo sapiens
  chr11:98891367-98891477
  hyper
gttgcagagcagaaacgctcggggaaggggggcaggtcctctgtacttagcagggaaggaaaatgccggttgactagtgagacgagtggagaaacacagagcaccctccg

SEQ ID NO: 54695 - DNA, 7 bp, Homo sapiens
  chr11:98891882-98891889
  hyper
ccacagg

SEQ ID NO: 54696 - DNA, 295 bp, Homo sapiens; identical to SEQ ID NO: 21151
  chr11:100997981-100998276
  hyper

SEQ ID NO: 54697 - DNA, 103 bp, Homo sapiens
  chr11:100998318-100998421
  hyper
ggccgtcccgcgggagcaggcagccgctcgcgcccggcgccttgcagggcggcggcgcgaacgggccctgctggggcggcgcgccctccgctttgtacaggat

SEQ ID NO: 54698 - DNA, 88 bp, Homo sapiens; identical to SEQ ID NO: 34022
  chr11:100999617-100999705
  hyper

SEQ ID NO: 54699 - DNA, 90 bp, Homo sapiens; identical to SEQ ID NO: 21154
  chr11:101453090-101453180
  hyper

SEQ ID NO: 54700 - DNA, 187 bp, Homo sapiens; identical to SEQ ID NO: 34024
  chr11:101454510-101454697
  hyper

SEQ ID NO: 54701 - DNA, 154 bp, Homo sapiens; identical to SEQ ID NO: 34025
  chr11:101918352-101918506
  hyper

SEQ ID NO: 54702 - DNA, 30 bp, Homo sapiens; identical to SEQ ID NO: 34026
  chr11:102980458-102980488
  hyper

SEQ ID NO: 54703 - DNA, 34 bp, Homo sapiens; identical to SEQ ID NO: 34027
  chr11:104034042-104034076
  hyper

SEQ ID NO: 54704 - DNA, 112 bp, Homo sapiens; identical to SEQ ID NO: 21157
  chr11:104034409-104034521
  hyper

SEQ ID NO: 54705 - DNA, 222 bp, Homo sapiens; identical to SEQ ID NO: 21158
  chr11:104034996-104035218
  hyper

SEQ ID NO: 54706 - DNA, 211 bp, Homo sapiens; identical to SEQ ID NO: 21159
  chr11:105481005-105481216
  hyper

SEQ ID NO: 54707 - DNA, 256 bp, Homo sapiens; identical to SEQ ID NO: 34034
  chr11:105481621-105481877
  hyper

SEQ ID NO: 54708 - DNA, 25 bp, Homo sapiens
  chr11:106888283-106888308
  hyper
tgtagtcccctcttccgccctagcc

SEQ ID NO: 54709 - DNA, 212 bp, Homo sapiens
  chr11:106888429-106888641
  hyper
tccgcgttctctcccccgaaggcggtccccccttccgccccccgctcaccgagggcgccgtcaggcggctgatgctctcgcccagcgagtccaggttgacccgcctccggcgctgcaccctcctggccccggcagtggcagcggcggcggcggcagaagcagccggggtcggggccggggcggcggcagcggcagctgcggccgggctgggc

SEQ ID NO: 54710 - DNA, 290 bp, Homo sapiens
  chr11:106888801-106889091
  hyper
ggccgaggcggtggcggcgaggacgcgagcggcggcggaggcggcggtggcgggaccggcaagcgacaacgttaagcgcgtcggggccgcggggcgctgcggtcgcgcccggcggggcgggagtccccggggccgcggagccccccgagccggctgctcatggcgggaacttggggcgccgccgcaccttggggcccgggctcggcggcggcgccgggctgggctgggggccgccgccgcctctgctgctgctcgcgcggcgccgcctcagcgcccgcctcggcgcatcg

SEQ ID NO: 54711 - DNA, 32 bp, Homo sapiens; identical to SEQ ID NO: 34036
  chr11:106889400-106889432
  hyper

SEQ ID NO: 54712 - DNA, 494 bp, Homo sapiens; identical to SEQ ID NO: 34037
  chr11:106889690-106890184
  hyper

SEQ ID NO: 54713 - DNA, 762 bp, Homo sapiens
  chr11:107461653-107462415
  hyper
ggaggccacccgggagcaattaaactgggccacaccagccacctcccacagcagcggggtccgcagatttaaccctttccccccagattccggcactgggtgccgcgctctctcccccagcaccgcgcccgcgcccccggctcccggactgggcatgctcagtagccgcccgcttcgtgctcccagggaagcctctgcacgccctcccccgctgctctcggtcgcctcctcgccgccagccgccccgggtgcatcccggcttgctccgctccacgcgacccagattcctgccccgcccccgccccttccgcgcccgcagccagtgcggcagccgcggccgcccctgtccagcctcggcgcccgggaccgagcgcgtcgctcgccgccgcggagcgcgtagccggagcgcctggggaaggcggagatgaagaccacgccgccgcgcgccgggagctgctgagcctaccgccgccagagtccaggtgattggcgaccccagaggagcctagggagtaggggcgaatgcccttggggaggagagaggtgcggcgaggacgcgaggcatcacgcaagctgcgctgtgcctgggaggcagcagaaatgctaagcatcgggggcagagagggaacgggaatgaaagtgcactctgccttggtgcaggggctccggggtcacccaggacagtgatttccccttctatcctgtcctcccaattaacacccgagaggctgcaggtcggcgcgagaggctgtttgcatctcg

SEQ ID NO: 54714 - DNA, 11 bp, Homo sapiens
  chr11:107462459-107462470
  hyper
gaagggatccc

SEQ ID NO: 54715 - DNA, 499 bp, Homo sapiens; identical to SEQ ID NO: 34039
  chr11:107799306-107799805
  hyper

SEQ ID NO: 54716 - DNA, 30 bp, Homo sapiens; identical to SEQ ID NO: 34040
  chr11:107800015-107800045
  hyper

SEQ ID NO: 54717 - DNA, 43 bp, Homo sapiens; identical to SEQ ID NO: 34041
  chr11:109292787-109292830
  hyper

SEQ ID NO: 54718 - DNA, 15 bp, Homo sapiens
  chr11:109292891-109292906
  hyper
cgcggctcggtctct

SEQ ID NO: 54719 - DNA, 123 bp, Homo sapiens; identical to SEQ ID NO: 21169
  chr11:109293052-109293175
  hyper

SEQ ID NO: 54720 - DNA, 214 bp, Homo sapiens
  chr11:109293506-109293720
  hyper
agaagagatggagcgcgttcctgcgcgtcagccgcggtcgcggacagaggcagagtgggatgtggtgccaggggtatccccctgggaatgggacccaagggatctgacgctgtccagggagggcgagtctggacggggagggaaaggaagggaggactgcgtacccggagcccgcgcggcggcccggagtgggtgctgggaagggtaggatcca

SEQ ID NO: 54721 - DNA, 26 bp, Homo sapiens
  chr11:109293873-109293899
  hyper
cgcggtgccggcgcagaccccatcct

SEQ ID NO: 54722 - DNA, 51 bp, Homo sapiens; identical to SEQ ID NO: 34045
  chr11:109294138-109294189
  hyper

SEQ ID NO: 54723 - DNA, 459 bp, Homo sapiens
  chr11:110581773-110582232
  hyper
gcgggggtggggaggcgggggacaggcagacagggctagaaacacccaaatcaattcctcagggagcgaaacggcagaggccggcagcccgcggcccacgtgcacttgctcagggaaccgttccagcgaaacctgacccggatcggaatcctcccgcagcacagcggccgtgtttatcggaatggaacgctacaagttgtcacctgcatccctctcccagctttgacagggaacacgcgctgcccccacgcccacaccgacacccggatccctatccagcccggccagagtcccaggggccagggaccagtgcagggagaaggtcccccacctcagccctcaggacccccaaccacagcccacccgcccccaccctgctcggttctaggcccagccgaacctacatgtccccgtagtgtcgagcgttatcatccacagtcgcccctcaaactgtgaccc

SEQ ID NO: 54724 - DNA, 461 bp, Homo sapiens
  chr11:110582434-110582895
  hyper
ggctgacaccgccaaagggcagtcagtgctcgcccaggccacttcgggaggcccaggggcacggcgaggggtcggggaaaggcgatcgcccactacagcccgcgcgcctagactgagggaggagccgggctgcagaaccggcggcggatggagacgggagggaggctgcgaggtcgctcgaggagagactaaggctctagaaacggagaagcgggcgctctgcgggaggcggcggcgctgccgctggccgtcaagggcgggaagtgttctgggactctcattaggggccgcgagcctcgagcgtcaaattcccgcggcgtccgcctagcgcgctgctgtggcgggcgcggagggcgcgcgccggcagtgggggctgcggcggcggagggcacgggcccccgctcagcgtcctcaccttcttggtgcagctgcctcccgcgagccgagacactcctgtcagg

SEQ ID NO: 54725 - DNA, 524 bp, Homo sapiens; identical to SEQ ID NO: 21175
  chr11:110583050-110583574
  hyper

SEQ ID NO: 54726 - DNA, 422 bp, Homo sapiens
  chr11:110583730-110584152
  hyper
tcgggtaaccctgagtgggcttctgcagccggtcatgtcagcggcccctgcacatttgcacccgcggtttccgctgtctgcaggctgcagagacgggggcattccaaacgtgaaagagcaatgaaggaaaatgcagacagagcgaggacgccgaaatttggctaagctattgagaaggctacaatatgtggaagtgtttatcagatatctgcgccgagagcataacttcctgtcagcccaaatagaggcaaaaatattttaaaggccaaagaataatcagagggagaggatttggagctgacccgcgttgagctgagtgttgctgcactttgcggggctggttgactggtacggatgattcggtagatggcattcttcccttggagtcaggactagagaagcagtggcggattagtgaggaa

SEQ ID NO: 54727 - DNA, 35 bp, Homo sapiens; identical to SEQ ID NO: 34049
  chr11:111170024-111170059
  hyper

SEQ ID NO: 54728 - DNA, 58 bp, Homo sapiens
  chr11:111383125-111383183
  hyper
ctcccccacccgccccgtctcgcgcccgccccgcccctcggcccgcggggttccaagg

SEQ ID NO: 54729 - DNA, 223 bp, Homo sapiens; identical to SEQ ID NO: 21179
  chr11:111383682-111383905
  hyper

SEQ ID NO: 54730 - DNA, 30 bp, Homo sapiens; identical to SEQ ID NO: 34053
  chr11:111385419-111385449
  hyper

SEQ ID NO: 54731 - DNA, 195 bp, Homo sapiens
  chr11:111412061-111412256
  hyper
ccgggaggcggccgcagagacagcggggtagggatgctggatccccggtgccgtgggaaccctgcctgttactcctcgtctcttctgcggggttggatggctgggtcgagcgcccggtatgagagcgcttagagatcgggaaagaactccagttagtgtgggacgagccccacctgactccggggaatgactctc

SEQ ID NO: 54732 - DNA, 30 bp, Homo sapiens; identical to SEQ ID NO: 34057
  chr11:111412594-111412624
  hyper

SEQ ID NO: 54733 - DNA, 137 bp, Homo sapiens; identical to SEQ ID NO: 34058
  chr11:113345029-113345166
  hyper

SEQ ID NO: 54734 - DNA, 320 bp, Homo sapiens; identical to SEQ ID NO: 11002
  chr11:113345418-113345738
  hyper

SEQ ID NO: 54735 - DNA, 102 bp, Homo sapiens; identical to SEQ ID NO: 34060
  chr11:113346239-113346341
  hyper

SEQ ID NO: 54736 - DNA, 181 bp, Homo sapiens; identical to SEQ ID NO: 34061
  chr11:113929598-113929779
  hyper

SEQ ID NO: 54737 - DNA, 32 bp, Homo sapiens; identical to SEQ ID NO: 34062
  chr11:113929995-113930027
  hyper

SEQ ID NO: 54738 - DNA, 352 bp, Homo sapiens; identical to SEQ ID NO: 11005
  chr11:113930374-113930726
  hyper

SEQ ID NO: 54739 - DNA, 34 bp, Homo sapiens; identical to SEQ ID NO: 34064
  chr11:113931033-113931067
  hyper

SEQ ID NO: 54740 - DNA, 354 bp, Homo sapiens; identical to SEQ ID NO: 34065
  chr11:113931343-113931697
  hyper

SEQ ID NO: 54741 - DNA, 30 bp, Homo sapiens; identical to SEQ ID NO: 34066
  chr11:113932041-113932071
  hyper

SEQ ID NO: 54742 - DNA, 30 bp, Homo sapiens; identical to SEQ ID NO: 34067
  chr11:115373239-115373269
  hyper

SEQ ID NO: 54743 - DNA, 792 bp, Homo sapiens; identical to SEQ ID NO: 34068
  chr11:115373755-115374547
  hyper

SEQ ID NO: 54744 - DNA, 249 bp, Homo sapiens; identical to SEQ ID NO: 34069
  chr11:115375185-115375434
  hyper

SEQ ID NO: 54745 - DNA, 72 bp, Homo sapiens; identical to SEQ ID NO: 34070
  chr11:115530024-115530096
  hyper

SEQ ID NO: 54746 - DNA, 63 bp, Homo sapiens; identical to SEQ ID NO: 34072
  chr11:115630411-115630474
  hyper

SEQ ID NO: 54747 - DNA, 397 bp, Homo sapiens
  chr11:115630910-115631307
  hyper
acagtggagccgccccctgctttgggaggagcaaaagagcctctcgcttgcctcccgctcgagctccttctcctcttccttttcctagcgcttctctccctccctcggcggggtccgcagagacagctgggcaggcggaggctgcgcgcctctcgcacctccacgcccaccctcccgccgcccccccctcggcctgaaagatctgcgtccacaccaccctgcacccagggcccgtcaggttttgcagaagtttgctgagggtcctcacagggggtctcccaggggaaggggtggagggctggaggggccgcggtgggaagaggtggcagacgccgcctggcaacggagaccctaccctttctagaaattcagaacgcagagaaaccagtgcccagcc

SEQ ID NO: 54748 - DNA, 35 bp, Homo sapiens; identical to SEQ ID NO: 34076
  chr11:116451313-116451348
  hyper

SEQ ID NO: 54749 - DNA, 264 bp, Homo sapiens; identical to SEQ ID NO: 34077
  chr11:116706504-116706768
  hyper

SEQ ID NO: 54750 - DNA, 227 bp, Homo sapiens; identical to SEQ ID NO: 34078
  chr11:117667351-117667578
  hyper

SEQ ID NO: 54751 - DNA, 197 bp, Homo sapiens; identical to SEQ ID NO: 34079
  chr11:117667865-117668062
  hyper

SEQ ID NO: 54752 - DNA, 178 bp, Homo sapiens; identical to SEQ ID NO: 34080
  chr11:117746361-117746539
  hyper

SEQ ID NO: 54753 - DNA, 220 bp, Homo sapiens; identical to SEQ ID NO: 34081
  chr11:117747536-117747756
  hyper

SEQ ID NO: 54754 - DNA, 64 bp, Homo sapiens; identical to SEQ ID NO: 34082
  chr11:118024161-118024225
  hyper

SEQ ID NO: 54755 - DNA, 90 bp, Homo sapiens; identical to SEQ ID NO: 34083
  chr11:118663112-118663202
  hyper

SEQ ID NO: 54756 - DNA, 52 bp, Homo sapiens; identical to SEQ ID NO: 34084
  chr11:119191797-119191849
  hyper

SEQ ID NO: 54757 - DNA, 510 bp, Homo sapiens; identical to SEQ ID NO: 34085
  chr11:119210471-119210981
  hyper

SEQ ID NO: 54758 - DNA, 44 bp, Homo sapiens; identical to SEQ ID NO: 34086
  chr11:119211198-119211242
  hyper

SEQ ID NO: 54759 - DNA, 83 bp, Homo sapiens; identical to SEQ ID NO: 34087
  chr11:119234852-119234935
  hyper

SEQ ID NO: 54760 - DNA, 10 bp, Homo sapiens
  chr11:119292809-119292819
  hyper
gggtgcgcag

SEQ ID NO: 54761 - DNA, 15 bp, Homo sapiens
  chr11:119293305-119293320
  hyper
agctctcccctcccc

SEQ ID NO: 54762 - DNA, 18 bp, Homo sapiens
  chr11:119293352-119293370
  hyper
cggcactgcggcttcctt

SEQ ID NO: 54763 - DNA, 333 bp, Homo sapiens
  chr11:119293615-119293948
  hyper
cgaaagacatcagggtgccacgcggcccctgccctgcagaagcatccccctcccgcccctgcctggaaagcaggcccctccctaagctctgcgcccttcttccctgggcgccctcggaccgtggcccgaagcctagtgttgggaagtcttgcatgggcgcctgacggcggtccccgagccccaggtcccaccggctccagttcccacctggactggggtcttccgctgctgcagcctcctccagacgcgccgccgcctccggttgctgcacccagctcggagcccgcagttttcaccggggatggaggagagggggagcggggagccgggggc

SEQ ID NO: 54764 - DNA, 105 bp, Homo sapiens
  chr11:119612122-119612227
  hyper
gcgcctgggaccctgcggggcctcctggaggcgggacgggcacggcgccacctagcggtcgtgggccgcggagagagcgtccctgtccttccccgtgtgggacct

SEQ ID NO: 54765 - DNA, 33 bp, Homo sapiens
  chr11:119612399-119612432
  hyper
cagcctcccaccctcccccgcacacgtcgttcc

SEQ ID NO: 54766 - DNA, 344 bp, Homo sapiens
  chr11:119613075-119613419
  hyper
ctgggcgcgccggcctggggggaaagccccgcctcccggatgtcgtctcttcgccccctactagctcttgtctcctccccaacccctcgccccaccccctgcctaatttttgccagtggatcatcggcctttggatgaatccgcagcaaatggctcattcggggcgggcccgcctccccatccccccagtgtgcggtctcctctccccagcaaagatgttcggtggcacttacggcccctttttaacaccaggcgaagccaatattgttaggaaggaagaactgctgtggcagctgctgcaaagacaaatcatatgcagtaatgcatcacgggctgagggaggg

SEQ ID NO: 54767 - DNA, 94 bp, Homo sapiens; identical to SEQ ID NO: 34095
  chr11:119884295-119884389
  hyper

SEQ ID NO: 54768 - DNA, 118 bp, Homo sapiens; identical to SEQ ID NO: 34096
  chr11:120110849-120110967
  hyper

SEQ ID NO: 54769 - DNA, 131 bp, Homo sapiens; identical to SEQ ID NO: 34097
  chr11:120382817-120382948
  hyper

SEQ ID NO: 54770 - DNA, 4 bp, Homo sapiens
  chr11:120435401-120435405
  hyper
gcac

SEQ ID NO: 54771 - DNA, 323 bp, Homo sapiens
  chr11:120435477-120435800
  hyper
gctgcaaggactgcgcccagcctccgcctcgcccctcgaggctcccgcgtgggccggcgggcagtgcgtgggccacaggaagcgggctgactggacccggctcaggacttcgcacaagggcagctctttgtttacagctcctctcccagctccccgctttcctttcgcccaccgcctcccttttccggcgatcggctccgccggctgcgggggggtggggggggtggggtgtcctgtgtagccgcccacctcctgtcccggcctcgtgctcccgctggggactgtttgcggtgagtctgtcgcacgcacgtcagggccgaggc

SEQ ID NO: 54772 - DNA, 47 bp, Homo sapiens; identical to SEQ ID NO: 21205
  chr11:120435830-120435877
  hyper

SEQ ID NO: 54773 - DNA, 129 bp, Homo sapiens; identical to SEQ ID NO: 34099
  chr11:121298044-121298173
  hyper

SEQ ID NO: 54774 - DNA, 163 bp, Homo sapiens; identical to SEQ ID NO: 34100
  chr11:121593473-121593636
  hyper

SEQ ID NO: 54775 - DNA, 95 bp, Homo sapiens; identical to SEQ ID NO: 21207
  chr11:122847170-122847265
  hyper

SEQ ID NO: 54776 - DNA, 383 bp, Homo sapiens
  chr11:122847696-122848079
  hyper
aacagggacgggagaggatggaagcgccgcccagagaaggagggagtcgccttagtatttgagtcagagatgggactctggggatgggggatgggggcgagtgggaggttagtgacgagcagtgcacgagtctgtcctgaaactggacgttttaaagatcagattgtggttctatctggatctcggcggagcggaggccccagagacctggtccctttgcagccaaacggactgcccaagaacgggcaaggacttggcgtggagaggaaagaacagagctaggggcaagttgctgaaaggcgagggagaaaggggtctatgatcggagaaaacagagagccgagagctgaatttccagtctgggacgcggtacttgggctggt

SEQ ID NO: 54777 - DNA, 168 bp, Homo sapiens
  chr11:122848591-122848759
  hyper
gttttcacctgatttcggggagataaaaataaaatcatgtcattcctccaaatctgagccatcgctggggtttaggaaaatgggctgcagtccgttgatgaagtatccaagagcggtgatagcctcaactgctcataagttatcgccttaagccgaatgagaatcgaa

SEQ ID NO: 54778 - DNA, 261 bp, Homo sapiens
  chr11:122850163-122850424
  hyper
ccctgcagagagaagagcaaccaagtgggcagagcgtgggtcgccggagagcaatctccgctccgctcccctcccctcccctagcccccagtgccttcctccgcccctcgcctccgtcagtctgctcgccccaaagcccctcaagcctttctctcaggaatccagggcagaggaagaaaaaaaaaaaaagccgcaagaatagcgcttggagatctttatctggaaagtcatctagaaatacaaacaacaaacagtaaataa

SEQ ID NO: 54779 - DNA, 641 bp, Homo sapiens
  chr11:122850536-122851177
  hyper
tttgcaaacgtcaaatggcccaggagcagtcctgtccccagcccccacctatcctcctagacccctgatgacactcattgctgttctggggctggtagatgcatggatataatcttgcctccaaaccttactgaaaaatacctttctgtttcccaagccacccctatccccctgcagccaaagggagagcaaaactgccttatccggagaagccccggagccgaaacagaggagcatttctcgcctctcacgtctcctcgtccgtttcggggtcgcgctagggacccagctacctaatatagtcctcattctttttctcattctttccctctcactccaagcccagcgaagcagaagggtttgaggggtttttccatggccgggtccggggagacttgtctttcctgaccctcgcaggcttgactctgtctgagacgcaccaagcagagagaagctgccacaagcaacatcggccaatcccagagaaaataaacaaacataacaacaaccagtgcgggtacttagggctttggccactgctgtatgggaggaccaccggagcagctgagaatagattgtcaccggcgggtggtgaagccagtgcagagatgcggacctggatttacaaacacttttagctt

SEQ ID NO: 54780 - DNA, 55 bp, Homo sapiens
  chr11:122851209-122851264
  hyper
ctgtcttgcccccagcccctccaccgaccatggttgttgccgcctctgagctatg

SEQ ID NO: 54781 - DNA, 68 bp, Homo sapiens
  chr11:122852370-122852438
  hyper
gagattcatcttgagcggagcacctgccacaggacaagggccgggacgaagtggaggacgcaggcaga

SEQ ID NO: 54782 - DNA, 377 bp, Homo sapiens
  chr11:122852475-122852852
  hyper
gaggctcgaatctccgctgctctctcccgggcctgggctaccccgggcgctggagaggcaagaagacaagctcctgggtaggttgggtctctgtgttggagaattggcagcttggagaggggggccgggagagccaatgacgaggctgccagaggcagaggggagggtgcgggaggctcggggcggggcggggagctgtccgcggtgctgaacaccaccggccgagcctgggaacaacagagcccgcagggttcttgttcctaccaggtttctcgacctcaatttctgccccgtcactgcaggggctgctttgttcccagtcgtttttaaaagaaagccaaaaggaaaaagtctctgttgtccggcaaactcctctt

SEQ ID NO: 54783 - DNA, 93 bp, Homo sapiens; identical to SEQ ID NO: 21213
  chr11:122854915-122855008
  hyper

SEQ ID NO: 54784 - DNA, 5 bp, Homo sapiens
  chr11:122855043-122855048
  hyper
ggggc

SEQ ID NO: 54785 - DNA, 17 bp, Homo sapiens
  chr11:122855721-122855738
  hyper
cgcgggccccagggctg

SEQ ID NO: 54786 - DNA, 440 bp, Homo sapiens; identical to SEQ ID NO: 34109
  chr11:123065493-123065933
  hyper

SEQ ID NO: 54787 - DNA, 53 bp, Homo sapiens; identical to SEQ ID NO: 34110
  chr11:123066144-123066197
  hyper

SEQ ID NO: 54788 - DNA, 381 bp, Homo sapiens; identical to SEQ ID NO: 34111
  chr11:123172482-123172863
  hyper

SEQ ID NO: 54789 - DNA, 75 bp, Homo sapiens; identical to SEQ ID NO: 34112
  chr11:123172915-123172990
  hyper

SEQ ID NO: 54790 - DNA, 80 bp, Homo sapiens; identical to SEQ ID NO: 34113
  chr11:123228636-123228716
  hyper

SEQ ID NO: 54791 - DNA, 270 bp, Homo sapiens; identical to SEQ ID NO: 21219
  chr11:123228788-123229058
  hyper

SEQ ID NO: 54792 - DNA, 8 bp, Homo sapiens
  chr11:123229461-123229469
  hyper
cgcccgaa

SEQ ID NO: 54793 - DNA, 13 bp, Homo sapiens
  chr11:123300811-123300824
  hyper
cctttacttggag

SEQ ID NO: 54794 - DNA, 46 bp, Homo sapiens
  chr11:123302026-123302072
  hyper
atggtggcattcagcttccacgcgtgccacccgctccccaactcag

SEQ ID NO: 54795 - DNA, 30 bp, Homo sapiens; identical to SEQ ID NO: 34120
  chr11:123524569-123524599
  hyper

SEQ ID NO: 54796 - DNA, 150 bp, Homo sapiens; identical to SEQ ID NO: 34121
  chr11:123524827-123524977
  hyper

SEQ ID NO: 54797 - DNA, 61 bp, Homo sapiens; identical to SEQ ID NO: 34122
  chr11:123525412-123525473
  hyper

SEQ ID NO: 54798 - DNA, 20 bp, Homo sapiens
  chr11:124629399-124629419
  hyper
ctcggccctctgcctcggag

SEQ ID NO: 54799 - DNA, 15 bp, Homo sapiens
  chr11:124629499-124629514
  hyper
cgccctaggagagcc

SEQ ID NO: 54800 - DNA, 214 bp, Homo sapiens; identical to SEQ ID NO: 34125
  chr11:124631577-124631791
  hyper

SEQ ID NO: 54801 - DNA, 46 bp, Homo sapiens; identical to SEQ ID NO: 34126
  chr11:124709117-124709163
  hyper

SEQ ID NO: 54802 - DNA, 183 bp, Homo sapiens; identical to SEQ ID NO: 34127
  chr11:124709482-124709665
  hyper

SEQ ID NO: 54803 - DNA, 156 bp, Homo sapiens; identical to SEQ ID NO: 34128
  chr11:124712781-124712937
  hyper

SEQ ID NO: 54804 - DNA, 336 bp, Homo sapiens; identical to SEQ ID NO: 34129
  chr11:124713057-124713393
  hyper

SEQ ID NO: 54805 - DNA, 49 bp, Homo sapiens; identical to SEQ ID NO: 11053
  chr11:124735054-124735103
  hyper

SEQ ID NO: 54806 - DNA, 55 bp, Homo sapiens
  chr11:124735382-124735437
  hyper
ctgtggaggggcttacggctcccagcccacgggtctcagacccaggggctgggcc

SEQ ID NO: 54807 - DNA, 714 bp, Homo sapiens
  chr11:124735482-124736196
  hyper
tacctgctgaaaacgctgctgcagatgaacttgttcgcggactctctggccggggacatctccaactccagcgagctgctcttgggcttcaactcctcgctggcggcgctcaaccacaccctgctgcctcccggcgatccctctctcaacggtgagaccctgcctcttggggatatgggatcctgggatggggatgaggtgagagggcggcgtggaagggaaggagaagcgctcctgtcccgaggtccgggattgagtggcgcctcccagcgcctccctgggtcgtggggtctaagggataatttggagcttcgagcacatgagtgggggtacccgcgggaggtcgagggcttgggagaagatggctactgagtctttttacacctccttcccttcccctacaacgcccaccccaggtgagaagaaccgttgctggtaacgggcagggaagtccgagctaagaaaggcccgggcccagcgcagggagggcagaggagggggcacagtctcccgccggcctcggccaagccaggtcactcggtgacccacccaggcagctggtcttcggaaccccgaagtttcccaagaactcacttaggaccagaggaagccaaaatgctggatgtgtttgctacggaggggataggggcggcgatcattttaaggaaacttagaagtttgtctttcagcggcgggactctcagccggcccacc

SEQ ID NO: 54808 - DNA, 205 bp, Homo sapiens
  chr11:124736252-124736457
  hyper
cggtgattaataaatgactgggacagcgcgctctcccctagcgccgcggggaagctgcgggagccggccgccgccagcctgcggagaggccggagcgcgccccctgcctgccgcatcgggaacccccgctttaccgggcgctttcgcgtgtggttccctccaggtgcacgcggtccccatccctctgcctcgacccactcgagtc

SEQ ID NO: 54809 - DNA, 316 bp, Homo sapiens
  chr11:124738461-124738777
  hyper
gatccctctactaaccggcctgtctgtaggcatcttcctttgagacgaggaacgcggaacgtctgccaataaggacatattggatcctgcagagggagagggtaggcaggtggggactgagctccgcagagaagcataggagatggaacgaccagaggattctctttccctctggagcctcaatctctccccacaatttccctgtctgaacgctctgcgccaccccctgtccccagggtcaagggtaggaccggaggacgctatgccccgcatcgtggagcagccgccagatctgctggtctcccgaggcgagccc

SEQ ID NO: 54810 - DNA, 60 bp, Homo sapiens; identical to SEQ ID NO: 34133
  chr11:124739403-124739463
  hyper

SEQ ID NO: 54811 - DNA, 252 bp, Homo sapiens; identical to SEQ ID NO: 34134
  chr11:124933396-124933648
  hyper

SEQ ID NO: 54812 - DNA, 77 bp, Homo sapiens; identical to SEQ ID NO: 34135
  chr11:125034228-125034305
  hyper

SEQ ID NO: 54813 - DNA, 50 bp, Homo sapiens; identical to SEQ ID NO: 34136
  chr11:125034731-125034781
  hyper

SEQ ID NO: 54814 - DNA, 395 bp, Homo sapiens
  chr11:125035368-125035763
  hyper
tccagcggctggaggcgggagcggtcccaggctggggccaggtgaccggaggagtcgaggagccgcggccgcggcctggggaggcagggcgaatgagggtttgcagacggatcagtggagacaggggaacaccggcggggcccgggaagccaggatccgaggggctacacgcacggaccctcacccagggaggagcgagaatgtgtagggtcaccggctttccatgattgctggggatctttggtgaggcgggcgtaggggcccgcgcgaggcttgggaatcgggagcccttctggctcgagaactaggggatgagttcgtaaaagagggaactgaaagcgatcgagagcggagagctgagggggatggcgcaggatcccgaatctgccgctcaa

SEQ ID NO: 54815 - DNA, 129 bp, Homo sapiens
  chr11:125036208-125036337
  hyper
tgaaagtagttgatctgagccatggcaggcgagccccgaatttttgctgcttccccctgaaagtgtttctttaggaggagaggacttgggccacacaggacccggtcctaagagagcgattccgggaag

SEQ ID NO: 54816 - DNA, 30 bp, Homo sapiens; identical to SEQ ID NO: 34138
  chr11:125133214-125133244
  hyper

SEQ ID NO: 54817 - DNA, 584 bp, Homo sapiens; identical to SEQ ID NO: 34139
  chr11:125365065-125365649
  hyper

SEQ ID NO: 54818 - DNA, 583 bp, Homo sapiens; identical to SEQ ID NO: 34140
  chr11:125365709-125366292
  hyper

SEQ ID NO: 54819 - DNA, 327 bp, Homo sapiens; identical to SEQ ID NO: 34142
  chr11:125774122-125774449
  hyper

SEQ ID NO: 54820 - DNA, 15 bp, Homo sapiens
  chr11:125774480-125774495
  hyper
cgccaccgagccggg

SEQ ID NO: 54821 - DNA, 58 bp, Homo sapiens; identical to SEQ ID NO: 34144
  chr11:126226052-126226110
  hyper

SEQ ID NO: 54822 - DNA, 16 bp, Homo sapiens
  chr11:126870413-126870429
  hyper
gcagcgaaggaaagcc

SEQ ID NO: 54823 - DNA, 23 bp, Homo sapiens
  chr11:126870430-126870453
  hyper
gcggggtaacttggctgtggtta

SEQ ID NO: 54824 - DNA, 197 bp, Homo sapiens
  chr11:126870543-126870740
  hyper
gtggcttcggtctctttgtgcctctgggtatctgcagccagccgacacaaactgcctgttcttagccgcctcgggaagccgggattgtcagcaatgtccccactcggagaagatccattctctggctcttggcatcccaggcacacggcttcctcaggcgggctcctcccacagtgagcgagcgagctagtgacgag

SEQ ID NO: 54825 - DNA, 332 bp, Homo sapiens
  chr11:126873058-126873390
  hyper
aaaaggaccaggaggcgtatcaagcctgagtgccggaaaacccacggcaatcttcagcagccaccacgtggggcagagaacgcgagcagtacctgcaggacccacagccggtcgggctctggcgccagcctcgacggcggccccgccatctccgcccggctgcccgcggcctcacctcctccgggggctcggttagcctcctggcgctgcaaggctgcctgcgcgcggttcgctccgggggagggaggaggagggaggcggcgaggagccgacggctccacctgatggagaagcgcggagagtccctagacctcggagtgcgctgcaagagg

SEQ ID NO: 54826 - DNA, 307 bp, Homo sapiens
  chr11:126873515-126873822
  hyper
tggaaaaccgcccgaattctgggtttctgcacatccaggctggctccaggtctcttgtgcccaccgtgcaagccggcgggatgccagcaggtggcatcctctccagcgtttcttcgccaggcgtggagtccggaggccgaatccatcagtccccagccccctccccaagcctccggtgccaagtgctgggtcctgtgagcccctggcccgccccccacctccgccagcggggcgagccggagctgggtgacccagaccctcgcggaggcgggagcctacagaggatgccggccggccccaggttctg

SEQ ID NO: 54827 - DNA, 106 bp, Homo sapiens; identical to SEQ ID NO: 34150
  chr11:128556994-128557100
  hyper

SEQ ID NO: 54828 - DNA, 129 bp, Homo sapiens
  chr11:128562763-128562892
  hyper
aactggggcgcgcggcggcccaggagggaggcggggaggtctccgggttgggccggggaacgccggcctccaggctgggtagggaggacggtccagagcgcgggcctccgggtctcaccccgggaaaag

SEQ ID NO: 54829 - DNA, 90 bp, Homo sapiens
  chr11:128563730-128563820
  hyper
tgtgtgatgcgaaaagcaggaccagcaggggaggaagagggggtgtggggggggagggaagacgagggagagcagaggggagagaagaga

SEQ ID NO: 54830 - DNA, 60 bp, Homo sapiens
  chr11:128563880-128563940
  hyper
gagagagataggacttcctccccgattcgcaaagtgaagtcacttcccaaaattagctga

SEQ ID NO: 54831 - DNA, 67 bp, Homo sapiens; identical to SEQ ID NO: 21242
  chr11:128564329-128564396
  hyper

SEQ ID NO: 54832 - DNA, 89 bp, Homo sapiens
  chr11:128564651-128564740
  hyper
gtgggtaagtggcctcgttgcacgagggtaggggtgcaagtgagtgtgtcgggggatctatctgagcgggctcctccagatggaagccc

SEQ ID NO: 54833 - DNA, 154 bp, Homo sapiens
  chr11:128565379-128565533
  hyper
ggctcagcaagagaaggctaagatgttgggctcagagaattcaagagatttttatcttctgggtggggtcgtggtttttattttctaagttttttttatgaaagtttgaaatatgctgacttaggtaaaagacaccaaccgaaggaacttgcaa

SEQ ID NO: 54834 - DNA, 96 bp, Homo sapiens
  chr11:129242780-129242876
  hyper
gaagagagaaaacagaagcgggaaattcgacagaggaggagaggcccaaagggcggggagcaatgcggggaagggagaagtgggagggaagaagag

SEQ ID NO: 54835 - DNA, 97 bp, Homo sapiens
  chr11:129243587-129243684
  hyper
tcaaagacgcgttgcgggccttgtctaatgctaggctgtgacttggcctcttaacatctattttctcacgcctgtaatcccagcactttgggaggcg

SEQ ID NO: 54836 - DNA, 41 bp, Homo sapiens; identical to SEQ ID NO: 21246
  chr11:129244603-129244644
  hyper

SEQ ID NO: 54837 - DNA, 30 bp, Homo sapiens; identical to SEQ ID NO: 34161
  chr11:129245832-129245862
  hyper

SEQ ID NO: 54838 - DNA, 206 bp, Homo sapiens; identical to SEQ ID NO: 34162
  chr11:129565510-129565716
  hyper

SEQ ID NO: 54839 - DNA, 308 bp, Homo sapiens; identical to SEQ ID NO: 34163
  chr11:130297447-130297755
  hyper

SEQ ID NO: 54840 - DNA, 91 bp, Homo sapiens; identical to SEQ ID NO: 34164
  chr11:130298269-130298360
  hyper

SEQ ID NO: 54841 - DNA, 68 bp, Homo sapiens; identical to SEQ ID NO: 34165
  chr11:130318554-130318622
  hyper

SEQ ID NO: 54842 - DNA, 30 bp, Homo sapiens; identical to SEQ ID NO: 34166
  chr11:130319107-130319137
  hyper

SEQ ID NO: 54843 - DNA, 37 bp, Homo sapiens; identical to SEQ ID NO: 34167
  chr11:131558038-131558075
  hyper

SEQ ID NO: 54844 - DNA, 69 bp, Homo sapiens; identical to SEQ ID NO: 34168
  chr11:131780262-131780331
  hyper

SEQ ID NO: 54845 - DNA, 15 bp, Homo sapiens
  chr11:131781572-131781587
  hyper
tggtttgtatggggt

SEQ ID NO: 54846 - DNA, 252 bp, Homo sapiens
  chr11:132813949-132814201
  hyper
acctccgccgcgcccaccgggctggggatgcctgcggggatgagcccgcaccgcgcccacttcgctccgtcccgacacccgcgccagcggagagaacgcggcgcccctcgcagcggcttcccctacagaggggcggggtggggggagcggggagggagaggggagggcgggagagggagttctggggaaagcagcaaactgaaaactgacactggcaccttccctcgccgatgccagcgcagaagttgacaa

SEQ ID NO: 54847 - DNA, 34 bp, Homo sapiens
  chr11:132864175-132864209
  hyper
ctattaaaaagcccaggcgcgattttctaattaa

SEQ ID NO: 54848 - DNA, 79 bp, Homo sapiens
  chr11:132934044-132934123
  hyper
gagtgaggggtggagcggagcccagccgagggagggaaggagaggaacgccggcccactagccgaccccagcgcaaccc

SEQ ID NO: 54849 - DNA, 185 bp, Homo sapiens; identical to SEQ ID NO: 34175
  chr11:132934388-132934573
  hyper

SEQ ID NO: 54850 - DNA, 226 bp, Homo sapiens
  chr11:132952542-132952768
  hyper
gagtggcacagccctcggcacggcacggccctgtcagctacgaagccgggcgaggggctcaaggcccctctggagaccgcttctcccccgcggcccgtcccgccgctgcggaccccatgcgcggcctccccgccccggcgcctgggcctcctcgcggcccgggcggggcccaccaacccggagaggtcgccagcctgcagggtgccgggggcccctccgagccgac

SEQ ID NO: 54851 - DNA, 38 bp, Homo sapiens; identical to SEQ ID NO: 21251
  chr11:133402168-133402206
  hyper

SEQ ID NO: 54852 - DNA, 30 bp, Homo sapiens; identical to SEQ ID NO: 21252
  chr11:133402260-133402290
  hyper

SEQ ID NO: 54853 - DNA, 37 bp, Homo sapiens
  chr11:133825189-133825226
  hyper
gaagagttttaaaaccgtccggaccaacatgtcagtt

SEQ ID NO: 54854 - DNA, 160 bp, Homo sapiens
  chr11:133825543-133825703
  hyper
gctcacagtcctggcaccctccaggctccgctcccacttccatacaagggccgagagccgggggtgccacccagaggcttgtaggtcgctctgcccatctccaaagcaaaagcccgcgcgctcacgcacgcatcacccaactcggtggctccccccttgc

SEQ ID NO: 54855 - DNA, 622 bp, Homo sapiens; identical to SEQ ID NO: 34181
  chr11:133825704-133826326
  hyper

SEQ ID NO: 54856 - DNA, 619 bp, Homo sapiens; identical to SEQ ID NO: 34182
  chr11:133826744-133827363
  hyper

SEQ ID NO: 54857 - DNA, 38 bp, Homo sapiens
  chr11:133906745-133906783
  hyper
cgcccccacccccaccgccaagccgaaaacccaatcct

SEQ ID NO: 54858 - DNA, 50 bp, Homo sapiens
  chr11:133906918-133906968
  hyper
cctcgctgcagacggttcgccttgtccactcttctcgactcttctcgact

SEQ ID NO: 54859 - DNA, 16 bp, Homo sapiens
  chr11:133938772-133938788
  hyper
agagaacccatgtgcc

SEQ ID NO: 54860 - DNA, 213 bp, Homo sapiens; identical to SEQ ID NO: 21257
  chr11:133938789-133939002
  hyper

SEQ ID NO: 54861 - DNA, 260 bp, Homo sapiens
  chr11:133939177-133939437
  hyper
tcccgggccggaggggcggcgcgcgcccgcgtccccgcagccagggctgggactcgggcctggctagggcgggggccctgggacgcccggcagttggaccggggcggggagctaatttgggatggggggcccgtcccaggcagtgagtcggtcccggacagccgtcggaccccgggggcgggctcttctcgggcggggtcctgtgctgggcggtgggctcatcccccgggtgggctcctcccaggcggggtcctgtgctg

SEQ ID NO: 54862 - DNA, 50 bp, Homo sapiens; identical to SEQ ID NO: 34187
  chr11:133994694-133994744
  hyper

SEQ ID NO: 54863 - DNA, 229 bp, Homo sapiens
  chr11:134145474-134145703
  hyper
ctgtgttctttgcaacggaagaagcaaagacttcaaagggagaaatcggaagatttcttttttcatcgtagggacttcacatcagcgtttccaaaaccgagtccatcgccttttccctctgcgcagcctctatcccttcctgtgtttcgcatctcaataaacgtccccgccaagtgacttcagcctgaaacatgcggcctcccggactcctctctgtgtcaccgacctc

SEQ ID NO: 54864 - DNA, 34 bp, Homo sapiens; identical to SEQ ID NO: 21261
  chr11:134146393-134146427
  hyper

SEQ ID NO: 54865 - DNA, 232 bp, Homo sapiens; identical to SEQ ID NO: 1015
  chr11:134146444-134146676
  hyper

SEQ ID NO: 54866 - DNA, 5 bp, Homo sapiens
  chr11:134146677-134146682
  hyper
tcccg

SEQ ID NO: 54867 - DNA, 19 bp, Homo sapiens
  chr11:134146894-134146913
  hyper
ccagcggctgggcaccgtg

SEQ ID NO: 54868 - DNA, 23 bp, Homo sapiens
  chr11:134201818-134201841
  hyper
gccccagccaatgagcgccggcg

SEQ ID NO: 54869 - DNA, 70 bp, Homo sapiens
  chr11:134202084-134202154
  hyper
ccagccctccgcacctcgggttctctcctcccgcgacccgcgaatcccgagttcccggggggagcagccc

SEQ ID NO: 54870 - DNA, 134 bp, Homo sapiens
  chr11:134281509-134281643
  hyper
ccagcccgagctcggttctcggccccctttccagctgcccccagcgcgcgcagcgcacacacacacacacacacacacacacacacacaccccagcgcgcgcccgggaggacatggcgtgggcaccgatgggga

SEQ ID NO: 54871 - DNA, 71 bp, Homo sapiens; identical to SEQ ID NO: 34193
  chr11:134281706-134281777
  hyper

SEQ ID NO: 54872 - DNA, 70 bp, Homo sapiens; identical to SEQ ID NO: 11103
  chr11:134282862-134282932
  hyper

SEQ ID NO: 54873 - DNA, 221 bp, Homo sapiens; identical to SEQ ID NO: 34195
  chr12:298173-298394
  hyper

SEQ ID NO: 54874 - DNA, 75 bp, Homo sapiens
  chr12:570015-570090
  hyper
gacgctggcggagaccgggcccctccagccgctccgggcttgcggttcccggggaggaggtccgtggggtccacg

SEQ ID NO: 54875 - DNA, 42 bp, Homo sapiens
  chr12:570171-570213
  hyper
gcccaccgccttctgtttggctcactccgtttcctctcctgc

SEQ ID NO: 54876 - DNA, 68 bp, Homo sapiens; identical to SEQ ID NO: 34197
  chr12:1059279-1059347
  hyper

SEQ ID NO: 54877 - DNA, 102 bp, Homo sapiens
  chr12:1639033-1639135
  hyper
cgcgtagcaagaaagcggaggacataactctcttcccctctcagagcctcgggccccgcagacgccgaggtgggcgctcgtgccaggatcgcggggcgcggg

SEQ ID NO: 54878 - DNA, 160 bp, Homo sapiens
  chr12:1639222-1639382
  hyper
gggggcagcaggcgtgcggcgccgggagaagggggccgggcggcggagactccccgtccgcacccccgcggcgaggcccccgggccgctctgcttaggggccgagggagccgggcgggaggcaggtgcggaggtcgcggtcccagcgcctgggaggagcc

SEQ ID NO: 54879 - DNA, 30 bp, Homo sapiens; identical to SEQ ID NO: 34199
  chr12:1906030-1906060
  hyper

SEQ ID NO: 54880 - DNA, 556 bp, Homo sapiens; identical to SEQ ID NO: 34200
  chr12:2161498-2162054
  hyper

SEQ ID NO: 54881 - DNA, 487 bp, Homo sapiens
  chr12:2162067-2162554
  hyper
cgggcgggcggcgcgggcaggggcgggcgcgggcgcggcggggctgggccggggggagtgagcgcggcgctctcgcgcgcccggtgtctccctctcgctgcctctgcagaaacagctcctgccagagcggcgctcggcgcggcgcggcgggcccggagcggcggcggcggctcttcctgcctccgcgcccaggagttgccggctccctttgacagcagagagccgggcaggggcctcaggaggactcgctgggagtgggcagaggcgcctcggcccctgccggcccaggcgggccccgcgcgccccccgcccctcctctccgcctcttctcgccctgcctctcccgatttattttttcaaatggtgtagccgccggaggtgcggtgctcagttcttggaaggggcccggatgtactgaggatgcgttacagtttcactcgaggaggcagtagtggaaaggagcagtttttggggtttgatgccataa

SEQ ID NO: 54882 - DNA, 347 bp, Homo sapiens
  chr12:2162817-2163164
  hyper
tttccaccgggttcctgccctacccgcgctccccgcggccccggggccggtccctgcggagtggcccggggccgcgtccgcgaggggcgcctccgcctcgtcggagcgcccgggagcccggcgggaccggggcccgaaccgccgcgcgagacggagcggaaaattcccgcccctccccctccgggccccagcttctccagagcatgtgtttcctgtgaaattccaggcgaggggggaaaagttccccaagtggctgccgccgcctcgctttctcgcgtccgcctggagagcccggctgcctggccagccgcgcggggggcagagggcgccggcgccgcggagcccag

SEQ ID NO: 54883 - DNA, 234 bp, Homo sapiens; identical to SEQ ID NO: 21275
  chr12:2163276-2163510
  hyper

SEQ ID NO: 54884 - DNA, 63 bp, Homo sapiens; identical to SEQ ID NO: 34202
  chr12:2800100-2800163
  hyper

SEQ ID NO: 54885 - DNA, 327 bp, Homo sapiens
  chr12:2861741-2862068
  hyper
ccatctgctcctccccgctcactcaggtctcctgctcaggacgcccttgccgagggcgcggggcatttgtactgaagaagggctgcaggagagtcggtgacccctccttctacttgtatgtagcggccccaagtgtcccgggagctggtggggcgcttgggctgtatgagcccggccgccaggaggctggggctgcgtcaggagctgtccgtggtgcttaagcggcgtctgctcgggcgcggggtgtggcgcggcgggtgagcgctgtccctggtcctggagaggttcctggcccccagtggcaacggtgagagcagtggcccagaa

SEQ ID NO: 54886 - DNA, 324 bp, Homo sapiens; identical to SEQ ID NO: 34204
  chr12:2862267-2862591
  hyper

SEQ ID NO: 54887 - DNA, 405 bp, Homo sapiens; identical to SEQ ID NO: 34205
  chr12:3474894-3475299
  hyper

SEQ ID NO: 54888 - DNA, 62 bp, Homo sapiens; identical to SEQ ID NO: 34206
  chr12:3475605-3475667
  hyper

SEQ ID NO: 54889 - DNA, 256 bp, Homo sapiens; identical to SEQ ID NO: 34207
  chr12:3599973-3600229
  hyper

SEQ ID NO: 54890 - DNA, 85 bp, Homo sapiens; identical to SEQ ID NO: 21281
  chr12:3600230-3600315
  hyper

SEQ ID NO: 54891 - DNA, 15 bp, Homo sapiens
  chr12:3600768-3600783
  hyper
tcaccaaacccttgc

SEQ ID NO: 54892 - DNA, 8 bp, Homo sapiens
  chr12:3600974-3600982
  hyper
cgctcgct

SEQ ID NO: 54893 - DNA, 214 bp, Homo sapiens; identical to SEQ ID NO: 34211
  chr12:3601042-3601256
  hyper

SEQ ID NO: 54894 - DNA, 62 bp, Homo sapiens; identical to SEQ ID NO: 34212
  chr12:3601510-3601572
  hyper

SEQ ID NO: 54895 - DNA, 249 bp, Homo sapiens
  chr12:3602021-3602270
  hyper
gtctggtggggctgccgcacatttcacatatggttacccatatgcagcggggggcggggatgggggtgtggcgcggggattgtccctctgtcttgccggaatgcaaaaaggtagagagacccttcctggtcttcttccctcgagttcttaactctgcgctaaaacccctaccccacggcgtaggcagcaaagctttataaatcccccttctctgagagactagaagcagcatgcatctgacaattgtca

SEQ ID NO: 54896 - DNA, 329 bp, Homo sapiens; identical to SEQ ID NO: 34215
  chr12:4140405-4140734
  hyper

SEQ ID NO: 54897 - DNA, 53 bp, Homo sapiens
  chr12:4274001-4274054
  hyper
cgtccgccccggggagagctggaaggtgggcccggatctcccacatcactatg

SEQ ID NO: 54898 - DNA, 83 bp, Homo sapiens; identical to SEQ ID NO: 21285
  chr12:4274188-4274271
  hyper

SEQ ID NO: 54899 - DNA, 11 bp, Homo sapiens
  chr12:4274409-4274420
  hyper
acacatacact

SEQ ID NO: 54900 - DNA, 271 bp, Homo sapiens; identical to SEQ ID NO: 21286
  chr12:4377981-4378252
  hyper

SEQ ID NO: 54901 - DNA, 228 bp, Homo sapiens
  chr12:4378330-4378558
  hyper
agtagaaaaaataaactgcttgggggtggaagatggcgaggggcggggggcggggagggaggcgggtcgcggcgctggctccggggtccgcggcacggcctcctctgccgcgctgcccagggcccggaccctgcccggcgctgcgcccaccgcgagggtgccagacccgccgcgccgccgccgcgctctcccagccgcggccccctcccccgccgcttcctcttgctc

SEQ ID NO: 54902 - DNA, 555 bp, Homo sapiens
  chr12:4378802-4379357
  hyper
ttccagagctattttcggccgcgtgaggcgtgtcctaagctgaatcagacaggaagagggggaagttcgggtcttttaattttttttttttccgaagggaggggagtgagatgctaggtgggtgacagacggcaggcgctcgccttcttaactcacgcctgtcgcatctgccgcctcagtaatccagccccgtccaagccgaaattcgccgaagggagtgcggatgcacaggcctggcggactctgcccccctccagaacgcagcggcccagcgccccggcgggcgcggctgcgaccagagggtcccggaagcgagtgaacacctgcaatcgcactgcccgtccccacccaccctgctcccccgtgctctccgcttcccgacgttttcctcttctccttgtccgcatttttctactttgcctgcactccctccttcctcttgatgtgcctcctatgtgtcccctcggatttatgtgtcccctcgcattttgccagtcgggttttcggttttgattgaccgtccatccctccacggagaaacacaaacacagctcc

SEQ ID NO: 54903 - DNA, 429 bp, Homo sapiens
  chr12:4379491-4379920
  hyper
ttgagccgaccgcggaatcacctggctgggaggcatcctccaggtaagcttgggagtatgtgtgcttagtgctgcaggctcctgcagaaaagtgcctataaacacccaacaccctgctgcaccctccacctccaggctttgtacactttccaaccgaaactccaaaacgctagcgtagagggtggggagccggccggaaaaagaataaaagtccaataaaactggcgttcgctaaagtttatcaccagtcctacatgggatatatatatatgtatttttttttccgtgaagggtgaaaaggagataaggaagaaccaacaatctaccccctcccgccgccccccacccccgcgccacggtgatcagtttggacttcaaagccagagcacaggctcttgcgctttttcttgaaaccgaagtctacactga

SEQ ID NO: 54904 - DNA, 30 bp, Homo sapiens; identical to SEQ ID NO: 34219
  chr12:4380166-4380196
  hyper

SEQ ID NO: 54905 - DNA, 139 bp, Homo sapiens; identical to SEQ ID NO: 34220
  chr12:4380525-4380664
  hyper

SEQ ID NO: 54906 - DNA, 41 bp, Homo sapiens; identical to SEQ ID NO: 34221
  chr12:4380888-4380929
  hyper

SEQ ID NO: 54907 - DNA, 268 bp, Homo sapiens
  chr12:4383224-4383492
  hyper
gaggtggacccggtccgcagggccgtgcgggaccgcaacctgctccgagacgaccgcgtcctgcagaacctgctcaccatcgaggagcgctaccttccgcagtgctcctacttcaagtgcgtgcagaaggacatccaaccctacatgcgcagaatggtggccacctggatgctggaggtaggtcggggggtggcgctcgccaggagccaggacccctccggatgctcgggtccccggccggagccctaaacctgggagagggcaatcc

SEQ ID NO: 54908 - DNA, 242 bp, Homo sapiens
  chr12:4383784-4384026
  hyper
aaaggcaaccccccccaaaaggccagagcaaattcgtcttggcctcaggtccccgcctgtggtcgcgactccgcgctggcacttcaccggggaggtggagggaggagggagaaggagagaaacggggaattcgggagccccggaagtcccattgaagaaacgcgtgtttcaggggaacccaaaagaaccgcttcttgcccctcactccaagtctttgcccagcgagccgtgtgcccacgtat

SEQ ID NO: 54909 - DNA, 83 bp, Homo sapiens; identical to SEQ ID NO: 21291
  chr12:5017990-5018073
  hyper

SEQ ID NO: 54910 - DNA, 106 bp, Homo sapiens; identical to SEQ ID NO: 21292
  chr12:5018692-5018798
  hyper

SEQ ID NO: 54911 - DNA, 6 bp, Homo sapiens
  chr12:5018799-5018805
  hyper
cgagcc

SEQ ID NO: 54912 - DNA, 229 bp, Homo sapiens; identical to SEQ ID NO: 1020
  chr12:5018806-5019035
  hyper

SEQ ID NO: 54913 - DNA, 124 bp, Homo sapiens
  chr12:5152915-5153039
  hyper
taggggccccagctgcgccctccggggagacacccgctgccacgagacccgggaggggaagcgggaggagggggagaggaggggaaggcgggggaggcgccgagggtggaggccaagcgcggcg

SEQ ID NO: 54914 - DNA, 12 bp, Homo sapiens
  chr12:5541088-5541100
  hyper
aaatgacccctt

SEQ ID NO: 54915 - DNA, 13 bp, Homo sapiens
  chr12:5541177-5541190
  hyper
ggggagggcggcg

SEQ ID NO: 54916 - DNA, 205 bp, Homo sapiens; identical to SEQ ID NO: 34232
  chr12:5541504-5541709
  hyper

SEQ ID NO: 54917 - DNA, 310 bp, Homo sapiens
  chr12:5542015-5542325
  hyper
tggcagacagaactccgggcggggaggtgccgcggcagctcccctgcacacgccctgcactctgccggccgctgagcctgattctcagctcgccccagcaccactctggcccgggcgtgggctggggggaggggacgcgcagctcaggacccggaacctcgcgttccagttttgggagttgggactcactgccacgcgccgcgtacctgcgttggagttccccgaaagggttttttcagaaaagacctcgcgccccgggctcctcttggccagcgcccacccggtggccaccccaccctgggcctttgcg

SEQ ID NO: 54918 - DNA, 320 bp, Homo sapiens; identical to SEQ ID NO: 21298
  chr12:5542439-5542759
  hyper

SEQ ID NO: 54919 - DNA, 116 bp, Homo sapiens; identical to SEQ ID NO: 34234
  chr12:6444922-6445038
  hyper

SEQ ID NO: 54920 - DNA, 30 bp, Homo sapiens; identical to SEQ ID NO: 34235
  chr12:6450544-6450574
  hyper

SEQ ID NO: 54921 - DNA, 90 bp, Homo sapiens; identical to SEQ ID NO: 34236
  chr12:6472461-6472551
  hyper

SEQ ID NO: 54922 - DNA, 46 bp, Homo sapiens; identical to SEQ ID NO: 34237
  chr12:6472854-6472900
  hyper

SEQ ID NO: 54923 - DNA, 138 bp, Homo sapiens; identical to SEQ ID NO: 21299
  chr12:6664370-6664508
  hyper

SEQ ID NO: 54924 - DNA, 65 bp, Homo sapiens; identical to SEQ ID NO: 34239
  chr12:6809448-6809513
  hyper

SEQ ID NO: 54925 - DNA, 30 bp, Homo sapiens; identical to SEQ ID NO: 34240
  chr12:8088887-8088917
  hyper

SEQ ID NO: 54926 - DNA, 386 bp, Homo sapiens; identical to SEQ ID NO: 34241
  chr12:8123142-8123528
  hyper

SEQ ID NO: 54927 - DNA, 66 bp, Homo sapiens
  chr12:8171294-8171360
  hyper
aatctggccccaggccgccgccgccgcgcccggcagtgacagcgaccgcgccgctgcgctcccgcc

SEQ ID NO: 54928 - DNA, 141 bp, Homo sapiens
  chr12:8171745-8171886
  hyper
ctgcggcagggaggtggtgccccggctatcgccgcgggctggccggctgggctgggaagaaggctcagggtgagatcaggcaaagagttctttcggactcacgagctctttttggatgaaaagccccgcagttctctccac

SEQ ID NO: 54929 - DNA, 92 bp, Homo sapiens; identical to SEQ ID NO: 34243
  chr12:8548890-8548982
  hyper

SEQ ID NO: 54930 - DNA, 160 bp, Homo sapiens; identical to SEQ ID NO: 34244
  chr12:10306356-10306516
  hyper

SEQ ID NO: 54931 - DNA, 279 bp, Homo sapiens; identical to SEQ ID NO: 34245
  chr12:11653509-11653788
  hyper

SEQ ID NO: 54932 - DNA, 30 bp, Homo sapiens; identical to SEQ ID NO: 11139
  chr12:12869188-12869218
  hyper

SEQ ID NO: 54933 - DNA, 43 bp, Homo sapiens; identical to SEQ ID NO: 34247
  chr12:13069440-13069483
  hyper

SEQ ID NO: 54934 - DNA, 208 bp, Homo sapiens; identical to SEQ ID NO: 34248
  chr12:13154576-13154784
  hyper

SEQ ID NO: 54935 - DNA, 51 bp, Homo sapiens; identical to SEQ ID NO: 34249
  chr12:13431314-13431365
  hyper

SEQ ID NO: 54936 - DNA, 30 bp, Homo sapiens; identical to SEQ ID NO: 34250
  chr12:14133113-14133143
  hyper

SEQ ID NO: 54937 - DNA, 30 bp, Homo sapiens; identical to SEQ ID NO: 34251
  chr12:14133343-14133373
  hyper

SEQ ID NO: 54938 - DNA, 32 bp, Homo sapiens
  chr12:14133587-14133619
  hyper
gaagggggggagaagcggcaccatacagcaac

SEQ ID NO: 54939 - DNA, 1230 bp, Homo sapiens
  chr12:14133881-14135111
  hyper
ccccgcgcacactcacccccgcgcacactcacgctgccgccgcgctgaggtgcagcgcacggggcttcacctgcaacgtgtcgattggacggatgggctcggcgcgtgggtccggcccggggcgccgctgccctgcccctctgctaggtgaagggatgaaaccccccaaaagaccagagacagccctacccagtcacagcaccccctcccccacaaaaaaaaaaaacctttaaaaaagccacgtccaaattagcaagtgccgggttctgctggatttcagagctttacctcatgccagattcgttcacgatttcacggcttcgaccctttatctgcctgacacccccaaacccctacattcaaaggagagactccaaagcccatctttacgtaccggctccgagcgcctccgcggttgcagtctgcggagaggggtggccggtggctgggaatggagggttttcctttcctgcaaagcaggattaatgatccgtctcgggggttttgaagttcatgactcttctttgcaaggcaaaaggatatgcattcggacgccagcactactggatggtggtgatcaagaatcacccttgacgagcactctcgatagagcgaagccccgagatttcctagaggtgaagaagccggaggaagtggtttttgaaagggggtggggggaaccttcctttctcaaaaagaggtggggggtggagaggcaggagcccagattccagttggtgaggatcggagccgggggaagggaagcgggcgggggcaggctgtgcaagtcaaccgcgcggcagccggagagggagagcaggaggggaggaggggagcgtcagaaaaatgggtattaatcaccggggacggggggaggcgcggggaacgcaggttgcctggtctggatttgggtctcacactcaaaaacgtgccgcgcacacacacacagacacacacacaccccctacctcgcacaccctgactccggggggaggagaaacccacgaagctggggaagatactgcttctgctcccaggggcgggtgtgagcgcgcgtgtcctctttctccacaccccccaccccaccccacccccaagcccctgcaccccctcactcctcttgctaagactctggcggaggcagcttcccacgtcatgtgctggggaagtggggtggtaaggtggatggaagggggacggaagggggaagaagcttagcccgagtccgtg

SEQ ID NO: 54940 - DNA, 333 bp, Homo sapiens; identical to SEQ ID NO: 34253
  chr12:14927056-14927389
  hyper

SEQ ID NO: 54941 - DNA, 83 bp, Homo sapiens; identical to SEQ ID NO: 34254
  chr12:14927697-14927780
  hyper

SEQ ID NO: 54942 - DNA, 30 bp, Homo sapiens; identical to SEQ ID NO: 34255
  chr12:14928130-14928160
  hyper

SEQ ID NO: 54943 - DNA, 59 bp, Homo sapiens
  chr12:15374199-15374258
  hyper
agccctcccacactgcgcagcccaggcttcaggttgcgtttgcgagttgctgggctgcg

SEQ ID NO: 54944 - DNA, 236 bp, Homo sapiens
  chr12:15374291-15374527
  hyper
cagtggcccggcgggggtctcctcactcgcgctcgctccgactagcggcggagggactgcggcaggacgcgagctgagcccggccaaggccgctgcgctcagcggccaggatgctgcagtgcggcgcttcggcgccccctactgggggcaggggcaggctcctcccgccgcgctgcctcccaggcttgcgagcttgggtctttaacgtgctgcacccaagacgggcttcccttttt

SEQ ID NO: 54945 - DNA, 70 bp, Homo sapiens; identical to SEQ ID NO: 34257
  chr12:15475751-15475821
  hyper

SEQ ID NO: 54946 - DNA, 41 bp, Homo sapiens; identical to SEQ ID NO: 34258
  chr12:16500483-16500524
  hyper

SEQ ID NO: 54947 - DNA, 119 bp, Homo sapiens; identical to SEQ ID NO: 34259
  chr12:16757916-16758035
  hyper

SEQ ID NO: 54948 - DNA, 30 bp, Homo sapiens; identical to SEQ ID NO: 34260
  chr12:16758398-16758428
  hyper

SEQ ID NO: 54949 - DNA, 89 bp, Homo sapiens; identical to SEQ ID NO: 34261
  chr12:20521231-20521320
  hyper

SEQ ID NO: 54950 - DNA, 110 bp, Homo sapiens
  chr12:20522347-20522457
  hyper
cgtggctgctggggagacctggtgctgcagccgctccggagctctcggaaactttcctccgcgctgtgcgcgggctccctgtcctttctgctggcgctgctggtgaggct

SEQ ID NO: 54951 - DNA, 282 bp, Homo sapiens
  chr12:20522487-20522769
  hyper
gcagtgtaaggaggcggcggcggcggaggaggaggaagcagccccgggagcagaagggggcgtcttcccggggcctcggggaggtgctcccgggggcggtgcgcggctcagcccctggctgcagccctcggcgctgctcttcagtctcctgtgtgccttcttctggatgggcttgtacctcctgcgcgccggggtgcgcctgcctctggctgtcgcgctgctggccgcctgctgcgggggggaagcgctcgtccagattgggctgggcgtcggggaggatca

SEQ ID NO: 54952 - DNA, 337 bp, Homo sapiens; identical to SEQ ID NO: 21315
  chr12:21680683-21681020
  hyper

SEQ ID NO: 54953 - DNA, 106 bp, Homo sapiens
  chr12:21810868-21810974
  hyper
ggctcgctcaatccccttcaaggacaagggctcaagtatgcacactccctcccccaccctccagatgaggaggtctccttccagaggcttccgctctcagctggtc

SEQ ID NO: 54954 - DNA, 208 bp, Homo sapiens; identical to SEQ ID NO: 34266
  chr12:21927174-21927382
  hyper

SEQ ID NO: 54955 - DNA, 30 bp, Homo sapiens; identical to SEQ ID NO: 34267
  chr12:21927596-21927626
  hyper

SEQ ID NO: 54956 - DNA, 45 bp, Homo sapiens; identical to SEQ ID NO: 34268
  chr12:21927907-21927952
  hyper

SEQ ID NO: 54957 - DNA, 34 bp, Homo sapiens; identical to SEQ ID NO: 34269
  chr12:21928417-21928451
  hyper

SEQ ID NO: 54958 - DNA, 238 bp, Homo sapiens; identical to SEQ ID NO: 21318
  chr12:22094810-22095048
  hyper

SEQ ID NO: 54959 - DNA, 794 bp, Homo sapiens
  chr12:22487473-22488267
  hyper
cggcgagtcgctcccgccggttctgcagcatcacggtcgccctcggcgagggtccgggagaaggctcggctccctcctaaacatgtggcccgtggcgtccccttgtcccctccgagcgatgctcctgcgcccttcgccgcctcccgcgctgctgcgccgccaggcaacccccccccccccaccccgccccgagacgcgctctctgcgccgcaccaagtccttggaaatttccacggcggcccgggaccgctatcctgccccgggctcctccgcctcgcccgccgggaccctcgctccccacccctcccggagaagaaaagaactcgctctcatcagttaattcagcggcgcgccgcagccttccgctgcgccccggacttcgcagacaaacgcccggggattggtggaaatcaaggtctccccctccctcccccacccgcaaaattgcctccttcgacccgatccgagccgcgacactcgcccagagcgcgcacccctcactcgtgcccttgttctttggagataacggcagacaataaaaaccaacagccccccgccaatagaaatatatcagtccctgagtgtggcggagactggctaatatcctgatccttcgacaagcggccggtgtgcccaggctgtcaccctgctgccgtcaccctagtctttctctagctggttggatattaacccgcagccaggcgcgaggaggctggcggagatttattccttcctgggcccccacccccattagccggtcccggagccgcggcccgtgtgtgtgcgcgcgcgcc

SEQ ID NO: 54960 - DNA, 340 bp, Homo sapiens; identical to SEQ ID NO: 34276
  chr12:22488339-22488679
  hyper

SEQ ID NO: 54961 - DNA, 273 bp, Homo sapiens
  chr12:24714636-24714909
  hyper
ttgtttcagaaattccgggcgggagggagggggagtggtagggagaaggattgcagaaagcgaaacaaaaagacgaaagagtcgggaggtgggggtgactaaggttagggggtgggccaggggtcgctctgatatcctagaagggttaaggggctttgtccaacttttagggtctggccttggacattggccgcgatgcccagcacagcccagggttctccccgcactctcctctcgcatcaaccacctccaccgccaccacttacaaaacaa

SEQ ID NO: 54962 - DNA, 77 bp, Homo sapiens
  chr12:24715158-24715235
  hyper
gctgagtggcgggcccggcgagcggcagaggggagctctgcgccttggaggtctgcccacaacaacatcgggacgaa

SEQ ID NO: 54963 - DNA, 119 bp, Homo sapiens
  chr12:24715264-24715383
  hyper
accttacccggtctcgttaatgcctcctccggcgtgggatgcaaagtggcacagaggcgggctgggggcccccgggaggagactggagatgggttttggtggctcgcctttttcactct

SEQ ID NO: 54964 - DNA, 276 bp, Homo sapiens
  chr12:24715757-24716033
  hyper
ctccttcttgcagctcgccgcccggccgccctctctatccatccgaagggaaggagccccagagttttcttccccgtctgctgcagagtaactagattgtaaataacgcggcgattacccacaccgtgcaggaattttttttttatctgccctccacttaaaggagcgataaaaatgaaatggcaggagtggaaggagccagggagagcgggatatctctagatctcgatggagctcgcatctataaatacgcattcatgtttagtcaagtccctt

SEQ ID NO: 54965 - DNA, 199 bp, Homo sapiens; identical to SEQ ID NO: 21324
  chr12:24716218-24716417
  hyper

SEQ ID NO: 54966 - DNA, 51 bp, Homo sapiens
  chr12:25056436-25056487
  hyper
gccactgaccgctatgtgcaaactgaagggggagaacgtgaatccagcttt

SEQ ID NO: 54967 - DNA, 217 bp, Homo sapiens
  chr12:25101375-25101592
  hyper
taacagtgaaaagatcgttctccctcccctctccacccgggtcaactcttccagccgctccctcctgcatcacgaacacacgctgcaggaaagcgcatttacagcccgggacatccccagacctcctctccaaaattccccacctcctgtgcataggagaaactgagagaagccctcacttcctttccaaacttcacaagcaggggagggagctgta

SEQ ID NO: 54968 - DNA, 259 bp, Homo sapiens; identical to SEQ ID NO: 21326
  chr12:25101660-25101919
  hyper

SEQ ID NO: 54969 - DNA, 57 bp, Homo sapiens; identical to SEQ ID NO: 34284
  chr12:26348245-26348302
  hyper

SEQ ID NO: 54970 - DNA, 219 bp, Homo sapiens; identical to SEQ ID NO: 11168
  chr12:28122168-28122387
  hyper

SEQ ID NO: 54971 - DNA, 35 bp, Homo sapiens; identical to SEQ ID NO: 34286
  chr12:28123589-28123624
  hyper

SEQ ID NO: 54972 - DNA, 119 bp, Homo sapiens
  chr12:28127648-28127767
  hyper
ctgccctggtgtttgcgctcccactgcagcaagggaggcctgagtctcttagggcaggggtccagggtcttgggagaggccttagggcaagggggatgatctttttcagcctcccctcc

SEQ ID NO: 54973 - DNA, 6 bp, Homo sapiens
  chr12:28128302-28128308
  hyper
ccccgt

SEQ ID NO: 54974 - DNA, 114 bp, Homo sapiens
  chr12:29935902-29936016
  hyper
cgtctcatctgaacgaaacccttaaggggctgatacacttctcatctgcaaagctgcccaacagcctccgagaaattctctacttggaagcatcgccaccaccgccacccctcc

SEQ ID NO: 54975 - DNA, 275 bp, Homo sapiens
  chr12:29936048-29936323
  hyper
gtcacgatccggcaggcgaaggggtgcggaggcggtttcaccagcccgctcccagccctgcctcgagagagaagcccgctgagagggcagacagttgagaaactcgatcccaactccccagccggcgcctcccgaaccgccccgagagcccagattagccgggcagtggatcccggagcaaagtgccatgcacatcctggagaggagggaggcgtggagggaaagggcggcaaaaatgaaatgcccccaagtcagtcccgcaacttctcccggtc

SEQ ID NO: 54976 - DNA, 336 bp, Homo sapiens
  chr12:29936995-29937331
  hyper
ggcgccctctgcccccggcccgccttgcttgcaggtggaccggggttcgcggcgcgcggctgcccgggagctgcggggaaggacaccccaggttcccacttgcggtgtccggctgtgctcacccccacgcccccgcccccatccttctcccccgaatggggctgggaaggggcacatctggcggacccctcccgggggacccaggagggtttagcaggtgcgcagtctggaacccccacacccaccttccagggagaaaagtgccgctgcttcccgggaagttcccggcttttcagcacccgggacaacagcagcggcgcccggagagacgctctc

SEQ ID NO: 54977 - DNA, 28 bp, Homo sapiens
  chr12:29937374-29937402
  hyper
ctgcccgggctttctctcacccgcccgg

SEQ ID NO: 54978 - DNA, 5 bp, Homo sapiens
  chr12:30322769-30322774
  hyper
acgtc

SEQ ID NO: 54979 - DNA, 9 bp, Homo sapiens
  chr12:30323517-30323526
  hyper
cttctgccc

SEQ ID NO: 54980 - DNA, 68 bp, Homo sapiens; identical to SEQ ID NO: 34295
  chr12:30354049-30354117
  hyper

SEQ ID NO: 54981 - DNA, 15 bp, Homo sapiens
  chr12:30975310-30975325
  hyper
cacaaaacaaaagag

SEQ ID NO: 54982 - DNA, 184 bp, Homo sapiens; identical to SEQ ID NO: 21331
  chr12:30975388-30975572
  hyper

SEQ ID NO: 54983 - DNA, 10 bp, Homo sapiens
  chr12:31079258-31079268
  hyper
gcagggagac

SEQ ID NO: 54984 - DNA, 165 bp, Homo sapiens; identical to SEQ ID NO: 21332
  chr12:31079499-31079664
  hyper

SEQ ID NO: 54985 - DNA, 117 bp, Homo sapiens; identical to SEQ ID NO: 3868
  chr12:31079693-31079810
  hyper

SEQ ID NO: 54986 - DNA, 30 bp, Homo sapiens; identical to SEQ ID NO: 34301
  chr12:33048755-33048785
  hyper

SEQ ID NO: 54987 - DNA, 64 bp, Homo sapiens; identical to SEQ ID NO: 34302
  chr12:33049326-33049390
  hyper

SEQ ID NO: 54988 - DNA, 209 bp, Homo sapiens
  chr12:33591804-33592013
  hyper
ccacctctgcaagggagttctgcgtccaagcatggcttgtccgtcccgcctggcccccatcaacaaggccgggaccagcggccggtggaacgagcgagagcagccctagtcccacaggtgagccgcccccacaagcagccaagccgcgagccgtcccggcgccgtcaccgcccgcactcacttctccactccgggagggagatgggagg

SEQ ID NO: 54989 - DNA, 28 bp, Homo sapiens
  chr12:33592057-33592085
  hyper
cggcgccgggaggcgggaagcggaccag

SEQ ID NO: 54990 - DNA, 35 bp, Homo sapiens
  chr12:33592578-33592613
  hyper
tgcgccgctgagagccggcaactcttaggagcccc

SEQ ID NO: 54991 - DNA, 102 bp, Homo sapiens; identical to SEQ ID NO: 34307
  chr12:33592932-33593034
  hyper

SEQ ID NO: 54992 - DNA, 40 bp, Homo sapiens; identical to SEQ ID NO: 11185
  chr12:33593092-33593132
  hyper

SEQ ID NO: 54993 - DNA, 66 bp, Homo sapiens; identical to SEQ ID NO: 34309
  chr12:39298564-39298630
  hyper

SEQ ID NO: 54994 - DNA, 82 bp, Homo sapiens; identical to SEQ ID NO: 21338
  chr12:39299560-39299642
  hyper

SEQ ID NO: 54995 - DNA, 111 bp, Homo sapiens; identical to SEQ ID NO: 34311
  chr12:39299877-39299988
  hyper

SEQ ID NO: 54996 - DNA, 30 bp, Homo sapiens; identical to SEQ ID NO: 11188
  chr12:39300375-39300405
  hyper

SEQ ID NO: 54997 - DNA, 32 bp, Homo sapiens; identical to SEQ ID NO: 34313
  chr12:39539440-39539472
  hyper

SEQ ID NO: 54998 - DNA, 225 bp, Homo sapiens
  chr12:40618470-40618695
  hyper
cagtttcttcccgcgcgactcccggccgcgccgccgctgcggtggaatctggtcccaggaggcggcgtccgcccggggtccggtctaggcgtgcgtgggggccacggtcacggtcatcccagccaggcccggctccagcagccccacggccgccgccagagttctgcgcggcccgtcgcctcggcggagcctctggcaggcccctgagctcgtttttggggcctg

SEQ ID NO: 54999 - DNA, 30 bp, Homo sapiens; identical to SEQ ID NO: 34315
  chr12:40619018-40619048
  hyper

SEQ ID NO: 55000 - DNA, 1 bp, Homo sapiens
  chr12:41086182-41086183
  hyper
t

SEQ ID NO: 55001 - DNA, 86 bp, Homo sapiens
  chr12:41582427-41582513
  hyper
gcccttggcgcccggcgagctgtaccgggtgctgccgctgcgcagcctcatccagaagctgcgagtccagtgcgactaccgcgccc

SEQ ID NO: 55002 - DNA, 241 bp, Homo sapiens; identical to SEQ ID NO: 11193
  chr12:41583049-41583290
  hyper

SEQ ID NO: 55003 - DNA, 35 bp, Homo sapiens; identical to SEQ ID NO: 34320
  chr12:42326337-42326372
  hyper

SEQ ID NO: 55004 - DNA, 74 bp, Homo sapiens; identical to SEQ ID NO: 34321
  chr12:42326647-42326721
  hyper

SEQ ID NO: 55005 - DNA, 559 bp, Homo sapiens; identical to SEQ ID NO: 34322
  chr12:42983315-42983874
  hyper

SEQ ID NO: 55006 - DNA, 42 bp, Homo sapiens; identical to SEQ ID NO: 34323
  chr12:42984438-42984480
  hyper

SEQ ID NO: 55007 - DNA, 255 bp, Homo sapiens
  chr12:43945526-43945781
  hyper
ggccagcgttccccaacgggctgagccgctcgtccccgcgacctgcatgtcccactcgggccccgcgcccccacttagccgctgaaggcgtctcgcggtgactttaccttgcctggggtggaagtcaacttcccaagacctggtgatgaagagcgagagatggtagagcagcccagtcagccacttggccacccacatggttccaccctggggaccccgatcggggaggcccaccagagccgccggcagccaagc

SEQ ID NO: 55008 - DNA, 121 bp, Homo sapiens; identical to SEQ ID NO: 21346
  chr12:43946298-43946419
  hyper

SEQ ID NO: 55009 - DNA, 376 bp, Homo sapiens; identical to SEQ ID NO: 34328
  chr12:45269011-45269387
  hyper

SEQ ID NO: 55010 - DNA, 88 bp, Homo sapiens
  chr12:45269416-45269504
  hyper
cgcggtctccaaggcaagcacagaaaaaaaaaaaatccatatccaaacccgcccccttactccaagcttcccactccagacctacttt

SEQ ID NO: 55011 - DNA, 278 bp, Homo sapiens
  chr12:45269624-45269902
  hyper
atgttctcagtaagacccgagactccatggtgcggatcagctcagtccatcgtctccctctttaaaaataaaaataaaaatcgaagaggttcttggaatcaagcgggaaaataacgtttgtctctcctgctgctgcctcggatttactgatcagtaggattaatacgctttggttgcctaagaaagaaaagggaggcctccccaggcgcgtgaagaacttagaccctccaatgcgcacatcattcccacacgcagggccgaggcggcagcgcggcccg

SEQ ID NO: 55012 - DNA, 233 bp, Homo sapiens; identical to SEQ ID NO: 34330
  chr12:45270680-45270913
  hyper

SEQ ID NO: 55013 - DNA, 32 bp, Homo sapiens; identical to SEQ ID NO: 34331
  chr12:45443857-45443889
  hyper

SEQ ID NO: 55014 - DNA, 141 bp, Homo sapiens; identical to SEQ ID NO: 21351
  chr12:45445258-45445399
  hyper

SEQ ID NO: 55015 - DNA, 86 bp, Homo sapiens; identical to SEQ ID NO: 34335
  chr12:46767304-46767390
  hyper

SEQ ID NO: 55016 - DNA, 276 bp, Homo sapiens; identical to SEQ ID NO: 34336
  chr12:47225027-47225303
  hyper

SEQ ID NO: 55017 - DNA, 62 bp, Homo sapiens
  chr12:47225319-47225381
  hyper
cgccctcggaaccgctggcgcagttttcagactcgcccaccgcccagagaccaggggcccac

SEQ ID NO: 55018 - DNA, 61 bp, Homo sapiens
  chr12:47225579-47225640
  hyper
cagcaggatcccgggcggtcgcggagccagctcccgcgggggaagtcgggcctctcagcca

SEQ ID NO: 55019 - DNA, 30 bp, Homo sapiens; identical to SEQ ID NO: 34339
  chr12:48395941-48395971
  hyper

SEQ ID NO: 55020 - DNA, 327 bp, Homo sapiens; identical to SEQ ID NO: 34340
  chr12:48396748-48397075
  hyper

SEQ ID NO: 55021 - DNA, 60 bp, Homo sapiens
  chr12:48397135-48397195
  hyper
ctggctcggtgagttccagaatttagaaaagtaactcattgtagtacctcggggcggcgg

SEQ ID NO: 55022 - DNA, 531 bp, Homo sapiens
  chr12:48398070-48398601
  hyper
gcaccagcgtctggggagccccgaggcgaatcatggctcaccgcggggcctggctgagccgggcccgggcggagcgcagcgaaacggcaggagcacggcgcgggtccgggtctctaccgcgccctcatgcaggaggcccttggagcaggagggggaagcgggagacccggcagcccagcagcgctctgcgtcttctccccgccgcggcgcccgttatatgcgcccggcccctttcgaggctggcgaactcgcccaaaccgcgggccgccccctgccccccgctgggctgtaacctgaaccgcccgcccccggagcccgcctgggccctgccagtgcccgcacctgcccaagccggacccccctctctgggagtcacgcttcccgccctccacccctagtgcgccgagtggcctgatcgggcggggcgcagagatggcccctgccccccaaacccggggctgcggcgctgcccccctctgaccacaggcgggaagggtggcctccggcccctcccctcggagttctgccgga

SEQ ID NO: 55023 - DNA, 188 bp, Homo sapiens; identical to SEQ ID NO: 34342
  chr12:48576788-48576976
  hyper

SEQ ID NO: 55024 - DNA, 44 bp, Homo sapiens; identical to SEQ ID NO: 34343
  chr12:48577469-48577513
  hyper

SEQ ID NO: 55025 - DNA, 432 bp, Homo sapiens; identical to SEQ ID NO: 34344
  chr12:48577898-48578330
  hyper

SEQ ID NO: 55026 - DNA, 64 bp, Homo sapiens
  chr12:49297738-49297802
  hyper
ataaataaataaataaataaataaataaaatgcactgaggagacagatttttgagagttaaaag

SEQ ID NO: 55027 - DNA, 20 bp, Homo sapiens
  chr12:49297915-49297935
  hyper
agacgcgtcttacagtggga

SEQ ID NO: 55028 - DNA, 95 bp, Homo sapiens; identical to SEQ ID NO: 34346
  chr12:49363823-49363918
  hyper

SEQ ID NO: 55029 - DNA, 30 bp, Homo sapiens; identical to SEQ ID NO: 34347
  chr12:49364135-49364165
  hyper

SEQ ID NO: 55030 - DNA, 101 bp, Homo sapiens
  chr12:49366423-49366524
  hyper
ctcaccctcgaagctctaaccactgtgggctatttttgccagagaggggccccaggctttccagccgccccccgcccctgccagaccgcagcccaaggcac

SEQ ID NO: 55031 - DNA, 39 bp, Homo sapiens; identical to SEQ ID NO: 34349
  chr12:49367954-49367993
  hyper

SEQ ID NO: 55032 - DNA, 30 bp, Homo sapiens; identical to SEQ ID NO: 34350
  chr12:49373373-49373403
  hyper

SEQ ID NO: 55033 - DNA, 693 bp, Homo sapiens; identical to SEQ ID NO: 34351
  chr12:49373730-49374423
  hyper

SEQ ID NO: 55034 - DNA, 233 bp, Homo sapiens
  chr12:49374681-49374914
  hyper
caagcacagtctcttcgctgtacagattcgaaaaataagcctgagaggccgagactgactcgccgcggcggagcagggttgggcagggtttccaaatctcagcggaacatttcgcgcctcccttcccctgggctcagctaggcctgggcctttgctgaggtccggcccccgtggcgtccgggagagggcagtgtctgggagggtgactctggcccggtgccctgggacactct

SEQ ID NO: 55035 - DNA, 206 bp, Homo sapiens
  chr12:49375119-49375325
  hyper
gctgctgcgcctggagccggaagacccggcccacaaaccgccctccccccacgacctcgtctacttcgagaaatcgcccaacttctgcacgtacagcggacgcctgggcacagcaggcacggcagggcgcgcctgtaacagctcgtcgcccgcgctggacggctgcgagctgctctgctgcggcaggggccaccgcacgcgcacgc

SEQ ID NO: 55036 - DNA, 241 bp, Homo sapiens; identical to SEQ ID NO: 34354
  chr12:49388730-49388971
  hyper

SEQ ID NO: 55037 - DNA, 35 bp, Homo sapiens
  chr12:49390838-49390873
  hyper
tagggccctggggtccgcgcccagccccggccggc

SEQ ID NO: 55038 - DNA, 209 bp, Homo sapiens
  chr12:49391877-49392086
  hyper
gagtcgcagctggggctgatgaagtgggcacctgagagttcccggggcctctcttagtccccaaggtcctatgggggccttcgtaagaaggtggagccacgtagggtggcggccggtcccagcggcgtcgtggggcggtcccggcagaacctctcagcagcaggtgagcctcgtagcttgggggcccgggccgccgacctccccagggc

SEQ ID NO: 55039 - DNA, 44 bp, Homo sapiens; identical to SEQ ID NO: 34357
  chr12:49392556-49392600
  hyper

SEQ ID NO: 55040 - DNA, 530 bp, Homo sapiens; identical to SEQ ID NO: 34358
  chr12:49483686-49484216
  hyper

SEQ ID NO: 55041 - DNA, 170 bp, Homo sapiens; identical to SEQ ID NO: 34359
  chr12:49485716-49485886
  hyper

SEQ ID NO: 55042 - DNA, 30 bp, Homo sapiens; identical to SEQ ID NO: 34360
  chr12:49487666-49487696
  hyper

SEQ ID NO: 55043 - DNA, 30 bp, Homo sapiens; identical to SEQ ID NO: 34361
  chr12:49688858-49688888
  hyper

SEQ ID NO: 55044 - DNA, 66 bp, Homo sapiens
  chr12:49690983-49691049
  hyper
caagcaggagatgaacgagtcccgacgccagatccagagtctaacgtgcgaggtggacgggctgcg

SEQ ID NO: 55045 - DNA, 15 bp, Homo sapiens
  chr12:49729713-49729728
  hyper
ggcatctcacctgtc

SEQ ID NO: 55046 - DNA, 272 bp, Homo sapiens; identical to SEQ ID NO: 21363
  chr12:49730090-49730362
  hyper

SEQ ID NO: 55047 - DNA, 55 bp, Homo sapiens; identical to SEQ ID NO: 34365
  chr12:49735987-49736042
  hyper

SEQ ID NO: 55048 - DNA, 36 bp, Homo sapiens; identical to SEQ ID NO: 34366
  chr12:49736792-49736828
  hyper

SEQ ID NO: 55049 - DNA, 36 bp, Homo sapiens; identical to SEQ ID NO: 21364
  chr12:50297461-50297497
  hyper

SEQ ID NO: 55050 - DNA, 33 bp, Homo sapiens; identical to SEQ ID NO: 21365
  chr12:50298055-50298088
  hyper

SEQ ID NO: 55051 - DNA, 186 bp, Homo sapiens; identical to SEQ ID NO: 11223
  chr12:50355598-50355784
  hyper

SEQ ID NO: 55052 - DNA, 80 bp, Homo sapiens
  chr12:50426799-50426879
  hyper
catcgacgatccctggacgcgggcgtcgggggcagggaggcttggctaggtccctggctgccaaccgtctggccacagcc

SEQ ID NO: 55053 - DNA, 241 bp, Homo sapiens; identical to SEQ ID NO: 34371
  chr12:50444182-50444423
  hyper

SEQ ID NO: 55054 - DNA, 85 bp, Homo sapiens; identical to SEQ ID NO: 34372
  chr12:52208668-52208753
  hyper

SEQ ID NO: 55055 - DNA, 109 bp, Homo sapiens; identical to SEQ ID NO: 34373
  chr12:52241703-52241812
  hyper

SEQ ID NO: 55056 - DNA, 133 bp, Homo sapiens; identical to SEQ ID NO: 34374
  chr12:52242262-52242395
  hyper

SEQ ID NO: 55057 - DNA, 180 bp, Homo sapiens
  chr12:52262803-52262983
  hyper
cgtgtgcacgccagccgagcgagtggccgagggacacccccgtgcttcccaaggcctggctccacgaggagcagaaccccagcggtgggattctgtcgcgcaatgctgtgtggctccgactagggcccgccctccagcaaagagatgctggtgggtgctctcggttcacccccgcactcg

SEQ ID NO: 55058 - DNA, 307 bp, Homo sapiens
  chr12:52263106-52263413
  hyper
gctgtgggggaagaggagggaggagggagcagatggcagcaattaccgctcggaccctcccccgccgtagcctggggccggaagatcggctcggcagctcgctcctgcgggaggggcggcggcctccccggccgggaaccggcggggagggggtccgggaggggcggctctggccgccggggcgcgggcatcccagcttctaggggagagtgatgtgagggcccggtggagacacctccttctcccgggacgagggctgagagattccctttggaaaggccgagtctccggccgcccccacccccag

SEQ ID NO: 55059 - DNA, 133 bp, Homo sapiens
  chr12:52301147-52301280
  hyper
gtcctgcagccccagcgaggggcgagcggcggccagtcggcgagctgggcaataaggaaacggtttattaggagggagtggtggagctgggccaggcaggaagacgctggaataagaaacatttttgctccag

SEQ ID NO: 55060 - DNA, 32 bp, Homo sapiens; identical to SEQ ID NO: 34377
  chr12:52317406-52317438
  hyper

SEQ ID NO: 55061 - DNA, 37 bp, Homo sapiens; identical to SEQ ID NO: 34378
  chr12:52400452-52400489
  hyper

SEQ ID NO: 55062 - DNA, 315 bp, Homo sapiens
  chr12:52400516-52400831
  hyper
cgcgtccgcggctcgttttcccccactgagcgcccagctcccgcagtttccccggccgtcgagcgccgtgggcggggctccagggcggcggcgcctcgcggggagggtcctccgtgctgggggcgaggccacccgaggcagctccccgcccgcccccaaccccgccccgctctcggagcctataaagggaggcgacccgcggcccgcccggctggcatcccccagccgccgccagccccgccgaggggagccagcgccgtctctgaggggcgtccggcgccggagccatgaccctccgccgactcaggaagctgc

SEQ ID NO: 55063 - DNA, 30 bp, Homo sapiens; identical to SEQ ID NO: 34381
  chr12:52615930-52615960
  hyper

SEQ ID NO: 55064 - DNA, 182 bp, Homo sapiens; identical to SEQ ID NO: 34382
  chr12:52626865-52627047
  hyper

SEQ ID NO: 55065 - DNA, 15 bp, Homo sapiens
  chr12:52652138-52652153
  hyper
tgcgtccgcaggagc

SEQ ID NO: 55066 - DNA, 23 bp, Homo sapiens
  chr12:52652613-52652636
  hyper
cacctgtccgcccctccgccggg

SEQ ID NO: 55067 - DNA, 30 bp, Homo sapiens; identical to SEQ ID NO: 34386
  chr12:52701983-52702013
  hyper

SEQ ID NO: 55068 - DNA, 211 bp, Homo sapiens; identical to SEQ ID NO: 11234
  chr12:52702362-52702573
  hyper

SEQ ID NO: 55069 - DNA, 30 bp, Homo sapiens; identical to SEQ ID NO: 34388
  chr12:53084893-53084923
  hyper

SEQ ID NO: 55070 - DNA, 15 bp, Homo sapiens
  chr12:53108074-53108089
  hyper
aaggggactggggtc

SEQ ID NO: 55071 - DNA, 258 bp, Homo sapiens
  chr12:53108218-53108476
  hyper
gccagagaagccccccgagcaccgcggagctcccgcccaagccccagccgctgcggccccggctaccgccgcgggcccgggctccgactcctcctcccagggcgcagccgccgccagtgctgctgtggccagtctctgcaaagacggtcggggtcagggagcctggcagtgtccgcccggcacgccagcccctcccacagtcccgagccgcaggtcttcccggggtgacgccccgccgagatccggcaaggcgtgggg

SEQ ID NO: 55072 - DNA, 41 bp, Homo sapiens; identical to SEQ ID NO: 34390
  chr12:53359275-53359316
  hyper

SEQ ID NO: 55073 - DNA, 32 bp, Homo sapiens
  chr12:53359563-53359595
  hyper
ctcctgggagagcccaccgagagttctggggc

SEQ ID NO: 55074 - DNA, 183 bp, Homo sapiens; identical to SEQ ID NO: 34392
  chr12:53719608-53719791
  hyper

SEQ ID NO: 55075 - DNA, 12 bp, Homo sapiens
  chr12:54089081-54089093
  hyper
ttttttttttat

SEQ ID NO: 55076 - DNA, 134 bp, Homo sapiens
  chr12:54089511-54089645
  hyper
aagaggaaccgcagatgccgggtggcgggagaggggctggggctgcagggagacaggtgggtttggtcggggttgggggttaggaggggaggacatgctctctgcaaattaggtgcaaacgaaggctcagaatg

SEQ ID NO: 55077 - DNA, 29 bp, Homo sapiens
  chr12:54132329-54132358
  hyper
ccctccggcaaaggcggagggacggcctg

SEQ ID NO: 55078 - DNA, 763 bp, Homo sapiens; identical to SEQ ID NO: 34395
  chr12:54144857-54145620
  hyper

SEQ ID NO: 55079 - DNA, 77 bp, Homo sapiens
  chr12:54145895-54145972
  hyper
cttgggctcccctccaaggtcccctccgctcgcccctctctgcccgctgccgccgccgccgccgccttccaggcctc

SEQ ID NO: 55080 - DNA, 278 bp, Homo sapiens
  chr12:54321628-54321906
  hyper
acttgccgcggcttcgagtagagacgttggtgcgggacccaactcctggggaaggcggggagcgctgggcggatgcctggccctagtgcggcgccaacacatacaagttccgctgtgaatgtttgaaagtgtaagtttctctcggattgatttttttttcctttaaatgtatccccttcaaaaaaaaaaaaaaacaaacaaacaaaaaaaaaaaaaacaaagacgtggacaggcaggcgccacccggtctgggagctgaggttcgtgactgctgccga

SEQ ID NO: 55081 - DNA, 70 bp, Homo sapiens
  chr12:54322131-54322201
  hyper
agtcgggagcccccacgcgccagtcgagcctacgcagctgtggggtgggaaggagaagacaagtcctccg

SEQ ID NO: 55082 - DNA, 255 bp, Homo sapiens
  chr12:54324544-54324799
  hyper
gggcgcttcctagtgcgggcactcatcctgccgctctccggtcggccatttattgtcttgtggggaagggctttcgccaagaaacttggtctgggttagtgaaataaaatactaaacaattactatatgtaaaattttaaaaccagcatattaaaataaactaaggaactctctgtcgtgggagaaatccacaggaaaaggaagagaaggagttagatgctggcgccgagttcctggcggagccaggcggcggtg

SEQ ID NO: 55083 - DNA, 28 bp, Homo sapiens
  chr12:54324937-54324965
  hyper
aggagcacaatgccgctaaatgatgcct

SEQ ID NO: 55084 - DNA, 82 bp, Homo sapiens
  chr12:54329276-54329358
  hyper
acgcacatacacagacgcttcccgtgaaaaagcatattaaatatctcctttctgtgttggatcatttaaaagaaaacatttc

SEQ ID NO: 55085 - DNA, 144 bp, Homo sapiens; identical to SEQ ID NO: 34403
  chr12:54330304-54330448
  hyper

SEQ ID NO: 55086 - DNA, 206 bp, Homo sapiens
  chr12:54330856-54331062
  hyper
aatgccagcccagcccgcagcctgctttctgaactctgagctgacccttctggatgaagatcacgcagataagaattactatcctaactcaccgatgtccgggtgctctcaaccgtcaaacaccaccttctccccacaaagaggagggaggtggcccgaaggggtttctgcagacctgtccatttgctctccacttgaggggtgca

SEQ ID NO: 55087 - DNA, 377 bp, Homo sapiens
  chr12:54333337-54333714
  hyper
ctgggctctctccaatggctgggacagtcaggtgtactgctccaaggagcagtcgcagtccgcccacctctggaagtctcccttcccaggtaaggaagggacccgagcgccgccgccgccggggacccctccccgccctgcctgccccggggctccgcgccccaaccacccccgccgtctggccccggcgcgcccgctcggctgggctgcctatggagccggccgggcgagctgcactgaggaatgcgccggggaagaaatctgctccgacacgttctctgtagctgcccggccgagaatgaagcaatcacaggcgcccgaaagccgggccgccggctctgctctgtccggtagctcgcctccgcctccccttgcag

SEQ ID NO: 55088 - DNA, 243 bp, Homo sapiens
  chr12:54343569-54343812
  hyper
aaggccttgatcttccggtggccagcgaaggggagggctgcttgcccccttgacgcgccatcccccttcccgcaggagcccgccgcctctgtttacacacagaggaggtgtcgtctccagtctagacaagggcgctaataacgcccataaaaggcggcctctccagagatgctctggcaactccgctcccgcgcgcctgccgctggccgctttctccacctccccccgccccgcccttctctg

SEQ ID NO: 55089 - DNA, 40 bp, Homo sapiens; identical to SEQ ID NO: 34409
  chr12:54345186-54345226
  hyper

SEQ ID NO: 55090 - DNA, 37 bp, Homo sapiens
  chr12:54345574-54345611
  hyper
gcaccaatcgctccacggtttgggtgcctcggcctga

SEQ ID NO: 55091 - DNA, 57 bp, Homo sapiens
  chr12:54348787-54348844
  hyper
cttccccaacttccgcgcgtccggggcgcagcttcccgggctgccttcgctgtccta

SEQ ID NO: 55092 - DNA, 39 bp, Homo sapiens
  chr12:54349336-54349375
  hyper
ccactcaagcggcggattcaaacccgacctcttaccagg

SEQ ID NO: 55093 - DNA, 73 bp, Homo sapiens; identical to SEQ ID NO: 21383
  chr12:54354621-54354694
  hyper

SEQ ID NO: 55094 - DNA, 91 bp, Homo sapiens
  chr12:54354814-54354905
  hyper
cggaaggttccggtgtaattcagcgggaggtggaaggcaggccccgatcccacagcgcgcctatgctcagcctttggtccgagcggccgcc

SEQ ID NO: 55095 - DNA, 40 bp, Homo sapiens; identical to SEQ ID NO: 34416
  chr12:54359643-54359683
  hyper

SEQ ID NO: 55096 - DNA, 218 bp, Homo sapiens
  chr12:54359742-54359960
  hyper
cgtaccttataaggaaggcgccggtcctccatttcagccttttctctgccaggacgcggccgtggcatttctggtcttgtaaacatcagactctttggggccttaaaaaaataaagacgcccctccttcctttaccgggggtgagccggccggggaaagcggcggacagggaaatcaactaatgaagactccgggaaacttttctctctttttctctc

SEQ ID NO: 55097 - DNA, 30 bp, Homo sapiens; identical to SEQ ID NO: 34418
  chr12:54363641-54363671
  hyper

SEQ ID NO: 55098 - DNA, 376 bp, Homo sapiens; identical to SEQ ID NO: 34419
  chr12:54366919-54367295
  hyper

SEQ ID NO: 55099 - DNA, 105 bp, Homo sapiens; identical to SEQ ID NO: 34420
  chr12:54367525-54367630
  hyper

SEQ ID NO: 55100 - DNA, 72 bp, Homo sapiens; identical to SEQ ID NO: 34421
  chr12:54368360-54368432
  hyper

SEQ ID NO: 55101 - DNA, 355 bp, Homo sapiens; identical to SEQ ID NO: 34422
  chr12:54368647-54369002
  hyper

SEQ ID NO: 55102 - DNA, 75 bp, Homo sapiens; identical to SEQ ID NO: 34423
  chr12:54377164-54377239
  hyper

SEQ ID NO: 55103 - DNA, 83 bp, Homo sapiens
  chr12:54378115-54378198
  hyper
tctggcttcctctttcccctaccccgcgtccattcggaacctccttttccgagcagccatgaagtgaccgtgaccccctccct

SEQ ID NO: 55104 - DNA, 360 bp, Homo sapiens
  chr12:54378814-54379174
  hyper
cgctgacgtcacggccgtctgaatcatcaaggccattttcaaatcccattggtctagccgtcacatggtgagaaccgaatgcgcggataattacggagctgatatttccccccctccccttctttttcctccctcccctccaaccgcgccccccctcccggatggggaaaaaaaaagatgtcagctcctccgctgtagtattgctccttaaaaacccctctctctgaaaatgacatgccctcgcaatgtaactccgaactcgtacgcggagcccttggctgcgcccggcggaggagagcgctatagccggagcgcaggcatgtatatgcagtctgggagtgacttcaattgcggggtgat

SEQ ID NO: 55105 - DNA, 265 bp, Homo sapiens
  chr12:54379623-54379888
  hyper
gcaaagtgagtttccctgagacccccaagtccgacagccagacccccagccccaatgaaatcaagacggagcagagcctggcgggccctaaagggagcccctcggagagcgaaaaggagagggccaaagctgccgactccagcccagacacctcggataacgaagcgaaaggtaaggccgcctgggccgcgggcgccactgggacgttccggcacttggtcttcgcggccggggaggggggcaggggagagggttgggcccagga

SEQ ID NO: 55106 - DNA, 256 bp, Homo sapiens; identical to SEQ ID NO: 21390
  chr12:54387959-54388215
  hyper

SEQ ID NO: 55107 - DNA, 102 bp, Homo sapiens
  chr12:54388245-54388347
  hyper
tagaaaggaccttgaggtctgctgggtgtttgggctgccctgggggcggcggcccagagtgtggagcaagcggcgcgcggggcgcggcggtcagcgtgggag

SEQ ID NO: 55108 - DNA, 208 bp, Homo sapiens; identical to SEQ ID NO: 34428
  chr12:54388627-54388835
  hyper

SEQ ID NO: 55109 - DNA, 95 bp, Homo sapiens; identical to SEQ ID NO: 34429
  chr12:54389157-54389252
  hyper

SEQ ID NO: 55110 - DNA, 26 bp, Homo sapiens
  chr12:54391298-54391324
  hyper
cccgcggcaaaggcccggcaagccag

SEQ ID NO: 55111 - DNA, 256 bp, Homo sapiens
  chr12:54391403-54391659
  hyper
tccctctctgcacgcctgcctttcccggctctcctatctcttttcatcttgccttccttcttttaattctcccccttttttccctttattctaatgctccgcttccttctttcctctcttgggcctgactccatgtttcagttggtctgtcccaggctgtctcgggttcagtctctctcaggctctgtcccctgatgtcctcttggtctcagtctggccccgggccccgctgagggctaaacgtctctgctcatcg

SEQ ID NO: 55112 - DNA, 9 bp, Homo sapiens
  chr12:54393451-54393460
  hyper
gacagagac

SEQ ID NO: 55113 - DNA, 18 bp, Homo sapiens
  chr12:54393461-54393479
  hyper
gattacgtcaagaaatag

SEQ ID NO: 55114 - DNA, 40 bp, Homo sapiens; identical to SEQ ID NO: 21394
  chr12:54393684-54393724
  hyper

SEQ ID NO: 55115 - DNA, 152 bp, Homo sapiens; identical to SEQ ID NO: 21395
  chr12:54393798-54393950
  hyper

SEQ ID NO: 55116 - DNA, 248 bp, Homo sapiens; identical to SEQ ID NO: 21396
  chr12:54394162-54394410
  hyper

SEQ ID NO: 55117 - DNA, 195 bp, Homo sapiens; identical to SEQ ID NO: 11269
  chr12:54394466-54394661
  hyper

SEQ ID NO: 55118 - DNA, 77 bp, Homo sapiens; identical to SEQ ID NO: 34436
  chr12:54398709-54398786
  hyper

SEQ ID NO: 55119 - DNA, 137 bp, Homo sapiens; identical to SEQ ID NO: 21398
  chr12:54398959-54399096
  hyper

SEQ ID NO: 55120 - DNA, 261 bp, Homo sapiens
  chr12:54399355-54399616
  hyper
tttgtctatggcccacggagaacaggacctcactggctgagagggagaggtggagagcgcgcgcgcgagagggatgggctacaaaccaggggtcaaacagcctggagaagtccgagtcccaccccaaagtcctgcaggcggcggcggaatagtcggtgcggggccagcatcagggtaagaggagggaggactttagggtgcgcgccgcgggcaagccgtcgtgggagcctcggagcgtgcatccgcgttcgcggagatgtt

SEQ ID NO: 55121 - DNA, 21 bp, Homo sapiens
  chr12:54399646-54399667
  hyper
agatcgcggcagttgctttgc

SEQ ID NO: 55122 - DNA, 14 bp, Homo sapiens
  chr12:54402676-54402690
  hyper
tcatgtcgtggatt

SEQ ID NO: 55123 - DNA, 211 bp, Homo sapiens; identical to SEQ ID NO: 21401
  chr12:54402856-54403067
  hyper

SEQ ID NO: 55124 - DNA, 120 bp, Homo sapiens
  chr12:54403360-54403480
  hyper
ccctttatggggctcagcaagaggcgagcgtggtgcaatatcccgactgtaaatcctccgccaacactaacagtagcgaaggacaaggccacttaaatcaaaactcgtctcccagcctca

SEQ ID NO: 55125 - DNA, 95 bp, Homo sapiens
  chr12:54408316-54408411
  hyper
ggcccagtagcctagcggaatgaacccagcattaaatggctccgaagggcctcgccgccttttccccacaccaaatgtgccatttatcccttgtc

SEQ ID NO: 55126 - DNA, 61 bp, Homo sapiens; identical to SEQ ID NO: 34442
  chr12:54422441-54422502
  hyper

SEQ ID NO: 55127 - DNA, 22 bp, Homo sapiens
  chr12:54425119-54425141
  hyper
gaccgcgggactggagccctgt

SEQ ID NO: 55128 - DNA, 300 bp, Homo sapiens; identical to SEQ ID NO: 34444
  chr12:54440853-54441153
  hyper

SEQ ID NO: 55129 - DNA, 30 bp, Homo sapiens; identical to SEQ ID NO: 34445
  chr12:54446784-54446814
  hyper

SEQ ID NO: 55130 - DNA, 45 bp, Homo sapiens
  chr12:54447977-54448022
  hyper
ccgagaaatcacagtcgctctgcgagccggcgcctctctcaggcg

SEQ ID NO: 55131 - DNA, 68 bp, Homo sapiens; identical to SEQ ID NO: 34447
  chr12:54500146-54500214
  hyper

SEQ ID NO: 55132 - DNA, 193 bp, Homo sapiens; identical to SEQ ID NO: 34448
  chr12:54520001-54520194
  hyper

SEQ ID NO: 55133 - DNA, 524 bp, Homo sapiens
  chr12:54520221-54520745
  hyper
cgtgcccccgagtcctgcttccccggggcctgctctgtatcaggcgcctgcgccttcaagggtacccggcccgcctgccctccccaagagccgagtttgcgctcctcccggaatcgtttgagagaaggacaaacttttggcaggatggaaatctagatgagcctgtccggagcaggtaagctgggcccgggacgggtgcgattcagcccgagaacaatctgtctctccccgtcccggtctctccctccccttacccctgtttcccctgcaggctgacatattaatctgccttcccccgggagaaatttgggctggggttgggcttctgtcagatgcatggggtcagagcagctttcctccccgagtttagggactaaggtggtagctggcaggggagggggagggttgcttccgaaactgaggattgaggggagggttaggggccgagaaacccagagtctgagggagacgacttctttcctcaaacgcaacttgggggaacttcggaaaagttttttgagggg

SEQ ID NO: 55134 - DNA, 143 bp, Homo sapiens
  chr12:54520868-54521011
  hyper
aaaaacccagccgcgtcccaaacccgctcaccccagcaggcccttagagacgcttggagatccccagacacgccccgcggaaagggaaggaaatgccagcccgagttgccgactctgccgggacggggcgggggatccgccca

SEQ ID NO: 55135 - DNA, 85 bp, Homo sapiens; identical to SEQ ID NO: 34450
  chr12:54611458-54611543
  hyper

SEQ ID NO: 55136 - DNA, 204 bp, Homo sapiens
  chr12:54812034-54812238
  hyper
gcccttggctgagttcgcccccagccccagggccccagtgccagggtccccgcactcgcccccagttctcggatcccctcgcctgaacagagattgggggcggagggaggagtaggagacagaggagaaaggagagggagccgccgtcctctctcgggtctttccccggtctgagttgaggggggaggggaggatgaggctggc

SEQ ID NO: 55137 - DNA, 263 bp, Homo sapiens; identical to SEQ ID NO: 21410
  chr12:54812359-54812622
  hyper

SEQ ID NO: 55138 - DNA, 52 bp, Homo sapiens; identical to SEQ ID NO: 34453
  chr12:54943371-54943423
  hyper

SEQ ID NO: 55139 - DNA, 30 bp, Homo sapiens; identical to SEQ ID NO: 34454
  chr12:54982627-54982657
  hyper

SEQ ID NO: 55140 - DNA, 166 bp, Homo sapiens; identical to SEQ ID NO: 34455
  chr12:57613840-57614006
  hyper

SEQ ID NO: 55141 - DNA, 30 bp, Homo sapiens; identical to SEQ ID NO: 34456
  chr12:57614370-57614400
  hyper

SEQ ID NO: 55142 - DNA, 47 bp, Homo sapiens; identical to SEQ ID NO: 34458
  chr12:57619110-57619157
  hyper

SEQ ID NO: 55143 - DNA, 33 bp, Homo sapiens; identical to SEQ ID NO: 34459
  chr12:57632036-57632069
  hyper

SEQ ID NO: 55144 - DNA, 64 bp, Homo sapiens; identical to SEQ ID NO: 34460
  chr12:57632479-57632543
  hyper

SEQ ID NO: 55145 - DNA, 60 bp, Homo sapiens; identical to SEQ ID NO: 34461
  chr12:57635046-57635106
  hyper

SEQ ID NO: 55146 - DNA, 256 bp, Homo sapiens; identical to SEQ ID NO: 34462
  chr12:57869962-57870218
  hyper

SEQ ID NO: 55147 - DNA, 301 bp, Homo sapiens
  chr12:57943780-57944081
  hyper
cgcccaggcccgcagcgcggcgctgcagcgcgaggggcggagaggcagagagcccgaaaggaccagacgcccaggtcgcccgcatcccgctgccgcaggagagagacagcgcgccccggccctgctccccaggcttcgcccgggcgccctcaactctgtccccagagactgagcacctgtcctccgcctcggcctctgctgagagccctctcctctggagcacacaccacccctgcagcccaagaagagtcccagccccacgccggctaccaccatggcggagaccaacaacgaatgtagc

SEQ ID NO: 55148 - DNA, 68 bp, Homo sapiens; identical to SEQ ID NO: 21415
  chr12:57944117-57944185
  hyper

SEQ ID NO: 55149 - DNA, 30 bp, Homo sapiens; identical to SEQ ID NO: 34464
  chr12:58004572-58004602
  hyper

SEQ ID NO: 55150 - DNA, 133 bp, Homo sapiens; identical to SEQ ID NO: 34465
  chr12:58004814-58004947
  hyper

SEQ ID NO: 55151 - DNA, 383 bp, Homo sapiens; identical to SEQ ID NO: 34466
  chr12:58014820-58015203
  hyper

SEQ ID NO: 55152 - DNA, 27 bp, Homo sapiens
  chr12:58021293-58021320
  hyper
ccgctggcggctgggcgcgggtgcagc

SEQ ID NO: 55153 - DNA, 203 bp, Homo sapiens
  chr12:58021713-58021916
  hyper
ggtgccttcgggggtacccctgccccatcctcttccgcttcacccctgcaggacccagacagttcccaggccccacttcgtggttctctctttgtcctagggctggccgttcctggccgcagcgcccccgctgtggccttagcctgttcaaggcccttctccacccccacatcctgcagcccctgccctaccaggtccagcgg

SEQ ID NO: 55154 - DNA, 66 bp, Homo sapiens
  chr12:58025580-58025646
  hyper
tcactccacacagcccgttaggagaatgcaggcatctgagcccagcagtggagaaaacaaaagccc

SEQ ID NO: 55155 - DNA, 136 bp, Homo sapiens
  chr12:58025873-58026009
  hyper
cagaaggaccagagcgcacagggcccggcggcccagccacatcctaggtgggggtagggtggggagtgagaaagggagggaagaagggagggcaagggatggggcccttggcccccgcgtcctcagaggctcctgc

SEQ ID NO: 55156 - DNA, 230 bp, Homo sapiens; identical to SEQ ID NO: 34471
  chr12:58026065-58026295
  hyper

SEQ ID NO: 55157 - DNA, 97 bp, Homo sapiens; identical to SEQ ID NO: 34472
  chr12:58159773-58159870
  hyper

SEQ ID NO: 55158 - DNA, 82 bp, Homo sapiens; identical to SEQ ID NO: 34473
  chr12:58160215-58160297
  hyper

SEQ ID NO: 55159 - DNA, 48 bp, Homo sapiens; identical to SEQ ID NO: 34474
  chr12:59313895-59313943
  hyper

SEQ ID NO: 55160 - DNA, 243 bp, Homo sapiens; identical to SEQ ID NO: 34475
  chr12:59990053-59990296
  hyper

SEQ ID NO: 55161 - DNA, 30 bp, Homo sapiens; identical to SEQ ID NO: 34476
  chr12:62584322-62584352
  hyper

SEQ ID NO: 55162 - DNA, 161 bp, Homo sapiens
  chr12:62584677-62584838
  hyper
gtctgggtgaggaatcgaattacaacccacttcaatcctcgacctggtcgtttgctgttattaggagaaatggggcagagagggagggcaccgctcacggagcctcatttcgcatgctccgatcccctctcggcgtccctctactccgcccctaccctgac

SEQ ID NO: 55163 - DNA, 185 bp, Homo sapiens
  chr12:62586017-62586202
  hyper
gcccttctaggcatcgtgggctggaaggaagggaaacccgccgatgtccccctggtagcagtgccctggcaccgtcaccaccgaggaggtgcgagttccaacatcgaacacaagcgagcaggtgtcgcctgtgtcactttgctaaaggcgggaggggagaaagaaaggagcggggggagggggcc

SEQ ID NO: 55164 - DNA, 140 bp, Homo sapiens; identical to SEQ ID NO: 34479
  chr12:62829159-62829299
  hyper

SEQ ID NO: 55165 - DNA, 86 bp, Homo sapiens; identical to SEQ ID NO: 34481
  chr12:63327187-63327273
  hyper

SEQ ID NO: 55166 - DNA, 8 bp, Homo sapiens
  chr12:63543840-63543848
  hyper
gcaccctt

SEQ ID NO: 55167 - DNA, 152 bp, Homo sapiens; identical to SEQ ID NO: 34484
  chr12:63544728-63544880
  hyper

SEQ ID NO: 55168 - DNA, 20 bp, Homo sapiens
  chr12:63545343-63545363
  hyper
cagtccgggtttcttccttc

SEQ ID NO: 55169 - DNA, 43 bp, Homo sapiens
  chr12:64061778-64061821
  hyper
aagactcaagaaaagcgccatgcggctccctcctagggctctc

SEQ ID NO: 55170 - DNA, 210 bp, Homo sapiens
  chr12:64062159-64062369
  hyper
ccttgttttctcataatcaaggagtatggtggagctgggtcaatttcaggcacagcccagccgagtcaggcgaggtccagagagacctgactcgcctggcagcctcaacggacttgtccccgcagccgttgcggacctcccggtcgtcatggcgactgtgaaatgtggggtggggcgcatgcgttggaagccattcgcgcgggcagtccc

SEQ ID NO: 55171 - DNA, 343 bp, Homo sapiens; identical to SEQ ID NO: 21425
  chr12:64062578-64062921
  hyper

SEQ ID NO: 55172 - DNA, 55 bp, Homo sapiens; identical to SEQ ID NO: 21426
  chr12:64063096-64063151
  hyper

SEQ ID NO: 55173 - DNA, 282 bp, Homo sapiens
  chr12:64784252-64784534
  hyper
gtcgtagacctcgggcggcagatgccgccgcaggaacacatccaggcggctgttcctgcgcgcggggaagccggacggcaaggggctggccatgcccggcgcccgcagcgtggcggagtgctgggactcgaggccctcagctcgccctctccccgcccccgcgctggaacccgcgcgccacaaagccgccggccacgcgtcgcctcctctccaggcgcggggacccgggccgcaactgcaggaatcgacgctaggtcggcttccctggagcgccctccccag

SEQ ID NO: 55174 - DNA, 113 bp, Homo sapiens
  chr12:64784564-64784677
  hyper
cctcagacggcgatgggcggggcaagacgctggtccttcaggcccgagttgatgggcacctcgggctcatcaccgtgaagtcccctgcggccgaagggcggtggatttttagg

SEQ ID NO: 55175 - DNA, 61 bp, Homo sapiens
  chr12:65219156-65219217
  hyper
gttccaggctcgcaggaagccagaccttgcgagaggtgtgtgggggcggagagtggcacag

SEQ ID NO: 55176 - DNA, 109 bp, Homo sapiens
  chr12:65219784-65219893
  hyper
gttctcccctaggaagtgtctagttgcagaggctgtagtatttattcaccatcttcctttacctcttttttttttcttttaaatctccttcccacgttaaaagtaagtg

SEQ ID NO: 55177 - DNA, 93 bp, Homo sapiens; identical to SEQ ID NO: 21429
  chr12:65220112-65220205
  hyper

SEQ ID NO: 55178 - DNA, 89 bp, Homo sapiens; identical to SEQ ID NO: 21430
  chr12:65220350-65220439
  hyper

SEQ ID NO: 55179 - DNA, 28 bp, Homo sapiens
  chr12:65514835-65514863
  hyper
ttgcctggtgagcatcgatccataggta

SEQ ID NO: 55180 - DNA, 73 bp, Homo sapiens; identical to SEQ ID NO: 34496
  chr12:65673227-65673300
  hyper

SEQ ID NO: 55181 - DNA, 151 bp, Homo sapiens; identical to SEQ ID NO: 11310
  chr12:66122419-66122570
  hyper

SEQ ID NO: 55182 - DNA, 12 bp, Homo sapiens
  chr12:66122788-66122800
  hyper
cgagaggtgtct

SEQ ID NO: 55183 - DNA, 196 bp, Homo sapiens; identical to SEQ ID NO: 34500
  chr12:66135151-66135347
  hyper

SEQ ID NO: 55184 - DNA, 195 bp, Homo sapiens; identical to SEQ ID NO: 34501
  chr12:66135407-66135602
  hyper

SEQ ID NO: 55185 - DNA, 121 bp, Homo sapiens
  chr12:66135863-66135984
  hyper
cgcagggcgcacgcacgcatcccggccccctcacactcacactgcgtcttctgtcacaccccctgtcgcacacacactgttctctgactcccaccatctcctgtctcacacccactccagt

SEQ ID NO: 55186 - DNA, 179 bp, Homo sapiens
  chr12:66136014-66136193
  hyper
ggtcgcgccggcgcacgctcgtccccttctgccccggagcccgcccgcgccgcacggtggccccttgcgctggcctgatcgtgggaaccaggcggggccccagcgtccctgcccctgcccggtcatccatctccctcccggtcggccagccgagacttcaaaggcgcctcctccggccg

SEQ ID NO: 55187 - DNA, 72 bp, Homo sapiens; identical to SEQ ID NO: 11316
  chr12:66217530-66217602
  hyper

SEQ ID NO: 55188 - DNA, 410 bp, Homo sapiens; identical to SEQ ID NO: 34504
  chr12:66218917-66219327
  hyper

SEQ ID NO: 55189 - DNA, 30 bp, Homo sapiens; identical to SEQ ID NO: 34505
  chr12:66219897-66219927
  hyper

SEQ ID NO: 55190 - DNA, 11 bp, Homo sapiens
  chr12:66582816-66582827
  hyper
agaggtgtgaa

SEQ ID NO: 55191 - DNA, 192 bp, Homo sapiens
  chr12:66583137-66583329
  hyper
tgccgcccgcgctgctcggagagctctgcgctgttctggacagctgcgacggcgcgctgggctggcgcggcctgggtgagtcggcggggaccggccgggggcggcgggggagcccagcgcgccgcggggcccgctcggcgtcgccctgcatggctggggtccctcgcggggctggcgcggcctccgggaagt

SEQ ID NO: 55192 - DNA, 144 bp, Homo sapiens; identical to SEQ ID NO: 34508
  chr12:66629273-66629417
  hyper

SEQ ID NO: 55193 - DNA, 30 bp, Homo sapiens; identical to SEQ ID NO: 11320
  chr12:68759101-68759131
  hyper

SEQ ID NO: 55194 - DNA, 61 bp, Homo sapiens; identical to SEQ ID NO: 11321
  chr12:69326653-69326714
  hyper

SEQ ID NO: 55195 - DNA, 245 bp, Homo sapiens
  chr12:69327014-69327259
  hyper
ccccggacgtccctccggcccactccggagccgcgcgggtgcctcccgggcggggcctcagccgccttcgcacctaggagagacggcgcccgcgcggtgcgccctttcgtggcgcggctgctggtgcccgcggccgggcggctgagctgggcggagggctgcgggcatggagtcgccgctcgcggacagtctttgctggagccccaggtcagaagtgtgtcctcgcctcggccacggctgtagcc

SEQ ID NO: 55196 - DNA, 58 bp, Homo sapiens
  chr12:69327463-69327521
  hyper
agctcccagcagtgccaagctgcccagcgaggctaagcaatcacggggcttcgagaaa

SEQ ID NO: 55197 - DNA, 55 bp, Homo sapiens; identical to SEQ ID NO: 34512
  chr12:70761007-70761062
  hyper

SEQ ID NO: 55198 - DNA, 411 bp, Homo sapiens; identical to SEQ ID NO: 34513
  chr12:71003634-71004045
  hyper

SEQ ID NO: 55199 - DNA, 176 bp, Homo sapiens; identical to SEQ ID NO: 11323
  chr12:71314436-71314612
  hyper

SEQ ID NO: 55200 - DNA, 63 bp, Homo sapiens; identical to SEQ ID NO: 11324
  chr12:71314613-71314676
  hyper

SEQ ID NO: 55201 - DNA, 30 bp, Homo sapiens; identical to SEQ ID NO: 34516
  chr12:71832897-71832927
  hyper

SEQ ID NO: 55202 - DNA, 554 bp, Homo sapiens; identical to SEQ ID NO: 34517
  chr12:71833313-71833867
  hyper

SEQ ID NO: 55203 - DNA, 30 bp, Homo sapiens; identical to SEQ ID NO: 34518
  chr12:71834228-71834258
  hyper

SEQ ID NO: 55204 - DNA, 10 bp, Homo sapiens
  chr12:72665788-72665798
  hyper
ctgggacttc

SEQ ID NO: 55205 - DNA, 52 bp, Homo sapiens; identical to SEQ ID NO: 34523
  chr12:72666342-72666394
  hyper

SEQ ID NO: 55206 - DNA, 39 bp, Homo sapiens
  chr12:72666674-72666713
  hyper
gcttgtgctggccttcgctgtgtccctcgtggcattgct

SEQ ID NO: 55207 - DNA, 41 bp, Homo sapiens; identical to SEQ ID NO: 34527
  chr12:75601190-75601231
  hyper

SEQ ID NO: 55208 - DNA, 130 bp, Homo sapiens
  chr12:75601910-75602040
  hyper
ccccgggaggggatcagcgtccagcgctgtccccgcctcttgcatcaaacctttcccaggtttccagagaactacagagatagcagtcctagtctttcttgacctttcatgacaccgttttccctgcctc

SEQ ID NO: 55209 - DNA, 101 bp, Homo sapiens
  chr12:75602875-75602976
  hyper
tctacattcctattgcggaaaggcggagcggggggatgctggcctgcagggtcaacatgccctttccaggaaatcgcccctttcaccacccccgcccccat

SEQ ID NO: 55210 - DNA, 263 bp, Homo sapiens
  chr12:75603231-75603494
  hyper
ccaacctccgcgcccagagtcaccatcgcgcagggttgggcaaaccatggagctcggggcgggtccagccggcactgcccgacccctccgggagcgggcagatcggctggccgtgaatggagtggagactggccgcaggtcaggagagctcaccacttgaaggtgaagtcgccctgctcggattccatctgcagattttgtttctcccccaaatcagccactgctggagctgtcccttcagcaccactcgccatcaacctccc

SEQ ID NO: 55211 - DNA, 226 bp, Homo sapiens
  chr12:75728110-75728336
  hyper
atagtgctttgcactcgactggcccattgtcagcatcccgcacttgttctttacctaacttgtgtggcttgcatattgcaatctgtattacaatccagacgcgctctgcagattacagattggatccacagaaagcagtttggatggttgaaattccctccaccagagggcgactcagagctttcccctgtagctcagagctttgtggaaggggaaccctgctgcc

SEQ ID NO: 55212 - DNA, 18 bp, Homo sapiens
  chr12:75728485-75728503
  hyper
ctccgcatcctccacatc

SEQ ID NO: 55213 - DNA, 18 bp, Homo sapiens
  chr12:77719293-77719311
  hyper
gatgggggtggccagcgc

SEQ ID NO: 55214 - DNA, 158 bp, Homo sapiens
  chr12:77719422-77719580
  hyper
acccgaggtctccagacgagtgagggagggatgcaggcttgggggtgatggagcgcttggctggtggctggtgagcgtccatacatcatagctctccttcccactcccccgcccctcttcgggattctctctttctctttccccgtcctcatttcttt

SEQ ID NO: 55215 - DNA, 120 bp, Homo sapiens
  chr12:79257351-79257471
  hyper
cctggcgcgcggtcccttcccccacccgctgagccttcctgttcggtatttcggtattaccaagctataaattgcctgagagcttagagacaatcaggtcaccaccgccctcacaagaga

SEQ ID NO: 55216 - DNA, 375 bp, Homo sapiens; identical to SEQ ID NO: 34534
  chr12:79257722-79258097
  hyper

SEQ ID NO: 55217 - DNA, 141 bp, Homo sapiens; identical to SEQ ID NO: 34535
  chr12:79258297-79258438
  hyper

SEQ ID NO: 55218 - DNA, 437 bp, Homo sapiens; identical to SEQ ID NO: 34536
  chr12:79258439-79258876
  hyper

SEQ ID NO: 55219 - DNA, 30 bp, Homo sapiens; identical to SEQ ID NO: 34538
  chr12:81330218-81330248
  hyper

SEQ ID NO: 55220 - DNA, 573 bp, Homo sapiens; identical to SEQ ID NO: 34539
  chr12:81330746-81331319
  hyper

SEQ ID NO: 55221 - DNA, 48 bp, Homo sapiens; identical to SEQ ID NO: 11341
  chr12:81331829-81331877
  hyper

SEQ ID NO: 55222 - DNA, 62 bp, Homo sapiens
  chr12:81471455-81471517
  hyper
tgccacctccaccaacgaccttccaaagattaaaccagccgtgtacaaactgctggattgaa

SEQ ID NO: 55223 - DNA, 8 bp, Homo sapiens
  chr12:81472111-81472119
  hyper
cgaccccg

SEQ ID NO: 55224 - DNA, 44 bp, Homo sapiens; identical to SEQ ID NO: 34544
  chr12:82153211-82153255
  hyper

SEQ ID NO: 55225 - DNA, 195 bp, Homo sapiens; identical to SEQ ID NO: 34545
  chr12:82153283-82153478
  hyper

SEQ ID NO: 55226 - DNA, 191 bp, Homo sapiens; identical to SEQ ID NO: 11344
  chr12:85305054-85305245
  hyper

SEQ ID NO: 55227 - DNA, 156 bp, Homo sapiens; identical to SEQ ID NO: 34547
  chr12:85305657-85305813
  hyper

SEQ ID NO: 55228 - DNA, 61 bp, Homo sapiens
  chr12:85306458-85306519
  hyper
ggttttgggggtcgccgccctgcaggctggcaaggagagactcgtgagcgcctgtgtgtct

SEQ ID NO: 55229 - DNA, 8 bp, Homo sapiens
  chr12:85306789-85306797
  hyper
cgagcggc

SEQ ID NO: 55230 - DNA, 158 bp, Homo sapiens; identical to SEQ ID NO: 34550
  chr12:85306798-85306956
  hyper

SEQ ID NO: 55231 - DNA, 46 bp, Homo sapiens
  chr12:85667226-85667272
  hyper
agtttccatgagaagcgaaacttcattctctttgctcagaatagag

SEQ ID NO: 55232 - DNA, 139 bp, Homo sapiens
  chr12:85673067-85673206
  hyper
aggcactgatcctaacgggttttcttaaaataatttgggtctaatgataaaatcgtggaccaaagggaagggtggcgaagagggtgtagggaattggttggcattagtataatggcttcattgcctcttgctcggcttc

SEQ ID NO: 55233 - DNA, 225 bp, Homo sapiens
  chr12:85673235-85673460
  hyper
actccgccgcattccagagaaaaagaaaaggccacggcctcgtaaagctcccagctggcccggaccccgagctcctcccggttagaagccgaagcggcccctctactacggcggctgcgattaacagttgccaatgcatctggttccttgggcttcggattaatgtgaatcttccacgtaaacgatttacggatgaaataaaagccttttagagcaatatttcct

SEQ ID NO: 55234 - DNA, 77 bp, Homo sapiens
  chr12:85674807-85674884
  hyper
tcaaagtttgaggatccctagatttctagcgtgtgtgaatttgtaatttctgcttttttttgcgtttgcaatacaac

SEQ ID NO: 55235 - DNA, 16 bp, Homo sapiens
  chr12:93966301-93966317
  hyper
agagctgggccagggc

SEQ ID NO: 55236 - DNA, 111 bp, Homo sapiens
  chr12:93966318-93966429
  hyper
ctaactggaagcttggggttaaatggtgcaggaacgtagaggcggaggagtccctgggattttccacgtctatttccccacccccaccccagccgcaggggtccagtttgg

SEQ ID NO: 55237 - DNA, 395 bp, Homo sapiens
  chr12:93966603-93966998
  hyper
gaaggacgcgaacccttctctgaccccagctcgggcggccacctgtctttgccgcggtgacccttctctcatgaccctgcggtgccttgagccctccgggaatggcggggaagggacgcggagccagtgggggaccgcggggtcggcggaggagccatccccgcaggcggcgcgtctggcgaaggccctgcgggagctcggtcagacaggtagggagccgatcggccgcgacgcgtgcgggagggagcgcctccccaaggaagcagctaggaagcggggtcgaggtgggaagcaaagaataagatggaaatacgtcccttgcttccaagggaccgcggagagcacgctcgcagggtcctgggtccttgggaatgcgtaaggaaagtggttctcca

SEQ ID NO: 55238 - DNA, 426 bp, Homo sapiens; identical to SEQ ID NO: 34556
  chr12:93985172-93985598
  hyper

SEQ ID NO: 55239 - DNA, 291 bp, Homo sapiens
  chr12:94543118-94543409
  hyper
caccggctggaccttcgaccggggcgcctgcgaggtgcggcccctgggcaacctgagccgcaactccctgcgcaacggcaccgaggtggtgtcgtgccacccgcagggctcgacggccggcgtggtgtaccgcgcgggccggaacaaccgctggtacctggcggtggccgccacctacgtgctgcctgagccggagacggcgagccgctgcaaccccgcggcatccgaccacgacacggccatcgcgctcaaggacacggaggggcgcagcctggccacgcaggagctggg

SEQ ID NO: 55240 - DNA, 454 bp, Homo sapiens
  chr12:94543445-94543899
  hyper
cttcgtggacgcctttctctggaacggcagcatctacttcccctactacccctacaactacacgagcggcgctgccaccggctggcccagcatggcgcgcatcgcgcagagcaccgaggtgctgttccagggccaggcatccctcgactgcggccacggccaccccgacggccgccgcctgctcctctcctccagcctagtggaggccctggacgtctgggcgggagtgttcagcgcggccgctggagagggccaggagcggcgctcccccaccaccacggcgctctgcctcttcagaatgagtgagatccaggcgcgcgccaagagggtcagctgggacttcaagacggccgagagccactgcgtaagtcctgcccccggggcgccgcggagagcgctgctgccggggagccgccgccgccgccgaggcagaacgagctgggggcgagcggcg

SEQ ID NO: 55241 - DNA, 10 bp, Homo sapiens
  chr12:94543961-94543971
  hyper
gaaggctcct

SEQ ID NO: 55242 - DNA, 332 bp, Homo sapiens; identical to SEQ ID NO: 34559
  chr12:95266862-95267194
  hyper

SEQ ID NO: 55243 - DNA, 44 bp, Homo sapiens; identical to SEQ ID NO: 34560
  chr12:95267247-95267291
  hyper

SEQ ID NO: 55244 - DNA, 114 bp, Homo sapiens; identical to SEQ ID NO: 34561
  chr12:95267567-95267681
  hyper

SEQ ID NO: 55245 - DNA, 92 bp, Homo sapiens; identical to SEQ ID NO: 34562
  chr12:95267706-95267798
  hyper

SEQ ID NO: 55246 - DNA, 2 bp, Homo sapiens
  chr12:95942978-95942980
  hyper
gt

SEQ ID NO: 55247 - DNA, 311 bp, Homo sapiens; identical to SEQ ID NO: 34564
  chr12:96883403-96883714
  hyper

SEQ ID NO: 55248 - DNA, 32 bp, Homo sapiens; identical to SEQ ID NO: 34565
  chr12:97380005-97380037
  hyper

SEQ ID NO: 55249 - DNA, 30 bp, Homo sapiens; identical to SEQ ID NO: 11363
  chr12:99287423-99287453
  hyper

SEQ ID NO: 55250 - DNA, 162 bp, Homo sapiens
  chr12:99288150-99288312
  hyper
aaaatgcgcttaacccgggggtggtgggggaatcgataaccagaacaggtttgaaaaaaaaagcccccctcccgccccctccgtagagaccgctagctgaggctgcaacacctgccccggcaaagcgtctccgcagccttcccggcttgcccgactcggctt

SEQ ID NO: 55251 - DNA, 88 bp, Homo sapiens
  chr12:101110941-101111029
  hyper
gcgctgggccaaatccgcggcgcgcctctgccgggcacctcccacctccagcttcgcccctcccctctcccggccgcgcgtcctccgc

SEQ ID NO: 55252 - DNA, 8 bp, Homo sapiens
  chr12:101111061-101111069
  hyper
cggctgcc

SEQ ID NO: 55253 - DNA, 96 bp, Homo sapiens
  chr12:101111277-101111373
  hyper
ccagtctgggcaggacgcgggccaggatggcctccctcaccgcatacggtaactggggccgtcgcgggttcctggggcggcggggcggaagggagg

SEQ ID NO: 55254 - DNA, 106 bp, Homo sapiens; identical to SEQ ID NO: 34574
  chr12:103311184-103311290
  hyper

SEQ ID NO: 55255 - DNA, 32 bp, Homo sapiens; identical to SEQ ID NO: 34575
  chr12:103344621-103344653
  hyper

SEQ ID NO: 55256 - DNA, 60 bp, Homo sapiens; identical to SEQ ID NO: 11370
  chr12:103350244-103350304
  hyper

SEQ ID NO: 55257 - DNA, 239 bp, Homo sapiens; identical to SEQ ID NO: 34577
  chr12:103350383-103350622
  hyper

SEQ ID NO: 55258 - DNA, 87 bp, Homo sapiens
  chr12:103351477-103351564
  hyper
acgtggaaggcgcaccgacagggatccggccagggagggcgagtgaaagaaggaaatcagaaaggaagggagttaacaaaataataa

SEQ ID NO: 55259 - DNA, 204 bp, Homo sapiens
  chr12:103358661-103358865
  hyper
gttctttacccactgcgaaagcgaatggcttggatctagcgcaggtcgaagttatattccttcttcctttgtatgcaagattaggttgttacaaaagagggtgtgtaggttaatggcaggaagcaagttgcagcgcggagcgcgggccctgagcgcgtgtcaggcttaatgatttattcaagctgcagcgcatccgggcgttga

SEQ ID NO: 55260 - DNA, 64 bp, Homo sapiens
  chr12:103358899-103358963
  hyper
gcgccgggaactctccaggctacctgaagctggggggaggaagaggaggcgtggggacccgagg

SEQ ID NO: 55261 - DNA, 204 bp, Homo sapiens
  chr12:103359352-103359556
  hyper
gagatgggggaaagccgccaacccacactccttggagggagtcactttctgcaaagtgcgttggagaggactgggccctgggtccgggctgtcgaagcaggaagtggatgtaggggacaaaagctccgcacctgccaaatgcgagaccttagagagagcctccccctcgccgctccctgctcccccgcgggcccgggaagcttg

SEQ ID NO: 55262 - DNA, 132 bp, Homo sapiens
  chr12:103359586-103359718
  hyper
cgcctccggactcgaccccaccatagccccgccgtccgaatcgtctctgaaccaaactacttctgcctgcctttctttggatctgtctttctctgtcatctgagtcactttctctctcgcctctcttttctt

SEQ ID NO: 55263 - DNA, 288 bp, Homo sapiens; identical to SEQ ID NO: 34586
  chr12:103889228-103889516
  hyper

SEQ ID NO: 55264 - DNA, 197 bp, Homo sapiens; identical to SEQ ID NO: 1063
  chr12:103889517-103889714
  hyper

SEQ ID NO: 55265 - DNA, 213 bp, Homo sapiens
  chr12:103889812-103890025
  hyper
gggctgccttgccgtgagaccctcccccgcgactgccaccaaagtcacagaaaactttcacacctctcatctgacactgtggcctgtgcacgactccaagcactggggaagccttcgacatcagaatatgaatggcacctgttcttccgggggcggcaagggggatcccgatgtttatcaaaatgggttgattttccacggagggggtacttc

SEQ ID NO: 55266 - DNA, 112 bp, Homo sapiens; identical to SEQ ID NO: 34589
  chr12:104322966-104323078
  hyper

SEQ ID NO: 55267 - DNA, 81 bp, Homo sapiens
  chr12:104609336-104609417
  hyper
ggattttgggtggtgcgctcttttctcctttccatttctgcattttccaatttacctttagcgaccgttctttcctgttaa

SEQ ID NO: 55268 - DNA, 261 bp, Homo sapiens
  chr12:104850244-104850505
  hyper
aaagaaaaacgaaaccgcccagttctgagcgtcggaaaatgggcactcgctccctgggggtttggggcaacttccccgctacgtcgcccagggattttaaataattgccagccaccagaaaccccctaacccttaattcttccctccgagacccagcccgctgcttgccacttccctctccaaacgctggcgggggtgggtggcagcaccgaggcgattttcttcgtctttttttcctccgggttttgtcatggaaacgct

SEQ ID NO: 55269 - DNA, 485 bp, Homo sapiens
  chr12:104850592-104851077
  hyper
ccgggcaacagctggacgcgaccatatcccgggtaggggcggggggagcgcgacgctccgccccggcgctagggtccctccctcctcccggctctccgcaggcgccctcccctcgccgggggccgcgagttgcatttggtaaaacccagccccggaatatatagatcgttggagcgcaatgaagtagcctttggagagaagggagagggcccgtcggacagccacagcggccagcgcagcggcagcggcggcggcaccaccatcaccgctcgcaccccagccgcccggcccgcgaccaggcagcggcggccgccggcgggatcggaggaggcggcggagcggcgaggaggaggagcaggagcgcgcagccagcgggtccacgcatctcagcacttccagaccaactccggcaccttccacacccctgcccgggctgggggctccgagagcggccgcgaagcgactccgatcctccctctgagcct

SEQ ID NO: 55270 - DNA, 63 bp, Homo sapiens
  chr12:104851186-104851249
  hyper
gccatgaagccagcgctgctggaagtgatgaggatgaacagaatctgccggatggtgctggcc

SEQ ID NO: 55271 - DNA, 112 bp, Homo sapiens
  chr12:104851920-104852032
  hyper
gttgcccctccaccacgcgccggccgtttgcccccggggtccgggtccgcagtgaccttgcggctggtgccccggggcctgctccagcccccagccctgagctggaaactcc

SEQ ID NO: 55272 - DNA, 107 bp, Homo sapiens; identical to SEQ ID NO: 34598
  chr12:104852725-104852832
  hyper

SEQ ID NO: 55273 - DNA, 43 bp, Homo sapiens; identical to SEQ ID NO: 34599
  chr12:105478265-105478308
  hyper

SEQ ID NO: 55274 - DNA, 30 bp, Homo sapiens; identical to SEQ ID NO: 34600
  chr12:106532217-106532247
  hyper

SEQ ID NO: 55275 - DNA, 610 bp, Homo sapiens
  chr12:106974383-106974993
  hyper
ataataatagcaacaataatagtctcatccgccctggagaccacccgtgcccccgtggcatccctcaaggactctccgggcggtggcagccgcccaccctggggacgcgctccttgctgccaccggaacgcccctggccaggctccatctacgcgctgtcagaccctcccgccgtctgaagaaggcttttactcttcagcctattccagtggcagagaagctaaggctacaaaggcgaacgcgaacagtcagatctgacttcgaattccgctgtcattgctgccaggcgcaccacgaggacgcgcggtgaccgccaccatggcattcggctgccaaaggtttccatcgacctctttcccatcaccagcatcgcagcgggaaagaatgtgcctggcgcccttctgggcactgggcatggggtggtgaacaaagtcctccagaaataaaccgggtaatgagcccggcagcggccggggcaggaagggaccttcgcagagagtggtcaggcacagcccctccgaggaggcgacgctcagctgagaccagggtgacgcaaaggtgtcggccggttaggcacctgtgaggaaggaggagccggcagagtgccaag

SEQ ID NO: 55276 - DNA, 439 bp, Homo sapiens; identical to SEQ ID NO: 34602
  chr12:106975246-106975685
  hyper

SEQ ID NO: 55277 - DNA, 119 bp, Homo sapiens; identical to SEQ ID NO: 34603
  chr12:106976403-106976522
  hyper

SEQ ID NO: 55278 - DNA, 11 bp, Homo sapiens
  chr12:106976842-106976853
  hyper
cgctttttctc

SEQ ID NO: 55279 - DNA, 355 bp, Homo sapiens
  chr12:106977497-106977852
  hyper
ccaggtcctcctagggtatgggggcctcggaatagcggtgcgctcggggtctggcggccagggccgggaagccgagcggaacgccccgaggcgggggagggtgacggcttcgcactgcgcctgggaggtggggaccgaggctccggctggtagagacgcgcagctggagggagtggcggcggcgaacccggtggtccgggggaatccgcagaaacgggaggtgggagtcctgggctgtggggtcgggcttttagcttttctgccaggaaggggcacccaacgccgggctccactagggagctgtgaccttgctggagggagggcaggacgcagactggcccgctaaactcggcgt

SEQ ID NO: 55280 - DNA, 30 bp, Homo sapiens; identical to SEQ ID NO: 34607
  chr12:106978736-106978766
  hyper

SEQ ID NO: 55281 - DNA, 56 bp, Homo sapiens
  chr12:106979534-106979590
  hyper
aaccgactcacagcaagtgctggggcgaagtaggaaacgtccaggataagagaggc

SEQ ID NO: 55282 - DNA, 163 bp, Homo sapiens
  chr12:106979636-106979799
  hyper
cgaagtgcctcgggcccgggagaacagttttgcaggggccagggctctagtggcctgctttggggccacttcagcatgacctgcggaaacgcgcccctttgttccgcacactgagccagtaatatattcctcgggtttccccaaaatactcaacaagtgtgga

SEQ ID NO: 55283 - DNA, 147 bp, Homo sapiens
  chr12:106980333-106980480
  hyper
ctgccaagctggagctggaaacttctgcctccatccactttccgctcccatctccagaacccagagctgaggcggccaaagtacttcctggagccggatttgagttccccgggccgcatcggtgggagggcacgctagtttacaggc

SEQ ID NO: 55284 - DNA, 28 bp, Homo sapiens
  chr12:106980719-106980747
  hyper
caaaccagacagtctcgccctccccggg

SEQ ID NO: 55285 - DNA, 133 bp, Homo sapiens; identical to SEQ ID NO: 21490
  chr12:106981406-106981539
  hyper

SEQ ID NO: 55286 - DNA, 42 bp, Homo sapiens; identical to SEQ ID NO: 34615
  chr12:107297268-107297310
  hyper

SEQ ID NO: 55287 - DNA, 100 bp, Homo sapiens
  chr12:107486450-107486550
  hyper
cctaaaattcgtaagcggtataagcaagacagtcccacgtctaaattcacagatttggcggatcgcatggaattcattaacatcagactcattaaacacc

SEQ ID NO: 55288 - DNA, 38 bp, Homo sapiens; identical to SEQ ID NO: 34618
  chr12:107711950-107711988
  hyper

SEQ ID NO: 55289 - DNA, 206 bp, Homo sapiens
  chr12:107714660-107714866
  hyper
gttagtttagggcgtcgtttccagcaggttctatcatcgtctcttcatgccccactgttttgaaggcctgacttgggtaggtttgaacccgcagttctgtccttgaagggggtggggccggggcgcttgttttcgagagctcgcgctggcggtgctgcccgtctgcgaaagccggagctagacacttcaaagcttcaattttccac

SEQ ID NO: 55290 - DNA, 37 bp, Homo sapiens
  chr12:107715153-107715190
  hyper
tccagccgaagcctttggaaaccgaccctgccgccct

SEQ ID NO: 55291 - DNA, 49 bp, Homo sapiens; identical to SEQ ID NO: 21492
  chr12:108168922-108168971
  hyper

SEQ ID NO: 55292 - DNA, 31 bp, Homo sapiens
  chr12:108169573-108169604
  hyper
aacctaaggtcctcttcgaaggtggtttgca

SEQ ID NO: 55293 - DNA, 44 bp, Homo sapiens
  chr12:108237422-108237466
  hyper
aaacagcttcttcatcgcggcagcttcggagaagcctcagctac

SEQ ID NO: 55294 - DNA, 88 bp, Homo sapiens
  chr12:108297323-108297411
  hyper
aagttggagatacaccgattctcctgtttctggggaaggattctcagaaggtggctcatatgagtaaaaatcatttttcctgggtagc

SEQ ID NO: 55295 - DNA, 290 bp, Homo sapiens; identical to SEQ ID NO: 21494
  chr12:108297466-108297756
  hyper

SEQ ID NO: 55296 - DNA, 79 bp, Homo sapiens; identical to SEQ ID NO: 34626
  chr12:108523360-108523439
  hyper

SEQ ID NO: 55297 - DNA, 30 bp, Homo sapiens; identical to SEQ ID NO: 34627
  chr12:109746889-109746919
  hyper

SEQ ID NO: 55298 - DNA, 100 bp, Homo sapiens; identical to SEQ ID NO: 34628
  chr12:110271088-110271188
  hyper

SEQ ID NO: 55299 - DNA, 372 bp, Homo sapiens; identical to SEQ ID NO: 11409
  chr12:111284662-111285034
  hyper

SEQ ID NO: 55300 - DNA, 12 bp, Homo sapiens
  chr12:111471165-111471177
  hyper
tggtgacatttc

SEQ ID NO: 55301 - DNA, 389 bp, Homo sapiens; identical to SEQ ID NO: 21497
  chr12:111471559-111471948
  hyper

SEQ ID NO: 55302 - DNA, 166 bp, Homo sapiens; identical to SEQ ID NO: 3946
  chr12:111472851-111473017
  hyper

SEQ ID NO: 55303 - DNA, 67 bp, Homo sapiens; identical to SEQ ID NO: 34637
  chr12:111844623-111844690
  hyper

SEQ ID NO: 55304 - DNA, 122 bp, Homo sapiens; identical to SEQ ID NO: 21499
  chr12:113013157-113013279
  hyper

SEQ ID NO: 55305 - DNA, 30 bp, Homo sapiens; identical to SEQ ID NO: 34639
  chr12:113229420-113229450
  hyper

SEQ ID NO: 55306 - DNA, 77 bp, Homo sapiens; identical to SEQ ID NO: 34640
  chr12:113494339-113494416
  hyper

SEQ ID NO: 55307 - DNA, 607 bp, Homo sapiens; identical to SEQ ID NO: 34641
  chr12:113494430-113495037
  hyper

SEQ ID NO: 55308 - DNA, 50 bp, Homo sapiens; identical to SEQ ID NO: 34642
  chr12:113495038-113495088
  hyper

SEQ ID NO: 55309 - DNA, 161 bp, Homo sapiens
  chr12:113541506-113541667
  hyper
ttagaaataacacgtcgcatacgccaagcagcgtcctatgctctttgtgtaaatcaagtcatttaattatcacaactccacgagataggcactgttatcaacctcatttcacagttgaggagactgaggcatagagaggttgagtaacttgcccaaggttg

SEQ ID NO: 55310 - DNA, 111 bp, Homo sapiens; identical to SEQ ID NO: 21504
  chr12:113592127-113592238
  hyper

SEQ ID NO: 55311 - DNA, 39 bp, Homo sapiens; identical to SEQ ID NO: 21505
  chr12:113592359-113592398
  hyper

SEQ ID NO: 55312 - DNA, 140 bp, Homo sapiens; identical to SEQ ID NO: 34645
  chr12:113900538-113900678
  hyper

SEQ ID NO: 55313 - DNA, 309 bp, Homo sapiens; identical to SEQ ID NO: 21506
  chr12:113900765-113901074
  hyper

SEQ ID NO: 55314 - DNA, 427 bp, Homo sapiens
  chr12:113901591-113902018
  hyper
ctcagactgccagagaccacacacagagacgggagagactccgagaccgtgggggacacacgcggcaaaaactcggagacttcagtcacaggttccctgacacctagagatggagagagacagaggcggccagagacgcagagacagacaatgattcctaagtgtcttagggtcggtgagagacacagagatgcgggacagcgagagacagacggagagatcggcagaggggcagagagaaaggcggaaaagagacccagagacgcggagtccgcggctgagacccgaaagcccgagacatcggagggtcgcggaggagtcgaggagacgcagagagaggaaagacggccgcggttagagacacgcgtggaaacccccgggggcggcagcgagggagtcaggagtgagcccgaagatggagagaagt

SEQ ID NO: 55315 - DNA, 79 bp, Homo sapiens; identical to SEQ ID NO: 34649
  chr12:113902608-113902687
  hyper

SEQ ID NO: 55316 - DNA, 447 bp, Homo sapiens; identical to SEQ ID NO: 21507
  chr12:113903021-113903468
  hyper

SEQ ID NO: 55317 - DNA, 45 bp, Homo sapiens; identical to SEQ ID NO: 21508
  chr12:113903498-113903543
  hyper

SEQ ID NO: 55318 - DNA, 23 bp, Homo sapiens
  chr12:113904756-113904779
  hyper
gcgatcgtgtctagacgtgtgtc

SEQ ID NO: 55319 - DNA, 13 bp, Homo sapiens
  chr12:113905016-113905029
  hyper
gaataggacaggt

SEQ ID NO: 55320 - DNA, 33 bp, Homo sapiens; identical to SEQ ID NO: 34652
  chr12:113905380-113905413
  hyper

SEQ ID NO: 55321 - DNA, 761 bp, Homo sapiens; identical to SEQ ID NO: 34653
  chr12:113905673-113906434
  hyper

SEQ ID NO: 55322 - DNA, 32 bp, Homo sapiens; identical to SEQ ID NO: 34654
  chr12:113907104-113907136
  hyper

SEQ ID NO: 55323 - DNA, 35 bp, Homo sapiens; identical to SEQ ID NO: 34656
  chr12:113909468-113909503
  hyper

SEQ ID NO: 55324 - DNA, 123 bp, Homo sapiens; identical to SEQ ID NO: 34657
  chr12:113909534-113909657
  hyper

SEQ ID NO: 55325 - DNA, 449 bp, Homo sapiens; identical to SEQ ID NO: 34658
  chr12:113909717-113910166
  hyper

SEQ ID NO: 55326 - DNA, 157 bp, Homo sapiens; identical to SEQ ID NO: 11429
  chr12:113910529-113910686
  hyper

SEQ ID NO: 55327 - DNA, 399 bp, Homo sapiens
  chr12:113912868-113913267
  hyper
agctcagccccagttcgagaactccctggacctgggctcagccaagctgcccagaacccgcccggccttctctagcccaccaccttccccggtgcacagcatcggaaaatgccagcagaccagctattagactcatcccgacctaacagcgctaacagatggcgaccaggcagcgaaatcccctcctatatgtaactaataaaccgcttgtgtcttaacagggtaatgcatggagacgcaatgtcacttatacaagatgttgatggaatttactatataaaaatcttcctcctagagtaaagagtatcaacattacaactcgacagacggcggcgggataagtaaaacagacaaaagacaaacaagataataatctgtttccaatcacttaagccctgt

SEQ ID NO: 55328 - DNA, 174 bp, Homo sapiens; identical to SEQ ID NO: 21515
  chr12:113914050-113914224
  hyper

SEQ ID NO: 55329 - DNA, 228 bp, Homo sapiens; identical to SEQ ID NO: 34662
  chr12:113914300-113914528
  hyper

SEQ ID NO: 55330 - DNA, 323 bp, Homo sapiens
  chr12:113916326-113916649
  hyper
gtgtgcctgcgcgtgtatttctcgcttgctaatgattgtgtgttgatagagtgatgcagtggcctcattagcctttgtttagaaggtgttaaaagggaaatctgcatcgggaaagcggcggtttacgcagcagcccggctgaacaccgcgagccaaggggctggggggcggggacggtgcccaccccccaggcccccactcttcccccaggcgcccaccgccgcggaccccgggagggaggaggggtccggggaaagcgaccccagctccttcctcccaaggcgagtatgtttaccctgctgggcacccttccgctccgcggg

SEQ ID NO: 55331 - DNA, 52 bp, Homo sapiens
  chr12:113916678-113916730
  hyper
tcctctcaactgccccgcagtgcgcggcggccttttccgccaggttttttgg

SEQ ID NO: 55332 - DNA, 207 bp, Homo sapiens
  chr12:113917310-113917517
  hyper
ttttatactggctcctacgaaaggaaccagaaaaaaaaataatacacattttgagcagcctctgtgggtgcagcttgttgaactcggagccagacgctttttctggcgaaacggagaaaaaacgccgcggaaacggtgcgcagggttggggagtataggttctgattgcaacataattccgcaagcttttttattttttatttttcc

SEQ ID NO: 55333 - DNA, 121 bp, Homo sapiens; identical to SEQ ID NO: 34666
  chr12:113917580-113917701
  hyper

SEQ ID NO: 55334 - DNA, 45 bp, Homo sapiens
  chr12:113917730-113917775
  hyper
cgcggccggctggggcctcgggcagtgacagtgaaacgaattcca

SEQ ID NO: 55335 - DNA, 136 bp, Homo sapiens; identical to SEQ ID NO: 34668
  chr12:113918155-113918291
  hyper

SEQ ID NO: 55336 - DNA, 192 bp, Homo sapiens; identical to SEQ ID NO: 34669
  chr12:113952930-113953122
  hyper

SEQ ID NO: 55337 - DNA, 42 bp, Homo sapiens; identical to SEQ ID NO: 34670
  chr12:113953467-113953509
  hyper

SEQ ID NO: 55338 - DNA, 368 bp, Homo sapiens; identical to SEQ ID NO: 34671
  chr12:113957639-113958007
  hyper

SEQ ID NO: 55339 - DNA, 177 bp, Homo sapiens
  chr12:114029660-114029837
  hyper
ctcgccgagctcgattctccgggtgccataaattaggacgccagtcgccggcgaacgctgggggcttccagtataccttccagcgcagcccgcaggctatttttatctccctcagcacctcggcacctcggaggagcttctgctaattcactaccccgacaccgtctcatctcccct

SEQ ID NO: 55340 - DNA, 96 bp, Homo sapiens; identical to SEQ ID NO: 34673
  chr12:114075780-114075876
  hyper

SEQ ID NO: 55341 - DNA, 120 bp, Homo sapiens
  chr12:114075909-114076029
  hyper
cgcgtttcacacagcgcacaatggccgccctcaaaggcgcgccgcccgcattgttcgggccggcgcccgcgcgtcctacctccgcgcgcgaattaacccccgtcaccccgccattgtcac

SEQ ID NO: 55342 - DNA, 218 bp, Homo sapiens
  chr12:114833767-114833985
  hyper
tccccaccgaacttgcgaatcgccgcgtttaacagcctgaaaatctggcctgctttttcccgggaactgcggaggttgtctctgtgactttgattatttgcattgatgaccctggggcaagattcttggaccaaccctggagtccggccccgatcgagtggaggtagttgggggaggcgagccgcggccgggggcgggggagggacgaggaactcgcg

SEQ ID NO: 55343 - DNA, 24 bp, Homo sapiens
  chr12:114834102-114834126
  hyper
gcggggccccgctggccgccacag

SEQ ID NO: 55344 - DNA, 30 bp, Homo sapiens; identical to SEQ ID NO: 34676
  chr12:114834466-114834496
  hyper

SEQ ID NO: 55345 - DNA, 124 bp, Homo sapiens
  chr12:114838726-114838850
  hyper
ctccaccctcccccttcacacactcggtggcttgggcctaccgttcgcctgctccacacgcctgctcggggcatcctctggctttttgctttgcgggacgcggaagacccgtccagcacgggta

SEQ ID NO: 55346 - DNA, 12 bp, Homo sapiens
  chr12:114841034-114841046
  hyper
acaaatggtgcg

SEQ ID NO: 55347 - DNA, 99 bp, Homo sapiens
  chr12:114841084-114841183
  hyper
gaggcaggaggaggcgggaggaggcgaaggctacggaagatcagaagaggggtcaagccatcgctcatgccggcctgaatcggccgctgacctggccct

SEQ ID NO: 55348 - DNA, 30 bp, Homo sapiens; identical to SEQ ID NO: 34679
  chr12:114841854-114841884
  hyper

SEQ ID NO: 55349 - DNA, 72 bp, Homo sapiens; identical to SEQ ID NO: 11445
  chr12:114843007-114843079
  hyper

SEQ ID NO: 55350 - DNA, 260 bp, Homo sapiens; identical to SEQ ID NO: 21527
  chr12:114843285-114843545
  hyper

SEQ ID NO: 55351 - DNA, 145 bp, Homo sapiens
  chr12:114843660-114843805
  hyper
aatacttcccagttggcaagcgccaaagaacacaaaatagcctccaagagcaccggcaaccatataatctcagtgccccgctcctcctttacacccccagggagggaaagttggaagcccagtgaatggtcgaagtcctttctga

SEQ ID NO: 55352 - DNA, 17 bp, Homo sapiens
  chr12:114844184-114844201
  hyper
acaaatcatttcaaacg

SEQ ID NO: 55353 - DNA, 74 bp, Homo sapiens
  chr12:114844300-114844374
  hyper
ttgcagacattctctccaacgctgacctcgagaaggagagctgcctgaccccgcctggccggcgctcgccttcc

SEQ ID NO: 55354 - DNA, 175 bp, Homo sapiens; identical to SEQ ID NO: 34683
  chr12:114845868-114846043
  hyper

SEQ ID NO: 55355 - DNA, 259 bp, Homo sapiens
  chr12:114846456-114846715
  hyper
tccaagaatgcaattcgtcccagagtggcccggcaggggcggggtgcgagtgggtggtggagtaggggtgggagtggagagaggtggtttctgtagagaataattattgtaccagggcccgccgaggcacgaggcactctattttgttttgtaatcacgacgactattatttttagtctgatcaatgggcacaatttctaagcagcgcagtggtggatgctcgcaaacttttgcgcaccgctggaaacccactaggttg

SEQ ID NO: 55356 - DNA, 179 bp, Homo sapiens; identical to SEQ ID NO: 21531
  chr12:114846768-114846947
  hyper

SEQ ID NO: 55357 - DNA, 62 bp, Homo sapiens; identical to SEQ ID NO: 34688
  chr12:114852127-114852189
  hyper

SEQ ID NO: 55358 - DNA, 71 bp, Homo sapiens
  chr12:114877262-114877333
  hyper
ctccgaagccagggtgctcaacctggccccctttctttcctgctggtgaggccacccgctttgggacagaa

SEQ ID NO: 55359 - DNA, 183 bp, Homo sapiens
  chr12:114878367-114878550
  hyper
ataattccatgcccacgagccgacagatttgcaattctcaagtacttctatgtgcatgtaattctacgggcaaattgttccgagtgcaagggatttggtgtgtgtgtcagtgattgcaccgctgaaaacaattctgtagatgtgtcgatgcctttagaagaaagggctccaaagaatcgtgtc

SEQ ID NO: 55360 - DNA, 10 bp, Homo sapiens
  chr12:114878584-114878594
  hyper
ggctaaatcc

SEQ ID NO: 55361 - DNA, 5 bp, Homo sapiens
  chr12:114878808-114878813
  hyper
cggga

SEQ ID NO: 55362 - DNA, 320 bp, Homo sapiens
  chr12:114881764-114882084
  hyper
tccgccggcagcgtgggccggagggattgcttcacactccggaattgggcccagacacatttagaaatgttttgctggacgtgtgccccgcaagggcgacagcggcagccggcagcctgggtgaagctgcgccgctggtcacaggctggcgcgcggcggcggccacagaggcgtcctaggtggagaatgcttctgcctttgcctgttctcccctaacccccacgtttgtatgcctcctggggacaggggtctgtctgcagcctgcagcgccccagctgtgaccagagaagcattaaggagcggcgcgggcaagaatttgg

SEQ ID NO: 55363 - DNA, 21 bp, Homo sapiens
  chr12:114883452-114883473
  hyper
ttgtttgaggatccccgcgcc

SEQ ID NO: 55364 - DNA, 30 bp, Homo sapiens; identical to SEQ ID NO: 34695
  chr12:114883832-114883862
  hyper

SEQ ID NO: 55365 - DNA, 39 bp, Homo sapiens; identical to SEQ ID NO: 34696
  chr12:114885145-114885184
  hyper

SEQ ID NO: 55366 - DNA, 15 bp, Homo sapiens
  chr12:114885371-114885386
  hyper
cgctggaagaaacga

SEQ ID NO: 55367 - DNA, 61 bp, Homo sapiens; identical to SEQ ID NO: 34698
  chr12:114885605-114885666
  hyper

SEQ ID NO: 55368 - DNA, 421 bp, Homo sapiens; identical to SEQ ID NO: 34699
  chr12:114917674-114918095
  hyper

SEQ ID NO: 55369 - DNA, 7 bp, Homo sapiens
  chr12:114918587-114918594
  hyper
ggagaag

SEQ ID NO: 55370 - DNA, 38 bp, Homo sapiens; identical to SEQ ID NO: 11459
  chr12:115106464-115106502
  hyper

SEQ ID NO: 55371 - DNA, 130 bp, Homo sapiens; identical to SEQ ID NO: 34702
  chr12:115121885-115122015
  hyper

SEQ ID NO: 55372 - DNA, 40 bp, Homo sapiens; identical to SEQ ID NO: 34703
  chr12:115130675-115130715
  hyper

SEQ ID NO: 55373 - DNA, 73 bp, Homo sapiens; identical to SEQ ID NO: 34704
  chr12:115889703-115889776
  hyper

SEQ ID NO: 55374 - DNA, 291 bp, Homo sapiens; identical to SEQ ID NO: 34707
  chr12:117319805-117320096
  hyper

SEQ ID NO: 55375 - DNA, 310 bp, Homo sapiens
  chr12:117798095-117798405
  hyper
ggggcgcagtcccgagagagccccttccgggacctcggacgcaaggcccctgagtggccctggaagttggatcccccggggaccctgctccgaaccctggccacctggaagcaacctcatcgagcgctccttccactgcccagccccgaaccgtggcggaacgcgcccctcggcctccctagagcctcctttgcgggagaagcacaactttcccaggttttggagacggcgctcttacaccccaatctcgcccagacggaagaagtgagaggtgcgggcggccccgccatgaccgcgggaggagagcgca

SEQ ID NO: 55376 - DNA, 193 bp, Homo sapiens; identical to SEQ ID NO: 34709
  chr12:117799086-117799279
  hyper

SEQ ID NO: 55377 - DNA, 83 bp, Homo sapiens; identical to SEQ ID NO: 21541
  chr12:117799330-117799413
  hyper

SEQ ID NO: 55378 - DNA, 9 bp, Homo sapiens
  chr12:117799529-117799538
  hyper
gtttatggg

SEQ ID NO: 55379 - DNA, 88 bp, Homo sapiens; identical to SEQ ID NO: 34711
  chr12:119212112-119212200
  hyper

SEQ ID NO: 55380 - DNA, 25 bp, Homo sapiens
  chr12:119212381-119212406
  hyper
atggtttccgcggagctggtgaagg

SEQ ID NO: 55381 - DNA, 62 bp, Homo sapiens; identical to SEQ ID NO: 34713
  chr12:119417764-119417826
  hyper

SEQ ID NO: 55382 - DNA, 78 bp, Homo sapiens
  chr12:119418516-119418594
  hyper
aaaagtggctgcaggcggattccccaggagtggatgggggtggggtggggtgagatgggaactctttcctctggacgg

SEQ ID NO: 55383 - DNA, 477 bp, Homo sapiens
  chr12:119418847-119419324
  hyper
tgagggtctgggggaggccggctggggtggatagattaagttttttacgagcccccccaaccccccccccccccccacgcagaagatcagctacaagacttgcgaaggggctggaaagaaaggtggcctggcccaaagggggcacccaggaaagggctgaggaaggccagcgatgatgggagaggagaggggcctgggaagcaggatctcctgcctggcgcagattggggtgccaggatggcttctcagagggatcagcgctgcaactcggtcgccgcggggccctggtgacaggcgcacgccccgccctttctcctcccaagacctgcgggcttttgttatgcagatggcggcaggaggctgagcctgaggaggagggggttggtggggaggaggagagacggagaggggggaggaaagtgcagctcgcgcgaccagcctcctcttccaacgtcacattgtgcgagagacaaaacc

SEQ ID NO: 55384 - DNA, 68 bp, Homo sapiens
  chr12:119419368-119419436
  hyper
cgtcgcctcttctctcctggtgctgcccagaaagccagccctcccttcccttcttggggcgcagaggc

SEQ ID NO: 55385 - DNA, 254 bp, Homo sapiens; identical to SEQ ID NO: 21545
  chr12:119419466-119419720
  hyper

SEQ ID NO: 55386 - DNA, 30 bp, Homo sapiens; identical to SEQ ID NO: 34716
  chr12:119446620-119446650
  hyper

SEQ ID NO: 55387 - DNA, 91 bp, Homo sapiens; identical to SEQ ID NO: 34717
  chr12:119458719-119458810
  hyper

SEQ ID NO: 55388 - DNA, 119 bp, Homo sapiens; identical to SEQ ID NO: 34718
  chr12:119499184-119499303
  hyper

SEQ ID NO: 55389 - DNA, 30 bp, Homo sapiens; identical to SEQ ID NO: 34719
  chr12:120031836-120031866
  hyper

SEQ ID NO: 55390 - DNA, 29 bp, Homo sapiens
  chr12:120032345-120032374
  hyper
cttctctctttgctgcgcccaagggcacc

SEQ ID NO: 55391 - DNA, 56 bp, Homo sapiens; identical to SEQ ID NO: 34721
  chr12:120032375-120032431
  hyper

SEQ ID NO: 55392 - DNA, 153 bp, Homo sapiens; identical to SEQ ID NO: 34722
  chr12:120032454-120032607
  hyper

SEQ ID NO: 55393 - DNA, 25 bp, Homo sapiens
  chr12:120032837-120032862
  hyper
ctctctaggagtggccgctggggcc

SEQ ID NO: 55394 - DNA, 151 bp, Homo sapiens
  chr12:120033169-120033320
  hyper
ccgcccacacttgcccacgggtggtggcaccatattcgattcgtgggcacctgcaaggctccatttgcacccgtaacttgccctttcccaaacccggtttgtggacagcgtctgcaccgatatgaaagcgtgcagccgctgaagttcagac

SEQ ID NO: 55395 - DNA, 32 bp, Homo sapiens; identical to SEQ ID NO: 34724
  chr12:120807600-120807632
  hyper

SEQ ID NO: 55396 - DNA, 193 bp, Homo sapiens; identical to SEQ ID NO: 34725
  chr12:120807844-120808037
  hyper

SEQ ID NO: 55397 - DNA, 30 bp, Homo sapiens; identical to SEQ ID NO: 34726
  chr12:120826930-120826960
  hyper

SEQ ID NO: 55398 - DNA, 191 bp, Homo sapiens; identical to SEQ ID NO: 34727
  chr12:121566850-121567041
  hyper

SEQ ID NO: 55399 - DNA, 36 bp, Homo sapiens; identical to SEQ ID NO: 34728
  chr12:122667836-122667872
  hyper

SEQ ID NO: 55400 - DNA, 527 bp, Homo sapiens; identical to SEQ ID NO: 34729
  chr12:122688648-122689175
  hyper

SEQ ID NO: 55401 - DNA, 156 bp, Homo sapiens; identical to SEQ ID NO: 34730
  chr12:123920515-123920671
  hyper

SEQ ID NO: 55402 - DNA, 42 bp, Homo sapiens; identical to SEQ ID NO: 34731
  chr12:124779516-124779558
  hyper

SEQ ID NO: 55403 - DNA, 15 bp, Homo sapiens
  chr12:125534407-125534422
  hyper
cgggaagggagggga

SEQ ID NO: 55404 - DNA, 15 bp, Homo sapiens
  chr12:125670102-125670117
  hyper
ctggatggaagaatt

SEQ ID NO: 55405 - DNA, 111 bp, Homo sapiens; identical to SEQ ID NO: 34734
  chr12:125670334-125670445
  hyper

SEQ ID NO: 55406 - DNA, 369 bp, Homo sapiens; identical to SEQ ID NO: 34735
  chr12:125671544-125671913
  hyper

SEQ ID NO: 55407 - DNA, 268 bp, Homo sapiens; identical to SEQ ID NO: 34736
  chr12:125672764-125673032
  hyper

SEQ ID NO: 55408 - DNA, 127 bp, Homo sapiens
  chr12:126168427-126168554
  hyper
gcacaggtggccccgcgcctctcacacaggttcagctcccgccggtccctgtgcagagcgccccctgccggtccctcttggaggctgggccagcgttgcgagtcttgccagggacgcgcgctctagc

SEQ ID NO: 55409 - DNA, 51 bp, Homo sapiens
  chr12:126168620-126168671
  hyper
gcacctgtcctagaccccctgcgcctattcctcgcccgccccatccttccc

SEQ ID NO: 55410 - DNA, 267 bp, Homo sapiens; identical to SEQ ID NO: 34738
  chr12:126675639-126675906
  hyper

SEQ ID NO: 55411 - DNA, 30 bp, Homo sapiens; identical to SEQ ID NO: 11481
  chr12:127212512-127212542
  hyper

SEQ ID NO: 55412 - DNA, 17 bp, Homo sapiens
  chr12:127765432-127765449
  hyper
cacgaggggccgacagg

SEQ ID NO: 55413 - DNA, 127 bp, Homo sapiens; identical to SEQ ID NO: 11483
  chr12:127865735-127865862
  hyper

SEQ ID NO: 55414 - DNA, 251 bp, Homo sapiens
  chr12:128751133-128751384
  hyper
cgcaccccgccttcacgctccgctgcgcgctgcttttccgcgctcagtgatccagttaggagctctccccgcagcagctgcgcgggactttgcattccagatgtccccagccctccaggctaaagcagcggccacctgaagttgaggaatggggcgtgacgaccaccaggtcccgcagtgaccacgggagggtggggagaaggagtccagctccgccttgagcgtcgggtccctgggcaggaccctccggg

SEQ ID NO: 55415 - DNA, 127 bp, Homo sapiens
  chr12:128751694-128751821
  hyper
aggctgcggaggctgcgggagaaaagttgtcccggccggagcgcgagcagcggcggagccggagccgccagagccagagccggagctgcggcggcgtggacccggcaggggcgggcctcggacagca

SEQ ID NO: 55416 - DNA, 27 bp, Homo sapiens
  chr12:128752240-128752267
  hyper
ggtcccgagtcccgaatctcccacccc

SEQ ID NO: 55417 - DNA, 266 bp, Homo sapiens; identical to SEQ ID NO: 21563
  chr12:128752944-128753210
  hyper

SEQ ID NO: 55418 - DNA, 84 bp, Homo sapiens; identical to SEQ ID NO: 34747
  chr12:129337826-129337910
  hyper

SEQ ID NO: 55419 - DNA, 10 bp, Homo sapiens
  chr12:129338816-129338826
  hyper
gcgttaatcc

SEQ ID NO: 55420 - DNA, 79 bp, Homo sapiens; identical to SEQ ID NO: 34749
  chr12:129338851-129338930
  hyper

SEQ ID NO: 55421 - DNA, 30 bp, Homo sapiens; identical to SEQ ID NO: 34750
  chr12:130387483-130387513
  hyper

SEQ ID NO: 55422 - DNA, 114 bp, Homo sapiens
  chr12:130387811-130387925
  hyper
aaaacagggcggccaggctgatgagtaccggcgaccagtggtgccacagcgtccccatctcagacgggcacatcctggagacccggagcgcagatcctccgctccccggcgccg

SEQ ID NO: 55423 - DNA, 131 bp, Homo sapiens; identical to SEQ ID NO: 21568
  chr12:130388279-130388410
  hyper

SEQ ID NO: 55424 - DNA, 30 bp, Homo sapiens; identical to SEQ ID NO: 34754
  chr12:130498725-130498755
  hyper

SEQ ID NO: 55425 - DNA, 42 bp, Homo sapiens; identical to SEQ ID NO: 11494
  chr12:130526846-130526888
  hyper

SEQ ID NO: 55426 - DNA, 164 bp, Homo sapiens; identical to SEQ ID NO: 34756
  chr12:130526931-130527095
  hyper

SEQ ID NO: 55427 - DNA, 43 bp, Homo sapiens; identical to SEQ ID NO: 21571
  chr12:130589266-130589309
  hyper

SEQ ID NO: 55428 - DNA, 47 bp, Homo sapiens
  chr12:130645186-130645233
  hyper
ccccaagtttcttaccgatgtaaaaattgtagggcttgttttaatta

SEQ ID NO: 55429 - DNA, 123 bp, Homo sapiens
  chr12:130645627-130645750
  hyper
ccctgggaggagagggccggccacctcctaggggtgctgtttttttaagggtcaacccaggacgctacgggaagcacctggcgcatccttgggaacagtggggcttggcggtgggcgcccacc

SEQ ID NO: 55430 - DNA, 235 bp, Homo sapiens; identical to SEQ ID NO: 34759
  chr12:130646084-130646319
  hyper

SEQ ID NO: 55431 - DNA, 89 bp, Homo sapiens; identical to SEQ ID NO: 34760
  chr12:130646565-130646654
  hyper

SEQ ID NO: 55432 - DNA, 48 bp, Homo sapiens; identical to SEQ ID NO: 34764
  chr12:131199494-131199542
  hyper

SEQ ID NO: 55433 - DNA, 49 bp, Homo sapiens; identical to SEQ ID NO: 34765
  chr12:131199887-131199936
  hyper

SEQ ID NO: 55434 - DNA, 47 bp, Homo sapiens; identical to SEQ ID NO: 34766
  chr12:131199937-131199984
  hyper

SEQ ID NO: 55435 - DNA, 24 bp, Homo sapiens
  chr12:131200355-131200379
  hyper
ctgagaagcctggggcgcactccc

SEQ ID NO: 55436 - DNA, 150 bp, Homo sapiens; identical to SEQ ID NO: 34769
  chr12:132312680-132312830
  hyper

SEQ ID NO: 55437 - DNA, 730 bp, Homo sapiens; identical to SEQ ID NO: 34770
  chr12:132312856-132313586
  hyper

SEQ ID NO: 55438 - DNA, 30 bp, Homo sapiens; identical to SEQ ID NO: 34771
  chr12:132314800-132314830
  hyper

SEQ ID NO: 55439 - DNA, 30 bp, Homo sapiens; identical to SEQ ID NO: 34772
  chr12:132315470-132315500
  hyper

SEQ ID NO: 55440 - DNA, 30 bp, Homo sapiens; identical to SEQ ID NO: 34773
  chr12:133174537-133174567
  hyper

SEQ ID NO: 55441 - DNA, 122 bp, Homo sapiens; identical to SEQ ID NO: 34774
  chr12:133194939-133195061
  hyper

SEQ ID NO: 55442 - DNA, 31 bp, Homo sapiens
  chr12:133195062-133195093
  hyper
agctcggaaaaagttcccacccggggaatcc

SEQ ID NO: 55443 - DNA, 33 bp, Homo sapiens
  chr12:133195196-133195229
  hyper
gctcccagccccacctgggacacccgggactcc

SEQ ID NO: 55444 - DNA, 140 bp, Homo sapiens; identical to SEQ ID NO: 34776
  chr12:133195488-133195628
  hyper

SEQ ID NO: 55445 - DNA, 163 bp, Homo sapiens
  chr12:133463573-133463736
  hyper
cttatacagttgtaacgaaggctaaatgatgtgcgtgaatcatgcgcaagaatcggtgggcagaacaccgaataaataccagttcttacatgacatttcactccacggaaaaatctggagcgcacactgcaccgccgcccgtgtggcctgcccgcaacccggt

SEQ ID NO: 55446 - DNA, 53 bp, Homo sapiens
  chr12:133463876-133463929
  hyper
ggcggcggcgactgcttgccttcctcgggccgctccatcgggattcacatctg

SEQ ID NO: 55447 - DNA, 127 bp, Homo sapiens; identical to SEQ ID NO: 34778
  chr12:133464414-133464541
  hyper

SEQ ID NO: 55448 - DNA, 30 bp, Homo sapiens; identical to SEQ ID NO: 34779
  chr12:133464773-133464803
  hyper

SEQ ID NO: 55449 - DNA, 15 bp, Homo sapiens
  chr12:133481368-133481383
  hyper
gaagcttttcctcac

SEQ ID NO: 55450 - DNA, 146 bp, Homo sapiens
  chr12:133484596-133484742
  hyper
cagacgtttttctctaggtaaagccgcgggatgaaccagcccctgtggaaatttagaagtaacgacgtccgtcaatttctgtatgaaaaatatacagatcgtgtgacacgtcttctgggaatgaaagtctgctaaactcgccgtca

SEQ ID NO: 55451 - DNA, 118 bp, Homo sapiens; identical to SEQ ID NO: 21582
  chr12:133485439-133485557
  hyper

SEQ ID NO: 55452 - DNA, 30 bp, Homo sapiens; identical to SEQ ID NO: 34787
  chr13:20692885-20692915
  hyper

SEQ ID NO: 55453 - DNA, 101 bp, Homo sapiens; identical to SEQ ID NO: 34788
  chr13:20734542-20734643
  hyper

SEQ ID NO: 55454 - DNA, 94 bp, Homo sapiens; identical to SEQ ID NO: 34789
  chr13:20735438-20735532
  hyper

SEQ ID NO: 55455 - DNA, 271 bp, Homo sapiens; identical to SEQ ID NO: 21584
  chr13:20735533-20735804
  hyper

SEQ ID NO: 55456 - DNA, 62 bp, Homo sapiens; identical to SEQ ID NO: 34791
  chr13:20766251-20766313
  hyper

SEQ ID NO: 55457 - DNA, 534 bp, Homo sapiens; identical to SEQ ID NO: 34792
  chr13:20805970-20806504
  hyper

SEQ ID NO: 55458 - DNA, 45 bp, Homo sapiens; identical to SEQ ID NO: 34793
  chr13:21520313-21520358
  hyper

SEQ ID NO: 55459 - DNA, 30 bp, Homo sapiens; identical to SEQ ID NO: 34794
  chr13:21634461-21634491
  hyper

SEQ ID NO: 55460 - DNA, 154 bp, Homo sapiens; identical to SEQ ID NO: 34795
  chr13:21634799-21634953
  hyper

SEQ ID NO: 55461 - DNA, 13 bp, Homo sapiens
  chr13:21649623-21649636
  hyper
aaataatcacaga

SEQ ID NO: 55462 - DNA, 267 bp, Homo sapiens; identical to SEQ ID NO: 21589
  chr13:21649775-21650042
  hyper

SEQ ID NO: 55463 - DNA, 395 bp, Homo sapiens
  chr13:22243469-22243864
  hyper
atgcttcagaaacacgtaagcaagacgcaccgagccagccccggacacccaatgaccctggactgcggcaaagggggggtgggaaaggaagaggggaggaccactcgctcttctctccttcctcctcgcccgggccggagcacgccttcctccccggagggcaggggaaggtcgctccaggtcgctggcacctccagcgcccccgaaatctgcaaattcatcgctccctttcgtcttcaggcgaagccctcccgtccggagtagggccagccccagttatgcatctccagcctttagctgactactaaggcggatccgacttctcccccataaccaggttttgattcgcttccccaccgcaggggttcagtctctgctttcgactttgcttctca

SEQ ID NO: 55464 - DNA, 69 bp, Homo sapiens; identical to SEQ ID NO: 34798
  chr13:22247111-22247180
  hyper

SEQ ID NO: 55465 - DNA, 159 bp, Homo sapiens
  chr13:23489692-23489851
  hyper
gcggagcgatgcccgcgccggcgcaggggcggataaaaagccgtagcgccacgggagtgggcgggagggagagggggtacccgagggccacaagagtatgacggggctgtaagagctggtgtggcgggtgctgcccccctgctctgtctgcaccgcaag

SEQ ID NO: 55466 - DNA, 57 bp, Homo sapiens; identical to SEQ ID NO: 21591
  chr13:23489914-23489971
  hyper

SEQ ID NO: 55467 - DNA, 264 bp, Homo sapiens
  chr13:23734020-23734284
  hyper
gaggggctcggagtgggagtgcaggggtgcggggagggagtgcagggacgcggggagggagtggaggggtggggacgtgctggaggggcgcgcctcgatagaactggagaaactggaaaagtggaggggcggggcagtggctggaggaacctctgaagcgacgcggggaatatgtgaaggagtgctatgttggaacttggaggggaggggggatgctggagaggcacacggtgatggacatggaaggacccgggaggtgtggag

SEQ ID NO: 55468 - DNA, 30 bp, Homo sapiens; identical to SEQ ID NO: 34801
  chr13:24007814-24007844
  hyper

SEQ ID NO: 55469 - DNA, 209 bp, Homo sapiens; identical to SEQ ID NO: 34802
  chr13:24040780-24040989
  hyper

SEQ ID NO: 55470 - DNA, 30 bp, Homo sapiens; identical to SEQ ID NO: 34803
  chr13:24153182-24153212
  hyper

SEQ ID NO: 55471 - DNA, 178 bp, Homo sapiens; identical to SEQ ID NO: 34804
  chr13:24153573-24153751
  hyper

SEQ ID NO: 55472 - DNA, 70 bp, Homo sapiens; identical to SEQ ID NO: 34805
  chr13:24154053-24154123
  hyper

SEQ ID NO: 55473 - DNA, 53 bp, Homo sapiens
  chr13:24477590-24477643
  hyper
tgccgaggtcccaggcgggcggcaggatccaattagtccgtgtaaaatgagag

SEQ ID NO: 55474 - DNA, 111 bp, Homo sapiens
  chr13:24477906-24478017
  hyper
taggcagcctgccggcgcagacccagcgagggaaggccagtctcgggcctccaaccggacacgcgctccccattccgggctctcccacgtctgcacactccagcccagcca

SEQ ID NO: 55475 - DNA, 243 bp, Homo sapiens; identical to SEQ ID NO: 34807
  chr13:25254954-25255197
  hyper

SEQ ID NO: 55476 - DNA, 26 bp, Homo sapiens
  chr13:25319830-25319856
  hyper
ccagaacaacgagggcgacgaagaca

SEQ ID NO: 55477 - DNA, 349 bp, Homo sapiens; identical to SEQ ID NO: 21597
  chr13:25321350-25321699
  hyper

SEQ ID NO: 55478 - DNA, 252 bp, Homo sapiens
  chr13:25321942-25322194
  hyper
cagggcgcacaaacctcgggagagaaggtggaagccgcaggggctctaaaggcagccccaggttggctaaagcggttcctggtacggacaccaaggcccccgtgctcgggccctacccagcctggttcaggtgagaggaggcaagcctcggcccggtaccggcgtcggaaccacagtcgggcctggccctgctgccggggcggggctgctggacttccctcccgctccgggctggacctgacatctgtctct

SEQ ID NO: 55479 - DNA, 72 bp, Homo sapiens; identical to SEQ ID NO: 34813
  chr13:25592968-25593040
  hyper

SEQ ID NO: 55480 - DNA, 55 bp, Homo sapiens; identical to SEQ ID NO: 34815
  chr13:25620899-25620954
  hyper

SEQ ID NO: 55481 - DNA, 90 bp, Homo sapiens
  chr13:25620955-25621045
  hyper
aggagccctggagactcagggcccgtctggtgcggcccgggctttgctccgcgctcgccccctgcagctgccggggccgccgcaactttt

SEQ ID NO: 55482 - DNA, 17 bp, Homo sapiens
  chr13:25621394-25621411
  hyper
ctcggccagcgcgggac

SEQ ID NO: 55483 - DNA, 79 bp, Homo sapiens
  chr13:25744637-25744716
  hyper
ttttcagtgaagtcacgtcagaaaacatcaaacaaatacgatctgccgacgggtctgagggtggatcgacagaggcagg

SEQ ID NO: 55484 - DNA, 84 bp, Homo sapiens; identical to SEQ ID NO: 34821
  chr13:25945934-25946018
  hyper

SEQ ID NO: 55485 - DNA, 21 bp, Homo sapiens
  chr13:25946599-25946620
  hyper
gcgtcgctgcacctgcggggc

SEQ ID NO: 55486 - DNA, 51 bp, Homo sapiens; identical to SEQ ID NO: 34824
  chr13:25946801-25946852
  hyper

SEQ ID NO: 55487 - DNA, 183 bp, Homo sapiens; identical to SEQ ID NO: 34827
  chr13:26624710-26624893
  hyper

SEQ ID NO: 55488 - DNA, 35 bp, Homo sapiens
  chr13:26625266-26625301
  hyper
cgacgccgggccctaggtccaggagctcctaagcc

SEQ ID NO: 55489 - DNA, 39 bp, Homo sapiens; identical to SEQ ID NO: 34829
  chr13:26626239-26626278
  hyper

SEQ ID NO: 55490 - DNA, 86 bp, Homo sapiens; identical to SEQ ID NO: 34830
  chr13:27050496-27050582
  hyper

SEQ ID NO: 55491 - DNA, 276 bp, Homo sapiens; identical to SEQ ID NO: 34831
  chr13:27131553-27131829
  hyper

SEQ ID NO: 55492 - DNA, 451 bp, Homo sapiens; identical to SEQ ID NO: 34832
  chr13:27131859-27132310
  hyper

SEQ ID NO: 55493 - DNA, 158 bp, Homo sapiens; identical to SEQ ID NO: 34833
  chr13:27132629-27132787
  hyper

SEQ ID NO: 55494 - DNA, 160 bp, Homo sapiens; identical to SEQ ID NO: 21609
  chr13:27334563-27334723
  hyper

SEQ ID NO: 55495 - DNA, 48 bp, Homo sapiens; identical to SEQ ID NO: 21610
  chr13:27334724-27334772
  hyper

SEQ ID NO: 55496 - DNA, 86 bp, Homo sapiens
  chr13:27334894-27334980
  hyper
agcagcctcggctcgcgcgcccagctttccccgccgcgcccgcccggcccacacgctccccgcgcgcgcgccgcccccgccccgcg

SEQ ID NO: 55497 - DNA, 30 bp, Homo sapiens; identical to SEQ ID NO: 11551
  chr13:28363673-28363703
  hyper

SEQ ID NO: 55498 - DNA, 142 bp, Homo sapiens; identical to SEQ ID NO: 34837
  chr13:28363953-28364095
  hyper

SEQ ID NO: 55499 - DNA, 28 bp, Homo sapiens
  chr13:28364723-28364751
  hyper
cgctggccactcgcgggctcccagctcc

SEQ ID NO: 55500 - DNA, 46 bp, Homo sapiens; identical to SEQ ID NO: 21613
  chr13:28365659-28365705
  hyper

SEQ ID NO: 55501 - DNA, 74 bp, Homo sapiens
  chr13:28366408-28366482
  hyper
cgagggcgcctgttacggcgtgggtggggttgacaagaatagagtacattatgcagttcatttagttaacaagt

SEQ ID NO: 55502 - DNA, 25 bp, Homo sapiens
  chr13:28366577-28366602
  hyper
ggcaatagtcctatttaagccgcgc

SEQ ID NO: 55503 - DNA, 360 bp, Homo sapiens
  chr13:28366664-28367024
  hyper
cggcagcagaggctactgtttcagcctaggtctcagccgcgcgttcagcctcctgggcagaggcagctgcgggataccgcggccagggaaagcgcgtggagagccgaaaggtgcggtgggcgcagagggcgggctggctgcggggcgaccgcgcgccggggccatgccgcgctccttcctggtggactcgctagtgctgcgcgaggcgggcgagaagaaggcgcccgagggcagcccgccgccgctcttcccctacgctgtgcccccgccgcacgcgctgcacggtctctcgcctggcgcctgccacgcgcgcaaggctgggctgctgtgcgtgtgcccgctctgcgtcaccgcctcgca

SEQ ID NO: 55504 - DNA, 6 bp, Homo sapiens
  chr13:28367253-28367259
  hyper
cgcgca

SEQ ID NO: 55505 - DNA, 193 bp, Homo sapiens
  chr13:28367601-28367794
  hyper
gtaagaggtcaaagtcgtaggattctggcgaccgcctaccaagggattgggtccacagcacagaggtctgatcgcttccttctctgctctgccacctccagacagcagctctaaccagctgcccagcagcaagaggatgcgcacggctttcaccagcacgcagctgctagagctggagcgcgagttcgcttct

SEQ ID NO: 55506 - DNA, 135 bp, Homo sapiens
  chr13:28368168-28368303
  hyper
acccgcagccaaaccactgcctggcatggatttggcactgctttgcagaggtcccgggcctgggcagggctgagagcttggcagagactggaccatggcgtccccgccccagggctcgctcgtgtccaaagccaa

SEQ ID NO: 55507 - DNA, 234 bp, Homo sapiens
  chr13:28368718-28368952
  hyper
acagatgataaatttcgcccgtagtatccatattggggaaacagatttgctctgtttccaacacgctcttccttcctctaaacataggaccccgctctgcgccgctggcgaccccactcttccccctccagactctggcccgccccagcctagctgtgtaattgtacggcctctgcaatgccagaagatatttatttatttatttatgtacaaaattttaaataaacttttttt

SEQ ID NO: 55508 - DNA, 77 bp, Homo sapiens
  chr13:28369990-28370067
  hyper
gaaagacggtccacctgaggttgcttaacatttttgaagctcatttcctcccccccacaaaacggctttattgagct

SEQ ID NO: 55509 - DNA, 15 bp, Homo sapiens
  chr13:28370409-28370424
  hyper
tagtcccagtctaac

SEQ ID NO: 55510 - DNA, 184 bp, Homo sapiens
  chr13:28370763-28370947
  hyper
caccatcccaggaggcgacattgtgccaatctacggccaatctgaacgaagccaaggtgctttagtgcataccagtgaatagaatcacaactgttttactatcagtgatgaggctgatgcttgctgagttttgctcgtttgcatgttgctctagggccccagggtgagtgcagttgtgcactct

SEQ ID NO: 55511 - DNA, 400 bp, Homo sapiens
  chr13:28371061-28371461
  hyper
acctctcctggattacaggagggggtggtcttgtgcacctgggaaaggccttcgccagcactcagtgtcaggcatcttgatcagaaatgcactttcgagcctgccagggaaccaagtttggaggggatggaaacggcggtgggagacatagaaaggatgaacacacacacccggctctccccgcactcgcctcttctccagctccccctcctctcccgcctaggagtccctcctgttcccagcttctccccagagtccgcagatccacagctgtgagccaggtccgcgtggggccagttttcccaggagtgcacgtttcctcctctcggcttcccagggattcatttccggaagaccaagctttcagctttctagtctgccttagcgagcagcgggagga

SEQ ID NO: 55512 - DNA, 104 bp, Homo sapiens
  chr13:28394662-28394766
  hyper
agttgtgttggaacccgtggagagaaggaactgtccgtttccaaactctgcttcggcccctctcccctcccacccacggccccaggcagagagggccggaaagg

SEQ ID NO: 55513 - DNA, 246 bp, Homo sapiens; identical to SEQ ID NO: 21619
  chr13:28395255-28395501
  hyper

SEQ ID NO: 55514 - DNA, 104 bp, Homo sapiens; identical to SEQ ID NO: 21620
  chr13:28395553-28395657
  hyper

SEQ ID NO: 55515 - DNA, 140 bp, Homo sapiens; identical to SEQ ID NO: 11563
  chr13:28396578-28396718
  hyper

SEQ ID NO: 55516 - DNA, 292 bp, Homo sapiens; identical to SEQ ID NO: 34853
  chr13:28397177-28397469
  hyper

SEQ ID NO: 55517 - DNA, 298 bp, Homo sapiens
  chr13:28491946-28492244
  hyper
ctgagagcctcttttctttctgcagggccgagcaaaaatattaaatggaagcaaatgaagcatcgaaatggagaccaatttacagaaatgtgcaattagttgagaagtgcaaagtaaacactccgggggtggcaggcgaggcagggagcaggggagggagagtggggcgcagactgagtccagagtgggtgtaggggtgcccagggaggaggggaagggggaggaaaaggagggggaggggaaaagtggccgatctttgtcctgagcggagcttgccgtccgctcataaccgcgtcgc

SEQ ID NO: 55518 - DNA, 61 bp, Homo sapiens; identical to SEQ ID NO: 34856
  chr13:28494773-28494834
  hyper

SEQ ID NO: 55519 - DNA, 30 bp, Homo sapiens; identical to SEQ ID NO: 34857
  chr13:28503435-28503465
  hyper

SEQ ID NO: 55520 - DNA, 145 bp, Homo sapiens; identical to SEQ ID NO: 34858
  chr13:28527239-28527384
  hyper

SEQ ID NO: 55521 - DNA, 689 bp, Homo sapiens
  chr13:28527845-28528534
  hyper
tgtgaagagaaggagcgggggttttaagagccacagcgccaccgagagagtggaaaggagtagattagctcgcgcctgctatgcgaggcgactccccccgagacccacccgcagcccagcgcccttggccaggaggcccggaaagccaccgaggcggccgaaaggggccgcggggcacccctcagcccctcctgcggcggctccggctgcccctgctcagcctcccgctccccgcccggagtcccagctctcagatcggccgcagagctgggaacagaggccgcggggtccaggccgttccgcccgctcagccggagcagcagcgccgcctgccgggggcctcgcgcaggcgagacaggccagacgccggaggccgcgggcggctgcagctttgacgggccgaacacaccagcgctcccgttccgccttttgaaaatcaaatcccttgggcctggtgccaccatcgctcagcccaggtcttcgacgacgggtcgaaggccagtgctccaggccttcttcaccgagtggcttcggcgcttgcggcccaggttccccgcacctccgcgccgtagttgcgcgcaccttttgaaaagcttggcgtcttcaggtataaggacaaaaacaaccgcggacatcacaccattccaaagaagaaaaagaaagtgcccggaatctcagggcgcgacttc

SEQ ID NO: 55522 - DNA, 84 bp, Homo sapiens
  chr13:28528748-28528832
  hyper
cgggcgcccgctgggagcgcggggaggctctgggctcagggaagctgcgctccgagtggccttggaggacggtcaaggagcccg

SEQ ID NO: 55523 - DNA, 38 bp, Homo sapiens; identical to SEQ ID NO: 34860
  chr13:28534516-28534554
  hyper

SEQ ID NO: 55524 - DNA, 251 bp, Homo sapiens; identical to SEQ ID NO: 34861
  chr13:28535305-28535556
  hyper

SEQ ID NO: 55525 - DNA, 39 bp, Homo sapiens
  chr13:28540706-28540745
  hyper
cgcctggaagtgtctcggagcgacccttgctcgggtgct

SEQ ID NO: 55526 - DNA, 18 bp, Homo sapiens
  chr13:28541082-28541100
  hyper
catcacaagggcacccgg

SEQ ID NO: 55527 - DNA, 71 bp, Homo sapiens; identical to SEQ ID NO: 34864
  chr13:28541179-28541250
  hyper

SEQ ID NO: 55528 - DNA, 74 bp, Homo sapiens; identical to SEQ ID NO: 34865
  chr13:28542653-28542727
  hyper

SEQ ID NO: 55529 - DNA, 484 bp, Homo sapiens
  chr13:28542728-28543212
  hyper
tttgcagcagcccagaagcgcaggaaggcgcggcggccgggtggtgcgggtggtgatgcgggtggtggtgcggatggtagtctgcggggctgctgtagcccatggctgcggccggggagccaccgttgaggccgtgagccacggcgttggcggcggccgcggcgcctccgggcgcgtagccattccagtcctcccggagtggggcgccatacgctgccggccaggatggccccggggactgcgcgctgtccaagttcgctgccgctgcagctgcggccgccacgtggtaaccgccgtagtccgggtactgcggggggctgacgaagttctgcggcgccaggttgaggccgccagagtggcgcacggagctagggtacatgctcacgtccttgtccaggaggtagctcacgtacatggtggcgagggtccgggagcagacctcaccatgctgcctggggaccgacgctggaggctgccggggggc

SEQ ID NO: 55530 - DNA, 194 bp, Homo sapiens
  chr13:28543242-28543436
  hyper
agcggcgggtggctgcgccccagcccgcggtgctccgctggctcctcgcggctcttctgcctccgaggcggtccctccctctggcctgcctcctccctccctccctttcttccttctttcctcccacctccttcccactaggctgcagaggcggggaagacccgccacaggctggcgtgcggagccccaggccg

SEQ ID NO: 55531 - DNA, 199 bp, Homo sapiens
  chr13:28544198-28544397
  hyper
ggcgagctaggggatcgttggtaaagcagtttcttaggctgctggttacacagaatgtcagtttgtgaaaattcattgagctacacttgtatgtttattatacttaaatataaggaaaagagaatttctgctaatgcttacctaggtatttatgtgtcttacatcatacctgtatctttaaaactctctgtcctttaca

SEQ ID NO: 55532 - DNA, 30 bp, Homo sapiens; identical to SEQ ID NO: 34869
  chr13:28545247-28545277
  hyper

SEQ ID NO: 55533 - DNA, 288 bp, Homo sapiens
  chr13:28551129-28551417
  hyper
gccacctctggccttcgcctattaccttgtctttgttggggagaccatgggtgtttcatttctcctctgccaatagaagcctaagtagtatttgttggggctctttacaccttccctgtgttggggggggcgggggggtgtcgacgggtggtagaatgtggtgggctcctccgcaggatgctaatgtactttcccccagtggacagtctggctgctggtacaggaagctgcccagcctaataggggtctgaaactccagggctgacaagcaaagatttctatgggcac

SEQ ID NO: 55534 - DNA, 88 bp, Homo sapiens; identical to SEQ ID NO: 21634
  chr13:28551461-28551549
  hyper

SEQ ID NO: 55535 - DNA, 292 bp, Homo sapiens
  chr13:28551658-28551950
  hyper
cgcagggctcttcccggcccaccgcctccttcctgcggcttccccggctccccaggccggaccgaggccagcgtttgactttcctggctcccagtctgctcccctagtgcccaagagcgagaacaccgcttccgctcacatgtaaaggtcgggcgcagcaaatgaagtgggaaaagagaaaaacagacaaaccgctgtggcataaaagattccttttccgtccgttttgctttgcagttcgggcttagcaggagagggttggggagaactggataaacgctttggaatccac

SEQ ID NO: 55536 - DNA, 218 bp, Homo sapiens
  chr13:28552167-28552385
  hyper
cccaggacgcacagctccgggccgtggcccccgcgcgtccggttgtgcgtcccgggtccctggcccgcgcggcagctacagcttggcggggtctgcgcggaggaggtcggccaggcgcaggctgccgatcttcttcacctcgcccagagcagtgcgcagctcctgcgcggacgggcagagcagccggcgcgccagctcgcgcggcaccgccgtccggt

SEQ ID NO: 55537 - DNA, 135 bp, Homo sapiens
  chr13:28552659-28552794
  hyper
cgcgtaggccgcgcccggcccccctgccccgccccgccccgcccggccccaaagaaggctgcgggagggtgaagtagagtacccaggcggtgatgtcctggcggaacaggggcgcccttggcgcgcccctctaac

SEQ ID NO: 55538 - DNA, 206 bp, Homo sapiens
  chr13:28552824-28553030
  hyper
actacattcggtcgggaccaggatccaggggcggggcgggaagtgacacgtttgtcttttgagaccttgggtcaagaagagcggaggagagagagggcggccgctgaggctcggaatttacgactaggtcgggagggagcagagacgcgataaggatcctgagcttttcctatctttcaaagtcctttgctctcagggggggcttt

SEQ ID NO: 55539 - DNA, 35 bp, Homo sapiens
  chr13:28553138-28553173
  hyper
gggataacatccatggggctcggcaaataaatgcc

SEQ ID NO: 55540 - DNA, 449 bp, Homo sapiens
  chr13:28674734-28675183
  hyper
tcttaaggatgcgcgtcaccgaccgcaaattccctcggactggtgcaaagtggaaggggggaggaaccctctccccagaggcagggaccgaggcgggagcggagaggttgggcagagccgagcagccggtgcctggcgcagcgctgcagccgagcccacgtgcccgccgcggtccgcagcctgtgctcggcggcccccggggctccccgactgcggcggggaagattgggcgcggtcccgccggagaagttgcactggctccgcggctctgccgccttgctgcccctgtgagtccccgaactctgtcgtttggatccggggcgtggggactgcagggagccacaaaccaccctcctagtgcgctgggatctttgaggccctgagaaaggcgctgaatccgctcggcacgctggcaactcccgccagcgcacaggcgagcattccattaa

SEQ ID NO: 55541 - DNA, 510 bp, Homo sapiens; identical to SEQ ID NO: 21639
  chr13:29068416-29068926
  hyper

SEQ ID NO: 55542 - DNA, 211 bp, Homo sapiens
  chr13:29069065-29069276
  hyper
cgccgccggccccgcgccctgagcgcccgtctcgcggctccagccaggagacaaccacttccccgggtaatcctcgccgccaggcgcccgctggccgctgcacccgagccccggagcccgctccgagccgccgccgctgccggggaggagccgagaggagtgtccgcctggcgcgctccgagcctcccgcggacctcgatgaagagcagcc

SEQ ID NO: 55543 - DNA, 32 bp, Homo sapiens; identical to SEQ ID NO: 11588
  chr13:29069551-29069583
  hyper

SEQ ID NO: 55544 - DNA, 30 bp, Homo sapiens; identical to SEQ ID NO: 34881
  chr13:29069801-29069831
  hyper

SEQ ID NO: 55545 - DNA, 334 bp, Homo sapiens; identical to SEQ ID NO: 34882
  chr13:29105249-29105583
  hyper

SEQ ID NO: 55546 - DNA, 208 bp, Homo sapiens; identical to SEQ ID NO: 34886
  chr13:29393656-29393864
  hyper

SEQ ID NO: 55547 - DNA, 14 bp, Homo sapiens
  chr13:29394329-29394343
  hyper
gggagcgcctgggc

SEQ ID NO: 55548 - DNA, 268 bp, Homo sapiens; identical to SEQ ID NO: 34888
  chr13:29394643-29394911
  hyper

SEQ ID NO: 55549 - DNA, 160 bp, Homo sapiens; identical to SEQ ID NO: 34889
  chr13:33001068-33001228
  hyper

SEQ ID NO: 55550 - DNA, 176 bp, Homo sapiens; identical to SEQ ID NO: 34890
  chr13:33590482-33590658
  hyper

SEQ ID NO: 55551 - DNA, 234 bp, Homo sapiens
  chr13:33591066-33591300
  hyper
cgtccccaaccgcgaggggctgcgctactaccggcgcctgctggagcggctgcgggagctgggcgtgcagcccgtggtcaccctgtaccactgggacctgccccagcgcctgcaggacgcctacggcggctgggccaaccgcgccctggccgaccacttcagggattacgcggagctctgcttccgccacttcggcggtcaggtcaagtactggatcaccatcgacaaccccta

SEQ ID NO: 55552 - DNA, 22 bp, Homo sapiens
  chr13:33591419-33591441
  hyper
agggccacgcaggggagacaga

SEQ ID NO: 55553 - DNA, 29 bp, Homo sapiens
  chr13:33924637-33924666
  hyper
cggacgcggcactcccgccggggtcccgg

SEQ ID NO: 55554 - DNA, 41 bp, Homo sapiens; identical to SEQ ID NO: 34893
  chr13:35517132-35517173
  hyper

SEQ ID NO: 55555 - DNA, 139 bp, Homo sapiens
  chr13:36704800-36704939
  hyper
cacacatcactggcccgggcacacggaaaagcacacacacaataagaggccgggcccggccactccttccttggttcccgctccgcagccagttctgacaatgacaagcacctctcccagctcctccgccctggctctc

SEQ ID NO: 55556 - DNA, 391 bp, Homo sapiens
  chr13:36705055-36705446
  hyper
gcaacgcccccgggtcgggccaggctggccagggcagggcggccgcctttcgaggaactgcgggcggggcggcggggccaagctgagcgcccgccctgccctcggcgccccgcggctgcgggcggagcgggctctgcggagtcccccggccgccctccccgcagctcccgtccccagggaaggcaaaccacgcaccggtccgcggagagacgccgccgggggtctttgtggccgcgctgggggccgcctcctggtgctgtcctcgccgggctgggcgcggccggggctgcggggctgcagggctggggggcggcggcggggccgggctgggcggcagcagctgctggagcgcggcgcctcggttgcggccactagtgcagggatgtgcctc

SEQ ID NO: 55557 - DNA, 4 bp, Homo sapiens
  chr13:36705447-36705451
  hyper
gccc

SEQ ID NO: 55558 - DNA, 77 bp, Homo sapiens
  chr13:36705489-36705566
  hyper
cagcctctctctccagaggagggcggcggcggcggcggcggcgggcgcgctcccttttcttgtctcactcgctcaca

SEQ ID NO: 55559 - DNA, 15 bp, Homo sapiens
  chr13:36705621-36705636
  hyper
cgcccttcttggcag

SEQ ID NO: 55560 - DNA, 91 bp, Homo sapiens; identical to SEQ ID NO: 34897
  chr13:36729246-36729337
  hyper

SEQ ID NO: 55561 - DNA, 345 bp, Homo sapiens; identical to SEQ ID NO: 34898
  chr13:36919879-36920224
  hyper

SEQ ID NO: 55562 - DNA, 51 bp, Homo sapiens
  chr13:36920266-36920317
  hyper
cgcccgctcagcctcccagccgagtccgcggggcctggggcgcccaccccg

SEQ ID NO: 55563 - DNA, 164 bp, Homo sapiens
  chr13:36920464-36920628
  hyper
cgctcgccgggggccggtcccgaggttcccaaggcctcgcgcgcgcgcttgccgtggcaaccaagacgttccacgacgcgcgctctcgaacgcttcgcgtcacgcggccgcgcggccccgcccgtcggcctcgctcccgccacagagcccgcagcacgccgccg

SEQ ID NO: 55564 - DNA, 336 bp, Homo sapiens
  chr13:36920785-36921121
  hyper
ggggagaaaaggagcgagggcggcaggcgacagagaacctcgcgagtcagcggccccgcgcagacccccccaggcacggtcccctgcggccacgtcggctgctcggcgcctgcgcaatctctttctctccagcgaaaccgaggcctccggagagcctagtagagagtgtgggcagtgagcgcttgtagccgctagagggagcgctgggcacagtgcacgagagacaataaaggctgattatcccctcaatgtctctgcagcctgagctttgtgacttctgtatccagagcacagttaatttccaaaagcccgcctgcaccacgtgttttaagtctt

SEQ ID NO: 55565 - DNA, 108 bp, Homo sapiens; identical to SEQ ID NO: 4013
  chr13:37005473-37005581
  hyper

SEQ ID NO: 55566 - DNA, 109 bp, Homo sapiens
  chr13:37006762-37006871
  hyper
agaccggctttcccgcaatcatgtaccctggatcttttattgggggctggggagaagagtatctcagctgggaaggaccggggctcccagatttcgtcttccaggtaac

SEQ ID NO: 55567 - DNA, 456 bp, Homo sapiens
  chr13:37248523-37248979
  hyper
gtcccgagaagcaatcgcagcccggctctccgagtcttggggtgactccacgggctgcaggaggagccgcgaggggccctgagtgcaatgtccttggccccgtgttgacctgcctcggtcccagacactgggaaccgggaaggtctaccctcgctctgcaaggtggattcctccatgcaagtgtagacagttctacactttgcagagtgtgtctaggtgccttctgtttgcttttgcctttgtggtgtgtggagggtcattcttgggtttgttttgctcctgtctgattttctagggtcatttgcgtcccttctcgggaacggggactcgccatgcgcacactgacagctggctttgcacctgctaaggcgctggagagtcttttcgcccgtcttagggtggccctaaatccggggaagttttatgtggcgctgaacacttgcgtttcccaggggc

SEQ ID NO: 55568 - DNA, 15 bp, Homo sapiens
  chr13:37249039-37249054
  hyper
cgggtctgatgagac

SEQ ID NO: 55569 - DNA, 18 bp, Homo sapiens
  chr13:38443600-38443618
  hyper
ccccgcagggatgtccgc

SEQ ID NO: 55570 - DNA, 87 bp, Homo sapiens; identical to SEQ ID NO: 34910
  chr13:39260356-39260443
  hyper

SEQ ID NO: 55571 - DNA, 300 bp, Homo sapiens; identical to SEQ ID NO: 34911
  chr13:39261007-39261307
  hyper

SEQ ID NO: 55572 - DNA, 94 bp, Homo sapiens; identical to SEQ ID NO: 34912
  chr13:39261689-39261783
  hyper

SEQ ID NO: 55573 - DNA, 102 bp, Homo sapiens; identical to SEQ ID NO: 34913
  chr13:39261928-39262030
  hyper

SEQ ID NO: 55574 - DNA, 112 bp, Homo sapiens; identical to SEQ ID NO: 11605
  chr13:39262129-39262241
  hyper

SEQ ID NO: 55575 - DNA, 95 bp, Homo sapiens; identical to SEQ ID NO: 34915
  chr13:42031220-42031315
  hyper

SEQ ID NO: 55576 - DNA, 69 bp, Homo sapiens; identical to SEQ ID NO: 34916
  chr13:42032580-42032649
  hyper

SEQ ID NO: 55577 - DNA, 188 bp, Homo sapiens; identical to SEQ ID NO: 21654
  chr13:43566059-43566247
  hyper

SEQ ID NO: 55578 - DNA, 137 bp, Homo sapiens; identical to SEQ ID NO: 34918
  chr13:44359843-44359980
  hyper

SEQ ID NO: 55579 - DNA, 236 bp, Homo sapiens; identical to SEQ ID NO: 34919
  chr13:44360043-44360279
  hyper

SEQ ID NO: 55580 - DNA, 327 bp, Homo sapiens; identical to SEQ ID NO: 34920
  chr13:44360467-44360794
  hyper

SEQ ID NO: 55581 - DNA, 99 bp, Homo sapiens; identical to SEQ ID NO: 34921
  chr13:44360995-44361094
  hyper

SEQ ID NO: 55582 - DNA, 9 bp, Homo sapiens
  chr13:44947737-44947746
  hyper
cgacgcgct

SEQ ID NO: 55583 - DNA, 320 bp, Homo sapiens
  chr13:44948197-44948517
  hyper
aagcacagcaaaaacatcacccagagggggaacgtagccaaaaccctggtaaggcggggtcggcgccggccaggcagagccctgcagcccggcggggtggggcggaaggtgggggcggggccgggcgggtagcggcgcagggtccggcctcccggctcccggcccgccccttctgcggggtcctgcagagtgggggctgagagctgggttcagggcggcgcggtctgcttggcgtcctcgtgggcggagagggccctggttggtcgtggcccctctgggagtggctacctgggctaccagggaggcgcagaggagccctc

SEQ ID NO: 55584 - DNA, 119 bp, Homo sapiens
  chr13:45885757-45885876
  hyper
ctgccgagcagcatccgcgcggagcgagctgcggtcctcgggaccccgcagcaggagccacgagcccgccccggcgtccgagccctgcaggcgaggccaggcttggcgcggagggacct

SEQ ID NO: 55585 - DNA, 59 bp, Homo sapiens
  chr13:45885905-45885964
  hyper
agttcctgctgccagagccgggcctcctctgctctccgcagcctcgcagggagggcgca

SEQ ID NO: 55586 - DNA, 146 bp, Homo sapiens; identical to SEQ ID NO: 34924
  chr13:46189788-46189934
  hyper

SEQ ID NO: 55587 - DNA, 33 bp, Homo sapiens; identical to SEQ ID NO: 34925
  chr13:46425360-46425393
  hyper

SEQ ID NO: 55588 - DNA, 410 bp, Homo sapiens
  chr13:46961084-46961494
  hyper
tctccaaggggtccccgacactgctctgagcgaccctaagatacctgggtgtctctgctgggcacaaacctctctggcgccacttccaccatccaacctctcccgcggccctcccttccctttctccaaccaccctctccaccccgcgccgctcccatctcgcccccggccccgccagcctcacccagccaaacccgagcggtggaacgctgcgctgggtaaacgccgcgcgtcgggtcctccctcgcgcggctccgggcagcgttccgtggccaccgcgctcccggtaacagcagaaaggggagggaggagagctaccgaggaggggacagcgacgccccgacgccgccacgccccccgcctcccacacgggggccaccgtagctctctagaagctcctcagggaagca

SEQ ID NO: 55589 - DNA, 99 bp, Homo sapiens
  chr13:46961533-46961632
  hyper
atggaagaaactctggagatgcgcgctcctacaccggtgccgcggcgcccgggcccagcaccacgcacctatgcgcgcctctgccggtcctcctagaaa

SEQ ID NO: 55590 - DNA, 236 bp, Homo sapiens; identical to SEQ ID NO: 34928
  chr13:50070422-50070658
  hyper

SEQ ID NO: 55591 - DNA, 15 bp, Homo sapiens
  chr13:50070684-50070699
  hyper
cgtctccccttctcc

SEQ ID NO: 55592 - DNA, 108 bp, Homo sapiens; identical to SEQ ID NO: 34930
  chr13:50704569-50704677
  hyper

SEQ ID NO: 55593 - DNA, 30 bp, Homo sapiens; identical to SEQ ID NO: 34931
  chr13:50705047-50705077
  hyper

SEQ ID NO: 55594 - DNA, 30 bp, Homo sapiens; identical to SEQ ID NO: 34932
  chr13:51086861-51086891
  hyper

SEQ ID NO: 55595 - DNA, 68 bp, Homo sapiens; identical to SEQ ID NO: 34933
  chr13:51797123-51797191
  hyper

SEQ ID NO: 55596 - DNA, 63 bp, Homo sapiens; identical to SEQ ID NO: 34934
  chr13:52979747-52979810
  hyper

SEQ ID NO: 55597 - DNA, 169 bp, Homo sapiens; identical to SEQ ID NO: 34935
  chr13:52980066-52980235
  hyper

SEQ ID NO: 55598 - DNA, 105 bp, Homo sapiens; identical to SEQ ID NO: 34936
  chr13:53174056-53174161
  hyper

SEQ ID NO: 55599 - DNA, 14 bp, Homo sapiens
  chr13:53174673-53174687
  hyper
gggtgctttcctac

SEQ ID NO: 55600 - DNA, 131 bp, Homo sapiens
  chr13:53312860-53312991
  hyper
tgccttccccacggtcgcgccactgcttagtgggagatgagccgagaacggcctttctcggaccgtccactacattctcccctactctacgcttcaatcttctcccgtgaaaccttcacttgcttttctac

SEQ ID NO: 55601 - DNA, 30 bp, Homo sapiens
  chr13:53313920-53313950
  hyper
aacgccgcgcgcacacacggtgcacggtcc

SEQ ID NO: 55602 - DNA, 245 bp, Homo sapiens
  chr13:53419775-53420020
  hyper
gggaataggggaatgggagtggggggagggttggataagaaacaaacaaaaaacaagtgcgacaggttgtctacctgaatgcacccaccctacccctccagtctcccttcccccagcctgtccgcggagctcggaggggggcgcccagccgaaggaaggcctcacctcggcgtgcgcgccgcggagccgctgctgcccctcgaagtgacaggcgctttccccagtggcgctgccgccctctgagc

SEQ ID NO: 55603 - DNA, 22 bp, Homo sapiens
  chr13:53421826-53421848
  hyper
cgccctgcgggaaggccgggct

SEQ ID NO: 55604 - DNA, 138 bp, Homo sapiens; identical to SEQ ID NO: 34944
  chr13:53422642-53422780
  hyper

SEQ ID NO: 55605 - DNA, 27 bp, Homo sapiens
  chr13:53422781-53422808
  hyper
cctcgcgccgcctttgcctttatagcc

SEQ ID NO: 55606 - DNA, 76 bp, Homo sapiens; identical to SEQ ID NO: 34946
  chr13:53422809-53422885
  hyper

SEQ ID NO: 55607 - DNA, 30 bp, Homo sapiens; identical to SEQ ID NO: 11621
  chr13:53423168-53423198
  hyper

SEQ ID NO: 55608 - DNA, 73 bp, Homo sapiens
  chr13:53423765-53423838
  hyper
ctaaacggtgatgggcgctgaattccacacaatacccggctcgtattaaagtgcatttagagaactttttcct

SEQ ID NO: 55609 - DNA, 128 bp, Homo sapiens
  chr13:53423978-53424106
  hyper
accatctgcttaggaaagtgtggagcttcggcactgccaaaatctgggctgggcggatcctggggctggccgggcgctgcgctgccccacagatagccccctcccatccctgacggccagggagatgg

SEQ ID NO: 55610 - DNA, 105 bp, Homo sapiens; identical to SEQ ID NO: 34949
  chr13:53424765-53424870
  hyper

SEQ ID NO: 55611 - DNA, 196 bp, Homo sapiens; identical to SEQ ID NO: 34950
  chr13:53425241-53425437
  hyper

SEQ ID NO: 55612 - DNA, 146 bp, Homo sapiens; identical to SEQ ID NO: 34951
  chr13:53425699-53425845
  hyper

SEQ ID NO: 55613 - DNA, 12 bp, Homo sapiens
  chr13:58203590-58203602
  hyper
gcatgttcgtac

SEQ ID NO: 55614 - DNA, 207 bp, Homo sapiens; identical to SEQ ID NO: 21668
  chr13:58203644-58203851
  hyper

SEQ ID NO: 55615 - DNA, 247 bp, Homo sapiens
  chr13:58204103-58204350
  hyper
cctggccccgcccccgccatcctcttctccgcctcccattggacgcgggccgagaaggcagggccttgctcctcgctcggattggctgacagggaatcagtatcaatgtttaagcggcggcgtgaggtgaatagagtcagtcagcaagagacgctggggagagagcagggatcgcgagcccggcggatgcggcagcggcggaaggcggctggggagacgctactccaactgttgaattgaattttca

SEQ ID NO: 55616 - DNA, 28 bp, Homo sapiens
  chr13:58204393-58204421
  hyper
ttgctttgaaatccgcatatctttctca

SEQ ID NO: 55617 - DNA, 63 bp, Homo sapiens; identical to SEQ ID NO: 34953
  chr13:58204937-58205000
  hyper

SEQ ID NO: 55618 - DNA, 202 bp, Homo sapiens
  chr13:58205840-58206042
  hyper
gaggaaactacaaatcgggacactagttctttacgctgcatttcctcccctccctttggctgctcggaaaggagagagaggaaaaaaaaaatacgcttggctggtagatgcagtccgccgccgccgctgcctcagccagcaatgcaagattagatctctaaatgcagcaaaacactgcctgaaaacagaccggcccgcgcag

SEQ ID NO: 55619 - DNA, 29 bp, Homo sapiens
  chr13:58206983-58207012
  hyper
tgccagctgtccctcgaggtgttcgccaa

SEQ ID NO: 55620 - DNA, 105 bp, Homo sapiens
  chr13:58208020-58208125
  hyper
gggctctcctcccctcaactccaccaagtcgttcgcgatcaagattctagacgagaacgacaacccgcctcggttcaccaaagggctctacgtgcttcaggtgca

SEQ ID NO: 55621 - DNA, 161 bp, Homo sapiens; identical to SEQ ID NO: 21671
  chr13:58208334-58208495
  hyper

SEQ ID NO: 55622 - DNA, 17 bp, Homo sapiens
  chr13:58208926-58208943
  hyper
cccgcagctgggtgggg

SEQ ID NO: 55623 - DNA, 69 bp, Homo sapiens; identical to SEQ ID NO: 34960
  chr13:67804269-67804338
  hyper

SEQ ID NO: 55624 - DNA, 100 bp, Homo sapiens; identical to SEQ ID NO: 34961
  chr13:67804644-67804744
  hyper

SEQ ID NO: 55625 - DNA, 23 bp, Homo sapiens
  chr13:67804745-67804768
  hyper
cgctggcgctccccaggcccggg

SEQ ID NO: 55626 - DNA, 328 bp, Homo sapiens
  chr13:67804863-67805191
  hyper
cgcggatccggggaaccagggccaccgctgcgggcggatgggggtcaccgaggcggctcgtctccaggcgcacacttcgcacatctctttgctaagtgaaggggccaaaatgcacagatgggggagtctacccaggaacagaggcgcgagacgtatagccacccctgggttgggagcacgagccagcagatccccggagcgcgttaaacggacaacatgcccggtgctgcaaatagaggcttttgctggcagggacattggaaagaagggcggagagggagtacagcgaaaggtggggaccgcagaatttggaatctctgcggagacc

SEQ ID NO: 55627 - DNA, 47 bp, Homo sapiens
  chr13:70681579-70681626
  hyper
agaggacggggaggacgatgaagaggaagaggaggaaggcttcttcc

SEQ ID NO: 55628 - DNA, 30 bp, Homo sapiens; identical to SEQ ID NO: 34966
  chr13:72438533-72438563
  hyper

SEQ ID NO: 55629 - DNA, 124 bp, Homo sapiens; identical to SEQ ID NO: 34967
  chr13:72438769-72438893
  hyper

SEQ ID NO: 55630 - DNA, 65 bp, Homo sapiens; identical to SEQ ID NO: 34968
  chr13:72440007-72440072
  hyper

SEQ ID NO: 55631 - DNA, 30 bp, Homo sapiens; identical to SEQ ID NO: 34969
  chr13:72440711-72440741
  hyper

SEQ ID NO: 55632 - DNA, 91 bp, Homo sapiens; identical to SEQ ID NO: 34970
  chr13:74707261-74707352
  hyper

SEQ ID NO: 55633 - DNA, 43 bp, Homo sapiens; identical to SEQ ID NO: 34971
  chr13:74707625-74707668
  hyper

SEQ ID NO: 55634 - DNA, 165 bp, Homo sapiens; identical to SEQ ID NO: 34972
  chr13:75149921-75150086
  hyper

SEQ ID NO: 55635 - DNA, 175 bp, Homo sapiens
  chr13:78492991-78493166
  hyper
taatatgcagtggggcggggcgttctggaaggggtgtgccagggagggaatgatgggggtcccaggcaaagctccgaactctttcacgtaacgggaggaatacagacacgtcttagttaagcgtgcgtgggaaccgcggaattaaggcacctagaggccaagggcttgtgtcaag

SEQ ID NO: 55636 - DNA, 259 bp, Homo sapiens
  chr13:78493196-78493455
  hyper
ataccccgcgattgaactcgaaagactcctcccggcggatgaaagccgctactccctggctggctgagctacagctcccgcagcgcgcccaggagtgcgccggagattcggaaacccgcagagacttctcaagtcagcaggaacttggaaaccgctgttccctccaaacggcttcaaacactcgcgctccttcctttacccaacctaattttaatttgccctctctataggcttaatttttatttttttaaaatcccaa

SEQ ID NO: 55637 - DNA, 163 bp, Homo sapiens
  chr13:78493809-78493972
  hyper
ctttccccttgggcgatgcctggacagcatcagtagtagttgcccgagggaggggggcagtcctcgtccggggacaggtcccaaaaggctgtttatttgttagagttctacgctcttcaaatgaacccaaatcaagggcaagttatcacgcaccatgtgacac

SEQ ID NO: 55638 - DNA, 47 bp, Homo sapiens; identical to SEQ ID NO: 34974
  chr13:79160995-79161042
  hyper

SEQ ID NO: 55639 - DNA, 234 bp, Homo sapiens
  chr13:79170884-79171118
  hyper
agctccttgttataattcattttatttccagaactctccgaccataaattattcaaagagtaagccaacccgagcggggcggccgcgcgccttccccacgcgcgccgggctggctctggccgctcagctcacccgatgccccgtgagccagccccgcgccagaagccgcggtggcaggaaggtttgatcaaacattaaataacgtaatgtttgcgacaaggcttatctcacaag

SEQ ID NO: 55640 - DNA, 175 bp, Homo sapiens
  chr13:79175595-79175770
  hyper
ttgcaaaaccacacccgcaccacgttctttttgaggtccagtttctcggcgatggcggcgatcttctcggacgagggccggggctgcacggcgaagtaggcctcgagggagcgcttctcgggcgcggcgatggaagtccgcttgcgcttcttctcgccgccgttgaagagctcag

SEQ ID NO: 55641 - DNA, 210 bp, Homo sapiens
  chr13:79176783-79176993
  hyper
gcgaagggcaaacacaaagcaaccaaaataacaacgggtttgggggcagtggagagcgggaaagacggagagggggcacattgacgaccagggagggggcagacgagaagggatgggagcgtggagagggggacagaagtagggagaaagggggacacaagaacacattccggaaacgggcgtgggagacgaaaaagagggaaaagaaga

SEQ ID NO: 55642 - DNA, 80 bp, Homo sapiens
  chr13:79177998-79178078
  hyper
tcagaaggtccagctattgtctaagggtgggcaccttttagaataaaaaagacgagatgcgcgcacgcccctctatgtgt

SEQ ID NO: 55643 - DNA, 221 bp, Homo sapiens; identical to SEQ ID NO: 34984
  chr13:79182709-79182930
  hyper

SEQ ID NO: 55644 - DNA, 226 bp, Homo sapiens
  chr13:79183180-79183406
  hyper
aatcaaagccccttgcgagggactgggaaatagttgccttgtcatgtaacacattgccctgatttattataaaattttaacgaaatcatgcatattttaacagcctttaatcactgcatgaaaatttaattcatgaactgtagcgcgtttaaataaatgaagtgttaattcattaggattaattaatttgttaaaggattgtgtgcaaggttaaggtggaaagaaa

SEQ ID NO: 55645 - DNA, 21 bp, Homo sapiens
  chr13:84455560-84455581
  hyper
tcttctctttgcaaacgtccc

SEQ ID NO: 55646 - DNA, 41 bp, Homo sapiens
  chr13:84455715-84455756
  hyper
tcaagttcatttagtgctccaatgtccgaagccaggaaagg

SEQ ID NO: 55647 - DNA, 274 bp, Homo sapiens; identical to SEQ ID NO: 34987
  chr13:84456111-84456385
  hyper

SEQ ID NO: 55648 - DNA, 199 bp, Homo sapiens
  chr13:88323380-88323579
  hyper
caggaggaaggcaggcgatcagcacagggctggaatcatctgttcctgaccaccagcaagcctggcactgccggggttatttccactcctccctttcccaatccgagaattgcacagtcccacgctcgaattacacacatggtccaagacttctctctcttcctacgaatgtgacatccaagggggccccggttgcgcc

SEQ ID NO: 55649 - DNA, 275 bp, Homo sapiens
  chr13:88324241-88324516
  hyper
atgcatgcacacccccgcgacccgctccctctggctcgtcccccggcgtgcgccactgaccaggggggaatgtggtgaagacggcgaggaggagagccgaggggggaggggagggccggccggcgcgaacccaggccggagggtgcgaggagccagaggaggctggagggggcggcggccacagctgggtcggagaaagttgccccctatgcagatggcaactgtgagtacccctgtgggggggagggtgcagcgaaggctgccagggaccccgc

SEQ ID NO: 55650 - DNA, 79 bp, Homo sapiens; identical to SEQ ID NO: 34991
  chr13:88325198-88325277
  hyper

SEQ ID NO: 55651 - DNA, 200 bp, Homo sapiens
  chr13:88325619-88325819
  hyper
tgagaggaagctcttcgacccttgctaactagaactgaattaaagttgtaaacgctggagtttaatactggctggactgaatttgcaatgggctttcagatggggtgggaggtgaatgggggcggggaagcacagggagggagggggaggggacccaacctcgctgaatggatgtgcggatttgatccagcggagaactg

SEQ ID NO: 55652 - DNA, 38 bp, Homo sapiens
  chr13:88326500-88326538
  hyper
cttaatcagcccaggcgtcctttccctgagattaaaaa

SEQ ID NO: 55653 - DNA, 110 bp, Homo sapiens
  chr13:88327014-88327124
  hyper
gatttaagagcttcttggggctcctttgatgcattatattacagcctttttgcctctgaaaagtatcctttaggttcccaccgtggcatttctagcgatggtttaaaata

SEQ ID NO: 55654 - DNA, 30 bp, Homo sapiens; identical to SEQ ID NO: 34995
  chr13:92050679-92050709
  hyper

SEQ ID NO: 55655 - DNA, 143 bp, Homo sapiens
  chr13:92050996-92051139
  hyper
cttgcgggctccctgcggctccactagttttcttcgccccgcccagccgcccactcttctcggctagggaagaagaccagagggtgctcagctggaaaactctggtgtctcagcttagggcctcctccgggaagagctaactg

SEQ ID NO: 55656 - DNA, 206 bp, Homo sapiens; identical to SEQ ID NO: 21690
  chr13:92051168-92051374
  hyper

SEQ ID NO: 55657 - DNA, 5 bp, Homo sapiens
  chr13:93879283-93879288
  hyper
tcccg

SEQ ID NO: 55658 - DNA, 86 bp, Homo sapiens; identical to SEQ ID NO: 21692
  chr13:93879375-93879461
  hyper

SEQ ID NO: 55659 - DNA, 47 bp, Homo sapiens
  chr13:93880042-93880089
  hyper
gcgggggaaggtgtgcgtctccgccgcctcattgtgtgcacacgcgg

SEQ ID NO: 55660 - DNA, 170 bp, Homo sapiens
  chr13:93880856-93881026
  hyper
ctctgtgaatgaaacgtgtcggggagagataatcctttggctgctaaagaacagaactgagagaggccgagggaggccaggagatgctgcgagggcgcgggctgctcaaaccgggcagctgaagtccttagtgacctcagatcgtcaagtcaaaacgctgaatttccacc

SEQ ID NO: 55661 - DNA, 65 bp, Homo sapiens; identical to SEQ ID NO: 35004
  chr13:95354293-95354358
  hyper

SEQ ID NO: 55662 - DNA, 46 bp, Homo sapiens; identical to SEQ ID NO: 35005
  chr13:95355963-95356009
  hyper

SEQ ID NO: 55663 - DNA, 285 bp, Homo sapiens
  chr13:95357026-95357311
  hyper
tttcctccagtcaagcgtgagtgatggggcggccgcgcaagggcaacggagtccagcggacaaagcttgcagagaggggcagtggcccggaggcaagggtggcggtggggggggtggggggatgggtcacaaaagtagagcaactgagcttgctgcctagcggtgccacttccctgctctgcgctaaggctatcgtcgaaggcccagagacaccttgaccctggaaacccaatccagcacgtcctgcctccccacaaatatccctcaccccaaatcgctgtgcgt

SEQ ID NO: 55664 - DNA, 233 bp, Homo sapiens
  chr13:95357341-95357574
  hyper
ttggatttattcagatagaactcttcggaagtttttcagatttttcaatttcaagaatttgcatgttttaagtgaagctgaaaccgcgaaggctcaggttacactttaaaatatgcaaggcttccgtgcggccccgacatttggtaaggctcaattgcttaagaaaaaagaaaaaaaaaagaacattgctttgagaatttggggtgccccccccccacttttgtcacaattca

SEQ ID NO: 55665 - DNA, 65 bp, Homo sapiens
  chr13:95359682-95359747
  hyper
cgcggaccctcgaggcggacgagttgcgggaacttcgcttgcctggaggacacggcggcccaggc

SEQ ID NO: 55666 - DNA, 58 bp, Homo sapiens
  chr13:95359803-95359861
  hyper
ctgctccggggagagtggaatcttctctccatcttctgcgccccgagcctggggtgag

SEQ ID NO: 55667 - DNA, 91 bp, Homo sapiens; identical to SEQ ID NO: 21696
  chr13:95360231-95360322
  hyper

SEQ ID NO: 55668 - DNA, 42 bp, Homo sapiens
  chr13:95360371-95360413
  hyper
gccctcttgccccggagccgctccccccgctccaacccctta

SEQ ID NO: 55669 - DNA, 201 bp, Homo sapiens; identical to SEQ ID NO: 21698
  chr13:95363009-95363210
  hyper

SEQ ID NO: 55670 - DNA, 23 bp, Homo sapiens
  chr13:95363429-95363452
  hyper
gtacacgtgtgcacaccggtcct

SEQ ID NO: 55671 - DNA, 303 bp, Homo sapiens
  chr13:95363493-95363796
  hyper
cgcggggtaggggtccagctggggcttgcccatgcccggcagcaggatgtaggcgagcggcggctgcagcccggggctgggccacgcgctgcagttgcacgggatcatgtagcccgggttgcccgggctggggtgcgagtgcgtgtgccccccggcggcggcggccgccgctgcagccgccgccgccgcgccgtggaaggcgcccgcgcccgcggtcgggtagcccagcgacgacgcgtacgggaggccggacgaggacgacgagatctctgccattttggagcccaggtcgagcagcgagta

SEQ ID NO: 55672 - DNA, 575 bp, Homo sapiens
  chr13:95364800-95365375
  hyper
ggttctcctcggtgactttctcatttgacagaagcagatgggggtggggaaggcggggaggtggccctggaggaggaagaggagggggaggcggaggagtgtccaggcgtgccacgagaacgcagagcgcagcaatggatataaatacaaatacagcagcaccagcctgtcttcttggctccgggcagggtgcgccgatgggaaacccccaatcggctgggtgattttttttttttggaggggggagctgtcccccgcagcacctgcctctcgagtcttcctctcccgctgctggactgacgggtggggcgaggaaggagggtggatgaggcttgagcaagcgttggtcgcccggcctcagaggaagttctcccggctcgccgaggagccgcgtccggccgtcccctgggccatgccggctctgttcgctccgagccccttcaggcgcgcctgccgacttagggctcccggagctcgccggccgcggagggcagcgcagcctccacgcggcgccgcaggcctggcaccggccgcgtccccgcctcgctcttctcggcagccgcctggcacttgca

SEQ ID NO: 55673 - DNA, 101 bp, Homo sapiens; identical to SEQ ID NO: 35014
  chr13:95365624-95365725
  hyper

SEQ ID NO: 55674 - DNA, 218 bp, Homo sapiens; identical to SEQ ID NO: 21702
  chr13:95619803-95620021
  hyper

SEQ ID NO: 55675 - DNA, 228 bp, Homo sapiens; identical to SEQ ID NO: 21703
  chr13:95620078-95620306
  hyper

SEQ ID NO: 55676 - DNA, 340 bp, Homo sapiens; identical to SEQ ID NO: 21704
  chr13:95620307-95620647
  hyper

SEQ ID NO: 55677 - DNA, 63 bp, Homo sapiens
  chr13:95621011-95621074
  hyper
gaccccagatcttcaccctaggatttccatctcagcatttcacgttcccggggaaaaagggag

SEQ ID NO: 55678 - DNA, 205 bp, Homo sapiens; identical to SEQ ID NO: 35018
  chr13:95655055-95655260
  hyper

SEQ ID NO: 55679 - DNA, 30 bp, Homo sapiens; identical to SEQ ID NO: 35019
  chr13:96056313-96056343
  hyper

SEQ ID NO: 55680 - DNA, 83 bp, Homo sapiens; identical to SEQ ID NO: 21706
  chr13:96296473-96296556
  hyper

SEQ ID NO: 55681 - DNA, 101 bp, Homo sapiens
  chr13:96297137-96297238
  hyper
ccctcagcaagctaatttcccagaggagcttcaggtgaattatcttccaaaaagagatgcgttttaatcgcagaagtctgcagatgcgaaggaccttgaaa

SEQ ID NO: 55682 - DNA, 30 bp, Homo sapiens; identical to SEQ ID NO: 35024
  chr13:96742799-96742829
  hyper

SEQ ID NO: 55683 - DNA, 57 bp, Homo sapiens; identical to SEQ ID NO: 35025
  chr13:96743056-96743113
  hyper

SEQ ID NO: 55684 - DNA, 198 bp, Homo sapiens; identical to SEQ ID NO: 35026
  chr13:96743376-96743574
  hyper

SEQ ID NO: 55685 - DNA, 324 bp, Homo sapiens; identical to SEQ ID NO: 35029
  chr13:99404616-99404940
  hyper

SEQ ID NO: 55686 - DNA, 30 bp, Homo sapiens; identical to SEQ ID NO: 35032
  chr13:100609476-100609506
  hyper

SEQ ID NO: 55687 - DNA, 327 bp, Homo sapiens; identical to SEQ ID NO: 35033
  chr13:100611882-100612209
  hyper

SEQ ID NO: 55688 - DNA, 32 bp, Homo sapiens; identical to SEQ ID NO: 35034
  chr13:100620640-100620672
  hyper

SEQ ID NO: 55689 - DNA, 30 bp, Homo sapiens; identical to SEQ ID NO: 35035
  chr13:100620880-100620910
  hyper

SEQ ID NO: 55690 - DNA, 189 bp, Homo sapiens
  chr13:100621752-100621941
  hyper
gtgaagagtgtgtcacggtgggcgagtgcgagtggtctccggggttccgaaagcgcattcctgtcttcccggaggggtcccttcccctcccggaaggcctgcctcgggcggcccaaatccggcagcaaatcccacgcccggtcctcggagcgcggagactgcgcggggcctacgacccggtgggaagag

SEQ ID NO: 55691 - DNA, 166 bp, Homo sapiens; identical to SEQ ID NO: 35037
  chr13:100622330-100622496
  hyper

SEQ ID NO: 55692 - DNA, 201 bp, Homo sapiens; identical to SEQ ID NO: 35038
  chr13:100622959-100623160
  hyper

SEQ ID NO: 55693 - DNA, 231 bp, Homo sapiens; identical to SEQ ID NO: 35039
  chr13:100623899-100624130
  hyper

SEQ ID NO: 55694 - DNA, 102 bp, Homo sapiens; identical to SEQ ID NO: 35040
  chr13:100624131-100624233
  hyper

SEQ ID NO: 55695 - DNA, 239 bp, Homo sapiens
  chr13:100624348-100624587
  hyper
gggtggtgaggggctgaggacccccgaggggcagtcccagtttcaaaaaccttggcctcacttctctgtgtgccttctggcacccaagtactttctgcctctacctccacctctcttgtggggtggaagagccctgggctgctgtttgggagagaagggtgaatagcccgtcctacctgtagtggtgatgctagaaacttcttgtttggacacccaacctgcctagcgctcacctaggg

SEQ ID NO: 55696 - DNA, 30 bp, Homo sapiens; identical to SEQ ID NO: 35042
  chr13:100626366-100626396
  hyper

SEQ ID NO: 55697 - DNA, 54 bp, Homo sapiens; identical to SEQ ID NO: 35044
  chr13:100631883-100631937
  hyper

SEQ ID NO: 55698 - DNA, 245 bp, Homo sapiens; identical to SEQ ID NO: 35045
  chr13:100635085-100635330
  hyper

SEQ ID NO: 55699 - DNA, 8 bp, Homo sapiens
  chr13:100635398-100635406
  hyper
cgcgggct

SEQ ID NO: 55700 - DNA, 100 bp, Homo sapiens; identical to SEQ ID NO: 35048
  chr13:100636984-100637084
  hyper

SEQ ID NO: 55701 - DNA, 26 bp, Homo sapiens
  chr13:100637364-100637390
  hyper
taccaccgcggcggccgggaggaggg

SEQ ID NO: 55702 - DNA, 521 bp, Homo sapiens
  chr13:100637485-100638006
  hyper
tgggggtgctctcccccaggggcccggccccacagcagctgcactcacacccagtcccctctggtcccccctcccggcttttgtcttgcaggtccatgagtcctccccgcagggctctgaatcctccccggccgccagctccggctatgagtcgtccacgcccccggggctggtgtcccccagcgccgagccccagagcagctccaacctgtccccagcggcggcggcagcggcggcggcggctgcggcggcggcggccgcggtgtccgcggtgcaccggggcggaggctcgggcagtggcggcgcgggaggcggctcaggcggcggcagcggcagtggcgggggcggcggcggggcgggcggcgggggcggcggcagctctggcgggggcagcgggacagccgggggtcacagcggcctctcctccaacttcaatgaatggtacgtgtgacgggtcggggcctctctccctctccctgtccccaccccagcgcagcagccctccccgcagctagcagcga

SEQ ID NO: 55703 - DNA, 30 bp, Homo sapiens; identical to SEQ ID NO: 35050
  chr13:100640440-100640470
  hyper

SEQ ID NO: 55704 - DNA, 187 bp, Homo sapiens; identical to SEQ ID NO: 11697
  chr13:100640972-100641159
  hyper

SEQ ID NO: 55705 - DNA, 213 bp, Homo sapiens
  chr13:100643842-100644055
  hyper
gttcccttttcaccccggctcttatgttgccagtctcccccctaccaccaggcaaagcccccctaaacttagggtctggaacaaggccgagccagcgagggcctgccaggagctgcgctggagcctctcgctgcatccagagctggttcttgttcttttctctctcttggcccactgggcccacagtggttaggtggccgagtgtggtttccc

SEQ ID NO: 55706 - DNA, 32 bp, Homo sapiens; identical to SEQ ID NO: 11700
  chr13:100647898-100647930
  hyper

SEQ ID NO: 55707 - DNA, 115 bp, Homo sapiens; identical to SEQ ID NO: 35055
  chr13:100648149-100648264
  hyper

SEQ ID NO: 55708 - DNA, 52 bp, Homo sapiens; identical to SEQ ID NO: 35058
  chr13:100649944-100649996
  hyper

SEQ ID NO: 55709 - DNA, 169 bp, Homo sapiens; identical to SEQ ID NO: 35059
  chr13:102068189-102068358
  hyper

SEQ ID NO: 55710 - DNA, 29 bp, Homo sapiens
  chr13:102068417-102068446
  hyper
cgccccggccaggccggcaaggaccccac

SEQ ID NO: 55711 - DNA, 58 bp, Homo sapiens; identical to SEQ ID NO: 35061
  chr13:102069013-102069071
  hyper

SEQ ID NO: 55712 - DNA, 44 bp, Homo sapiens
  chr13:102568410-102568454
  hyper
gctcagatcagactgcgagcggtggctcgaccccgggtgtggca

SEQ ID NO: 55713 - DNA, 89 bp, Homo sapiens
  chr13:102568484-102568573
  hyper
gccagtccctatcctcccgggaagccgagactcagggggaacaggtttcccagagcccagcctgcagggacgcggagggcaggagccgc

SEQ ID NO: 55714 - DNA, 109 bp, Homo sapiens; identical to SEQ ID NO: 35063
  chr13:102568659-102568768
  hyper

SEQ ID NO: 55715 - DNA, 412 bp, Homo sapiens
  chr13:102569542-102569954
  hyper
tcggcttctgccggtgattgtcaagtgctttggaaatcagcatctggagagaccaatcttctcccctgagatctctaatcaaacgctccgttcccaccccactacaccccctccacctatgtggtccccctcctgatgtacctcttcagaaagaaacaaaacgtataggtaataatgatttaaaaataataagaaagaaagctaagatggattgcagggatggggtgctaagaggccgagccaaagcaggtggaattgaaggaacatcggggcgctttttcttagatgcaactcgctggttcccgagccttccgcggcttggttggggcttctcggtcttaacgtggttaccggtgcactgaaactctcagcagcggttggagggcgaggtggtttccgccctccctgctaa

SEQ ID NO: 55716 - DNA, 30 bp, Homo sapiens; identical to SEQ ID NO: 35065
  chr13:102572245-102572275
  hyper

SEQ ID NO: 55717 - DNA, 56 bp, Homo sapiens; identical to SEQ ID NO: 21723
  chr13:103046665-103046721
  hyper

SEQ ID NO: 55718 - DNA, 58 bp, Homo sapiens; identical to SEQ ID NO: 21724
  chr13:103046995-103047053
  hyper

SEQ ID NO: 55719 - DNA, 247 bp, Homo sapiens; identical to SEQ ID NO: 11708
  chr13:103047054-103047301
  hyper

SEQ ID NO: 55720 - DNA, 30 bp, Homo sapiens; identical to SEQ ID NO: 11709
  chr13:103052128-103052158
  hyper

SEQ ID NO: 55721 - DNA, 254 bp, Homo sapiens; identical to SEQ ID NO: 21727
  chr13:103052574-103052828
  hyper

SEQ ID NO: 55722 - DNA, 63 bp, Homo sapiens; identical to SEQ ID NO: 21728
  chr13:103052829-103052892
  hyper

SEQ ID NO: 55723 - DNA, 292 bp, Homo sapiens
  chr13:103052940-103053232
  hyper
tccgactccccaaatcagatgcatttgcatttcttatgtaatgtactgcaagttcccttgttggagccctttggaatcggggcgcatgatcaccagtaggcttaaaagcaggaactcacggcctggctcatccccacccctggccctgtgggaccccgacgcagggctttgacaccgctttctaaagggggggacttcaattacaaatattagaggggctgggcttgtcctctcagtctggggttccctcccggcgcaagccttgctcaagtattcccggtggcaggatgtg

SEQ ID NO: 55724 - DNA, 59 bp, Homo sapiens; identical to SEQ ID NO: 35072
  chr13:103054561-103054620
  hyper

SEQ ID NO: 55725 - DNA, 1 bp, Homo sapiens
  chr13:107186854-107186855
  hyper
t

SEQ ID NO: 55726 - DNA, 48 bp, Homo sapiens
  chr13:107186884-107186932
  hyper
gagagggtcaggtatcgccatcggacaccttcccggacttgacacccg

SEQ ID NO: 55727 - DNA, 97 bp, Homo sapiens; identical to SEQ ID NO: 35074
  chr13:108518548-108518645
  hyper

SEQ ID NO: 55728 - DNA, 108 bp, Homo sapiens
  chr13:108518705-108518813
  hyper
tgctgctgccgctgctgctgctggtgctccttgtcccgggcccgggtcagcttggcctcggcgcagaaccacaagtgatcagagagcaggactgtgaaaaacaagaga

SEQ ID NO: 55729 - DNA, 43 bp, Homo sapiens
  chr13:108519367-108519410
  hyper
tgtcagcgcgcgggtccccatggccccgcggagcccagcccgc

SEQ ID NO: 55730 - DNA, 115 bp, Homo sapiens
  chr13:108519622-108519737
  hyper
ccccaccccccaccccgcgctctaagtgctgccgccgccgccgccgccgccgccgctgccgcagggccgcccgcgggcgccgccgccggggctccgactgctgacgccgcctccc

SEQ ID NO: 55731 - DNA, 2 bp, Homo sapiens
  chr13:108519901-108519903
  hyper
cg

SEQ ID NO: 55732 - DNA, 21 bp, Homo sapiens
  chr13:108520805-108520826
  hyper
aatctggggtcacctcgattc

SEQ ID NO: 55733 - DNA, 278 bp, Homo sapiens; identical to SEQ ID NO: 35083
  chr13:109148376-109148654
  hyper

SEQ ID NO: 55734 - DNA, 107 bp, Homo sapiens
  chr13:110958709-110958816
  hyper
acttctgccttggagcgcgccttaggcagcagtcgtgggaaagctcagatacagctgtttccaggcaaagggcccagagcttttcagcctcagccaccagggtctcc

SEQ ID NO: 55735 - DNA, 73 bp, Homo sapiens
  chr13:110958981-110959054
  hyper
cgcgggttcaaatcccgccggctcccaggcaccctcaccccgccacagcgcgggctgtttctcctcccttccc

SEQ ID NO: 55736 - DNA, 132 bp, Homo sapiens; identical to SEQ ID NO: 4051
  chr13:110959517-110959649
  hyper

SEQ ID NO: 55737 - DNA, 173 bp, Homo sapiens
  chr13:110959970-110960143
  hyper
gagtagaaagggggagggtgggagagcgaagaccgagctcctcggccaaggagcacccacaggggcctaacgggaggctctccttctttccgggtcgtgggggggacggccctccggtcacccctgcatgcgggccgcgcaccgcgctgtccccgcgtctcgcggaccgagac

SEQ ID NO: 55738 - DNA, 197 bp, Homo sapiens
  chr13:110960344-110960541
  hyper
cggtgtaactctcggggactgacaagccgggcccgcacgttcacgtctctcttcctccctttcccatgcaggtggctgctgctggggacagtgaccgtggggttcctcgcccagagcgtcttggcggtaagtcctggctcccgcgcttggacttgcgcgcccgagagtggttgggacgtttgagtggccttggagaa

SEQ ID NO: 55739 - DNA, 221 bp, Homo sapiens; identical to SEQ ID NO: 35090
  chr13:110960909-110961130
  hyper

SEQ ID NO: 55740 - DNA, 112 bp, Homo sapiens; identical to SEQ ID NO: 35091
  chr13:111766833-111766945
  hyper

SEQ ID NO: 55741 - DNA, 80 bp, Homo sapiens; identical to SEQ ID NO: 35092
  chr13:111767213-111767293
  hyper

SEQ ID NO: 55742 - DNA, 252 bp, Homo sapiens; identical to SEQ ID NO: 35093
  chr13:111767866-111768118
  hyper

SEQ ID NO: 55743 - DNA, 30 bp, Homo sapiens; identical to SEQ ID NO: 35094
  chr13:111768438-111768468
  hyper

SEQ ID NO: 55744 - DNA, 136 bp, Homo sapiens
  chr13:112707869-112708005
  hyper
gccgcagggggttggggtcatttttttgatgccgccgcccttaagagttccagtccttcaggcgaaaggggcagatcaggccttcggggaggacccttgcctgggagagggagggcagtgccccaggggccgcctc

SEQ ID NO: 55745 - DNA, 30 bp, Homo sapiens; identical to SEQ ID NO: 35097
  chr13:112709027-112709057
  hyper

SEQ ID NO: 55746 - DNA, 68 bp, Homo sapiens
  chr13:112709815-112709883
  hyper
cagagacccagaccccgagaaacaagtgtggctccagcccaggagcctcacagaacacatttcctcct

SEQ ID NO: 55747 - DNA, 123 bp, Homo sapiens
  chr13:112709928-112710051
  hyper
gcaactaggtcctccgaggtgaggctggggctccgcctgcagagggagtgacagcgcgccgcgagggtccgcgacccaggcaggggtggccgcaccaccccggagcgccgcacagccccgcag

SEQ ID NO: 55748 - DNA, 14 bp, Homo sapiens
  chr13:112710745-112710759
  hyper
gaggggactgggga

SEQ ID NO: 55749 - DNA, 241 bp, Homo sapiens
  chr13:112711776-112712017
  hyper
tccccggtgcacacccggccgcgccgagaactaaatccgcgggctgaaattacgttttaaaaattaacatgttgaagcgtgtgccatttagtgagaggtgttttgggcaaagaatcaatttaactgtgactgaccgacgggcttgactgtattaattctgctaccgaaaaaaaaaaaaaaaaaaaagcaatgagccgcaagccttggactcgcagagctgccggtgcccgtccgagagccc

SEQ ID NO: 55750 - DNA, 16 bp, Homo sapiens
  chr13:112715354-112715370
  hyper
gggaacgctcccagcc

SEQ ID NO: 55751 - DNA, 77 bp, Homo sapiens
  chr13:112715642-112715719
  hyper
tttcctgatgcagccacagggcccagcagcggctcagcctaggccaccgggtccaggcctctaggcaataggcccgg

SEQ ID NO: 55752 - DNA, 182 bp, Homo sapiens
  chr13:112715803-112715985
  hyper
cgccgggcgctcggcgcatccgccgtgcccacagcgctgaggaccaactagggctgccctcggccaggggcactgtgcccgtttgagtggcactcggacctggcgaggggtggaagcccaggtagagctcgcgtctttaagagccacccgacagaactgcgcgctacatctgcgccagctgg

SEQ ID NO: 55753 - DNA, 40 bp, Homo sapiens; identical to SEQ ID NO: 21744
  chr13:112716313-112716353
  hyper

SEQ ID NO: 55754 - DNA, 55 bp, Homo sapiens
  chr13:112716622-112716677
  hyper
cggaggcacacagcacgcgcgcgtgcgcgcgcgcgcacacacacatacacacaca

SEQ ID NO: 55755 - DNA, 299 bp, Homo sapiens; identical to SEQ ID NO: 21746
  chr13:112717536-112717835
  hyper

SEQ ID NO: 55756 - DNA, 20 bp, Homo sapiens
  chr13:112717949-112717969
  hyper
ggactcgggactgacactgg

SEQ ID NO: 55757 - DNA, 218 bp, Homo sapiens
  chr13:112720505-112720723
  hyper
atgcccacacaaatactccccctttacccgaattgtggggcctggactgtgaaggccttcgctgcaagagcgggcactggcgaacttcagtgcacgccgcggccgagaacggatgcagggcgggggatggctgagccgcctgatccttgcagagaacctgcaggggccctcggagggtatcccctgcgtccaagggagcgcccctccttttcagcact

SEQ ID NO: 55758 - DNA, 245 bp, Homo sapiens; identical to SEQ ID NO: 21748
  chr13:112720767-112721012
  hyper

SEQ ID NO: 55759 - DNA, 91 bp, Homo sapiens
  chr13:112722312-112722403
  hyper
agcacccggattacaagtaccggccgcgccgcaagaccaagacgctgctcaagaaggacaagtactcgctggccggcgggctcctggcggc

SEQ ID NO: 55760 - DNA, 111 bp, Homo sapiens; identical to SEQ ID NO: 35112
  chr13:112722871-112722982
  hyper

SEQ ID NO: 55761 - DNA, 236 bp, Homo sapiens; identical to SEQ ID NO: 35113
  chr13:112723488-112723724
  hyper

SEQ ID NO: 55762 - DNA, 333 bp, Homo sapiens
  chr13:112724172-112724505
  hyper
aagtatcttctgctccggctgtttcactgcggacggctggggctgctgcgcgttaccttgctgcaagcggggcgccttccacctggctgggggtctgcgccacagtttggtccagaggagggaggaggaagggaagaccccagtggtgggaccctggaccaggccatggatgaaggacaaagaccagggcaggtcacgggtttcccaattccccagcaattaagatttcgagcagaatttatctaaatgtgtttcaaggaaacacaatcgctgaaccaaaacgtactgcagccgagccccctccgtccatcctctgcccctccccctggcttc

SEQ ID NO: 55763 - DNA, 30 bp, Homo sapiens; identical to SEQ ID NO: 35115
  chr13:112725438-112725468
  hyper

SEQ ID NO: 55764 - DNA, 45 bp, Homo sapiens; identical to SEQ ID NO: 35116
  chr13:112725825-112725870
  hyper

SEQ ID NO: 55765 - DNA, 169 bp, Homo sapiens
  chr13:112726560-112726729
  hyper
cggactccagcgccccctcgaccccgtcgggctccggccgactcccgccccctccccacccacgctcggcctgggcccgggggcagcggctccagaggcgtcggcggcagaatttaacccccggtctgagtccttggaaacttcaagtgaaaagcagacttggccttgg

SEQ ID NO: 55766 - DNA, 378 bp, Homo sapiens; identical to SEQ ID NO: 35118
  chr13:112726796-112727174
  hyper

SEQ ID NO: 55767 - DNA, 42 bp, Homo sapiens; identical to SEQ ID NO: 35119
  chr13:112727837-112727879
  hyper

SEQ ID NO: 55768 - DNA, 4 bp, Homo sapiens
  chr13:112727961-112727965
  hyper
cgca

SEQ ID NO: 55769 - DNA, 104 bp, Homo sapiens
  chr13:112758003-112758107
  hyper
ctcagcacctgcaggcggggggaccgcgcgcttggctcgaagaccccgccctgggcaggggacagaaaatatgaaatcagatggggagttatgaataactgtcc

SEQ ID NO: 55770 - DNA, 17 bp, Homo sapiens
  chr13:112758257-112758274
  hyper
acttttctcagtgtggg

SEQ ID NO: 55771 - DNA, 78 bp, Homo sapiens; identical to SEQ ID NO: 21754
  chr13:112758613-112758691
  hyper

SEQ ID NO: 55772 - DNA, 364 bp, Homo sapiens
  chr13:112759248-112759612
  hyper
tgcggcagcgggacgcgagggcgggaggggcgcagcagcggggagccggagcgcagcggaggggagcgctggggggcggggagcgctcgggcagccaccctgtccccgtctggagccccgcgctgcgtctaggagggcgcaacacgcagtccccgcgggggccagagctcggagccccctagtgcatgccccctctcctcgcgccctgccgaggcctcggccctgcctgccgtgccctgggcctggttgtgcccgggggtccccgcgggcagggcgcggggcaggcagggcgcgcgcgccgacgctcttttgtctgataactaatttgagttaatgcgatctttatgtaaagctaacagcggat

SEQ ID NO: 55773 - DNA, 139 bp, Homo sapiens
  chr13:112759642-112759781
  hyper
tcacaatcacttatctggaaacctgcggttggattaatcgttatattcccgagatgagcgtcgctgcaatccgcagcgaacgcgggtagggacctggagacgcctcccgggcgctggcggggccggtgtgggccagctc

SEQ ID NO: 55774 - DNA, 95 bp, Homo sapiens
  chr13:112760327-112760422
  hyper
gaagaggaacttgcattacaaagacttgtctttctgagctgaagtcaaaacgggggcgtcaagcgcgctccgtttggcggcggtggaggggccgc

SEQ ID NO: 55775 - DNA, 128 bp, Homo sapiens
  chr13:112761214-112761342
  hyper
agtccagaccccctccaacgttggtaggggtaggaagaggaggaggggcccagggaggggggtctttcgcaagtggggcctcgggggatccctgctctccttctggtgcattccgcaactttaaaagc

SEQ ID NO: 55776 - DNA, 69 bp, Homo sapiens; identical to SEQ ID NO: 35126
  chr13:113547082-113547151
  hyper

SEQ ID NO: 55777 - DNA, 132 bp, Homo sapiens; identical to SEQ ID NO: 35127
  chr13:114462866-114462998
  hyper

SEQ ID NO: 55778 - DNA, 119 bp, Homo sapiens
  chr14:21093631-21093750
  hyper
aggatcctgaagtactaacactttctaactagtaaaataattaaatcttcctttcccaggattctcccggattacacagcatcagttcctctgaattctgcattcgtaattaaaatcct

SEQ ID NO: 55779 - DNA, 30 bp, Homo sapiens; identical to SEQ ID NO: 35130
  chr14:21098864-21098894
  hyper

SEQ ID NO: 55780 - DNA, 119 bp, Homo sapiens
  chr14:21100629-21100748
  hyper
gcaacttttccccgacggcacctcctgggcgcccttgaaagacgccttaaatctaaacctataatacataggtaatcaactaaagctgaaagggaatggccaaagcacccacgtggagt

SEQ ID NO: 55781 - DNA, 23 bp, Homo sapiens
  chr14:21100778-21100801
  hyper
agtggcttttagagctcaacatc

SEQ ID NO: 55782 - DNA, 176 bp, Homo sapiens
  chr14:21100831-21101007
  hyper
ccagtcccgcggtgacctttatctttcggtgagtgaaatcggtcgttcgtgtttttcgtgggtcttccaaccacaggccgcctgagatggttctagtccctttgagtatacagacccttcctgtgcattgaccgacacagctcggcccggatcccgaaatgaacgtttctaccttc

SEQ ID NO: 55783 - DNA, 3 bp, Homo sapiens
  chr14:21101008-21101011
  hyper
gaa

SEQ ID NO: 55784 - DNA, 19 bp, Homo sapiens
  chr14:21101037-21101056
  hyper
cgcacgttgactttcctgg

SEQ ID NO: 55785 - DNA, 30 bp, Homo sapiens; identical to SEQ ID NO: 11759
  chr14:21121400-21121430
  hyper

SEQ ID NO: 55786 - DNA, 15 bp, Homo sapiens
  chr14:21121902-21121917
  hyper
ctcatcccccacccc

SEQ ID NO: 55787 - DNA, 292 bp, Homo sapiens; identical to SEQ ID NO: 35136
  chr14:21769054-21769346
  hyper

SEQ ID NO: 55788 - DNA, 139 bp, Homo sapiens; identical to SEQ ID NO: 35137
  chr14:21994200-21994339
  hyper

SEQ ID NO: 55789 - DNA, 88 bp, Homo sapiens; identical to SEQ ID NO: 35138
  chr14:23291857-23291945
  hyper

SEQ ID NO: 55790 - DNA, 30 bp, Homo sapiens; identical to SEQ ID NO: 35139
  chr14:23652871-23652901
  hyper

SEQ ID NO: 55791 - DNA, 177 bp, Homo sapiens; identical to SEQ ID NO: 35140
  chr14:23821399-23821576
  hyper

SEQ ID NO: 55792 - DNA, 592 bp, Homo sapiens; identical to SEQ ID NO: 35141
  chr14:23821601-23822193
  hyper

SEQ ID NO: 55793 - DNA, 121 bp, Homo sapiens
  chr14:24803473-24803594
  hyper
gaacccggacagaaacgagaagcatccaggactcagctttctccctgagcagacccagaagggtagagtgacttgcccagggtcactgcagttcctagccaggctcaatggtcctttcttt

SEQ ID NO: 55794 - DNA, 70 bp, Homo sapiens; identical to SEQ ID NO: 35144
  chr14:24804424-24804494
  hyper

SEQ ID NO: 55795 - DNA, 36 bp, Homo sapiens; identical to SEQ ID NO: 35145
  chr14:24808711-24808747
  hyper

SEQ ID NO: 55796 - DNA, 30 bp, Homo sapiens; identical to SEQ ID NO: 35146
  chr14:24837774-24837804
  hyper

SEQ ID NO: 55797 - DNA, 234 bp, Homo sapiens; identical to SEQ ID NO: 35147
  chr14:25518435-25518669
  hyper

SEQ ID NO: 55798 - DNA, 432 bp, Homo sapiens; identical to SEQ ID NO: 35148
  chr14:25519184-25519616
  hyper

SEQ ID NO: 55799 - DNA, 35 bp, Homo sapiens
  chr14:26674319-26674354
  hyper
agcccgactctggggcgtttgggaggtgggcctga

SEQ ID NO: 55800 - DNA, 193 bp, Homo sapiens; identical to SEQ ID NO: 21771
  chr14:26674384-26674577
  hyper

SEQ ID NO: 55801 - DNA, 110 bp, Homo sapiens; identical to SEQ ID NO: 35150
  chr14:27066218-27066328
  hyper

SEQ ID NO: 55802 - DNA, 60 bp, Homo sapiens; identical to SEQ ID NO: 11772
  chr14:27067097-27067157
  hyper

SEQ ID NO: 55803 - DNA, 65 bp, Homo sapiens; identical to SEQ ID NO: 35153
  chr14:27067614-27067679
  hyper

SEQ ID NO: 55804 - DNA, 37 bp, Homo sapiens; identical to SEQ ID NO: 35154
  chr14:27068238-27068275
  hyper

SEQ ID NO: 55805 - DNA, 46 bp, Homo sapiens; identical to SEQ ID NO: 35155
  chr14:29224761-29224807
  hyper

SEQ ID NO: 55806 - DNA, 207 bp, Homo sapiens
  chr14:29225561-29225768
  hyper
ggagggccagagcggggatcgcagcagaatctgcagcactggtgttaaggagaatttgagcgctcgaatgctgttgttaaatttcttcccagagccccatgctccctcgtttagcatctcccttccccaataattacttgagaggatgagctcgagattgaagagtgaggttggcttttctgtgtgaggagccgataggatccacca

SEQ ID NO: 55807 - DNA, 38 bp, Homo sapiens; identical to SEQ ID NO: 21776
  chr14:29226033-29226071
  hyper

SEQ ID NO: 55808 - DNA, 207 bp, Homo sapiens; identical to SEQ ID NO: 35158
  chr14:29226360-29226567
  hyper

SEQ ID NO: 55809 - DNA, 48 bp, Homo sapiens; identical to SEQ ID NO: 35159
  chr14:29227895-29227943
  hyper

SEQ ID NO: 55810 - DNA, 386 bp, Homo sapiens
  chr14:29228268-29228654
  hyper
ccctgttttgtgtttcgagcgggagagcagacactcagctcaaatagaggcctttctctcgtctttcggggtgtttattctatggccaaaaggtaagatggccaaggcagcgatctgagcgtgatgtctggccccgcggggggcccaggaggcccaagttgggacagctccggagctaccccggtgcccctcagctgggggagggcgcgcggcagccgcctgccagccccacaggctgctctccaaaggagctgggctttttcagcgtttctgtttccttgtagcctcatctatcttatctaacaagttcacgctccgggagaaaagaagagggtgagaaaaaaaaaaaagaaagaaaaaagaaaacctcttcaccgcggtgattc

SEQ ID NO: 55811 - DNA, 329 bp, Homo sapiens
  chr14:29228778-29229107
  hyper
gattgttttaaaaataaaagtgaccccccacagacacctttgatgttgttgattctgacacagaggagtcgagttgttttgtttacacatgctaacggtaacttgctcctgatgccgctctacgcgcagcttagtctgtcttctcctctcctccccgcaggcgactccttccaaagagcgagagagaaatacgggtattactgttatcccccactgggttcaataccccttacatgtaattgaatattcgaattaacgtcacctgcatgcaccccagtcttttaactctgaaatgtgctttatagcaatacagacttgaaacctttaac

SEQ ID NO: 55812 - DNA, 332 bp, Homo sapiens
  chr14:29229386-29229718
  hyper
ggaaccctcgcagttacagcctcaagaggcaaggcaggggagggagaaaagctggacctcttgagaaacgctcctccaacagattttccatggcctcgtgttggagaaggggcgcgggggaggagcgagggttggggtaggaagacctactggaaccgactccggagagtgagggccaggtgggtgtaagatgagcacaaagtaaaaacttgcccattggtttgtccacgcaggtttcttgaaagaagcagatagatctgattagtagatactactttccccacgcaaagggagactttggggtgaagggttctctgcgtgcttcctggctt

SEQ ID NO: 55813 - DNA, 200 bp, Homo sapiens
  chr14:29230871-29231071
  hyper
cttttcttttggctgcgtacgtacttggcttcagagagcctggaacacctggcagcgtcacagagacttgcctggagagtcccaggggtctctgtcaaggccttctcctcatccttgtcctcttcctcctcctgctcctcttcttcgccttggactttctcccttttaaagtggctccctagcttacacaagctaaacat

SEQ ID NO: 55814 - DNA, 142 bp, Homo sapiens
  chr14:29231283-29231425
  hyper
cgcccccggggacgttgagggtgcgcgtgcgcgcgctgagagcagccactgacaacctgcagctccctaatgagtgacgaggcagggctgctgcagaaaagtaacacttccctggtgtgaagacctcttactgagaagttta

SEQ ID NO: 55815 - DNA, 30 bp, Homo sapiens; identical to SEQ ID NO: 35164
  chr14:29231696-29231726
  hyper

SEQ ID NO: 55816 - DNA, 35 bp, Homo sapiens; identical to SEQ ID NO: 35165
  chr14:29234555-29234590
  hyper

SEQ ID NO: 55817 - DNA, 150 bp, Homo sapiens; identical to SEQ ID NO: 21784
  chr14:29234853-29235003
  hyper

SEQ ID NO: 55818 - DNA, 203 bp, Homo sapiens; identical to SEQ ID NO: 35168
  chr14:29236018-29236221
  hyper

SEQ ID NO: 55819 - DNA, 54 bp, Homo sapiens; identical to SEQ ID NO: 35169
  chr14:29236281-29236335
  hyper

SEQ ID NO: 55820 - DNA, 371 bp, Homo sapiens; identical to SEQ ID NO: 35170
  chr14:29236413-29236784
  hyper

SEQ ID NO: 55821 - DNA, 33 bp, Homo sapiens
  chr14:29237030-29237063
  hyper
gccgttcagctacaacgcgctcatcatgatggc

SEQ ID NO: 55822 - DNA, 77 bp, Homo sapiens; identical to SEQ ID NO: 35172
  chr14:29237139-29237216
  hyper

SEQ ID NO: 55823 - DNA, 317 bp, Homo sapiens; identical to SEQ ID NO: 35173
  chr14:29237573-29237890
  hyper

SEQ ID NO: 55824 - DNA, 30 bp, Homo sapiens; identical to SEQ ID NO: 35174
  chr14:29242568-29242598
  hyper

SEQ ID NO: 55825 - DNA, 63 bp, Homo sapiens; identical to SEQ ID NO: 11788
  chr14:29243208-29243271
  hyper

SEQ ID NO: 55826 - DNA, 3 bp, Homo sapiens
  chr14:29243513-29243516
  hyper
tta

SEQ ID NO: 55827 - DNA, 336 bp, Homo sapiens
  chr14:29243888-29244224
  hyper
tccctttcttcttaatcttctgtgtgccaccacctccccccaaccttttttcccctcccaaagttgtttccttttgtttacccggtgcggtttcagatctcagcacttctcagctagtagataaaattatttgctctgtaatggacatctcttctcctctccacttgttaccccactcgcccttcgctttctaccccattttgcttctctctgcccaagcctgtggtccaaggtgcagggatctcacaggaaaacaggtagcctcggggtgggaattcccagagcactgaaggcgccggttgttggccagagggaggccgggactccggtgggcag

SEQ ID NO: 55828 - DNA, 592 bp, Homo sapiens
  chr14:29247097-29247689
  hyper
atcttctcaccctggcgagttttcctgaaactacttatccttagcgtcagcgctgtaagaggtggagccgctcagtcccgcgggtggctgcagacagaaggtgggcgagtcctgggacttaaaaagttttgcagaaggttgaaaagaggagcagagggagagttttgagtttatttattttattttcctttttttttttttgtcttgtgccaagcccttgaagttaacgtagcgacgacgtggtccttgtaggaccaagcattcttggcattctgtcgagattgagattccagagcatcggatgaacgggacttatagctaaggcgtactcacccacccctcccttcgtctttttacgcacgcagcaactcgtcctcacgtgcataggggtagtggacagtgttgacttgaattgctgtccctcgttccaagcctttcctgtgaatgaacccgaaaacactcgacaggtcgtgaataatcgttttaatgagtgtgcaaagcgtgcgacggggtgcaccgagctgtcgggttaaacaaacaacttgtaccctgaccaaatccgattgttaaagtgcaaagtgatgtcagtacc

SEQ ID NO: 55829 - DNA, 15 bp, Homo sapiens
  chr14:29254425-29254440
  hyper
ggcgcccgcagaagc

SEQ ID NO: 55830 - DNA, 420 bp, Homo sapiens
  chr14:29254713-29255133
  hyper
ggctccaggcccaggggtccgttcacttccccgtccggtttgggggacgccaattcgcctaagaaaaccctggcagaagagcgcggacccttcactacaaacctcacgtcagggttacagccacatttaggaacctcttcggaaaagctgagaaatcactgttttgcaaaaagccttctgtactgtgatggggctttgtggtgagaggaacctctgagaagcctcgtgcggcttgagtttagagtcacgccctgcccagcgacattctcccgcgcacgggagaacctgcacttccggtctccaaccctcgcgggccgtgactcttcccctcccccgcgccgggccctgcatttccggcccccttgctctcctgcacttccgcccagtcacatggatgatggatagcgttgggagctgttt

SEQ ID NO: 55831 - DNA, 30 bp, Homo sapiens; identical to SEQ ID NO: 35181
  chr14:30396081-30396111
  hyper

SEQ ID NO: 55832 - DNA, 51 bp, Homo sapiens; identical to SEQ ID NO: 35182
  chr14:30396380-30396431
  hyper

SEQ ID NO: 55833 - DNA, 245 bp, Homo sapiens; identical to SEQ ID NO: 35183
  chr14:30396925-30397170
  hyper

SEQ ID NO: 55834 - DNA, 39 bp, Homo sapiens; identical to SEQ ID NO: 35184
  chr14:30739946-30739985
  hyper

SEQ ID NO: 55835 - DNA, 623 bp, Homo sapiens; identical to SEQ ID NO: 35185
  chr14:31343352-31343975
  hyper

SEQ ID NO: 55836 - DNA, 159 bp, Homo sapiens
  chr14:31344187-31344346
  hyper
cgcccctcacgaccccggccccttgctccgctgggtggaggctggagccagccctcacgcttctctcttcgcaggtgtgtgtctgctgctgctgccggggcccgcgggcagcgagggagccggtgagtgggggagctggggtgcgtccaggcggtcgca

SEQ ID NO: 55837 - DNA, 40 bp, Homo sapiens; identical to SEQ ID NO: 35187
  chr14:32671453-32671493
  hyper

SEQ ID NO: 55838 - DNA, 232 bp, Homo sapiens; identical to SEQ ID NO: 35188
  chr14:33401993-33402225
  hyper

SEQ ID NO: 55839 - DNA, 95 bp, Homo sapiens
  chr14:33402367-33402462
  hyper
cggcctgtgtcactcttggccttggcaacttctggccaatccgccctgcccctctgggtcccggcgggccggctgcgccctaggctcaaagggtt

SEQ ID NO: 55840 - DNA, 155 bp, Homo sapiens
  chr14:33402762-33402917
  hyper
ggctcgccagccggaagaaagaggaggaagtgggacaacgggggtcctgggcaggggtaggggaaacgatcaactcccactgcccccacccactagtcgagttggaatgcaagtcgtcacttaaaaaggctcacccaaaccgcaggcatacctcc

SEQ ID NO: 55841 - DNA, 550 bp, Homo sapiens
  chr14:33403316-33403866
  hyper
gcgctgcctgatgtgcataagacgggcagagaggggttccggccaggaagggaggctctacgtccccattcctgcacacgcgggctggcttccaggttgctggaagccgcgggaggcgcgagcttgcctggatggtggttatttctctagagaaaggaggagagagagagcgcgcctgagtcttgcactttgggtcggaagtgcgcggcgtgtgtgtgtgtgtgtgtgtgtgtgtgtgtagaggggggcgggaaagaaacgcaccctccgctgccggtcattcccttgcaccggccaagtcctcgccaagcctcccggtgcatccttcctccgccaccccctccccttcttccctcagctgggctcgcgcggcgcagccggagcagccagtgagagcaacatcctggaaagaggggggagcaccgccgccccccaaaagggaaaaaaggccccaccctgacacgttttgctgtttgcaagtccctcgcacgccccccgcacctcctcctcgcgcttgcggccccccccacccccagcccgctgcgcgcac

SEQ ID NO: 55842 - DNA, 30 bp, Homo sapiens; identical to SEQ ID NO: 35193
  chr14:33407749-33407779
  hyper

SEQ ID NO: 55843 - DNA, 60 bp, Homo sapiens; identical to SEQ ID NO: 35194
  chr14:33408303-33408363
  hyper

SEQ ID NO: 55844 - DNA, 55 bp, Homo sapiens; identical to SEQ ID NO: 35195
  chr14:33408623-33408678
  hyper

SEQ ID NO: 55845 - DNA, 177 bp, Homo sapiens; identical to SEQ ID NO: 35196
  chr14:34419561-34419738
  hyper

SEQ ID NO: 55846 - DNA, 182 bp, Homo sapiens; identical to SEQ ID NO: 35197
  chr14:34529691-34529873
  hyper

SEQ ID NO: 55847 - DNA, 131 bp, Homo sapiens
  chr14:36003826-36003957
  hyper
gttcctggagcgctgcctcagctcgcccgtctccgccgagtctttccccgggggcgccgccgccgtggccgctttctcctgctccgtggcgccagcagccgcaccgaccccgggggagcagtttctgctgc

SEQ ID NO: 55848 - DNA, 218 bp, Homo sapiens; identical to SEQ ID NO: 21798
  chr14:36004493-36004711
  hyper

SEQ ID NO: 55849 - DNA, 97 bp, Homo sapiens
  chr14:36972706-36972803
  hyper
ctgactttattcttacggaattaaacacaataatttttttaaaatatcttctttgaggcaagtgaccacgagagcacctgttatttaaaagtttatt

SEQ ID NO: 55850 - DNA, 12 bp, Homo sapiens
  chr14:36973210-36973222
  hyper
ccctgcgcagcc

SEQ ID NO: 55851 - DNA, 328 bp, Homo sapiens
  chr14:36973538-36973866
  hyper
tgctccgccgcaggaagaaagacgcccgacaggcgcccactgcccgaacccacgcgggggccagtcagccagcgggccgtgttgggaaagctccgcgcggcggcgggacataggatccccatcggggacctgggcgacggcctgagcttgggcgcccctccagctgggcgtcatctccacacagttcttcccttgcgccgcgaattcagcccctgtgaagacgctttgggcattggcgagcaacaggggaaaaaacgagtcacttaaatgggagaaggaaggggatggtcatgaggacttggaggaaaccacacggaaaagaaatcct

SEQ ID NO: 55852 - DNA, 247 bp, Homo sapiens
  chr14:36974982-36975229
  hyper
tattaaaagggttgtgctgcagctaaaatatctcacagtgtgtgtgaacctcataaaagggaggacccggattccaagcccctcgaagtccccaagcagcctggagggtgggggactcccctctccttctctccacactgagcccccgggcaagcccaggcctcctcctgcgccggggtccccgggctccgaaactgcgagagccctgcggagcccggccagaggggcagagggtgggggctggggg

SEQ ID NO: 55853 - DNA, 19 bp, Homo sapiens
  chr14:36975280-36975299
  hyper
cggggagccgggatccgcc

SEQ ID NO: 55854 - DNA, 58 bp, Homo sapiens; identical to SEQ ID NO: 21801
  chr14:36975399-36975457
  hyper

SEQ ID NO: 55855 - DNA, 142 bp, Homo sapiens; identical to SEQ ID NO: 21802
  chr14:36977503-36977645
  hyper

SEQ ID NO: 55856 - DNA, 30 bp, Homo sapiens; identical to SEQ ID NO: 35210
  chr14:36978658-36978688
  hyper

SEQ ID NO: 55857 - DNA, 67 bp, Homo sapiens; identical to SEQ ID NO: 35211
  chr14:36979742-36979809
  hyper

SEQ ID NO: 55858 - DNA, 244 bp, Homo sapiens; identical to SEQ ID NO: 35212
  chr14:36981839-36982083
  hyper

SEQ ID NO: 55859 - DNA, 294 bp, Homo sapiens; identical to SEQ ID NO: 35213
  chr14:36982402-36982696
  hyper

SEQ ID NO: 55860 - DNA, 288 bp, Homo sapiens; identical to SEQ ID NO: 35214
  chr14:36983130-36983418
  hyper

SEQ ID NO: 55861 - DNA, 30 bp, Homo sapiens
  chr14:36983678-36983708
  hyper
gagttcacctttccccgggacaagtaaaca

SEQ ID NO: 55862 - DNA, 117 bp, Homo sapiens
  chr14:36984146-36984263
  hyper
actctcactagacccaaccatcctcttgggaatcttcgagtccctctggctgttggaaactgtgtctcagcagtgaggcccaggtttctgagggagaaagcccggcctagcccacag

SEQ ID NO: 55863 - DNA, 73 bp, Homo sapiens
  chr14:36986228-36986301
  hyper
ccttgagattggatgcgcttggttgtttttcattttctttttttaaaaaaaaaaacccacaaattttaggggg

SEQ ID NO: 55864 - DNA, 10 bp, Homo sapiens
  chr14:36988143-36988153
  hyper
ctcctgagct

SEQ ID NO: 55865 - DNA, 38 bp, Homo sapiens; identical to SEQ ID NO: 35220
  chr14:36988606-36988644
  hyper

SEQ ID NO: 55866 - DNA, 36 bp, Homo sapiens; identical to SEQ ID NO: 35221
  chr14:36989186-36989222
  hyper

SEQ ID NO: 55867 - DNA, 829 bp, Homo sapiens; identical to SEQ ID NO: 35222
  chr14:36989705-36990534
  hyper

SEQ ID NO: 55868 - DNA, 323 bp, Homo sapiens
  chr14:36990535-36990858
  hyper
ctccccggccggccccggcaggtgcctccaagacacccgcgctggtcaaggagcttcttgaatttagtttttgttttcacattttctttcccctccttgtagagaaggagctcctgatcatgacgaacaggcagttttgagctacttaattcatccgggctccctttttttattaatagcaattacagtagagaaagttttatttatttttaaagatttcagccctctccttgaagagagctcttactccctcaatacaaagccaacttctataataacattcgcttttctcaccgcctaccttctttaccagggtaaagaaa

SEQ ID NO: 55869 - DNA, 22 bp, Homo sapiens
  chr14:36991177-36991199
  hyper
tgagtcccgaatggggtctaat

SEQ ID NO: 55870 - DNA, 165 bp, Homo sapiens; identical to SEQ ID NO: 21808
  chr14:36991613-36991778
  hyper

SEQ ID NO: 55871 - DNA, 84 bp, Homo sapiens
  chr14:36992417-36992501
  hyper
ggggcgcaggcccaggctcggccctagatgcgcggaatcgccatcagcctttgcttacaccagcgtggccgcagggaaactcct

SEQ ID NO: 55872 - DNA, 35 bp, Homo sapiens; identical to SEQ ID NO: 21809
  chr14:36993438-36993473
  hyper

SEQ ID NO: 55873 - DNA, 10 bp, Homo sapiens
  chr14:36994999-36995009
  hyper
catcatccac

SEQ ID NO: 55874 - DNA, 63 bp, Homo sapiens; identical to SEQ ID NO: 35231
  chr14:36995010-36995073
  hyper

SEQ ID NO: 55875 - DNA, 84 bp, Homo sapiens; identical to SEQ ID NO: 35232
  chr14:37051112-37051196
  hyper

SEQ ID NO: 55876 - DNA, 30 bp, Homo sapiens; identical to SEQ ID NO: 35233
  chr14:37051599-37051629
  hyper

SEQ ID NO: 55877 - DNA, 30 bp, Homo sapiens; identical to SEQ ID NO: 35234
  chr14:37051933-37051963
  hyper

SEQ ID NO: 55878 - DNA, 387 bp, Homo sapiens; identical to SEQ ID NO: 11829
  chr14:37116983-37117370
  hyper

SEQ ID NO: 55879 - DNA, 4 bp, Homo sapiens
  chr14:37124988-37124992
  hyper
ggcc

SEQ ID NO: 55880 - DNA, 107 bp, Homo sapiens; identical to SEQ ID NO: 21813
  chr14:37125545-37125652
  hyper

SEQ ID NO: 55881 - DNA, 165 bp, Homo sapiens; identical to SEQ ID NO: 35240
  chr14:37125763-37125928
  hyper

SEQ ID NO: 55882 - DNA, 85 bp, Homo sapiens; identical to SEQ ID NO: 21814
  chr14:37126156-37126241
  hyper

SEQ ID NO: 55883 - DNA, 269 bp, Homo sapiens
  chr14:37126297-37126566
  hyper
cttgcaatcccgcagcccggagttttgccccgtgcattaaaacatgttctctttcatttgcagatttaataaacaaacgtaaccatatcacatggagctccacactgtccttctgaaagcaattccgctgttgaaaactgaaaaatgggtgtaatttgctttcagaaagtaatgttagggtcacggcaatttctcgggccgttatttatttttactttaaagtctttaggaaagatttgcttatatgctcggaaaacttccaaatgcgc

SEQ ID NO: 55884 - DNA, 317 bp, Homo sapiens
  chr14:37126964-37127281
  hyper
cgtgaggctccttgatgagaaggtggagaggctgccgggctattctccgagcatcttccggccgagctctgctcctctccgtgcgcttgcggcttctccttgggctagcgcgtccgcagtccctccaagtccaggccgcaggtcagtgtgcgggcgcctcctgtcctcctctcccaccagaggacccctgagggctgtctccatccccaatccccgcgactgctccttttagccgccatcccctcccgcagcgcagatcctgcaggggccagcggtccagggcggaccctccctcgccctgggcgcggggcgagctt

SEQ ID NO: 55885 - DNA, 344 bp, Homo sapiens
  chr14:37127311-37127655
  hyper
gaaactcagctggccgcttaccctgcaagacggggacatagcagagggccgagttctggagaagctgggcttgtttttctctctgcaccgcgcgcaatgccccaactgaccctgaagggtcttgcctttactgcatttgcccccagacggctagaagtcaatgcactatgaaaatcccagtcccggacctcggactctggctgtcttacaatccctgcaactcctccgagtggacaagaggcgggcaccgtcgcctgggcctcgcttggggggggggggtcctgtccccagcagggggcaagttggaggaatcagctccttaatattttctgctagctctgctt

SEQ ID NO: 55886 - DNA, 323 bp, Homo sapiens
  chr14:37130260-37130583
  hyper
caggacagtggctgaatgtggcagagccttgggctccgtagtgagtgccccacgcactggcaattggtcgacttggggctgtgcgctagcgttagccgcctgtggttcagttccccgcacacggcgtggcccgtgcctcgagcctgtgtggctagtggttggccggtccacctggactggggggtcgccgcaggaagctggcggtaggaggaacctccctggccttaacagtggcccccacctgtggctcgggctccccgcaacctcctggtttctttggccggcctatcttctcacacctgcgctctcgccacctggcatgg

SEQ ID NO: 55887 - DNA, 30 bp, Homo sapiens; identical to SEQ ID NO: 35244
  chr14:37131143-37131173
  hyper

SEQ ID NO: 55888 - DNA, 85 bp, Homo sapiens; identical to SEQ ID NO: 21820
  chr14:37132290-37132375
  hyper

SEQ ID NO: 55889 - DNA, 306 bp, Homo sapiens
  chr14:37132695-37133001
  hyper
acatcctgggcatccgctccatcaccgaccaaggtaggggctcagaggctgggcgtgtggatgtgcagcgtctgcccccgcactctcgcggaggtcccagtatctgcagcctcagggacactgtctttcccaccacctgaggctttttcctttggaaacgtaaggagtcttcctagggggtgttctgatctcattaacttgaaactcatgcccctggtttccttgccacacacagtcttctgcctcatctcaaactaccagacccataacatccccccatccccaacacatggttcgcattttcca

SEQ ID NO: 55890 - DNA, 247 bp, Homo sapiens
  chr14:37133052-37133299
  hyper
gagagtgcggccggggctggacttggggcgcagcccgggaggcccgagcctgcttggggctgccggctgcagactccgctgtgggcagagcagcttgcttggggatcactacggccgggagaagtctggccgggaggagtccagcacgccttggaaattgaagtattctccgattctggtaatcaggccaaatttgctcaggcaggaagttcaaatgtcacctaattggtttcgttcttatgcttca

SEQ ID NO: 55891 - DNA, 86 bp, Homo sapiens; identical to SEQ ID NO: 35247
  chr14:37133668-37133754
  hyper

SEQ ID NO: 55892 - DNA, 12 bp, Homo sapiens
  chr14:37135739-37135751
  hyper
cgccgccccgca

SEQ ID NO: 55893 - DNA, 243 bp, Homo sapiens
  chr14:37136345-37136588
  hyper
gcggagaggggcacccagataaacgtaacaaagctaccattttctcgactaaaggtcacattgtaatctcccaaggaagttagtgagaaaacctcaaattatacggactggctgtggaccgtttaatttttctttccctccgtccctccctcatgtctccaaaggaaaatttaaaacactcgtgtttttattttccccccgagaaaagctaaacaaccaccacaacaaaagccccagatttaa

SEQ ID NO: 55894 - DNA, 170 bp, Homo sapiens; identical to SEQ ID NO: 35250
  chr14:37666822-37666992
  hyper

SEQ ID NO: 55895 - DNA, 112 bp, Homo sapiens; identical to SEQ ID NO: 35251
  chr14:38052852-38052964
  hyper

SEQ ID NO: 55896 - DNA, 95 bp, Homo sapiens; identical to SEQ ID NO: 35252
  chr14:38057238-38057333
  hyper

SEQ ID NO: 55897 - DNA, 33 bp, Homo sapiens
  chr14:38060644-38060677
  hyper
gctcctggtggtcaccgaggcgctgcctagagg

SEQ ID NO: 55898 - DNA, 1 bp, Homo sapiens
  chr14:38060916-38060917
  hyper
g

SEQ ID NO: 55899 - DNA, 45 bp, Homo sapiens; identical to SEQ ID NO: 35254
  chr14:38062015-38062060
  hyper

SEQ ID NO: 55900 - DNA, 128 bp, Homo sapiens; identical to SEQ ID NO: 35255
  chr14:38072551-38072679
  hyper

SEQ ID NO: 55901 - DNA, 42 bp, Homo sapiens; identical to SEQ ID NO: 35256
  chr14:38677446-38677488
  hyper

SEQ ID NO: 55902 - DNA, 30 bp, Homo sapiens; identical to SEQ ID NO: 35257
  chr14:38678172-38678202
  hyper

SEQ ID NO: 55903 - DNA, 52 bp, Homo sapiens; identical to SEQ ID NO: 35258
  chr14:38678631-38678683
  hyper

SEQ ID NO: 55904 - DNA, 142 bp, Homo sapiens; identical to SEQ ID NO: 35259
  chr14:38679118-38679260
  hyper

SEQ ID NO: 55905 - DNA, 136 bp, Homo sapiens; identical to SEQ ID NO: 35260
  chr14:38679744-38679880
  hyper

SEQ ID NO: 55906 - DNA, 102 bp, Homo sapiens; identical to SEQ ID NO: 21826
  chr14:38725258-38725360
  hyper

SEQ ID NO: 55907 - DNA, 30 bp, Homo sapiens; identical to SEQ ID NO: 35263
  chr14:42074229-42074259
  hyper

SEQ ID NO: 55908 - DNA, 70 bp, Homo sapiens
  chr14:42074474-42074544
  hyper
tctgtggtcttcctgcgcagtccctcagcggctcggagtttggccttccagctctccaactcagatcctg

SEQ ID NO: 55909 - DNA, 183 bp, Homo sapiens; identical to SEQ ID NO: 11850
  chr14:42075097-42075280
  hyper

SEQ ID NO: 55910 - DNA, 108 bp, Homo sapiens
  chr14:42075480-42075588
  hyper
accaactgcagtattcgtaatgtctgatgctgagctgagttgattcccaaatataaatgttcttttcagaatccgctcccatctgattagtaagcaaatcaccaccca

SEQ ID NO: 55911 - DNA, 20 bp, Homo sapiens
  chr14:42076803-42076823
  hyper
gcaaatgtgttaactcggcg

SEQ ID NO: 55912 - DNA, 377 bp, Homo sapiens
  chr14:42076853-42077230
  hyper
ctctgaggacgcccagacccattttcctggctggatttggagcggctgctgggctgtggacccaggtgtgtggatcgctttacccagaagcttggaaagcgccaatattaacctgcttccaggtacatcacaaggtcaagagagtgtcttgcagccctcttgtttccgtgtatctacaccttcttctcttggccagaaggatatttacgttttggttcacagcatttgaagccaaaagttcagcccttcgaactggtttgctatacaaaacaaaacaaaacaaataaggtaatgaggattgcttattaaactgcttaacaaaatccccgactcttcctcagccctttctcggctccctcctccccaccaaaatgtca

SEQ ID NO: 55913 - DNA, 100 bp, Homo sapiens
  chr14:42077268-42077368
  hyper
cttgaaggaaacgtgattaaagggctatgcgagaacgctctctttgctgcccgcggtccggtgggcttcgaagccaatcgtgagaaggaccggttccctc

SEQ ID NO: 55914 - DNA, 200 bp, Homo sapiens; identical to SEQ ID NO: 35270
  chr14:42077488-42077688
  hyper

SEQ ID NO: 55915 - DNA, 490 bp, Homo sapiens
  chr14:42078799-42079289
  hyper
cgaagacattagaattaacaagataaagcacttccaaagtagtctcatcaatgttttattccatagtgaagacggtctgaataatttaactaaggagtgttcgtttgtctcccgcctttgggagctgcttgctggctacattcagcggaggatttggcccagccaagctcagggtgccctgcttcaggaggcagtgactggggctgctggggggcggggggttctctttgctaacgccgtttaggaagtgtaggggcgctgcctgattttcccccactcgctgcatttctatagatatccatatgatggcatttgcagacttctagctggccgatagctgctctgcttgtccctgcgcactgacgtccccaactcctcttcgagtctgggctcggctgctgctgcagccctcgcaggctggtggtgctacaaggccatgtatgcagcgggctttgggggctgggctctgccactgcagctggcaggacgg

SEQ ID NO: 55916 - DNA, 161 bp, Homo sapiens
  chr14:42079328-42079489
  hyper
gaccccctggcagacagcaagcgcatcgtggccgaggcggccgcctggatgcgagaggagggagatgcccagagccacagaggagcgtggagggcggtggtgtcctgtctttgcctgcaaaacctttctctctctctccctccccgcgacaatgaatattg

SEQ ID NO: 55917 - DNA, 486 bp, Homo sapiens; identical to SEQ ID NO: 35272
  chr14:48143051-48143537
  hyper

SEQ ID NO: 55918 - DNA, 102 bp, Homo sapiens; identical to SEQ ID NO: 11855
  chr14:48143617-48143719
  hyper

SEQ ID NO: 55919 - DNA, 76 bp, Homo sapiens
  chr14:48144623-48144699
  hyper
gggtccaacagggagcggagtgtgcgtctggagctcgcttgggcacaccagcccagccgccaccgccaccgctctc

SEQ ID NO: 55920 - DNA, 105 bp, Homo sapiens; identical to SEQ ID NO: 21834
  chr14:48145257-48145362
  hyper

SEQ ID NO: 55921 - DNA, 197 bp, Homo sapiens; identical to SEQ ID NO: 4105
  chr14:48145469-48145666
  hyper

SEQ ID NO: 55922 - DNA, 171 bp, Homo sapiens; identical to SEQ ID NO: 35279
  chr14:50155136-50155307
  hyper

SEQ ID NO: 55923 - DNA, 154 bp, Homo sapiens; identical to SEQ ID NO: 35280
  chr14:51026705-51026859
  hyper

SEQ ID NO: 55924 - DNA, 17 bp, Homo sapiens
  chr14:51338713-51338730
  hyper
gcgaacagcctgacccg

SEQ ID NO: 55925 - DNA, 49 bp, Homo sapiens; identical to SEQ ID NO: 35282
  chr14:51410296-51410345
  hyper

SEQ ID NO: 55926 - DNA, 94 bp, Homo sapiens; identical to SEQ ID NO: 35283
  chr14:51410569-51410663
  hyper

SEQ ID NO: 55927 - DNA, 210 bp, Homo sapiens
  chr14:51561428-51561638
  hyper
cgctgtccgcctcgctgtataggctcatcttgtccaggtccagatagtcatagtcggagaccccggagcccgcggcccgatggctctggggggattcagactctggggtctgcaccaggatgttgcgggcgcacgcctgacacaaattgtgagagcagggcaggatgatgggctcccgatagaaggagccgcacacggggcatttcaact

SEQ ID NO: 55928 - DNA, 425 bp, Homo sapiens; identical to SEQ ID NO: 35288
  chr14:51562235-51562660
  hyper

SEQ ID NO: 55929 - DNA, 17 bp, Homo sapiens
  chr14:52534631-52534648
  hyper
aggtggccaggaaggcg

SEQ ID NO: 55930 - DNA, 221 bp, Homo sapiens; identical to SEQ ID NO: 21839
  chr14:52534791-52535012
  hyper

SEQ ID NO: 55931 - DNA, 220 bp, Homo sapiens
  chr14:52734557-52734777
  hyper
agaacaccacctctgtggaaaaaggcaactcggcggtgatgggcggggtgctcttcagcaccggcctcctgggcaacctgctggccctggggctgctggcgcgctcggggctggggtggtgctcgcggcgtccactgcgcccgctgccctcggtcttctacatgctggtgtgtggcctgacggtcaccgacttgctgggcaagtgcctcctaagcccggt

SEQ ID NO: 55932 - DNA, 169 bp, Homo sapiens
  chr14:52735255-52735424
  hyper
gactgtgccgagccgcgcgcggacgggagggaagcgtcccctcagcccctggaggagctggatcacctcctgctgctggcgctgatgaccgtgctcttcactatgtgttctctgcccgtaattgtgagtccccgggccccgaggcagcagggcactgagactgtccggc

SEQ ID NO: 55933 - DNA, 20 bp, Homo sapiens
  chr14:52735451-52735471
  hyper
cggatcgggatggacgcggc

SEQ ID NO: 55934 - DNA, 97 bp, Homo sapiens
  chr14:52781428-52781525
  hyper
gggtgcagcgccggccgcaggagctccctctccttgttccacgtgctggtgaccgagctggtgttcaccgacctgctcgggacctgcctcatcagcc

SEQ ID NO: 55935 - DNA, 61 bp, Homo sapiens
  chr14:52781916-52781977
  hyper
tgtcattctcaacctcatccgcatgcaccgccgaagccggagaagccgctgcggaccttcc

SEQ ID NO: 55936 - DNA, 233 bp, Homo sapiens; identical to SEQ ID NO: 35302
  chr14:53417159-53417392
  hyper

SEQ ID NO: 55937 - DNA, 220 bp, Homo sapiens; identical to SEQ ID NO: 21840
  chr14:54422431-54422651
  hyper

SEQ ID NO: 55938 - DNA, 34 bp, Homo sapiens; identical to SEQ ID NO: 11874
  chr14:54422926-54422960
  hyper

SEQ ID NO: 55939 - DNA, 57 bp, Homo sapiens; identical to SEQ ID NO: 35305
  chr14:54423406-54423463
  hyper

SEQ ID NO: 55940 - DNA, 387 bp, Homo sapiens; identical to SEQ ID NO: 35306
  chr14:54430156-54430543
  hyper

SEQ ID NO: 55941 - DNA, 35 bp, Homo sapiens; identical to SEQ ID NO: 35307
  chr14:54687254-54687289
  hyper

SEQ ID NO: 55942 - DNA, 83 bp, Homo sapiens
  chr14:57260863-57260946
  hyper
cattttaggccaattcgttaaaccagccgtctaaacgggccctggcactgggtatccgaccgctccacgcgccagctggtgag

SEQ ID NO: 55943 - DNA, 59 bp, Homo sapiens
  chr14:57261821-57261880
  hyper
gcaccggagcccgaagtcttccccaccgctggcaggagagccccgcgagctctcccgga

SEQ ID NO: 55944 - DNA, 107 bp, Homo sapiens
  chr14:57261965-57262072
  hyper
cgcgaaggaggcctcaaccttaggacaacccgggcgtcccgggcgaaggtctcgatctgccggagccactgcctttcaggcatcgctccattaaagccagggaggag

SEQ ID NO: 55945 - DNA, 248 bp, Homo sapiens
  chr14:57263831-57264079
  hyper
tatcagagcaccctgcgctgacaggctcgggcggtttagaagagaaaatcagaggtgctcagggcacctggtcacaaacctgggcatgcagatgcctgatgggggcttggaccctttcgtggcacgaaaaggagagagactgctgttcatcttaaaagtctcgaaggaggcaaaaacccaggcggaagtcatggctgactctgatcctgcatcttctcattctggttgttttccaccgcgtctgctcc

SEQ ID NO: 55946 - DNA, 42 bp, Homo sapiens
  chr14:57265240-57265282
  hyper
gccagcccagagagaaaggggaaaacccggcaaggcaagagc

SEQ ID NO: 55947 - DNA, 160 bp, Homo sapiens; identical to SEQ ID NO: 35315
  chr14:57265517-57265677
  hyper

SEQ ID NO: 55948 - DNA, 30 bp, Homo sapiens; identical to SEQ ID NO: 35318
  chr14:57271654-57271684
  hyper

SEQ ID NO: 55949 - DNA, 37 bp, Homo sapiens
  chr14:57272067-57272104
  hyper
gctcacttacccgggtagcccacggaggggtgcagca

SEQ ID NO: 55950 - DNA, 77 bp, Homo sapiens; identical to SEQ ID NO: 35320
  chr14:57272324-57272401
  hyper

SEQ ID NO: 55951 - DNA, 30 bp, Homo sapiens; identical to SEQ ID NO: 11888
  chr14:57273051-57273081
  hyper

SEQ ID NO: 55952 - DNA, 69 bp, Homo sapiens; identical to SEQ ID NO: 21848
  chr14:57274417-57274486
  hyper

SEQ ID NO: 55953 - DNA, 291 bp, Homo sapiens
  chr14:57275305-57275596
  hyper
gtctaccttactctggggggaggagttccctctcctactcccctctgttgctaataacttttggtgcctgtaaaaagtcccgagctgagcaggagaaatcctgaccccgaagctctaggatggaggggagaatttctaggagcgacttccccgtcccctccccaagcaatccaccaccgcagggtcggcgccgctcggccttcgctccccgcgcaccagttctatctgtgaaggaagcaaaagccaactcggtggaatcctgacaggggacttgggtttccaaaaatatgt

SEQ ID NO: 55954 - DNA, 336 bp, Homo sapiens; identical to SEQ ID NO: 21850
  chr14:57276104-57276440
  hyper

SEQ ID NO: 55955 - DNA, 214 bp, Homo sapiens
  chr14:57276666-57276880
  hyper
tcccactaccgctctcatctctagatcacatttttctttttgcaacgatcgttattacacctcaaaatttgtaagagaaaaaatacatccgcctacagaactccacgttcgcagaggggcatcggtcggtctattggaggtactggggtgatggccgacagacacggggacacgtagatatggatatagacaagacagacggacacttacctta

SEQ ID NO: 55956 - DNA, 126 bp, Homo sapiens; identical to SEQ ID NO: 35328
  chr14:57281138-57281264
  hyper

SEQ ID NO: 55957 - DNA, 15 bp, Homo sapiens
  chr14:57283299-57283314
  hyper
catacctgagataca

SEQ ID NO: 55958 - DNA, 82 bp, Homo sapiens
  chr14:58332215-58332297
  hyper
ctgggcgcacccagccgggccccttgccctctcacggttcagcaccgaggacagcggacatacttttctccccggggggtcc

SEQ ID NO: 55959 - DNA, 68 bp, Homo sapiens; identical to SEQ ID NO: 11902
  chr14:58332640-58332708
  hyper

SEQ ID NO: 55960 - DNA, 100 bp, Homo sapiens; identical to SEQ ID NO: 35334
  chr14:58618341-58618441
  hyper

SEQ ID NO: 55961 - DNA, 158 bp, Homo sapiens; identical to SEQ ID NO: 35335
  chr14:59931281-59931439
  hyper

SEQ ID NO: 55962 - DNA, 334 bp, Homo sapiens; identical to SEQ ID NO: 35336
  chr14:60043273-60043607
  hyper

SEQ ID NO: 55963 - DNA, 44 bp, Homo sapiens; identical to SEQ ID NO: 21856
  chr14:60097566-60097610
  hyper

SEQ ID NO: 55964 - DNA, 77 bp, Homo sapiens; identical to SEQ ID NO: 35339
  chr14:60336952-60337029
  hyper

SEQ ID NO: 55965 - DNA, 16 bp, Homo sapiens
  chr14:60386034-60386050
  hyper
atccagagaacgacac

SEQ ID NO: 55966 - DNA, 156 bp, Homo sapiens
  chr14:60386051-60386207
  hyper
agacctgcggttgctttggtttgccttttactaagttcatttctcagcctctctgcccactctgaaaagtctcccctttccccccttttaattctactctattttgtaaattactgttgtctcctgaaaattttggaatgcttaaaaggcactcaa

SEQ ID NO: 55967 - DNA, 386 bp, Homo sapiens
  chr14:60386252-60386638
  hyper
ttctctggacctcactgggcgttcgtttgcccgcgccgtccttccattcggcttgccgggcgcgcagcggcttgcggctgtggtcagccaccttcccgggaggcggtggtcgctggccgcgggaaggatgccgcgctgggggtcggggttcgtcccggctgtcacgccaccttgtgacatcacagggccatgccctcggggctcaaggccagagaggctccgcgcttccaggacccgagagctaaagataatgaatgggagagagcgagactggaggaggtaacgaataagtccccaccaccttgcccataacgcgttgctttcagtcacgttccgcgaactggcgaaggtaagtgaaaagataagcgcaggtacagaaaaacctg

SEQ ID NO: 55968 - DNA, 18 bp, Homo sapiens
  chr14:60386701-60386719
  hyper
ttccgctgattggttgga

SEQ ID NO: 55969 - DNA, 162 bp, Homo sapiens; identical to SEQ ID NO: 21859
  chr14:60794473-60794635
  hyper

SEQ ID NO: 55970 - DNA, 164 bp, Homo sapiens
  chr14:60794667-60794831
  hyper
gcgccgcctgcgggaggacctccgggagccgagctgcctccccgcaaacccggcccgggcccacgcgggctcagggcgccaggcggggtgcgccgaggtgcagctccccggccctaggcttcgctggggtgggggtcgaggcctctccgcgggtggctccctcc

SEQ ID NO: 55971 - DNA, 373 bp, Homo sapiens
  chr14:60973324-60973697
  hyper
ttgggttaataaaattaaatcaagtcccttgcgatggcgaagatggatctcctgatagtagtccccaacctccaggcacttctcagtcccttcctgccaagccaccagacagtgctcctactctgccacacgcagcccgcacccttctggcggctcccgcgaggccaactcagactctcagttccagttgcccgcgagcctcagacacgcagaagctaaagcgccctcatctaattatttgcagaactattatccaagaaatgggccatgggataaatattcccatttcctggatggggcccctagactgtccacttgctcacaaagattaagggtaagaaaccagctctccccgaatgtgccgcttccaaac

SEQ ID NO: 55972 - DNA, 15 bp, Homo sapiens
  chr14:60974077-60974092
  hyper
cgatgtttctttcta

SEQ ID NO: 55973 - DNA, 12 bp, Homo sapiens
  chr14:60974403-60974415
  hyper
cacctccaacca

SEQ ID NO: 55974 - DNA, 96 bp, Homo sapiens
  chr14:60976514-60976610
  hyper
ctgcttcaaggagcgcacgcggcacctgctacgcgagtggtacctgcaggatccataccctaaccccagcaaaaaacgtgagctcgcccaggcaac

SEQ ID NO: 55975 - DNA, 142 bp, Homo sapiens
  chr14:60978147-60978289
  hyper
ggcgccctttggccgcgaccacgggaaccagcggtgaggcctgacccagcaccacgttcttcttgctttgctttttcctaaggattttgctgcaaagtctccttcggaacccgaactgcaagctgagcgcctgcccagattc

SEQ ID NO: 55976 - DNA, 408 bp, Homo sapiens; identical to SEQ ID NO: 21862
  chr14:60981268-60981676
  hyper

SEQ ID NO: 55977 - DNA, 20 bp, Homo sapiens
  chr14:60981793-60981813
  hyper
tcattgtccgcgcgctggcc

SEQ ID NO: 55978 - DNA, 138 bp, Homo sapiens
  chr14:60981972-60982110
  hyper
cggtccgctcccaaagagaagcccagactgggcccacagtacccgggaaggtgagtccttactcgggggcccagatctccccacggaggccacagatctgggtccccgaggaaggagagccccccttttcgcgcaccc

SEQ ID NO: 55979 - DNA, 219 bp, Homo sapiens
  chr14:60982622-60982841
  hyper
accgcatgttcgcgatagcacatttgagccctggcaggccacctgggccgccttctttcggaaaccttgcggggtttccaagcaaggtttacaatgggaaactttatttcccattgtaagctcttacaaatctcctctggctagatccttccttgcagctctctttgctaggatttatattcccaaacttcttcagacgtgccctaccgcgagggaacg

SEQ ID NO: 55980 - DNA, 88 bp, Homo sapiens
  chr14:60982911-60982999
  hyper
acaagcagtttcacgcctccctgcccgctcatgctgtttccgcttgccctgtggtttgctctgcctggaacgccgccccctacctcaa

SEQ ID NO: 55981 - DNA, 15 bp, Homo sapiens
  chr14:61104140-61104155
  hyper
cctaccccccagtgc

SEQ ID NO: 55982 - DNA, 50 bp, Homo sapiens; identical to SEQ ID NO: 21864
  chr14:61104241-61104291
  hyper

SEQ ID NO: 55983 - DNA, 369 bp, Homo sapiens
  chr14:61109470-61109839
  hyper
caatggcaagaacagcctccgaagtgcgcggatgacaggaaaagatcttcagttcttctgccgctagagaagtgcgggatacaagcctctattggatccacaacctggagtcctgccttcggactttgccaaagacttgcaggcggtggggaggcagtaggaaatgaagccccctccagcctcagccgccgccgcgttcggtgcagcagcagcagtgccactgccacagagcagaggaaggcccgctccgcgcgagttctgtgccaggtgtcccgttggccctcagcggacaagggagagccgctaataagggtcgctgctcagcaaactcagagctcatccataagtgccaacgccactgcttctttc

SEQ ID NO: 55984 - DNA, 25 bp, Homo sapiens
  chr14:61110243-61110268
  hyper
agaggagaaacgaaaagtggcttta

SEQ ID NO: 55985 - DNA, 266 bp, Homo sapiens
  chr14:61114456-61114722
  hyper
gccacagccacctccccaccgtccttctgaatctctgtccgaaacgctatagagaacagaaggagcctgcccaggtggccgaaggtgttgccccgaggtgggggaaagtagagaccaatttttaaaatattgccttgtgagctccagtgcgagagagggctgcgactggagaccctttcctcgtctgggcatgcggcgcggtcagccagaccgacgggctgcagtgccgggccacgcgcgagcgagcacggcgaggatcaaccctt

SEQ ID NO: 55986 - DNA, 314 bp, Homo sapiens; identical to SEQ ID NO: 21867
  chr14:61114997-61115311
  hyper

SEQ ID NO: 55987 - DNA, 532 bp, Homo sapiens
  chr14:61115517-61116049
  hyper
gcagtagctggtctcctcgccgtcccagatggtgcgcggcagtggaaattttcggcgcacccgatatttgcccacggcgcccaggggtcggccgcgcagcttctcggcctccacgtaatgcgccttcagccacagttgctgcagtttggggtggttgtgaggcgagaactggtggctctccaggatcttgtagagctcacggaagttgccgcggtggaaggcgaccaccgccttggccttgagtacgctctcgttcttgtgcaggtggtcgcaggcgggcagtgaccacaggaacctgcccaggcgctccaggtttccgccttgctgcagaacctcgcacacgcacgccacttgctcctgcgtaaagccaaacgacggcagcatcgacatggctggggcctgccggggcgcacggcccaggcgcacgcggcagggagcagagccgagaggcagggggcggcggccgcagggaggggggcgcggctgttcctaacctcctccttaggctttgcaaaggcgaaaaccggagtcg

SEQ ID NO: 55988 - DNA, 122 bp, Homo sapiens; identical to SEQ ID NO: 35362
  chr14:61116488-61116610
  hyper

SEQ ID NO: 55989 - DNA, 153 bp, Homo sapiens; identical to SEQ ID NO: 35363
  chr14:61116875-61117028
  hyper

SEQ ID NO: 55990 - DNA, 187 bp, Homo sapiens
  chr14:61118778-61118965
  hyper
aggccgtgactgggccggccaacatttttcctcccgcttaatccaatagatcgcgtaactggaaagggaaagtgctatgcgctttataccaaggagtctacctgctatttcgatccctcggttaggggaaccaattgttataaatgttaattattggctcggatatataaggtttcccaaaatggaa

SEQ ID NO: 55991 - DNA, 70 bp, Homo sapiens; identical to SEQ ID NO: 35365
  chr14:61124556-61124626
  hyper

SEQ ID NO: 55992 - DNA, 155 bp, Homo sapiens; identical to SEQ ID NO: 35366
  chr14:61188472-61188627
  hyper

SEQ ID NO: 55993 - DNA, 50 bp, Homo sapiens; identical to SEQ ID NO: 35367
  chr14:61655782-61655832
  hyper

SEQ ID NO: 55994 - DNA, 39 bp, Homo sapiens; identical to SEQ ID NO: 35368
  chr14:61748115-61748154
  hyper

SEQ ID NO: 55995 - DNA, 42 bp, Homo sapiens; identical to SEQ ID NO: 35369
  chr14:61788181-61788223
  hyper

SEQ ID NO: 55996 - DNA, 483 bp, Homo sapiens; identical to SEQ ID NO: 35370
  chr14:61788722-61789205
  hyper

SEQ ID NO: 55997 - DNA, 154 bp, Homo sapiens; identical to SEQ ID NO: 4151
  chr14:62279322-62279476
  hyper

SEQ ID NO: 55998 - DNA, 59 bp, Homo sapiens; identical to SEQ ID NO: 21873
  chr14:62279519-62279578
  hyper

SEQ ID NO: 55999 - DNA, 95 bp, Homo sapiens
  chr14:62583714-62583809
  hyper
ccctctccccaaacccgacctccgtaggggacaccgagccaaggcctgcagcgagtgacctgcccggggaggcgcgggaccgaggctcacctacc

SEQ ID NO: 56000 - DNA, 360 bp, Homo sapiens; identical to SEQ ID NO: 35376
  chr14:62583918-62584278
  hyper

SEQ ID NO: 56001 - DNA, 13 bp, Homo sapiens
  chr14:62584279-62584292
  hyper
atctggtgagtgg

SEQ ID NO: 56002 - DNA, 151 bp, Homo sapiens; identical to SEQ ID NO: 35378
  chr14:63511856-63512007
  hyper

SEQ ID NO: 56003 - DNA, 37 bp, Homo sapiens; identical to SEQ ID NO: 21877
  chr14:63512063-63512100
  hyper

SEQ ID NO: 56004 - DNA, 282 bp, Homo sapiens; identical to SEQ ID NO: 21878
  chr14:63512291-63512573
  hyper

SEQ ID NO: 56005 - DNA, 308 bp, Homo sapiens
  chr14:63512816-63513124
  hyper
ccaccccggagcgggagcgcgagccctgaagtccgagcgcacagccggcgcccggaatggcccctgcgacccgggccgggcttggcgtctgggggagcgtgcggccgcccaggggagtttcccccaggaccgctgagcgcaggaggcgatccgcgagcccgccaccgctgcaaagttgcgggaaaggttgcacttgatgtgaagagtaggggaagagggtgaataattcacacccgagagagggggagtgaggagggcagtgttagcgatggaaaaacggtaaaggctgtgggggcgaagatgcgcca

SEQ ID NO: 56006 - DNA, 30 bp, Homo sapiens; identical to SEQ ID NO: 35381
  chr14:63670862-63670892
  hyper

SEQ ID NO: 56007 - DNA, 30 bp, Homo sapiens; identical to SEQ ID NO: 35382
  chr14:64760774-64760804
  hyper

SEQ ID NO: 56008 - DNA, 66 bp, Homo sapiens; identical to SEQ ID NO: 11941
  chr14:64761073-64761139
  hyper

SEQ ID NO: 56009 - DNA, 226 bp, Homo sapiens; identical to SEQ ID NO: 35384
  chr14:65007311-65007537
  hyper

SEQ ID NO: 56010 - DNA, 39 bp, Homo sapiens; identical to SEQ ID NO: 35385
  chr14:65007552-65007591
  hyper

SEQ ID NO: 56011 - DNA, 62 bp, Homo sapiens
  chr14:65009193-65009255
  hyper
aacgccctggagtcctatacctacaacatcaagcagacggtggaagacgagaaactgagggg

SEQ ID NO: 56012 - DNA, 315 bp, Homo sapiens; identical to SEQ ID NO: 35387
  chr14:65016501-65016816
  hyper

SEQ ID NO: 56013 - DNA, 30 bp, Homo sapiens; identical to SEQ ID NO: 35388
  chr14:65170683-65170713
  hyper

SEQ ID NO: 56014 - DNA, 52 bp, Homo sapiens; identical to SEQ ID NO: 35389
  chr14:65170984-65171036
  hyper

SEQ ID NO: 56015 - DNA, 38 bp, Homo sapiens; identical to SEQ ID NO: 35390
  chr14:65345951-65345989
  hyper

SEQ ID NO: 56016 - DNA, 30 bp, Homo sapiens; identical to SEQ ID NO: 35391
  chr14:67878885-67878915
  hyper

SEQ ID NO: 56017 - DNA, 308 bp, Homo sapiens; identical to SEQ ID NO: 35392
  chr14:69726355-69726663
  hyper

SEQ ID NO: 56018 - DNA, 521 bp, Homo sapiens; identical to SEQ ID NO: 35393
  chr14:69727096-69727617
  hyper

SEQ ID NO: 56019 - DNA, 81 bp, Homo sapiens; identical to SEQ ID NO: 35394
  chr14:69727831-69727912
  hyper

SEQ ID NO: 56020 - DNA, 58 bp, Homo sapiens; identical to SEQ ID NO: 35395
  chr14:69950779-69950837
  hyper

SEQ ID NO: 56021 - DNA, 30 bp, Homo sapiens; identical to SEQ ID NO: 35396
  chr14:69951121-69951151
  hyper

SEQ ID NO: 56022 - DNA, 100 bp, Homo sapiens
  chr14:70014623-70014723
  hyper
agggtgggcgagacacggccgccttccttcacatccaacgccggtgaggctcagcactcattgtctcactggcagcacagacaaagccttgcgggctcca

SEQ ID NO: 56023 - DNA, 116 bp, Homo sapiens; identical to SEQ ID NO: 21888
  chr14:70346020-70346136
  hyper

SEQ ID NO: 56024 - DNA, 39 bp, Homo sapiens; identical to SEQ ID NO: 21889
  chr14:70346491-70346530
  hyper

SEQ ID NO: 56025 - DNA, 40 bp, Homo sapiens; identical to SEQ ID NO: 35399
  chr14:70346833-70346873
  hyper

SEQ ID NO: 56026 - DNA, 147 bp, Homo sapiens; identical to SEQ ID NO: 35400
  chr14:70653698-70653845
  hyper

SEQ ID NO: 56027 - DNA, 227 bp, Homo sapiens; identical to SEQ ID NO: 35401
  chr14:70654063-70654290
  hyper

SEQ ID NO: 56028 - DNA, 42 bp, Homo sapiens; identical to SEQ ID NO: 35402
  chr14:70654291-70654333
  hyper

SEQ ID NO: 56029 - DNA, 74 bp, Homo sapiens; identical to SEQ ID NO: 21893
  chr14:70654713-70654787
  hyper

SEQ ID NO: 56030 - DNA, 498 bp, Homo sapiens; identical to SEQ ID NO: 21894
  chr14:70655032-70655530
  hyper

SEQ ID NO: 56031 - DNA, 40 bp, Homo sapiens
  chr14:70656090-70656130
  hyper
cctcaggagacgctgcctgcaattccgaaattaagtctcc

SEQ ID NO: 56032 - DNA, 112 bp, Homo sapiens
  chr14:72398631-72398743
  hyper
aatacataaaaatgacgaggttaggaacaatatcgctgacggtcgcggtgtcccgttttaatttagagggcgccagcaacacgtcagtgagggagattcagaagccgccggg

SEQ ID NO: 56033 - DNA, 214 bp, Homo sapiens; identical to SEQ ID NO: 21896
  chr14:72399019-72399233
  hyper

SEQ ID NO: 56034 - DNA, 149 bp, Homo sapiens
  chr14:72399780-72399929
  hyper
tgtccatttcagatgcgtgacaggtgcccgtgtgtgtgtgtctgcagtttgggactgtggaagcacgagcttacataagtggttaggcaagctggcgtgtggacttgtgtgggatgggtgcaggtctgcatataaatcatgttcctggg

SEQ ID NO: 56035 - DNA, 210 bp, Homo sapiens
  chr14:72400029-72400239
  hyper
tttgcctctaatcaggcgttcattaactttttccctgaacaagctcgcccatttgtggtttggaagaaaagaaagcgagtctccgcggtgaggtgtggagggcaggggcgggtggggaggtttgttgtttgggaactgcgctagcaaaggaagcggtggctattcgcttggagaggatgacaaatgaactggttgcgtgaggagtgaaga

SEQ ID NO: 56036 - DNA, 76 bp, Homo sapiens; identical to SEQ ID NO: 35411
  chr14:73358964-73359040
  hyper

SEQ ID NO: 56037 - DNA, 88 bp, Homo sapiens; identical to SEQ ID NO: 35412
  chr14:74208209-74208297
  hyper

SEQ ID NO: 56038 - DNA, 176 bp, Homo sapiens; identical to SEQ ID NO: 35413
  chr14:74254402-74254578
  hyper

SEQ ID NO: 56039 - DNA, 175 bp, Homo sapiens; identical to SEQ ID NO: 21898
  chr14:74706222-74706397
  hyper

SEQ ID NO: 56040 - DNA, 38 bp, Homo sapiens; identical to SEQ ID NO: 21899
  chr14:74707873-74707911
  hyper

SEQ ID NO: 56041 - DNA, 464 bp, Homo sapiens; identical to SEQ ID NO: 35418
  chr14:74707912-74708376
  hyper

SEQ ID NO: 56042 - DNA, 88 bp, Homo sapiens
  chr14:74708774-74708862
  hyper
cccttccgcaccagccgcactgctaccagttccttgggtacatttgtaaggtggttttcaaggaaataaaggagaaagaaccaaaaat

SEQ ID NO: 56043 - DNA, 137 bp, Homo sapiens
  chr14:74708955-74709092
  hyper
gggccgccacagactctgcgccctttcaagacatttctccactagggcgttctctggcacccccgccgccacatcgttttctcccaccctaatttgttttcagcctctttgcaccctctctgcgcttttctatgctt

SEQ ID NO: 56044 - DNA, 30 bp, Homo sapiens; identical to SEQ ID NO: 35420
  chr14:74725251-74725281
  hyper

SEQ ID NO: 56045 - DNA, 182 bp, Homo sapiens; identical to SEQ ID NO: 35421
  chr14:74892589-74892771
  hyper

SEQ ID NO: 56046 - DNA, 18 bp, Homo sapiens
  chr14:74892798-74892816
  hyper
cgccgccgcccgccccgc

SEQ ID NO: 56047 - DNA, 17 bp, Homo sapiens
  chr14:74893057-74893074
  hyper
gaagtcgggggagcccg

SEQ ID NO: 56048 - DNA, 275 bp, Homo sapiens
  chr14:75077895-75078170
  hyper
tgcgaaaggatttaacgtcggggctccgggagagttggtaagaaaggatgaggatgatgatctatctgccttcaactcttcgaaagcggatcaaatcttccaatcccgattttggaacctcggggctgtttcccgaagtactaaagacagagggacgagggtatgagagcggcgccctctcctctcgcctgcacgcccctccacaaatgagccctggctcccctctgtaccctccaaacttccctctcccatgctcaccccgtgagccgccctcg

SEQ ID NO: 56049 - DNA, 247 bp, Homo sapiens; identical to SEQ ID NO: 35425
  chr14:75078651-75078898
  hyper

SEQ ID NO: 56050 - DNA, 107 bp, Homo sapiens
  chr14:76604575-76604682
  hyper
tagagagattcagcccggacaatcagggttggcttcacggaggagggggtatctgagctgagctttgatgaatacgtcagatttgggggaaaggttgctgctggata

SEQ ID NO: 56051 - DNA, 89 bp, Homo sapiens; identical to SEQ ID NO: 21905
  chr14:76604716-76604805
  hyper

SEQ ID NO: 56052 - DNA, 32 bp, Homo sapiens; identical to SEQ ID NO: 21906
  chr14:76605040-76605072
  hyper

SEQ ID NO: 56053 - DNA, 89 bp, Homo sapiens
  chr14:76605376-76605465
  hyper
cactcccaggggcccagggaaaatttgcagttattatgaaggagatgagacagattaaaagcccttgtgttcgccgctttgccccttta

SEQ ID NO: 56054 - DNA, 109 bp, Homo sapiens; identical to SEQ ID NO: 35428
  chr14:76795936-76796045
  hyper

SEQ ID NO: 56055 - DNA, 92 bp, Homo sapiens; identical to SEQ ID NO: 11971
  chr14:76819300-76819392
  hyper

SEQ ID NO: 56056 - DNA, 84 bp, Homo sapiens; identical to SEQ ID NO: 35430
  chr14:76842636-76842720
  hyper

SEQ ID NO: 56057 - DNA, 202 bp, Homo sapiens; identical to SEQ ID NO: 35431
  chr14:76843184-76843386
  hyper

SEQ ID NO: 56058 - DNA, 10 bp, Homo sapiens
  chr14:76843732-76843742
  hyper
cgctccacct

SEQ ID NO: 56059 - DNA, 41 bp, Homo sapiens; identical to SEQ ID NO: 21909
  chr14:76843953-76843994
  hyper

SEQ ID NO: 56060 - DNA, 187 bp, Homo sapiens; identical to SEQ ID NO: 35433
  chr14:77227599-77227786
  hyper

SEQ ID NO: 56061 - DNA, 239 bp, Homo sapiens; identical to SEQ ID NO: 35434
  chr14:77228556-77228795
  hyper

SEQ ID NO: 56062 - DNA, 308 bp, Homo sapiens; identical to SEQ ID NO: 35435
  chr14:77591237-77591545
  hyper

SEQ ID NO: 56063 - DNA, 104 bp, Homo sapiens; identical to SEQ ID NO: 35436
  chr14:77600264-77600368
  hyper

SEQ ID NO: 56064 - DNA, 87 bp, Homo sapiens; identical to SEQ ID NO: 35437
  chr14:77606262-77606349
  hyper

SEQ ID NO: 56065 - DNA, 99 bp, Homo sapiens; identical to SEQ ID NO: 35438
  chr14:77606757-77606856
  hyper

SEQ ID NO: 56066 - DNA, 1081 bp, Homo sapiens
  chr14:77607236-77608317
  hyper
ttccaggggctaaggaatcggccagccggaggcgcgagaaaagttctgggaaggcggttgcacctaggatgggtggatgccacggggcctccgtccaggctgtcccgtccgcacgggtcgactggtcaccttggaatcccctttgcaggtcccagcgccccccgggaacccgcagcctccgcggagagcgtgggcctctccctaccgctggggcgcagcgcagtgcacgcctgagggtggtcgccgggggctgggcacgcccccagtcctgcgccgccgggggctgcggcggtgctgcccaccccagagagccctcggcctggggctccggcgaagcaagtgccttcccggcgccggtcgccaggggggcgcgggagcagccagatgcgccgcagcgctgggaaggcggcgaaggacaggggctaggggagtgaggggcgctcggcaggcagcctcagccctggccctgcgcgggagaagggacagcagagaccgcccgtggggccccggggtgtagggagctgtccgttcagccctggcgcccgcctcgcccgcggcagagggcggcacagccggagccttggaaagaccggcagcgccggcagccgcgggcttctcggccactgcctcccggacgcacgggaagccgccccccgcgccgccgccgccgcactgccgccgtcgcagaggggtgaggaaatcaactcaccgagctctggtcgccgacaagaggagccccggacgccggctctcgccctgcccgaggctgcaaagttgtggactcggcccggctggctcgcagcctgcgcttcgcttcgggaactgggcaagtagcggggatgtggggaggagggagcgggcagctgctggcttcccacttgggcgccagcgagtaagggccaggaagcggcggggatggcagctgggcaccccccagccccgccacccctccctccgctcctgggggcggtgctctggccgccagtctcagcatcgtggacttgccccctcctcccctctcgattccccttgagcgggctggggcgccctgcctggtttcagcgcccgttccagctgggag

SEQ ID NO: 56067 - DNA, 127 bp, Homo sapiens; identical to SEQ ID NO: 35440
  chr14:77737019-77737146
  hyper

SEQ ID NO: 56068 - DNA, 65 bp, Homo sapiens; identical to SEQ ID NO: 21917
  chr14:77737147-77737212
  hyper

SEQ ID NO: 56069 - DNA, 549 bp, Homo sapiens; identical to SEQ ID NO: 35442
  chr14:77964498-77965047
  hyper

SEQ ID NO: 56070 - DNA, 190 bp, Homo sapiens; identical to SEQ ID NO: 35443
  chr14:77965493-77965683
  hyper

SEQ ID NO: 56071 - DNA, 30 bp, Homo sapiens; identical to SEQ ID NO: 11983
  chr14:78624601-78624631
  hyper

SEQ ID NO: 56072 - DNA, 30 bp, Homo sapiens; identical to SEQ ID NO: 35445
  chr14:79745212-79745242
  hyper

SEQ ID NO: 56073 - DNA, 36 bp, Homo sapiens; identical to SEQ ID NO: 35447
  chr14:85997566-85997602
  hyper

SEQ ID NO: 56074 - DNA, 10 bp, Homo sapiens
  chr14:85999522-85999532
  hyper
gctccaggag

SEQ ID NO: 56075 - DNA, 117 bp, Homo sapiens
  chr14:85999613-85999730
  hyper
aaacatatccgggggtgtcaggaggggtaggggtgggggccgcggcgcctacattagcccggccgcgtcggattgaggcagtagtgtggtctgagcagcctccagacccacgccggg

SEQ ID NO: 56076 - DNA, 59 bp, Homo sapiens; identical to SEQ ID NO: 35453
  chr14:85999838-85999897
  hyper

SEQ ID NO: 56077 - DNA, 35 bp, Homo sapiens; identical to SEQ ID NO: 35454
  chr14:86000128-86000163
  hyper

SEQ ID NO: 56078 - DNA, 262 bp, Homo sapiens; identical to SEQ ID NO: 35456
  chr14:88789384-88789646
  hyper

SEQ ID NO: 56079 - DNA, 171 bp, Homo sapiens; identical to SEQ ID NO: 35457
  chr14:88790076-88790247
  hyper

SEQ ID NO: 56080 - DNA, 236 bp, Homo sapiens; identical to SEQ ID NO: 35458
  chr14:88790298-88790534
  hyper

SEQ ID NO: 56081 - DNA, 447 bp, Homo sapiens; identical to SEQ ID NO: 35459
  chr14:88792916-88793363
  hyper

SEQ ID NO: 56082 - DNA, 30 bp, Homo sapiens; identical to SEQ ID NO: 35460
  chr14:89493162-89493192
  hyper

SEQ ID NO: 56083 - DNA, 30 bp, Homo sapiens; identical to SEQ ID NO: 35461
  chr14:89493428-89493458
  hyper

SEQ ID NO: 56084 - DNA, 548 bp, Homo sapiens; identical to SEQ ID NO: 35463
  chr14:90084100-90084648
  hyper

SEQ ID NO: 56085 - DNA, 110 bp, Homo sapiens; identical to SEQ ID NO: 35464
  chr14:90085840-90085950
  hyper

SEQ ID NO: 56086 - DNA, 625 bp, Homo sapiens; identical to SEQ ID NO: 35465
  chr14:90526555-90527180
  hyper

SEQ ID NO: 56087 - DNA, 163 bp, Homo sapiens
  chr14:90527551-90527714
  hyper
gagcctactagtaggcgcagaggacgcccccgcgcaggatccagagaccaagggcgctctggcatggtcaaggcgagggaggctgcccgggggagaagcccctaacttcctttgctccctgttccaacctccctttctggtctcctctctccagcccgtccgc

SEQ ID NO: 56088 - DNA, 173 bp, Homo sapiens; identical to SEQ ID NO: 21928
  chr14:90527758-90527931
  hyper

SEQ ID NO: 56089 - DNA, 519 bp, Homo sapiens; identical to SEQ ID NO: 35467
  chr14:90528183-90528702
  hyper

SEQ ID NO: 56090 - DNA, 213 bp, Homo sapiens; identical to SEQ ID NO: 35468
  chr14:90528934-90529147
  hyper

SEQ ID NO: 56091 - DNA, 295 bp, Homo sapiens; identical to SEQ ID NO: 35469
  chr14:90850099-90850394
  hyper

SEQ ID NO: 56092 - DNA, 53 bp, Homo sapiens; identical to SEQ ID NO: 12000
  chr14:91580352-91580405
  hyper

SEQ ID NO: 56093 - DNA, 30 bp, Homo sapiens; identical to SEQ ID NO: 35471
  chr14:91581588-91581618
  hyper

SEQ ID NO: 56094 - DNA, 30 bp, Homo sapiens; identical to SEQ ID NO: 35472
  chr14:91720177-91720207
  hyper

SEQ ID NO: 56095 - DNA, 416 bp, Homo sapiens; identical to SEQ ID NO: 35473
  chr14:92040467-92040883
  hyper

SEQ ID NO: 56096 - DNA, 232 bp, Homo sapiens
  chr14:92789280-92789512
  hyper
ggtaaaggaagggctcgttgcagctccatatggaagaaaggagagaaaaagggagaaggaaggggattatattggtcagtagaggtccaactactgaagagaagagtgcacgggggagtgcgccctacgggacgagtacacgtgctgggaagggcggggggtgagaggcgggcaggaggggaggagtagggaggcgagagcagcgggcgggaggcgccacggcctctcagac

SEQ ID NO: 56097 - DNA, 280 bp, Homo sapiens
  chr14:92789542-92789822
  hyper
aaagttcccggggagagctcgcccctgggagggccgacgtcgagcctgctcgccgcgagggtctcaggtaccgcgcgtccagccagccttcccgcggcgcgcactcggccgcccgggctcggctcgtcgggaagcaggggaacatcgccggctggcagccggggcggccgccgccaaacttggaggaggaggatgctgcgagtgggcgcggcggcgcggggcgcgggggcgcactgagtgctccctacggcgctgctgccagggctgtggccgggcgagc

SEQ ID NO: 56098 - DNA, 201 bp, Homo sapiens; identical to SEQ ID NO: 21935
  chr14:92790436-92790637
  hyper

SEQ ID NO: 56099 - DNA, 91 bp, Homo sapiens
  chr14:92790703-92790794
  hyper
tgcgtctcgcccctgccctggttcaaaggggtcccctgggtgccctgaggtgtttgttcttcccaaaccctaaaggcgttggggcagtctg

SEQ ID NO: 56100 - DNA, 306 bp, Homo sapiens
  chr14:92979611-92979917
  hyper
gcatccaagaggaggcggcgtgcacatctgtcaggaatgtggaggaggcgccctggctctggtctgaggttgcccttgaacgatttcgaggctccctcgggcaaggctgtggctccgagtgggacgaactccccgccagctctgggcctccccacctgccggcccgcggtcggcgccggcacaggcggagggcgtcttccttcccctgcggccccaagccaagtggaagacttttctctaagtttccctctccgaagccccgcgggcctcccgcgccccagccccagccacagcctgtggaggcgg

SEQ ID NO: 56101 - DNA, 779 bp, Homo sapiens
  chr14:92979991-92980770
  hyper
ggccgcccgggcctccgtgtgccccagggggctccgggccgcgagccgctgccgaatggcttttgacaaaaaaacccttgaccaccaaggccagcctcttcctgaaagccccgctcgctccgatacaggaagtagaagggagcgagagccccagagcgcggcggcagcggcggcctggcccttccagagggccagagccagggacatgcgggcgcccgggactccgcgttccgcgcggcccggcgcctgagcgcctccgttccccgtcccggagctgccggcggcatgatccgacacgccggggcgcccgcgcgcggggaccccacggggtaagtccgggcggccgccccctcctccctcgcgatccccacggcccgcgtcctggccgccccactccacttcttgtcccagagagtccttcgggcgcgtgacctcggggttgtcgggctgatacgggacccccaccgtggccgaggccagaacctggttctgcggggcagggggcggccctggtgactccgctggacccgatgttggctaaactttcaaggccaggcatttcactgggaacccagtgcacactttaggctgctggtggacggattacgagggagtgcgtcgctacctgtcagcgccggggctgcccgcgtggacgcggccccctccctggcgtctgccccgcctgaactttgcaaacaaaactcgcggtcccagccccgccagcctgctgcacccgctgctctgcgagtcgcagcgcgcgccctcgggtactagagccc

SEQ ID NO: 56102 - DNA, 62 bp, Homo sapiens; identical to SEQ ID NO: 35478
  chr14:93389271-93389333
  hyper

SEQ ID NO: 56103 - DNA, 160 bp, Homo sapiens
  chr14:93389776-93389936
  hyper
agagggttccgggcgcccctgcccaccttgaggtccgggcaccgcgcggcgccccgcacccctccacacttcccttcgggcgcggcgagttttcagcaccgcggacagcgcctccgcctcccgcctgaccctgcagtgtggcctccgcctgggacccaca

SEQ ID NO: 56104 - DNA, 269 bp, Homo sapiens; identical to SEQ ID NO: 35481
  chr14:93897179-93897448
  hyper

SEQ ID NO: 56105 - DNA, 30 bp, Homo sapiens; identical to SEQ ID NO: 35482
  chr14:94226381-94226411
  hyper

SEQ ID NO: 56106 - DNA, 95 bp, Homo sapiens
  chr14:94254294-94254389
  hyper
acatccccagagccccgcgtgtacactttagctccgcgcacagctccagaatactgcgtgcataccttggccccatggacacctccagaaacagc

SEQ ID NO: 56107 - DNA, 466 bp, Homo sapiens
  chr14:94254513-94254979
  hyper
atccccgtgcacacccaccgactcctgcctgcaccctcgctgaccctgcatgcacggccccaagaaatctcacgctgcctgcacccacactgcccagccggcctcattgcgcacactgcaacataggcacctccgtgcgctgcccctttgcacgcctccgcccagccccgatctcccgctcccgggcgtgggttcccccacgcctccatctccgcccgcacccttccaacgcctcacgctaccttgcctggcggcggccccagccgaccctgggctcggggaaaagaggtccgcgttccccccgcggcagctctgtttcccagcagccggacagcccccatttaaagccagccgcctccccagtcccccgccctctaggcggggcctccgtcctcaccttggcggctgcgcgggcgcccgggggcttcacatgccggggaggagcgcccggcgctggagcaaaagt

SEQ ID NO: 56108 - DNA, 7 bp, Homo sapiens
  chr14:94255277-94255284
  hyper
accctca

SEQ ID NO: 56109 - DNA, 59 bp, Homo sapiens; identical to SEQ ID NO: 35486
  chr14:94255304-94255363
  hyper

SEQ ID NO: 56110 - DNA, 23 bp, Homo sapiens
  chr14:94255584-94255607
  hyper
cccccaagcctctcccgaggctg

SEQ ID NO: 56111 - DNA, 46 bp, Homo sapiens; identical to SEQ ID NO: 12016
  chr14:94255669-94255715
  hyper

SEQ ID NO: 56112 - DNA, 74 bp, Homo sapiens
  chr14:94405660-94405734
  hyper
ataggcgtcgatgttcgcgccgtggtccagcagcagctgcattgtgcgcaggcagccgtggcggatggccacga

SEQ ID NO: 56113 - DNA, 243 bp, Homo sapiens
  chr14:94405785-94406028
  hyper
gctcggtggcgtacacgttgttgttgaccaccgcgaagtacagcgcggagctgcgccggtcttcgtagaggcgcgcgcgctcgggggccagcggcgtgttcacgtcgaagcgcgcgctcagcagcgcctccagcacctcgtcgtggttgcgctcggccgccaggtgcagcggactgacgccgctacggcgtatgcgcgtgcggctggtcaccggcagcagcatctgcacgatcctgccgggtc

SEQ ID NO: 56114 - DNA, 85 bp, Homo sapiens; identical to SEQ ID NO: 35490
  chr14:94641576-94641661
  hyper

SEQ ID NO: 56115 - DNA, 66 bp, Homo sapiens; identical to SEQ ID NO: 35491
  chr14:95233491-95233557
  hyper

SEQ ID NO: 56116 - DNA, 30 bp, Homo sapiens; identical to SEQ ID NO: 35492
  chr14:95234025-95234055
  hyper

SEQ ID NO: 56117 - DNA, 94 bp, Homo sapiens
  chr14:95234549-95234643
  hyper
gtggcccgtctacatcgccatcactttattgtactgtcacccttaatttaactataaatactacggtgggggctagtcgcgggcggcctcgggc

SEQ ID NO: 56118 - DNA, 14 bp, Homo sapiens
  chr14:95235369-95235383
  hyper
ctggaagaggttct

SEQ ID NO: 56119 - DNA, 182 bp, Homo sapiens; identical to SEQ ID NO: 35495
  chr14:95235513-95235695
  hyper

SEQ ID NO: 56120 - DNA, 395 bp, Homo sapiens
  chr14:95236111-95236506
  hyper
tgtagccgaggcgggagccgctgaccgcggccgggaggcccgcgccgccgggggccacggggcgcgggtagaaggcgccatagtccgaggaggcgccgccgctggcgccgtagagcgagtccccgtgcagggccgggaagacgacgggagccgccgcgctgtgcgccaccggcaacaccgagtccttgcagcgcggccgggcggctaggatgttgtcgatgctgaacatgctggcgggcatccccgagccccgcgtcgggaccggggggcggcgggaacgcgccgaggacagagccttaaagtgggggggtccactctcctccagccgccgaccaaaccgaaagagagcgccggcgagcgcgcagccctgcgcccctccccgccccctgcgtccg

SEQ ID NO: 56121 - DNA, 125 bp, Homo sapiens; identical to SEQ ID NO: 35497
  chr14:95237011-95237136
  hyper

SEQ ID NO: 56122 - DNA, 55 bp, Homo sapiens; identical to SEQ ID NO: 35498
  chr14:95237867-95237922
  hyper

SEQ ID NO: 56123 - DNA, 59 bp, Homo sapiens
  chr14:95239633-95239692
  hyper
gggaggaccgcgagcgtccagaggcagccggcgagcgcttaggtcggaaatgcagtaaa

SEQ ID NO: 56124 - DNA, 30 bp, Homo sapiens; identical to SEQ ID NO: 12023
  chr14:95240484-95240514
  hyper

SEQ ID NO: 56125 - DNA, 29 bp, Homo sapiens
  chr14:96342281-96342310
  hyper
gcccaaagccacattcgccacgctcccgc

SEQ ID NO: 56126 - DNA, 26 bp, Homo sapiens
  chr14:96342605-96342631
  hyper
cgcagcgcgcgtcagcgggggctccc

SEQ ID NO: 56127 - DNA, 18 bp, Homo sapiens
  chr14:96342879-96342897
  hyper
cgcactgctgtgcttgcg

SEQ ID NO: 56128 - DNA, 110 bp, Homo sapiens
  chr14:96343133-96343243
  hyper
gggtgcagctctgcgcgttctcatgctgtctctctctctttccctccgcgctgcctctccgaggtcctcccgccgagccccggcgcggggcatgaggagcccccgggtgc

SEQ ID NO: 56129 - DNA, 85 bp, Homo sapiens
  chr14:96343319-96343404
  hyper
cgcccggcggccagccctatccggcggcggccagcgggtcaacgctgcccgggagaatgaggcaggagccggcggcagcctcctt

SEQ ID NO: 56130 - DNA, 2 bp, Homo sapiens
  chr14:96343433-96343435
  hyper
cc

SEQ ID NO: 56131 - DNA, 84 bp, Homo sapiens; identical to SEQ ID NO: 21956
  chr14:96343701-96343785
  hyper

SEQ ID NO: 56132 - DNA, 173 bp, Homo sapiens; identical to SEQ ID NO: 35506
  chr14:96505338-96505511
  hyper

SEQ ID NO: 56133 - DNA, 153 bp, Homo sapiens; identical to SEQ ID NO: 35507
  chr14:96505900-96506053
  hyper

SEQ ID NO: 56134 - DNA, 30 bp, Homo sapiens; identical to SEQ ID NO: 35508
  chr14:96506466-96506496
  hyper

SEQ ID NO: 56135 - DNA, 17 bp, Homo sapiens
  chr14:97059083-97059100
  hyper
cgcgccccagggcccag

SEQ ID NO: 56136 - DNA, 183 bp, Homo sapiens
  chr14:97499315-97499498
  hyper
gatgtggggtctgctcccagagcgcgcgcgctgtggctcttggaaggtggggctctgaggaccggggtcctgcgtgcatagacctggagcccaccttaaagacgctgcttcagggacgcttcaacaagccccaacccacccaactgcgtggcgctccccgcctttgggcgccctgttagggtt

SEQ ID NO: 56137 - DNA, 83 bp, Homo sapiens
  chr14:97684961-97685044
  hyper
gaagggccccagtgacgactggattcggaattttcctctcacttcgtggtagtgaagaatttaactacaacagtaacaacact

SEQ ID NO: 56138 - DNA, 9 bp, Homo sapiens
  chr14:97685288-97685297
  hyper
ttcccaggc

SEQ ID NO: 56139 - DNA, 312 bp, Homo sapiens
  chr14:97685395-97685707
  hyper
cgctccggccagctgcccgggaagcgcccaagcacacgtcccgagtcccagattggattaagttgcccaactacctactttttctctctttaaggagaagcctaattggagaagattcggttttcttcgccatggcaggtccctttctcctgacccgcagttgcaggggctgagggtaggcgcaggtccgccctggggtcgaagccaccatcgggcctcgaggttgcccccctaacatccggcctgcacgcctggcgggggcgcaacagtgtctcacggctcgggagctcgtttttggcttctgagcaaggt

SEQ ID NO: 56140 - DNA, 81 bp, Homo sapiens
  chr14:99584664-99584745
  hyper
agcgttcccggcccaccgcaccatattgtgcaaggcgcgggctgaaggaaacagcgtcccgtgtcgcgcagtgtttgtttg

SEQ ID NO: 56141 - DNA, 30 bp, Homo sapiens; identical to SEQ ID NO: 35515
  chr14:99713234-99713264
  hyper

SEQ ID NO: 56142 - DNA, 6 bp, Homo sapiens
  chr14:99736183-99736189
  hyper
ccagag

SEQ ID NO: 56143 - DNA, 30 bp, Homo sapiens; identical to SEQ ID NO: 35517
  chr14:99736401-99736431
  hyper

SEQ ID NO: 56144 - DNA, 30 bp, Homo sapiens; identical to SEQ ID NO: 35518
  chr14:99736980-99737010
  hyper

SEQ ID NO: 56145 - DNA, 58 bp, Homo sapiens; identical to SEQ ID NO: 35519
  chr14:99738350-99738408
  hyper

SEQ ID NO: 56146 - DNA, 70 bp, Homo sapiens; identical to SEQ ID NO: 35520
  chr14:99739091-99739161
  hyper

SEQ ID NO: 56147 - DNA, 169 bp, Homo sapiens; identical to SEQ ID NO: 35521
  chr14:99739709-99739878
  hyper

SEQ ID NO: 56148 - DNA, 175 bp, Homo sapiens; identical to SEQ ID NO: 35522
  chr14:99740538-99740713
  hyper

SEQ ID NO: 56149 - DNA, 49 bp, Homo sapiens; identical to SEQ ID NO: 35523
  chr14:100111198-100111247
  hyper

SEQ ID NO: 56150 - DNA, 54 bp, Homo sapiens; identical to SEQ ID NO: 35524
  chr14:100111503-100111557
  hyper

SEQ ID NO: 56151 - DNA, 155 bp, Homo sapiens; identical to SEQ ID NO: 35525
  chr14:100111764-100111919
  hyper

SEQ ID NO: 56152 - DNA, 363 bp, Homo sapiens; identical to SEQ ID NO: 35526
  chr14:100125656-100126019
  hyper

SEQ ID NO: 56153 - DNA, 236 bp, Homo sapiens; identical to SEQ ID NO: 35527
  chr14:100260026-100260262
  hyper

SEQ ID NO: 56154 - DNA, 329 bp, Homo sapiens
  chr14:100437465-100437794
  hyper
gacctcgacggccctcggatcagggatgccccgagtccgagcgggcagggtgctcagcagggccaggtgatgggaatcatggggccatcgagcacggaccctggctcccccggtggcctctgtgagctctggggtcaggcggggactggaggagcgtccgcgccgggagggagcgcaccgcgccacgtgcccgcccggcgccccgcccccaccccggccacgcccctcgcgcttccctcaaagccccgcccctcagccccgccactctcgtccgccccgcccctcgcagcctcaagctcagcgctcccggaggcgcggacggtggggcc

SEQ ID NO: 56155 - DNA, 204 bp, Homo sapiens; identical to SEQ ID NO: 35529
  chr14:100438017-100438221
  hyper

SEQ ID NO: 56156 - DNA, 483 bp, Homo sapiens
  chr14:100438222-100438705
  hyper
cccacccggagaagatgagcccccgctgccccccgcagcccagtcagacgcggagccgccgcgcccggggccggctcccccgctagcgcccgcgtcccgcgccccgccgccgccgccgccgccgccgggtcgcccctggcccggcgcgcccgtccccggcagcgacaatgaggtgagtcggggccggcgcctcgtgggaggtggcagcggccagcgtcggaggggctgggctgggggcccgcggtgcccccgagggcgggaggggggctccacgggcgcgggggcttccagagaaccgcgggggctctgcagagattcgggggcattcagagcgcgggaatggcttcgcgagagccgtgggggcgtctggagagccgggagggtctgcagggcttgtggggggcagtgttctgcaaggggcaggcggcgctggctttggctgcttgtggggtcctcttaggctccggggggcctgcggcggcc

SEQ ID NO: 56157 - DNA, 160 bp, Homo sapiens
  chr14:100438811-100438971
  hyper
tgaagcccccaggcgttgccgaagcctccccctgccagcgcccagagccgcgtttgggcttttacaggtgtagtttcccctcgacttggagcccgtcaaccccttcgtctcctaattctcaaccccccttttttttcttcttgcacgccagtaaagtgca

SEQ ID NO: 56158 - DNA, 270 bp, Homo sapiens; identical to SEQ ID NO: 35531
  chr14:101033483-101033753
  hyper

SEQ ID NO: 56159 - DNA, 175 bp, Homo sapiens; identical to SEQ ID NO: 35532
  chr14:101033978-101034153
  hyper

SEQ ID NO: 56160 - DNA, 601 bp, Homo sapiens; identical to SEQ ID NO: 35533
  chr14:101034879-101035480
  hyper

SEQ ID NO: 56161 - DNA, 177 bp, Homo sapiens; identical to SEQ ID NO: 35534
  chr14:101193397-101193574
  hyper

SEQ ID NO: 56162 - DNA, 40 bp, Homo sapiens; identical to SEQ ID NO: 21972
  chr14:101543828-101543868
  hyper

SEQ ID NO: 56163 - DNA, 18 bp, Homo sapiens
  chr14:101923096-101923114
  hyper
gttactatattaaagcgc

SEQ ID NO: 56164 - DNA, 17 bp, Homo sapiens
  chr14:101923250-101923267
  hyper
cgcgccgttgtgagtcc

SEQ ID NO: 56165 - DNA, 79 bp, Homo sapiens
  chr14:101923521-101923600
  hyper
aagaggagagaaaggcgaggcacagtgggtgcgcaaagaaaaagaggttctcagcggagcgtgtgtgaggcggggggtt

SEQ ID NO: 56166 - DNA, 35 bp, Homo sapiens
  chr14:101924047-101924082
  hyper
tccccgacgcgcctggagcccgggagggaggcgcg

SEQ ID NO: 56167 - DNA, 15 bp, Homo sapiens
  chr14:101924423-101924438
  hyper
gaggccatcaaaggc

SEQ ID NO: 56168 - DNA, 33 bp, Homo sapiens; identical to SEQ ID NO: 35540
  chr14:101924457-101924490
  hyper

SEQ ID NO: 56169 - DNA, 191 bp, Homo sapiens; identical to SEQ ID NO: 21977
  chr14:101924858-101925049
  hyper

SEQ ID NO: 56170 - DNA, 91 bp, Homo sapiens
  chr14:101925901-101925992
  hyper
acccaggaaggacgcccgccgttcccagcaccccagcgtctgaaaaatgaatgtgaactccgcaagcgtgctcccgcggacattttacatg

SEQ ID NO: 56171 - DNA, 166 bp, Homo sapiens
  chr14:102026194-102026360
  hyper
ggggcggcaggcgcacgggacgctggcggcggcggcggcttccgacttgggctcagaccccgccgctccagacaagtccccgcgactgcgacagtgtctcgggcagttcagctccccagacgggagacagaccctcgcgacctggttcaggccttgccctggggga

SEQ ID NO: 56172 - DNA, 41 bp, Homo sapiens
  chr14:102026967-102027008
  hyper
gcacctctcagcccggccccggcggccgctgacccaggaac

SEQ ID NO: 56173 - DNA, 391 bp, Homo sapiens; identical to SEQ ID NO: 35546
  chr14:102029904-102030295
  hyper

SEQ ID NO: 56174 - DNA, 256 bp, Homo sapiens; identical to SEQ ID NO: 35547
  chr14:102030653-102030909
  hyper

SEQ ID NO: 56175 - DNA, 120 bp, Homo sapiens; identical to SEQ ID NO: 21982
  chr14:102247792-102247912
  hyper

SEQ ID NO: 56176 - DNA, 49 bp, Homo sapiens; identical to SEQ ID NO: 21983
  chr14:103021342-103021391
  hyper

SEQ ID NO: 56177 - DNA, 116 bp, Homo sapiens
  chr14:103022003-103022119
  hyper
agcttctctggaagacctggtgctggtccgctctcccgggacctcattttccttatgtggacaacgggggcggggtcacagcagcccctcgggcttatagccgggttgttctttcc

SEQ ID NO: 56178 - DNA, 81 bp, Homo sapiens; identical to SEQ ID NO: 35551
  chr14:103389208-103389289
  hyper

SEQ ID NO: 56179 - DNA, 225 bp, Homo sapiens; identical to SEQ ID NO: 35552
  chr14:103389663-103389888
  hyper

SEQ ID NO: 56180 - DNA, 30 bp, Homo sapiens; identical to SEQ ID NO: 35553
  chr14:103390143-103390173
  hyper

SEQ ID NO: 56181 - DNA, 201 bp, Homo sapiens
  chr14:103394683-103394884
  hyper
ccaggggactgggggcggggtgggcgcggagcaggcccggacccccgcgtggcgccgcctcagcccgtgtctcttgcagctcctgccgctggatggggaactcgtcctggcttcaggagccggattcggcgtctcagacgtgggctcgcacctggactgtggcgcgggtgaggcggtcgggcaggggcggggctctggaaa

SEQ ID NO: 56182 - DNA, 281 bp, Homo sapiens
  chr14:103395101-103395382
  hyper
tgccgtcttccgcgactctgaccgcttctcctggcatgacccgcacctgtggcgctctggggacgaggcacctggcctcttcttcgtggacgccgagcgcgtgccctgccgccacgacgacgtcttctttccgcctagtgcctccttccgcgtggggctcggccctggcgctagccccgtgcgtgtccgcagcatctcggctctgggccgggtgagcactgaggggagggaggctcgggtcccctctccccacctcggcccgaccccgcccctcctggtct

SEQ ID NO: 56183 - DNA, 92 bp, Homo sapiens; identical to SEQ ID NO: 12062
  chr14:103550468-103550560
  hyper

SEQ ID NO: 56184 - DNA, 45 bp, Homo sapiens; identical to SEQ ID NO: 21989
  chr14:103655601-103655646
  hyper

SEQ ID NO: 56185 - DNA, 32 bp, Homo sapiens; identical to SEQ ID NO: 35558
  chr14:103673859-103673891
  hyper

SEQ ID NO: 56186 - DNA, 30 bp, Homo sapiens; identical to SEQ ID NO: 35559
  chr14:103686765-103686795
  hyper

SEQ ID NO: 56187 - DNA, 170 bp, Homo sapiens
  chr14:103687219-103687389
  hyper
ccctggaggtcgtggctggaagcgaggccgcgggggtccaggagcgctcatcggggcgccagatgcagcctgcgggacgtccagtgcccgcgcaggggccgggcgaggccgtggcctccaggcaacgcgcagccgcgttggcgcgagttttaaatcggtgccttcccagc

SEQ ID NO: 56188 - DNA, 44 bp, Homo sapiens
  chr14:103739923-103739967
  hyper
ctgggttgagcggggcggatctgggactccgaggcttcctacgt

SEQ ID NO: 56189 - DNA, 208 bp, Homo sapiens
  chr14:103740150-103740358
  hyper
gggggttgagagaaagatgatcaggtgggttggagaaaggagacgcttcccgctgggcgagtgagcccaggacgcggcagaagagggcagaccctaggggaccgccgcgtccccaggcgcgcacgcgacccctccccgcgccgaaaatcctctccccgcctcagtctccccgcctccgcctccccacccatagtgtcactccgaccct

SEQ ID NO: 56190 - DNA, 7 bp, Homo sapiens
  chr14:103740430-103740437
  hyper
agtgcac

SEQ ID NO: 56191 - DNA, 72 bp, Homo sapiens; identical to SEQ ID NO: 35562
  chr14:103740539-103740611
  hyper

SEQ ID NO: 56192 - DNA, 35 bp, Homo sapiens; identical to SEQ ID NO: 35563
  chr14:103745329-103745364
  hyper

SEQ ID NO: 56193 - DNA, 122 bp, Homo sapiens
  chr14:103745577-103745699
  hyper
gagtgggcaggaccacgctggacacgcagttcgcgtgcggccgctccccgagcagtgcgcggcgtgggcggaggagcggctccgcgaggagatcgaggcgaacgcggcgcccgcgttgctgg

SEQ ID NO: 56194 - DNA, 39 bp, Homo sapiens
  chr14:103745750-103745789
  hyper
acatccgccacggcgacggctccgcggtgctcccgggcg

SEQ ID NO: 56195 - DNA, 300 bp, Homo sapiens; identical to SEQ ID NO: 35565
  chr14:103989154-103989454
  hyper

SEQ ID NO: 56196 - DNA, 41 bp, Homo sapiens
  chr14:104601832-104601873
  hyper
gggcagggtccctgacacttccttaactcccaaagaccttc

SEQ ID NO: 56197 - DNA, 70 bp, Homo sapiens
  chr14:104601963-104602033
  hyper
cgaggctggggcagcccacaggaggagcgcgggacccgggcttgagtttgcacccaggcagagcgcccac

SEQ ID NO: 56198 - DNA, 40 bp, Homo sapiens
  chr14:104602063-104602103
  hyper
aagtcgtcgtgcccggcagccagcccgaatcttccagccc

SEQ ID NO: 56199 - DNA, 466 bp, Homo sapiens; identical to SEQ ID NO: 35568
  chr14:104602310-104602776
  hyper

SEQ ID NO: 56200 - DNA, 267 bp, Homo sapiens; identical to SEQ ID NO: 35569
  chr14:104603085-104603352
  hyper

SEQ ID NO: 56201 - DNA, 488 bp, Homo sapiens; identical to SEQ ID NO: 35570
  chr14:104604185-104604673
  hyper

SEQ ID NO: 56202 - DNA, 148 bp, Homo sapiens
  chr14:104604884-104605032
  hyper
cccgagcgcgcccaccggagccaccgcgctcctcgcgacactcgcaggctctgcgaacttccgagcggctgggccgggccatgggggcgcctcggggccggatcacgtagccgcggcgcccccggagagccagcgtggccgggagcgc

SEQ ID NO: 56203 - DNA, 156 bp, Homo sapiens; identical to SEQ ID NO: 21998
  chr14:104605114-104605270
  hyper

SEQ ID NO: 56204 - DNA, 244 bp, Homo sapiens; identical to SEQ ID NO: 35572
  chr14:105070950-105071194
  hyper

SEQ ID NO: 56205 - DNA, 30 bp, Homo sapiens; identical to SEQ ID NO: 35573
  chr14:105292388-105292418
  hyper

SEQ ID NO: 56206 - DNA, 437 bp, Homo sapiens; identical to SEQ ID NO: 35574
  chr14:105310006-105310443
  hyper

SEQ ID NO: 56207 - DNA, 349 bp, Homo sapiens; identical to SEQ ID NO: 35575
  chr14:105310485-105310834
  hyper

SEQ ID NO: 56208 - DNA, 220 bp, Homo sapiens; identical to SEQ ID NO: 35576
  chr14:105433940-105434160
  hyper

SEQ ID NO: 56209 - DNA, 19 bp, Homo sapiens
  chr14:105434286-105434305
  hyper
cgcccggcctccggttctc

SEQ ID NO: 56210 - DNA, 23 bp, Homo sapiens
  chr14:105512040-105512063
  hyper
atgtgcaaaatgttccgcctgcg

SEQ ID NO: 56211 - DNA, 81 bp, Homo sapiens
  chr14:105714334-105714415
  hyper
gctccagggctgcaggcccagggccagatcctgacttgcccacccgccggctgtgtgaccttcagcgcgcgactaacctct

SEQ ID NO: 56212 - DNA, 67 bp, Homo sapiens
  chr15:23158330-23158397
  hyper
cgccgggcgggtcaccgcaccccgagatgtgcccccaaggctctttcgaccgccgtgaagtggcggg

SEQ ID NO: 56213 - DNA, 38 bp, Homo sapiens; identical to SEQ ID NO: 22004
  chr15:23158489-23158527
  hyper

SEQ ID NO: 56214 - DNA, 32 bp, Homo sapiens; identical to SEQ ID NO: 35581
  chr15:25915272-25915304
  hyper

SEQ ID NO: 56215 - DNA, 31 bp, Homo sapiens
  chr15:26107609-26107640
  hyper
acagagaggccttggcggcgctgtggcttcg

SEQ ID NO: 56216 - DNA, 236 bp, Homo sapiens; identical to SEQ ID NO: 22005
  chr15:26107860-26108096
  hyper

SEQ ID NO: 56217 - DNA, 130 bp, Homo sapiens
  chr15:26108701-26108831
  hyper
gagagaggaaaccgcgaagcgcgagaaaaggcgcccccgtccccaagcagcccgcgcgcccttccaggggccagacctgctccatcctggacggcgaaacgacctcgggagaccccggttaggaccttac

SEQ ID NO: 56218 - DNA, 23 bp, Homo sapiens
  chr15:26327541-26327564
  hyper
ccctgtctgcgcctgcgcctgcg

SEQ ID NO: 56219 - DNA, 299 bp, Homo sapiens; identical to SEQ ID NO: 35586
  chr15:26327610-26327909
  hyper

SEQ ID NO: 56220 - DNA, 30 bp, Homo sapiens; identical to SEQ ID NO: 12083
  chr15:27016662-27016692
  hyper

SEQ ID NO: 56221 - DNA, 161 bp, Homo sapiens; identical to SEQ ID NO: 35588
  chr15:27017654-27017815
  hyper

SEQ ID NO: 56222 - DNA, 45 bp, Homo sapiens; identical to SEQ ID NO: 35589
  chr15:27018284-27018329
  hyper

SEQ ID NO: 56223 - DNA, 63 bp, Homo sapiens; identical to SEQ ID NO: 35590
  chr15:27018746-27018809
  hyper

SEQ ID NO: 56224 - DNA, 146 bp, Homo sapiens; identical to SEQ ID NO: 35591
  chr15:27111977-27112123
  hyper

SEQ ID NO: 56225 - DNA, 17 bp, Homo sapiens
  chr15:27113012-27113029
  hyper
cgcgctcccagcccagg

SEQ ID NO: 56226 - DNA, 140 bp, Homo sapiens; identical to SEQ ID NO: 35593
  chr15:27113477-27113617
  hyper

SEQ ID NO: 56227 - DNA, 16 bp, Homo sapiens
  chr15:27213172-27213188
  hyper
tcggttgtgagaaccg

SEQ ID NO: 56228 - DNA, 177 bp, Homo sapiens; identical to SEQ ID NO: 35595
  chr15:27216067-27216244
  hyper

SEQ ID NO: 56229 - DNA, 39 bp, Homo sapiens; identical to SEQ ID NO: 35596
  chr15:27216830-27216869
  hyper

SEQ ID NO: 56230 - DNA, 30 bp, Homo sapiens; identical to SEQ ID NO: 35597
  chr15:27603952-27603982
  hyper

SEQ ID NO: 56231 - DNA, 42 bp, Homo sapiens; identical to SEQ ID NO: 35598
  chr15:28339778-28339820
  hyper

SEQ ID NO: 56232 - DNA, 279 bp, Homo sapiens; identical to SEQ ID NO: 35599
  chr15:28340309-28340588
  hyper

SEQ ID NO: 56233 - DNA, 55 bp, Homo sapiens
  chr15:28341644-28341699
  hyper
aggcctgaagaagcccgtccaggggtcagcctcctcctcagccggtcctgggctg

SEQ ID NO: 56234 - DNA, 40 bp, Homo sapiens; identical to SEQ ID NO: 35602
  chr15:28342521-28342561
  hyper

SEQ ID NO: 56235 - DNA, 39 bp, Homo sapiens
  chr15:28344134-28344173
  hyper
cgcctggcagagagccggagggggtgctcagggggcagc

SEQ ID NO: 56236 - DNA, 9 bp, Homo sapiens
  chr15:28344287-28344296
  hyper
tgtgtaaac

SEQ ID NO: 56237 - DNA, 78 bp, Homo sapiens; identical to SEQ ID NO: 35605
  chr15:28344614-28344692
  hyper

SEQ ID NO: 56238 - DNA, 340 bp, Homo sapiens; identical to SEQ ID NO: 35606
  chr15:28351758-28352098
  hyper

SEQ ID NO: 56239 - DNA, 22 bp, Homo sapiens
  chr15:28352099-28352121
  hyper
ggctctggccccacggtgagcc

SEQ ID NO: 56240 - DNA, 88 bp, Homo sapiens; identical to SEQ ID NO: 22018
  chr15:28352152-28352240
  hyper

SEQ ID NO: 56241 - DNA, 43 bp, Homo sapiens; identical to SEQ ID NO: 35609
  chr15:28352957-28353000
  hyper

SEQ ID NO: 56242 - DNA, 48 bp, Homo sapiens
  chr15:29077236-29077284
  hyper
tgagaaactgacttccgtaggagtgcgggtgtgcgtgcgtgccgcgga

SEQ ID NO: 56243 - DNA, 11 bp, Homo sapiens
  chr15:29077383-29077394
  hyper
gagcggcgaag

SEQ ID NO: 56244 - DNA, 196 bp, Homo sapiens; identical to SEQ ID NO: 35611
  chr15:29077428-29077624
  hyper

SEQ ID NO: 56245 - DNA, 51 bp, Homo sapiens; identical to SEQ ID NO: 35612
  chr15:29077646-29077697
  hyper

SEQ ID NO: 56246 - DNA, 79 bp, Homo sapiens
  chr15:29130728-29130807
  hyper
gccgagcaagcagggcgcggcggccggggcaaggtgcggagcctcgcgttcaccggctctacctgcggagcctcgcgtt

SEQ ID NO: 56247 - DNA, 32 bp, Homo sapiens; identical to SEQ ID NO: 22023
  chr15:29131875-29131907
  hyper

SEQ ID NO: 56248 - DNA, 174 bp, Homo sapiens; identical to SEQ ID NO: 35616
  chr15:29407300-29407474
  hyper

SEQ ID NO: 56249 - DNA, 6 bp, Homo sapiens
  chr15:29407771-29407777
  hyper
gaggca

SEQ ID NO: 56250 - DNA, 30 bp, Homo sapiens; identical to SEQ ID NO: 35619
  chr15:29561245-29561275
  hyper

SEQ ID NO: 56251 - DNA, 524 bp, Homo sapiens; identical to SEQ ID NO: 35620
  chr15:29861915-29862439
  hyper

SEQ ID NO: 56252 - DNA, 43 bp, Homo sapiens; identical to SEQ ID NO: 35621
  chr15:29863048-29863091
  hyper

SEQ ID NO: 56253 - DNA, 70 bp, Homo sapiens; identical to SEQ ID NO: 35622
  chr15:29863540-29863610
  hyper

SEQ ID NO: 56254 - DNA, 90 bp, Homo sapiens; identical to SEQ ID NO: 12105
  chr15:30260547-30260637
  hyper

SEQ ID NO: 56255 - DNA, 331 bp, Homo sapiens; identical to SEQ ID NO: 35624
  chr15:30260871-30261202
  hyper

SEQ ID NO: 56256 - DNA, 181 bp, Homo sapiens; identical to SEQ ID NO: 35625
  chr15:31775293-31775474
  hyper

SEQ ID NO: 56257 - DNA, 113 bp, Homo sapiens; identical to SEQ ID NO: 22030
  chr15:31775483-31775596
  hyper

SEQ ID NO: 56258 - DNA, 2 bp, Homo sapiens
  chr15:31776145-31776147
  hyper
gg

SEQ ID NO: 56259 - DNA, 67 bp, Homo sapiens; identical to SEQ ID NO: 35629
  chr15:32162215-32162282
  hyper

SEQ ID NO: 56260 - DNA, 130 bp, Homo sapiens; identical to SEQ ID NO: 35630
  chr15:32322366-32322496
  hyper

SEQ ID NO: 56261 - DNA, 114 bp, Homo sapiens
  chr15:33009633-33009747
  hyper
gggcgccggggtcagcgccctcgaagttgggggcctcgggcggggccgccggggagccacgacggccgctcgaccagagcatcccgcagtcccgttccctccagaggggaagaa

SEQ ID NO: 56262 - DNA, 21 bp, Homo sapiens
  chr15:33011348-33011369
  hyper
agcttgcggagcaaggccata

SEQ ID NO: 56263 - DNA, 38 bp, Homo sapiens
  chr15:33011633-33011671
  hyper
ctaatgcattcccgggtcgaatccgtctactgccttcc

SEQ ID NO: 56264 - DNA, 30 bp, Homo sapiens; identical to SEQ ID NO: 35637
  chr15:33486950-33486980
  hyper

SEQ ID NO: 56265 - DNA, 308 bp, Homo sapiens
  chr15:33602886-33603194
  hyper
cgcgccagcccagggcccccgcaccgcccccgccagctcgacgcgcccagcgttgcgctctccacggagcgggcggccgcagcgcacttggctggggcgagaggcgagaggggtgggcggactgcttggttggcgttggcgctctgcagtgcagtggagtgttagcccagctccctatatggtcggggattagcttggcgctgctgaggctgaggctgagccaggagctggaggaggaggtggaggacgaggacgaaaaggaggaggagaaagagcgcagcagcagtcagcgcacgccgagcggctgc

SEQ ID NO: 56266 - DNA, 128 bp, Homo sapiens; identical to SEQ ID NO: 35639
  chr15:33603647-33603775
  hyper

SEQ ID NO: 56267 - DNA, 627 bp, Homo sapiens
  chr15:34728851-34729478
  hyper
gggcttaccaaggcccgccgcccgacccatggagccctgcttggggaccgggggcctcgatgttctccttcaccatctgcggccagatctccctccagcagccttgccaggcagtgcctggcgtggagaaggggccctgcagaggcgcaggtccgcaccgtgcccccaacccggcgcctgcagcccaggggcaacaaggtgtggggtttttgagtttttccctctgggccttattatacagggaaagggaaggggcgaagatccgggctcgagttctcccagggaagtgaacccagaggcgatcccaaactcagtagttgccgcccggcacggggacttgatgccggcgccaagccgggcagcggaacgcaccagcggcccgaccagcccggcgagacgcgagcgggcggccccgccagacagcgccacttgccggcgccgagagtggcccctcgccgcggtgagcccctcccgggatgcgaaagccatcgcctagtccccgccgcacccgcccgcccatcgtgggaggaggatgggccggtccgagaggcgtaaggccgccgggctgcacccctagatcccagcggcggcctccccgcagccccgccgagtccggggggcagcgct

SEQ ID NO: 56268 - DNA, 41 bp, Homo sapiens
  chr15:34729582-34729623
  hyper
aggttccccagcttacctggccagggcgcggggctgccccg

SEQ ID NO: 56269 - DNA, 89 bp, Homo sapiens; identical to SEQ ID NO: 35641
  chr15:34729954-34730043
  hyper

SEQ ID NO: 56270 - DNA, 169 bp, Homo sapiens
  chr15:34787304-34787473
  hyper
cgttacctggcgccgtcggggcccagcggcacgctcaaggcgggcaaggccaccaaggtgggcaaggacgagctctttgccctggagcagagctgcgcccaggtcgtgctgcaggcggccaacgggaggaatgtgtccacgcgccagggtatggacctgtctgccaatc

SEQ ID NO: 56271 - DNA, 34 bp, Homo sapiens; identical to SEQ ID NO: 12120
  chr15:34806507-34806541
  hyper

SEQ ID NO: 56272 - DNA, 378 bp, Homo sapiens; identical to SEQ ID NO: 35645
  chr15:34806978-34807356
  hyper

SEQ ID NO: 56273 - DNA, 40 bp, Homo sapiens; identical to SEQ ID NO: 35646
  chr15:35014171-35014211
  hyper

SEQ ID NO: 56274 - DNA, 16 bp, Homo sapiens
  chr15:35047133-35047149
  hyper
ccggcgcggcagcctg

SEQ ID NO: 56275 - DNA, 424 bp, Homo sapiens; identical to SEQ ID NO: 35648
  chr15:35047293-35047717
  hyper

SEQ ID NO: 56276 - DNA, 12 bp, Homo sapiens
  chr15:35087698-35087710
  hyper
tgactcaccgtc

SEQ ID NO: 56277 - DNA, 30 bp, Homo sapiens; identical to SEQ ID NO: 35650
  chr15:37175266-37175296
  hyper

SEQ ID NO: 56278 - DNA, 55 bp, Homo sapiens; identical to SEQ ID NO: 22040
  chr15:37180743-37180798
  hyper

SEQ ID NO: 56279 - DNA, 44 bp, Homo sapiens; identical to SEQ ID NO: 35652
  chr15:37394668-37394712
  hyper

SEQ ID NO: 56280 - DNA, 59 bp, Homo sapiens; identical to SEQ ID NO: 35655
  chr15:39873175-39873234
  hyper

SEQ ID NO: 56281 - DNA, 30 bp, Homo sapiens; identical to SEQ ID NO: 35656
  chr15:39873453-39873483
  hyper

SEQ ID NO: 56282 - DNA, 58 bp, Homo sapiens
  chr15:40211761-40211819
  hyper
cacccaggagcattccgccggggccatctgaggagggggactcccgcctggatcccgc

SEQ ID NO: 56283 - DNA, 54 bp, Homo sapiens; identical to SEQ ID NO: 22042
  chr15:40212190-40212244
  hyper

SEQ ID NO: 56284 - DNA, 30 bp, Homo sapiens; identical to SEQ ID NO: 35658
  chr15:40212680-40212710
  hyper

SEQ ID NO: 56285 - DNA, 660 bp, Homo sapiens; identical to SEQ ID NO: 35659
  chr15:40544738-40545398
  hyper

SEQ ID NO: 56286 - DNA, 117 bp, Homo sapiens
  chr15:40575513-40575630
  hyper
gagcggttcctcctccgcgctcccctgggaatgcggcggcggttgcggggcgggggcgggggctgctcgccgggggccacatgcacccaaccgggccaatcccaaagtcgcagtctt

SEQ ID NO: 56287 - DNA, 53 bp, Homo sapiens
  chr15:40575744-40575797
  hyper
ggaattgggaccccatgagcgcagaactggaccacgcgcgagctaggggtggc

SEQ ID NO: 56288 - DNA, 156 bp, Homo sapiens; identical to SEQ ID NO: 35661
  chr15:41787106-41787262
  hyper

SEQ ID NO: 56289 - DNA, 145 bp, Homo sapiens
  chr15:41804733-41804878
  hyper
gggtaagggctaactcggtggcgactactgccaccttgaagggcactcaaggtggacctccccgcggaatagtccaagacgcaagtcggtgcgcacgtggacttcgttaccctgagggtgaaacctccaactagcaggtcactgt

SEQ ID NO: 56290 - DNA, 40 bp, Homo sapiens
  chr15:41805772-41805812
  hyper
aaccactgacacctggcctgttgaccggccacccccaagc

SEQ ID NO: 56291 - DNA, 54 bp, Homo sapiens; identical to SEQ ID NO: 35663
  chr15:41877632-41877686
  hyper

SEQ ID NO: 56292 - DNA, 45 bp, Homo sapiens; identical to SEQ ID NO: 35664
  chr15:41913327-41913372
  hyper

SEQ ID NO: 56293 - DNA, 17 bp, Homo sapiens
  chr15:41913733-41913750
  hyper
tccgggacccgcgagcg

SEQ ID NO: 56294 - DNA, 144 bp, Homo sapiens
  chr15:41913807-41913951
  hyper
tgccacgcgctacgcccgtccccacgcgcctggtggcgtgttcttggcgcgaagtgttaagagtctgggtgtttttgtgcgttggggggaaggagagggtggcgggggcgggggggcgctgaggcgtcacgtggacgccacagc

SEQ ID NO: 56295 - DNA, 97 bp, Homo sapiens
  chr15:41952475-41952572
  hyper
ctgctgctctggggccgtttggactcctggtgttgggggaggggtcagggaggtgctgctcgcgtctccttttgcgcctgcgcggcgggctccgagc

SEQ ID NO: 56296 - DNA, 84 bp, Homo sapiens
  chr15:41952711-41952795
  hyper
acgccccgcacggtaactctcgggcctgggtggagggcatcgcttagtactggcccgattggagtttttcgagagtttgaagct

SEQ ID NO: 56297 - DNA, 30 bp, Homo sapiens; identical to SEQ ID NO: 35667
  chr15:42868444-42868474
  hyper

SEQ ID NO: 56298 - DNA, 57 bp, Homo sapiens; identical to SEQ ID NO: 35668
  chr15:43810817-43810874
  hyper

SEQ ID NO: 56299 - DNA, 170 bp, Homo sapiens; identical to SEQ ID NO: 35669
  chr15:44486726-44486896
  hyper

SEQ ID NO: 56300 - DNA, 37 bp, Homo sapiens
  chr15:45403599-45403636
  hyper
cgttctgcccggtggcggggtcgggcgccgcccacat

SEQ ID NO: 56301 - DNA, 52 bp, Homo sapiens
  chr15:45404130-45404182
  hyper
cacgtcggaaagaacatggtagcctgcgggcatggggcgccaatacgtgaca

SEQ ID NO: 56302 - DNA, 42 bp, Homo sapiens; identical to SEQ ID NO: 22052
  chr15:45405117-45405159
  hyper

SEQ ID NO: 56303 - DNA, 67 bp, Homo sapiens; identical to SEQ ID NO: 35674
  chr15:45405416-45405483
  hyper

SEQ ID NO: 56304 - DNA, 239 bp, Homo sapiens; identical to SEQ ID NO: 35675
  chr15:45406627-45406866
  hyper

SEQ ID NO: 56305 - DNA, 28 bp, Homo sapiens
  chr15:45406867-45406895
  hyper
ttccactgctcatcgttattctagtgtt

SEQ ID NO: 56306 - DNA, 246 bp, Homo sapiens
  chr15:45421435-45421681
  hyper
tggggtgcttccagtcactcttcaagtcactcccaaacttctcagactgcacccgaggctctgcggcgccgcctccctctcccggcctggtacagagaagggctgggtgcgccaggacagtagtaccggggtctgccagctccgcagaggtccctccaatcccccctcctcctctgcgcccccccacccatgcccagcaatcccagcagctccagcgcaaacctagcgacgcagttccgggtctgg

SEQ ID NO: 56307 - DNA, 140 bp, Homo sapiens; identical to SEQ ID NO: 35678
  chr15:45421706-45421846
  hyper

SEQ ID NO: 56308 - DNA, 201 bp, Homo sapiens
  chr15:45427410-45427611
  hyper
cggggacgtggtgctgcccttccagagaagccgctgggaccccgagaccggacggagtcccagcaatccccgggacccggtgaggcggggaaggcggcgggaagggaccgcaccccagccaggtgggacctgggcttcgggcctggcagggcctggaggggagaggcgcccactccccagccgcggacacccgccgggccc

SEQ ID NO: 56309 - DNA, 67 bp, Homo sapiens
  chr15:45427786-45427853
  hyper
cttttccccgagactcgcagaaccccctgctcatgtgggcggcgcccgaccccgccaccgggcagaa

SEQ ID NO: 56310 - DNA, 14 bp, Homo sapiens
  chr15:45479446-45479460
  hyper
agagtttggggctt

SEQ ID NO: 56311 - DNA, 59 bp, Homo sapiens; identical to SEQ ID NO: 35682
  chr15:45479774-45479833
  hyper

SEQ ID NO: 56312 - DNA, 247 bp, Homo sapiens
  chr15:47477018-47477265
  hyper
ctgggcgagttggatccgggtcggcagccggctgaaccgccacgctgccccgctttttttattttctttttagatacggcatctaattggtgggtgctgggaggcagggctggttgggtgagcacgagtacctgggtgtagggaacgacctaccttcttgctttccttggggtttagaggggaaggggtgggggcacccagagccccgaagcccggagcgtcccgcgctagcgggcttgcgcgcggc

SEQ ID NO: 56313 - DNA, 158 bp, Homo sapiens; identical to SEQ ID NO: 35686
  chr15:47477354-47477512
  hyper

SEQ ID NO: 56314 - DNA, 146 bp, Homo sapiens; identical to SEQ ID NO: 35687
  chr15:48009524-48009670
  hyper

SEQ ID NO: 56315 - DNA, 81 bp, Homo sapiens; identical to SEQ ID NO: 35688
  chr15:48009881-48009962
  hyper

SEQ ID NO: 56316 - DNA, 740 bp, Homo sapiens; identical to SEQ ID NO: 35689
  chr15:48010082-48010822
  hyper

SEQ ID NO: 56317 - DNA, 49 bp, Homo sapiens; identical to SEQ ID NO: 35690
  chr15:48011314-48011363
  hyper

SEQ ID NO: 56318 - DNA, 143 bp, Homo sapiens; identical to SEQ ID NO: 35691
  chr15:48470373-48470516
  hyper

SEQ ID NO: 56319 - DNA, 72 bp, Homo sapiens; identical to SEQ ID NO: 35692
  chr15:48470517-48470589
  hyper

SEQ ID NO: 56320 - DNA, 225 bp, Homo sapiens; identical to SEQ ID NO: 22061
  chr15:48937987-48938212
  hyper

SEQ ID NO: 56321 - DNA, 80 bp, Homo sapiens
  chr15:48938510-48938590
  hyper
tgccgaccgaggagagggctctgccgcccccacttgccctgggtgtcgagagcccactccagacgcggctcttctgaggc

SEQ ID NO: 56322 - DNA, 67 bp, Homo sapiens
  chr15:51385846-51385913
  hyper
tcagagctgcacaagcgccgggagctgtgggcacgtgaggagggcgagcgggtcctaggtgcgtaga

SEQ ID NO: 56323 - DNA, 39 bp, Homo sapiens
  chr15:51386181-51386220
  hyper
ccttctccgccggctgcgcggcagcgatggaccctgtgc

SEQ ID NO: 56324 - DNA, 414 bp, Homo sapiens; identical to SEQ ID NO: 12151
  chr15:51559380-51559794
  hyper

SEQ ID NO: 56325 - DNA, 86 bp, Homo sapiens
  chr15:51633989-51634075
  hyper
gcgctgtgccagtggcgcgggctgagctcggcgctgcgggctttggaggcgcagcggggccgggagcagcgcgaggacagtgccct

SEQ ID NO: 56326 - DNA, 70 bp, Homo sapiens
  chr15:53075739-53075809
  hyper
cggcctccgaaggccctttcacccaccccacacaagaggaaacaaagacttctcagctcaaggcctcagg

SEQ ID NO: 56327 - DNA, 165 bp, Homo sapiens; identical to SEQ ID NO: 22065
  chr15:53077361-53077526
  hyper

SEQ ID NO: 56328 - DNA, 59 bp, Homo sapiens
  chr15:53078005-53078064
  hyper
ggaatttcctcctgtcgcccttcttccaccagccgctgttatttcgtgaccggaaggcg

SEQ ID NO: 56329 - DNA, 251 bp, Homo sapiens; identical to SEQ ID NO: 35704
  chr15:53078741-53078992
  hyper

SEQ ID NO: 56330 - DNA, 76 bp, Homo sapiens; identical to SEQ ID NO: 22068
  chr15:53079264-53079340
  hyper

SEQ ID NO: 56331 - DNA, 38 bp, Homo sapiens
  chr15:53080299-53080337
  hyper
actgggaccttgggacggtcagcctccctctcctttcc

SEQ ID NO: 56332 - DNA, 2 bp, Homo sapiens
  chr15:53080933-53080935
  hyper
gt

SEQ ID NO: 56333 - DNA, 243 bp, Homo sapiens; identical to SEQ ID NO: 4229
  chr15:53081054-53081297
  hyper

SEQ ID NO: 56334 - DNA, 343 bp, Homo sapiens
  chr15:53081677-53082020
  hyper
gggtggtggtggtgatggtggtggtggtgatggtgggggaacttgtccgagactgtggagatgggaggcagcggctgcagaggggtcaaggtggtgtaggtggtgggcatgctcatacctgggggagtctcgcaggccatggtcatggtgggatgcagggggccggccaggctgtgctcaggggcccggtggtggtggtggtaatctccgccgccgctgccgccgtccagcagggacgccatgcccatggagcgcgggtgcgcggggggcaggtggctgccgcggtgcgccacggagctgcgcgcgtgggggctgccgcccagcaggtcggcaggggcgggca

SEQ ID NO: 56335 - DNA, 285 bp, Homo sapiens; identical to SEQ ID NO: 35712
  chr15:53082758-53083043
  hyper

SEQ ID NO: 56336 - DNA, 19 bp, Homo sapiens
  chr15:53083116-53083135
  hyper
cgttgacccggcacccttc

SEQ ID NO: 56337 - DNA, 13 bp, Homo sapiens
  chr15:53083136-53083149
  hyper
tcctcccagatac

SEQ ID NO: 56338 - DNA, 1070 bp, Homo sapiens
  chr15:53095746-53096816
  hyper
tcaaaaaaacaaacacgaattcagccgctgctttaataacctctgaccagaggagctgattttgccaccgagttatcggtcagtgctgcgaggtcagtggcctgtgatcatgtttatagcaggtttggcttggatttggtgacacagccagcaaacctgggagattatgaaaccgtgaaccagcccagggaagtgtagtcaagtttcagtttgggcatttctccgggtgagggaatccggtgggctccatttctacaaggctcacaaacgcaggtgcagttcggccgccgcacgctgcctggcgggagaaacgcgcacaaaccgcagacgcgtgctcctgtagttgccactagctcggggcacgcccgtgttatttacaccctgctcgggggcccccctctcatttgttactttaaactcatggggaggaactgttagctgccgtggcgggactggcaggctgggaggggggcgcccccgctcggctcccgggccgtgacgcggccgctgccctccgcccctggcttccaccctgtttgcatggccacaagctcagcggtggaccagcgtggccaggcccccggagcccttgccccggcctaccgcccctacttcttccccctcaccaccccccccaaacgcttgtgagactggcttaccctggtgggcgagtcgcagcgcattagcggatttcatggcaagttgcttctgtgacatgagatcaggttcgcgttcgaggatttgccccctaggagggaaggaaaggagagtcaatctgcataatttcaaatgagaaataaatagggaaacagggaactgaatttcaagccccctaattcctccctccccccgaacctgtgagccaccccgcaccccccacaacacgccccgtgcacaggtaaaaaaaaaaaaaaaaagtaatcagcacacgtcgcaggtgataccttttattgtgctcattttaaagacaggaacaggatggcctcctgcccgaagactttctctgcagccaggcccggggcaggagggtcagctgggcagcatccgggcccgcggattcctgcaaggtc

SEQ ID NO: 56339 - DNA, 340 bp, Homo sapiens
  chr15:53096891-53097231
  hyper
tccctccagcttcttcggctccatctttaagtccaggcaaagatcaattccctctctctcttgaacacacacatttgcagccataaataaacagctcccagctaaatcaggaaccggagaggagaaagggaaaaagaaaggagaaaagagaaggattgagaacccaagcgcgagtctcgcctcttccgggcgccgactggctctttttggtcaggccagcctcgcatttggggatgcaacttgcatttgaatagctgcctgggcttgttatggacccgggaaagctctgaaagggaatcactatgcaaattgtcccagttacaatcgaaaggttcgatct

SEQ ID NO: 56340 - DNA, 308 bp, Homo sapiens
  chr15:53097261-53097569
  hyper
gctatctatgcattagggttgcattaccgccttcgtcggcctcctcgccacccccgctcgcgcctgcaggggaggctttttttttttttgcttatgtttatattttccctcagtaattaaaaaaaaataaaaaaagaaaataaaaggctgaaggtggtggcatagctggctagggcctgggaggcccacgggctgagaggggaggaggtgcggaagggcggggttgggtggcggggggggtcgttcttttgcagcaggtgttgatggtgcgtttgaaatcaaacatttagatttttttttcgctttgc

SEQ ID NO: 56341 - DNA, 32 bp, Homo sapiens; identical to SEQ ID NO: 22079
  chr15:53098658-53098690
  hyper

SEQ ID NO: 56342 - DNA, 111 bp, Homo sapiens; identical to SEQ ID NO: 35718
  chr15:54051776-54051887
  hyper

SEQ ID NO: 56343 - DNA, 190 bp, Homo sapiens; identical to SEQ ID NO: 22081
  chr15:54270707-54270897
  hyper

SEQ ID NO: 56344 - DNA, 32 bp, Homo sapiens; identical to SEQ ID NO: 35720
  chr15:55879909-55879941
  hyper

SEQ ID NO: 56345 - DNA, 607 bp, Homo sapiens; identical to SEQ ID NO: 35721
  chr15:55880176-55880783
  hyper

SEQ ID NO: 56346 - DNA, 42 bp, Homo sapiens; identical to SEQ ID NO: 35723
  chr15:56034387-56034429
  hyper

SEQ ID NO: 56347 - DNA, 72 bp, Homo sapiens; identical to SEQ ID NO: 35724
  chr15:56034651-56034723
  hyper

SEQ ID NO: 56348 - DNA, 375 bp, Homo sapiens; identical to SEQ ID NO: 35725
  chr15:56034885-56035260
  hyper

SEQ ID NO: 56349 - DNA, 206 bp, Homo sapiens; identical to SEQ ID NO: 35726
  chr15:56035304-56035510
  hyper

SEQ ID NO: 56350 - DNA, 65 bp, Homo sapiens; identical to SEQ ID NO: 35727
  chr15:58357155-58357220
  hyper

SEQ ID NO: 56351 - DNA, 241 bp, Homo sapiens; identical to SEQ ID NO: 35729
  chr15:58358522-58358763
  hyper

SEQ ID NO: 56352 - DNA, 159 bp, Homo sapiens; identical to SEQ ID NO: 35730
  chr15:59729656-59729815
  hyper

SEQ ID NO: 56353 - DNA, 30 bp, Homo sapiens; identical to SEQ ID NO: 35731
  chr15:60286804-60286834
  hyper

SEQ ID NO: 56354 - DNA, 22 bp, Homo sapiens
  chr15:60288844-60288866
  hyper
ccccactcgccaaccacctgat

SEQ ID NO: 56355 - DNA, 80 bp, Homo sapiens
  chr15:60289546-60289626
  hyper
cttagctgggggaggccagcacggatcagccgctttctttcttttctctctttctttttcaaacccgctttgtgggtggc

SEQ ID NO: 56356 - DNA, 30 bp, Homo sapiens; identical to SEQ ID NO: 35736
  chr15:60289876-60289906
  hyper

SEQ ID NO: 56357 - DNA, 30 bp, Homo sapiens; identical to SEQ ID NO: 35737
  chr15:60292201-60292231
  hyper

SEQ ID NO: 56358 - DNA, 205 bp, Homo sapiens; identical to SEQ ID NO: 22084
  chr15:60295917-60296122
  hyper

SEQ ID NO: 56359 - DNA, 62 bp, Homo sapiens
  chr15:60296209-60296271
  hyper
tcacacggcgcacaccggccggcgcgtccagctgcctgcccagtggccgaggctcttccccc

SEQ ID NO: 56360 - DNA, 115 bp, Homo sapiens
  chr15:60296483-60296598
  hyper
ttctgctcctgtcaccgcttaaaactatcagatggttcgagggaggacatggaggcagccacctagctcagcggagacgcggagcccacagcagcgccctccggagccctaacac

SEQ ID NO: 56361 - DNA, 228 bp, Homo sapiens
  chr15:60297409-60297637
  hyper
agggcagcttctgggcgctgcacccaagctgcggggacatgttcgagaacggcagcttcctgcggcgccgcaagcgcttcaaggtgcttaagtccgaccacctggcgcccagcaagccagccgacgcggcgcagtacctgcagcagcaggccaagctgcggctcagcgcgctggcggcctcgggcacgcacctgccacagatgcccgccgccgcctacaacttgggcg

SEQ ID NO: 56362 - DNA, 71 bp, Homo sapiens
  chr15:60298108-60298179
  hyper
cctccgccttgcactcggtggcggtgcactgacccgcaggagcccacgccccctctcgttctcctccccac

SEQ ID NO: 56363 - DNA, 49 bp, Homo sapiens; identical to SEQ ID NO: 35743
  chr15:60883305-60883354
  hyper

SEQ ID NO: 56364 - DNA, 136 bp, Homo sapiens; identical to SEQ ID NO: 35744
  chr15:61519885-61520021
  hyper

SEQ ID NO: 56365 - DNA, 54 bp, Homo sapiens; identical to SEQ ID NO: 35745
  chr15:61520408-61520462
  hyper

SEQ ID NO: 56366 - DNA, 143 bp, Homo sapiens
  chr15:61520773-61520916
  hyper
tcgggcagccagggccgaaactgtcaagaggagaaaaggtaaagcggaaggagggtggccataaacagatttttttgccccttcttaaaaggacactgccgctttaaaagtttctttcccgggcccccactccccgcatctcc

SEQ ID NO: 56367 - DNA, 94 bp, Homo sapiens; identical to SEQ ID NO: 35747
  chr15:61521200-61521294
  hyper

SEQ ID NO: 56368 - DNA, 161 bp, Homo sapiens; identical to SEQ ID NO: 35748
  chr15:61521311-61521472
  hyper

SEQ ID NO: 56369 - DNA, 10 bp, Homo sapiens
  chr15:61521937-61521947
  hyper
ccagcttggg

SEQ ID NO: 56370 - DNA, 32 bp, Homo sapiens; identical to SEQ ID NO: 35750
  chr15:62456269-62456301
  hyper

SEQ ID NO: 56371 - DNA, 21 bp, Homo sapiens
  chr15:62456901-62456922
  hyper
cacacggggcaggtgcggcag

SEQ ID NO: 56372 - DNA, 141 bp, Homo sapiens; identical to SEQ ID NO: 35752
  chr15:62457155-62457296
  hyper

SEQ ID NO: 56373 - DNA, 176 bp, Homo sapiens; identical to SEQ ID NO: 35753
  chr15:63334493-63334669
  hyper

SEQ ID NO: 56374 - DNA, 30 bp, Homo sapiens; identical to SEQ ID NO: 35754
  chr15:63335974-63336004
  hyper

SEQ ID NO: 56375 - DNA, 38 bp, Homo sapiens; identical to SEQ ID NO: 35755
  chr15:63673771-63673809
  hyper

SEQ ID NO: 56376 - DNA, 36 bp, Homo sapiens; identical to SEQ ID NO: 35756
  chr15:65204199-65204235
  hyper

SEQ ID NO: 56377 - DNA, 121 bp, Homo sapiens; identical to SEQ ID NO: 35757
  chr15:65360172-65360293
  hyper

SEQ ID NO: 56378 - DNA, 76 bp, Homo sapiens; identical to SEQ ID NO: 35758
  chr15:65360323-65360399
  hyper

SEQ ID NO: 56379 - DNA, 15 bp, Homo sapiens
  chr15:65648085-65648100
  hyper
gaatccggcattgtg

SEQ ID NO: 56380 - DNA, 15 bp, Homo sapiens
  chr15:65648136-65648151
  hyper
cgcacgccaaacgag

SEQ ID NO: 56381 - DNA, 530 bp, Homo sapiens; identical to SEQ ID NO: 35761
  chr15:65669295-65669825
  hyper

SEQ ID NO: 56382 - DNA, 151 bp, Homo sapiens; identical to SEQ ID NO: 35762
  chr15:65670634-65670785
  hyper

SEQ ID NO: 56383 - DNA, 185 bp, Homo sapiens; identical to SEQ ID NO: 35763
  chr15:65714138-65714323
  hyper

SEQ ID NO: 56384 - DNA, 18 bp, Homo sapiens
  chr15:65714819-65714837
  hyper
ccatggcacgcactgcgg

SEQ ID NO: 56385 - DNA, 38 bp, Homo sapiens; identical to SEQ ID NO: 35765
  chr15:65715098-65715136
  hyper

SEQ ID NO: 56386 - DNA, 120 bp, Homo sapiens; identical to SEQ ID NO: 35766
  chr15:65715528-65715648
  hyper

SEQ ID NO: 56387 - DNA, 121 bp, Homo sapiens; identical to SEQ ID NO: 35767
  chr15:68112086-68112207
  hyper

SEQ ID NO: 56388 - DNA, 59 bp, Homo sapiens
  chr15:68112552-68112611
  hyper
aacctaattaactgacgaaaactgccgttaattcaactagtaaaagatatgtgcttgcg

SEQ ID NO: 56389 - DNA, 237 bp, Homo sapiens; identical to SEQ ID NO: 35769
  chr15:68113226-68113463
  hyper

SEQ ID NO: 56390 - DNA, 117 bp, Homo sapiens
  chr15:68113751-68113868
  hyper
gctaagaataattaccgaacgagattgtaattatggggtgggggagcctgggccgagggagagggaatgagctggcggggacttgggggcagctctcggactgggaaggaaaatagg

SEQ ID NO: 56391 - DNA, 241 bp, Homo sapiens
  chr15:68113898-68114139
  hyper
aggaaagacagcgggatagttggagcgggacagaggcacagcctgggaaagacacccgaatggaggggccagaggcagaaagaaaggggccgagcgggttccaggactcccctgggagaaaagggaaaggcagggagatccgagacagaaagaccggaaccgaggagggggaagagggcaagaacgcgatctaaaagagaccctcagaggagacagagcccacaaacttgggagaggtttt

SEQ ID NO: 56392 - DNA, 251 bp, Homo sapiens
  chr15:68114195-68114446
  hyper
ggagtctgtgggctgggcctgccctctcctcagtcccttcaccaggcctgagctatcggttcgcgcttccagagtcccttcccagggtctctgcgagccaggagggaaaggaagagaggggagaagtggaggaaaaggggagacacgccccagaggagttggaacgcaggagggaaaggggaccatacccggtagcccgagggaaaaacgaggcgagaggggagaaggcgaccccgcgctgctacccgcgg

SEQ ID NO: 56393 - DNA, 30 bp, Homo sapiens; identical to SEQ ID NO: 35771
  chr15:68114981-68115011
  hyper

SEQ ID NO: 56394 - DNA, 1093 bp, Homo sapiens
  chr15:68115276-68116369
  hyper
caccaccctggccctcgcctgcggccggaaagtgaagtactcctccctgcgcccgttcctcttgagtcccccttagccccatcacccggttttggcccagaccaaaactggctccttggccgggagcactgggccctccccacttcgttcttggggacaaactttatggccccagggcctttcctccctcctggcctctccagctagagcgggacgcaggtgcagggtgctggacgcaggtgtgcggccgcttacctggggcgtgcaggccttgggctgcggggaggcggcgggcgccgcgcgtggcccgcgggcgggcggacccggggagggcgctagcgactgcgcgggcggtgggtgtggcgccccggctctcagctgtcaggcgcgcctgccccgccactcgggctgtgaccgcgccgtccccgccgccgcgccatgcgctccaggcttcggcctcttcttccggccagtccccggcctcggggtcaacggctcagggttcgcatctccgcgcccggggtcccggcgccccgtgcccgctgagagcgggaggggccgcgggtgggagcgcggagaaccagggagcacggctgtgcgcgcgcgcggggaggggccgcgccgtcacccggagagcccggcggatcccggactcccgcccgccgctcctcccgccgcgcacctccgctcaccgctcgcccggctccagccgccgccgcactgtgagtacccacgtccggtagcccgccgcccccgcgctctgctcctgcagcttttttttcgtttagttctgatttgggctcctgtggctgttgtttttatgattatacctaaagacaccaccgcctcgctcccaccactgccagtctcccgcttcgctgccctccccaagctcgtccatctagctccgggagccgacgggggttcctcaagctgctctggctgctgctccttgtcgctgcatatggctcttcgcctgtgctttccgctttggcccccgaaattccgttcctttcctagggacccccttcttctgactccgggcccggacccccctcctctcactcagggaaaaccgcgcagggacccagga

SEQ ID NO: 56395 - DNA, 365 bp, Homo sapiens
  chr15:68117465-68117830
  hyper
aatctttctgctcaacgaacgcgggcgccagccgtgagaggagaagctcgggtttgtggaaactggcaatgttgtcccctgaagccggctcgggcaccaagctgggtgcggtgggggccgcgctaggtccgggtgcgcaccgagcgctttggagagggtcaggttcagcaccgcgaacagcggtagcctccgcctctctccttccctggcagacacggttccctcctccttctcctcacccccctccttctcttcacccccctctaccccctgctgtctggagatgggcagtgaccgcccctcccccctccccacccctccttgcactgcccccgcccgcccgcgtgcatgcgcgactgagcaga

SEQ ID NO: 56396 - DNA, 41 bp, Homo sapiens
  chr15:68118633-68118674
  hyper
gcgagaggccgaacgcctgtgcaagtcgttcctgggcgagc

SEQ ID NO: 56397 - DNA, 38 bp, Homo sapiens; identical to SEQ ID NO: 35775
  chr15:68120630-68120668
  hyper

SEQ ID NO: 56398 - DNA, 5 bp, Homo sapiens
  chr15:68120954-68120959
  hyper
caact

SEQ ID NO: 56399 - DNA, 174 bp, Homo sapiens
  chr15:68122469-68122643
  hyper
ggcagtatccgggtcacggtttctttgcctctcttgaaattcggtttgttgccttcaagagccagataaggaagacaatcactcgcccgccgatgatttggaaacgaggaaatcctatccagaccaaaggagtatctcccagccaagtcctgcaaatacagacagaggtgagcc

SEQ ID NO: 56400 - DNA, 35 bp, Homo sapiens
  chr15:68122673-68122708
  hyper
ccaggagctgggacccaggtcgcccaggttcccag

SEQ ID NO: 56401 - DNA, 38 bp, Homo sapiens; identical to SEQ ID NO: 22098
  chr15:68125223-68125261
  hyper

SEQ ID NO: 56402 - DNA, 47 bp, Homo sapiens; identical to SEQ ID NO: 22099
  chr15:68125664-68125711
  hyper

SEQ ID NO: 56403 - DNA, 297 bp, Homo sapiens; identical to SEQ ID NO: 35780
  chr15:68125947-68126244
  hyper

SEQ ID NO: 56404 - DNA, 85 bp, Homo sapiens; identical to SEQ ID NO: 35781
  chr15:68126922-68127007
  hyper

SEQ ID NO: 56405 - DNA, 35 bp, Homo sapiens; identical to SEQ ID NO: 22101
  chr15:68127766-68127801
  hyper

SEQ ID NO: 56406 - DNA, 152 bp, Homo sapiens
  chr15:68128350-68128502
  hyper
gggcgggacagcgcgggtgtgggagtttgccggcccctttccccaccgcggattgcacctttggaagctgcacttttcttctctgtaaaatgggcatcaccattaccacccaggcaggaagttccgtggctgcggctcgacagaggagccag

SEQ ID NO: 56407 - DNA, 40 bp, Homo sapiens; identical to SEQ ID NO: 35784
  chr15:68549442-68549482
  hyper

SEQ ID NO: 56408 - DNA, 65 bp, Homo sapiens; identical to SEQ ID NO: 35785
  chr15:68569420-68569485
  hyper

SEQ ID NO: 56409 - DNA, 529 bp, Homo sapiens; identical to SEQ ID NO: 35786
  chr15:68723523-68724052
  hyper

SEQ ID NO: 56410 - DNA, 265 bp, Homo sapiens; identical to SEQ ID NO: 35787
  chr15:68870820-68871085
  hyper

SEQ ID NO: 56411 - DNA, 173 bp, Homo sapiens; identical to SEQ ID NO: 35788
  chr15:69136224-69136397
  hyper

SEQ ID NO: 56412 - DNA, 30 bp, Homo sapiens; identical to SEQ ID NO: 35789
  chr15:69366538-69366568
  hyper

SEQ ID NO: 56413 - DNA, 86 bp, Homo sapiens; identical to SEQ ID NO: 35790
  chr15:70877578-70877664
  hyper

SEQ ID NO: 56414 - DNA, 43 bp, Homo sapiens; identical to SEQ ID NO: 35791
  chr15:71055227-71055270
  hyper

SEQ ID NO: 56415 - DNA, 37 bp, Homo sapiens; identical to SEQ ID NO: 35792
  chr15:71055857-71055894
  hyper

SEQ ID NO: 56416 - DNA, 79 bp, Homo sapiens; identical to SEQ ID NO: 35793
  chr15:71146120-71146199
  hyper

SEQ ID NO: 56417 - DNA, 131 bp, Homo sapiens; identical to SEQ ID NO: 35794
  chr15:71408456-71408587
  hyper

SEQ ID NO: 56418 - DNA, 143 bp, Homo sapiens; identical to SEQ ID NO: 35795
  chr15:72476743-72476886
  hyper

SEQ ID NO: 56419 - DNA, 101 bp, Homo sapiens; identical to SEQ ID NO: 35796
  chr15:72490031-72490132
  hyper

SEQ ID NO: 56420 - DNA, 211 bp, Homo sapiens; identical to SEQ ID NO: 35797
  chr15:72564738-72564949
  hyper

SEQ ID NO: 56421 - DNA, 30 bp, Homo sapiens; identical to SEQ ID NO: 35798
  chr15:72565377-72565407
  hyper

SEQ ID NO: 56422 - DNA, 30 bp, Homo sapiens; identical to SEQ ID NO: 35799
  chr15:73611158-73611188
  hyper

SEQ ID NO: 56423 - DNA, 404 bp, Homo sapiens; identical to SEQ ID NO: 22108
  chr15:73659600-73660004
  hyper

SEQ ID NO: 56424 - DNA, 260 bp, Homo sapiens; identical to SEQ ID NO: 22109
  chr15:73660067-73660327
  hyper

SEQ ID NO: 56425 - DNA, 278 bp, Homo sapiens; identical to SEQ ID NO: 35801
  chr15:73660446-73660724
  hyper

SEQ ID NO: 56426 - DNA, 132 bp, Homo sapiens; identical to SEQ ID NO: 35802
  chr15:73660793-73660925
  hyper

SEQ ID NO: 56427 - DNA, 186 bp, Homo sapiens
  chr15:73661666-73661852
  hyper
tcccggccttcccgcaaccctcctggagagggggcttccggaaatgcgccgcgtcggggaggctcccacggttttcctgtgacatgggcagggtgcgaaccccgcgccagtctttcccctgcaaagcctcgcagcagccaggcaaggagggcgtggggaaacagggagacacgcacagggcgcgcg

SEQ ID NO: 56428 - DNA, 164 bp, Homo sapiens; identical to SEQ ID NO: 35804
  chr15:74044686-74044850
  hyper

SEQ ID NO: 56429 - DNA, 12 bp, Homo sapiens
  chr15:74045097-74045109
  hyper
tccgaaaggtcc

SEQ ID NO: 56430 - DNA, 44 bp, Homo sapiens; identical to SEQ ID NO: 35806
  chr15:74045854-74045898
  hyper

SEQ ID NO: 56431 - DNA, 24 bp, Homo sapiens
  chr15:74421982-74422006
  hyper
cgctgaaagaaatgtcggggtttc

SEQ ID NO: 56432 - DNA, 471 bp, Homo sapiens; identical to SEQ ID NO: 35808
  chr15:74422386-74422857
  hyper

SEQ ID NO: 56433 - DNA, 30 bp, Homo sapiens; identical to SEQ ID NO: 12214
  chr15:74428205-74428235
  hyper

SEQ ID NO: 56434 - DNA, 322 bp, Homo sapiens; identical to SEQ ID NO: 35810
  chr15:74428801-74429123
  hyper

SEQ ID NO: 56435 - DNA, 56 bp, Homo sapiens
  chr15:74658095-74658151
  hyper
ctcgggtgaacgcagcgagcgagggcagaggccagcagaggcgaggagtggatgct

SEQ ID NO: 56436 - DNA, 10 bp, Homo sapiens
  chr15:74658587-74658597
  hyper
gtgctctgac

SEQ ID NO: 56437 - DNA, 140 bp, Homo sapiens; identical to SEQ ID NO: 35814
  chr15:75119374-75119514
  hyper

SEQ ID NO: 56438 - DNA, 30 bp, Homo sapiens; identical to SEQ ID NO: 35815
  chr15:75250808-75250838
  hyper

SEQ ID NO: 56439 - DNA, 252 bp, Homo sapiens
  chr15:75251094-75251346
  hyper
ggctgaccccctccccgtctcctggtgggatcaggaaccctcggggtatgctccgaaccgggacttcggtctcggtccagtctccatgggccccacacagcggtgggggctggaggcacagcagccttgggaagaaacaaagactgtccgcagcgcgtagcggggcgtggagaaccgagggctgtgtaaggtcaggccctgagaaaaagcccccgaaaggctggaagttacgttggaacgggctggttgtgg

SEQ ID NO: 56440 - DNA, 32 bp, Homo sapiens
  chr15:75251382-75251414
  hyper
ttgggctgcacgatcacttggaagggattggg

SEQ ID NO: 56441 - DNA, 194 bp, Homo sapiens
  chr15:75251478-75251672
  hyper
cggttctgcgtccggccaggttggccctcgaggacccagccgtccccaacctcctaaactgctgtcggatgtagaagactcgcattcactgctctccacagtcggtgaagggagaacgccgaaaagggccgcattccctcctgccggtcccctccccttcccgcgctccctctgcagcacttaaaatgtaaatg

SEQ ID NO: 56442 - DNA, 25 bp, Homo sapiens
  chr15:75251786-75251811
  hyper
ggggtgggggcgggagatgcgggga

SEQ ID NO: 56443 - DNA, 15 bp, Homo sapiens
  chr15:75470896-75470911
  hyper
ctgtggggggtgggg

SEQ ID NO: 56444 - DNA, 15 bp, Homo sapiens
  chr15:75471217-75471232
  hyper
cggtttccccatctg

SEQ ID NO: 56445 - DNA, 34 bp, Homo sapiens; identical to SEQ ID NO: 35820
  chr15:76005149-76005183
  hyper

SEQ ID NO: 56446 - DNA, 25 bp, Homo sapiens
  chr15:76627826-76627851
  hyper
cccacccaggcgcacaccaagttct

SEQ ID NO: 56447 - DNA, 30 bp, Homo sapiens; identical to SEQ ID NO: 35823
  chr15:76628327-76628357
  hyper

SEQ ID NO: 56448 - DNA, 462 bp, Homo sapiens; identical to SEQ ID NO: 4252
  chr15:76628564-76629026
  hyper

SEQ ID NO: 56449 - DNA, 162 bp, Homo sapiens
  chr15:76630847-76631009
  hyper
tctgcccggtaagcgcgccggggcctgtgccggggtgagcggggtgtatgtgcgtgcgtgtgtgtaggggtacgcttgtgtccctaacgagaagttgtcagttgtgtgtggttccgtctgccgggatagtgtttttctgtatcagtgcggaactgtgtgctg

SEQ ID NO: 56450 - DNA, 74 bp, Homo sapiens; identical to SEQ ID NO: 35829
  chr15:76632517-76632591
  hyper

SEQ ID NO: 56451 - DNA, 159 bp, Homo sapiens; identical to SEQ ID NO: 35830
  chr15:76634951-76635110
  hyper

SEQ ID NO: 56452 - DNA, 155 bp, Homo sapiens
  chr15:76638317-76638472
  hyper
ggtcagctgttagggcgtgggggagggagggggcagggagcagggacgaggaagtggaagaataggggattgtgaggagtgatttctttccagattatcgagactcaagactttccagaacgtggcaaagagccctggaagaaatgtcccaggaa

SEQ ID NO: 56453 - DNA, 120 bp, Homo sapiens; identical to SEQ ID NO: 35832
  chr15:76638855-76638975
  hyper

SEQ ID NO: 56454 - DNA, 158 bp, Homo sapiens; identical to SEQ ID NO: 35833
  chr15:77924553-77924711
  hyper

SEQ ID NO: 56455 - DNA, 159 bp, Homo sapiens; identical to SEQ ID NO: 35834
  chr15:77927216-77927375
  hyper

SEQ ID NO: 56456 - DNA, 429 bp, Homo sapiens; identical to SEQ ID NO: 35835
  chr15:78111440-78111869
  hyper

SEQ ID NO: 56457 - DNA, 400 bp, Homo sapiens; identical to SEQ ID NO: 35836
  chr15:78111916-78112316
  hyper

SEQ ID NO: 56458 - DNA, 300 bp, Homo sapiens; identical to SEQ ID NO: 35837
  chr15:78236768-78237068
  hyper

SEQ ID NO: 56459 - DNA, 113 bp, Homo sapiens; identical to SEQ ID NO: 35838
  chr15:78632556-78632669
  hyper

SEQ ID NO: 56460 - DNA, 39 bp, Homo sapiens; identical to SEQ ID NO: 35839
  chr15:78632683-78632722
  hyper

SEQ ID NO: 56461 - DNA, 74 bp, Homo sapiens; identical to SEQ ID NO: 35840
  chr15:78633047-78633121
  hyper

SEQ ID NO: 56462 - DNA, 50 bp, Homo sapiens
  chr15:78912231-78912281
  hyper
tcccaggcaggaggtcggttgagagcgtatggcgttctgagtagtgcagg

SEQ ID NO: 56463 - DNA, 182 bp, Homo sapiens; identical to SEQ ID NO: 22123
  chr15:78912441-78912623
  hyper

SEQ ID NO: 56464 - DNA, 259 bp, Homo sapiens
  chr15:78912653-78912912
  hyper
tgggcgggatgcagacggtggagcgggaggcttgggcgcgccagtttgggagccagtgcgcggggcagggcgacgggcagcgcggggacgcgaatccccaactcctgcgcccaagacgaaggacccggtctcgacctccccatcacccggcgcgtaccagcgcccgctcagtgactcccaggtttggtggtggctaggggtgggaggtgagccgaaagggaaaaagccaccccacccaagtcgccgccgggctggagcc

SEQ ID NO: 56465 - DNA, 242 bp, Homo sapiens; identical to SEQ ID NO: 35843
  chr15:78913228-78913470
  hyper

SEQ ID NO: 56466 - DNA, 55 bp, Homo sapiens; identical to SEQ ID NO: 22125
  chr15:78913480-78913535
  hyper

SEQ ID NO: 56467 - DNA, 30 bp, Homo sapiens
  chr15:78913651-78913681
  hyper
atgctattaaataattgttaaatattttag

SEQ ID NO: 56468 - DNA, 253 bp, Homo sapiens; identical to SEQ ID NO: 35845
  chr15:78933391-78933644
  hyper

SEQ ID NO: 56469 - DNA, 36 bp, Homo sapiens; identical to SEQ ID NO: 35846
  chr15:79103265-79103301
  hyper

SEQ ID NO: 56470 - DNA, 215 bp, Homo sapiens; identical to SEQ ID NO: 22128
  chr15:79382571-79382786
  hyper

SEQ ID NO: 56471 - DNA, 11 bp, Homo sapiens
  chr15:79383257-79383268
  hyper
ggtgcctcctc

SEQ ID NO: 56472 - DNA, 56 bp, Homo sapiens; identical to SEQ ID NO: 35849
  chr15:79383328-79383384
  hyper

SEQ ID NO: 56473 - DNA, 509 bp, Homo sapiens
  chr15:79383438-79383947
  hyper
cgccccaccgcggcgcactgtagacctggggttaagtgccagttgtcattttctcctccaaaggctcgccccccccccccactttatttctaatacgaggtggaaggaggaaggtgggtggcgaaatagagctgcaaaagcgtccagtcctagtctttgcatagtcagccgggtcacattgaattccagcatccggctgcactcccggcggcttccccagctacctgaggacagtacagggggtgagatggggtggtggttggtgaacgttggttactttattttatattattttattttgagagttgccataattaccggcgccaccccccgtgcaccctgaggtctggttggcgagccgctgctgggagttttctgcaaataccccccaaagcctgaaggcgggcttcaaacgcaggcgccggggaccatgggagccttcaaatagctgcgctggcgcaatgataccttaatgatagattttccgttcttatttttagctctcattc

SEQ ID NO: 56474 - DNA, 169 bp, Homo sapiens; identical to SEQ ID NO: 22131
  chr15:79383977-79384146
  hyper

SEQ ID NO: 56475 - DNA, 147 bp, Homo sapiens
  chr15:79502064-79502211
  hyper
cgccgggaaatcaaacgtccatttacatcttgtcctgcaaagcttcatcaaaacttctttgccggccagtcacgtccccttatcacttttccagcccagctttgtgactgtaagtgttggacggagaactgataagggtaggtgatt

SEQ ID NO: 56476 - DNA, 499 bp, Homo sapiens
  chr15:79574779-79575278
  hyper
agaacaaaggggacacgagttcaaattcctgccagggtctgagacctgcaacgtcagactttgggagcgtcccctcacttctccggaccccaggagtggccgcgcctgctccgcgctcaccctcggggagtctaggagccccctgctaagttgctgagcgagtcggagccccaagagctagggtcgagggggtggggcagcaggcgcctctgccgaggctgcaggtaggcacttccccacccccgcggccccctccttcctccttcctcgcagctcgcacacccacacaaccctcgcccgtcgcggctggagagctgctctcggcgccagcgggcagcagcgcgtcgtcagccagcacagccggccgaagaccaagccggaggtctggggctgcgcagagacctgcacacccgcagcgcggaaccgggggcgattcctatctttctttcatgcttctttctttttcttaaaaccaaaccaaaccaaaccaaacccaaaa

SEQ ID NO: 56477 - DNA, 25 bp, Homo sapiens
  chr15:79575474-79575499
  hyper
gggtgctggacgccccctgattttg

SEQ ID NO: 56478 - DNA, 85 bp, Homo sapiens; identical to SEQ ID NO: 22135
  chr15:79576060-79576145
  hyper

SEQ ID NO: 56479 - DNA, 35 bp, Homo sapiens
  chr15:79576277-79576312
  hyper
atctgcttctaactgcttcccgtgactgcagaagg

SEQ ID NO: 56480 - DNA, 15 bp, Homo sapiens
  chr15:79724105-79724120
  hyper
ccccgcgggtggctc

SEQ ID NO: 56481 - DNA, 151 bp, Homo sapiens; identical to SEQ ID NO: 22137
  chr15:79724351-79724502
  hyper

SEQ ID NO: 56482 - DNA, 282 bp, Homo sapiens
  chr15:79725140-79725422
  hyper
gagcagggattcgggaagagaagccacggaagatgatcatgcagtttggggcaagttttcctggttgagcatcgcttcaggaaacggtgttttgagggttaaatatgtgagctatctgtgcaaaaagcctgacacatcagaggcgcgaagtaagatggaaagctggacaagccccaggtggaccgaccggtgcatccaattcttaaattgagatttccagtcacgttgatgtggaatgggatcgttgttcttcccgagggtttgataaggatgctcaacttc

SEQ ID NO: 56483 - DNA, 30 bp, Homo sapiens; identical to SEQ ID NO: 35858
  chr15:80543967-80543997
  hyper

SEQ ID NO: 56484 - DNA, 133 bp, Homo sapiens; identical to SEQ ID NO: 35859
  chr15:80544203-80544336
  hyper

SEQ ID NO: 56485 - DNA, 302 bp, Homo sapiens; identical to SEQ ID NO: 35860
  chr15:80544364-80544666
  hyper

SEQ ID NO: 56486 - DNA, 38 bp, Homo sapiens; identical to SEQ ID NO: 35861
  chr15:81073195-81073233
  hyper

SEQ ID NO: 56487 - DNA, 119 bp, Homo sapiens
  chr15:82336760-82336879
  hyper
cgcgccgttgagtgccgtgttcttattccgggaggcgcggatcatggagaagtgctcggcagcagagatgatctccctccgagccatggccacatcctccttcctgcccgtcacaacaa

SEQ ID NO: 56488 - DNA, 244 bp, Homo sapiens
  chr15:82336972-82337216
  hyper
aggagggagtgggagagagagacagacacgcccattatcctggggtaaccgcggggaccggggacagcccgcgtccaggacagcgagacggcaggacaagagatgggcggaaagggggcgtctccctcactgacctcgggccgcgccacgggctgggcagcggatcccacccgcgaggcgctcgaggaacagcccattggctgcctggccctcccccagtgactgcagtcgtcccgaaccaaac

SEQ ID NO: 56489 - DNA, 166 bp, Homo sapiens
  chr15:82339904-82340070
  hyper
aacaatgaggccatgcggccgcagccgcacacgggctgactggggagatctcgtggtgccgcggggcggtcccggggctcgaaggcagaggctcccctaggtgtgccctgcctgaccccggctacaggaacgagcgctgtgggcctcggtttctcacccgtaaaat

SEQ ID NO: 56490 - DNA, 30 bp, Homo sapiens; identical to SEQ ID NO: 22141
  chr15:82340157-82340187
  hyper

SEQ ID NO: 56491 - DNA, 381 bp, Homo sapiens
  chr15:83314955-83315336
  hyper
agcagacactcttcccgctagcaagggaccgcaccgtcacctgaggggcagccaagaggcgggcggtgcacctgtgccttccagaataggaaccccacccacttgcccctcttccccaccaacgacacagcccagtagttgactcaggtgccaggagagagcgcggggaggctgggcggtagccagggagaccaagggaagcggttgccagagaaatgcggcgtcagtcagggccggggctgcaggcgcggggcgggggaggagagacgcggcctcctcccaggcgggcctggcgggaggcaccccggcttctaagagcgaattcggctcccgactctcttcccccagctgagagcacggtgcaaggggccagggctgcag

SEQ ID NO: 56492 - DNA, 20 bp, Homo sapiens
  chr15:83316231-83316251
  hyper
cgtgcgacggcagtgtgaga

SEQ ID NO: 56493 - DNA, 322 bp, Homo sapiens
  chr15:83348912-83349234
  hyper
cgtcgcaggctcacccggcgcttgatggacatggtggccacgttctggagcacaacgtactgcacctcactgcggagaggacgggtcagagcaccccgggcccctcggttggggcaagggtcagcggatgaggggaaaaggtggggcaagtcgttgcggggagaggaccagtgcggagggcaggactacggtcagtgtggagcgggtgggcagaggtggaagcggctggtgggcgtgagggggcggagccgggcagcccgtggggcggggcaggaggcgagggagggggcggggctgggggcggagcgcacctgtggctgcg

SEQ ID NO: 56494 - DNA, 50 bp, Homo sapiens
  chr15:83349686-83349736
  hyper
agagtttccggtagtttttgtgaatcaggtcgatgcgctccgggcagacc

SEQ ID NO: 56495 - DNA, 30 bp, Homo sapiens; identical to SEQ ID NO: 35869
  chr15:83378057-83378087
  hyper

SEQ ID NO: 56496 - DNA, 30 bp, Homo sapiens; identical to SEQ ID NO: 35870
  chr15:83378625-83378655
  hyper

SEQ ID NO: 56497 - DNA, 165 bp, Homo sapiens; identical to SEQ ID NO: 12261
  chr15:83378857-83379022
  hyper

SEQ ID NO: 56498 - DNA, 127 bp, Homo sapiens; identical to SEQ ID NO: 35872
  chr15:83620954-83621081
  hyper

SEQ ID NO: 56499 - DNA, 28 bp, Homo sapiens
  chr15:83775821-83775849
  hyper
gccaggtttaaaaaccggatgccggctc

SEQ ID NO: 56500 - DNA, 112 bp, Homo sapiens; identical to SEQ ID NO: 35874
  chr15:83775890-83776002
  hyper

SEQ ID NO: 56501 - DNA, 116 bp, Homo sapiens; identical to SEQ ID NO: 4273
  chr15:83776022-83776138
  hyper

SEQ ID NO: 56502 - DNA, 98 bp, Homo sapiens; identical to SEQ ID NO: 22150
  chr15:83776157-83776255
  hyper

SEQ ID NO: 56503 - DNA, 95 bp, Homo sapiens
  chr15:83776785-83776880
  hyper
gtcacaggcgtcaatacggccatgcccctgccctggaggggcccaggggccggtggggagcggaacaaacacggacactacgaacctggccgtgt

SEQ ID NO: 56504 - DNA, 182 bp, Homo sapiens
  chr15:83875901-83876083
  hyper
gccgggagcccttgcctcagccccggcccggtcttcttcgtgccgcgccgccctcagccctcaccacagccggccgcgagctgcgggctcggggctgaggcgatggggaaagggggcgggcgcgccatcatgaaggggaaaatggtgggcgggcgggcccgcgcgcggccgcggtactcacc

SEQ ID NO: 56505 - DNA, 282 bp, Homo sapiens; identical to SEQ ID NO: 35881
  chr15:83876201-83876483
  hyper

SEQ ID NO: 56506 - DNA, 401 bp, Homo sapiens
  chr15:83876654-83877055
  hyper
cgctcccctccccttccctcccgcgcgggccggttaattcctaggtacacggccggctttcgcggagaaaccgagcgcgccagcccggcttctcggctggcgggcgggcggtgggcgcgtcctcccccagcaccgaagcccgcgccgggcgggcgggagtgcctactccggaggacgcccgccgcctgctctcttttgttcttggcccggagctgcctgccgcagcccagccaatcaccacccggccgcccccttcccctcccgtccgtgccactctgggggttctccccactcgcgccccccgctcccacgcccacctcccgctgactcgaccctctcctggctacccccagccagccacttccgcggctgctctctggtgagtgggggacaaaggcgct

SEQ ID NO: 56507 - DNA, 216 bp, Homo sapiens; identical to SEQ ID NO: 35883
  chr15:83951897-83952113
  hyper

SEQ ID NO: 56508 - DNA, 54 bp, Homo sapiens; identical to SEQ ID NO: 35884
  chr15:83952768-83952822
  hyper

SEQ ID NO: 56509 - DNA, 34 bp, Homo sapiens; identical to SEQ ID NO: 35885
  chr15:84034378-84034412
  hyper

SEQ ID NO: 56510 - DNA, 34 bp, Homo sapiens
  chr15:84115713-84115747
  hyper
ttgtccctccctaggcgcatttctgagccttcct

SEQ ID NO: 56511 - DNA, 171 bp, Homo sapiens
  chr15:84115966-84116137
  hyper
gccggtcttctgcgcggctcaagtagcccaggtctccacgcaacaatgaagcgtgggcggccccagcagcttcatttgcatatcgccgcggcttggccaatgggctgcgcaggggctttggaacgcagtgttgccatcggcgtgcgcgcgtgtgtgcgagtgtgacagcgg

SEQ ID NO: 56512 - DNA, 176 bp, Homo sapiens; identical to SEQ ID NO: 35889
  chr15:84116377-84116553
  hyper

SEQ ID NO: 56513 - DNA, 113 bp, Homo sapiens; identical to SEQ ID NO: 35890
  chr15:84116651-84116764
  hyper

SEQ ID NO: 56514 - DNA, 49 bp, Homo sapiens; identical to SEQ ID NO: 35891
  chr15:84116828-84116877
  hyper

SEQ ID NO: 56515 - DNA, 121 bp, Homo sapiens; identical to SEQ ID NO: 35892
  chr15:84322476-84322597
  hyper

SEQ ID NO: 56516 - DNA, 47 bp, Homo sapiens
  chr15:84748531-84748578
  hyper
attatttacctggcccgggtggcattttactttgcatccttgattgg

SEQ ID NO: 56517 - DNA, 138 bp, Homo sapiens
  chr15:84749260-84749398
  hyper
gggatcctcaaatagaacgaatccgggaccctgcagaaatgaagggcatgtagtgtagaggtttttcctttttatttagaaaggaatgaaagaccgacagtgcacctgcttggatagtaagcacgtgacccaaaactt

SEQ ID NO: 56518 - DNA, 316 bp, Homo sapiens
  chr15:88799221-88799537
  hyper
ggaagaggttcccatcgtccggccgccggcaattgatctcagtcttgctgcagacacaatttgcagggcaagccagcacggagcccacatagtccagccagacgcttcccagcaagaaaatccgccagaaactacacttggctgggcaaagagagacatccatctccgatcgctgcttctaaaaaagaggaggaggagaggagaggggggtggggtggggggagtggggagagcagggggggaaggaaacaaagacggcgagggaggggggaagggggagggggggcctctgcctttgaaacgccgagcgatcaga

SEQ ID NO: 56519 - DNA, 129 bp, Homo sapiens; identical to SEQ ID NO: 22160
  chr15:88800412-88800541
  hyper

SEQ ID NO: 56520 - DNA, 137 bp, Homo sapiens
  chr15:88801103-88801240
  hyper
catccgggaaagaagtgtgtgtggggggggccccgcttttgcgctggtagggatttttttcttaataaaacataaagatgccaagtgtgagctgtttgctgaaaaaaaaaaaaacgagcattcgctgtgggaaagga

SEQ ID NO: 56521 - DNA, 30 bp, Homo sapiens; identical to SEQ ID NO: 35901
  chr15:88801449-88801479
  hyper

SEQ ID NO: 56522 - DNA, 63 bp, Homo sapiens; identical to SEQ ID NO: 35902
  chr15:89147617-89147680
  hyper

SEQ ID NO: 56523 - DNA, 1447 bp, Homo sapiens
  chr15:89147722-89149169
  hyper
cgcggaccggcaccccctcccccaaagctgttgccatggccacaggggacatttgatgtgaagcgcggctcccccctctccactcgctttctccgctcgccttcaggatgacgtcatgaacatccgtggccctgacaggccacccgtgggttggtctcagctttaaagcagctgttctcctctggcccggcagccgcggcgactgtgtttgcacccggcggaccatgccaggactacggacccggacaggactgatggcctcagagaggcaagtattcaaggggcacttcacaaacagcttcctcaaaccccaccccctcccccgcactgcgctgctacttgcactgcggctcctggggggaagcaaagtaccggcagctgggtggtgaggggctttcttccagaaagaaacggagagcaagtggtcttcctccctagccgcggcgacccatgccaggtaaaaatcccagccgaggtccccggtcccgtcccctcctccaggtcaagggctcgggactggagaagcagccaactggagctgatattcgggaagctaagcctgaggctgctctggagggccggagaagcgagcggccaggcttggcacccgccaaatgtgccttgccaaaatgaagaggaaggaaggcgactccggagcccagcaggtgagcgctcctacgggatgctgggcaggctagaggtgtgggggcgtctggttccagtacctgcccggggcgacgcggaaacccagcttgcagtttgtttcgctcggtcccgcgcccagtaggagaaagacggccccacagcctcgcgggagccggctctcgcaacccagccgccccaagcccgccgtcgcccctcctcccgcgcttctcgcccctgattctagatgcagctgacttgttgcatgcagaagagcagctgggttcggcgttccaagcctctcctctttgctttgcctgccaccagatctgagcgccaggctggccagcacccagagagcccagagccgcaggaaaaaatgtgaaaagtaccaggagaccactgggtaatcgccccagtgcaaagggcctttcttcctacccaccgcaattgcagcaaataactccagggaggggaatcagaggcgccggggattgcgccctgggagagccctatctgctgaaagagagcgcctaatgccgttacttcccagtgtagcctttccactcggcagaccaagcgcctctccttcgagtcgctacccgcttggagtcggctcagaatcaggctgctaaaggtccctggagcccctcccccagcgaatccgagcctgcagcttcagcaccagaggctggacagcgccccggccctagggtgcccatggtcggtgcctgcgcacggctcggcctcccagcccacgccacttgcgctcgcggcccctcagaccccacgcggaggaggtcag

SEQ ID NO: 56524 - DNA, 325 bp, Homo sapiens
  chr15:89248428-89248753
  hyper
ggaggctgacgggggcgcagcttttcctcctgagtgttcgctgcccgggctggcggcgcggagccggcccgccgccgtctgcccctctgcccggcccttttttccagcagttctgccaagaggagcggggtgcggggcaggagatgaggaaggaggaggagaagaaaagggagaggagaggaggagacgcaaagggaagggaggggtgggaagggaagaggaggcaaagggtggggagaggaggggaggggaggagaggagaggggaggggagggactggatcgggcgccaatcccgcccgccgcgcgccgcccgggctccctcg

SEQ ID NO: 56525 - DNA, 47 bp, Homo sapiens
  chr15:89346003-89346050
  hyper
gtccttggtctctcccggggaatttgaagacccagagactcgcagct

SEQ ID NO: 56526 - DNA, 277 bp, Homo sapiens
  chr15:89346393-89346670
  hyper
ccgccagccccggagctgccgggtccgcgccgccccggggagcgctcctctcccgccctgagcgcaggccggcttccccatcggcgcgccggtccggagccagggtccagcgcgctccagacgcctctgccttcccctccccctgtcggccgcccctcggtccctgggggtggggtttccctttgcgctcgccccctcccgcccccacccctcacgggccctcccctcccccgcccgtccctatgtatgtgtcacagcgcgccatgcccgcccgccc

SEQ ID NO: 56527 - DNA, 360 bp, Homo sapiens
  chr15:89346943-89347303
  hyper
gcagcgagacccgggcctcccggccccaggagcccccagctgcctcgccaggtgtgtgggactgaagttcttggagaagggagtccaactcttcaaggtaactgtctccttccctccagagcgaggctctcccagggcgcccggcgagccaggaacgggactgagactgcacgccccggggctgggggctgcactgccttggtctccgccctagagctatgtgtgccgggggcgcagcacatccaccggctgcgtccgcggtggagttgagcaaactttttggctgttgcagactcagtgaatggggcaaaggaacacgtgaggaggggcacttgtctcctagtccgccaggatgaagga

SEQ ID NO: 56528 - DNA, 58 bp, Homo sapiens; identical to SEQ ID NO: 35908
  chr15:89438805-89438863
  hyper

SEQ ID NO: 56529 - DNA, 53 bp, Homo sapiens; identical to SEQ ID NO: 22172
  chr15:89903431-89903484
  hyper

SEQ ID NO: 56530 - DNA, 72 bp, Homo sapiens
  chr15:89903814-89903886
  hyper
agaaagcactggggggtgaagggagtgagaaaatgcccaggggaaaagttggtaggtcgccctagttgccgc

SEQ ID NO: 56531 - DNA, 131 bp, Homo sapiens; identical to SEQ ID NO: 35910
  chr15:89905759-89905890
  hyper

SEQ ID NO: 56532 - DNA, 145 bp, Homo sapiens; identical to SEQ ID NO: 35911
  chr15:89906124-89906269
  hyper

SEQ ID NO: 56533 - DNA, 137 bp, Homo sapiens; identical to SEQ ID NO: 35912
  chr15:89908862-89908999
  hyper

SEQ ID NO: 56534 - DNA, 30 bp, Homo sapiens; identical to SEQ ID NO: 12296
  chr15:89909322-89909352
  hyper

SEQ ID NO: 56535 - DNA, 339 bp, Homo sapiens
  chr15:89910748-89911087
  hyper
ggggcggggaagccgtgaacgccgaggccattgtaaggctgggtggtgcggagcgcgggaagggggctgggatttgaatgggagcctgtgattggccgatccctggactgacgtcacttccccgcggggcgattagcctgcgagaggagggccggcggtccagtgcgctgggggcggccggggcgctcgaggctctctaagcgctccgcgcgggtgccctacgtgagccccgggacgccgtcgaggcaggccggcagcgccggtgccaggacgcacggaacggggagcaggggagaaatgcgccgggagggcgagggaggaagggaactgggcgggggc

SEQ ID NO: 56536 - DNA, 910 bp, Homo sapiens
  chr15:89911186-89912096
  hyper
ctcccgcgctcggcaggcagcagcacgtggagcccacggcgcggcagcggcactggctaagggaggcccgtttctctctttggttatctagctgtatgagtgccacagagccgtcataaagctagataaccgaaagtagaaatgattctcacaacttctgcgtgcgagcgcccgccccaccgaccgccccggcccggcccgcaagagccagaggagccgagaggagcccagcgccggcccagcggactccagctcgacggagcggccgcgccccgaccaggtacctgacctcggctctctctctggggacacttgcagtgccagctttcccccagtcctcctctttcctggtcccccacccctatcccccagcgccggagcaggaaccccaaagtggagcgggccggggagagggagggggttggggttgcagaggggtcgctggaaggggaaggcgccagccttcgccttcaccccataaatcaggctggaacaatccgctcccggagccgtggacggggattttgggatgcaaatgcgatgggagagagacagcggtcggtagggggtgggtggagggagtgaatggggtgggctgggggctgccctgccgctaacaatgcggcctttatcgaattattcgacgagtcagcccctgagcgccattagcatacggctggggggttgccggagcttcgcccctcggtgaggtcaagttcttgataatttgatcacttttcacgggctctggcagctgcctttgtgtgcagttggggggtctgtgtgcagcgtgaagcggagcagaactggcggggagtgcgctcaatggcaaggggccagggcaggggcctccctccccgacgggtcggccctgccctgcatacaaaccaagagccggcgggtgggcggg

SEQ ID NO: 56537 - DNA, 375 bp, Homo sapiens; identical to SEQ ID NO: 35915
  chr15:89913180-89913555
  hyper

SEQ ID NO: 56538 - DNA, 96 bp, Homo sapiens
  chr15:89914135-89914231
  hyper
cgtttgggcttcatttttgtctccggtttgtgctactctttcttcatccaaaaaggcgttggagatcccgagaatctgctgcagcttggaagccag

SEQ ID NO: 56539 - DNA, 345 bp, Homo sapiens; identical to SEQ ID NO: 22178
  chr15:89914895-89915240
  hyper

SEQ ID NO: 56540 - DNA, 105 bp, Homo sapiens
  chr15:89915369-89915474
  hyper
ttttgcctagggtcagttcagctgggtcaggcaggggacaaatggatggtgtggaaggggcctgggtaggggcctgggtttgtcctggggcggctcttccacgag

SEQ ID NO: 56541 - DNA, 32 bp, Homo sapiens
  chr15:89922006-89922038
  hyper
cgcagcccagagctggcatcaggccatcaggc

SEQ ID NO: 56542 - DNA, 201 bp, Homo sapiens; identical to SEQ ID NO: 22179
  chr15:89922546-89922747
  hyper

SEQ ID NO: 56543 - DNA, 129 bp, Homo sapiens
  chr15:89942626-89942755
  hyper
cgccccccagcagcccgggccgcgtttgaccactagtagggcagaaccactgaccggcaggcggcgctccccggggctcccggctcgagccccagggcaccgggaggagtaaggaccccgagcgggagg

SEQ ID NO: 56544 - DNA, 465 bp, Homo sapiens
  chr15:89942945-89943410
  hyper
agcgagggcggcgggccaggcccgggatagggtgggaccgagggagggggacgcggcgtagggccccggcctactcctctggcccggagacccaggacctcgtccgcactccaactctccgagggaacgcggggatctcaggactcacgagcccaagattgtttggagcgcgccgggagccttaggatgcctggctccctctgggcgcagaaaagggcgggcttgcctcctccccaggacggaaggtggccggaagagccccgtcccagctcagatgggcttccccgccatcttccggacaaagtgtcaagtacaagttcaagttcagggccaggcccgggggggggcgctgagccttacccggccgcctttgttctctggcataatcgctcccacgtccccctcccgggcggggcccagcagagacccccgccccgccccgccccgccgcgccccgcaggagcc

SEQ ID NO: 56545 - DNA, 69 bp, Homo sapiens
  chr15:89943706-89943775
  hyper
ggctgggcagccccgctgggcctccggtggggtggggggcgcactgtcgctccagggctctggggagta

SEQ ID NO: 56546 - DNA, 109 bp, Homo sapiens; identical to SEQ ID NO: 35921
  chr15:89945180-89945289
  hyper

SEQ ID NO: 56547 - DNA, 39 bp, Homo sapiens; identical to SEQ ID NO: 35922
  chr15:89949371-89949410
  hyper

SEQ ID NO: 56548 - DNA, 173 bp, Homo sapiens
  chr15:89951113-89951286
  hyper
ggctgttctaatcgccgtctccaagtacctgctcatgaataaacaccaaccccatttatcaggtacttagcgctcattgtgaaggggaaattggcccttttctgaaattgtctatccacaacccatctgcgcagttctggttgcagaattcccctcacccttgagacacacac

SEQ ID NO: 56549 - DNA, 31 bp, Homo sapiens; identical to SEQ ID NO: 35926
  chr15:89951346-89951377
  hyper

SEQ ID NO: 56550 - DNA, 352 bp, Homo sapiens
  chr15:89951801-89952153
  hyper
gcagcttccggcagaggccctcaggtttcagagttctccaagtggggagaagggcggcctgctcagcccgcgcacccgtggcagcaccacagagggaataaaagcagggtaaacaatttgaagatccccacgaaggcaagagagtaaatttacaaactcatttgcgtccggaatacttgcttctttttcactcatacattccttctaaaatgtgggctttctgtgtacatgggcgcgcattcccaggactcggttccctgggtggaattcacccaggaatacaatcgattttctgaacctgcgtaaggccacaggcagctctgaaaatgaaagcgtttgctaagtgggggag

SEQ ID NO: 56551 - DNA, 63 bp, Homo sapiens
  chr15:89953055-89953118
  hyper
agggcggggagtagggattccctccagctccgcagggcatctcacaagcgccttcttctgcgc

SEQ ID NO: 56552 - DNA, 151 bp, Homo sapiens
  chr15:89954335-89954486
  hyper
ctggcgctgccttccaggaaagaggggcagcagcagcctcggctgagccgggtgcccttgtgggctatctggtgggggctcgcgggtccttgccttctctgcctggggtaggtgggaggtaggttcttgaacttcccggggcttctccctg

SEQ ID NO: 56553 - DNA, 89 bp, Homo sapiens; identical to SEQ ID NO: 35931
  chr15:89954753-89954842
  hyper

SEQ ID NO: 56554 - DNA, 184 bp, Homo sapiens; identical to SEQ ID NO: 35932
  chr15:89955001-89955185
  hyper

SEQ ID NO: 56555 - DNA, 54 bp, Homo sapiens; identical to SEQ ID NO: 35933
  chr15:89956300-89956354
  hyper

SEQ ID NO: 56556 - DNA, 123 bp, Homo sapiens
  chr15:89956450-89956573
  hyper
gctatgagaccacagccctttgtgtcccccacataagctgggcttccccgtaattagaatggtattcccagccattgaggcttttcatgaggcagaacaaaaactccccgagatgaatatccc

SEQ ID NO: 56557 - DNA, 40 bp, Homo sapiens; identical to SEQ ID NO: 35935
  chr15:89959963-89960003
  hyper

SEQ ID NO: 56558 - DNA, 85 bp, Homo sapiens; identical to SEQ ID NO: 35936
  chr15:89962817-89962902
  hyper

SEQ ID NO: 56559 - DNA, 121 bp, Homo sapiens
  chr15:90039711-90039832
  hyper
taatcacctgcaggagcaggcaggtgagcggcagccgccagcggaggttggtgttccaggccatgctgcaggggtgcctggccgggctggcagcgggcggttcggacgctcggaggccggc

SEQ ID NO: 56560 - DNA, 65 bp, Homo sapiens; identical to SEQ ID NO: 35938
  chr15:90293501-90293566
  hyper

SEQ ID NO: 56561 - DNA, 158 bp, Homo sapiens; identical to SEQ ID NO: 35939
  chr15:90319855-90320013
  hyper

SEQ ID NO: 56562 - DNA, 25 bp, Homo sapiens
  chr15:90320089-90320114
  hyper
cgtggccccgcagaggcgcagacgc

SEQ ID NO: 56563 - DNA, 177 bp, Homo sapiens; identical to SEQ ID NO: 12318
  chr15:90357883-90358060
  hyper

SEQ ID NO: 56564 - DNA, 298 bp, Homo sapiens; identical to SEQ ID NO: 35942
  chr15:90358102-90358400
  hyper

SEQ ID NO: 56565 - DNA, 156 bp, Homo sapiens; identical to SEQ ID NO: 35943
  chr15:91427788-91427944
  hyper

SEQ ID NO: 56566 - DNA, 73 bp, Homo sapiens; identical to SEQ ID NO: 35944
  chr15:91642967-91643040
  hyper

SEQ ID NO: 56567 - DNA, 68 bp, Homo sapiens; identical to SEQ ID NO: 35945
  chr15:91643277-91643345
  hyper

SEQ ID NO: 56568 - DNA, 142 bp, Homo sapiens; identical to SEQ ID NO: 35946
  chr15:91643657-91643799
  hyper

SEQ ID NO: 56569 - DNA, 45 bp, Homo sapiens; identical to SEQ ID NO: 35947
  chr15:92936662-92936707
  hyper

SEQ ID NO: 56570 - DNA, 231 bp, Homo sapiens
  chr15:92936922-92937153
  hyper
ctgaataaagccaggcgggagaagcaaaggctagcgcctggacgctggagttggtgggaggaggcgagcagaggcgcggagcaaagctgtcaaactgcgcgcggagccgggcgcggggcgggggaagggagaggagggagggaggggcaggcgggagccgggagggagcgagcgggctcgccgcgcctgagcaacccctgcctgtcgctgccgctgccgctgccgctgccg

SEQ ID NO: 56571 - DNA, 280 bp, Homo sapiens
  chr15:92937374-92937654
  hyper
gatcgaagaagaaatcgggtaaatagctgctcccaggcccgtgccacgagccctggcgggatctctccctccttctgtactctccaccctccgaccccctttgtgtgcgccgcgccccgctgtagctccgctggagagatggggacggtttggcagaaggtggcggcgacaggggcccgggacggtttggggagaggagggtgggggcgcggctgctgtggggtgtccccgggcggggttcacgggaagcccccagctggcccgcgtcgggaagcggact

SEQ ID NO: 56572 - DNA, 39 bp, Homo sapiens; identical to SEQ ID NO: 35949
  chr15:92937696-92937735
  hyper

SEQ ID NO: 56573 - DNA, 191 bp, Homo sapiens; identical to SEQ ID NO: 22197
  chr15:92937736-92937927
  hyper

SEQ ID NO: 56574 - DNA, 53 bp, Homo sapiens; identical to SEQ ID NO: 35951
  chr15:92938325-92938378
  hyper

SEQ ID NO: 56575 - DNA, 305 bp, Homo sapiens; identical to SEQ ID NO: 35952
  chr15:93198707-93199012
  hyper

SEQ ID NO: 56576 - DNA, 35 bp, Homo sapiens; identical to SEQ ID NO: 35953
  chr15:93257618-93257653
  hyper

SEQ ID NO: 56577 - DNA, 465 bp, Homo sapiens; identical to SEQ ID NO: 35954
  chr15:93615914-93616379
  hyper

SEQ ID NO: 56578 - DNA, 257 bp, Homo sapiens; identical to SEQ ID NO: 35955
  chr15:93616396-93616653
  hyper

SEQ ID NO: 56579 - DNA, 107 bp, Homo sapiens; identical to SEQ ID NO: 22201
  chr15:93631632-93631739
  hyper

SEQ ID NO: 56580 - DNA, 646 bp, Homo sapiens
  chr15:93632014-93632660
  hyper
aatgtgggcaagatgggagcaagatgagacgcggggctaaggaagaccaaagcagcgccgtggccccggcatgtgtcggcggcgcctcggagatgtcagagccgggtctgcccggctcccgacccgcgcttaccttggcggctgcatgagcccctgcggcccgcggggggtggcgctggcggggctgcgggagaagagggggtgtcggggcgccgctcgtctgccccggggcaaggtgggaggggctccgctggcgctggtccccgccgccccggccggctcagcagcggcccggggagcgcctcctgctcccgggctgcatgcctgcgagcgcctggcggagccggcccgggagcgaacggccagtgcttccccggcccagcggctcgggcggcgcagccagcgctcgggagacaactgcagagtggggcggccgggaccagccccctccctcgcccggcccccgcccgccgccgagcgcggcgtcgcgaggttcgtttgcgcgccgaggggagggggcgggccgggcgcccgggccgcgggcggggggcgcgcgcgggcggggccggcagggaggggcggggaggagcggggtgcgggctcgcgttgccccgccccgccgcggccccaccctcccgcatcagca

SEQ ID NO: 56581 - DNA, 33 bp, Homo sapiens; identical to SEQ ID NO: 22203
  chr15:93633233-93633266
  hyper

SEQ ID NO: 56582 - DNA, 64 bp, Homo sapiens; identical to SEQ ID NO: 35958
  chr15:95388665-95388729
  hyper

SEQ ID NO: 56583 - DNA, 144 bp, Homo sapiens; identical to SEQ ID NO: 35959
  chr15:96865078-96865222
  hyper

SEQ ID NO: 56584 - DNA, 51 bp, Homo sapiens; identical to SEQ ID NO: 35960
  chr15:96874282-96874333
  hyper

SEQ ID NO: 56585 - DNA, 74 bp, Homo sapiens; identical to SEQ ID NO: 35961
  chr15:96884425-96884499
  hyper

SEQ ID NO: 56586 - DNA, 30 bp, Homo sapiens; identical to SEQ ID NO: 35962
  chr15:96897398-96897428
  hyper

SEQ ID NO: 56587 - DNA, 81 bp, Homo sapiens
  chr15:96897853-96897934
  hyper
ccgtgcggctggctgcgcctaggagttccgccacgggtccgacggggcaccctgggtccccgcagcccgtcacaggcgttt

SEQ ID NO: 56588 - DNA, 193 bp, Homo sapiens
  chr15:96911366-96911559
  hyper
gctttcaggtgaattcgttccgggcgttcggtgtccctgggcttgcctaggggtactggggacccttagtgggccagaacccgaagctgaacgtgaataagggacagggtaggacctgaaattgcagagacatagaaaatcaatacgtggtcgggagtcaactgcgcgcgaccaagggctctgccctccctct

SEQ ID NO: 56589 - DNA, 198 bp, Homo sapiens; identical to SEQ ID NO: 35965
  chr15:96911763-96911961
  hyper

SEQ ID NO: 56590 - DNA, 50 bp, Homo sapiens
  chr15:96952646-96952696
  hyper
ccggcggggcagggccggggagctggggacggggtggtctttagggtggc

SEQ ID NO: 56591 - DNA, 11 bp, Homo sapiens
  chr15:96959719-96959730
  hyper
cgaatttcggg

SEQ ID NO: 56592 - DNA, 36 bp, Homo sapiens; identical to SEQ ID NO: 35970
  chr15:96960508-96960544
  hyper

SEQ ID NO: 56593 - DNA, 43 bp, Homo sapiens
  chr15:98504144-98504187
  hyper
gagcctgggtctggtgttcgaggacgagcgcaagggctgctat

SEQ ID NO: 56594 - DNA, 157 bp, Homo sapiens; identical to SEQ ID NO: 22208
  chr15:98836021-98836178
  hyper

SEQ ID NO: 56595 - DNA, 109 bp, Homo sapiens; identical to SEQ ID NO: 35974
  chr15:98965273-98965382
  hyper

SEQ ID NO: 56596 - DNA, 267 bp, Homo sapiens; identical to SEQ ID NO: 35975
  chr15:98971698-98971965
  hyper

SEQ ID NO: 56597 - DNA, 138 bp, Homo sapiens; identical to SEQ ID NO: 35976
  chr15:99193529-99193667
  hyper

SEQ ID NO: 56598 - DNA, 32 bp, Homo sapiens; identical to SEQ ID NO: 35978
  chr15:100346202-100346234
  hyper

SEQ ID NO: 56599 - DNA, 581 bp, Homo sapiens; identical to SEQ ID NO: 35979
  chr15:100881263-100881844
  hyper

SEQ ID NO: 56600 - DNA, 126 bp, Homo sapiens; identical to SEQ ID NO: 35980
  chr15:100881966-100882092
  hyper

SEQ ID NO: 56601 - DNA, 12 bp, Homo sapiens
  chr15:100914039-100914051
  hyper
cgggagggaggg

SEQ ID NO: 56602 - DNA, 15 bp, Homo sapiens
  chr15:101420369-101420384
  hyper
tttcgcgggacgtct

SEQ ID NO: 56603 - DNA, 96 bp, Homo sapiens
  chr15:101420425-101420521
  hyper
cgaagccgggaaaccgaggccgtccagcgcccgcgcggggccgggccgcccgcatccctgcgaggccccgacgtgtccctgcgctgcccgctttga

SEQ ID NO: 56604 - DNA, 55 bp, Homo sapiens
  chr15:101420610-101420665
  hyper
tggacgagtctggctttgagagggtcggagggtccgagagcgccaagagagagtc

SEQ ID NO: 56605 - DNA, 126 bp, Homo sapiens; identical to SEQ ID NO: 35985
  chr15:101420734-101420860
  hyper

SEQ ID NO: 56606 - DNA, 62 bp, Homo sapiens; identical to SEQ ID NO: 35987
  chr15:101459070-101459132
  hyper

SEQ ID NO: 56607 - DNA, 221 bp, Homo sapiens; identical to SEQ ID NO: 35988
  chr15:101460044-101460265
  hyper

SEQ ID NO: 56608 - DNA, 41 bp, Homo sapiens; identical to SEQ ID NO: 35989
  chr16:204480-204521
  hyper

SEQ ID NO: 56609 - DNA, 266 bp, Homo sapiens
  chr16:215150-215416
  hyper
gctgagcgccgcctccgggacccccaggacaggctgcggcccctcccctgcccttcaccctcccacagttcctgccctgactccaataaatggatgaggacggagcgatctgggctctgtgttctcagtattggagggaaggaggggagaagctgagtgatgggtccgggggcttcgcaggaactcggtcgtccccactgtcgtcgcggcctggggttcacttggggggcgccttggggaggttctagcccctgagcaccggagct

SEQ ID NO: 56610 - DNA, 22 bp, Homo sapiens
  chr16:216224-216246
  hyper
acgcagccgccctcctccccgg

SEQ ID NO: 56611 - DNA, 93 bp, Homo sapiens; identical to SEQ ID NO: 22213
  chr16:216583-216676
  hyper

SEQ ID NO: 56612 - DNA, 208 bp, Homo sapiens; identical to SEQ ID NO: 35994
  chr16:223321-223529
  hyper

SEQ ID NO: 56613 - DNA, 62 bp, Homo sapiens
  chr16:230203-230265
  hyper
cgccactgcactcaccgcacccggccaatttttgtgtttttagtagagactaaataccatat

SEQ ID NO: 56614 - DNA, 442 bp, Homo sapiens
  chr16:230610-231052
  hyper
gggccctccctccccaagccccccggacgcgcctcacccacgttcctctcgcaggaccttcctggctttccccgccacgaagacctacttctcccacctggacctgagccccggctcctcacaagtcagagcccacggccagaaggtggcggacgcgctgagcctcgccgtggagcgcctggacgacctaccccacgcgctgtccgcgctgagccacctgcacgcgtgccagctgcgagtggacccggccagcttccaggtgagcggctgccgtgctgggcccctgtccccgggagggccccggcggggtgggtgcggggggcgtgcggggcgggtgcaggcgagtgagccttgagcgctcgccgcagctcctgggccactgcctgctggtaaccctcgcccggcactaccccggagacttcagccccgcgctgcaggcgtc

SEQ ID NO: 56615 - DNA, 337 bp, Homo sapiens; identical to SEQ ID NO: 35997
  chr16:609979-610316
  hyper

SEQ ID NO: 56616 - DNA, 158 bp, Homo sapiens; identical to SEQ ID NO: 35998
  chr16:610343-610501
  hyper

SEQ ID NO: 56617 - DNA, 185 bp, Homo sapiens; identical to SEQ ID NO: 35999
  chr16:680959-681144
  hyper

SEQ ID NO: 56618 - DNA, 564 bp, Homo sapiens; identical to SEQ ID NO: 36000
  chr16:725381-725945
  hyper

SEQ ID NO: 56619 - DNA, 1028 bp, Homo sapiens; identical to SEQ ID NO: 36001
  chr16:750383-751411
  hyper

SEQ ID NO: 56620 - DNA, 38 bp, Homo sapiens; identical to SEQ ID NO: 36002
  chr16:863839-863877
  hyper

SEQ ID NO: 56621 - DNA, 104 bp, Homo sapiens
  chr16:1030655-1030759
  hyper
tccgagccaccctcggggacggccgggccgaggccacctcgcggggcggccttgggcggggacccggacccgcggttggacgttcgcctcggggggggcaatgt

SEQ ID NO: 56622 - DNA, 161 bp, Homo sapiens; identical to SEQ ID NO: 36004
  chr16:1031121-1031282
  hyper

SEQ ID NO: 56623 - DNA, 100 bp, Homo sapiens; identical to SEQ ID NO: 36005
  chr16:1031402-1031502
  hyper

SEQ ID NO: 56624 - DNA, 378 bp, Homo sapiens; identical to SEQ ID NO: 36006
  chr16:1031741-1032119
  hyper

SEQ ID NO: 56625 - DNA, 34 bp, Homo sapiens; identical to SEQ ID NO: 36007
  chr16:1032389-1032423
  hyper

SEQ ID NO: 56626 - DNA, 519 bp, Homo sapiens; identical to SEQ ID NO: 36008
  chr16:1203265-1203784
  hyper

SEQ ID NO: 56627 - DNA, 156 bp, Homo sapiens; identical to SEQ ID NO: 36009
  chr16:1203807-1203963
  hyper

SEQ ID NO: 56628 - DNA, 77 bp, Homo sapiens; identical to SEQ ID NO: 22225
  chr16:1204034-1204111
  hyper

SEQ ID NO: 56629 - DNA, 180 bp, Homo sapiens; identical to SEQ ID NO: 36011
  chr16:1204128-1204308
  hyper

SEQ ID NO: 56630 - DNA, 324 bp, Homo sapiens; identical to SEQ ID NO: 36012
  chr16:1382374-1382698
  hyper

SEQ ID NO: 56631 - DNA, 83 bp, Homo sapiens
  chr16:1382818-1382901
  hyper
ttgcagcgagtggagatggtgccactgcgctccaacctggttgagagctatttttgagagctttttcgagactctgtctgaaa

SEQ ID NO: 56632 - DNA, 202 bp, Homo sapiens
  chr16:1382940-1383142
  hyper
ttcgggaccagcgggttggggacaggacccatcaatgccttaacaaaccctgcaggagaccgcgggcccgctggggttccaggacagcgcagcggaggaagagcggggagccacccgggaggggctggcggggtccagtgcagaccccaggggctccgggggctctggccggctgtgaccccacaagcgccaactgggccct

SEQ ID NO: 56633 - DNA, 49 bp, Homo sapiens; identical to SEQ ID NO: 36014
  chr16:1383733-1383782
  hyper

SEQ ID NO: 56634 - DNA, 50 bp, Homo sapiens; identical to SEQ ID NO: 36015
  chr16:1384020-1384070
  hyper

SEQ ID NO: 56635 - DNA, 254 bp, Homo sapiens; identical to SEQ ID NO: 36016
  chr16:1384494-1384748
  hyper

SEQ ID NO: 56636 - DNA, 197 bp, Homo sapiens; identical to SEQ ID NO: 36017
  chr16:1922108-1922305
  hyper

SEQ ID NO: 56637 - DNA, 453 bp, Homo sapiens; identical to SEQ ID NO: 36018
  chr16:1968132-1968585
  hyper

SEQ ID NO: 56638 - DNA, 67 bp, Homo sapiens; identical to SEQ ID NO: 22230
  chr16:2040847-2040914
  hyper

SEQ ID NO: 56639 - DNA, 40 bp, Homo sapiens; identical to SEQ ID NO: 22231
  chr16:2042160-2042200
  hyper

SEQ ID NO: 56640 - DNA, 39 bp, Homo sapiens; identical to SEQ ID NO: 36023
  chr16:2042464-2042503
  hyper

SEQ ID NO: 56641 - DNA, 114 bp, Homo sapiens; identical to SEQ ID NO: 36024
  chr16:2069994-2070108
  hyper

SEQ ID NO: 56642 - DNA, 47 bp, Homo sapiens; identical to SEQ ID NO: 36025
  chr16:2070147-2070194
  hyper

SEQ ID NO: 56643 - DNA, 32 bp, Homo sapiens; identical to SEQ ID NO: 36026
  chr16:2287088-2287120
  hyper

SEQ ID NO: 56644 - DNA, 30 bp, Homo sapiens; identical to SEQ ID NO: 36027
  chr16:2287491-2287521
  hyper

SEQ ID NO: 56645 - DNA, 15 bp, Homo sapiens
  chr16:2892527-2892542
  hyper
gctccccactgttgt

SEQ ID NO: 56646 - DNA, 57 bp, Homo sapiens; identical to SEQ ID NO: 36030
  chr16:3016793-3016850
  hyper

SEQ ID NO: 56647 - DNA, 229 bp, Homo sapiens
  chr16:3068201-3068430
  hyper
ggcgggggtcttaaagaagcggtgacgtcactggaccaccgccccggaggaggggcagagaccctgtccctgacggcagcgggcgtgcgaatcccaggcttgtcagaggggggcgctggaggctggggtcgctgggcccgcctcgggctggcagacgtccagactcacccagggtgagggcgccaggcttagggtagaacagagcttgagactccgcttcaccacttaa

SEQ ID NO: 56648 - DNA, 73 bp, Homo sapiens; identical to SEQ ID NO: 36033
  chr16:3096869-3096942
  hyper

SEQ ID NO: 56649 - DNA, 248 bp, Homo sapiens; identical to SEQ ID NO: 36034
  chr16:3209117-3209365
  hyper

SEQ ID NO: 56650 - DNA, 119 bp, Homo sapiens; identical to SEQ ID NO: 36035
  chr16:3220438-3220557
  hyper

SEQ ID NO: 56651 - DNA, 232 bp, Homo sapiens; identical to SEQ ID NO: 36039
  chr16:3224952-3225184
  hyper

SEQ ID NO: 56652 - DNA, 12 bp, Homo sapiens
  chr16:3225459-3225471
  hyper
acactcaggagg

SEQ ID NO: 56653 - DNA, 17 bp, Homo sapiens
  chr16:3232618-3232635
  hyper
ttttggaccaaaaaccg

SEQ ID NO: 56654 - DNA, 44 bp, Homo sapiens
  chr16:3232695-3232739
  hyper
accaacgagccacacgccccgtagcctccggcttgtctttgtgg

SEQ ID NO: 56655 - DNA, 31 bp, Homo sapiens
  chr16:3237826-3237857
  hyper
tatatcataccagcacgacattgaaaccacc

SEQ ID NO: 56656 - DNA, 447 bp, Homo sapiens; identical to SEQ ID NO: 22239
  chr16:3238546-3238993
  hyper

SEQ ID NO: 56657 - DNA, 35 bp, Homo sapiens; identical to SEQ ID NO: 36049
  chr16:3241024-3241059
  hyper

SEQ ID NO: 56658 - DNA, 48 bp, Homo sapiens
  chr16:3241501-3241549
  hyper
cccggctagctcagtcggtagagcatgggactcttaatctcagggtcg

SEQ ID NO: 56659 - DNA, 46 bp, Homo sapiens
  chr16:3241663-3241709
  hyper
tcccctcaatgattgaattttggtctccgcgcgctcccagcagcaa

SEQ ID NO: 56660 - DNA, 37 bp, Homo sapiens; identical to SEQ ID NO: 36051
  chr16:3355197-3355234
  hyper

SEQ ID NO: 56661 - DNA, 29 bp, Homo sapiens
  chr16:3355250-3355279
  hyper
cgcagaacagacgcggcagtgcgacgcct

SEQ ID NO: 56662 - DNA, 135 bp, Homo sapiens
  chr16:3355718-3355853
  hyper
attttccgtaggcggtggccgcggcgcttccgggccgcgcggctggagcctgaggcggggccaccgtcgggcacgagaaaccattctctccccgcttttcgcagctgtatcccagaggcgcggctgaagctcgct

SEQ ID NO: 56663 - DNA, 18 bp, Homo sapiens
  chr16:3551488-3551506
  hyper
aaccgaacagcaggccgg

SEQ ID NO: 56664 - DNA, 160 bp, Homo sapiens; identical to SEQ ID NO: 36054
  chr16:4363920-4364080
  hyper

SEQ ID NO: 56665 - DNA, 505 bp, Homo sapiens; identical to SEQ ID NO: 36055
  chr16:4377915-4378420
  hyper

SEQ ID NO: 56666 - DNA, 186 bp, Homo sapiens; identical to SEQ ID NO: 36056
  chr16:4587903-4588089
  hyper

SEQ ID NO: 56667 - DNA, 453 bp, Homo sapiens; identical to SEQ ID NO: 36057
  chr16:4588308-4588761
  hyper

SEQ ID NO: 56668 - DNA, 382 bp, Homo sapiens
  chr16:5037518-5037900
  hyper
cccccccaccacggccgctcactgccgctctgcccccaggcctacgagaagcgtttccccacgtgcccacagatcccagtcttcctgggcagcgaggtcttgcgcgagtcccgcagcccggacggggctgtgcacgtggtggagcggagctgccggctgcgcgtggacgccccgcggctgctgcggaaggtgggcggccctggggctggggggcggaggaggggacctgttgcggaggtgcgggagggctgggcgcgggagctggggaccagggcggcggggtccaggaggtggagcaggggcgtgtgagttgatatttggatggaggttccaggatgagggtggcgggaccagggcccaggaggggcgagggctggaaggc

SEQ ID NO: 56669 - DNA, 21 bp, Homo sapiens
  chr16:5038004-5038025
  hyper
tgggtccgggctgggtgggcg

SEQ ID NO: 56670 - DNA, 44 bp, Homo sapiens; identical to SEQ ID NO: 36059
  chr16:6069508-6069552
  hyper

SEQ ID NO: 56671 - DNA, 61 bp, Homo sapiens; identical to SEQ ID NO: 36060
  chr16:6070141-6070202
  hyper

SEQ ID NO: 56672 - DNA, 289 bp, Homo sapiens; identical to SEQ ID NO: 36061
  chr16:6533425-6533714
  hyper

SEQ ID NO: 56673 - DNA, 33 bp, Homo sapiens; identical to SEQ ID NO: 36062
  chr16:7354091-7354124
  hyper

SEQ ID NO: 56674 - DNA, 75 bp, Homo sapiens; identical to SEQ ID NO: 36064
  chr16:10133426-10133501
  hyper

SEQ ID NO: 56675 - DNA, 64 bp, Homo sapiens; identical to SEQ ID NO: 36065
  chr16:10133502-10133566
  hyper

SEQ ID NO: 56676 - DNA, 100 bp, Homo sapiens
  chr16:10274299-10274399
  hyper
agtgagaggcagggccgcggtgagcaaggcgaccagaagaaagggattaccaacttggcttcctgctctaggagccaggcatggaactcagcagcaggat

SEQ ID NO: 56677 - DNA, 596 bp, Homo sapiens
  chr16:10274429-10275025
  hyper
gtccccgacgccatccacatccctcgatccatctctaactctatccacaactccaattcgagctaattctccatcccccagccccttctcgcatccagcttcctcatcccctgtctccaggcacttccccatccccatctctgtccatatcccccaccgcattccccaagttcgccgcgggccacagaccctaagcgccgcgcgtgttctgtaccccaccaagctcctaggtgcacagaataaaccctccatccaacccctcccacctgggatagagaggaccaagttatcaaccccgccccctgctggcgcggagcgaactacagaccccgcagggcgtgcggaggcggcacccagaccccgcgtcccagcttgagagctcagctagttggctgaccccgccccctacgagcccgtcgtgtgcaccacacactttgctctacgcccagccccaactacagacccggctcctctcagtcagagtacaccccaagtgcttgggagtgaggacgctgcctggtgggcccaggctccgctgtgcctggggaacttggggctcgccccacctcgagccaaggggccgtggagagtccttc

SEQ ID NO: 56678 - DNA, 60 bp, Homo sapiens
  chr16:10275248-10275308
  hyper
ctagcctttctactgcgggcgctgttgccaagtcctaggtgcacgtgggcagtgggccgc

SEQ ID NO: 56679 - DNA, 106 bp, Homo sapiens; identical to SEQ ID NO: 22249
  chr16:10275392-10275498
  hyper

SEQ ID NO: 56680 - DNA, 19 bp, Homo sapiens
  chr16:10276341-10276360
  hyper
agggggagggaaggacgcg

SEQ ID NO: 56681 - DNA, 239 bp, Homo sapiens; identical to SEQ ID NO: 36073
  chr16:10480064-10480303
  hyper

SEQ ID NO: 56682 - DNA, 69 bp, Homo sapiens; identical to SEQ ID NO: 36074
  chr16:12897833-12897902
  hyper

SEQ ID NO: 56683 - DNA, 325 bp, Homo sapiens
  chr16:12994737-12995062
  hyper
gctgggggacttccaaggaaagaccttccaggacacgccatagcctcggccttgttcggctgtcccctcttacccccgaccttctttgattcgttcatcccgagcccctctcccccggagggtgcttatccctggctcaggggcttgccacctgtccttcccagctccgcctgggtccttgcttgggcccagagagttgagccatgcgggttgcgctcagggctggagggcgcagccgggaagggcaaggaggccccgcacgcctgggaggggcgatcctgaccagactgcacccagtctgtcttggagtgaaagccatttagtc

SEQ ID NO: 56684 - DNA, 44 bp, Homo sapiens
  chr16:12995593-12995637
  hyper
ctccacccccgcctcacccagtggccggccggacctgcaccccg

SEQ ID NO: 56685 - DNA, 289 bp, Homo sapiens; identical to SEQ ID NO: 22254
  chr16:12996328-12996617
  hyper

SEQ ID NO: 56686 - DNA, 228 bp, Homo sapiens
  chr16:12996720-12996948
  hyper
gtgtgactctgctccctcaccctctggccgcctcctcccgctggtgactgaggcggacttgagacacgtagcctgggagcccgtggccccgaaatcttcgggtttggggagagggtccatggcacccctcggattccaggtgctagctttttggtaaacaggggcaggcgagcccgaaaggggaggggggcgtgtgtgagcccgagcgcgcgtgtgtgaaggagggag

SEQ ID NO: 56687 - DNA, 375 bp, Homo sapiens
  chr16:12997011-12997386
  hyper
gaggggagggcgagaacaaaagccttgcttggagcggccgcctcgctttcccagagcttcgccgtccctggatttgggacctcagctgcccccgcccctttacccacctcatccctttctctggccaccacttctccctgcccggggccgtggccatcgctgcagattgagccccttgccctggctggcgtggactccgggggcccgagccccctcctcgcgcgccctcacttccaagcaccctgatttcgtcaactttcgggtttgccttgttcattatgcaagccccagcaccagctagttccagcagatgggagaaggctttgggggattaatggagctatttgccttttgctttttttaaattttttttat

SEQ ID NO: 56688 - DNA, 764 bp, Homo sapiens; identical to SEQ ID NO: 36077
  chr16:15528335-15529099
  hyper

SEQ ID NO: 56689 - DNA, 484 bp, Homo sapiens; identical to SEQ ID NO: 36078
  chr16:15950853-15951337
  hyper

SEQ ID NO: 56690 - DNA, 80 bp, Homo sapiens; identical to SEQ ID NO: 36079
  chr16:15952285-15952365
  hyper

SEQ ID NO: 56691 - DNA, 30 bp, Homo sapiens; identical to SEQ ID NO: 36080
  chr16:19422447-19422477
  hyper

SEQ ID NO: 56692 - DNA, 137 bp, Homo sapiens
  chr16:19567065-19567202
  hyper
ttggtaaggaagcagcggcgggtgggctttggagaggggctgtccttacttgtgatggggtcggcctgggtctgagagtgtgaattcctctctgtcgggttctggtggtcgaccggccacccccaagttgtcttgac

SEQ ID NO: 56693 - DNA, 78 bp, Homo sapiens
  chr16:19567449-19567527
  hyper
ttggtcagtttcctcagctcctctgttcacctggagacttgcttttctcatctgtaaaatggccgccattcatcctat

SEQ ID NO: 56694 - DNA, 251 bp, Homo sapiens; identical to SEQ ID NO: 36082
  chr16:20084648-20084899
  hyper

SEQ ID NO: 56695 - DNA, 118 bp, Homo sapiens; identical to SEQ ID NO: 36083
  chr16:20085303-20085421
  hyper

SEQ ID NO: 56696 - DNA, 372 bp, Homo sapiens; identical to SEQ ID NO: 36084
  chr16:21294924-21295296
  hyper

SEQ ID NO: 56697 - DNA, 34 bp, Homo sapiens; identical to SEQ ID NO: 36085
  chr16:21295340-21295374
  hyper

SEQ ID NO: 56698 - DNA, 116 bp, Homo sapiens; identical to SEQ ID NO: 36086
  chr16:21675345-21675461
  hyper

SEQ ID NO: 56699 - DNA, 50 bp, Homo sapiens
  chr16:21831571-21831621
  hyper
agctttggtcccagacgcgcagaaggaagcggcctgaatcttacccagtc

SEQ ID NO: 56700 - DNA, 195 bp, Homo sapiens; identical to SEQ ID NO: 36088
  chr16:22173697-22173892
  hyper

SEQ ID NO: 56701 - DNA, 377 bp, Homo sapiens; identical to SEQ ID NO: 12422
  chr16:22203596-22203973
  hyper

SEQ ID NO: 56702 - DNA, 228 bp, Homo sapiens
  chr16:22824473-22824701
  hyper
tctggacatggtcaccgagaactgtcctgtaggcattcacttaggaatcattcgaagtggaattgctcctggatacgttctccttgtactctgtttcctcctcctagtgtctctgtgtgaagaagccctcctcactcagccctcggcgaccctctggtaccctggacagctccccggggagcagtctaccgctaggcggcggctgctaagagaggaaccctcctgacg

SEQ ID NO: 56703 - DNA, 170 bp, Homo sapiens
  chr16:22825157-22825327
  hyper
cgtctgggtctgtctggtctgcatgtcggcgcgatctcgacctggattcgtgtccctggatgtcgagaggccagcgtggtgggggtgtccagcctcccggaggagtactatgccttgacaccttcgtttcaccgccccaaagctggcctggggctccgtagggagtggcc

SEQ ID NO: 56704 - DNA, 75 bp, Homo sapiens; identical to SEQ ID NO: 36093
  chr16:22826252-22826327
  hyper

SEQ ID NO: 56705 - DNA, 64 bp, Homo sapiens; identical to SEQ ID NO: 22267
  chr16:23313400-23313464
  hyper

SEQ ID NO: 56706 - DNA, 31 bp, Homo sapiens; identical to SEQ ID NO: 22268
  chr16:23706520-23706551
  hyper

SEQ ID NO: 56707 - DNA, 104 bp, Homo sapiens; identical to SEQ ID NO: 36097
  chr16:23765896-23766000
  hyper

SEQ ID NO: 56708 - DNA, 30 bp, Homo sapiens; identical to SEQ ID NO: 36098
  chr16:23766456-23766486
  hyper

SEQ ID NO: 56709 - DNA, 262 bp, Homo sapiens; identical to SEQ ID NO: 36099
  chr16:23846792-23847054
  hyper

SEQ ID NO: 56710 - DNA, 47 bp, Homo sapiens; identical to SEQ ID NO: 22271
  chr16:23847956-23848003
  hyper

SEQ ID NO: 56711 - DNA, 561 bp, Homo sapiens; identical to SEQ ID NO: 36105
  chr16:23848004-23848565
  hyper

SEQ ID NO: 56712 - DNA, 90 bp, Homo sapiens; identical to SEQ ID NO: 22274
  chr16:24267025-24267115
  hyper

SEQ ID NO: 56713 - DNA, 265 bp, Homo sapiens; identical to SEQ ID NO: 22275
  chr16:24267220-24267485
  hyper

SEQ ID NO: 56714 - DNA, 21 bp, Homo sapiens
  chr16:24267578-24267599
  hyper
ctattttttgccatccgccct

SEQ ID NO: 56715 - DNA, 153 bp, Homo sapiens; identical to SEQ ID NO: 36108
  chr16:24621912-24622065
  hyper

SEQ ID NO: 56716 - DNA, 160 bp, Homo sapiens
  chr16:25702795-25702955
  hyper
agagaagatggggggcggggggcggtggctggaaagatggaagttgggatgggaaagcggttgtagaaaaggattcactcctggaccgaaggcaggaggatatcccgggcgagagaagggagggtcggggatgggctgagttggagtcccagaggaaaag

SEQ ID NO: 56717 - DNA, 650 bp, Homo sapiens
  chr16:25702992-25703642
  hyper
cccggtgcgcggcaccggaggcaggcgttgggctttacctctctaaaagtactggggcaaaggaatggagaacacggcgtcccgagctcccaagggaggggagtaaacgaggtggggtggggaacaccccaagtgcgtgcgtgctgggggctggggggcacgatctccgttctcccgggtgccccagccctagcgcacgcctccgctcccccgcccccttcgcaggcgcgcgcgaggcgcaccccccttccctcggcggcgccgggcgcgcgcccggccccctcctcctcccctccgcgcctctcctctctcccggcagaaagttagcagcggggaaggaactccgggctgcaacagcgcgcggcggcggcggcagaggctgaagcagaagccgcggcggagccggggaagcgggggcgctgcagacggagcaggtgccgccggcgggtccgcgcgcccccctcggtccccttgcctgaggctgaggggggggcggtggtgggggggccacccggactcggcgggcagcgtggggcggggggccatgcggccgggctcccccctggcgcagcgggacagcggccagggccgggggcgcagcggcgtcgcttcatgcagccggggcggctgggcagcggcggcggcggcgg

SEQ ID NO: 56718 - DNA, 16 bp, Homo sapiens
  chr16:25704628-25704644
  hyper
tcggctgagagggctg

SEQ ID NO: 56719 - DNA, 43 bp, Homo sapiens; identical to SEQ ID NO: 36111
  chr16:28073999-28074042
  hyper

SEQ ID NO: 56720 - DNA, 100 bp, Homo sapiens
  chr16:28074076-28074176
  hyper
cgcccctccgaccggcagcgggggtgggcgccttcccggggcgcgggagcgtccccaaagccgcggggcgtccgcagcgggtaggagctctgccttgcac

SEQ ID NO: 56721 - DNA, 253 bp, Homo sapiens
  chr16:28074684-28074937
  hyper
gcagcgccagcaggttcagggccacggccaggagcgctcggccgcggcggctagtcttcatgccgcccgcgccgccgggacgggactgcaccgccggggagctccgcgcgcgaagttggcagctggcgccccgcgtcagcggccgctgcccgccgcgccccggggctcgggtgcctgagatcggcggcggcggacgcggcgcgggcccatgccccccccaaccccggggtgggggcgcggcgcggggggcgtg

SEQ ID NO: 56722 - DNA, 4 bp, Homo sapiens
  chr16:28074955-28074959
  hyper
cggg

SEQ ID NO: 56723 - DNA, 190 bp, Homo sapiens
  chr16:28075197-28075387
  hyper
ccagggtgagggtctgagacgcaaggagaatcccaggcaaggcgctcctgagaaaagatccccacggcggacgtggggcaacaaaacccgccgggagcgggcatctcatgagacccagagaggccctgccccaggagacaagggcagagcctgctggggctccccaagagggacacggaccagcaggacc

SEQ ID NO: 56724 - DNA, 120 bp, Homo sapiens; identical to SEQ ID NO: 36115
  chr16:28304473-28304593
  hyper

SEQ ID NO: 56725 - DNA, 51 bp, Homo sapiens; identical to SEQ ID NO: 36116
  chr16:28891741-28891792
  hyper

SEQ ID NO: 56726 - DNA, 89 bp, Homo sapiens
  chr16:29888658-29888747
  hyper
cagtgtgaggtcgggcccagaggagagaaggcggcggcgcggctgaggtccccgcagctgggccaagactcgggcgctgggaccgtccc

SEQ ID NO: 56727 - DNA, 30 bp, Homo sapiens; identical to SEQ ID NO: 36118
  chr16:30023074-30023104
  hyper

SEQ ID NO: 56728 - DNA, 30 bp, Homo sapiens; identical to SEQ ID NO: 36119
  chr16:31022167-31022197
  hyper

SEQ ID NO: 56729 - DNA, 138 bp, Homo sapiens; identical to SEQ ID NO: 36120
  chr16:31226609-31226747
  hyper

SEQ ID NO: 56730 - DNA, 47 bp, Homo sapiens; identical to SEQ ID NO: 36121
  chr16:31227038-31227085
  hyper

SEQ ID NO: 56731 - DNA, 93 bp, Homo sapiens; identical to SEQ ID NO: 36123
  chr16:31483566-31483659
  hyper

SEQ ID NO: 56732 - DNA, 156 bp, Homo sapiens; identical to SEQ ID NO: 36124
  chr16:31498557-31498713
  hyper

SEQ ID NO: 56733 - DNA, 91 bp, Homo sapiens; identical to SEQ ID NO: 36125
  chr16:31499538-31499629
  hyper

SEQ ID NO: 56734 - DNA, 249 bp, Homo sapiens; identical to SEQ ID NO: 36126
  chr16:31540812-31541061
  hyper

SEQ ID NO: 56735 - DNA, 80 bp, Homo sapiens; identical to SEQ ID NO: 22284
  chr16:31580480-31580560
  hyper

SEQ ID NO: 56736 - DNA, 753 bp, Homo sapiens
  chr16:47176772-47177525
  hyper
caaattagtaagaaccgaacaccagcggcggggaattctgagacctctggcggagcgcgaggagcgccgcgtcccgggaagcacccgagcagcagcgctccccgggggccgggacaagccgggtccgcggcgcccgcgcgccgcccccggagcccgcagtggtgccgcagcctccgtggccgcagcaggtgggacccggctggcccagcaggccccgttccccgccgcgaggtgcaggcgccgcggggctattcgaaaaccactgcacgacgtcacggccgcggcttttattgttctcgtggaattactttttgccatcacatctggagaaagagcggcctccgctccacgacaggaatctcacaactttgcaaagggatgcgcggaattctacggaagcggcgcgagggcgcagcccggagggccctgctgggcccaggggcctcctggccgccttcccgacccgatccctcttcccacacgcgccccgcgaacgtcggccggactcgcaggggtcggaagcggcgcgcccggagagccggcggagccgggcagggctcgcgccccgcggtccgctccgagtagccgcgagccccgccagacaaagaggcgcgtcgggtcccgggcgcgggtaagggacgcagaggcgcgggcagggcggcgcgccagcctcggcccgcagggggcgccgtccgtggccccagccccggtccttacctttgaggaccgagcagagccgctccagggccatgt

SEQ ID NO: 56737 - DNA, 158 bp, Homo sapiens
  chr16:47177606-47177764
  hyper
ggccccactccgtccccatcgccggccagcagctgcctccccgctcccctgaggagagctcaggtcctgcggcccgccatgcccgagccccacagtgggctcccgcgcggcccgagcaccccgacgggcgccgcctcctgctccgcggcgccccgtcc

SEQ ID NO: 56738 - DNA, 31 bp, Homo sapiens; identical to SEQ ID NO: 36129
  chr16:47177824-47177855
  hyper

SEQ ID NO: 56739 - DNA, 33 bp, Homo sapiens; identical to SEQ ID NO: 36130
  chr16:47178260-47178293
  hyper

SEQ ID NO: 56740 - DNA, 9 bp, Homo sapiens
  chr16:48845125-48845134
  hyper
tctgccctc

SEQ ID NO: 56741 - DNA, 62 bp, Homo sapiens; identical to SEQ ID NO: 22286
  chr16:49309108-49309170
  hyper

SEQ ID NO: 56742 - DNA, 197 bp, Homo sapiens
  chr16:49309262-49309459
  hyper
ctccgcagacagcagacaccacagtgatcaccctcggctcctcgcctgcgcggctcccggggcgcttagcgcggtgtggagaacccgggcggagaagccaggtctgggcttgttgggtcctagaagcctccctgagttcccctcacagtacctttaagcctggctgggtgccggaaacgctgcgcagaataggaaac

SEQ ID NO: 56743 - DNA, 78 bp, Homo sapiens
  chr16:49311445-49311523
  hyper
tatctctgtgggtcccggaggcacagggctgcaagggcgcccgctagagctgctccacggcttaccggattgcatgcg

SEQ ID NO: 56744 - DNA, 232 bp, Homo sapiens
  chr16:49312299-49312531
  hyper
gccctcgcgcccaggcctttctatggttgcgttcccccaagtctcctgcctttcggaacctcgccctttggcaccccagacccccaacctcgcagctggggaagatgcggattttagaaagctgtttcagaaaaataaaagtcccacttcgactttattagattaaagcaaaattaaaccttgactattcacacgtatgttacagaggaagaggaggcgtccggaagaagct

SEQ ID NO: 56745 - DNA, 157 bp, Homo sapiens
  chr16:49313206-49313363
  hyper
taggaagtttcaagtcgtgctgctttctcgccctcttaatttcagcctctttctcactccccttcctgccttcgccctctccctgcctcccttccggctacgagccagtcagagaggaaacaccaggaatccggagaaggtcgagtacttccagccc

SEQ ID NO: 56746 - DNA, 312 bp, Homo sapiens
  chr16:49313710-49314022
  hyper
ctgggtgacaggaagggcctgtccccaaaacgggagttgctcttattccagtttctcaaatgagcgcgccaagcgaatctcgactgtgctctgtgatccaatttaataaacccatgaggtggctctagcgccctgagacctttgacctctctcccgtttcccctcagcctcaaaaaacaaacaacaaacaaaaaaaacccagcaactcaggctccttctggcgctaccggaaaaacaaaaacgaacaaacaaaaagcccctgatccctcctggacccagctgccaggacacagtggagaagccactgtgatt

SEQ ID NO: 56747 - DNA, 301 bp, Homo sapiens; identical to SEQ ID NO: 22290
  chr16:49314118-49314419
  hyper

SEQ ID NO: 56748 - DNA, 223 bp, Homo sapiens
  chr16:49314561-49314784
  hyper
cctgaaatccagggaacccttcggagaggcccggaaggcagaagcagaaaattctgtctctcgggggatggggctggatcccaagagccagagacagggaaagcagaggacagttgaagccacagaactgagaggccccgctatctgtccctccaagcagcccgaagtacatgcagccgccacttctgcctaccacctccggacagcccgagcacccctgagg

SEQ ID NO: 56749 - DNA, 204 bp, Homo sapiens
  chr16:49315072-49315276
  hyper
ccagcccaatctgcacgccgcgggaggaaggaacactcacctggtcgaagtagatgatcatggtgcgattactcatctcggacggctcgtggttggtgctcctgatggcagagaaagccaccttggcgctgccagagcgcacagagatgcccagggcagtgcccgtggggtcggacgtggggttggagtcgcacaccaccaggc

SEQ ID NO: 56750 - DNA, 613 bp, Homo sapiens
  chr16:49315306-49315919
  hyper
cattctgcccgcgggccgggcccgccagccacgcagcccccagcagcagcagctccaggacgcccagcatcgcgccgccggcgcccaccccgccccccacccccagggctgctcgcgccagccgccccccccgtcccagtcccgctccgaagccccctcctcagctccgtgcgcagctccgccgccgccgctctggacactacacctcttcctcgcactccgggactagcgtcccctccgcgactagcgtcccctccgcgctgtgttcccggagcccctcccgggcctcaggggtgccgcggctgcccagccgcacttggatgcatagccgctgctgctcggtcccgctgctgccgccgcctcctgcccgcacccgccgctgccgccgccgccgccgctctgaattattgatgcagccggcgctgcagccggagcgggcggagagcgcgcgccgggcacaaaggcgcggacctcggcctggccccgcccccgccgcctcccggcccgcctccctccgaggccctgcccccgccccggccgaggccacgccccccagccaatcctgacgcgccgcgctccccaccgagccaatggcggcgctgtccgcgctcgg

SEQ ID NO: 56751 - DNA, 43 bp, Homo sapiens
  chr16:49316580-49316623
  hyper
gggagatcattgaacccctacggagtaccgggtactgggccgg

SEQ ID NO: 56752 - DNA, 49 bp, Homo sapiens; identical to SEQ ID NO: 36138
  chr16:49317153-49317202
  hyper

SEQ ID NO: 56753 - DNA, 35 bp, Homo sapiens; identical to SEQ ID NO: 12458
  chr16:49317700-49317735
  hyper

SEQ ID NO: 56754 - DNA, 30 bp, Homo sapiens; identical to SEQ ID NO: 36140
  chr16:50699376-50699406
  hyper

SEQ ID NO: 56755 - DNA, 96 bp, Homo sapiens; identical to SEQ ID NO: 36141
  chr16:51167714-51167810
  hyper

SEQ ID NO: 56756 - DNA, 18 bp, Homo sapiens
  chr16:51184406-51184424
  hyper
tggcggccagcagcactc

SEQ ID NO: 56757 - DNA, 112 bp, Homo sapiens
  chr16:51184695-51184807
  hyper
gcggtcaggccggggcgacctccacccgcacccacgcctcatggggctcccgggtcttggccgcggctgggatccccggaaaagcagggacggagaagccaggccggcatgc

SEQ ID NO: 56758 - DNA, 302 bp, Homo sapiens; identical to SEQ ID NO: 22295
  chr16:51185542-51185844
  hyper

SEQ ID NO: 56759 - DNA, 49 bp, Homo sapiens
  chr16:51186280-51186329
  hyper
cggcccggctccgcccaggacccctcccggacctcccccccggctgccc

SEQ ID NO: 56760 - DNA, 188 bp, Homo sapiens
  chr16:51186939-51187127
  hyper
aactaaacttcggctgagtaatgggggaggaggggggtgcagatacacaatccctgccctatctcacgatcaggaaaggagagggctcataaggacgccccaattcgcgagcgcccttgagtctggccggtgccacggtcggttcgcgcgaagtgggcaccggtctcccgagccgacttcgtgtactc

SEQ ID NO: 56761 - DNA, 134 bp, Homo sapiens; identical to SEQ ID NO: 36149
  chr16:51187416-51187550
  hyper

SEQ ID NO: 56762 - DNA, 79 bp, Homo sapiens; identical to SEQ ID NO: 36150
  chr16:51189282-51189361
  hyper

SEQ ID NO: 56763 - DNA, 49 bp, Homo sapiens; identical to SEQ ID NO: 36153
  chr16:54317177-54317226
  hyper

SEQ ID NO: 56764 - DNA, 80 bp, Homo sapiens; identical to SEQ ID NO: 36154
  chr16:54318670-54318750
  hyper

SEQ ID NO: 56765 - DNA, 43 bp, Homo sapiens; identical to SEQ ID NO: 22299
  chr16:54319377-54319420
  hyper

SEQ ID NO: 56766 - DNA, 77 bp, Homo sapiens
  chr16:54319468-54319545
  hyper
ggcagccgcggccggatgctgcaccccggggctgtccttcagctcatactgcgcgccctgtacgcacatggagaagg

SEQ ID NO: 56767 - DNA, 47 bp, Homo sapiens; identical to SEQ ID NO: 36157
  chr16:54320739-54320786
  hyper

SEQ ID NO: 56768 - DNA, 30 bp, Homo sapiens; identical to SEQ ID NO: 36158
  chr16:54321354-54321384
  hyper

SEQ ID NO: 56769 - DNA, 83 bp, Homo sapiens
  chr16:54628867-54628950
  hyper
tccccacccccgccgcccacccgccctcaggttttaaatttggaagatattgtggaaatggacaaactcgcctttgcctgctg

SEQ ID NO: 56770 - DNA, 34 bp, Homo sapiens; identical to SEQ ID NO: 36162
  chr16:54962651-54962685
  hyper

SEQ ID NO: 56771 - DNA, 33 bp, Homo sapiens; identical to SEQ ID NO: 36163
  chr16:54963623-54963656
  hyper

SEQ ID NO: 56772 - DNA, 44 bp, Homo sapiens; identical to SEQ ID NO: 36164
  chr16:54964141-54964185
  hyper

SEQ ID NO: 56773 - DNA, 21 bp, Homo sapiens
  chr16:54965114-54965135
  hyper
cctatccgcagggctacttgt

SEQ ID NO: 56774 - DNA, 38 bp, Homo sapiens
  chr16:54966792-54966830
  hyper
cgaccccgagggccccgaagcaggttggtggacatggg

SEQ ID NO: 56775 - DNA, 95 bp, Homo sapiens; identical to SEQ ID NO: 36168
  chr16:54971471-54971566
  hyper

SEQ ID NO: 56776 - DNA, 46 bp, Homo sapiens; identical to SEQ ID NO: 36169
  chr16:54972930-54972976
  hyper

SEQ ID NO: 56777 - DNA, 129 bp, Homo sapiens; identical to SEQ ID NO: 36171
  chr16:55357444-55357573
  hyper

SEQ ID NO: 56778 - DNA, 315 bp, Homo sapiens
  chr16:55357611-55357926
  hyper
cggagcgcaggggctgcagcccggaccgggagccttcttcaggctccctggctgccccgcggccactgcgggaggcgcgcgcgcgaggcagccaagccttgccttcggaggagatgcccagggatcttagcaagcagcctgcggctgccagggatcggacctggcgagtttcccgacggaatctgagggatcccgaacctcggcctcgagggggcgctatccggcctactcgaggaccaggcagctgcagagaagctccaaggtcaaggccctgggccaggccagggcttggagagccggaatctagcccgagtc

SEQ ID NO: 56779 - DNA, 230 bp, Homo sapiens; identical to SEQ ID NO: 22305
  chr16:55358086-55358316
  hyper

SEQ ID NO: 56780 - DNA, 110 bp, Homo sapiens; identical to SEQ ID NO: 36174
  chr16:55358566-55358676
  hyper

SEQ ID NO: 56781 - DNA, 14 bp, Homo sapiens
  chr16:55358784-55358798
  hyper
cggaccccacgggc

SEQ ID NO: 56782 - DNA, 54 bp, Homo sapiens
  chr16:55359071-55359125
  hyper
taggggacagactgggtggagggagtgcctagtgcacggcgcctgcctctgatc

SEQ ID NO: 56783 - DNA, 27 bp, Homo sapiens
  chr16:55362982-55363009
  hyper
ggtgcacccccagcccggcctaggcca

SEQ ID NO: 56784 - DNA, 33 bp, Homo sapiens
  chr16:55363223-55363256
  hyper
gtagtgggcccccagcggcgctgggagtatcta

SEQ ID NO: 56785 - DNA, 260 bp, Homo sapiens; identical to SEQ ID NO: 22306
  chr16:55364843-55365103
  hyper

SEQ ID NO: 56786 - DNA, 27 bp, Homo sapiens
  chr16:55365434-55365461
  hyper
cgtttccaacgccgggtcccggccagg

SEQ ID NO: 56787 - DNA, 27 bp, Homo sapiens
  chr16:55404972-55404999
  hyper
tctttgagcatcaaacgtgtcctcctt

SEQ ID NO: 56788 - DNA, 19 bp, Homo sapiens
  chr16:55512935-55512954
  hyper
cggccggggaaaagaggtg

SEQ ID NO: 56789 - DNA, 138 bp, Homo sapiens; identical to SEQ ID NO: 12486
  chr16:55513226-55513364
  hyper

SEQ ID NO: 56790 - DNA, 57 bp, Homo sapiens; identical to SEQ ID NO: 36183
  chr16:55513482-55513539
  hyper

SEQ ID NO: 56791 - DNA, 251 bp, Homo sapiens; identical to SEQ ID NO: 36184
  chr16:55514076-55514327
  hyper

SEQ ID NO: 56792 - DNA, 197 bp, Homo sapiens
  chr16:55689918-55690115
  hyper
ccgcgccctgccggccgccccgcgcctccagctcttccccggccccgcccgaacgccacacggcggagcccagccccagcccgcgccctagagcctgccaaggcgccgccggtcgggggccggcagggcgcaaggcaccagggatcccctcgccgccggacacgtgagtgcgccctgagcgcgggacagggctaggt

SEQ ID NO: 56793 - DNA, 40 bp, Homo sapiens
  chr16:56224517-56224557
  hyper
cctgtccctccactccgggcaccctggcctccccagggtg

SEQ ID NO: 56794 - DNA, 113 bp, Homo sapiens; identical to SEQ ID NO: 36191
  chr16:56224880-56224993
  hyper

SEQ ID NO: 56795 - DNA, 490 bp, Homo sapiens; identical to SEQ ID NO: 36192
  chr16:56225199-56225689
  hyper

SEQ ID NO: 56796 - DNA, 45 bp, Homo sapiens; identical to SEQ ID NO: 36193
  chr16:56226280-56226325
  hyper

SEQ ID NO: 56797 - DNA, 1 bp, Homo sapiens
  chr16:56228369-56228370
  hyper
g

SEQ ID NO: 56798 - DNA, 10 bp, Homo sapiens
  chr16:56228581-56228591
  hyper
gaggggagtg

SEQ ID NO: 56799 - DNA, 215 bp, Homo sapiens; identical to SEQ ID NO: 36196
  chr16:56623169-56623384
  hyper

SEQ ID NO: 56800 - DNA, 202 bp, Homo sapiens; identical to SEQ ID NO: 36197
  chr16:56623667-56623869
  hyper

SEQ ID NO: 56801 - DNA, 47 bp, Homo sapiens; identical to SEQ ID NO: 22317
  chr16:56651275-56651322
  hyper

SEQ ID NO: 56802 - DNA, 47 bp, Homo sapiens; identical to SEQ ID NO: 22318
  chr16:56659128-56659175
  hyper

SEQ ID NO: 56803 - DNA, 101 bp, Homo sapiens
  chr16:56659673-56659774
  hyper
cagccagttgcagggctccattctgctttccaactgcctgactgcttgttcgtctcactggtgtgagctccagcatcccctttgctcgaaatggaccccaa

SEQ ID NO: 56804 - DNA, 549 bp, Homo sapiens; identical to SEQ ID NO: 36200
  chr16:56665957-56666506
  hyper

SEQ ID NO: 56805 - DNA, 374 bp, Homo sapiens; identical to SEQ ID NO: 36204
  chr16:56677138-56677512
  hyper

SEQ ID NO: 56806 - DNA, 52 bp, Homo sapiens; identical to SEQ ID NO: 36205
  chr16:56701956-56702008
  hyper

SEQ ID NO: 56807 - DNA, 23 bp, Homo sapiens
  chr16:56709814-56709837
  hyper
cagcatagcccctcccgcacgag

SEQ ID NO: 56808 - DNA, 19 bp, Homo sapiens
  chr16:56710030-56710049
  hyper
accacgcctcccacctgcc

SEQ ID NO: 56809 - DNA, 69 bp, Homo sapiens
  chr16:58018565-58018634
  hyper
tcgcaacaggtaccacgagggaaagctggcgcccatcgcgccaggcatcaaccgagtggactggccctg

SEQ ID NO: 56810 - DNA, 380 bp, Homo sapiens
  chr16:58018845-58019225
  hyper
gtggcacttgcggtgggtggagccgagacgtgcgcgcggatctggaggcaggactgcccttggggagggggcggagccaggcggagccttcgggccgggggctttgccctggtggggcagcggaggcgggacctgttctccgtacacgtgtgggtggggctggattgtgggcggggctggattgtgggcggggcttagatgaggaggcggggcttgtcctgggggggggcggatgagcgctcgagaggggctttctgttcgcagcggagggtctcagcggctacgcggtgcggtacttgaagcccgacgtgacccagacctggcgggtagggagcgctgcgcgcagacccgtccctgagcggggagcgggggtcctggtg

SEQ ID NO: 56811 - DNA, 54 bp, Homo sapiens
  chr16:58019430-58019484
  hyper
cccctgcctttcgactccctgtaagtgacgccacgcgcccggggaccccatatc

SEQ ID NO: 56812 - DNA, 7 bp, Homo sapiens
  chr16:58497214-58497221
  hyper
tctaaac

SEQ ID NO: 56813 - DNA, 283 bp, Homo sapiens
  chr16:58497469-58497752
  hyper
cgcggtccgtccgggactagccccaggcccggcaccgccccgcgggccgagcgcccacacccgccaaacccacgcgggcacgcccccgcggcgcaccgcccccagcccggcctccgcccctgcagccgcgggcacgcggaggggctcctggctgcccgcacctgcacccgcgcgtcggcggcgccgaagccccgctccccgcctgcgcgtctgtctcgtccgcatctccgcggtgagtcggcggcgccctcgcccctgagcccagggccagcttctctcgccg

SEQ ID NO: 56814 - DNA, 346 bp, Homo sapiens
  chr16:58497829-58498175
  hyper
ccgcgagtcccgcaccgactcgctcccgccccatttcgcctccgcgggggcggcgccccctcctccccgcggctcccgctctccttcctcgccttcccggccgcgctggggacccccagccgccgtccgcgaccccccaccgcgacgcccggaggcggcggggtctctttgttcgggcggcgggcacgggggaccacctcccacggtgtcaccgcacccaccccgcgcccttcctccgcctcctggagttcaccgggaccaggtggcggcgggtgcctttttgggggtgcgcggccatgcaattggtggatttttttaaaccgttttggaggggggagcgcggcgt

SEQ ID NO: 56815 - DNA, 366 bp, Homo sapiens; identical to SEQ ID NO: 22331
  chr16:58498204-58498570
  hyper

SEQ ID NO: 56816 - DNA, 30 bp, Homo sapiens; identical to SEQ ID NO: 36212
  chr16:58499185-58499215
  hyper

SEQ ID NO: 56817 - DNA, 31 bp, Homo sapiens
  chr16:62068517-62068548
  hyper
cccccagatatcatgacgccaggtgaaagaa

SEQ ID NO: 56818 - DNA, 75 bp, Homo sapiens; identical to SEQ ID NO: 36214
  chr16:62069009-62069084
  hyper

SEQ ID NO: 56819 - DNA, 138 bp, Homo sapiens; identical to SEQ ID NO: 12513
  chr16:62069136-62069274
  hyper

SEQ ID NO: 56820 - DNA, 35 bp, Homo sapiens; identical to SEQ ID NO: 12514
  chr16:62069336-62069371
  hyper

SEQ ID NO: 56821 - DNA, 13 bp, Homo sapiens
  chr16:62070773-62070786
  hyper
taggaggaagagg

SEQ ID NO: 56822 - DNA, 126 bp, Homo sapiens
  chr16:65155091-65155217
  hyper
acaaacgggcgccagagctcccgcagagactcgggctggagggctgtagcgcaccgcagcctgctgccccagaaccacagtcggcggccccaaacccacgctattaaagtgcgggcaatctccttc

SEQ ID NO: 56823 - DNA, 648 bp, Homo sapiens
  chr16:65155737-65156385
  hyper
gaagccccaaccaggcgagaggaagggactggcggcgcacctcacctggggcccttgagggtggacgcaacctccgagccgccagtccctggcgcagggcaagcgctgcggtgtcagtcccggccccagtcccggtcccattcacaagtcagcggcggctgcgagcggcccccgcggcatctgctcctcggcccgcgacgctcccctcagctggcggcggccgcggaatgagccgccgagcgcgctagtggcaggaatgagaaaccggggggaggtggcgggcgggcaggcgggtgcggggcggggggggcgggaggagggaggctgccgctgtgagggaaggaaagggcgggggctgagagaagccgaggctgcgagaggcagcgagatgggcctcgcagaggctgcgggggccgaccccgtccgcgcccctccccccaggggcccagagatgctaacccctggattcgtggccgcccctcccgccccgtggcgcggcgctccgactccctcagggctcagatggagtctggagcgactgaagttgggctccagggacgcacagccaatcagggagggcggcggagggaagctggagaggggttgggagcccccattttcctccttcccccaaatccgctccagctg

SEQ ID NO: 56824 - DNA, 173 bp, Homo sapiens
  chr16:65156489-65156662
  hyper
cactccaccaccccaccttccaaaaatccctcaacgttggcggctcctgcccagcccccacccctctcaatctcccatcccttgcaaactcttctggtggctctggtggtgaagtcgggcggggagggagacttaggacttgggaagagcccagtctccgttctctctcagct

SEQ ID NO: 56825 - DNA, 23 bp, Homo sapiens
  chr16:65156872-65156895
  hyper
aagggcctaatggggcgcagcgc

SEQ ID NO: 56826 - DNA, 347 bp, Homo sapiens; identical to SEQ ID NO: 36221
  chr16:65156939-65157286
  hyper

SEQ ID NO: 56827 - DNA, 15 bp, Homo sapiens
  chr16:65157823-65157838
  hyper
gtaaccccccaacct

SEQ ID NO: 56828 - DNA, 15 bp, Homo sapiens
  chr16:65157863-65157878
  hyper
cgcgaggacattgac

SEQ ID NO: 56829 - DNA, 275 bp, Homo sapiens
  chr16:66461511-66461786
  hyper
cggagcgggatcccgggtctcccgcggaccctcgaccccgggctggccactgggatctgcgcgagccgaggctgaccctgatcgcgccctcgggcctcggggaaggggaggtatccaggttttctgcctgactcgagtccccgacgagcatcaaccgcatttggggaacccaagacagcctccccagcagcttgccctcggtttcggggacccctgaacaacccaaccaagaagggaaaactagggcgcactctcggtcggggtgggagaggaaa

SEQ ID NO: 56830 - DNA, 149 bp, Homo sapiens
  chr16:66461840-66461989
  hyper
taggaagtttgacccttcgacgagcaggtcgcctggggtatgcccctgtctccgtgcctctgtctcagcaccgagcgtcggagagagagcgcgccctccgcaccttctcccactttgggacagactttcccttgcgctgtcagagggac

SEQ ID NO: 56831 - DNA, 148 bp, Homo sapiens
  chr16:66612734-66612882
  hyper
ccctgtgtctcacagcggtaatcgtgtgttgcatcgatgcgtttgtggtcaccacgaagatgaggaccaacttgaaaagattcctgggagtcgaagttgaaaggaagctttcccccgccaaggacgcctaccccgaaaccggccccga

SEQ ID NO: 56832 - DNA, 175 bp, Homo sapiens; identical to SEQ ID NO: 36226
  chr16:66638277-66638452
  hyper

SEQ ID NO: 56833 - DNA, 85 bp, Homo sapiens; identical to SEQ ID NO: 36227
  chr16:66878235-66878320
  hyper

SEQ ID NO: 56834 - DNA, 106 bp, Homo sapiens; identical to SEQ ID NO: 12525
  chr16:66878819-66878925
  hyper

SEQ ID NO: 56835 - DNA, 39 bp, Homo sapiens; identical to SEQ ID NO: 36229
  chr16:66958838-66958877
  hyper

SEQ ID NO: 56836 - DNA, 178 bp, Homo sapiens; identical to SEQ ID NO: 36230
  chr16:67184208-67184386
  hyper

SEQ ID NO: 56837 - DNA, 68 bp, Homo sapiens; identical to SEQ ID NO: 36231
  chr16:67189168-67189236
  hyper

SEQ ID NO: 56838 - DNA, 81 bp, Homo sapiens
  chr16:67197617-67197698
  hyper
ccactcggtgctggacgccttccgcgcgcactgcccgcgcctgcgcacctataccctcaagctcacgcgcgagccgcatcc

SEQ ID NO: 56839 - DNA, 240 bp, Homo sapiens; identical to SEQ ID NO: 22345
  chr16:67197769-67198009
  hyper

SEQ ID NO: 56840 - DNA, 243 bp, Homo sapiens
  chr16:67198039-67198282
  hyper
cctcaagggtgagtgtgaaataaacaaatcctgcagtgtttctgcgtcctattaaaggcggggtcggatctgaaagggaaggacagggaacgcgcggggtaccggaggagccatcccggcagaggttgggtttcctcaagagcctctggacgacacagctgcggggggtcagggtcggggcactcacacccttggaatgactacgtcccggggttcggcgggagggggcgtgcttccctgccc

SEQ ID NO: 56841 - DNA, 360 bp, Homo sapiens
  chr16:67198557-67198917
  hyper
gtccgagccccgccccgcgggcttgcacgtggcccccgcctgacccggcgccccggggcggagtagggcggagcgggcggcaaacgcagcactttccgcggctttgacgagcccgcagcggccgggcccgagcgcagagccgggccgagactgcaccatgcaggaagcgccagctgcgctgcccacggagccaggccccagccccgtgcctgccttcctcggcaagctatgggcgctggtgggggacccaggcacagaccacctgatccgctggagcccggtgagggccggggcccctcgattccccctgtggtcccggggtccctccacgtcagtgaacacccatgcccgcccaacccc

SEQ ID NO: 56842 - DNA, 146 bp, Homo sapiens; identical to SEQ ID NO: 36234
  chr16:67199375-67199521
  hyper

SEQ ID NO: 56843 - DNA, 44 bp, Homo sapiens; identical to SEQ ID NO: 36235
  chr16:67360535-67360579
  hyper

SEQ ID NO: 56844 - DNA, 30 bp, Homo sapiens; identical to SEQ ID NO: 36236
  chr16:67427344-67427374
  hyper

SEQ ID NO: 56845 - DNA, 40 bp, Homo sapiens; identical to SEQ ID NO: 36237
  chr16:67433365-67433405
  hyper

SEQ ID NO: 56846 - DNA, 30 bp, Homo sapiens; identical to SEQ ID NO: 36238
  chr16:67572408-67572438
  hyper

SEQ ID NO: 56847 - DNA, 63 bp, Homo sapiens; identical to SEQ ID NO: 36239
  chr16:67679073-67679136
  hyper

SEQ ID NO: 56848 - DNA, 103 bp, Homo sapiens; identical to SEQ ID NO: 36240
  chr16:67700928-67701031
  hyper

SEQ ID NO: 56849 - DNA, 99 bp, Homo sapiens; identical to SEQ ID NO: 36241
  chr16:67877035-67877134
  hyper

SEQ ID NO: 56850 - DNA, 45 bp, Homo sapiens; identical to SEQ ID NO: 12529
  chr16:68118410-68118455
  hyper

SEQ ID NO: 56851 - DNA, 156 bp, Homo sapiens; identical to SEQ ID NO: 36243
  chr16:68118759-68118915
  hyper

SEQ ID NO: 56852 - DNA, 224 bp, Homo sapiens; identical to SEQ ID NO: 36244
  chr16:68504068-68504292
  hyper

SEQ ID NO: 56853 - DNA, 65 bp, Homo sapiens
  chr16:68544194-68544259
  hyper
cggcccggacacccacgggccaccgcgtcgaggcagcgcgagccccgggcgccccctgcaggttg

SEQ ID NO: 56854 - DNA, 48 bp, Homo sapiens; identical to SEQ ID NO: 22352
  chr16:68676360-68676408
  hyper

SEQ ID NO: 56855 - DNA, 55 bp, Homo sapiens
  chr16:68676984-68677039
  hyper
taattcaggggatgtggggatgctagaaagagagacggctcgccagacatctgag

SEQ ID NO: 56856 - DNA, 99 bp, Homo sapiens; identical to SEQ ID NO: 36248
  chr16:68679959-68680058
  hyper

SEQ ID NO: 56857 - DNA, 26 bp, Homo sapiens
  chr16:68771298-68771324
  hyper
ctcggcgtccccggccagccatgggc

SEQ ID NO: 56858 - DNA, 71 bp, Homo sapiens
  chr16:71459956-71460027
  hyper
cgtgcttgccggttcttgccaccctccgccgcttgcaccggacccaggcgctcatcccccgcttcccccgc

SEQ ID NO: 56859 - DNA, 166 bp, Homo sapiens
  chr16:71460351-71460517
  hyper
gcaggcattttcttacaggaggtagcaagcttgtctaagcagaggccctcttagcgcagtgggcagcgcgtcagtctcataatctgaaggtcctgagttcgagcctcagagagggcagctgttttgttgtgctacgaatgcagcaaatgttcggatgtaacccagc

SEQ ID NO: 56860 - DNA, 28 bp, Homo sapiens
  chr16:73100271-73100299
  hyper
cggagccagcgtgcgcgtccctaatgcc

SEQ ID NO: 56861 - DNA, 7 bp, Homo sapiens
  chr16:73100575-73100582
  hyper
cgcccca

SEQ ID NO: 56862 - DNA, 107 bp, Homo sapiens; identical to SEQ ID NO: 36254
  chr16:75528762-75528869
  hyper

SEQ ID NO: 56863 - DNA, 412 bp, Homo sapiens; identical to SEQ ID NO: 36255
  chr16:75528922-75529334
  hyper

SEQ ID NO: 56864 - DNA, 41 bp, Homo sapiens; identical to SEQ ID NO: 36256
  chr16:76311161-76311202
  hyper

SEQ ID NO: 56865 - DNA, 65 bp, Homo sapiens; identical to SEQ ID NO: 36257
  chr16:77246006-77246071
  hyper

SEQ ID NO: 56866 - DNA, 623 bp, Homo sapiens; identical to SEQ ID NO: 36258
  chr16:77246307-77246930
  hyper

SEQ ID NO: 56867 - DNA, 59 bp, Homo sapiens; identical to SEQ ID NO: 36260
  chr16:77469028-77469087
  hyper

SEQ ID NO: 56868 - DNA, 266 bp, Homo sapiens; identical to SEQ ID NO: 36261
  chr16:77822153-77822419
  hyper

SEQ ID NO: 56869 - DNA, 169 bp, Homo sapiens; identical to SEQ ID NO: 22359
  chr16:77822420-77822589
  hyper

SEQ ID NO: 56870 - DNA, 273 bp, Homo sapiens
  chr16:77822874-77823147
  hyper
gggaaagctgcggctgggatgctgcccgggtagaaccgccgcgcgcaccccctccgcgccctcacccgggtctcagagcctccccgggccaaagctggggaggatgcagaggggcggcctccccaagccagatctaggggtgacgggaggagaatgtgagctcctgggcgcggggagaatgctggcgcccaggcaccccgggtctggaagattgcgctacgggagttctccgtctgagaggacaactcagctttcgcacgggagggttgatgc

SEQ ID NO: 56871 - DNA, 184 bp, Homo sapiens
  chr16:78079785-78079969
  hyper
ggggagcggctacagcgcgggatcctggggagatagctcaaggcaggccagggaaggacaggccgggcaatgggcgcggagacgaaggggccggacagcggcgaggcgctggctccggtcgcggcacccggctgctgagggcagtgctgctgcttgggacgttccaggcgaccaagtaccctcg

SEQ ID NO: 56872 - DNA, 105 bp, Homo sapiens
  chr16:78080054-78080159
  hyper
ctgaagtgttggccgcgagcggagctgctgcagcgctggcttccccgggccgctgcgggtggacttggacaacataaagggctgattgagcggggccactttttc

SEQ ID NO: 56873 - DNA, 167 bp, Homo sapiens; identical to SEQ ID NO: 36265
  chr16:79632650-79632817
  hyper

SEQ ID NO: 56874 - DNA, 95 bp, Homo sapiens; identical to SEQ ID NO: 36266
  chr16:79633073-79633168
  hyper

SEQ ID NO: 56875 - DNA, 59 bp, Homo sapiens; identical to SEQ ID NO: 36267
  chr16:79633469-79633528
  hyper

SEQ ID NO: 56876 - DNA, 51 bp, Homo sapiens; identical to SEQ ID NO: 36268
  chr16:79633792-79633843
  hyper

SEQ ID NO: 56877 - DNA, 30 bp, Homo sapiens; identical to SEQ ID NO: 36269
  chr16:79634970-79635000
  hyper

SEQ ID NO: 56878 - DNA, 32 bp, Homo sapiens; identical to SEQ ID NO: 36270
  chr16:79635617-79635649
  hyper

SEQ ID NO: 56879 - DNA, 58 bp, Homo sapiens; identical to SEQ ID NO: 36271
  chr16:79804242-79804300
  hyper

SEQ ID NO: 56880 - DNA, 369 bp, Homo sapiens; identical to SEQ ID NO: 36272
  chr16:80574670-80575039
  hyper

SEQ ID NO: 56881 - DNA, 30 bp, Homo sapiens; identical to SEQ ID NO: 36274
  chr16:81779906-81779936
  hyper

SEQ ID NO: 56882 - DNA, 30 bp, Homo sapiens; identical to SEQ ID NO: 36275
  chr16:81813567-81813597
  hyper

SEQ ID NO: 56883 - DNA, 48 bp, Homo sapiens
  chr16:82660312-82660360
  hyper
tggccgccagtcccccgtgcaattccattctctggaaaagtggaatca

SEQ ID NO: 56884 - DNA, 72 bp, Homo sapiens
  chr16:82660496-82660568
  hyper
aaggaatccgtcttgtaaagccattggtcctggtcatcagcctctacccaatgctttcgtgatgctgctgct

SEQ ID NO: 56885 - DNA, 124 bp, Homo sapiens; identical to SEQ ID NO: 36277
  chr16:82660780-82660904
  hyper

SEQ ID NO: 56886 - DNA, 161 bp, Homo sapiens; identical to SEQ ID NO: 36278
  chr16:82661251-82661412
  hyper

SEQ ID NO: 56887 - DNA, 292 bp, Homo sapiens; identical to SEQ ID NO: 36279
  chr16:82661468-82661760
  hyper

SEQ ID NO: 56888 - DNA, 30 bp, Homo sapiens; identical to SEQ ID NO: 36280
  chr16:84001873-84001903
  hyper

SEQ ID NO: 56889 - DNA, 52 bp, Homo sapiens; identical to SEQ ID NO: 36281
  chr16:84402140-84402192
  hyper

SEQ ID NO: 56890 - DNA, 125 bp, Homo sapiens; identical to SEQ ID NO: 36282
  chr16:84633325-84633450
  hyper

SEQ ID NO: 56891 - DNA, 285 bp, Homo sapiens
  chr16:84853376-84853661
  hyper
agccggccctggaggccagcggccccgccttcctcgcccacccggcgcccgcgcctcagctgccccccgcctccttcagcccgctgagcctgcggggcggggccgggggcggggccggtgatgctcggtcctaccagcgccgccagcgatctgggggcgtggcctccgggctccggggagcctacaagaggcggtacgctgagccccggcacccactcgcatcccagggcgtctccggctgctcctattgagctgtctgctcgctgtgcccgctgtgcctgctgt

SEQ ID NO: 56892 - DNA, 183 bp, Homo sapiens; identical to SEQ ID NO: 36284
  chr16:85203399-85203582
  hyper

SEQ ID NO: 56893 - DNA, 360 bp, Homo sapiens; identical to SEQ ID NO: 36285
  chr16:85932306-85932666
  hyper

SEQ ID NO: 56894 - DNA, 1 bp, Homo sapiens
  chr16:85932667-85932668
  hyper
c

SEQ ID NO: 56895 - DNA, 159 bp, Homo sapiens
  chr16:85932669-85932828
  hyper
cgagccaagctgacgctattggtcggtgtggccgtcgctctgcgcaccgcccgtcccccccacgaccctttttaaggccgcgcgaccgctggcgcatcgcctggagcgcggcagcaagcgtgggaacgcgggcggcgagacggcggcaggacggcggca

SEQ ID NO: 56896 - DNA, 115 bp, Homo sapiens
  chr16:85932858-85932973
  hyper
tgtcccgcgcggtccggtcccgcggggtccccgacgccaggcggggcgtgggggtggaactacctaccgtaatgtccccgggcgcagctcagtggccacccgtgtccctctctgc

SEQ ID NO: 56897 - DNA, 30 bp, Homo sapiens; identical to SEQ ID NO: 36288
  chr16:86081925-86081955
  hyper

SEQ ID NO: 56898 - DNA, 70 bp, Homo sapiens
  chr16:86320284-86320354
  hyper
gggctccagaaaccccgaccctcgcaggggagagccagccgaaccagacgtgtgggggcagcagccgccg

SEQ ID NO: 56899 - DNA, 98 bp, Homo sapiens
  chr16:86320391-86320489
  hyper
ttgggtccagggacccaagacggggatctgggaggagggggatgcccttggggcctgagacccgggcggtttccgaagcgaagtagttacccagaacc

SEQ ID NO: 56900 - DNA, 265 bp, Homo sapiens
  chr16:86320490-86320755
  hyper
ctccctaccttctccccgcctccctgtctttctgcccctctgtcccctgcagctgctcggccctccctcctctgaaacccaccgcccgcccaaggctcactccttcctgctgttcccgcccgcgaagctgttgcagggacggtgcgcccttgggctgcactcaccaccgcccctcgcccgcgacgtcctggccccctaaccccagctttcccgccgccgctcactcccgcgctccgctgcagctcagcccggtctgcaactctcc

SEQ ID NO: 56901 - DNA, 220 bp, Homo sapiens
  chr16:86320800-86321020
  hyper
caggcttccctctcctcctccttctgcctctcccctgtccccgttccattctcctgcgcccctcgccagcgcgctcgcagcccatcggctcctgccggggcccctctggtgccagccgccttcaggctgtgggtccgtccgctggtggaggggaaggtcggggctggccccgggccccgcgctgctgggccccatggtcagtggagacgcctcctggtct

SEQ ID NO: 56902 - DNA, 243 bp, Homo sapiens; identical to SEQ ID NO: 22372
  chr16:86531046-86531289
  hyper

SEQ ID NO: 56903 - DNA, 52 bp, Homo sapiens
  chr16:86531573-86531625
  hyper
gtccctcccgccgcgcagggtctccgcgggcgcgccccgccccaaatagagc

SEQ ID NO: 56904 - DNA, 324 bp, Homo sapiens; identical to SEQ ID NO: 36295
  chr16:86539103-86539427
  hyper

SEQ ID NO: 56905 - DNA, 36 bp, Homo sapiens; identical to SEQ ID NO: 36296
  chr16:86539463-86539499
  hyper

SEQ ID NO: 56906 - DNA, 101 bp, Homo sapiens; identical to SEQ ID NO: 36299
  chr16:86543663-86543764
  hyper

SEQ ID NO: 56907 - DNA, 163 bp, Homo sapiens; identical to SEQ ID NO: 36301
  chr16:86599222-86599385
  hyper

SEQ ID NO: 56908 - DNA, 148 bp, Homo sapiens
  chr16:86599844-86599992
  hyper
ttgtagggtttacctctaaaacctcgataggttatccttgacgaccccgagcctggaaactccctgttgatgattaattatttgattaaataagtataacatccaggagaggccctgccattccaatccagcgcgtttgctttgaatc

SEQ ID NO: 56909 - DNA, 168 bp, Homo sapiens
  chr16:86600315-86600483
  hyper
ctgcgctcctcgccccgattggcgccgactcctctcagctgccgggtgattggctcaaagttccgggagggggcgtggcccgaggaaagtaaaaactcgctttcagcaagaagacttttgaaacttttcccaatccctaaaagggacttggcctctttttctgggctc

SEQ ID NO: 56910 - DNA, 272 bp, Homo sapiens
  chr16:86600686-86600958
  hyper
gcgctgcgcttgcccggggcgcgccctccaggatgccgatccgcccggtccgctgaaagcgcgcgcccctgctcggcccgagcgccgccgcccgcgcaccctcgccccggaggctgccaggagcccggggccgcccctcccgctcccctcctctccccctctggctctctcgcgctctctcgctctcagggcccccctcgctcccccggccgcagtccgtgcgcgagggcgccggcgagccgtctcggaagcagcatgcaggcgcgctactc

SEQ ID NO: 56911 - DNA, 73 bp, Homo sapiens
  chr16:86601213-86601286
  hyper
gaagatcaccttgaacggcatctaccagttcatcatggaccgcttccccttctaccgggagaacaagcagggc

SEQ ID NO: 56912 - DNA, 84 bp, Homo sapiens; identical to SEQ ID NO: 12569
  chr16:86775022-86775106
  hyper

SEQ ID NO: 56913 - DNA, 30 bp, Homo sapiens; identical to SEQ ID NO: 36307
  chr16:87622644-87622674
  hyper

SEQ ID NO: 56914 - DNA, 33 bp, Homo sapiens; identical to SEQ ID NO: 22379
  chr16:87635070-87635103
  hyper

SEQ ID NO: 56915 - DNA, 66 bp, Homo sapiens
  chr16:87635133-87635199
  hyper
gcctccacacccccatcagcccactgcaccggtctgctgccatttcccgcacgcatttcaggaggg

SEQ ID NO: 56916 - DNA, 37 bp, Homo sapiens; identical to SEQ ID NO: 36309
  chr16:87635424-87635461
  hyper

SEQ ID NO: 56917 - DNA, 294 bp, Homo sapiens; identical to SEQ ID NO: 36310
  chr16:87636197-87636491
  hyper

SEQ ID NO: 56918 - DNA, 413 bp, Homo sapiens
  chr16:87636907-87637320
  hyper
ctacacctggcccagcggcaacacgtaccagggcacctgggcgcagggcaagcgccacggcatcggcctggagagcaaggggaagtgggtgtacaagggcgagtggacgcacggattcaaggggcgctacggggtgcgggagtgcgcgggcaacggggccaaatacgaagggacctggagcaacgggctgcaggacggctacgggaccgagacctactcggacggaggtaggtgccgcgggccgggccgggccggggcgggagggacgtgcttccgatcgcgccccttctgtggatctctggggaagttgagctgcgtcctccggttgggccgtgggcaccaggggcctttcccgggcttccctggaagccacggcggctcctggctacaggttgccccgctgcctggtgggg

SEQ ID NO: 56919 - DNA, 78 bp, Homo sapiens; identical to SEQ ID NO: 36313
  chr16:87637599-87637677
  hyper

SEQ ID NO: 56920 - DNA, 120 bp, Homo sapiens; identical to SEQ ID NO: 36314
  chr16:88449303-88449423
  hyper

SEQ ID NO: 56921 - DNA, 302 bp, Homo sapiens; identical to SEQ ID NO: 36315
  chr16:88449693-88449995
  hyper

SEQ ID NO: 56922 - DNA, 65 bp, Homo sapiens; identical to SEQ ID NO: 12576
  chr16:88450363-88450428
  hyper

SEQ ID NO: 56923 - DNA, 178 bp, Homo sapiens; identical to SEQ ID NO: 36317
  chr16:89006356-89006534
  hyper

SEQ ID NO: 56924 - DNA, 30 bp, Homo sapiens; identical to SEQ ID NO: 36318
  chr16:89006819-89006849
  hyper

SEQ ID NO: 56925 - DNA, 11 bp, Homo sapiens
  chr16:89007509-89007520
  hyper
tggtccccgcc

SEQ ID NO: 56926 - DNA, 222 bp, Homo sapiens
  chr16:89007558-89007780
  hyper
ccgcaccgggctcaggcgcgcggcggggctggggcgcgcggggcggccgcctgggccatgccggggactcggctccggccaccccgcgcgggaacaaagcgcgcaccccgcccggggcggtctccggcctccgcggcccgcgccgggtccagccgccgcgcctgtggctccaacgccgcgcgctcgcccgagagtctcacggggccccgcggcccccgcccc

SEQ ID NO: 56927 - DNA, 14 bp, Homo sapiens
  chr16:89267320-89267334
  hyper
gccagcccaaagcc

SEQ ID NO: 56928 - DNA, 444 bp, Homo sapiens
  chr16:89267364-89267808
  hyper
agcaaattccaggccctgctcccccaccggcgccttcggctccaatcctccagcgccccaggccgccccgcgcctggcagctcccaggcccagattcagcccccgcccggcccctctccgcgggtccggcccgtgcgcgcccgtctgcggcaccgtcgggccggcggccgccccggagcaggaagcccaggaggacggccggggggcccgggtcagaggcgccaggtaggatggagaaaggacacccagggcctcggcgggctgggggcggggagggctgcggggcagcagggacgggggcgcacctgggtgaccgggctttgcaggaggccggcgccgggcagcgcgtagagccagccgcgtgtgcagggccgggtgccgttgcgtgcgggcgcggggcgcgggcccggggcgggtgcagggcgcgggatcggggtagcgcag

SEQ ID NO: 56929 - DNA, 95 bp, Homo sapiens; identical to SEQ ID NO: 36321
  chr16:89268397-89268492
  hyper

SEQ ID NO: 56930 - DNA, 30 bp, Homo sapiens; identical to SEQ ID NO: 36322
  chr16:89268813-89268843
  hyper

SEQ ID NO: 56931 - DNA, 61 bp, Homo sapiens; identical to SEQ ID NO: 36323
  chr16:89778723-89778784
  hyper

SEQ ID NO: 56932 - DNA, 83 bp, Homo sapiens; identical to SEQ ID NO: 36324
  chr16:89992890-89992973
  hyper

SEQ ID NO: 56933 - DNA, 208 bp, Homo sapiens; identical to SEQ ID NO: 36325
  chr17:1083533-1083741
  hyper

SEQ ID NO: 56934 - DNA, 136 bp, Homo sapiens
  chr17:1174413-1174549
  hyper
cacggcccagtgcggtggccgaggggccgggcctagcacaggcctccgggggaagctggcgccgctgtccgggggcttcctctgccgggccgcctccctggccgcggggctacctgcgatccgcccccgggatggg

SEQ ID NO: 56935 - DNA, 30 bp, Homo sapiens; identical to SEQ ID NO: 36328
  chr17:1811643-1811673
  hyper

SEQ ID NO: 56936 - DNA, 212 bp, Homo sapiens; identical to SEQ ID NO: 36329
  chr17:1901506-1901718
  hyper

SEQ ID NO: 56937 - DNA, 50 bp, Homo sapiens; identical to SEQ ID NO: 36330
  chr17:1901920-1901970
  hyper

SEQ ID NO: 56938 - DNA, 272 bp, Homo sapiens; identical to SEQ ID NO: 36331
  chr17:1927434-1927706
  hyper

SEQ ID NO: 56939 - DNA, 176 bp, Homo sapiens; identical to SEQ ID NO: 36332
  chr17:1927990-1928166
  hyper

SEQ ID NO: 56940 - DNA, 34 bp, Homo sapiens; identical to SEQ ID NO: 36333
  chr17:1957561-1957595
  hyper

SEQ ID NO: 56941 - DNA, 132 bp, Homo sapiens; identical to SEQ ID NO: 36334
  chr17:1959132-1959264
  hyper

SEQ ID NO: 56942 - DNA, 32 bp, Homo sapiens; identical to SEQ ID NO: 22391
  chr17:1959436-1959468
  hyper

SEQ ID NO: 56943 - DNA, 45 bp, Homo sapiens
  chr17:1959520-1959565
  hyper
aactggggcaacttctcccgaggcgggaggcgctggttcctcggc

SEQ ID NO: 56944 - DNA, 49 bp, Homo sapiens; identical to SEQ ID NO: 36336
  chr17:2627535-2627584
  hyper

SEQ ID NO: 56945 - DNA, 517 bp, Homo sapiens; identical to SEQ ID NO: 36337
  chr17:2627798-2628315
  hyper

SEQ ID NO: 56946 - DNA, 89 bp, Homo sapiens; identical to SEQ ID NO: 36338
  chr17:2652543-2652632
  hyper

SEQ ID NO: 56947 - DNA, 61 bp, Homo sapiens; identical to SEQ ID NO: 36339
  chr17:2659604-2659665
  hyper

SEQ ID NO: 56948 - DNA, 294 bp, Homo sapiens; identical to SEQ ID NO: 36340
  chr17:2680204-2680498
  hyper

SEQ ID NO: 56949 - DNA, 136 bp, Homo sapiens; identical to SEQ ID NO: 36341
  chr17:2756282-2756418
  hyper

SEQ ID NO: 56950 - DNA, 48 bp, Homo sapiens
  chr17:3438866-3438914
  hyper
cgaagtagaagccttcgtgttggtacttggggttgaagaaggccccct

SEQ ID NO: 56951 - DNA, 74 bp, Homo sapiens; identical to SEQ ID NO: 36343
  chr17:3599635-3599709
  hyper

SEQ ID NO: 56952 - DNA, 183 bp, Homo sapiens; identical to SEQ ID NO: 36344
  chr17:3866983-3867166
  hyper

SEQ ID NO: 56953 - DNA, 116 bp, Homo sapiens
  chr17:4544491-4544607
  hyper
agaaagcgagaggaccgacggcggctccagtgactgctgagtttccagacaagggagctttgtgcaatgaggggcgcacaggagcatgccctcaattccaaggagatcgggtagcg

SEQ ID NO: 56954 - DNA, 294 bp, Homo sapiens
  chr17:4544710-4545004
  hyper
gagaatcggccagaggccaacgggggcgcatgtcctccccggtatttgactgactcggagccaggggcgcagcccaccccgcccggctctggggagctcaccttgccccgtgcgggccacagtcgcttcccgagcgccgcctccccgtgctggccgaccagccacagctgcacctggttgttggaaccggcatagagcgaggccccagtggacacgcggatgcggtagagacccatcttgctcaaagatgtttcgctccttctggtggagaagggtggacgagctaaataaccc

SEQ ID NO: 56955 - DNA, 154 bp, Homo sapiens; identical to SEQ ID NO: 36346
  chr17:4981395-4981549
  hyper

SEQ ID NO: 56956 - DNA, 34 bp, Homo sapiens; identical to SEQ ID NO: 36347
  chr17:4981951-4981985
  hyper

SEQ ID NO: 56957 - DNA, 74 bp, Homo sapiens
  chr17:5000354-5000428
  hyper
cccagtgggaaggagcggggacgattctggcgatcacatgaggaagggagcagcctcagcagcgcaggtggaca

SEQ ID NO: 56958 - DNA, 57 bp, Homo sapiens; identical to SEQ ID NO: 36349
  chr17:5000879-5000936
  hyper

SEQ ID NO: 56959 - DNA, 58 bp, Homo sapiens; identical to SEQ ID NO: 36350
  chr17:5001149-5001207
  hyper

SEQ ID NO: 56960 - DNA, 37 bp, Homo sapiens; identical to SEQ ID NO: 36351
  chr17:5973300-5973337
  hyper

SEQ ID NO: 56961 - DNA, 270 bp, Homo sapiens; identical to SEQ ID NO: 36352
  chr17:5973825-5974095
  hyper

SEQ ID NO: 56962 - DNA, 366 bp, Homo sapiens
  chr17:6616271-6616637
  hyper
gatctgtgctcacttcgaggtttccgtgcttgcctggacggctcttgcgccctgggatctgtaaaccccaagggtggtgcgccctggggtcgccatgcccctcagattctttacagggcacctcccatccggcacctggagctcctgagtgcgcgcgccccgggagagctgtgctccccgcgaaatccgtgcgctccagctcagggctcccgggatcggtgcccgttagtgggcacaggacgccgggtgtccgaagggctgcctggagatgcaactgaccttggcgggcatcagaatgacgagtggcagcagcaggagcggggtgacgaacaagatcacgaaggacttgaacttggagacatagct

SEQ ID NO: 56963 - DNA, 197 bp, Homo sapiens; identical to SEQ ID NO: 22405
  chr17:6616686-6616883
  hyper

SEQ ID NO: 56964 - DNA, 27 bp, Homo sapiens
  chr17:6616884-6616911
  hyper
cttcgggccagccctctaggggcagcc

SEQ ID NO: 56965 - DNA, 36 bp, Homo sapiens; identical to SEQ ID NO: 36355
  chr17:6679303-6679339
  hyper

SEQ ID NO: 56966 - DNA, 214 bp, Homo sapiens; identical to SEQ ID NO: 36356
  chr17:6679581-6679795
  hyper

SEQ ID NO: 56967 - DNA, 30 bp, Homo sapiens; identical to SEQ ID NO: 36357
  chr17:6735130-6735160
  hyper

SEQ ID NO: 56968 - DNA, 230 bp, Homo sapiens; identical to SEQ ID NO: 36358
  chr17:6926198-6926428
  hyper

SEQ ID NO: 56969 - DNA, 36 bp, Homo sapiens; identical to SEQ ID NO: 36359
  chr17:7197656-7197692
  hyper

SEQ ID NO: 56970 - DNA, 181 bp, Homo sapiens; identical to SEQ ID NO: 36361
  chr17:7554612-7554793
  hyper

SEQ ID NO: 56971 - DNA, 30 bp, Homo sapiens; identical to SEQ ID NO: 36362
  chr17:7621433-7621463
  hyper

SEQ ID NO: 56972 - DNA, 49 bp, Homo sapiens; identical to SEQ ID NO: 36363
  chr17:7976269-7976318
  hyper

SEQ ID NO: 56973 - DNA, 589 bp, Homo sapiens; identical to SEQ ID NO: 36364
  chr17:8055166-8055755
  hyper

SEQ ID NO: 56974 - DNA, 63 bp, Homo sapiens
  chr17:8230272-8230335
  hyper
gtcgtctccaagccacggtctcaccaccctccatcagcctcgggcgacaccaaggggaacaga

SEQ ID NO: 56975 - DNA, 127 bp, Homo sapiens
  chr17:8230694-8230821
  hyper
tagccactcctccttcccacccacccgcagcactctcgaggtcgcaacggcagtcaccaggtcccggggcctgcgttcagctgcttgatccgactaggtttggcttcggacccgaatgggtcagctc

SEQ ID NO: 56976 - DNA, 38 bp, Homo sapiens; identical to SEQ ID NO: 36367
  chr17:8533161-8533199
  hyper

SEQ ID NO: 56977 - DNA, 38 bp, Homo sapiens
  chr17:8868582-8868620
  hyper
ccctacgacacagggcgtcctgtgtcagaggcaggagg

SEQ ID NO: 56978 - DNA, 86 bp, Homo sapiens
  chr17:8869385-8869471
  hyper
ggtctggggtaggggcttaggggaaagacgagaaagaggaagctccgacgagctgcttccttctctcactgcgacccacttcctct

SEQ ID NO: 56979 - DNA, 475 bp, Homo sapiens
  chr17:8906518-8906993
  hyper
ccgcgctcgggaagctctggctggggctgcggtcggagggcggcgcccaagttttcttgaaggcctcggagggcagctggagcggcgtagagcctgcgcggggatggcgggggtggccgcgggccggggccgtctgggggcggccatcccgggcggtgcgtggaaaagtaggcactggtgcgcggcgaggggcgcacgccagagccccagccccgcgtcctgcgcacttggcgcgctctggccgcggtcccggcgagccccagcctgctccgggccgcgaccccggctccgcgccttcctgcccgcccgggtcctttgtagcccgctggccccgcggtcgcgcacggtcacgccggcaggtcgcgctcggcggccggccaagccagccccggccctgccgcgcccgcgccccgggccaccccgcccggccccctcggcgctgcacccctcgctttccccatctccagccgctcgc

SEQ ID NO: 56980 - DNA, 153 bp, Homo sapiens; identical to SEQ ID NO: 22414
  chr17:8907575-8907728
  hyper

SEQ ID NO: 56981 - DNA, 22 bp, Homo sapiens
  chr17:8907776-8907798
  hyper
cgggtgacggaggctttatcct

SEQ ID NO: 56982 - DNA, 123 bp, Homo sapiens; identical to SEQ ID NO: 36374
  chr17:8925590-8925713
  hyper

SEQ ID NO: 56983 - DNA, 151 bp, Homo sapiens
  chr17:10102264-10102415
  hyper
cggagggctgcgcgctccctcgcagaggggcctgtcactggggagaggggctcccactcgcgcccccaccgccggggaccgcgggaatggaaacgcccctctgttctgtgcctgctttgtaggcctggcggcccgtggcgtgcgggcggct

SEQ ID NO: 56984 - DNA, 432 bp, Homo sapiens; identical to SEQ ID NO: 36378
  chr17:10632918-10633350
  hyper

SEQ ID NO: 56985 - DNA, 60 bp, Homo sapiens; identical to SEQ ID NO: 36379
  chr17:11145224-11145284
  hyper

SEQ ID NO: 56986 - DNA, 32 bp, Homo sapiens; identical to SEQ ID NO: 36380
  chr17:11501937-11501969
  hyper

SEQ ID NO: 56987 - DNA, 50 bp, Homo sapiens; identical to SEQ ID NO: 36381
  chr17:12568739-12568789
  hyper

SEQ ID NO: 56988 - DNA, 33 bp, Homo sapiens; identical to SEQ ID NO: 36382
  chr17:12877698-12877731
  hyper

SEQ ID NO: 56989 - DNA, 103 bp, Homo sapiens; identical to SEQ ID NO: 36383
  chr17:13503842-13503945
  hyper

SEQ ID NO: 56990 - DNA, 115 bp, Homo sapiens
  chr17:13504195-13504310
  hyper
gccgccggccacaccgccagctccctcgggcctccggccaggacgccgccaccaggggcccccgcctcctcgccgccgccggacagccccacgacggggccggacagggtctggc

SEQ ID NO: 56991 - DNA, 89 bp, Homo sapiens
  chr17:13504681-13504770
  hyper
gggtccgtgcttaagaaaccatcgtcttagactcgcccaagtcctgagcttggggcagccttggcccctcggttccccgcaagagtcgc

SEQ ID NO: 56992 - DNA, 230 bp, Homo sapiens
  chr17:13505188-13505418
  hyper
cggcccccgccactctgctcgcaggcgctcaccggctgcctcctgggccgccgctggccgccgccacacgtgggacgccgagggcagcaaacttgctggtgacgtcaaaggcccgggccggaccagcccccggacgagcgcagcggggcgcggaccagcggccaggcggggccagacgggcggggtgggatggagaaaaggtggcgcgggctccgcagcagccgcccaat

SEQ ID NO: 56993 - DNA, 152 bp, Homo sapiens; identical to SEQ ID NO: 36387
  chr17:14200755-14200907
  hyper

SEQ ID NO: 56994 - DNA, 111 bp, Homo sapiens
  chr17:14200930-14201041
  hyper
cgcagctgctaacccccgaggggccgcctcgctggcgaggggagcgggaggaaggtccggattccggtggcaggaactggggctctgggccaccggttcaggctgccccag

SEQ ID NO: 56995 - DNA, 27 bp, Homo sapiens
  chr17:14201181-14201208
  hyper
cggaaaatactgcggggatggtttggc

SEQ ID NO: 56996 - DNA, 244 bp, Homo sapiens; identical to SEQ ID NO: 36389
  chr17:14203027-14203271
  hyper

SEQ ID NO: 56997 - DNA, 201 bp, Homo sapiens
  chr17:14204011-14204212
  hyper
catctgggcaactaccgccaaggctggcttctagggaacgagtgcggaaatgcgtgcgggtgtgggagcgcaccactcagtagggtaggacctctcccagcgctaggtcactgcagcattcttcccaccatctgctcctgtcaccagcccctaactccgcccctttgggcccgccccttgttccgaagccaatagcaaccc

SEQ ID NO: 56998 - DNA, 103 bp, Homo sapiens; identical to SEQ ID NO: 36391
  chr17:14204731-14204834
  hyper

SEQ ID NO: 56999 - DNA, 566 bp, Homo sapiens; identical to SEQ ID NO: 36392
  chr17:14205251-14205817
  hyper

SEQ ID NO: 57000 - DNA, 134 bp, Homo sapiens; identical to SEQ ID NO: 36393
  chr17:14206209-14206343
  hyper

SEQ ID NO: 57001 - DNA, 7 bp, Homo sapiens
  chr17:14212588-14212595
  hyper
cggagac

SEQ ID NO: 57002 - DNA, 30 bp, Homo sapiens; identical to SEQ ID NO: 12624
  chr17:15164652-15164682
  hyper

SEQ ID NO: 57003 - DNA, 786 bp, Homo sapiens; identical to SEQ ID NO: 36396
  chr17:15166015-15166801
  hyper

SEQ ID NO: 57004 - DNA, 86 bp, Homo sapiens; identical to SEQ ID NO: 36397
  chr17:15244447-15244533
  hyper

SEQ ID NO: 57005 - DNA, 63 bp, Homo sapiens; identical to SEQ ID NO: 22428
  chr17:15244987-15245050
  hyper

SEQ ID NO: 57006 - DNA, 253 bp, Homo sapiens; identical to SEQ ID NO: 36399
  chr17:15820777-15821030
  hyper

SEQ ID NO: 57007 - DNA, 84 bp, Homo sapiens; identical to SEQ ID NO: 36400
  chr17:15847883-15847967
  hyper

SEQ ID NO: 57008 - DNA, 30 bp, Homo sapiens; identical to SEQ ID NO: 36401
  chr17:15849181-15849211
  hyper

SEQ ID NO: 57009 - DNA, 25 bp, Homo sapiens
  chr17:16310306-16310331
  hyper
cgtcccaaggcgcctggctcaccgc

SEQ ID NO: 57010 - DNA, 393 bp, Homo sapiens; identical to SEQ ID NO: 36403
  chr17:16472011-16472404
  hyper

SEQ ID NO: 57011 - DNA, 149 bp, Homo sapiens; identical to SEQ ID NO: 36404
  chr17:16472622-16472771
  hyper

SEQ ID NO: 57012 - DNA, 39 bp, Homo sapiens; identical to SEQ ID NO: 36405
  chr17:16492416-16492455
  hyper

SEQ ID NO: 57013 - DNA, 64 bp, Homo sapiens; identical to SEQ ID NO: 36406
  chr17:16570208-16570272
  hyper

SEQ ID NO: 57014 - DNA, 45 bp, Homo sapiens
  chr17:16570654-16570699
  hyper
ctgaggagctgaggggctgaggcggctgaggggctgaggctggtg

SEQ ID NO: 57015 - DNA, 145 bp, Homo sapiens
  chr17:16570794-16570939
  hyper
ggggctgaaaggctgaagggcgggcagcgtgccgggtccctgcggctgggtccaccgcacgtcacgtggcagaatcccggggctgctttctctccggctgctcagccacttgttttctcactgtgaacctcgtgggctcctgctc

SEQ ID NO: 57016 - DNA, 30 bp, Homo sapiens; identical to SEQ ID NO: 36408
  chr17:17204181-17204211
  hyper

SEQ ID NO: 57017 - DNA, 63 bp, Homo sapiens; identical to SEQ ID NO: 36409
  chr17:17398606-17398669
  hyper

SEQ ID NO: 57018 - DNA, 74 bp, Homo sapiens; identical to SEQ ID NO: 12631
  chr17:17398902-17398976
  hyper

SEQ ID NO: 57019 - DNA, 30 bp, Homo sapiens; identical to SEQ ID NO: 36411
  chr17:18314944-18314974
  hyper

SEQ ID NO: 57020 - DNA, 10 bp, Homo sapiens
  chr17:18538275-18538285
  hyper
cctcctaccc

SEQ ID NO: 57021 - DNA, 618 bp, Homo sapiens; identical to SEQ ID NO: 36413
  chr17:19436820-19437438
  hyper

SEQ ID NO: 57022 - DNA, 222 bp, Homo sapiens; identical to SEQ ID NO: 36414
  chr17:19483136-19483358
  hyper

SEQ ID NO: 57023 - DNA, 34 bp, Homo sapiens; identical to SEQ ID NO: 36415
  chr17:20747407-20747441
  hyper

SEQ ID NO: 57024 - DNA, 121 bp, Homo sapiens; identical to SEQ ID NO: 36416
  chr17:20755828-20755949
  hyper

SEQ ID NO: 57025 - DNA, 43 bp, Homo sapiens; identical to SEQ ID NO: 36417
  chr17:20755950-20755993
  hyper

SEQ ID NO: 57026 - DNA, 166 bp, Homo sapiens; identical to SEQ ID NO: 36418
  chr17:26120495-26120661
  hyper

SEQ ID NO: 57027 - DNA, 78 bp, Homo sapiens; identical to SEQ ID NO: 22437
  chr17:26554556-26554634
  hyper

SEQ ID NO: 57028 - DNA, 48 bp, Homo sapiens; identical to SEQ ID NO: 22438
  chr17:26554705-26554753
  hyper

SEQ ID NO: 57029 - DNA, 178 bp, Homo sapiens; identical to SEQ ID NO: 12638
  chr17:26554791-26554969
  hyper

SEQ ID NO: 57030 - DNA, 335 bp, Homo sapiens; identical to SEQ ID NO: 36421
  chr17:26578290-26578625
  hyper

SEQ ID NO: 57031 - DNA, 202 bp, Homo sapiens; identical to SEQ ID NO: 36422
  chr17:27038906-27039108
  hyper

SEQ ID NO: 57032 - DNA, 2 bp, Homo sapiens
  chr17:27044880-27044882
  hyper
cg

SEQ ID NO: 57033 - DNA, 37 bp, Homo sapiens
  chr17:27332416-27332453
  hyper
ggggaagcgggaccacgggccgccagctggaccgtcc

SEQ ID NO: 57034 - DNA, 50 bp, Homo sapiens
  chr17:27332660-27332710
  hyper
cgcgaagcccgcgccccgcccggcttggccggcgccgggggcagcgcagc

SEQ ID NO: 57035 - DNA, 30 bp, Homo sapiens; identical to SEQ ID NO: 36425
  chr17:27466437-27466467
  hyper

SEQ ID NO: 57036 - DNA, 113 bp, Homo sapiens; identical to SEQ ID NO: 36426
  chr17:27940225-27940338
  hyper

SEQ ID NO: 57037 - DNA, 671 bp, Homo sapiens; identical to SEQ ID NO: 36428
  chr17:27949457-27950128
  hyper

SEQ ID NO: 57038 - DNA, 36 bp, Homo sapiens; identical to SEQ ID NO: 36429
  chr17:28088606-28088642
  hyper

SEQ ID NO: 57039 - DNA, 251 bp, Homo sapiens
  chr17:28562765-28563016
  hyper
tctgatctctagatagccgccgccaaagagctcttgaagaatttttgcgtcactttgaggcgaataaacttaatgcttccccgcggccgcggctccgcgctcccgctggatggggttgcgctcgccagggaggggccgcgctacggggcggggtgcgcgcccgaccccagagccaggaggggagggacccccgacacacacacacgctcgcagggaggagcggagcgcggagcagccggcagggcagggcc

SEQ ID NO: 57040 - DNA, 61 bp, Homo sapiens; identical to SEQ ID NO: 36431
  chr17:28563999-28564060
  hyper

SEQ ID NO: 57041 - DNA, 175 bp, Homo sapiens; identical to SEQ ID NO: 36432
  chr17:28705281-28705456
  hyper

SEQ ID NO: 57042 - DNA, 127 bp, Homo sapiens; identical to SEQ ID NO: 36433
  chr17:29020895-29021022
  hyper

SEQ ID NO: 57043 - DNA, 260 bp, Homo sapiens
  chr17:29249457-29249717
  hyper
cgcccgagtccgggctctcgatgtctgcgcacccaggcgcgccccacgccctcggactcagacatcccagccagggctaaacgtcgggcccaggccgccgacagtcctgtgccccctgcccgctcccagacgccccccgaaggcctccccagcgccccacctcggggacgccgagggccccctaactcagcctccccacctgcagctccgcgccgagccccgcggtgcgccccccgcgccctcctctcggttccttctga

SEQ ID NO: 57044 - DNA, 9 bp, Homo sapiens
  chr17:29249930-29249939
  hyper
gctcctctc

SEQ ID NO: 57045 - DNA, 30 bp, Homo sapiens; identical to SEQ ID NO: 36435
  chr17:29335681-29335711
  hyper

SEQ ID NO: 57046 - DNA, 73 bp, Homo sapiens; identical to SEQ ID NO: 22447
  chr17:29718142-29718215
  hyper

SEQ ID NO: 57047 - DNA, 271 bp, Homo sapiens
  chr17:29718269-29718540
  hyper
cccccaggacatcctgagcgctcgggagacgccaggcgcggcagcgggcacggatagcggaaaggggcgcgaccccgcggaatcctccggcagggcagggcctttgggtggctccgggtgtccagaggaaggggtgggctcggggacgcggagggaaactggggacgcggagggaaactgaggtcgcggaggacgcggccgttggcagctcgctgcgcctgccggccccgcgtgggccgccccactcgggaggacgcgggctccttttgtc

SEQ ID NO: 57048 - DNA, 409 bp, Homo sapiens
  chr17:29718778-29719187
  hyper
ggcggccccggagggcgcgcggcgatggcggcggcgggcaggcggcgggcgcggcgggcgaggggtccgggctgagctgcgggccggcccggatggcgggcggcgcgggctggtcgggcgcccccgcggctctgctgcgctccgtgcgccgcctgcgcgaggtgttcgaggtgtgcggccgcgaccccgacggcttcctgcgcgtggagcgcgtcgcggcgctcggactgcgcttcggccagggcgaggaggtaagctggcccgaccccagtcccggcccggggaccccagcccagccccgccgcccctcccccagctcccccgccgggtcacccgcgtggcccgaggcggtggcctccctcccaatcccctccctccgccggagcccaggacctcggccccccccggg

SEQ ID NO: 57049 - DNA, 243 bp, Homo sapiens; identical to SEQ ID NO: 36438
  chr17:29886485-29886728
  hyper

SEQ ID NO: 57050 - DNA, 76 bp, Homo sapiens; identical to SEQ ID NO: 36439
  chr17:30846530-30846606
  hyper

SEQ ID NO: 57051 - DNA, 118 bp, Homo sapiens; identical to SEQ ID NO: 1281
  chr17:31618291-31618409
  hyper

SEQ ID NO: 57052 - DNA, 15 bp, Homo sapiens
  chr17:31618410-31618425
  hyper
cggagggcaactcac

SEQ ID NO: 57053 - DNA, 78 bp, Homo sapiens
  chr17:31619319-31619397
  hyper
gggcgcccgcccggggctgagcgccgcctcagcccgcagcccctggcagtggcctctcccgagcgcctcccaggcttt

SEQ ID NO: 57054 - DNA, 264 bp, Homo sapiens; identical to SEQ ID NO: 22454
  chr17:31619687-31619951
  hyper

SEQ ID NO: 57055 - DNA, 421 bp, Homo sapiens
  chr17:31620026-31620447
  hyper
ccagccttgctgtctctcgcgtcttctctctgcccccgcggcgacaagagctggggactgcggggacccgccaacacctcccgggggtgacccggactcgctgctccgcgcgcccttctcctctcgagactccgagctcgcggtggccgtgacgccggctaagctccttccccggttgcccgggagaaccctctttgggccccaggcgaacttgggcagcggccgcgcgacgctggcgcggctgggctccgagcacctgctcctcagctcgctggccccgcggctccgggcgggcggggcggcggcggccgtgagcgccgtgcgctcctggagacgcggtgctgacgcgcccggctcctcctcgctgcattttaattcctggccactgtggccgctgcacaccgagcgggaagcctcttgc

SEQ ID NO: 57056 - DNA, 28 bp, Homo sapiens
  chr17:32483992-32484020
  hyper
tgggggatgtcagggcggccacgctgat

SEQ ID NO: 57057 - DNA, 70 bp, Homo sapiens
  chr17:32484049-32484119
  hyper
ttcagagccgccgccgctcggttccttttcccatgatgttttggactccgaatgccgtttctcgccgccg

SEQ ID NO: 57058 - DNA, 57 bp, Homo sapiens; identical to SEQ ID NO: 12653
  chr17:32906021-32906078
  hyper

SEQ ID NO: 57059 - DNA, 67 bp, Homo sapiens
  chr17:32906312-32906379
  hyper
gcggaatcgcgaggtcggcccttggcccgagtctcattaaggagccgcgcgcgccgccaggctagga

SEQ ID NO: 57060 - DNA, 178 bp, Homo sapiens
  chr17:32906636-32906814
  hyper
ggaggcggcgacggcggcggcggctgcttcgtgcaactgtggcttcccccacctcctcttcctttttgctcctcgattcttcttcttcccccacacacgtccatggggagccggctcccctgccagcacctcctctcctctcggccccgtaggcaccagctgccgcttccctggccgc

SEQ ID NO: 57061 - DNA, 153 bp, Homo sapiens; identical to SEQ ID NO: 12654
  chr17:32907265-32907418
  hyper

SEQ ID NO: 57062 - DNA, 32 bp, Homo sapiens; identical to SEQ ID NO: 22458
  chr17:32907620-32907652
  hyper

SEQ ID NO: 57063 - DNA, 52 bp, Homo sapiens; identical to SEQ ID NO: 22459
  chr17:32907753-32907805
  hyper

SEQ ID NO: 57064 - DNA, 259 bp, Homo sapiens; identical to SEQ ID NO: 22460
  chr17:32907873-32908132
  hyper

SEQ ID NO: 57065 - DNA, 273 bp, Homo sapiens
  chr17:32908374-32908647
  hyper
gggggagggtgtcgctccagtcctctcctggttataaagaagggttcgaacccgaaggtctggggtcgtgtccgcccacggaaatctagagggatccgagggatcctccggatcgcgtccaggccgccccccgcccccgtctctccctgcagccggccgggctgggggctgttgggatccgccgggatcgcgtctttcctcgccccgggcgcgcaggccggtgcggggccgcgccgcccgtcgcctcgcttcctgcggcggtcctcgggaagg

SEQ ID NO: 57066 - DNA, 32 bp, Homo sapiens; identical to SEQ ID NO: 36452
  chr17:33672862-33672894
  hyper

SEQ ID NO: 57067 - DNA, 164 bp, Homo sapiens; identical to SEQ ID NO: 36453
  chr17:33673326-33673490
  hyper

SEQ ID NO: 57068 - DNA, 301 bp, Homo sapiens; identical to SEQ ID NO: 12660
  chr17:33700472-33700773
  hyper

SEQ ID NO: 57069 - DNA, 402 bp, Homo sapiens; identical to SEQ ID NO: 12661
  chr17:33700974-33701376
  hyper

SEQ ID NO: 57070 - DNA, 117 bp, Homo sapiens; identical to SEQ ID NO: 36456
  chr17:33775327-33775444
  hyper

SEQ ID NO: 57071 - DNA, 399 bp, Homo sapiens; identical to SEQ ID NO: 36457
  chr17:35014243-35014642
  hyper

SEQ ID NO: 57072 - DNA, 362 bp, Homo sapiens; identical to SEQ ID NO: 36458
  chr17:35060253-35060615
  hyper

SEQ ID NO: 57073 - DNA, 372 bp, Homo sapiens; identical to SEQ ID NO: 36459
  chr17:35078532-35078904
  hyper

SEQ ID NO: 57074 - DNA, 30 bp, Homo sapiens; identical to SEQ ID NO: 36460
  chr17:35165346-35165376
  hyper

SEQ ID NO: 57075 - DNA, 52 bp, Homo sapiens; identical to SEQ ID NO: 22467
  chr17:35165593-35165645
  hyper

SEQ ID NO: 57076 - DNA, 153 bp, Homo sapiens
  chr17:35165691-35165844
  hyper
gccggcgccgcgcgctcgcctccctcgcctctcctttgtgtccgcctcgcctcgcctctcggcctcgccgcgctccattcccgcggcgctggcccgggccgagcgaactgctttgcctttggccacgttgagcgcgccgaggcagccgggggc

SEQ ID NO: 57077 - DNA, 141 bp, Homo sapiens
  chr17:35165845-35165986
  hyper
cggggctccaggacccgtctgctcctggtgcccccagctcctcagggtccggccgggtcacctgggccgatccaggcgggcaggggcctcgctgctcctcccccgcagcccctctcgccctcccggggaccgtgtgcgggg

SEQ ID NO: 57078 - DNA, 17 bp, Homo sapiens
  chr17:35166016-35166033
  hyper
tccgactggggaacttg

SEQ ID NO: 57079 - DNA, 30 bp, Homo sapiens; identical to SEQ ID NO: 36463
  chr17:35242096-35242126
  hyper

SEQ ID NO: 57080 - DNA, 105 bp, Homo sapiens; identical to SEQ ID NO: 22469
  chr17:35285437-35285542
  hyper

SEQ ID NO: 57081 - DNA, 129 bp, Homo sapiens; identical to SEQ ID NO: 22470
  chr17:35285666-35285795
  hyper

SEQ ID NO: 57082 - DNA, 290 bp, Homo sapiens; identical to SEQ ID NO: 36465
  chr17:35289328-35289618
  hyper

SEQ ID NO: 57083 - DNA, 283 bp, Homo sapiens
  chr17:35290655-35290938
  hyper
ctttcacggccttgtcactcttttctgctccttgggctgttctggaaccgaagagagaggagggaaatggctaggggcggccatcatcctcgggatcaatagcagccgagagtgactgggcaggctctgtccatgggccgagcgtcattctggaacctggagggggcgggggcgggggaaggaagggaagtggaagtttgagaggggcaccttcaggctccccaaactgcatggcagctggagagggctgacagaaccctctccaacccgggttctgaccagg

SEQ ID NO: 57084 - DNA, 289 bp, Homo sapiens
  chr17:35291540-35291829
  hyper
atctggacaccaggacgagcggagcctgacgccctagagcgagcgtcctgtcctcatcctcaactctcctgcctcgctggtccgtctgtggggaggggccttctttcccctatacctaggtcccaaggttcttacacccctaaatggatggagcaacctcctcctgcccaccagagggaggtgacaggccctgggttggggaagggccgacagctaggtccagctgtcgtccggtaggtcccactgaccgccccacactccaccgtgacccctctgctttgcatgagaa

SEQ ID NO: 57085 - DNA, 29 bp, Homo sapiens
  chr17:35292626-35292655
  hyper
gcccaggttcactgcgactccgcttcccc

SEQ ID NO: 57086 - DNA, 35 bp, Homo sapiens; identical to SEQ ID NO: 36469
  chr17:35292896-35292931
  hyper

SEQ ID NO: 57087 - DNA, 307 bp, Homo sapiens; identical to SEQ ID NO: 22472
  chr17:35294154-35294461
  hyper

SEQ ID NO: 57088 - DNA, 542 bp, Homo sapiens; identical to SEQ ID NO: 22473
  chr17:35294505-35295047
  hyper

SEQ ID NO: 57089 - DNA, 465 bp, Homo sapiens; identical to SEQ ID NO: 22474
  chr17:35295160-35295625
  hyper

SEQ ID NO: 57090 - DNA, 127 bp, Homo sapiens
  chr17:35296016-35296143
  hyper
cattctccaggccttcggggttgtttgccctccaggcagagcccaggctccctcccggccactaccttttccgaccccgagcggtcttggcggtaagctccgagccttttgcgtagagtgtctgggc

SEQ ID NO: 57091 - DNA, 436 bp, Homo sapiens
  chr17:35296292-35296728
  hyper
cttccctggctgccgaagttgtctggtggttcggcttcagccccaggtgactccgactcccacgggctccgctcagtagtcctcctaggaaactgccagccacagccagcaacctccttgatgaaacctgggggaaagccgagacctccagcttgctggtggggagacttctccctaccccccttattcgtttagcattttaattatattatcgtacactcacaattttgccgctccattcacacaaacacacaagtcaacagagaagaacgggcacaaatgcgaattgtaattccaccctacggatgtgaaatatcgcaatttactcggctgacttggtctctgcttttctgagtttgtggtcatagttcaaaccagggagcaggaggaagagggattcaaagccactcagagggccaagacgcgctgtccccag

SEQ ID NO: 57092 - DNA, 258 bp, Homo sapiens; identical to SEQ ID NO: 22478
  chr17:35296888-35297146
  hyper

SEQ ID NO: 57093 - DNA, 460 bp, Homo sapiens; identical to SEQ ID NO: 36474
  chr17:35297147-35297607
  hyper

SEQ ID NO: 57094 - DNA, 58 bp, Homo sapiens
  chr17:35298153-35298211
  hyper
ggagaccggcctcaacatgcgcgtcattcaggtcaggccccggcgcgcctctccatcc

SEQ ID NO: 57095 - DNA, 66 bp, Homo sapiens; identical to SEQ ID NO: 22481
  chr17:35299185-35299251
  hyper

SEQ ID NO: 57096 - DNA, 30 bp, Homo sapiens; identical to SEQ ID NO: 36480
  chr17:35301109-35301139
  hyper

SEQ ID NO: 57097 - DNA, 26 bp, Homo sapiens
  chr17:35303314-35303340
  hyper
cgattcttctaacaacgtggttgtgg

SEQ ID NO: 57098 - DNA, 16 bp, Homo sapiens
  chr17:35303535-35303551
  hyper
gcggagctcccgcagg

SEQ ID NO: 57099 - DNA, 617 bp, Homo sapiens
  chr17:36102404-36103021
  hyper
tttctctttgcttttcgtcttaagggaacacggtgggcaaaagaagggagtgcgtgtgcccgaggcttgggagccccctgtgcagtgacctaggaaccgctagcgatttcttgaaaaattactttaatcaagtccggcgctcccgggagcgggggaggaaaggcagcacccgctcgggacgggagaaaaaagcctccaggtctgtcccgcgtctccaactcggcgagggtctccggctccccagtccctctccctgccctgctggggcctggggctttggggagggaagagcggggctggggtctaaggaccctgggccgggcctggctctccgccggccgggcctgcgggtgtcggcgacccgggggctccgcgggcggctcgggcgctcacagagcccgcgtcccgcgccagagcggtgaggccgcggggccgcacggggcgcctggctgggtgcgcgctgggagcggcgagcagccccgcgcccgcgttttgatctccttcccccctctaagccgcgtttacaacttcaccaatgaataacccgcctctcttttcaacctaatcacggctctttgtgtatctttctgttgatgatttatagaaataaattaata

SEQ ID NO: 57100 - DNA, 31 bp, Homo sapiens; identical to SEQ ID NO: 22485
  chr17:36103540-36103571
  hyper

SEQ ID NO: 57101 - DNA, 434 bp, Homo sapiens
  chr17:36103601-36104035
  hyper
cctaaagcggagtggcccgggagcgacgtgctgtctcagggaaccgctcggctccttagataattagtaaccagctgtcaaagtctagggcggtcggggaggacccacaaacgatcccggccctggggatacactgccagccggcctgaactcccggggagaggccgggggtgggcagcgaggtctggaaacgccctcctttctcagactgagaccagatcctctgcgaactgaggtctgagacgcgttcgcccccacaccaccgcgcttcgtttctttggccccgcgcgtgtccacccggaccctgcatggaacatgccctttgcaaatctaaacccgcgttggggatcccggataattccgggccttgcatgggcgcggctaacaagagtgcccaccagggaactcgcctcccagatcccggctccggatgc

SEQ ID NO: 57102 - DNA, 444 bp, Homo sapiens
  chr17:36104779-36105223
  hyper
ctcctccaaggcctgaaccagcacctccttggtgaccccggagctcagcagggcgctcaggagttcttgctggagcgacgtgagcttggacaccattttccaaggacggaaaaagaagggggtgagggggtgggtgggtgcgagagaggagggtggaggggagtttcacaagcaaaccccaaatccaggaacccctccacccttcagcctccagacacctgttactccccggggtcccggaggctcctccgaaaggagtcagaaaacttctaacttgccatgatcgccaccattaggccatataagatatgcaaattagtgggaagggcccagctttcggctggatgcaaatgatggtggggagggggaaacccggagagagggagagccggaggggcagacctggagagcagaagacctgggccgggagcggggctttgccag

SEQ ID NO: 57103 - DNA, 132 bp, Homo sapiens
  chr17:36105596-36105728
  hyper
gcatgccctggagggactccatttatttctacctcggttactacctccaggccccagaacctccctggcctggtctggcggtttgggtttgcagaactgcccgccagagagcgtaggcgagggtgaaggagt

SEQ ID NO: 57104 - DNA, 75 bp, Homo sapiens; identical to SEQ ID NO: 36488
  chr17:36715017-36715092
  hyper

SEQ ID NO: 57105 - DNA, 136 bp, Homo sapiens; identical to SEQ ID NO: 36489
  chr17:36729051-36729187
  hyper

SEQ ID NO: 57106 - DNA, 46 bp, Homo sapiens; identical to SEQ ID NO: 36490
  chr17:36829977-36830023
  hyper

SEQ ID NO: 57107 - DNA, 40 bp, Homo sapiens; identical to SEQ ID NO: 36491
  chr17:36905467-36905507
  hyper

SEQ ID NO: 57108 - DNA, 297 bp, Homo sapiens
  chr17:37366040-37366337
  hyper
cccccactctgcatccgggcagcgccagcagtgccccagcacccccgcagcccgcctctccttggcgccccgctcccctccgcctataaatagcacaggacgtgctcgccgtggcgatgacgcggctgggcaggcggaggggaaggaggcagctctgccagagcggtgggcggcgagcgcggcggcgggaggggtgcggcccctccatgctgggctccgatgacaggggcgactgagtcatcccggggacccacgggccacgactgtccccgccgccagcgtttctgtctccggctt

SEQ ID NO: 57109 - DNA, 4 bp, Homo sapiens
  chr17:37381007-37381011
  hyper
gcag

SEQ ID NO: 57110 - DNA, 296 bp, Homo sapiens
  chr17:37381850-37382146
  hyper
gttctccagaggctgcccccagttagcccccggcacggcagcccccaacccgcgggagcgggcagagaaagttgccggggtggcgggcgaggggaggccaccacgctgagccgcaggagcgggacgaccccgggcgcgaggaccgagggtctgcagaggatgctgctcgcagcgcggggaggagggaagtggggccgcggggatgagccgagggagggagccaaggagctgtccgtgtccagccggctccgccgtccgctgcgcccgccccccatcccctcccctcccccgccggc

SEQ ID NO: 57111 - DNA, 52 bp, Homo sapiens; identical to SEQ ID NO: 36498
  chr17:37388387-37388439
  hyper

SEQ ID NO: 57112 - DNA, 131 bp, Homo sapiens; identical to SEQ ID NO: 36499
  chr17:37752808-37752939
  hyper

SEQ ID NO: 57113 - DNA, 361 bp, Homo sapiens; identical to SEQ ID NO: 36500
  chr17:37753021-37753382
  hyper

SEQ ID NO: 57114 - DNA, 144 bp, Homo sapiens; identical to SEQ ID NO: 36501
  chr17:37755368-37755512
  hyper

SEQ ID NO: 57115 - DNA, 117 bp, Homo sapiens; identical to SEQ ID NO: 36502
  chr17:37756218-37756335
  hyper

SEQ ID NO: 57116 - DNA, 30 bp, Homo sapiens; identical to SEQ ID NO: 36503
  chr17:37760128-37760158
  hyper

SEQ ID NO: 57117 - DNA, 121 bp, Homo sapiens
  chr17:37760367-37760488
  hyper
ccaggtggcacccaccgaggcacagtccgggcaggggtggggctgcccccaggtctccatccccacccctcaccccaggaggggacagaatggccgcggggaggaggagccggcgagctca

SEQ ID NO: 57118 - DNA, 98 bp, Homo sapiens
  chr17:37760561-37760659
  hyper
caaaccctccctccccaaaccgaccccccaacagtttgccattccatacaaatttggaaacaggtttttaaaaaacagcatgacgcacaacggggacg

SEQ ID NO: 57119 - DNA, 762 bp, Homo sapiens
  chr17:37761235-37761997
  hyper
tcaagaaagagggagcgcctggctcctttttgcctcggcagctgggtgtctgtttttaaaataataatgagagggggaaacgcgttccattgctcagctgcccccttaccaacgccttgggcctgcagggaggagggggaggaggaaacctcagcgaagatattgggaatgggggaggggtgcctccagggagcccccggagagaggtccctggagaagcactccttgggagagaggaggagggaaccccttggggagagagaaggcgagtcccctgggggaagcgaggcccctgggacaggccacccacaggtaacaggactgcgctgccccaggagagcggcaggaccggtggcccgctccccgcgcccggcgccggggtaggatgggggtgtccctgcgctctgggggctggggacaggggggcgggcaaaggcaaaagaaaaagaagggagccggcgcgaagtctcagttatgaaaaaacgcattgagctcctcgtacatggggccccggtcgtggtgaaggtgcatatcgtaagacaagagattctccgagtggacgcccccgcgcacagccgacgagccgaagactagcccgtggcccgtgggccgcgaaccgggcagcgccgagtagtgcatagagtagtggtagcttttctcgtggtcgggcgaggagtcctgcttgagtgagaagttgccattgagacagagcggggggctgagcgggccctcgtactcggagctgttgtagtccgggctcgc

SEQ ID NO: 57120 - DNA, 446 bp, Homo sapiens; identical to SEQ ID NO: 22498
  chr17:37762334-37762780
  hyper

SEQ ID NO: 57121 - DNA, 45 bp, Homo sapiens; identical to SEQ ID NO: 36506
  chr17:37763928-37763973
  hyper

SEQ ID NO: 57122 - DNA, 186 bp, Homo sapiens; identical to SEQ ID NO: 36507
  chr17:37783470-37783656
  hyper

SEQ ID NO: 57123 - DNA, 30 bp, Homo sapiens; identical to SEQ ID NO: 36508
  chr17:37794096-37794126
  hyper

SEQ ID NO: 57124 - DNA, 269 bp, Homo sapiens; identical to SEQ ID NO: 36509
  chr17:37856457-37856726
  hyper

SEQ ID NO: 57125 - DNA, 94 bp, Homo sapiens; identical to SEQ ID NO: 36510
  chr17:37857113-37857207
  hyper

SEQ ID NO: 57126 - DNA, 306 bp, Homo sapiens; identical to SEQ ID NO: 36511
  chr17:38264389-38264695
  hyper

SEQ ID NO: 57127 - DNA, 86 bp, Homo sapiens
  chr17:38347474-38347560
  hyper
cctttcgctcctcatcgccttgcactgccatcttcccacccactcccctcaccccctggcgccctggccgcccctccgctgccgtg

SEQ ID NO: 57128 - DNA, 25 bp, Homo sapiens
  chr17:38347753-38347778
  hyper
cggccgtcggcgggatggggggccg

SEQ ID NO: 57129 - DNA, 114 bp, Homo sapiens; identical to SEQ ID NO: 36514
  chr17:38478719-38478833
  hyper

SEQ ID NO: 57130 - DNA, 30 bp, Homo sapiens; identical to SEQ ID NO: 36515
  chr17:39683809-39683839
  hyper

SEQ ID NO: 57131 - DNA, 104 bp, Homo sapiens
  chr17:40332839-40332943
  hyper
acttgccccccagctcgaacctcaagccccgacctccgtcccactcacgcgttccgtcaaaacgggtggcgatggtgtccaggaaggtgttttgcggggccagc

SEQ ID NO: 57132 - DNA, 30 bp, Homo sapiens; identical to SEQ ID NO: 36517
  chr17:40400826-40400856
  hyper

SEQ ID NO: 57133 - DNA, 88 bp, Homo sapiens; identical to SEQ ID NO: 22502
  chr17:40464190-40464278
  hyper

SEQ ID NO: 57134 - DNA, 70 bp, Homo sapiens
  chr17:40464317-40464387
  hyper
cgccaagatgcttctcaaccctcggggccaggggcagtcccagagccgcaacaaccgtcccatcctcctc

SEQ ID NO: 57135 - DNA, 36 bp, Homo sapiens; identical to SEQ ID NO: 36519
  chr17:40573790-40573826
  hyper

SEQ ID NO: 57136 - DNA, 30 bp, Homo sapiens; identical to SEQ ID NO: 36520
  chr17:40669662-40669692
  hyper

SEQ ID NO: 57137 - DNA, 106 bp, Homo sapiens; identical to SEQ ID NO: 36521
  chr17:40912947-40913053
  hyper

SEQ ID NO: 57138 - DNA, 261 bp, Homo sapiens; identical to SEQ ID NO: 36522
  chr17:40932562-40932823
  hyper

SEQ ID NO: 57139 - DNA, 59 bp, Homo sapiens; identical to SEQ ID NO: 12713
  chr17:40932843-40932902
  hyper

SEQ ID NO: 57140 - DNA, 30 bp, Homo sapiens; identical to SEQ ID NO: 36524
  chr17:40933234-40933264
  hyper

SEQ ID NO: 57141 - DNA, 80 bp, Homo sapiens; identical to SEQ ID NO: 36525
  chr17:41723454-41723534
  hyper

SEQ ID NO: 57142 - DNA, 56 bp, Homo sapiens; identical to SEQ ID NO: 36526
  chr17:41723778-41723834
  hyper

SEQ ID NO: 57143 - DNA, 32 bp, Homo sapiens; identical to SEQ ID NO: 36527
  chr17:41832619-41832651
  hyper

SEQ ID NO: 57144 - DNA, 217 bp, Homo sapiens; identical to SEQ ID NO: 36528
  chr17:41983831-41984048
  hyper

SEQ ID NO: 57145 - DNA, 81 bp, Homo sapiens; identical to SEQ ID NO: 36529
  chr17:41984266-41984347
  hyper

SEQ ID NO: 57146 - DNA, 209 bp, Homo sapiens; identical to SEQ ID NO: 36530
  chr17:41984363-41984572
  hyper

SEQ ID NO: 57147 - DNA, 79 bp, Homo sapiens
  chr17:42061257-42061336
  hyper
ccgggctgagtgttccgaggcgagcggctgctgtttgcgcagctaagtggcgtctgtgtacccagcggggcgcagcggt

SEQ ID NO: 57148 - DNA, 39 bp, Homo sapiens
  chr17:42061381-42061420
  hyper
cacggccgcgccgccccatttgcacgccccggccgccgg

SEQ ID NO: 57149 - DNA, 88 bp, Homo sapiens; identical to SEQ ID NO: 36533
  chr17:42082176-42082264
  hyper

SEQ ID NO: 57150 - DNA, 53 bp, Homo sapiens
  chr17:42082469-42082522
  hyper
cggcgtgggccgtgacgcagcgaggggatggggttgtgcggccacctgtcctc

SEQ ID NO: 57151 - DNA, 138 bp, Homo sapiens; identical to SEQ ID NO: 36535
  chr17:42082805-42082943
  hyper

SEQ ID NO: 57152 - DNA, 160 bp, Homo sapiens; identical to SEQ ID NO: 36536
  chr17:42083143-42083303
  hyper

SEQ ID NO: 57153 - DNA, 98 bp, Homo sapiens; identical to SEQ ID NO: 36537
  chr17:42083525-42083623
  hyper

SEQ ID NO: 57154 - DNA, 30 bp, Homo sapiens; identical to SEQ ID NO: 36538
  chr17:42091732-42091762
  hyper

SEQ ID NO: 57155 - DNA, 97 bp, Homo sapiens; identical to SEQ ID NO: 36539
  chr17:42393478-42393575
  hyper

SEQ ID NO: 57156 - DNA, 82 bp, Homo sapiens; identical to SEQ ID NO: 22513
  chr17:42394024-42394106
  hyper

SEQ ID NO: 57157 - DNA, 22 bp, Homo sapiens
  chr17:42635273-42635295
  hyper
tgcaccagttctatccgctggt

SEQ ID NO: 57158 - DNA, 185 bp, Homo sapiens
  chr17:42733526-42733711
  hyper
cggtgcctgccagtccgggccaatcccgaacacatttactttgagcgggaaaagctcagaagcggcgagagagcgtggtccgctaaccgccccttcctctccttgtctctggggggtaacggagcctggagtggtcgcccattggatgggcatcggaccaatggcgggctgcgaaacgggagggg

SEQ ID NO: 57159 - DNA, 22 bp, Homo sapiens
  chr17:42733884-42733906
  hyper
cggggtgcgggctgagggagcc

SEQ ID NO: 57160 - DNA, 66 bp, Homo sapiens; identical to SEQ ID NO: 36543
  chr17:42906582-42906648
  hyper

SEQ ID NO: 57161 - DNA, 182 bp, Homo sapiens; identical to SEQ ID NO: 36544
  chr17:42907014-42907196
  hyper

SEQ ID NO: 57162 - DNA, 200 bp, Homo sapiens; identical to SEQ ID NO: 22519
  chr17:42907951-42908151
  hyper

SEQ ID NO: 57163 - DNA, 80 bp, Homo sapiens; identical to SEQ ID NO: 12729
  chr17:42988684-42988764
  hyper

SEQ ID NO: 57164 - DNA, 150 bp, Homo sapiens
  chr17:43044508-43044658
  hyper
ccccaagggcaagtccgtgcacctgggagccctgcgctctgactagttgggttcatttcccgcatttccagtagcgttccagacggtgcccagcagcgtctgtcttggagcgggaacccaggaactgaggatcggcgatgtccgctggct

SEQ ID NO: 57165 - DNA, 119 bp, Homo sapiens
  chr17:43044688-43044807
  hyper
gggccgctgtggggtgggatctccacctgcgtccgcctggcgcccccgccaactccgatcaggtacccatttgccccgggctccctgggtgccctgggcccagcccagccccatgcccc

SEQ ID NO: 57166 - DNA, 6 bp, Homo sapiens
  chr17:43044863-43044869
  hyper
cgccgc

SEQ ID NO: 57167 - DNA, 150 bp, Homo sapiens; identical to SEQ ID NO: 22521
  chr17:43045116-43045266
  hyper

SEQ ID NO: 57168 - DNA, 141 bp, Homo sapiens; identical to SEQ ID NO: 36550
  chr17:43045371-43045512
  hyper

SEQ ID NO: 57169 - DNA, 233 bp, Homo sapiens; identical to SEQ ID NO: 36551
  chr17:43047752-43047985
  hyper

SEQ ID NO: 57170 - DNA, 38 bp, Homo sapiens
  chr17:43339899-43339937
  hyper
catgaccaaggaactcagcaccccgtgtgccccagctc

SEQ ID NO: 57171 - DNA, 25 bp, Homo sapiens
  chr17:43974231-43974256
  hyper
gtgatgaacctggtacgcacggttt

SEQ ID NO: 57172 - DNA, 42 bp, Homo sapiens
  chr17:43974358-43974400
  hyper
gaatttctggggaatggcttggctgcccgcccgggaccaggc

SEQ ID NO: 57173 - DNA, 102 bp, Homo sapiens; identical to SEQ ID NO: 36555
  chr17:44919159-44919261
  hyper

SEQ ID NO: 57174 - DNA, 88 bp, Homo sapiens; identical to SEQ ID NO: 36556
  chr17:44928630-44928718
  hyper

SEQ ID NO: 57175 - DNA, 101 bp, Homo sapiens; identical to SEQ ID NO: 36557
  chr17:44929256-44929357
  hyper

SEQ ID NO: 57176 - DNA, 130 bp, Homo sapiens; identical to SEQ ID NO: 36558
  chr17:44929573-44929703
  hyper

SEQ ID NO: 57177 - DNA, 34 bp, Homo sapiens; identical to SEQ ID NO: 12740
  chr17:45055871-45055905
  hyper

SEQ ID NO: 57178 - DNA, 117 bp, Homo sapiens; identical to SEQ ID NO: 36560
  chr17:45056144-45056261
  hyper

SEQ ID NO: 57179 - DNA, 37 bp, Homo sapiens; identical to SEQ ID NO: 36561
  chr17:45056814-45056851
  hyper

SEQ ID NO: 57180 - DNA, 30 bp, Homo sapiens; identical to SEQ ID NO: 36562
  chr17:45331645-45331675
  hyper

SEQ ID NO: 57181 - DNA, 304 bp, Homo sapiens
  chr17:45810546-45810850
  hyper
ggagtgggggggagccggagagcttcataaagccacagcaaagcgctgcgactctagtgacagcggcccgctggagaggaagcccgagagctgccgcgcgcctgccggacgagggcgtagaagccaggcgtcagagcccgggctccggtggggtcccccacccggccctcgggtcccccgccccctgctccctgcccatcccagcccacgcgaccctctcgcgcgcggaggggcgggtcctcgacggctacgggaaggtgccagcccgccccggatgggcatcgtggagccgggttgcggagac

SEQ ID NO: 57182 - DNA, 78 bp, Homo sapiens
  chr17:45811341-45811419
  hyper
ctgtgcccgcgccggaacaagaacgtctcgtctgtttttctggctcgacaatgcttctgactccgtgtccctcactgc

SEQ ID NO: 57183 - DNA, 288 bp, Homo sapiens
  chr17:45867027-45867315
  hyper
acttgtactttcaaccacgtcccccactccaaaattctgcgcctccctcaagccagttcctcctctgcttcctcctcgcagcagccggcgcgtctttgttccgtccaggcatcttcaacgcgtccctccctctggacgctgccgaggaaatactgaagtggtagaggatgtggggaggccgtccaagagtggaggtgtcccgggcctgctctctccaggaggaggagtgcaggctggggtccacctccccggtccagcagtgctggggaggggaccccgcacgtgtgc

SEQ ID NO: 57184 - DNA, 24 bp, Homo sapiens
  chr17:45867460-45867484
  hyper
ctcaaagaccgccagctctggggg

SEQ ID NO: 57185 - DNA, 156 bp, Homo sapiens; identical to SEQ ID NO: 36565
  chr17:46089946-46090102
  hyper

SEQ ID NO: 57186 - DNA, 30 bp, Homo sapiens; identical to SEQ ID NO: 36566
  chr17:46507708-46507738
  hyper

SEQ ID NO: 57187 - DNA, 36 bp, Homo sapiens; identical to SEQ ID NO: 36567
  chr17:46619087-46619123
  hyper

SEQ ID NO: 57188 - DNA, 259 bp, Homo sapiens; identical to SEQ ID NO: 22534
  chr17:46621094-46621353
  hyper

SEQ ID NO: 57189 - DNA, 77 bp, Homo sapiens
  chr17:46621779-46621856
  hyper
gaaccccaacaggctcgccaccattttttttaaacctccttccactgctttttctccccctcttctagctgcccctc

SEQ ID NO: 57190 - DNA, 102 bp, Homo sapiens; identical to SEQ ID NO: 22535
  chr17:46621909-46622011
  hyper

SEQ ID NO: 57191 - DNA, 78 bp, Homo sapiens; identical to SEQ ID NO: 22536
  chr17:46655070-46655148
  hyper

SEQ ID NO: 57192 - DNA, 216 bp, Homo sapiens; identical to SEQ ID NO: 22537
  chr17:46655178-46655394
  hyper

SEQ ID NO: 57193 - DNA, 24 bp, Homo sapiens
  chr17:46655395-46655419
  hyper
gcgcaggagcccgaggggacagac

SEQ ID NO: 57194 - DNA, 50 bp, Homo sapiens; identical to SEQ ID NO: 22539
  chr17:46659859-46659909
  hyper

SEQ ID NO: 57195 - DNA, 191 bp, Homo sapiens
  chr17:46663552-46663743
  hyper
agacaagagaggagacgcctaaatcactgagaaaaggaataagaagagagggaagagaaacgttaaaacttggggacaaggtgctttttgggatccgacaggttcccgaattgcccgaagtccaatactctccaggctcccaaatttcccctcttcctcttggagcctgcaatcagtaaattcgccaaaag

SEQ ID NO: 57196 - DNA, 553 bp, Homo sapiens; identical to SEQ ID NO: 36577
  chr17:46670978-46671531
  hyper

SEQ ID NO: 57197 - DNA, 200 bp, Homo sapiens
  chr17:46674970-46675170
  hyper
tatctcctaactgagatgcccacccagcaccctgtgggagattggggcagggggcgctcactagttctgtgtcccggggtgggcgcccaggggagccggggcgacggcgacgggaagtctcactcactgttgcacgaattcatccgctgcatccacgggtagaccggagtggagcacttctgctcttctgtctcgccgaa

SEQ ID NO: 57198 - DNA, 157 bp, Homo sapiens
  chr17:46675600-46675757
  hyper
tatatccgagattgggttttagctgaggggggatggcgaggtgccagtgagggccagaaggaaatacaaccatctgatccaacactgaccaatggcagaggcaggaattgtcaaatagcacccaggaggagcgcagcccgcacgagggacccgcgca

SEQ ID NO: 57199 - DNA, 1002 bp, Homo sapiens; identical to SEQ ID NO: 36579
  chr17:46687804-46688806
  hyper

SEQ ID NO: 57200 - DNA, 378 bp, Homo sapiens; identical to SEQ ID NO: 36580
  chr17:46689986-46690364
  hyper

SEQ ID NO: 57201 - DNA, 38 bp, Homo sapiens
  chr17:46690429-46690467
  hyper
cgctgcggtgggaggcccggctcctggccccgctagcg

SEQ ID NO: 57202 - DNA, 41 bp, Homo sapiens; identical to SEQ ID NO: 22546
  chr17:46690664-46690705
  hyper

SEQ ID NO: 57203 - DNA, 53 bp, Homo sapiens; identical to SEQ ID NO: 36582
  chr17:46690852-46690905
  hyper

SEQ ID NO: 57204 - DNA, 63 bp, Homo sapiens
  chr17:46691442-46691505
  hyper
ggaaatgtttctaagcgacccccttcaagggaaagaaaaaagaaagaagaaagaaagataaga

SEQ ID NO: 57205 - DNA, 213 bp, Homo sapiens
  chr17:46691592-46691805
  hyper
tgggcccttccggccccctcctgcccttgtcggccccgaggcgagctcaccttgcgggcgcatccaggggaagagctgtgtgggcgacgggctctgctcggagccctcggcctcctcgcccaggccgctggcggcggcaagcttgcagtctgcgtactgcaccaggtctggatcctgcgcaccgaataggctctggcgttgcagcgggtcgta

SEQ ID NO: 57206 - DNA, 255 bp, Homo sapiens; identical to SEQ ID NO: 22548
  chr17:46692110-46692365
  hyper

SEQ ID NO: 57207 - DNA, 141 bp, Homo sapiens; identical to SEQ ID NO: 36585
  chr17:46702566-46702707
  hyper

SEQ ID NO: 57208 - DNA, 6 bp, Homo sapiens
  chr17:46710940-46710946
  hyper
gtccag

SEQ ID NO: 57209 - DNA, 10 bp, Homo sapiens
  chr17:46713949-46713959
  hyper
tctgtggtct

SEQ ID NO: 57210 - DNA, 58 bp, Homo sapiens; identical to SEQ ID NO: 22549
  chr17:46714072-46714130
  hyper

SEQ ID NO: 57211 - DNA, 154 bp, Homo sapiens; identical to SEQ ID NO: 12768
  chr17:46714131-46714285
  hyper

SEQ ID NO: 57212 - DNA, 301 bp, Homo sapiens; identical to SEQ ID NO: 36589
  chr17:46723899-46724200
  hyper

SEQ ID NO: 57213 - DNA, 43 bp, Homo sapiens; identical to SEQ ID NO: 36590
  chr17:46755656-46755699
  hyper

SEQ ID NO: 57214 - DNA, 205 bp, Homo sapiens; identical to SEQ ID NO: 22551
  chr17:46795436-46795641
  hyper

SEQ ID NO: 57215 - DNA, 147 bp, Homo sapiens; identical to SEQ ID NO: 22552
  chr17:46797582-46797729
  hyper

SEQ ID NO: 57216 - DNA, 172 bp, Homo sapiens; identical to SEQ ID NO: 36596
  chr17:46799288-46799460
  hyper

SEQ ID NO: 57217 - DNA, 30 bp, Homo sapiens; identical to SEQ ID NO: 36598
  chr17:46800233-46800263
  hyper

SEQ ID NO: 57218 - DNA, 112 bp, Homo sapiens
  chr17:46800489-46800601
  hyper
gcctggggggaggggcggggtgtcctgcttttgggctagaggcccggggccgctcccgagctttctcccctcttccctggagagcgactgttcgggagggtgagaatggtat

SEQ ID NO: 57219 - DNA, 293 bp, Homo sapiens
  chr17:46800668-46800961
  hyper
gtttacggtaacgagttcatctatttaattcgcggttgcagctcggggatttctattagacaggacgggttggggccggggggcacagggtctcccctgaaggaaacccaattagagtgcagcacttagcaccttcaatataactttaatgaagggggggaggggagctgcagggaagagaagtttgctctaggttggggaaggaaagctggagctgctcccgagaactggggggcctggatgaggctttttcctgcttcgagggctttccagcttccggcccgggaactact

SEQ ID NO: 57220 - DNA, 30 bp, Homo sapiens; identical to SEQ ID NO: 36601
  chr17:46801636-46801666
  hyper

SEQ ID NO: 57221 - DNA, 202 bp, Homo sapiens
  chr17:46802257-46802459
  hyper
catctccgttagtggcggtggcagcccctcttgtggcctttttcctctctccaaggggtcaccccgcaccatgccgctccccctcatctatcttgccccctccccacaggcccatctgcgctgaactctcgccagttccgaagtcggcgagggagggggtttacttgcccgatcgttggtgggtttgagcttatagaggcag

SEQ ID NO: 57222 - DNA, 30 bp, Homo sapiens; identical to SEQ ID NO: 36604
  chr17:46803786-46803816
  hyper

SEQ ID NO: 57223 - DNA, 352 bp, Homo sapiens; identical to SEQ ID NO: 36606
  chr17:46805572-46805924
  hyper

SEQ ID NO: 57224 - DNA, 107 bp, Homo sapiens; identical to SEQ ID NO: 36607
  chr17:46806788-46806895
  hyper

SEQ ID NO: 57225 - DNA, 143 bp, Homo sapiens
  chr17:46810273-46810416
  hyper
cctgcacaacccaggcgtcctgatcttccagactgactgggctgagcctggccttcccctaaccccacagatgcctttgtgtcctgctgggagcctcctggcagaccctccgggagcccggagcctcccccagctttctttac

SEQ ID NO: 57226 - DNA, 138 bp, Homo sapiens; identical to SEQ ID NO: 22559
  chr17:46810958-46811096
  hyper

SEQ ID NO: 57227 - DNA, 30 bp, Homo sapiens; identical to SEQ ID NO: 36610
  chr17:46812585-46812615
  hyper

SEQ ID NO: 57228 - DNA, 71 bp, Homo sapiens; identical to SEQ ID NO: 36611
  chr17:46815930-46816001
  hyper

SEQ ID NO: 57229 - DNA, 12 bp, Homo sapiens
  chr17:46816270-46816282
  hyper
gggtcaggtctt

SEQ ID NO: 57230 - DNA, 230 bp, Homo sapiens; identical to SEQ ID NO: 22561
  chr17:46825054-46825284
  hyper

SEQ ID NO: 57231 - DNA, 26 bp, Homo sapiens
  chr17:46830110-46830136
  hyper
cccagggccccctccgggttctccca

SEQ ID NO: 57232 - DNA, 64 bp, Homo sapiens; identical to SEQ ID NO: 36619
  chr17:46830189-46830253
  hyper

SEQ ID NO: 57233 - DNA, 40 bp, Homo sapiens; identical to SEQ ID NO: 36620
  chr17:46830483-46830523
  hyper

SEQ ID NO: 57234 - DNA, 154 bp, Homo sapiens
  chr17:46832639-46832793
  hyper
caacaggacctccaagccagcctcacgcacgcaggcctggctctctcctgcagaatccccacctgccctataactacccacttcagatatgggggaatggaggagatattccaatcacgccatctacctacagtttccacggccccttctgttg

SEQ ID NO: 57235 - DNA, 61 bp, Homo sapiens; identical to SEQ ID NO: 36623
  chr17:46918852-46918913
  hyper

SEQ ID NO: 57236 - DNA, 129 bp, Homo sapiens
  chr17:47072676-47072805
  hyper
acaaaaacaaaaatccgacaaacacgtggctgggtagaacaaaacgctcattggggagggtgggctctaaggtggtggaggatatagagaaaccgagttggaagccctcccccgcccctaagtcccagc

SEQ ID NO: 57237 - DNA, 95 bp, Homo sapiens
  chr17:47073465-47073560
  hyper
cgggtccttccctcgggctccgggagccggaggatccggaatgagttggtcaaagccgagggaagggacccaggcggatccgcttccccctcccc

SEQ ID NO: 57238 - DNA, 35 bp, Homo sapiens
  chr17:47073953-47073988
  hyper
ttccttgtctcccaccgttcctgtctcctggagtc

SEQ ID NO: 57239 - DNA, 181 bp, Homo sapiens; identical to SEQ ID NO: 22565
  chr17:47074228-47074409
  hyper

SEQ ID NO: 57240 - DNA, 265 bp, Homo sapiens
  chr17:47074895-47075160
  hyper
tctcctgggctctccccgaactctcccgcgacctctgcgcgccctcaggccgccttccccgccctgggctcgggacaacttctggggtggggtgcaaagaaagtttgcggctcctgccgccggcctctccgcctcttggcctaggaggctcgccgcccgcgcccgctcgttcggccttgcccgggaccgcgtcctgccccgagaccgccaccatgaacaagctttacatcggcaacctcaacgagagcgtgacccccgcggactt

SEQ ID NO: 57241 - DNA, 52 bp, Homo sapiens
  chr17:47075364-47075416
  hyper
caactcctctcttcccgggcctgcggggtttggcctccgtacccaccctcga

SEQ ID NO: 57242 - DNA, 81 bp, Homo sapiens
  chr17:47075634-47075715
  hyper
cagcccctccctatccgccggtggacgcccccccagctggaaaaccccggctcccgttcctcagtcttaggcctttccagg

SEQ ID NO: 57243 - DNA, 78 bp, Homo sapiens
  chr17:47076055-47076133
  hyper
cagagaaaaataaagtttcattctgcacactgcctcccgccccgcgccccactttctgaggaacggggagccctttct

SEQ ID NO: 57244 - DNA, 262 bp, Homo sapiens; identical to SEQ ID NO: 36631
  chr17:47081179-47081441
  hyper

SEQ ID NO: 57245 - DNA, 442 bp, Homo sapiens; identical to SEQ ID NO: 36632
  chr17:47210040-47210482
  hyper

SEQ ID NO: 57246 - DNA, 36 bp, Homo sapiens; identical to SEQ ID NO: 36633
  chr17:47307637-47307673
  hyper

SEQ ID NO: 57247 - DNA, 142 bp, Homo sapiens; identical to SEQ ID NO: 36634
  chr17:47308577-47308719
  hyper

SEQ ID NO: 57248 - DNA, 95 bp, Homo sapiens; identical to SEQ ID NO: 36635
  chr17:47547802-47547897
  hyper

SEQ ID NO: 57249 - DNA, 396 bp, Homo sapiens
  chr17:47573694-47574090
  hyper
ggggagtgcccacttcgccggggcgaacccgctcccggggttcccccacggccggcgggctcctccgacgcgcgtgttctcacggcttgaagcagcgcagcggatcgcgagggacggagcgggtgtgcccctacccgggctggcggtggctacgtctcggggtgcagagcgccggggcgcactaggcggggacccttcctggccgcgcgcagctctggctacgcaggcgggaggcggcaggcagggggcgctgcggggcgaggcaagtgcagtccgccgctgcctgcctgcgagtctggggctgcgcgccgctccccacctagctgcgcgacccgagcgccgcgcccaccgcgctccgtgggctcccgcgcctcgaagggtcgggatccggtctga

SEQ ID NO: 57250 - DNA, 1105 bp, Homo sapiens
  chr17:47574149-47575254
  hyper
gcctcggattctgtagcgcggtatcccgggccaccgactcggcaaaggtcggcgggtcctccgggtggtccgacgagattgtcagatgtggcctgctttatggccatgaaccgaatgccctggaaggtctggcaacggaggaggcgtcttcactctccccgccagcatctttcatcagagcactgcgccccaaattccggctttacagatacggagactgaggctctgagagtttaaacgacttggccaagatctcacagcaagttgggccagagtcgtggctagactccccgacctgattcccagctcggtactcccccaccttttcagggggcagccgctgtcccagctcggggtcacggctgcgtttcccagcagggcggggggggttgacactgtccccagagtccgtcggcggtagagcctgcgggtgaggtgggcagagattctgtccgggtgcgggccccagcccgaaagctcagccccagttccctggagctgtcaggacctgtggctgcgtccggggatttgggagcgaccgcgggcacgtctgctgactaacgccgctggttagagacgctgctcagacgcgggtgggcgagcgtagaccaggagagcggggaggagggaccggatcccagaggggcaacgacttgggctccgggtctgggcaagagcgagggtccccgcgcgaagacccaaggaaggaggggagctgggcgtggaggacctgggcgcttgggaaggtgtaccccgacaggaacctgccgtctgcagcccctgcggctcccgcctccgcctcggcgcgcggctgctcggtctgggatggctgtgcgcggtccgagtttcttcctgggccgcggtgagagagagagggctgaaaccagagcgcgtcccggcgggtcggctggcgggccgcgccggtaatggaggcactttgtcattcagacgtctgtaaccagagccgccgggctggctaatgcgcctaatagggatggaacgagggcagcaaatgggcgtgcgtgagcggccgggctgagctgggtggatggtggatggggaggcagctccgcgggggacgggcccctaccgcactgttccagcc

SEQ ID NO: 57251 - DNA, 295 bp, Homo sapiens; identical to SEQ ID NO: 36637
  chr17:47928151-47928446
  hyper

SEQ ID NO: 57252 - DNA, 103 bp, Homo sapiens; identical to SEQ ID NO: 36638
  chr17:47967958-47968061
  hyper

SEQ ID NO: 57253 - DNA, 311 bp, Homo sapiens; identical to SEQ ID NO: 22574
  chr17:47987619-47987930
  hyper

SEQ ID NO: 57254 - DNA, 85 bp, Homo sapiens; identical to SEQ ID NO: 36640
  chr17:48040403-48040488
  hyper

SEQ ID NO: 57255 - DNA, 352 bp, Homo sapiens
  chr17:48041320-48041672
  hyper
cctaggtctgggaaggtctgaagatcccggcggagctgccttcgttcggggccgggcaaattcgttgcagccgggttggcctcagggcctctcgccggctcgctatgtttccccggggcgccctggcaggccagccggcggtctgtcagtccagctcctggtgcgggcgcctcgttttggtccaccgggtccggggctgggacaccgagggaaaacttcagagctccgggccaccgagcctggaagttacgcgtcccccagcccacgcgtccccaatcccggggtatttcctgctccctcatccagcgaagttcagcgtcgcgtgtctccccagcggcgcagcctgcctcca

SEQ ID NO: 57256 - DNA, 56 bp, Homo sapiens
  chr17:48041721-48041777
  hyper
tctctctctgtctctctctctcttcctccgtccccccaccccgtgtcccaagaatt

SEQ ID NO: 57257 - DNA, 72 bp, Homo sapiens; identical to SEQ ID NO: 22575
  chr17:48042069-48042141
  hyper

SEQ ID NO: 57258 - DNA, 26 bp, Homo sapiens
  chr17:48042409-48042435
  hyper
aactgaaaatcactgcgaatgacaat

SEQ ID NO: 57259 - DNA, 144 bp, Homo sapiens
  chr17:48048808-48048952
  hyper
agccgtagggagcagcgggcctggagggaggccttggggctccatgatcgcgacccgggcagatctcgtaacttgctggaactggggtagggaaaggcagctgtccgggaaggaacttggagggggtctgctgggagagttggg

SEQ ID NO: 57260 - DNA, 248 bp, Homo sapiens
  chr17:48049059-48049307
  hyper
ctgccagcccagagctgccagcagtggggtcgaggcaggggaggcaggacaggcgcgggcgggagcggaaacccaacggtttttctgggaattggttgaggcagggtcgaggagggaggatctcagaagcccgcagcgcccgaggccacgggtgagggatgcgggggaggtgacggcagctggtgaccgcggctggccgagggcgggtacactgacgtgtggagggtgagcccgactaggggaagaag

SEQ ID NO: 57261 - DNA, 44 bp, Homo sapiens
  chr17:48050526-48050570
  hyper
ccagcctgcagctgcagcacctaaaccagcgtttccagcacacg

SEQ ID NO: 57262 - DNA, 222 bp, Homo sapiens; identical to SEQ ID NO: 12817
  chr17:48070683-48070905
  hyper

SEQ ID NO: 57263 - DNA, 72 bp, Homo sapiens; identical to SEQ ID NO: 36647
  chr17:48071121-48071193
  hyper

SEQ ID NO: 57264 - DNA, 122 bp, Homo sapiens; identical to SEQ ID NO: 36648
  chr17:48071583-48071705
  hyper

SEQ ID NO: 57265 - DNA, 70 bp, Homo sapiens; identical to SEQ ID NO: 36650
  chr17:48585866-48585936
  hyper

SEQ ID NO: 57266 - DNA, 75 bp, Homo sapiens; identical to SEQ ID NO: 36651
  chr17:48619216-48619291
  hyper

SEQ ID NO: 57267 - DNA, 390 bp, Homo sapiens; identical to SEQ ID NO: 36652
  chr17:48619346-48619736
  hyper

SEQ ID NO: 57268 - DNA, 146 bp, Homo sapiens
  chr17:48636435-48636581
  hyper
atcccctccccccatcggccggggcgggaactgagacgaccccaaccctctgcggtggcgggaggtgcgcgggggctgcgtgggtggtgcagccttaggagagtgaacaacgcccaggggtgatggcctcagcaaagtgaggggtg

SEQ ID NO: 57269 - DNA, 111 bp, Homo sapiens
  chr17:48637136-48637247
  hyper
ttccttcttaggggtcctcgctctgctccgcagcccctcctggggatccgggctctgcggtccagcgcgacctgcctggggccacgtgttcaagcacgaagcccctgcgtg

SEQ ID NO: 57270 - DNA, 54 bp, Homo sapiens; identical to SEQ ID NO: 36654
  chr17:48637706-48637760
  hyper

SEQ ID NO: 57271 - DNA, 30 bp, Homo sapiens; identical to SEQ ID NO: 36655
  chr17:48712444-48712474
  hyper

SEQ ID NO: 57272 - DNA, 527 bp, Homo sapiens
  chr17:50235952-50236479
  hyper
gactctccaggtcgcgcgcgcccttcctgctcctctgctattttcctgaactccccagaacccccagttgcctggcttccatcgcccgcaactagcgccgctgtcgagattttccgcaatacaactgcaggggtcgttatttcctcgcctacggatccctacgcttcccaactcagagaggaggaggacaggtgggggcgggagggggaggaggagaaggaggcttggccaggtgagcgtcctcgccgccgccgggcgtcccagcgtcagctccgcagcccggcacccgggggcggaggcaggaggcccgggcggggaggtgaggctgagcgcggccatgaggaggaggaggaggaggctgggtgtcacagcttcaggccaccttggccgccgcctcggccccagtccctggcagccgcctccgcactccgccccgccctggctgcctctgttaccctccaggattttcgagtttctcttcttaaaaagaacttcgtgctgcgggttcggcgcgggagacccaggca

SEQ ID NO: 57273 - DNA, 60 bp, Homo sapiens; identical to SEQ ID NO: 36657
  chr17:50236690-50236750
  hyper

SEQ ID NO: 57274 - DNA, 30 bp, Homo sapiens; identical to SEQ ID NO: 36658
  chr17:50237251-50237281
  hyper

SEQ ID NO: 57275 - DNA, 25 bp, Homo sapiens
  chr17:53341227-53341252
  hyper
cgtcccactgaaaaacggttttctt

SEQ ID NO: 57276 - DNA, 87 bp, Homo sapiens; identical to SEQ ID NO: 36660
  chr17:53342183-53342270
  hyper

SEQ ID NO: 57277 - DNA, 48 bp, Homo sapiens
  chr17:53342828-53342876
  hyper
aatttgagtgcatcgcgatggagaaaatgtcccgaccgctccccctga

SEQ ID NO: 57278 - DNA, 558 bp, Homo sapiens
  chr17:53343089-53343647
  hyper
ctgatgaaattgaggagctcacccagcacccttcctccccttcctcctcctccatgaaaggggagggacccctcctgagctacatttaaaagagcttcgggcacccggcctccctgggtcccgctcctgcggcgcgggtgggaggtgtaacttgacaggtcaggatcgttccctagaacgaggcacacccgcacgcagagcgagcccgcctgcggagggcagagcctcccgggctggggaggagaaaccctggggcctggttctgtgcggggcagggggcgggggtcggcttgagggagggggtttcactgcgtagcctgggttttggggttgtgttacagcttctgttactggttagtatttggaactcacgaggtgtgagagaagactcgttttcttctggtgaagggtagctgagaaagcggggtgggggctggggccggtggggggagtggtctctcggcgggaagccgtgcacgcctccagcgttgacactttcccggtgcactttttctggtgggaggggagagcggagcaggctcacgtgtaaccgcgcag

SEQ ID NO: 57279 - DNA, 216 bp, Homo sapiens
  chr17:53922790-53923006
  hyper
cccaggacggcgtccgcgggcctcagcgactctgcggagggtttccgcgggatgctcaagggggcagtgtggtcctgccgaagagggccgcctcgcctcgaggaacgccttggccattttcacaggaaaatgtttaccctggaaattaaattatatttgggattttgggtttcccctcccccaccccgccgtgggaggtttcggaaagttactgtg

SEQ ID NO: 57280 - DNA, 30 bp, Homo sapiens; identical to SEQ ID NO: 36664
  chr17:54671575-54671605
  hyper

SEQ ID NO: 57281 - DNA, 343 bp, Homo sapiens; identical to SEQ ID NO: 36665
  chr17:54671992-54672335
  hyper

SEQ ID NO: 57282 - DNA, 155 bp, Homo sapiens; identical to SEQ ID NO: 36666
  chr17:54673918-54674073
  hyper

SEQ ID NO: 57283 - DNA, 248 bp, Homo sapiens
  chr17:54674738-54674986
  hyper
aaactttctgtgccccgggccaatatttttttagacagagtttcacttgcgaggggcggaggtggtggggagtggggaagaggaggggtcttatgcgaggggggcgaaagcaagaattttcatgcctggtaaacacgcgaattatgcgaagagagttattcccagctgggcgggcagccaaaactcggagagcgcgccgaggccagcgcccccacccccacgttggcaatgtcattggattacaatgc

SEQ ID NO: 57284 - DNA, 37 bp, Homo sapiens
  chr17:54675272-54675309
  hyper
tcctggaacattgtgcctaatgcgcagctggttacct

SEQ ID NO: 57285 - DNA, 20 bp, Homo sapiens
  chr17:54755949-54755969
  hyper
taaccccccaggaagcgctc

SEQ ID NO: 57286 - DNA, 33 bp, Homo sapiens; identical to SEQ ID NO: 36670
  chr17:54756362-54756395
  hyper

SEQ ID NO: 57287 - DNA, 134 bp, Homo sapiens
  chr17:56234271-56234405
  hyper
tttagaaagttatctcgccctccctcctcccccacaaaaaaagtttgagtcgccgctgcgggttgctagcggagtcgcgcgtcgggagctacgtagggcagggaaggcatggcttctgttttcgtccaatgaga

SEQ ID NO: 57288 - DNA, 97 bp, Homo sapiens
  chr17:56234743-56234840
  hyper
acgtgagccctaccacctgcaccctgagaaaacacaagaccaatccgaagccgcgcacagcctttaccacgtcccagctcctcgctctggagggcaa

SEQ ID NO: 57289 - DNA, 128 bp, Homo sapiens
  chr17:56326821-56326949
  hyper
gcgtcccctccgcctcgagcagaggctccttcccccatggggtcctgggctttggagccccggagccggcctgccgaagctcagcgaggatcgtgctggtttcaggaggaagcctgcgctgggcgccg

SEQ ID NO: 57290 - DNA, 49 bp, Homo sapiens
  chr17:56327222-56327271
  hyper
cccggagcccggccacgtggcggtcacgttctggccgccgcaggccaga

SEQ ID NO: 57291 - DNA, 181 bp, Homo sapiens; identical to SEQ ID NO: 22588
  chr17:56832946-56833127
  hyper

SEQ ID NO: 57292 - DNA, 336 bp, Homo sapiens
  chr17:56833221-56833557
  hyper
ggcaacctagtgctgatcgctcgtgccggtgcggccgttaaccgcccttgccggagccctaggctcaaaagcagccccttacccttcctgggcttcccccaacccctttcccggtctgccctggggcatgagcagcgatggccggctgcatccctgaggagaaaacttaccggcgcttcctggagctattcctgggcgagtttcgcggaccgtgcggcggcggcgagccggagccggaacccgaacccgaacccgaacccgaacccgagtccgagcccgagcccgaacctgaactggtagaagctgaggcggccgaggcttcggtagaggaacccg

SEQ ID NO: 57293 - DNA, 59 bp, Homo sapiens
  chr17:56834247-56834306
  hyper
cagtctgtcttttcccgggctgagtgccttgttgtttggcggcagagacgcgactcctt

SEQ ID NO: 57294 - DNA, 718 bp, Homo sapiens; identical to SEQ ID NO: 36677
  chr17:58212587-58213305
  hyper

SEQ ID NO: 57295 - DNA, 48 bp, Homo sapiens
  chr17:58216565-58216613
  hyper
cgaggactagcagcagatctggtgtgcagaaccctggattcgagtccc

SEQ ID NO: 57296 - DNA, 73 bp, Homo sapiens
  chr17:58217551-58217624
  hyper
tgttcagtcccaggcagtgcgggacaggtgggcgaagctcgaaccccatgctctgtcccggcactggcaggaa

SEQ ID NO: 57297 - DNA, 117 bp, Homo sapiens
  chr17:58218648-58218765
  hyper
aggccaaggctggcccgcttagggaccgcgctcgggctggacgtcgcgctcagcgcgcagggcccccatggacgtcgcgccgctgacctagctgtcagacatcgccacgaggagttg

SEQ ID NO: 57298 - DNA, 64 bp, Homo sapiens; identical to SEQ ID NO: 22594
  chr17:58218993-58219057
  hyper

SEQ ID NO: 57299 - DNA, 270 bp, Homo sapiens; identical to SEQ ID NO: 22595
  chr17:58227104-58227374
  hyper

SEQ ID NO: 57300 - DNA, 210 bp, Homo sapiens; identical to SEQ ID NO: 36683
  chr17:58228164-58228374
  hyper

SEQ ID NO: 57301 - DNA, 31 bp, Homo sapiens
  chr17:58499314-58499345
  hyper
agcccgtaggcactggcggggatctttatac

SEQ ID NO: 57302 - DNA, 91 bp, Homo sapiens; identical to SEQ ID NO: 36686
  chr17:59467463-59467554
  hyper

SEQ ID NO: 57303 - DNA, 92 bp, Homo sapiens; identical to SEQ ID NO: 22598
  chr17:59474741-59474833
  hyper

SEQ ID NO: 57304 - DNA, 44 bp, Homo sapiens; identical to SEQ ID NO: 22599
  chr17:59475100-59475144
  hyper

SEQ ID NO: 57305 - DNA, 53 bp, Homo sapiens; identical to SEQ ID NO: 36689
  chr17:59475357-59475410
  hyper

SEQ ID NO: 57306 - DNA, 283 bp, Homo sapiens
  chr17:59476127-59476410
  hyper
gaagagggggcttcaatcacaggtgctcgcagacaccccaactccctcacgcgttactcagcactccttaacttaggagacgtgcgcttccgagagatgagaagaaactaaaaaagtggttggcagggcgaagagaggaagccggtatttcggaagaaggagactttcgtctccggtaccggatagggcgaaaattcgttgggtcgcgggtggagaatccggggtccgcccgcgcggtgccgccctgtgctcagcgaaaggtgcgctcaccttcctggccccg

SEQ ID NO: 57307 - DNA, 1512 bp, Homo sapiens
  chr17:59476635-59478147
  hyper
gccgcccgagcctcccgactcgcccgcccaccggcctcgctttccagtgcctgctgtctctttccggggcgcagggacccccaggcggcgccacgacccggagctgggtcggaggccaggctggggctcgggccagagcggccgggcctctgggcgcgggagaaggagggcgccccctctccgctcggggtcgtgtcaatgctttgcacttggggccggcgtgcggctgcgggtccttccccaaggccccgggacccgggctcccctcgcctcaggccctttcggcgggtcaggtcggccctccgcgctctccagtccggcgcaggcagccgcaggcgcgggcgggcggtgggggccggggcaggaggaggggtctcggggcccggcggcccgtcattggttaatattttattctgttgacatgttttcttactgctgaggcttccgacaccttctcccaggccccccctcccggccggagcttggcctgagctgtcaaaaccccgcccccggagacccacaattggtccaaaaagcgtaaaatcagcaatcaaggggggcctggctcgttagcgcaggggatccgagctgggcaggacatgtgagatagtcacagttttccagagatcacgacaagatctaaccagtcgcgcgtggtccccggcgccggagcgggccagctcagcccggcccagcccggccccgcgcagagcccccgccgcccccgcgcacagagccgggtgccccttgcggtgcgccggacgggaagccccgaggagcagctgctgcgcccgccacccgggtcgtccgtccaccgcgcgcgccgccgcccgggccgggggtccgagccgcgcgcccccggccccggccccggcccccgggcgcctgggccggatgtcccgatgagagagccggcgctggcggccagcgccatggcttaccacccgttccacgcgccacggcccgccgacttccccatgtccgcctttctggcggcggcgcagccctccttcttcccggcactcgcgctgccgcccggcgcgctggccaagccgctgcccgacccgggcctggcgggggcggcggccgcggcggcggcggcggcagcagcggccgaggcggggctgcacgtctcggcactgggcccgcacccgcccgccgcgcatctgcgctccctcaagagcctggagcccgaggacgaggtggaggacgaccccaaggtgacgctggaggccaaggagctgtgggaccagttccacaagctaggcacggagatggtcatcaccaagtccgggaggtagggctgccggccggctggaaggcgcgcgggcgggcgggcgggctggggcacgggactgcacggatcagagcagagctggggactcccggctcccggctcccggctccaggttctggccctgacgccacgcttcgctcccacggacaaccaagttgacttttctcgtttggcaccggagcgatttttttttaaaacaaaaacgctaaaatcct

SEQ ID NO: 57308 - DNA, 76 bp, Homo sapiens
  chr17:59478602-59478678
  hyper
atcaggctctgtagcccagttcccaatacaaacaccctccagatttatttctgggagcttccgtcccaagtgggta

SEQ ID NO: 57309 - DNA, 368 bp, Homo sapiens; identical to SEQ ID NO: 36693
  chr17:59488634-59489002
  hyper

SEQ ID NO: 57310 - DNA, 72 bp, Homo sapiens; identical to SEQ ID NO: 36694
  chr17:59490147-59490219
  hyper

SEQ ID NO: 57311 - DNA, 195 bp, Homo sapiens; identical to SEQ ID NO: 22605
  chr17:59534556-59534751
  hyper

SEQ ID NO: 57312 - DNA, 41 bp, Homo sapiens
  chr17:59535096-59535137
  hyper
gcctctctgcctcctcgggcgtcagtgccacctcccttcgc

SEQ ID NO: 57313 - DNA, 48 bp, Homo sapiens; identical to SEQ ID NO: 22606
  chr17:59535219-59535267
  hyper

SEQ ID NO: 57314 - DNA, 21 bp, Homo sapiens
  chr17:59539215-59539236
  hyper
gtccccagggacctccgagaa

SEQ ID NO: 57315 - DNA, 110 bp, Homo sapiens
  chr17:59539601-59539711
  hyper
cctgtttcatgatcagaggagaagccccgggctttcatctcctcccgggccggcgagcaggcggcttgtttattcccctggcggagccgtttccgcgtgtgccgtgggga

SEQ ID NO: 57316 - DNA, 301 bp, Homo sapiens; identical to SEQ ID NO: 36704
  chr17:60705635-60705936
  hyper

SEQ ID NO: 57317 - DNA, 90 bp, Homo sapiens; identical to SEQ ID NO: 36705
  chr17:61600708-61600798
  hyper

SEQ ID NO: 57318 - DNA, 165 bp, Homo sapiens; identical to SEQ ID NO: 36706
  chr17:61777909-61778074
  hyper

SEQ ID NO: 57319 - DNA, 27 bp, Homo sapiens
  chr17:61926145-61926172
  hyper
aaaaaaacaagactttttgcaaattat

SEQ ID NO: 57320 - DNA, 22 bp, Homo sapiens
  chr17:61926603-61926625
  hyper
atcaggaaaaccgctctccggc

SEQ ID NO: 57321 - DNA, 54 bp, Homo sapiens; identical to SEQ ID NO: 36710
  chr17:62776217-62776271
  hyper

SEQ ID NO: 57322 - DNA, 275 bp, Homo sapiens; identical to SEQ ID NO: 36711
  chr17:62776523-62776798
  hyper

SEQ ID NO: 57323 - DNA, 270 bp, Homo sapiens; identical to SEQ ID NO: 36712
  chr17:62777021-62777291
  hyper

SEQ ID NO: 57324 - DNA, 141 bp, Homo sapiens; identical to SEQ ID NO: 36713
  chr17:64825634-64825775
  hyper

SEQ ID NO: 57325 - DNA, 229 bp, Homo sapiens; identical to SEQ ID NO: 36714
  chr17:64831214-64831443
  hyper

SEQ ID NO: 57326 - DNA, 60 bp, Homo sapiens; identical to SEQ ID NO: 36715
  chr17:64961565-64961625
  hyper

SEQ ID NO: 57327 - DNA, 45 bp, Homo sapiens; identical to SEQ ID NO: 12865
  chr17:64961987-64962032
  hyper

SEQ ID NO: 57328 - DNA, 169 bp, Homo sapiens; identical to SEQ ID NO: 22613
  chr17:66596302-66596471
  hyper

SEQ ID NO: 57329 - DNA, 459 bp, Homo sapiens
  chr17:66596525-66596984
  hyper
ggcctgcaacttggagctcgacccgctgtggctgccgccagccggttcagtccggggctcggttcgggaaaagttgtgcacgatcgtgccggggtccgaggcagctgcggccgagtcccgcgccagggaggaggcgcggccggtgcacgggcacccccgcgggcgctcccgaggccgcagctggcgctgtacttggggccagaggtggaagtagaggtcggcggagagcagcgcgcccagcagcagcagagtcagtaggcggtcccggcgcagccccggcatggcgtgctggccaagggggacgccgggggcaggccggctgtctccggggtcccgggaggggtcgcggggtgcgggcagaagaggtgcctggagtcccgcgggtgggccggggtcagtgagaccggaatgctccccgcgcgggctagtcccctgtggaggggtgtcgctcctcaactt

SEQ ID NO: 57330 - DNA, 494 bp, Homo sapiens
  chr17:66597021-66597515
  hyper
cagcgggcgtcgcttctccgcgccgagtgagccgagggaatggggttcccggggtgcccgcttcttgcgccttttctcccgtgcgcccgcccgcccggacgctcgcggcaggtgaagggccccggggcgccggcgccggctgccaccgcgggcggacgggcgacggggcggggggcgaccgcggagggcggacggaggccgccggctgcaaagcccggggcgtctctcctgaggatgctgtcgctcggcggcggctgctagtgctcccgcgactcctcctgcgggcggcggagacgccagtgccggcggctggcacgggcggcgcgagtggggagttggcgaagcaggagcggctccggggagcttgtctgtgcgcctggactcctagaggcagaggtagcgcggggcctccccgagcctggcctggcgccggcacccccacccactctccgctggcacctgcctctggcgcagctgacggccaactcccgatc

SEQ ID NO: 57331 - DNA, 749 bp, Homo sapiens; identical to SEQ ID NO: 36718
  chr17:68165237-68165986
  hyper

SEQ ID NO: 57332 - DNA, 30 bp, Homo sapiens; identical to SEQ ID NO: 36720
  chr17:70026970-70027000
  hyper

SEQ ID NO: 57333 - DNA, 100 bp, Homo sapiens
  chr17:70112816-70112916
  hyper
aaattttccgcagggcgttctagggatgagttgagggaagccgcatgacgcgcggctccccggtgccacagctaaggacagatattttcgcaaaacccag

SEQ ID NO: 57334 - DNA, 30 bp, Homo sapiens; identical to SEQ ID NO: 36724
  chr17:70115315-70115345
  hyper

SEQ ID NO: 57335 - DNA, 16 bp, Homo sapiens
  chr17:70215667-70215683
  hyper
ccagggcagcagacac

SEQ ID NO: 57336 - DNA, 59 bp, Homo sapiens; identical to SEQ ID NO: 36727
  chr17:70588893-70588952
  hyper

SEQ ID NO: 57337 - DNA, 30 bp, Homo sapiens; identical to SEQ ID NO: 36728
  chr17:71160848-71160878
  hyper

SEQ ID NO: 57338 - DNA, 256 bp, Homo sapiens; identical to SEQ ID NO: 36729
  chr17:71161183-71161439
  hyper

SEQ ID NO: 57339 - DNA, 917 bp, Homo sapiens; identical to SEQ ID NO: 36730
  chr17:71161499-71162416
  hyper

SEQ ID NO: 57340 - DNA, 61 bp, Homo sapiens; identical to SEQ ID NO: 36731
  chr17:71639405-71639466
  hyper

SEQ ID NO: 57341 - DNA, 62 bp, Homo sapiens; identical to SEQ ID NO: 36732
  chr17:71639789-71639851
  hyper

SEQ ID NO: 57342 - DNA, 30 bp, Homo sapiens; identical to SEQ ID NO: 36733
  chr17:71640237-71640267
  hyper

SEQ ID NO: 57343 - DNA, 265 bp, Homo sapiens; identical to SEQ ID NO: 36734
  chr17:71640832-71641097
  hyper

SEQ ID NO: 57344 - DNA, 179 bp, Homo sapiens
  chr17:71641365-71641544
  hyper
gggggcagcgtgagccggggacgagcgcggcggaggcggagacgcggagaggggggccgagcgctaccccgtggccgcgactggagagcagcctgcgcgccgggaggggcggcggcggcggcggcggccccgagccaggcccgggagcgagccccgcagaaatacaatccgactgcgcg

SEQ ID NO: 57345 - DNA, 62 bp, Homo sapiens; identical to SEQ ID NO: 36736
  chr17:71897979-71898041
  hyper

SEQ ID NO: 57346 - DNA, 70 bp, Homo sapiens; identical to SEQ ID NO: 36737
  chr17:71898345-71898415
  hyper

SEQ ID NO: 57347 - DNA, 49 bp, Homo sapiens; identical to SEQ ID NO: 22622
  chr17:71948390-71948439
  hyper

SEQ ID NO: 57348 - DNA, 124 bp, Homo sapiens
  chr17:71948863-71948987
  hyper
ggcgctccccgcccgccaacctccaacctccaacctccgccctccaccctccaccctccttgctctgtccgcgtggacgcagcccccggttcagacactagcgggtgcgcggggccgcccagga

SEQ ID NO: 57349 - DNA, 109 bp, Homo sapiens; identical to SEQ ID NO: 36739
  chr17:71949194-71949303
  hyper

SEQ ID NO: 57350 - DNA, 251 bp, Homo sapiens; identical to SEQ ID NO: 36740
  chr17:72208417-72208668
  hyper

SEQ ID NO: 57351 - DNA, 97 bp, Homo sapiens; identical to SEQ ID NO: 36741
  chr17:72209140-72209237
  hyper

SEQ ID NO: 57352 - DNA, 112 bp, Homo sapiens
  chr17:72270174-72270286
  hyper
gtaggcttggataagcgccttggcaacgcccctacaaatattcatgatcattattagtatgttaccaacctattggttaattcttctcctaactcaggagacctccaaaaag

SEQ ID NO: 57353 - DNA, 43 bp, Homo sapiens
  chr17:72270415-72270458
  hyper
agcaccggagccgcgaccgtggattgaacgcttccccagagac

SEQ ID NO: 57354 - DNA, 53 bp, Homo sapiens
  chr17:72322310-72322363
  hyper
ccccctgccccgcctcgggtcggcgtccttagccgctggcgcgttgttggttt

SEQ ID NO: 57355 - DNA, 15 bp, Homo sapiens
  chr17:72322611-72322626
  hyper
cgccaccccactgag

SEQ ID NO: 57356 - DNA, 96 bp, Homo sapiens; identical to SEQ ID NO: 36746
  chr17:72427312-72427408
  hyper

SEQ ID NO: 57357 - DNA, 4 bp, Homo sapiens
  chr17:72428340-72428344
  hyper
ctgg

SEQ ID NO: 57358 - DNA, 23 bp, Homo sapiens
  chr17:72428381-72428404
  hyper
tgatgtaacggtgatgcaggctc

SEQ ID NO: 57359 - DNA, 37 bp, Homo sapiens
  chr17:72667300-72667337
  hyper
gtgagctcctgggaccgcaatgccctgagaacgcagc

SEQ ID NO: 57360 - DNA, 181 bp, Homo sapiens; identical to SEQ ID NO: 36749
  chr17:72838924-72839105
  hyper

SEQ ID NO: 57361 - DNA, 30 bp, Homo sapiens; identical to SEQ ID NO: 36750
  chr17:72848653-72848683
  hyper

SEQ ID NO: 57362 - DNA, 190 bp, Homo sapiens; identical to SEQ ID NO: 36751
  chr17:72856276-72856466
  hyper

SEQ ID NO: 57363 - DNA, 97 bp, Homo sapiens; identical to SEQ ID NO: 22629
  chr17:72856941-72857038
  hyper

SEQ ID NO: 57364 - DNA, 316 bp, Homo sapiens
  chr17:72857368-72857684
  hyper
ggccaggttcttgagggtccgggtcctccagccgccccctccttgagccccgagagtcctgcgtgggtccaaccccccgggtgtcccgcctctgtctccgccgtccttgctcgcgcgccgcgggaacccagccccaagttggcggcgaagttggtgcccctcgcccgccgctcgccacttaccgaggggaaggggcgctgcgcccgcgacgagagcccgcgccggccgcctccctcgcggtgtctgtcccagagcctcggccccggagggctggcgcgctcagtctcagctccgcgggcgccggagcccgggcgcg

SEQ ID NO: 57365 - DNA, 67 bp, Homo sapiens; identical to SEQ ID NO: 36753
  chr17:72857958-72858025
  hyper

SEQ ID NO: 57366 - DNA, 23 bp, Homo sapiens
  chr17:72889334-72889357
  hyper
ctccatccttgggtgcggggccc

SEQ ID NO: 57367 - DNA, 380 bp, Homo sapiens; identical to SEQ ID NO: 36755
  chr17:72889430-72889810
  hyper

SEQ ID NO: 57368 - DNA, 40 bp, Homo sapiens; identical to SEQ ID NO: 36756
  chr17:72890033-72890073
  hyper

SEQ ID NO: 57369 - DNA, 30 bp, Homo sapiens; identical to SEQ ID NO: 36757
  chr17:72920550-72920580
  hyper

SEQ ID NO: 57370 - DNA, 42 bp, Homo sapiens
  chr17:72921032-72921074
  hyper
gctccgaggtgccaggggaggtgggggcgaggtagggtgggc

SEQ ID NO: 57371 - DNA, 75 bp, Homo sapiens; identical to SEQ ID NO: 36759
  chr17:72932011-72932086
  hyper

SEQ ID NO: 57372 - DNA, 258 bp, Homo sapiens; identical to SEQ ID NO: 36760
  chr17:72932356-72932614
  hyper

SEQ ID NO: 57373 - DNA, 235 bp, Homo sapiens; identical to SEQ ID NO: 36761
  chr17:73073449-73073684
  hyper

SEQ ID NO: 57374 - DNA, 1 bp, Homo sapiens
  chr17:73584937-73584938
  hyper
g

SEQ ID NO: 57375 - DNA, 428 bp, Homo sapiens
  chr17:74071017-74071445
  hyper
gggaggctggcaccccgaggcggtcatcgtgcccctgctcttcgcgctcatcttcctcgtgggcaccgtgggcaacacgctggtgctggcggtgctgctgcgcggcggccaggcggtcagcactaccaacctgttcatccttaacctgggcgtggccgacctgtgtttcatcctgtgctgcgtgcccttccaggccaccatctacaccctggacggctgggtgttcggctcgctgctgtgcaaggcggtgcacttcctcatcttcctcaccatgcacgccagcagcttcacgctggccgccgtctccctggacaggtgagccagcgccttggcctccctgggagatgggcatccacgcgggggatggagcgggaggcgggactggggaccaagaagggacgcgcagagtgggacaggacactaagaag

SEQ ID NO: 57376 - DNA, 208 bp, Homo sapiens
  chr17:74071481-74071689
  hyper
aggaataagaatgggggaccgtggtgtccctcggttagatgcgtcctggggcctggaagcctggagaatgtggctctccagcgccgcccgtgcctgacaacgcgcagcgtttcccagtacgacgcgtttgtgcgcgttcatctcgcttgagcttaatgccctccgtgagggtgggataggacaaagtgcccaatatacagaagagttg

SEQ ID NO: 57377 - DNA, 103 bp, Homo sapiens; identical to SEQ ID NO: 36765
  chr17:74072477-74072580
  hyper

SEQ ID NO: 57378 - DNA, 233 bp, Homo sapiens
  chr17:74073036-74073269
  hyper
ccaagcgcaaggtgacacgcatgatcctcatcgtggccgcgctcttctgcctctgctggatgccccaccacgcgctcatcctctgcgtgtggttcggccagttcccgctcacgcgcgccacttatgcgcttcgcatcctctcgcacctggtctcctacgccaactcctgcgtcaaccccatcgtttacgcgctggtctccaagcacttccgcaaaggcttccgcacgatctgc

SEQ ID NO: 57379 - DNA, 21 bp, Homo sapiens
  chr17:74073433-74073454
  hyper
catcctcgagccctgtcctgg

SEQ ID NO: 57380 - DNA, 63 bp, Homo sapiens; identical to SEQ ID NO: 36767
  chr17:74117965-74118028
  hyper

SEQ ID NO: 57381 - DNA, 146 bp, Homo sapiens; identical to SEQ ID NO: 36768
  chr17:74136296-74136442
  hyper

SEQ ID NO: 57382 - DNA, 149 bp, Homo sapiens; identical to SEQ ID NO: 36769
  chr17:74136570-74136719
  hyper

SEQ ID NO: 57383 - DNA, 30 bp, Homo sapiens; identical to SEQ ID NO: 36770
  chr17:74378928-74378958
  hyper

SEQ ID NO: 57384 - DNA, 15 bp, Homo sapiens
  chr17:74533543-74533558
  hyper
caccgccttcctctc

SEQ ID NO: 57385 - DNA, 143 bp, Homo sapiens; identical to SEQ ID NO: 36772
  chr17:74533674-74533817
  hyper

SEQ ID NO: 57386 - DNA, 53 bp, Homo sapiens; identical to SEQ ID NO: 22639
  chr17:74534310-74534363
  hyper

SEQ ID NO: 57387 - DNA, 46 bp, Homo sapiens; identical to SEQ ID NO: 36774
  chr17:74534387-74534433
  hyper

SEQ ID NO: 57388 - DNA, 322 bp, Homo sapiens
  chr17:74581221-74581543
  hyper
tatccagacacggcgagcggaagccggggagaagggagcgggcgcggggcggacagagaccgcagcgggcgggaaaggcgactggccgcggcccgacggagggtccccgcgaagttggaaaccggagacttgggcccctgcccaaaaagcagaatctgacgttaccgagggagagttcccgacaaaaaaggaagtttttatctgcttcggggacccagccagatttcgacaatagaaagtgtacttatcaggccggggaggacttcaccaacaaggggcaccggggcgggtcgccagtgcacaggggcgaggtcttccttgg

SEQ ID NO: 57389 - DNA, 384 bp, Homo sapiens
  chr17:74864669-74865053
  hyper
ggaggcgctggggaccggggcgcgggcccggggccgcctttagccggcaccgagggcgcggggccggggatgagggcgcccgccgcggggagcccgtctgcgcgccgcggcaccttcccgcccagcgagcgagcccgagcaggcagacgcgcggccggcggtctgggggcgcgccgcctcccggtccccaaaatgtgaagcggggagggcggagacgcagagacggcccggccgggcgccctcgccgccctccggcagccgcgccgctccctccgctgcacgcccaggcctgagcagcgaggccaccgggccgcgcgctcccagcttcgctcggacgcggcttcggcccgcagagggttcgtggcccggacgcggcgagagctg

SEQ ID NO: 57390 - DNA, 63 bp, Homo sapiens
  chr17:74865192-74865255
  hyper
ctggttggttttttccccaggggggcgccgggtggaggtgggcgaggtcggttcctgcgaacg

SEQ ID NO: 57391 - DNA, 145 bp, Homo sapiens
  chr17:74865553-74865698
  hyper
aaagttagtgtgcggcgccttggagctccccctccggtccctcccgtcccgcccgtctgcccctaggtcggctaccccccaacccctccgcctgtgccaccctctccccagcctttggtggcactgctctcctccccgcggggct

SEQ ID NO: 57392 - DNA, 58 bp, Homo sapiens
  chr17:74866243-74866301
  hyper
gtggtccccctgccggctccagacggggatgggggcggggagacggtggctcacctgg

SEQ ID NO: 57393 - DNA, 30 bp, Homo sapiens; identical to SEQ ID NO: 36779
  chr17:74965579-74965609
  hyper

SEQ ID NO: 57394 - DNA, 20 bp, Homo sapiens
  chr17:75368715-75368735
  hyper
gccgtgttccatccccgccc

SEQ ID NO: 57395 - DNA, 202 bp, Homo sapiens
  chr17:75369238-75369440
  hyper
gactgtcccccagcggccactcgggccccagccccccaggcctggccttgacaggcgggcggagcagccagtgcgagacagggaggccggtgcgggtgcgggaacctgatccgcccgggaggcgggggcggggcgggggcgcagcgcgcggggaggggccggcgcccgccttcctcccccattcattcagctgagccagggg

SEQ ID NO: 57396 - DNA, 1 bp, Homo sapiens
  chr17:75370268-75370269
  hyper
g

SEQ ID NO: 57397 - DNA, 26 bp, Homo sapiens
  chr17:75370316-75370342
  hyper
gggcctgcgtgcgggcagggagagta

SEQ ID NO: 57398 - DNA, 30 bp, Homo sapiens; identical to SEQ ID NO: 36785
  chr17:75370646-75370676
  hyper

SEQ ID NO: 57399 - DNA, 88 bp, Homo sapiens; identical to SEQ ID NO: 36786
  chr17:75447639-75447727
  hyper

SEQ ID NO: 57400 - DNA, 45 bp, Homo sapiens
  chr17:75524591-75524636
  hyper
accccctctcgtggtcgccagggtaggggtgggaggaatctggaa

SEQ ID NO: 57401 - DNA, 98 bp, Homo sapiens; identical to SEQ ID NO: 36789
  chr17:75953838-75953936
  hyper

SEQ ID NO: 57402 - DNA, 76 bp, Homo sapiens; identical to SEQ ID NO: 22644
  chr17:76227773-76227849
  hyper

SEQ ID NO: 57403 - DNA, 18 bp, Homo sapiens
  chr17:76254836-76254854
  hyper
cgccggggaggctgctgc

SEQ ID NO: 57404 - DNA, 146 bp, Homo sapiens; identical to SEQ ID NO: 36793
  chr17:77178726-77178872
  hyper

SEQ ID NO: 57405 - DNA, 102 bp, Homo sapiens; identical to SEQ ID NO: 4505
  chr17:77178962-77179064
  hyper

SEQ ID NO: 57406 - DNA, 32 bp, Homo sapiens; identical to SEQ ID NO: 22647
  chr17:77179081-77179113
  hyper

SEQ ID NO: 57407 - DNA, 52 bp, Homo sapiens; identical to SEQ ID NO: 22648
  chr17:77179278-77179330
  hyper

SEQ ID NO: 57408 - DNA, 75 bp, Homo sapiens; identical to SEQ ID NO: 4507
  chr17:77179380-77179455
  hyper

SEQ ID NO: 57409 - DNA, 27 bp, Homo sapiens
  chr17:77179456-77179483
  hyper
gcaggggggcgcccggcggcggctctg

SEQ ID NO: 57410 - DNA, 13 bp, Homo sapiens
  chr17:77179617-77179630
  hyper
cgcgcctctgccc

SEQ ID NO: 57411 - DNA, 429 bp, Homo sapiens; identical to SEQ ID NO: 36800
  chr17:77179799-77180228
  hyper

SEQ ID NO: 57412 - DNA, 114 bp, Homo sapiens; identical to SEQ ID NO: 36801
  chr17:77188779-77188893
  hyper

SEQ ID NO: 57413 - DNA, 34 bp, Homo sapiens; identical to SEQ ID NO: 36802
  chr17:77216439-77216473
  hyper

SEQ ID NO: 57414 - DNA, 129 bp, Homo sapiens; identical to SEQ ID NO: 36803
  chr17:77290796-77290925
  hyper

SEQ ID NO: 57415 - DNA, 233 bp, Homo sapiens; identical to SEQ ID NO: 36804
  chr17:77772557-77772790
  hyper

SEQ ID NO: 57416 - DNA, 16 bp, Homo sapiens
  chr17:77776550-77776566
  hyper
ggaccggttgggccac

SEQ ID NO: 57417 - DNA, 148 bp, Homo sapiens; identical to SEQ ID NO: 22654
  chr17:77776679-77776827
  hyper

SEQ ID NO: 57418 - DNA, 219 bp, Homo sapiens
  chr17:77777056-77777275
  hyper
atcagaaacctccagccccaacccctgcctggagatgcccggggcgcgctgactctgttctcgcatcaccccgggccctggctcaacgcgtgagcagcctgtggttccagataccccgagtggagagtttgaccccagattctgcctgcactgacaggcttggcctggcggttacgagccacggttgatgagcgcccctcctcccgtgacccagctcat

SEQ ID NO: 57419 - DNA, 83 bp, Homo sapiens
  chr17:77777502-77777585
  hyper
gctccagggactcctcggactccgcctggcgcttcccgttttttcatttcctaccccacccccatgcagaaggaattgaagtg

SEQ ID NO: 57420 - DNA, 34 bp, Homo sapiens
  chr17:77777961-77777995
  hyper
ccccggtacagggcttcctcggtgcacccctagc

SEQ ID NO: 57421 - DNA, 270 bp, Homo sapiens
  chr17:77778673-77778943
  hyper
gaaatgtgatgttcacgctgagtttctgtatttttctagtttcaacctcagagcttactttttggccaaacggatgaaggggtaagccaccgtggaagtcccagcagatacccccaccatcgccccatccatcctgggaggttcggtggccctcgaggcagagacatggactgtggctggggtattgggggcagatgttcaatgtgttggggtgtggagagggtagattggcagcctactgaggattaaaggggtgtcctgcaaaccagc

SEQ ID NO: 57422 - DNA, 304 bp, Homo sapiens; identical to SEQ ID NO: 36812
  chr17:77786467-77786771
  hyper

SEQ ID NO: 57423 - DNA, 112 bp, Homo sapiens; identical to SEQ ID NO: 36814
  chr17:77814794-77814906
  hyper

SEQ ID NO: 57424 - DNA, 30 bp, Homo sapiens; identical to SEQ ID NO: 36815
  chr17:77815150-77815180
  hyper

SEQ ID NO: 57425 - DNA, 133 bp, Homo sapiens; identical to SEQ ID NO: 36816
  chr17:77815455-77815588
  hyper

SEQ ID NO: 57426 - DNA, 30 bp, Homo sapiens; identical to SEQ ID NO: 36817
  chr17:77815905-77815935
  hyper

SEQ ID NO: 57427 - DNA, 176 bp, Homo sapiens; identical to SEQ ID NO: 36818
  chr17:77904151-77904327
  hyper

SEQ ID NO: 57428 - DNA, 159 bp, Homo sapiens; identical to SEQ ID NO: 36819
  chr17:78045491-78045650
  hyper

SEQ ID NO: 57429 - DNA, 30 bp, Homo sapiens; identical to SEQ ID NO: 36820
  chr17:78449436-78449466
  hyper

SEQ ID NO: 57430 - DNA, 30 bp, Homo sapiens; identical to SEQ ID NO: 36821
  chr17:78449720-78449750
  hyper

SEQ ID NO: 57431 - DNA, 880 bp, Homo sapiens; identical to SEQ ID NO: 36822
  chr17:78449963-78450843
  hyper

SEQ ID NO: 57432 - DNA, 454 bp, Homo sapiens
  chr17:78451477-78451931
  hyper
gcggggctcggctcccgagatcgcggtccgggttccggcgccgggctgggggctcaggaccagggctggcgcagccgccccgccccgccccgccccggggctatcagagcggtcaaagcctcggaaatccctccgtccacgctcccgtggtacagagaaggaaactgaggctccgagactgcggggccgggctacagccgtggccccccgacccctccccgccgcccccggcttctctggtctctgcgttctgcagcctttccctgcgcgcagccgggggctgggggtccccagccagcagggacccacgggcagtcccgggtgccgggatcgggcgtccgcccctcgggcgggagcagaggccggctcgatggagacctttttgagaaatggcggcctctacccgccccccagcccccgagcgcccgccgtctgcgttcagcatctcagcttt

SEQ ID NO: 57433 - DNA, 188 bp, Homo sapiens; identical to SEQ ID NO: 22659
  chr17:78452108-78452296
  hyper

SEQ ID NO: 57434 - DNA, 132 bp, Homo sapiens
  chr17:78452549-78452681
  hyper
agcggcctggcacctcggcacagaggagcgtgtcccccttccgcagaggaagggagtggacggcgtcagaaagggaggggagcctggggcggtgtctggggctagcgggacctctgggcactgtggggcccc

SEQ ID NO: 57435 - DNA, 113 bp, Homo sapiens
  chr17:78452833-78452946
  hyper
ctcggcctccccagtgttctgaaagtatctgagagggagggagcaggaaaacgaagggccgccctgcccaaactcatcggggtgtctggttactaggtcggaagaggggggat

SEQ ID NO: 57436 - DNA, 45 bp, Homo sapiens; identical to SEQ ID NO: 36826
  chr17:78978134-78978179
  hyper

SEQ ID NO: 57437 - DNA, 81 bp, Homo sapiens; identical to SEQ ID NO: 36827
  chr17:78978379-78978460
  hyper

SEQ ID NO: 57438 - DNA, 66 bp, Homo sapiens; identical to SEQ ID NO: 36828
  chr17:79316947-79317013
  hyper

SEQ ID NO: 57439 - DNA, 57 bp, Homo sapiens; identical to SEQ ID NO: 36829
  chr17:79317833-79317890
  hyper

SEQ ID NO: 57440 - DNA, 15 bp, Homo sapiens
  chr17:79615121-79615136
  hyper
cgaacctggctgcct

SEQ ID NO: 57441 - DNA, 121 bp, Homo sapiens; identical to SEQ ID NO: 12933
  chr17:79761692-79761813
  hyper

SEQ ID NO: 57442 - DNA, 376 bp, Homo sapiens; identical to SEQ ID NO: 36832
  chr17:79761833-79762209
  hyper

SEQ ID NO: 57443 - DNA, 164 bp, Homo sapiens; identical to SEQ ID NO: 36833
  chr17:79762474-79762638
  hyper

SEQ ID NO: 57444 - DNA, 86 bp, Homo sapiens; identical to SEQ ID NO: 36834
  chr17:79859940-79860026
  hyper

SEQ ID NO: 57445 - DNA, 185 bp, Homo sapiens; identical to SEQ ID NO: 36835
  chr17:79860488-79860673
  hyper

SEQ ID NO: 57446 - DNA, 34 bp, Homo sapiens; identical to SEQ ID NO: 36836
  chr17:79918595-79918629
  hyper

SEQ ID NO: 57447 - DNA, 41 bp, Homo sapiens; identical to SEQ ID NO: 36837
  chr17:79988475-79988516
  hyper

SEQ ID NO: 57448 - DNA, 82 bp, Homo sapiens; identical to SEQ ID NO: 36838
  chr17:80188720-80188802
  hyper

SEQ ID NO: 57449 - DNA, 426 bp, Homo sapiens
  chr17:80329283-80329709
  hyper
cctgccccccacctgcgcgcgggcgggtccagggcttggtggacacggagaatcccaggctccgtgccctgcaaacacgggcgtgaggggcgcaggggtgaacgctggaggcggagaacccaagaggggctgcggggtcagccttggggcagccgggctggaggcagcttcgctccgcagacgcagacgcgagacccgcctgggaccctccgccgaccccgctgcggccccgcgacccccgcgtcttcccggcgccgcgcggtcagcgccgccccctagacacccggcgccgtcccctccgcgcgcctgctgcccgctggggttattttaataccgggccctggcgcggggcgcggcgcattcccagctggcggcgggcaggtggcggcggcgcagagacccggcgcggggcggggggcgcggctt

SEQ ID NO: 57450 - DNA, 45 bp, Homo sapiens; identical to SEQ ID NO: 36840
  chr17:80330164-80330209
  hyper

SEQ ID NO: 57451 - DNA, 177 bp, Homo sapiens; identical to SEQ ID NO: 36841
  chr17:80333064-80333241
  hyper

SEQ ID NO: 57452 - DNA, 4 bp, Homo sapiens
  chr18:500042-500046
  hyper
cccg

SEQ ID NO: 57453 - DNA, 525 bp, Homo sapiens; identical to SEQ ID NO: 22667
  chr18:500738-501263
  hyper

SEQ ID NO: 57454 - DNA, 96 bp, Homo sapiens; identical to SEQ ID NO: 36843
  chr18:903748-903844
  hyper

SEQ ID NO: 57455 - DNA, 88 bp, Homo sapiens
  chr18:904374-904462
  hyper
ttcatgaataaaaatcggagcgcaacagtgcaacaaaatattctgtacttaaaggcaacaggcaggcagatgttgacaaagagggctc

SEQ ID NO: 57456 - DNA, 84 bp, Homo sapiens
  chr18:904648-904732
  hyper
cgggctagccgcccgccctctcccttgccttcctccccttcttttctgactttccctctttcccttaatcgcctgcttcttcct

SEQ ID NO: 57457 - DNA, 9 bp, Homo sapiens
  chr18:904991-905000
  hyper
aggaacttg

SEQ ID NO: 57458 - DNA, 76 bp, Homo sapiens
  chr18:905030-905106
  hyper
cagctctcctggcagcgggaggagttgaagggtaagggagggaaaatcttaccaaagcgaccggctcactcgactg

SEQ ID NO: 57459 - DNA, 177 bp, Homo sapiens; identical to SEQ ID NO: 36846
  chr18:905713-905890
  hyper

SEQ ID NO: 57460 - DNA, 663 bp, Homo sapiens
  chr18:906208-906871
  hyper
cagccctgcctggcccgggatggaggaaccttggcttttttcttaaccccgggtttctaaccggcaggcgcggcccaggttcccggaggcagccccagagtcgcggaccgatgtgccaggctgtggatgagccctgggtaggggagggttcgtaccagcggcgcctggggcagcgaggagcgcgcgttctgcctgcgaagctgccttctccgagccccgcccaggaacattagctctggggggccgctgatcattgatttggacggagagatgggttctgggttctgtattaggattccagcatctgggctcgaggcagggcaatatccagaaagaccccagggttcggggtacccgggccagggctgaggcgcatcgccgagcaaaggctgggtgcgaggcgtgcggaatgatgcgcttgccttgcccgggcctctccaaggatggagaaaaggcgagtgaagcagcgaagtacgactccaaccccgcccagagagtgctactagcgctggctgcacgccaagtctctccaggggtccaaagcgagagggatttgttttaacccatctctacccgtcctgtgtcaagaacggaggctgtagagggcgactgcgaagtcgccaggcactcgctggatctcggtccccctcctcgtgctctggg

SEQ ID NO: 57461 - DNA, 158 bp, Homo sapiens; identical to SEQ ID NO: 22673
  chr18:907314-907472
  hyper

SEQ ID NO: 57462 - DNA, 100 bp, Homo sapiens
  chr18:907594-907694
  hyper
ggatcctcgccgagctggggaggaacttgcactgaccacaccttctgtccccggccaccccgcaggccagaggaagaggcgtacggcgaggacggaaacc

SEQ ID NO: 57463 - DNA, 191 bp, Homo sapiens
  chr18:907721-907912
  hyper
cgccgggcgcagggagccccgcctccgcgccgcgcgccgccgccgcctggtaccgcccggccgggagaaggtgagattcgcgcggcctcgcgcacacccgcggctgggagctcgggactgcggtgacgggaggggcagtgtggtgacccacccaggatttttttttttttcccgtgaaagtcctcaagcct

SEQ ID NO: 57464 - DNA, 22 bp, Homo sapiens
  chr18:908432-908454
  hyper
gcggcggtgggtgcccgtgggg

SEQ ID NO: 57465 - DNA, 15 bp, Homo sapiens
  chr18:909070-909085
  hyper
actttctctgtatgt

SEQ ID NO: 57466 - DNA, 106 bp, Homo sapiens; identical to SEQ ID NO: 12949
  chr18:909183-909289
  hyper

SEQ ID NO: 57467 - DNA, 169 bp, Homo sapiens; identical to SEQ ID NO: 22677
  chr18:909318-909487
  hyper

SEQ ID NO: 57468 - DNA, 145 bp, Homo sapiens; identical to SEQ ID NO: 22678
  chr18:909587-909732
  hyper

SEQ ID NO: 57469 - DNA, 221 bp, Homo sapiens; identical to SEQ ID NO: 36854
  chr18:961763-961984
  hyper

SEQ ID NO: 57470 - DNA, 372 bp, Homo sapiens; identical to SEQ ID NO: 36855
  chr18:2846451-2846823
  hyper

SEQ ID NO: 57471 - DNA, 190 bp, Homo sapiens; identical to SEQ ID NO: 36856
  chr18:2847026-2847216
  hyper

SEQ ID NO: 57472 - DNA, 601 bp, Homo sapiens; identical to SEQ ID NO: 36857
  chr18:2847537-2848138
  hyper

SEQ ID NO: 57473 - DNA, 89 bp, Homo sapiens; identical to SEQ ID NO: 36858
  chr18:2906054-2906143
  hyper

SEQ ID NO: 57474 - DNA, 30 bp, Homo sapiens; identical to SEQ ID NO: 36859
  chr18:2906366-2906396
  hyper

SEQ ID NO: 57475 - DNA, 6 bp, Homo sapiens
  chr18:3499061-3499067
  hyper
gacagt

SEQ ID NO: 57476 - DNA, 42 bp, Homo sapiens; identical to SEQ ID NO: 36861
  chr18:4453666-4453708
  hyper

SEQ ID NO: 57477 - DNA, 42 bp, Homo sapiens
  chr18:4453922-4453964
  hyper
taaccccttgccctccgcacatcctccccttctctagcagaa

SEQ ID NO: 57478 - DNA, 65 bp, Homo sapiens
  chr18:4454163-4454228
  hyper
agggtcttcatcgccgcgggccctccgaaggtgcctctcccagctgcagccgcccctcaatgaaa

SEQ ID NO: 57479 - DNA, 24 bp, Homo sapiens
  chr18:5196235-5196259
  hyper
agagacagcgtcggacgttcacaa

SEQ ID NO: 57480 - DNA, 412 bp, Homo sapiens; identical to SEQ ID NO: 22683
  chr18:5197347-5197759
  hyper

SEQ ID NO: 57481 - DNA, 175 bp, Homo sapiens; identical to SEQ ID NO: 36867
  chr18:5542983-5543158
  hyper

SEQ ID NO: 57482 - DNA, 270 bp, Homo sapiens; identical to SEQ ID NO: 36868
  chr18:5543899-5544169
  hyper

SEQ ID NO: 57483 - DNA, 77 bp, Homo sapiens; identical to SEQ ID NO: 36869
  chr18:5544170-5544247
  hyper

SEQ ID NO: 57484 - DNA, 85 bp, Homo sapiens
  chr18:5628082-5628167
  hyper
cactggagcccaccccgctcctacgccgcaaagcagcacaattacagcctgggaggggcaagtcttgcggggcccgtcggtaact

SEQ ID NO: 57485 - DNA, 579 bp, Homo sapiens; identical to SEQ ID NO: 36871
  chr18:5628792-5629371
  hyper

SEQ ID NO: 57486 - DNA, 112 bp, Homo sapiens; identical to SEQ ID NO: 36872
  chr18:5629372-5629484
  hyper

SEQ ID NO: 57487 - DNA, 205 bp, Homo sapiens
  chr18:5629569-5629774
  hyper
cgaggttcgcaccttcccggaaggcccccccctcccccgcgtttccccagggcgagcaaggtctagcttctgagactccgctctctgggctagcggttcgagctgcaggggggcggggacggattcggagggagcactagagagagagcccgcgctcactcctgccctcctcgcaaagaactggccagccccactcgcgtccagc

SEQ ID NO: 57488 - DNA, 56 bp, Homo sapiens
  chr18:5630256-5630312
  hyper
cgctttctcccccatcgacctcgagccaagggcaggcggcccgcacccgcgcccct

SEQ ID NO: 57489 - DNA, 293 bp, Homo sapiens
  chr18:5630362-5630655
  hyper
gaaaggcgctcacctgagtcaccgaagccttcctttggggcccctcccggagcttgttcgcagcccgcaggcacaaccttccttggagaaaaaaagtagcgcaagggcagagagaggtagggctgctcacaggtccctccgcaggggctctttccttcgaattctccggggtccagtctcgggctcggcggcgggaaagagctcctggaggctggaaggggccgccagacccgggctcctcccgcagctgcggtggcggcacctccaagttgccacctgcagcgcgcttcggg

SEQ ID NO: 57490 - DNA, 105 bp, Homo sapiens; identical to SEQ ID NO: 36875
  chr18:5630693-5630798
  hyper

SEQ ID NO: 57491 - DNA, 85 bp, Homo sapiens; identical to SEQ ID NO: 36876
  chr18:5891336-5891421
  hyper

SEQ ID NO: 57492 - DNA, 32 bp, Homo sapiens; identical to SEQ ID NO: 36877
  chr18:5891443-5891475
  hyper

SEQ ID NO: 57493 - DNA, 88 bp, Homo sapiens; identical to SEQ ID NO: 36878
  chr18:5894858-5894946
  hyper

SEQ ID NO: 57494 - DNA, 6 bp, Homo sapiens
  chr18:5895017-5895023
  hyper
cgctca

SEQ ID NO: 57495 - DNA, 322 bp, Homo sapiens
  chr18:5895205-5895527
  hyper
gtccccgccggcgctgtggcgggagccatttccaagagtttccaagaagtgtcaggtcctccgcatcccgcatcccgcatcccgcctcggagccctcctctccgccgctcatcctccagctcccggcgtcccctagcgcggcgctcccgggcgggcccctgcggccgcgccgccggccctcgcgcctcttttgtgtggctgcggcgcgccgggctccgccgggtggagttgagcccgcggcggcggctcggggcggccggactggcggctgttgctaagagaccggagccatgacacagggaaattgcggcagggtggcggt

SEQ ID NO: 57496 - DNA, 236 bp, Homo sapiens
  chr18:5895739-5895975
  hyper
ccgcggggcagggggcgcggggtgcctcctcggcctcggctctccccgccccggggcgccccgagaccgccgcctgcctccgcgggcagctttgttcttctttcctccaactacctgtctgagccgcgggccccagaggccccaaagagaggcccggagggtctccccagcagcatccgaggggcgctctcggggagctaggggccagagtccgcggtccctccgtgcctgcctcc

SEQ ID NO: 57497 - DNA, 173 bp, Homo sapiens; identical to SEQ ID NO: 36881
  chr18:6414507-6414680
  hyper

SEQ ID NO: 57498 - DNA, 130 bp, Homo sapiens; identical to SEQ ID NO: 36882
  chr18:6730009-6730139
  hyper

SEQ ID NO: 57499 - DNA, 32 bp, Homo sapiens; identical to SEQ ID NO: 36883
  chr18:7116490-7116522
  hyper

SEQ ID NO: 57500 - DNA, 170 bp, Homo sapiens; identical to SEQ ID NO: 36884
  chr18:7117059-7117229
  hyper

SEQ ID NO: 57501 - DNA, 21 bp, Homo sapiens
  chr18:7117615-7117636
  hyper
cgcctgcgggggacagggacc

SEQ ID NO: 57502 - DNA, 224 bp, Homo sapiens; identical to SEQ ID NO: 36886
  chr18:7117867-7118091
  hyper

SEQ ID NO: 57503 - DNA, 46 bp, Homo sapiens; identical to SEQ ID NO: 12973
  chr18:7118131-7118177
  hyper

SEQ ID NO: 57504 - DNA, 174 bp, Homo sapiens; identical to SEQ ID NO: 36888
  chr18:7566582-7566756
  hyper

SEQ ID NO: 57505 - DNA, 263 bp, Homo sapiens; identical to SEQ ID NO: 36889
  chr18:7567072-7567335
  hyper

SEQ ID NO: 57506 - DNA, 29 bp, Homo sapiens
  chr18:7567754-7567783
  hyper
ccctccgccctcgcgcgcccacccaccgc

SEQ ID NO: 57507 - DNA, 139 bp, Homo sapiens; identical to SEQ ID NO: 36891
  chr18:7568400-7568539
  hyper

SEQ ID NO: 57508 - DNA, 96 bp, Homo sapiens; identical to SEQ ID NO: 36892
  chr18:7568540-7568636
  hyper

SEQ ID NO: 57509 - DNA, 14 bp, Homo sapiens
  chr18:8608968-8608982
  hyper
gaaaacatgtgcat

SEQ ID NO: 57510 - DNA, 101 bp, Homo sapiens; identical to SEQ ID NO: 36895
  chr18:9708380-9708481
  hyper

SEQ ID NO: 57511 - DNA, 549 bp, Homo sapiens; identical to SEQ ID NO: 36896
  chr18:9708821-9709370
  hyper

SEQ ID NO: 57512 - DNA, 16 bp, Homo sapiens
  chr18:9771753-9771769
  hyper
tcgatggtggtgttct

SEQ ID NO: 57513 - DNA, 456 bp, Homo sapiens; identical to SEQ ID NO: 36898
  chr18:10454714-10455170
  hyper

SEQ ID NO: 57514 - DNA, 228 bp, Homo sapiens
  chr18:11148741-11148969
  hyper
cgagggcacgctcccggggctcttggccgcccctcgcccaccgggctctgggtagcccctcaccaggctcttggcggccacctagcccggcgcccggccccctgcggccggcccatttagtgtgaatcctggatccggcagcggcggcggcttcttcaggggtagctgatgccggggccttggagagggacgctttgggagggtcctgggaggcggcgcggcgagcaa

SEQ ID NO: 57515 - DNA, 49 bp, Homo sapiens; identical to SEQ ID NO: 22707
  chr18:11149045-11149094
  hyper

SEQ ID NO: 57516 - DNA, 141 bp, Homo sapiens; identical to SEQ ID NO: 36900
  chr18:11149115-11149256
  hyper

SEQ ID NO: 57517 - DNA, 104 bp, Homo sapiens
  chr18:11149888-11149992
  hyper
cccaaacccagggaaccgtttaaggtccgagggaaacgcacaggcccggcaggagagaagccaggggcttggagagtcctgtgcgaccccgacttctgctgggt

SEQ ID NO: 57518 - DNA, 63 bp, Homo sapiens; identical to SEQ ID NO: 12986
  chr18:11751569-11751632
  hyper

SEQ ID NO: 57519 - DNA, 226 bp, Homo sapiens
  chr18:11752379-11752605
  hyper
attgctttttgcgcacattcctaacttcctgacgtccatcccagcgggcaggcatggggtgtttgggcggcaacagcaagacgacggaagaccagggcgtcgatgaaaaagaacgacgcgaggccaacaaaaagatcgagaagcagttgcagaaagagcgcctggcttacaaggctacccaccgcctgctgctcctgggtaaggccgaggggcgcgcggcggctcc

SEQ ID NO: 57520 - DNA, 60 bp, Homo sapiens; identical to SEQ ID NO: 22711
  chr18:11752640-11752700
  hyper

SEQ ID NO: 57521 - DNA, 39 bp, Homo sapiens
  chr18:11752730-11752769
  hyper
aggaacccgcgtgtaggaaatccccgtgctgggggagga

SEQ ID NO: 57522 - DNA, 142 bp, Homo sapiens; identical to SEQ ID NO: 36906
  chr18:11947249-11947391
  hyper

SEQ ID NO: 57523 - DNA, 35 bp, Homo sapiens; identical to SEQ ID NO: 12991
  chr18:12253812-12253847
  hyper

SEQ ID NO: 57524 - DNA, 43 bp, Homo sapiens; identical to SEQ ID NO: 12992
  chr18:12254104-12254147
  hyper

SEQ ID NO: 57525 - DNA, 16 bp, Homo sapiens
  chr18:12254578-12254594
  hyper
ccgccccactggtgcc

SEQ ID NO: 57526 - DNA, 159 bp, Homo sapiens; identical to SEQ ID NO: 36910
  chr18:12287804-12287963
  hyper

SEQ ID NO: 57527 - DNA, 337 bp, Homo sapiens
  chr18:12307751-12308088
  hyper
gaagaggccctaagaacgtgtgcccggggtgcgaccggggggtggggggcagggggcagagaccctgaaaagctccaccgccgaaccccagggcagtgtcccggcttggctggactgggcgcgggcggctgcaatgctcccgggcgcggcgctgggaccccgcgggccacgtcggctccgctgccccgacgccagggcccgactcgcgtctccctctggcggggcaccacaaggggcagcgaaacggtggtgggggcgggcgccgcgctccttcccgtctcctccccgccagctccgggcccgtccttttccgcccggctcccggcaagggtccccc

SEQ ID NO: 57528 - DNA, 30 bp, Homo sapiens; identical to SEQ ID NO: 36912
  chr18:12308897-12308927
  hyper

SEQ ID NO: 57529 - DNA, 105 bp, Homo sapiens; identical to SEQ ID NO: 36913
  chr18:12911116-12911221
  hyper

SEQ ID NO: 57530 - DNA, 143 bp, Homo sapiens; identical to SEQ ID NO: 22717
  chr18:13868570-13868713
  hyper

SEQ ID NO: 57531 - DNA, 307 bp, Homo sapiens; identical to SEQ ID NO: 36915
  chr18:13868946-13869253
  hyper

SEQ ID NO: 57532 - DNA, 58 bp, Homo sapiens; identical to SEQ ID NO: 36916
  chr18:14450734-14450792
  hyper

SEQ ID NO: 57533 - DNA, 91 bp, Homo sapiens; identical to SEQ ID NO: 36917
  chr18:15198009-15198100
  hyper

SEQ ID NO: 57534 - DNA, 100 bp, Homo sapiens; identical to SEQ ID NO: 36919
  chr18:18821813-18821913
  hyper

SEQ ID NO: 57535 - DNA, 478 bp, Homo sapiens
  chr18:18821914-18822392
  hyper
agggctccacaggctgggcggggggcgtcgttggaggggggtaggggagaaatgcgcgcccaccaccctcacagagggcgagggacccccaaaagccactcgcggacgccgaggcagcgggaaggcgcgaggcggggcggggggagggggcgcgggggtccccgctgcggaggccagggcgggcgggaggggcagcacctgaggaatccgcctccggctgcggcggccgccgcctcgctccgccccggggaactgagcgcgcggaccgcgcgcctgccagagagacgccagccgccggcggcgctagcacctcggagtcgggcggccggagcagcggagcgcagcgcggcgcagggaacggcactgggggtggggagaccagcccggccgagccgagggccaccccctggtcctctgccctcgcgccccgctagggccaggtgagcggccgcggggactccggggcgcgggcaggagg

SEQ ID NO: 57536 - DNA, 212 bp, Homo sapiens
  chr18:18823274-18823486
  hyper
gccgctgcctctaaccgaggctgcgggtcctggagaaactcctcagtcttgcccctttctccggtgaacgtgacggttccaaggtccttatcctccccacccactcctctggccccggctgagaggatagaaaccacattttaatttctgcttttcacaccgtaaggtgtttttttccgcctccccccgcctcgaggcgggaatccctgctt

SEQ ID NO: 57537 - DNA, 88 bp, Homo sapiens; identical to SEQ ID NO: 36922
  chr18:19748288-19748376
  hyper

SEQ ID NO: 57538 - DNA, 60 bp, Homo sapiens; identical to SEQ ID NO: 36923
  chr18:19749864-19749924
  hyper

SEQ ID NO: 57539 - DNA, 78 bp, Homo sapiens; identical to SEQ ID NO: 36924
  chr18:20716572-20716650
  hyper

SEQ ID NO: 57540 - DNA, 88 bp, Homo sapiens; identical to SEQ ID NO: 36925
  chr18:21977137-21977225
  hyper

SEQ ID NO: 57541 - DNA, 116 bp, Homo sapiens
  chr18:22928965-22929081
  hyper
aatgctcagaagctgcgagtgaacaaaactgccaatcgtgcaaactttaataaacttttttttttttgaaaagaaaaatccctcccaaattccttcacggggtttcagaagcttct

SEQ ID NO: 57542 - DNA, 231 bp, Homo sapiens; identical to SEQ ID NO: 22724
  chr18:22930559-22930790
  hyper

SEQ ID NO: 57543 - DNA, 100 bp, Homo sapiens
  chr18:24128030-24128130
  hyper
gggtccagctcggagccgtccccgggcggcccaccgcgggcccggggcgccagcagtcgcggcggcgcctcgggctccagcgcggcgctctggtccatat

SEQ ID NO: 57544 - DNA, 307 bp, Homo sapiens
  chr18:24764644-24764951
  hyper
acaccctggaggacccgacagactggcagcagaaactaaagactgttcctgccgtcctctttccaacctctgcatgccccaagaggggtctgaccccggaatcctggagtccagggtgccccgccggggcgcaggaaggaaactcaggtagctgacaagttcaggcggccgtccttctccagcgccccctcaaagtcaggatcccctcctgctcccgccccccacctcccgccatgcgtccactgaagtgaagggaagtgggttggaatactggaggtaggggagatagaaaaaggaagaagcctcc

SEQ ID NO: 57545 - DNA, 37 bp, Homo sapiens; identical to SEQ ID NO: 36934
  chr18:24765383-24765420
  hyper

SEQ ID NO: 57546 - DNA, 53 bp, Homo sapiens; identical to SEQ ID NO: 13011
  chr18:25755399-25755452
  hyper

SEQ ID NO: 57547 - DNA, 257 bp, Homo sapiens; identical to SEQ ID NO: 22728
  chr18:25756729-25756986
  hyper

SEQ ID NO: 57548 - DNA, 335 bp, Homo sapiens; identical to SEQ ID NO: 22729
  chr18:25757452-25757787
  hyper

SEQ ID NO: 57549 - DNA, 148 bp, Homo sapiens; identical to SEQ ID NO: 22730
  chr18:25757824-25757972
  hyper

SEQ ID NO: 57550 - DNA, 346 bp, Homo sapiens
  chr18:25758141-25758487
  hyper
gagggaagcctagagtgcgccgagcaccgccccggcaggtggaggggctgcgggaaataaaataacttgggcaggaacttgattggtagcaggttcatctttggtccgcggtagggaatctaatggagatgaagaatggtggggaagggggggcggtgtctccttgggagcctaacgtacgcttctttattttgtcattctttggagatgggtaatctttcctggcaggggcagacacagcaaactaaggacgcaggccaagctcatcctagctattgttgtctgaggcgctcgccgggagccacctgcgggcgggggagggcggaggccgcggctcctctctgga

SEQ ID NO: 57551 - DNA, 68 bp, Homo sapiens; identical to SEQ ID NO: 22732
  chr18:28620831-28620899
  hyper

SEQ ID NO: 57552 - DNA, 71 bp, Homo sapiens; identical to SEQ ID NO: 22733
  chr18:28621097-28621168
  hyper

SEQ ID NO: 57553 - DNA, 162 bp, Homo sapiens
  chr18:28621474-28621636
  hyper
gaagcagtaagaatccgcgagaccagactcggctcactgccgacgcgggtatagacctcgctcccatcggaccccatgcgcatccatggatgcgggtaagtcgcgggtccgcggctcctttctgggcgtgcggaatgaaactctgttgaagcctgaagcttc

SEQ ID NO: 57554 - DNA, 92 bp, Homo sapiens
  chr18:28621932-28622024
  hyper
ttcgcgcccccggcacatcccgcccccagctgggtggctggcgggggtggaccgcttgggtgagcttctgaataccctttaggggagatacc

SEQ ID NO: 57555 - DNA, 93 bp, Homo sapiens; identical to SEQ ID NO: 36943
  chr18:28622025-28622118
  hyper

SEQ ID NO: 57556 - DNA, 295 bp, Homo sapiens
  chr18:28622488-28622783
  hyper
tccgtgcagcgtccagggcggatccacccccgtccccaccccagccctatccggcgagatctggcttaccacgagggtcagcagcagatgcaggcagacggctccgcgcacggagcgccggggcccagcggcggccatcgggatgccgggcagggccaggagaacgcgggcgccgggagggtgccgagagcgagacctgccgaggtgcagggcgcgggaggtgcttttctcgccgctgcttgtttttaagtgtatttggcctctctcaggcttgcctgcccgggagcaacttcac

SEQ ID NO: 57557 - DNA, 66 bp, Homo sapiens; identical to SEQ ID NO: 36945
  chr18:29078189-29078255
  hyper

SEQ ID NO: 57558 - DNA, 81 bp, Homo sapiens; identical to SEQ ID NO: 36946
  chr18:29599743-29599824
  hyper

SEQ ID NO: 57559 - DNA, 324 bp, Homo sapiens; identical to SEQ ID NO: 36948
  chr18:30350080-30350404
  hyper

SEQ ID NO: 57560 - DNA, 319 bp, Homo sapiens; identical to SEQ ID NO: 36949
  chr18:30350720-30351039
  hyper

SEQ ID NO: 57561 - DNA, 30 bp, Homo sapiens; identical to SEQ ID NO: 36950
  chr18:30352193-30352223
  hyper

SEQ ID NO: 57562 - DNA, 97 bp, Homo sapiens
  chr18:31020398-31020495
  hyper
ggaattgttttcaaacgcgcggggcaaggactccccaccgcctctggaaggggtgaagaactagtcgactctaactccctcagggtggccagggaat

SEQ ID NO: 57563 - DNA, 36 bp, Homo sapiens; identical to SEQ ID NO: 36952
  chr18:31158511-31158547
  hyper

SEQ ID NO: 57564 - DNA, 173 bp, Homo sapiens; identical to SEQ ID NO: 22738
  chr18:31739469-31739642
  hyper

SEQ ID NO: 57565 - DNA, 80 bp, Homo sapiens
  chr18:31802052-31802132
  hyper
tcttgtgaagaaaatcgacgctgctgcggctccccagccccactggcttctgcagcgtgaggctgagatgcattgggctc

SEQ ID NO: 57566 - DNA, 214 bp, Homo sapiens
  chr18:31802167-31802381
  hyper
tttgtggccatgagactagagccaccccagaaaaaggaacaaatacacacaccattcgatagcgcctaaacccatctttctttgttgttcatcttctagctgcggctttatttgtggaagagggaagtgaggaagggaatgggggggcggggaggaggaatctccaggaccttatctacaatctcaacagtcgcggcaacgatctctgggagtg

SEQ ID NO: 57567 - DNA, 263 bp, Homo sapiens
  chr18:31802675-31802938
  hyper
ggaagctcctgcagccggtccgggaacccgaggcggggagggaggccagctctggaggtgcgctgccgctttaaaataaaggaccacaaagactgtacagtggggaaaacgcgcctggctaatgcgagtggggacgacttggggagggggttgaggaaggtagggggcacacgagccaacggcggctcacggctccccctctctcccgcctctctccttcctccctccccgccgggctgctccggcagacaaataacagagga

SEQ ID NO: 57568 - DNA, 120 bp, Homo sapiens; identical to SEQ ID NO: 22741
  chr18:31802968-31803088
  hyper

SEQ ID NO: 57569 - DNA, 128 bp, Homo sapiens
  chr18:31803310-31803438
  hyper
agggatgcgaggtcccggccgcagcgggagcctgctttgggtgggggaagggatgggaagaggggaggagggtccggttgggcaccagcaatcaatgccccgtgctaccaagtctggtccattcgtaa

SEQ ID NO: 57570 - DNA, 24 bp, Homo sapiens
  chr18:31803472-31803496
  hyper
cttagcggtcggtctctttaatat

SEQ ID NO: 57571 - DNA, 35 bp, Homo sapiens; identical to SEQ ID NO: 36957
  chr18:31804992-31805027
  hyper

SEQ ID NO: 57572 - DNA, 381 bp, Homo sapiens; identical to SEQ ID NO: 36959
  chr18:32073450-32073831
  hyper

SEQ ID NO: 57573 - DNA, 132 bp, Homo sapiens; identical to SEQ ID NO: 36961
  chr18:33878418-33878550
  hyper

SEQ ID NO: 57574 - DNA, 15 bp, Homo sapiens
  chr18:34833539-34833554
  hyper
caggcccatttctgc

SEQ ID NO: 57575 - DNA, 572 bp, Homo sapiens; identical to SEQ ID NO: 36963
  chr18:34833958-34834530
  hyper

SEQ ID NO: 57576 - DNA, 30 bp, Homo sapiens; identical to SEQ ID NO: 36964
  chr18:34973974-34974004
  hyper

SEQ ID NO: 57577 - DNA, 190 bp, Homo sapiens
  chr18:35064882-35065072
  hyper
acccacaggagagaccgcgcagacccttgacccgaagaatacttcttattttatggtgatgaactagcctcgataatagccatggctgatatcacacccagttaggggggccataaataattctcttctcccccgcacagaagctataaaccagggccgaggcgcgatagtttatcaaagacgagggctg

SEQ ID NO: 57578 - DNA, 171 bp, Homo sapiens; identical to SEQ ID NO: 36966
  chr18:35065516-35065687
  hyper

SEQ ID NO: 57579 - DNA, 61 bp, Homo sapiens; identical to SEQ ID NO: 36967
  chr18:35067550-35067611
  hyper

SEQ ID NO: 57580 - DNA, 29 bp, Homo sapiens
  chr18:35104522-35104551
  hyper
aggtaaattttcggccggcggggcagccc

SEQ ID NO: 57581 - DNA, 44 bp, Homo sapiens; identical to SEQ ID NO: 13033
  chr18:35104934-35104978
  hyper

SEQ ID NO: 57582 - DNA, 25 bp, Homo sapiens
  chr18:35144820-35144845
  hyper
tctctcccttttagacggctgcgct

SEQ ID NO: 57583 - DNA, 133 bp, Homo sapiens
  chr18:35145465-35145598
  hyper
gaatggtcgacgggttccccgggctgtggcttaatccgttcatgtgcccggcactgcccgggctgctgccgagcccgttggtactgaggcttgcgttgtcagcctgtccgtttgctaacgtggccatctttat

SEQ ID NO: 57584 - DNA, 55 bp, Homo sapiens; identical to SEQ ID NO: 13038
  chr18:35146710-35146765
  hyper

SEQ ID NO: 57585 - DNA, 195 bp, Homo sapiens; identical to SEQ ID NO: 36974
  chr18:35146895-35147090
  hyper

SEQ ID NO: 57586 - DNA, 78 bp, Homo sapiens; identical to SEQ ID NO: 36975
  chr18:35147091-35147169
  hyper

SEQ ID NO: 57587 - DNA, 235 bp, Homo sapiens
  chr18:35147569-35147804
  hyper
ggggcggcggggctgagcggctggcctaacccccgccggccctcggctagccactttcgggtttcagggtttctcttttcttgccctcggattacattacgttactagaggatatgtctgcaattttaattaaagaaatgagaccccagctgcctgcaaacccaggccaaccccatttggtacaagcacaatacggagctctccagcgccggaggaggcccggaggcccgaggtt

SEQ ID NO: 57588 - DNA, 15 bp, Homo sapiens
  chr18:35147834-35147849
  hyper
cgcctctctctgagg

SEQ ID NO: 57589 - DNA, 30 bp, Homo sapiens; identical to SEQ ID NO: 36978
  chr18:40857392-40857422
  hyper

SEQ ID NO: 57590 - DNA, 189 bp, Homo sapiens; identical to SEQ ID NO: 36979
  chr18:43913431-43913620
  hyper

SEQ ID NO: 57591 - DNA, 56 bp, Homo sapiens
  chr18:43914155-43914211
  hyper
gccgcccgcgcccgcgccccggagccgcgccacaaagggcccgcgcgcagccgccg

SEQ ID NO: 57592 - DNA, 348 bp, Homo sapiens
  chr18:43914278-43914626
  hyper
tggctctgtgcgaaacagaggtatcgctttttcctttcggggtctgcttcggagcgtggatcgccgcaggcaccggggcgggggcgggcgccgcgggcggccgggggctcagggcacacccgcgaggacgcagggcgagcggtggcttccccccaccccattttagggggacccccgagggtgggggcggccgccctcgtgggagcttttgtagtgaagttagggtttggcgaatttgggtcccttcctccccagccccattttttattttttgcggcggacgtggttcccccaaatcacagccccttcccctaatacctagccctgtatgatcgaaaggagaaagat

SEQ ID NO: 57593 - DNA, 140 bp, Homo sapiens; identical to SEQ ID NO: 36982
  chr18:43914882-43915022
  hyper

SEQ ID NO: 57594 - DNA, 139 bp, Homo sapiens; identical to SEQ ID NO: 36984
  chr18:44337012-44337151
  hyper

SEQ ID NO: 57595 - DNA, 83 bp, Homo sapiens; identical to SEQ ID NO: 22758
  chr18:44772977-44773060
  hyper

SEQ ID NO: 57596 - DNA, 126 bp, Homo sapiens; identical to SEQ ID NO: 22759
  chr18:44773466-44773592
  hyper

SEQ ID NO: 57597 - DNA, 19 bp, Homo sapiens
  chr18:44774387-44774406
  hyper
gcccttgctgggcaccggg

SEQ ID NO: 57598 - DNA, 36 bp, Homo sapiens
  chr18:44775554-44775590
  hyper
ctccgccgcagaaccccgggccgagccctacaggtc

SEQ ID NO: 57599 - DNA, 30 bp, Homo sapiens; identical to SEQ ID NO: 36991
  chr18:44776834-44776864
  hyper

SEQ ID NO: 57600 - DNA, 19 bp, Homo sapiens
  chr18:44777331-44777350
  hyper
cgcgcggctggccagccgg

SEQ ID NO: 57601 - DNA, 42 bp, Homo sapiens
  chr18:44777750-44777792
  hyper
acctctgggtgtctttaggcgtgtggctgccggcccatcttc

SEQ ID NO: 57602 - DNA, 187 bp, Homo sapiens
  chr18:44777862-44778049
  hyper
cgcgaagatccgggctctggcccgagcgaatggcgctcaaaccccggcctggggagaatgacggcctgaattgcggcggggcgtcccctccaccgcagaaagtgtgggtacgcagaaacccgcggcaggagagccccaagtggagcgcagtctgacagcgtctgtctctgaactcgtgtcggaccga

SEQ ID NO: 57603 - DNA, 330 bp, Homo sapiens
  chr18:44780673-44781003
  hyper
caatgctttcctcttcgagctgacatgcattttacacgtcaggactctcctcagccggctaattgattcaaattgttttattggttaaactggtgtcacccattttcatgatctatcaccacatggaggagagcatttccactcccatctccgttccgggcggctgcggttcacccaggccaaggacaggtaaaggagcccagacgcgggacccagaggaaaaccacaaaccgagctggcctcctcataactggagaggcgacgtctggaagtaagaggaggaggccggcacagcagcgcatatgggcttccagctacaaatttaaactg

SEQ ID NO: 57604 - DNA, 161 bp, Homo sapiens
  chr18:44781041-44781202
  hyper
tttcctccacctgggacacagtcggtttccgagccggcgttgaactccgcggtataggaggccacaacaaaacccgggtgggaactgtccgcggtgctgacgagatgcatcgttccaaagcacagcgaatcctactgtgttcaagtcgggaagaagcctcc

SEQ ID NO: 57605 - DNA, 264 bp, Homo sapiens; identical to SEQ ID NO: 36996
  chr18:44786883-44787147
  hyper

SEQ ID NO: 57606 - DNA, 80 bp, Homo sapiens
  chr18:44787701-44787781
  hyper
gtttagggtgagggtcggtctctcctcgcgccctgcttctcggcttagcttgctcagatccgcacccccccactccccac

SEQ ID NO: 57607 - DNA, 5 bp, Homo sapiens
  chr18:44787846-44787851
  hyper
agccc

SEQ ID NO: 57608 - DNA, 86 bp, Homo sapiens
  chr18:44789786-44789872
  hyper
ggaggatgaatggggcgctcgccgcggctcatggcgccccctaggagcggcaggaaacttctcctgcagggcagcgcgggccgggc

SEQ ID NO: 57609 - DNA, 26 bp, Homo sapiens
  chr18:44789937-44789963
  hyper
ctaggacatgccgggggctgtttgct

SEQ ID NO: 57610 - DNA, 30 bp, Homo sapiens; identical to SEQ ID NO: 37000
  chr18:44790732-44790762
  hyper

SEQ ID NO: 57611 - DNA, 53 bp, Homo sapiens
  chr18:45058240-45058293
  hyper
atcctggctgggcaccagagctgcacgcacgccgcatccatcttccggccgcc

SEQ ID NO: 57612 - DNA, 140 bp, Homo sapiens; identical to SEQ ID NO: 37002
  chr18:45058307-45058447
  hyper

SEQ ID NO: 57613 - DNA, 123 bp, Homo sapiens; identical to SEQ ID NO: 37003
  chr18:45275551-45275674
  hyper

SEQ ID NO: 57614 - DNA, 90 bp, Homo sapiens; identical to SEQ ID NO: 37004
  chr18:45662989-45663079
  hyper

SEQ ID NO: 57615 - DNA, 110 bp, Homo sapiens; identical to SEQ ID NO: 37005
  chr18:45663423-45663533
  hyper

SEQ ID NO: 57616 - DNA, 30 bp, Homo sapiens; identical to SEQ ID NO: 37006
  chr18:45935031-45935061
  hyper

SEQ ID NO: 57617 - DNA, 202 bp, Homo sapiens; identical to SEQ ID NO: 37007
  chr18:47087502-47087704
  hyper

SEQ ID NO: 57618 - DNA, 67 bp, Homo sapiens; identical to SEQ ID NO: 37008
  chr18:47088061-47088128
  hyper

SEQ ID NO: 57619 - DNA, 125 bp, Homo sapiens; identical to SEQ ID NO: 37009
  chr18:47339606-47339731
  hyper

SEQ ID NO: 57620 - DNA, 339 bp, Homo sapiens; identical to SEQ ID NO: 37010
  chr18:47792640-47792979
  hyper

SEQ ID NO: 57621 - DNA, 30 bp, Homo sapiens; identical to SEQ ID NO: 37011
  chr18:49866847-49866877
  hyper

SEQ ID NO: 57622 - DNA, 31 bp, Homo sapiens
  chr18:49867272-49867303
  hyper
cgtcgcacccccttccgtaccccacttccct

SEQ ID NO: 57623 - DNA, 61 bp, Homo sapiens
  chr18:52989220-52989281
  hyper
tacgcgagatcgattcaacttttccgaggggtttttattagttcctcgaataatgccgatt

SEQ ID NO: 57624 - DNA, 71 bp, Homo sapiens
  chr18:52989882-52989953
  hyper
catgggcccagagcctacggaggggctggggcgctgctcccctcgctggcgctgggcgccccaagggcgca

SEQ ID NO: 57625 - DNA, 1404 bp, Homo sapiens; identical to SEQ ID NO: 37016
  chr18:53254613-53256017
  hyper

SEQ ID NO: 57626 - DNA, 195 bp, Homo sapiens; identical to SEQ ID NO: 22773
  chr18:53256942-53257137
  hyper

SEQ ID NO: 57627 - DNA, 118 bp, Homo sapiens
  chr18:53257204-53257322
  hyper
gggtaggcgtcgcgcgtggggcggcactgtgggagttcccgaggccgaggtcgttcgcaggccccatttccctgcgctcttattcgtgttgccgcttcttggccgtccttgctctttg

SEQ ID NO: 57628 - DNA, 104 bp, Homo sapiens; identical to SEQ ID NO: 22775
  chr18:53446866-53446970
  hyper

SEQ ID NO: 57629 - DNA, 39 bp, Homo sapiens; identical to SEQ ID NO: 22776
  chr18:53447816-53447855
  hyper

SEQ ID NO: 57630 - DNA, 38 bp, Homo sapiens
  chr18:54789032-54789070
  hyper
ctgggagtgcatgtgcgttgctgagcgtggcctgagcc

SEQ ID NO: 57631 - DNA, 31 bp, Homo sapiens
  chr18:54789256-54789287
  hyper
atgcattggtagctggcgcctttagtcgggt

SEQ ID NO: 57632 - DNA, 54 bp, Homo sapiens
  chr18:55019653-55019707
  hyper
atcctgtgcttagatcgaactgtaacattattccaatcacatttatcttgcagg

SEQ ID NO: 57633 - DNA, 216 bp, Homo sapiens
  chr18:55020439-55020655
  hyper
aaagcccctagaagccgctgtccaaatcgatgtgattgcatttctcgtattcttcctcagcatcccttccctcatttcagaaatgggggttgggggaggctttcaggagggtgagggtggagggaaagacggtgtgtttgttcgggagggggcggcgagcagagatggacaggcgtgaggggagcgccctccccgcgccctgtccgcagactccgc

SEQ ID NO: 57634 - DNA, 141 bp, Homo sapiens; identical to SEQ ID NO: 4552
  chr18:55020804-55020945
  hyper

SEQ ID NO: 57635 - DNA, 113 bp, Homo sapiens; identical to SEQ ID NO: 22780
  chr18:55020965-55021078
  hyper

SEQ ID NO: 57636 - DNA, 154 bp, Homo sapiens
  chr18:55021242-55021396
  hyper
tttctccaaaaacaattctatggggctgcaaaggcgtagcgggtcaggctggcggggcggccgctgtccgcggtgctgattccctggtcctcgcagcgccgcgggctccagccctgcgcccggcgtgcgccctgctctccgcatgacggccatt

SEQ ID NO: 57637 - DNA, 3 bp, Homo sapiens
  chr18:55103411-55103414
  hyper
agc

SEQ ID NO: 57638 - DNA, 32 bp, Homo sapiens; identical to SEQ ID NO: 13074
  chr18:55105140-55105172
  hyper

SEQ ID NO: 57639 - DNA, 264 bp, Homo sapiens
  chr18:55105464-55105728
  hyper
aatgtccaggtcccccgctgggaaggacacactataccctatggcaagccagggtgggcgacttcccatggatcgggtggaggggggtatctttcaggatcggcgggcggtctaggggaacaattcgtggtggcgatgatttgcatagcgcgggtcttgggatgcgcgcggttccgagccagcctcgcacagctcgcttccggagctgcgagctcaggtttccacccccgatcccccgggctttcctcgcaccgctgagcccag

SEQ ID NO: 57640 - DNA, 231 bp, Homo sapiens
  chr18:55105830-55106061
  hyper
ttcctttgccgtctgctggtggattcctattcccagtcggtaatcgccccgcagtgttgatctaagaaggtaaagaaaactaggtttccctgcaaagagcctcccccaaatcggcggactccggatactttgagtggatttagaaatttatgtaatctttctcctttagtttatttttcatcctctcctacagttttctctgatttgctgttggttcggggcaagataaag

SEQ ID NO: 57641 - DNA, 46 bp, Homo sapiens; identical to SEQ ID NO: 13078
  chr18:56887753-56887799
  hyper

SEQ ID NO: 57642 - DNA, 170 bp, Homo sapiens; identical to SEQ ID NO: 37030
  chr18:56888013-56888183
  hyper

SEQ ID NO: 57643 - DNA, 150 bp, Homo sapiens
  chr18:56888404-56888554
  hyper
ttcgccctttcccctcgctcctttcccattccctctgcaacaggtcctgctctctaggcaccggcttggaggctccctcgccatggcccctagaacccaggcggagaggacggccgcgctgcgggtgcggagggcgcctgcgggtggggt

SEQ ID NO: 57644 - DNA, 13 bp, Homo sapiens
  chr18:56888623-56888636
  hyper
gctcacccagcat

SEQ ID NO: 57645 - DNA, 135 bp, Homo sapiens
  chr18:56931583-56931718
  hyper
ggtgccctcaccgtacgccgaccgtgtggggaacacgctctctggaagctgagttgggggtcctggtctctcttgccgccccctgcccccagcttcctgcgcgtgggctccagcggtctccgcaaagactttcag

SEQ ID NO: 57646 - DNA, 30 bp, Homo sapiens
  chr18:56932322-56932352
  hyper
gacacgccgccctcgcgcgcagagactgct

SEQ ID NO: 57647 - DNA, 22 bp, Homo sapiens
  chr18:56932645-56932667
  hyper
gccagagcgacaccctgtctct

SEQ ID NO: 57648 - DNA, 136 bp, Homo sapiens; identical to SEQ ID NO: 37035
  chr18:56932957-56933093
  hyper

SEQ ID NO: 57649 - DNA, 86 bp, Homo sapiens
  chr18:56934924-56935010
  hyper
agcttccagtgtcaacggtggatatcgagcacgctcaggcgggagtccgggactctccttcttcagagagtctcaggagattgtga

SEQ ID NO: 57650 - DNA, 88 bp, Homo sapiens
  chr18:56935319-56935407
  hyper
cttggtgaactgagaggagtccttaggagagcggggacgccaggggccgggggacacttcgctctcgccctagggaaggtggtcttga

SEQ ID NO: 57651 - DNA, 140 bp, Homo sapiens; identical to SEQ ID NO: 37037
  chr18:56935479-56935619
  hyper

SEQ ID NO: 57652 - DNA, 77 bp, Homo sapiens
  chr18:56935927-56936004
  hyper
aggctccagcgcctgcggtgatgggagcggcgtggccagcggggcccggcagcctgttgccctccagctgcagggct

SEQ ID NO: 57653 - DNA, 383 bp, Homo sapiens; identical to SEQ ID NO: 37039
  chr18:56936333-56936716
  hyper

SEQ ID NO: 57654 - DNA, 50 bp, Homo sapiens
  chr18:56939373-56939423
  hyper
ccccaaaggggagctcgtactacaaactggaacagactgcttgaagggcg

SEQ ID NO: 57655 - DNA, 233 bp, Homo sapiens; identical to SEQ ID NO: 22790
  chr18:56940722-56940955
  hyper

SEQ ID NO: 57656 - DNA, 401 bp, Homo sapiens
  chr18:56941788-56942189
  hyper
acccctcaaatctgaggcgagacccgaggcgagcgcttggccttccctgaactggtggcctgaaccgtgaattaaaatgctttcctataaaagctcaaggacctagaggacaatatccctaaaatctccttttcagtaggcgctctgatctccacagcaggggtgtcttctttatcccgcttgcgttcagacaagcgtttgctgcgtccctttagagggcaaggcaaccgtcgagggccacgtcgtgggcatcaaacaaattgggaaaggccagggccgttggcctggtggagtttaacgtccagtctggaagacaagacaaaggaagagggaaaacacacatcctcagatccccaacctttaaattggtgttagaaggatgtttgcggaggacaagtcaa

SEQ ID NO: 57657 - DNA, 30 bp, Homo sapiens; identical to SEQ ID NO: 37044
  chr18:57069866-57069896
  hyper

SEQ ID NO: 57658 - DNA, 210 bp, Homo sapiens; identical to SEQ ID NO: 22792
  chr18:57364448-57364658
  hyper

SEQ ID NO: 57659 - DNA, 289 bp, Homo sapiens
  chr18:57364691-57364980
  hyper
tttgcaccacctgcacggggagcaggggtccggaatattatggggctggggggaaaatgaggctaggagttggggtatcggatgcaaacccagcagagaagcaggtaaagggggtacctgcggtgtccggctggcgcgagggccctgaggttcaagttgtctcgtcgggacgttcacgtccgattgacagacttgctggactcggcttggggctgcgccctcgcctcttccctctccctcctctgggagaagcgcgcagggtggggaaagcgggcggttgtttgcattt

SEQ ID NO: 57660 - DNA, 159 bp, Homo sapiens; identical to SEQ ID NO: 22794
  chr18:59000829-59000988
  hyper

SEQ ID NO: 57661 - DNA, 279 bp, Homo sapiens; identical to SEQ ID NO: 22795
  chr18:59001022-59001301
  hyper

SEQ ID NO: 57662 - DNA, 28 bp, Homo sapiens
  chr18:60263895-60263923
  hyper
accccgggcgcaccgccctccaggggtg

SEQ ID NO: 57663 - DNA, 135 bp, Homo sapiens; identical to SEQ ID NO: 37050
  chr18:60264219-60264354
  hyper

SEQ ID NO: 57664 - DNA, 21 bp, Homo sapiens
  chr18:60985733-60985754
  hyper
tgtgcccgggctgggaggaga

SEQ ID NO: 57665 - DNA, 137 bp, Homo sapiens; identical to SEQ ID NO: 37053
  chr18:63417736-63417873
  hyper

SEQ ID NO: 57666 - DNA, 64 bp, Homo sapiens
  chr18:67067494-67067558
  hyper
ttcagtcctagttaacgaaaacgcatgcataaatcaaccactcgggtcggtcggtcttctccac

SEQ ID NO: 57667 - DNA, 44 bp, Homo sapiens
  chr18:67067907-67067951
  hyper
gaccggggagccgggtggggagcgggcctcggggcgcccggcgg

SEQ ID NO: 57668 - DNA, 17 bp, Homo sapiens
  chr18:67068698-67068715
  hyper
ggggcccacacctgccg

SEQ ID NO: 57669 - DNA, 184 bp, Homo sapiens
  chr18:67069032-67069216
  hyper
ggctgtagtttagggcgccttcgccgtggccgagggcggctcccgcgccccgcaagtgctcccctacccggggacccgcgcccgcgtgcaggcaggtgtgtgccccgcgcccgcccgcggtcactgctccgtgacggcaaagttgatggagacctttccctattcttgagagatgcgctgcctg

SEQ ID NO: 57670 - DNA, 181 bp, Homo sapiens; identical to SEQ ID NO: 22798
  chr18:70209205-70209386
  hyper

SEQ ID NO: 57671 - DNA, 440 bp, Homo sapiens; identical to SEQ ID NO: 37059
  chr18:70209493-70209933
  hyper

SEQ ID NO: 57672 - DNA, 89 bp, Homo sapiens; identical to SEQ ID NO: 37060
  chr18:70210724-70210813
  hyper

SEQ ID NO: 57673 - DNA, 258 bp, Homo sapiens; identical to SEQ ID NO: 37061
  chr18:70211036-70211294
  hyper

SEQ ID NO: 57674 - DNA, 127 bp, Homo sapiens
  chr18:70211499-70211626
  hyper
gaactgtccggttcccgcagggctagaagaggggcctccggcccgggtctgtgtgtctgctcctctggacctcggactggtggagcggctggcgcttgcgcttatttattaaattgcggtgtccgcg

SEQ ID NO: 57675 - DNA, 18 bp, Homo sapiens
  chr18:70211666-70211684
  hyper
ctgcgcctggagctcggc

SEQ ID NO: 57676 - DNA, 66 bp, Homo sapiens
  chr18:70534216-70534282
  hyper
catccctgaactgcacgctatcctccacccccggggggttcctgcgcactgaaagaccgttctccg

SEQ ID NO: 57677 - DNA, 153 bp, Homo sapiens
  chr18:70535220-70535373
  hyper
cggaaagaggagcgggtgggtgggcgtctgggaggcgggctggagggcggtgcaggggagcggggcggccggggggggggccggggggcggggaagggagggaggagaaaggagccggaagagggcagagttaccaaatgggctccttagtca

SEQ ID NO: 57678 - DNA, 86 bp, Homo sapiens
  chr18:70535582-70535668
  hyper
agaggatgcagccgcaaatcccgagccggatcctcgtgccggacggaaggcgtggaagcgggaggggccttcgtgtgaaaatccct

SEQ ID NO: 57679 - DNA, 101 bp, Homo sapiens
  chr18:70535909-70536010
  hyper
ttactcctgcaaagacgcgggcttcttgcaattgagccccccacctcgaggtatttaaaaccaccccaaggcacacacggacccccgttcccccgcgccac

SEQ ID NO: 57680 - DNA, 229 bp, Homo sapiens; identical to SEQ ID NO: 22804
  chr18:70536604-70536833
  hyper

SEQ ID NO: 57681 - DNA, 154 bp, Homo sapiens; identical to SEQ ID NO: 22805
  chr18:70536871-70537025
  hyper

SEQ ID NO: 57682 - DNA, 33 bp, Homo sapiens; identical to SEQ ID NO: 13107
  chr18:70537332-70537365
  hyper

SEQ ID NO: 57683 - DNA, 378 bp, Homo sapiens; identical to SEQ ID NO: 37070
  chr18:72123440-72123818
  hyper

SEQ ID NO: 57684 - DNA, 15 bp, Homo sapiens
  chr18:72124175-72124190
  hyper
aacccatgtccccgg

SEQ ID NO: 57685 - DNA, 48 bp, Homo sapiens; identical to SEQ ID NO: 13109
  chr18:72124237-72124285
  hyper

SEQ ID NO: 57686 - DNA, 97 bp, Homo sapiens
  chr18:73167832-73167929
  hyper
gggccgggcacccgggaacccgcgagcgcggggctgggctctgggctgcgtccgggggccccgacttggttattgatcggcccaagcgcaggagaac

SEQ ID NO: 57687 - DNA, 2 bp, Homo sapiens
  chr18:73628017-73628019
  hyper
aa

SEQ ID NO: 57688 - DNA, 114 bp, Homo sapiens; identical to SEQ ID NO: 37075
  chr18:73628494-73628608
  hyper

SEQ ID NO: 57689 - DNA, 24 bp, Homo sapiens
  chr18:74962147-74962171
  hyper
ttccacctgcgcggctgcagccgg

SEQ ID NO: 57690 - DNA, 6 bp, Homo sapiens
  chr18:74962209-74962215
  hyper
cggagg

SEQ ID NO: 57691 - DNA, 250 bp, Homo sapiens; identical to SEQ ID NO: 37080
  chr18:74962692-74962942
  hyper

SEQ ID NO: 57692 - DNA, 70 bp, Homo sapiens; identical to SEQ ID NO: 37082
  chr18:74963720-74963790
  hyper

SEQ ID NO: 57693 - DNA, 81 bp, Homo sapiens
  chr18:75362850-75362931
  hyper
caggaccctgcaggacgcgggccgaggctcccagctgccggccatgccctcggctcctctcccgacacgcgccagcactgc

SEQ ID NO: 57694 - DNA, 111 bp, Homo sapiens
  chr18:75362985-75363096
  hyper
gaagaagccgggaccgcgagcagctggacgctttctccctggggctcagccacacattttagtcacagttacagactacgggggatttgaagccttcgctttagtttttat

SEQ ID NO: 57695 - DNA, 256 bp, Homo sapiens
  chr18:75611969-75612225
  hyper
tctccagctgagccccgaggaggccgctgctccgtgtcctggactctgagcaaagccgcgggccttagaccctccccagcctcaggcgagccccagtgccgacacctgctaagagacggtgcattgcgggctaaacccgcagacactgagcggggacgccacttccgacggcgtaaggcacctaaagtagccacagaggaaactgggggtgcaggagctgcaggagccccggcggcctgcaggggcggtggcgcgg

SEQ ID NO: 57696 - DNA, 145 bp, Homo sapiens; identical to SEQ ID NO: 22814
  chr18:75612286-75612431
  hyper

SEQ ID NO: 57697 - DNA, 332 bp, Homo sapiens; identical to SEQ ID NO: 37085
  chr18:77153184-77153516
  hyper

SEQ ID NO: 57698 - DNA, 166 bp, Homo sapiens; identical to SEQ ID NO: 37086
  chr18:77159847-77160013
  hyper

SEQ ID NO: 57699 - DNA, 132 bp, Homo sapiens; identical to SEQ ID NO: 37087
  chr18:77547916-77548048
  hyper

SEQ ID NO: 57700 - DNA, 9 bp, Homo sapiens
  chr18:77557882-77557891
  hyper
aggctggga

SEQ ID NO: 57701 - DNA, 170 bp, Homo sapiens
  chr18:77557912-77558082
  hyper
cgccggagtccgggatgccggctccagagacgccgcgctccgccccgaggaggccgccggccgggtaagcggagcccggagctcgcggagtctggaccgcaggtaaagttgagcgcgccgtggggccgggggtggggggtccgcggcgaaggagccggggccgcagtggg

SEQ ID NO: 57702 - DNA, 39 bp, Homo sapiens; identical to SEQ ID NO: 22819
  chr18:77558358-77558397
  hyper

SEQ ID NO: 57703 - DNA, 415 bp, Homo sapiens; identical to SEQ ID NO: 22820
  chr18:77558416-77558831
  hyper

SEQ ID NO: 57704 - DNA, 212 bp, Homo sapiens; identical to SEQ ID NO: 22821
  chr18:77558930-77559142
  hyper

SEQ ID NO: 57705 - DNA, 74 bp, Homo sapiens; identical to SEQ ID NO: 37092
  chr18:78005084-78005158
  hyper

SEQ ID NO: 57706 - DNA, 78 bp, Homo sapiens; identical to SEQ ID NO: 37093
  chr19:496464-496542
  hyper

SEQ ID NO: 57707 - DNA, 102 bp, Homo sapiens
  chr19:591263-591365
  hyper
agagcgagaccggcgcgtgtccccgtgggctgtgtgtgaacaggggcccgtgaccgcggcggggttcccggggcgcgagcctgtggccggagaggtgtgtct

SEQ ID NO: 57708 - DNA, 115 bp, Homo sapiens
  chr19:591416-591531
  hyper
tattttggtgggacgtgtggtttgtgtgtgttgggaccaggtggcgggcgtgcgcgtgtacgcccggggccggtgtgcaccggtgggcagtagtgtgagccgcaggcaggtctca

SEQ ID NO: 57709 - DNA, 89 bp, Homo sapiens; identical to SEQ ID NO: 37095
  chr19:639980-640069
  hyper

SEQ ID NO: 57710 - DNA, 103 bp, Homo sapiens; identical to SEQ ID NO: 37096
  chr19:661158-661261
  hyper

SEQ ID NO: 57711 - DNA, 61 bp, Homo sapiens; identical to SEQ ID NO: 37097
  chr19:822595-822656
  hyper

SEQ ID NO: 57712 - DNA, 42 bp, Homo sapiens
  chr19:1401710-1401752
  hyper
ggcaccgcagccccgcgcccggggacgcgaacctgcaggctg

SEQ ID NO: 57713 - DNA, 2 bp, Homo sapiens
  chr19:1401795-1401797
  hyper
tc

SEQ ID NO: 57714 - DNA, 197 bp, Homo sapiens; identical to SEQ ID NO: 37099
  chr19:1446633-1446830
  hyper

SEQ ID NO: 57715 - DNA, 246 bp, Homo sapiens
  chr19:1450073-1450319
  hyper
attggctgtctcacccgcatccctcatcccgcatcctcccccgctcgcggtggtctcgcccagcgctaggagcggcagcgccgcctgcccaggcccggaccgggctttgtccgccccggagcccctgcccgcgccgcggagaccccggagcccgcgcgctccgaggccaccccgggccgggatttccggtggggcccgcggagccgcgcagagggaggaggccccagacccaggcgccccgccagc

SEQ ID NO: 57716 - DNA, 42 bp, Homo sapiens; identical to SEQ ID NO: 22826
  chr19:1450390-1450432
  hyper

SEQ ID NO: 57717 - DNA, 77 bp, Homo sapiens; identical to SEQ ID NO: 37101
  chr19:1523753-1523830
  hyper

SEQ ID NO: 57718 - DNA, 102 bp, Homo sapiens
  chr19:1524447-1524549
  hyper
ccgtgggttgcgtgtccggggtgtgggcgtgcggctcggcctcgggatgcgacgctgtgttgcccctgggtgtgtgtgcgagcctggcgagggtctgagtgt

SEQ ID NO: 57719 - DNA, 49 bp, Homo sapiens; identical to SEQ ID NO: 37103
  chr19:1718861-1718910
  hyper

SEQ ID NO: 57720 - DNA, 30 bp, Homo sapiens; identical to SEQ ID NO: 13129
  chr19:1719137-1719167
  hyper

SEQ ID NO: 57721 - DNA, 180 bp, Homo sapiens; identical to SEQ ID NO: 37105
  chr19:1725554-1725734
  hyper

SEQ ID NO: 57722 - DNA, 61 bp, Homo sapiens; identical to SEQ ID NO: 37106
  chr19:1726021-1726082
  hyper

SEQ ID NO: 57723 - DNA, 415 bp, Homo sapiens; identical to SEQ ID NO: 37107
  chr19:1749776-1750191
  hyper

SEQ ID NO: 57724 - DNA, 36 bp, Homo sapiens; identical to SEQ ID NO: 37108
  chr19:1752836-1752872
  hyper

SEQ ID NO: 57725 - DNA, 670 bp, Homo sapiens
  chr19:1753502-1754172
  hyper
ccacatcctggtggccgcgctcgcagccgggccgggccgtgcgccgcgcagcctggcagcctcgcgcgcagccaccggggagcgggcgggagtcatgcagcggccttgagcactaggggccggcgctgaggagcgcgcgcggcgggagggcagccgagcatggagctgagcctggagagcctggggggcctgcacagcgtggcccacgcgcaggcgggcgagctgctgagcccgggccacgcgcgctcggcggcggcgcagcaccgcggcctggtggcgcccgggcgcccgggcctggtggccggcatggcgagcctgctggacggcggcggcggcggcggcggtgggggcgccgggggcgcgggcggcgcgggcagcgcgggcggcggcgcggacttccgcggggaactggcgggcccgctgcacccggcaatgggcatggcctgcgaggcgccgggcctgggcggcacctacacgacgctcacgcccctgcagcacctgccgccgctcgcggccgtggccgacaagttccaccagcacgcggcggccgcggccgtggccggggcgcacggcggccatccccacgcgcacccgcacccggcggccgcgccgcccccgccacccccgccgcagcgtctggcggccagcgtgagcggcagcttcaccctca

SEQ ID NO: 57726 - DNA, 485 bp, Homo sapiens
  chr19:1754254-1754739
  hyper
gctgtcgccgctgcccaacgcgctgccgcccgcgctgcacggcgccccgcagcccccgccgccgccaccacccccgccgctggccgcctacggcccgccaggccacctggctggggacaagctgctgccgcccgccgccttcgagccgcacgccgcgctgctgggacgcgcggaggacgcactggcccgcgggctgcccggaggcggcggcggcacaggcagcggcggagcgggcagcgggagcgccgcggggctgctggcgccgctgggcgggctggcggcggccggggcgcacgggccgcacgggggaggcggcggccccggcgggagcggcggcggccccagcgcgggcgcagcggccgaggagatcaacaccaaggaggtggcgcagcgcatcacggcggagctgaagcgctacagcatcccgcaggcaatcttcgcgcagcggatcctgtgtcgctctcagggcacgctctccgacctgc

SEQ ID NO: 57727 - DNA, 78 bp, Homo sapiens
  chr19:1754804-1754882
  hyper
tggctgcaggagccagagttccagcgcatgtcggcgctgcgcttggcaggtaggagcgtggcgcgcagggccagaccc

SEQ ID NO: 57728 - DNA, 111 bp, Homo sapiens
  chr19:1757305-1757416
  hyper
tggggaaacaggctccgtttgtgcctcgccttcctgacttgtgacaatgacaaacagtctcagctctgggagtctgggtttcctgtcgaggaagggagagttagaacagtc

SEQ ID NO: 57729 - DNA, 447 bp, Homo sapiens
  chr19:1757615-1758062
  hyper
cctgtcgcgtctcaggtgccctgggggccgcgtctacaccaccggactccgcctggggcgtaagaggtggcgggggcgagggccgcggggtcactaggctccggcccaggcctttagttccggtcgctgcgcaaatgaaaagcggttaagtggcggcaaatcgcggcggttagggggagacggccggatgcgtccccatctccacctaacacggcgacgccccaacgctggtgctcggaaagggaactctgcccccgccccgcccccgcaccatttcaaccccgcagcagaggactcgccgccctttctactccggcatccccattccccgctccgcgagcaccgcgggcctccccaggcctcctccaaggagaactttgcgccccgggtctcccgtcgcgcttgcccggctcggggcgggccacgcgtttccgcaggtgccgagtg

SEQ ID NO: 57730 - DNA, 33 bp, Homo sapiens; identical to SEQ ID NO: 37112
  chr19:1758771-1758804
  hyper

SEQ ID NO: 57731 - DNA, 302 bp, Homo sapiens
  chr19:1762172-1762474
  hyper
ccatctggagaccctcgtgctggctgctgggggtcctgcgtgccttccgcgcgcccccagctgcgcccgccagccctccaaccctcctgccctcctgccctcctgccctcctctctgggagtcgggacagaagctgctgggctctcctccctggagctggggctttgggaaggtcgagtagaccctcagtgagtgggatgcgcgagttggggacgctagttgcggggcagcaggggtccacgcatttccaagcgccctttcccgtccaaggacctgctggggggatgactgtgcctcagttt

SEQ ID NO: 57732 - DNA, 169 bp, Homo sapiens; identical to SEQ ID NO: 13138
  chr19:1762627-1762796
  hyper

SEQ ID NO: 57733 - DNA, 24 bp, Homo sapiens
  chr19:1764269-1764293
  hyper
gcccccaccccatggcggcccagc

SEQ ID NO: 57734 - DNA, 300 bp, Homo sapiens; identical to SEQ ID NO: 37116
  chr19:1765665-1765965
  hyper

SEQ ID NO: 57735 - DNA, 30 bp, Homo sapiens; identical to SEQ ID NO: 37117
  chr19:1768342-1768372
  hyper

SEQ ID NO: 57736 - DNA, 230 bp, Homo sapiens; identical to SEQ ID NO: 37118
  chr19:1769737-1769967
  hyper

SEQ ID NO: 57737 - DNA, 41 bp, Homo sapiens; identical to SEQ ID NO: 37119
  chr19:1775395-1775436
  hyper

SEQ ID NO: 57738 - DNA, 117 bp, Homo sapiens; identical to SEQ ID NO: 22842
  chr19:1776259-1776376
  hyper

SEQ ID NO: 57739 - DNA, 169 bp, Homo sapiens
  chr19:1776534-1776703
  hyper
acgccgaggaaggtggattccgcttgctccattttttgccaaaaatatttacaaatgggaagggtcggaaatgaagatgagcgcccccctcccaccccgcgctctcccccgctcctctcatctggtctgggtgacctccgagactggccggccgcgggatcccaggagc

SEQ ID NO: 57740 - DNA, 21 bp, Homo sapiens
  chr19:1776990-1777011
  hyper
agtgccaccccttcccgaacc

SEQ ID NO: 57741 - DNA, 391 bp, Homo sapiens; identical to SEQ ID NO: 37122
  chr19:1856988-1857379
  hyper

SEQ ID NO: 57742 - DNA, 17 bp, Homo sapiens
  chr19:2251135-2251152
  hyper
accccttcctggagacg

SEQ ID NO: 57743 - DNA, 81 bp, Homo sapiens
  chr19:2251715-2251796
  hyper
gacctaccaggccaacaattgccagggcgtgtgcggctggcctcagtccgaccgcaacccgcgctacggcaaccacgtggt

SEQ ID NO: 57744 - DNA, 326 bp, Homo sapiens; identical to SEQ ID NO: 22844
  chr19:2252658-2252984
  hyper

SEQ ID NO: 57745 - DNA, 416 bp, Homo sapiens
  chr19:2289837-2290253
  hyper
tgaaaaacagtcctgcggttgggcgtctacaaaaaaaggggaagttctgcctggggagcgccgtgcagccgtccccttcccctccgggaaatgcataggtggacacgcgagcggccggcccgcgggggaggggaggggagggtccgccctggggacccctcagatcatcttcatgttgaacttgcgcgcgcctccctggcccgccgcggcggccggcccatccaccttgcggaaggagtactccaccgagaagttgtttttgtgctgcccgcggccgcggctccacacgaacagcagcacgaagcagaagaggaccacgcccaggaaggtgatgcagcccatggcggtggacaccaggatggtggtgaggtcgagcggcgcgcgcagggccgccagcgtctcgttgtgggcctcgc

SEQ ID NO: 57746 - DNA, 234 bp, Homo sapiens
  chr19:2302559-2302793
  hyper
ccccagcaaggggcacgtcccaccaggcccggactgcccgtctgcccctgcagggcccctcgctctggtggcgggctcggtgagctctgctgcccggtctcgggagtctgggggagcgcggcgtcgacccctgtggagggaggactcgtgtttcaaggacagagcctcattaccatgcacgaccagccgcagctgaggccgcagaggcctttggcaggggggccgggccggcgg

SEQ ID NO: 57747 - DNA, 33 bp, Homo sapiens; identical to SEQ ID NO: 37130
  chr19:2308140-2308173
  hyper

SEQ ID NO: 57748 - DNA, 106 bp, Homo sapiens; identical to SEQ ID NO: 37131
  chr19:2478809-2478915
  hyper

SEQ ID NO: 57749 - DNA, 30 bp, Homo sapiens; identical to SEQ ID NO: 37132
  chr19:2703070-2703100
  hyper

SEQ ID NO: 57750 - DNA, 30 bp, Homo sapiens; identical to SEQ ID NO: 37133
  chr19:3244155-3244185
  hyper

SEQ ID NO: 57751 - DNA, 30 bp, Homo sapiens; identical to SEQ ID NO: 37134
  chr19:3270512-3270542
  hyper

SEQ ID NO: 57752 - DNA, 1 bp, Homo sapiens
  chr19:3361138-3361139
  hyper
g

SEQ ID NO: 57753 - DNA, 15 bp, Homo sapiens
  chr19:3585992-3586007
  hyper
ggggccccctttgca

SEQ ID NO: 57754 - DNA, 53 bp, Homo sapiens
  chr19:3785596-3785649
  hyper
ccacgtgtactcacacgcatacggatgcatgcacacgcacagaaacacacagg

SEQ ID NO: 57755 - DNA, 103 bp, Homo sapiens; identical to SEQ ID NO: 37139
  chr19:3786583-3786686
  hyper

SEQ ID NO: 57756 - DNA, 139 bp, Homo sapiens; identical to SEQ ID NO: 37140
  chr19:3821971-3822110
  hyper

SEQ ID NO: 57757 - DNA, 88 bp, Homo sapiens
  chr19:3822203-3822291
  hyper
acacagaacagccgcacgcgcaccaggcacgaggcggggtgggatgtgagatgctaccgctgccaggtcgcggcggagccttcctcct

SEQ ID NO: 57758 - DNA, 210 bp, Homo sapiens; identical to SEQ ID NO: 37142
  chr19:3868851-3869061
  hyper

SEQ ID NO: 57759 - DNA, 85 bp, Homo sapiens; identical to SEQ ID NO: 37143
  chr19:3869118-3869203
  hyper

SEQ ID NO: 57760 - DNA, 304 bp, Homo sapiens; identical to SEQ ID NO: 37144
  chr19:3880484-3880788
  hyper

SEQ ID NO: 57761 - DNA, 59 bp, Homo sapiens; identical to SEQ ID NO: 37145
  chr19:3881573-3881632
  hyper

SEQ ID NO: 57762 - DNA, 106 bp, Homo sapiens; identical to SEQ ID NO: 37146
  chr19:3933108-3933214
  hyper

SEQ ID NO: 57763 - DNA, 257 bp, Homo sapiens; identical to SEQ ID NO: 37147
  chr19:3933461-3933718
  hyper

SEQ ID NO: 57764 - DNA, 81 bp, Homo sapiens; identical to SEQ ID NO: 37148
  chr19:4077899-4077980
  hyper

SEQ ID NO: 57765 - DNA, 197 bp, Homo sapiens; identical to SEQ ID NO: 37149
  chr19:4198002-4198199
  hyper

SEQ ID NO: 57766 - DNA, 92 bp, Homo sapiens; identical to SEQ ID NO: 37150
  chr19:4279567-4279659
  hyper

SEQ ID NO: 57767 - DNA, 70 bp, Homo sapiens; identical to SEQ ID NO: 13159
  chr19:4304487-4304557
  hyper

SEQ ID NO: 57768 - DNA, 35 bp, Homo sapiens; identical to SEQ ID NO: 37152
  chr19:4380549-4380584
  hyper

SEQ ID NO: 57769 - DNA, 32 bp, Homo sapiens; identical to SEQ ID NO: 37153
  chr19:4597471-4597503
  hyper

SEQ ID NO: 57770 - DNA, 182 bp, Homo sapiens
  chr19:5292630-5292812
  hyper
tggggtccacaggcccgagaggagcggaaacaaatggatggaggtaaacttcctgcgattttcgggggtggctaagagcagggattcctgccatgcaccccccaccgctacctgccccctctgcggtcctgttgcctcctccgccttctgcgaagtccccagtcacagctcccccgggctgg

SEQ ID NO: 57771 - DNA, 71 bp, Homo sapiens; identical to SEQ ID NO: 13161
  chr19:5293067-5293138
  hyper

SEQ ID NO: 57772 - DNA, 27 bp, Homo sapiens
  chr19:5293155-5293182
  hyper
cggctcggagatcgggcccaggccccg

SEQ ID NO: 57773 - DNA, 175 bp, Homo sapiens; identical to SEQ ID NO: 37157
  chr19:5293462-5293637
  hyper

SEQ ID NO: 57774 - DNA, 122 bp, Homo sapiens; identical to SEQ ID NO: 37158
  chr19:5294020-5294142
  hyper

SEQ ID NO: 57775 - DNA, 30 bp, Homo sapiens; identical to SEQ ID NO: 13164
  chr19:5338746-5338776
  hyper

SEQ ID NO: 57776 - DNA, 30 bp, Homo sapiens; identical to SEQ ID NO: 37161
  chr19:5339394-5339424
  hyper

SEQ ID NO: 57777 - DNA, 352 bp, Homo sapiens; identical to SEQ ID NO: 37162
  chr19:5340451-5340803
  hyper

SEQ ID NO: 57778 - DNA, 38 bp, Homo sapiens; identical to SEQ ID NO: 37163
  chr19:5436741-5436779
  hyper

SEQ ID NO: 57779 - DNA, 214 bp, Homo sapiens; identical to SEQ ID NO: 13167
  chr19:5437029-5437243
  hyper

SEQ ID NO: 57780 - DNA, 63 bp, Homo sapiens; identical to SEQ ID NO: 37165
  chr19:5567596-5567659
  hyper

SEQ ID NO: 57781 - DNA, 432 bp, Homo sapiens; identical to SEQ ID NO: 37166
  chr19:5827883-5828315
  hyper

SEQ ID NO: 57782 - DNA, 30 bp, Homo sapiens; identical to SEQ ID NO: 37167
  chr19:5962276-5962306
  hyper

SEQ ID NO: 57783 - DNA, 56 bp, Homo sapiens; identical to SEQ ID NO: 37168
  chr19:6393996-6394052
  hyper

SEQ ID NO: 57784 - DNA, 44 bp, Homo sapiens; identical to SEQ ID NO: 37169
  chr19:6501870-6501914
  hyper

SEQ ID NO: 57785 - DNA, 53 bp, Homo sapiens; identical to SEQ ID NO: 37170
  chr19:6502724-6502777
  hyper

SEQ ID NO: 57786 - DNA, 45 bp, Homo sapiens; identical to SEQ ID NO: 37171
  chr19:6531154-6531199
  hyper

SEQ ID NO: 57787 - DNA, 345 bp, Homo sapiens
  chr19:6590478-6590823
  hyper
cccctcccccacccggagcgagtggctggggccatcccgtcctaggaggccccaggaagcccccacgcccagccttgtgaagcccccagcagcctctgagtcagcctgccgggggaacaccagagccgagtcatcttccatttccatgtgtgcctacctttcccatcccgggatctccctgtacctcctggcagggctgcctgtctcgtagcccctacaccgggcagcctggtccccgcctcgcctccctgttctggtctctgtctctgccctaccagatcttcctctctggcctctttgtacccatctcattctgtcttttcggtcacgcgcctctctatgttt

SEQ ID NO: 57788 - DNA, 123 bp, Homo sapiens; identical to SEQ ID NO: 37173
  chr19:7197100-7197223
  hyper

SEQ ID NO: 57789 - DNA, 270 bp, Homo sapiens; identical to SEQ ID NO: 37174
  chr19:7565964-7566234
  hyper

SEQ ID NO: 57790 - DNA, 103 bp, Homo sapiens; identical to SEQ ID NO: 22868
  chr19:7794909-7795012
  hyper

SEQ ID NO: 57791 - DNA, 152 bp, Homo sapiens; identical to SEQ ID NO: 37176
  chr19:7795540-7795692
  hyper

SEQ ID NO: 57792 - DNA, 50 bp, Homo sapiens; identical to SEQ ID NO: 37177
  chr19:7795734-7795784
  hyper

SEQ ID NO: 57793 - DNA, 43 bp, Homo sapiens
  chr19:7852985-7853028
  hyper
tgtacatctttgggccgtttgcagtcacgcgtgtgcacatggc

SEQ ID NO: 57794 - DNA, 204 bp, Homo sapiens
  chr19:7853157-7853361
  hyper
agggaaggatttccgagtccctggccttgcctgcaggagcctctctccgcagcctccacggagcgcgcggcgctgctcggctgccaggacctgctgaggacaaacggtgtgtgcagagccgggcgcctgggcgcccggggcgtgtgcggcgggagcgtctgagaccccagagatggagtcctgggtgcgtgggggccctgtggt

SEQ ID NO: 57795 - DNA, 11 bp, Homo sapiens
  chr19:7853460-7853471
  hyper
gcagacggcgg

SEQ ID NO: 57796 - DNA, 60 bp, Homo sapiens; identical to SEQ ID NO: 13177
  chr19:7853543-7853603
  hyper

SEQ ID NO: 57797 - DNA, 110 bp, Homo sapiens; identical to SEQ ID NO: 37180
  chr19:7853873-7853983
  hyper

SEQ ID NO: 57798 - DNA, 30 bp, Homo sapiens; identical to SEQ ID NO: 37181
  chr19:7926920-7926950
  hyper

SEQ ID NO: 57799 - DNA, 95 bp, Homo sapiens; identical to SEQ ID NO: 37182
  chr19:7927441-7927536
  hyper

SEQ ID NO: 57800 - DNA, 261 bp, Homo sapiens
  chr19:8115276-8115537
  hyper
gaaggtagggggcagtgagccgtagcggagaggctggccccagcccgccacgccgcttccccacgctcgcagccacgcggagccgcgtcctggtccagcctcacccacccagagcaagaggcggaggaactggaacagcgccccggcccgtgggctgccactggccgcagcaacgggacgggtgagagcacctgcccccgacgcgtcttaactgctctggtggggcggggctgaccgtgcaagccccgccccagtctaagc

SEQ ID NO: 57801 - DNA, 96 bp, Homo sapiens; identical to SEQ ID NO: 37184
  chr19:8428705-8428801
  hyper

SEQ ID NO: 57802 - DNA, 126 bp, Homo sapiens; identical to SEQ ID NO: 37185
  chr19:8429231-8429357
  hyper

SEQ ID NO: 57803 - DNA, 145 bp, Homo sapiens; identical to SEQ ID NO: 37186
  chr19:9434811-9434956
  hyper

SEQ ID NO: 57804 - DNA, 20 bp, Homo sapiens
  chr19:9517771-9517791
  hyper
gtttccaggcatgagggcaa

SEQ ID NO: 57805 - DNA, 106 bp, Homo sapiens; identical to SEQ ID NO: 37189
  chr19:9517879-9517985
  hyper

SEQ ID NO: 57806 - DNA, 17 bp, Homo sapiens
  chr19:9609036-9609053
  hyper
accgaaggtcccaatgg

SEQ ID NO: 57807 - DNA, 290 bp, Homo sapiens
  chr19:9903623-9903913
  hyper
tggtgcaggggaaaccgttggttcagctgcggttcctgggaagggggtgccgctctgatcacgcgcacttctgattcccctctcggggctcggaagcggctgagggctctggacccggtctccgaggcgtgaggcggtgggagggtcggcggccgcgtcctccacgaccctggggagaagtcccagtttccgcgcagccgacaacggttggaccccgtccctccggcttcactgggcaccgtgggggcagaacccggcggcggcttggggtgggggcgggaccacgatgg

SEQ ID NO: 57808 - DNA, 191 bp, Homo sapiens; identical to SEQ ID NO: 37193
  chr19:10024331-10024522
  hyper

SEQ ID NO: 57809 - DNA, 55 bp, Homo sapiens; identical to SEQ ID NO: 37194
  chr19:10121131-10121186
  hyper

SEQ ID NO: 57810 - DNA, 64 bp, Homo sapiens; identical to SEQ ID NO: 37195
  chr19:10197697-10197761
  hyper

SEQ ID NO: 57811 - DNA, 118 bp, Homo sapiens; identical to SEQ ID NO: 37196
  chr19:10347133-10347251
  hyper

SEQ ID NO: 57812 - DNA, 30 bp, Homo sapiens; identical to SEQ ID NO: 37197
  chr19:10397660-10397690
  hyper

SEQ ID NO: 57813 - DNA, 135 bp, Homo sapiens
  chr19:10398074-10398209
  hyper
cgcctacagtgagggacaggggctcggtcccggctggggtgaggggagggggctggaagaggtgggggaagggtagttgacagtcgctctatagggagcgcccgcggacctcactcagaggctcccccttgcctt

SEQ ID NO: 57814 - DNA, 181 bp, Homo sapiens
  chr19:10398285-10398466
  hyper
caggtgttcccggtgggctacttggtggtgaccctgaggcatggaagccgggtcatctattccgaaagcctggagcgcttcaccggcctggatctggccaacgtgaccttgacctacgagtttgctgctggaccccgcgacttctggcagcccgtgatctgccacgcgcgcctcaatctcg

SEQ ID NO: 57815 - DNA, 313 bp, Homo sapiens; identical to SEQ ID NO: 37199
  chr19:10400448-10400761
  hyper

SEQ ID NO: 57816 - DNA, 173 bp, Homo sapiens; identical to SEQ ID NO: 37200
  chr19:10400989-10401162
  hyper

SEQ ID NO: 57817 - DNA, 30 bp, Homo sapiens; identical to SEQ ID NO: 37201
  chr19:10402001-10402031
  hyper

SEQ ID NO: 57818 - DNA, 81 bp, Homo sapiens; identical to SEQ ID NO: 37202
  chr19:10402409-10402490
  hyper

SEQ ID NO: 57819 - DNA, 62 bp, Homo sapiens; identical to SEQ ID NO: 22881
  chr19:10406349-10406411
  hyper

SEQ ID NO: 57820 - DNA, 82 bp, Homo sapiens; identical to SEQ ID NO: 37207
  chr19:10530397-10530479
  hyper

SEQ ID NO: 57821 - DNA, 452 bp, Homo sapiens
  chr19:10531512-10531964
  hyper
accctgaagcctcccccgcagcacctgtggcggcagcctcggacccccatccgtatccagcagcgcggctactccgacagcgcggagcgcgccgagcgggagcggcagccgcaccggcccatagagcgcgccgatgccatggacaccagcgaccggcccggcctgcgcacgacccgcatgtcctggccctcgtccttccatggcactggcaccggcagcggcggcgcgggcggaggcagcagcaggcggtaagactccccgcggcggatgcgcgcggaacggatgggcgcgcagggaggaggcaactcgagctgccggccgcagggggcgctaggatgcgggtggggtcggtttggctggcgggggcggagggaattcggctgcgggggcgtctgggacctggcccctggttgtgcgctctacgggaggcttcctgctgaagcccatcctgg

SEQ ID NO: 57822 - DNA, 203 bp, Homo sapiens; identical to SEQ ID NO: 13192
  chr19:10616329-10616532
  hyper

SEQ ID NO: 57823 - DNA, 12 bp, Homo sapiens
  chr19:10624739-10624751
  hyper
cgcgtggcgcag

SEQ ID NO: 57824 - DNA, 202 bp, Homo sapiens
  chr19:10625465-10625667
  hyper
gagcaggaacatgggagcgtggaagcgcgggtggcgtccgagcaccaacaacacggctagattctctagcacgatgaaggcgcacaccgccaggcacaccacggcgtcggcgcgcaggccggcacccggctggtagcgcgcaccgcggagcttgccggtgtagttgtaatgcaggacgatgacctcgctcaccggcgccggc

SEQ ID NO: 57825 - DNA, 45 bp, Homo sapiens; identical to SEQ ID NO: 37212
  chr19:10625744-10625789
  hyper

SEQ ID NO: 57826 - DNA, 19 bp, Homo sapiens
  chr19:10628995-10629014
  hyper
tccgcggctcaagccatcc

SEQ ID NO: 57827 - DNA, 190 bp, Homo sapiens; identical to SEQ ID NO: 37214
  chr19:10629393-10629583
  hyper

SEQ ID NO: 57828 - DNA, 118 bp, Homo sapiens; identical to SEQ ID NO: 37215
  chr19:10691879-10691997
  hyper

SEQ ID NO: 57829 - DNA, 30 bp, Homo sapiens; identical to SEQ ID NO: 37216
  chr19:10806164-10806194
  hyper

SEQ ID NO: 57830 - DNA, 544 bp, Homo sapiens; identical to SEQ ID NO: 37217
  chr19:11529608-11530152
  hyper

SEQ ID NO: 57831 - DNA, 275 bp, Homo sapiens; identical to SEQ ID NO: 37218
  chr19:11531328-11531603
  hyper

SEQ ID NO: 57832 - DNA, 17 bp, Homo sapiens
  chr19:11532425-11532442
  hyper
cacgaggcccagcaggt

SEQ ID NO: 57833 - DNA, 35 bp, Homo sapiens; identical to SEQ ID NO: 37220
  chr19:11533057-11533092
  hyper

SEQ ID NO: 57834 - DNA, 30 bp, Homo sapiens; identical to SEQ ID NO: 37221
  chr19:11533564-11533594
  hyper

SEQ ID NO: 57835 - DNA, 78 bp, Homo sapiens
  chr19:11590953-11591031
  hyper
ggccgaggcccggggcgcgcgatccgacgccacccgctttcccagggctctcggggacgctttgtcgctttggcttgg

SEQ ID NO: 57836 - DNA, 7 bp, Homo sapiens
  chr19:11591185-11591192
  hyper
gaatcgc

SEQ ID NO: 57837 - DNA, 51 bp, Homo sapiens; identical to SEQ ID NO: 37223
  chr19:11591537-11591588
  hyper

SEQ ID NO: 57838 - DNA, 30 bp, Homo sapiens; identical to SEQ ID NO: 37224
  chr19:11591796-11591826
  hyper

SEQ ID NO: 57839 - DNA, 39 bp, Homo sapiens
  chr19:11592671-11592710
  hyper
aggcgttgggggtggcgcagcctcctttggtgcgcgggc

SEQ ID NO: 57840 - DNA, 272 bp, Homo sapiens; identical to SEQ ID NO: 22889
  chr19:11592750-11593022
  hyper

SEQ ID NO: 57841 - DNA, 226 bp, Homo sapiens
  chr19:11593159-11593385
  hyper
gcgatggtctgttccccaccccgtgttcctcccggtttccgtcatcggaaactgagctaggaggggggctgctcctgggcgcgcggaccccgctgcggttcccatggaaacctgccggctccggcagtgcggggagagtggaggggacctgcctcgcggggggagggagctcgcgggggcggccccagcggccggactcgctcatccttgccgattcttctgtccc

SEQ ID NO: 57842 - DNA, 136 bp, Homo sapiens; identical to SEQ ID NO: 37226
  chr19:11650677-11650813
  hyper

SEQ ID NO: 57843 - DNA, 139 bp, Homo sapiens
  chr19:11689321-11689460
  hyper
tctgcaggccctccacgggaccgcagcctgggagggcaggaggccctgcacctgcggccggtctgacctgctcctcacctccctgcctgcctcctccgtgctgggcgccgccgcgacacgtcccgcggacattcaggag

SEQ ID NO: 57844 - DNA, 171 bp, Homo sapiens; identical to SEQ ID NO: 37228
  chr19:11805426-11805597
  hyper

SEQ ID NO: 57845 - DNA, 278 bp, Homo sapiens; identical to SEQ ID NO: 37229
  chr19:11909455-11909733
  hyper

SEQ ID NO: 57846 - DNA, 158 bp, Homo sapiens; identical to SEQ ID NO: 37230
  chr19:11909793-11909951
  hyper

SEQ ID NO: 57847 - DNA, 333 bp, Homo sapiens; identical to SEQ ID NO: 37231
  chr19:11959427-11959760
  hyper

SEQ ID NO: 57848 - DNA, 151 bp, Homo sapiens; identical to SEQ ID NO: 22896
  chr19:11959761-11959912
  hyper

SEQ ID NO: 57849 - DNA, 30 bp, Homo sapiens; identical to SEQ ID NO: 37233
  chr19:11960297-11960327
  hyper

SEQ ID NO: 57850 - DNA, 30 bp, Homo sapiens; identical to SEQ ID NO: 37234
  chr19:11998469-11998499
  hyper

SEQ ID NO: 57851 - DNA, 342 bp, Homo sapiens; identical to SEQ ID NO: 37235
  chr19:11998761-11999103
  hyper

SEQ ID NO: 57852 - DNA, 62 bp, Homo sapiens; identical to SEQ ID NO: 13209
  chr19:12075756-12075818
  hyper

SEQ ID NO: 57853 - DNA, 20 bp, Homo sapiens
  chr19:12076359-12076379
  hyper
tcgtgcgtgggaggagcagt

SEQ ID NO: 57854 - DNA, 392 bp, Homo sapiens; identical to SEQ ID NO: 37238
  chr19:12146632-12147024
  hyper

SEQ ID NO: 57855 - DNA, 281 bp, Homo sapiens; identical to SEQ ID NO: 37239
  chr19:12163055-12163336
  hyper

SEQ ID NO: 57856 - DNA, 12 bp, Homo sapiens
  chr19:12163881-12163893
  hyper
tgacagcagaag

SEQ ID NO: 57857 - DNA, 89 bp, Homo sapiens
  chr19:12163923-12164012
  hyper
gcgactggttctggccacactttccaaggtcagctccctccctccctcccacctttacttcgaatatttgccttcggccaaacttgctc

SEQ ID NO: 57858 - DNA, 310 bp, Homo sapiens; identical to SEQ ID NO: 22902
  chr19:12175504-12175814
  hyper

SEQ ID NO: 57859 - DNA, 146 bp, Homo sapiens
  chr19:12176005-12176151
  hyper
gtcatgggggcaatcccgccttgggtgtggggctcgtgcgggaggagctgcgctgtgaggccctcagtgccccctttctcctgttaaaacttaaacaggcccggtgctgggaatagaggcgtgagccaccgcgcctggcctagcgt

SEQ ID NO: 57860 - DNA, 15 bp, Homo sapiens
  chr19:12203013-12203028
  hyper
tcagggctctgaagg

SEQ ID NO: 57861 - DNA, 36 bp, Homo sapiens
  chr19:12266983-12267019
  hyper
ggggactggggaccccgcagcccaccgctcctccca

SEQ ID NO: 57862 - DNA, 32 bp, Homo sapiens
  chr19:12267667-12267699
  hyper
acaaggcccggcagaaccgaaatgacctgttc

SEQ ID NO: 57863 - DNA, 9 bp, Homo sapiens
  chr19:12306263-12306272
  hyper
ggtcatggg

SEQ ID NO: 57864 - DNA, 234 bp, Homo sapiens; identical to SEQ ID NO: 37249
  chr19:12475809-12476043
  hyper

SEQ ID NO: 57865 - DNA, 30 bp, Homo sapiens; identical to SEQ ID NO: 37250
  chr19:12476667-12476697
  hyper

SEQ ID NO: 57866 - DNA, 131 bp, Homo sapiens
  chr19:12750856-12750987
  hyper
cagggcaccctactccgctcacctgcgacggcagcagccagtccccacgggcggaggggacctcatgcgacattcagcccgcgagattctcagagactgctcgcccgcaacacgcagtaacgatctcagga

SEQ ID NO: 57867 - DNA, 54 bp, Homo sapiens; identical to SEQ ID NO: 22905
  chr19:12751056-12751110
  hyper

SEQ ID NO: 57868 - DNA, 180 bp, Homo sapiens; identical to SEQ ID NO: 37252
  chr19:12936457-12936637
  hyper

SEQ ID NO: 57869 - DNA, 101 bp, Homo sapiens; identical to SEQ ID NO: 37253
  chr19:12945480-12945581
  hyper

SEQ ID NO: 57870 - DNA, 30 bp, Homo sapiens; identical to SEQ ID NO: 37254
  chr19:12949855-12949885
  hyper

SEQ ID NO: 57871 - DNA, 4 bp, Homo sapiens
  chr19:12952139-12952143
  hyper
cggg

SEQ ID NO: 57872 - DNA, 98 bp, Homo sapiens; identical to SEQ ID NO: 37257
  chr19:12978444-12978542
  hyper

SEQ ID NO: 57873 - DNA, 38 bp, Homo sapiens; identical to SEQ ID NO: 37258
  chr19:12996096-12996134
  hyper

SEQ ID NO: 57874 - DNA, 152 bp, Homo sapiens; identical to SEQ ID NO: 37259
  chr19:12996701-12996853
  hyper

SEQ ID NO: 57875 - DNA, 30 bp, Homo sapiens; identical to SEQ ID NO: 37260
  chr19:13030286-13030316
  hyper

SEQ ID NO: 57876 - DNA, 88 bp, Homo sapiens; identical to SEQ ID NO: 37261
  chr19:13213616-13213704
  hyper

SEQ ID NO: 57877 - DNA, 19 bp, Homo sapiens
  chr19:13616677-13616696
  hyper
ctggaagaggggaggcgga

SEQ ID NO: 57878 - DNA, 209 bp, Homo sapiens; identical to SEQ ID NO: 22907
  chr19:13617256-13617465
  hyper

SEQ ID NO: 57879 - DNA, 43 bp, Homo sapiens; identical to SEQ ID NO: 37264
  chr19:13617489-13617532
  hyper

SEQ ID NO: 57880 - DNA, 234 bp, Homo sapiens; identical to SEQ ID NO: 37265
  chr19:13617846-13618080
  hyper

SEQ ID NO: 57881 - DNA, 132 bp, Homo sapiens
  chr19:13618381-13618513
  hyper
agagaggggagcgtcgcatggttgggaggcagggaggggggaattggggtgcttcctcctcccctgggaggaaagcctgttttccaccccgttccatttcggttgcagacagccggacgctccccagcatct

SEQ ID NO: 57882 - DNA, 365 bp, Homo sapiens; identical to SEQ ID NO: 37267
  chr19:14320287-14320652
  hyper

SEQ ID NO: 57883 - DNA, 334 bp, Homo sapiens; identical to SEQ ID NO: 37268
  chr19:14583182-14583516
  hyper

SEQ ID NO: 57884 - DNA, 107 bp, Homo sapiens; identical to SEQ ID NO: 13230
  chr19:14583613-14583720
  hyper

SEQ ID NO: 57885 - DNA, 82 bp, Homo sapiens
  chr19:14584775-14584857
  hyper
gaagaccatgcagccgcccaggaagtggcaggccccgccggccggagcgcgccccgcagtgtacagacgcagcaccagcgcg

SEQ ID NO: 57886 - DNA, 186 bp, Homo sapiens; identical to SEQ ID NO: 37272
  chr19:14667548-14667734
  hyper

SEQ ID NO: 57887 - DNA, 47 bp, Homo sapiens; identical to SEQ ID NO: 37273
  chr19:14886822-14886869
  hyper

SEQ ID NO: 57888 - DNA, 111 bp, Homo sapiens
  chr19:15090061-15090172
  hyper
ggggaggtggggagacgggcagggagacccggggataactaaggggataggaaactcaccagaacgaccaggagaaaagcggtggcaacggctctaaggggcaagcaggag

SEQ ID NO: 57889 - DNA, 230 bp, Homo sapiens
  chr19:15090499-15090729
  hyper
ctatgctgcgggagggatccgggccggccctgcgctcacgtgggtgtgggggcaccgagcggccgggggagggggcgggatcccctccgcgatgccctccgcctcccccgcgcccagcccaggctccgcagccgtgtgggagaagggggacagcgtgcttgcgaagggagggggactgggggtgggcgggggtgagtggcctctccggcatccagcccccgccccctgct

SEQ ID NO: 57890 - DNA, 1 bp, Homo sapiens
  chr19:15090745-15090746
  hyper
c

SEQ ID NO: 57891 - DNA, 120 bp, Homo sapiens; identical to SEQ ID NO: 37276
  chr19:15090747-15090867
  hyper

SEQ ID NO: 57892 - DNA, 44 bp, Homo sapiens
  chr19:15121641-15121685
  hyper
gcgtgttggtacccccggctgagcgcagccaggacacacgcgtt

SEQ ID NO: 57893 - DNA, 86 bp, Homo sapiens
  chr19:15121894-15121980
  hyper
gccgccgccaggcgagggcgtcacgctgtggaagggcaagatgaagccgcccgcctggtacgcccgcctgccgctacccttgcacc

SEQ ID NO: 57894 - DNA, 295 bp, Homo sapiens; identical to SEQ ID NO: 37278
  chr19:15217958-15218253
  hyper

SEQ ID NO: 57895 - DNA, 215 bp, Homo sapiens
  chr19:15288218-15288433
  hyper
gcacagagaaacagacggggcaagtggatgggcaggtggaaagagaggcagggcccacggacaaacagactgggatggatgcatagacagacggatcgatcgggtggatgggctcacttgcaagtgcgctcgcggccaccggcgtggcagtcgaagttgtcgtagaggcaggcgggcgagctgcaggcggggtcgcagcggctgttgttgaagag

SEQ ID NO: 57896 - DNA, 45 bp, Homo sapiens
  chr19:15288856-15288901
  hyper
ccggcaggagcgcgccacccgctcgcaacgcggaccccagaacgg

SEQ ID NO: 57897 - DNA, 164 bp, Homo sapiens; identical to SEQ ID NO: 37280
  chr19:15333656-15333820
  hyper

SEQ ID NO: 57898 - DNA, 120 bp, Homo sapiens; identical to SEQ ID NO: 37281
  chr19:15334731-15334851
  hyper

SEQ ID NO: 57899 - DNA, 147 bp, Homo sapiens; identical to SEQ ID NO: 22921
  chr19:15342587-15342734
  hyper

SEQ ID NO: 57900 - DNA, 178 bp, Homo sapiens
  chr19:15343929-15344107
  hyper
gggccaatgagctgacggtaggccggggagggggcggtggggtggggtgggcaatgggcaatgagacggagggcggggccgggacctaatatggcgggtcaggagggtctggaagacgaagaagagggacaggcaatgccaggtctaggactaggagggaggcgcgggcggtattagc

SEQ ID NO: 57901 - DNA, 208 bp, Homo sapiens; identical to SEQ ID NO: 13242
  chr19:15619208-15619416
  hyper

SEQ ID NO: 57902 - DNA, 300 bp, Homo sapiens; identical to SEQ ID NO: 37285
  chr19:15695292-15695592
  hyper

SEQ ID NO: 57903 - DNA, 131 bp, Homo sapiens; identical to SEQ ID NO: 22925
  chr19:17007662-17007793
  hyper

SEQ ID NO: 57904 - DNA, 100 bp, Homo sapiens; identical to SEQ ID NO: 37288
  chr19:17008419-17008519
  hyper

SEQ ID NO: 57905 - DNA, 296 bp, Homo sapiens; identical to SEQ ID NO: 37290
  chr19:17137063-17137359
  hyper

SEQ ID NO: 57906 - DNA, 65 bp, Homo sapiens; identical to SEQ ID NO: 37291
  chr19:17137395-17137460
  hyper

SEQ ID NO: 57907 - DNA, 139 bp, Homo sapiens
  chr19:17392502-17392641
  hyper
cagaccctgcttgagcgcctccgggtgtcaagggcccctgaggacactaaagctctcgaaccccgatgtggacccccgtgcggcgcggggcagcctggctgggaaccctgctcggccctggagaggggccccccgagcc

SEQ ID NO: 57908 - DNA, 222 bp, Homo sapiens
  chr19:17392866-17393088
  hyper
gcagtagaggagctgctgcgctgcggcgcggaccctaatttggtgctagaggacggcgcagcggctgtgcacttggcggccggagcccggcacccgcgcggcctgcgttgcctcggggccctactgcgccaaggcggggaccccaacgctcggtaagatagagcctgggtccggggcggggtctccccaagccgaagtctgggaatccgggaaggggcgccc

SEQ ID NO: 57909 - DNA, 490 bp, Homo sapiens; identical to SEQ ID NO: 37293
  chr19:17501171-17501661
  hyper

SEQ ID NO: 57910 - DNA, 129 bp, Homo sapiens; identical to SEQ ID NO: 37294
  chr19:17559138-17559267
  hyper

SEQ ID NO: 57911 - DNA, 499 bp, Homo sapiens
  chr19:17716787-17717286
  hyper
ccaaggcgcaagccccgtccctccccgcccagcgccctccgcgcaggcgcagtgccgctcggccgaccgcccgcgctaaggcgcaggcgcggcaccgccctcctcggcggagcgcgtgtccgacttgagcttcacgaactccttggccacctcgtcgttgctgcgctgcgagaggattcgcagcaccgtgaggcccgtgtcgtccatgtggatgcggcggccgagcggcagccagcaggcggcgctcccgcgctgggccagctcacgcagctgcagcacggccagccccaccgtgcggtcctcgcgcgcgaagcagtagtccttgacgcacacctgcagctcatagcactcgggacccgcgtcggcgctcagcgtgctgcgtggggaggggcggaacgtgagacaggccacacctactgtgatgccccgcccacggccccgtccccaccgcatttgcgggccacgcccacaccggggtgcccacacctgtcacctccca

SEQ ID NO: 57912 - DNA, 209 bp, Homo sapiens
  chr19:17717315-17717524
  hyper
acttgacctacaaccctgtgcttggccgcgcccacagcagctgaccccgagctgggccacgcccacgcctgttcttcccatttttccacccaccgaaaaatgaccgcatagttttacatccagctcccgcccctcagacaccgccctgcaaggccatgctcccaccctgagatacccgcgcctgtgccctctgccggctgaactgctgc

SEQ ID NO: 57913 - DNA, 156 bp, Homo sapiens
  chr19:17791026-17791182
  hyper
tctccctgtcttccccggtcagtaaatggtccctgagtcaccgtcttcgtcgtcacatcccgccacctccccgcctgcgccgggttgctgtatcagggtcagcggggcggaagcgccacccttccccagcgggcttcgggtcacacgcatgaggct

SEQ ID NO: 57914 - DNA, 192 bp, Homo sapiens
  chr19:17791211-17791403
  hyper
ggaggcgcgccggcggacaggggggcggggatgaggggggtgcccactgctgtccccagcgacgagcgggtgaagacaccgcgtcatgcggcctcaaaggtctttggggcccccagaagcgctgactgatgaatgtagtggccgtacccggggaggctgaggcaggagttcaggctgcgggacacccctgca

SEQ ID NO: 57915 - DNA, 37 bp, Homo sapiens; identical to SEQ ID NO: 37297
  chr19:17798697-17798734
  hyper

SEQ ID NO: 57916 - DNA, 92 bp, Homo sapiens; identical to SEQ ID NO: 37298
  chr19:17798977-17799069
  hyper

SEQ ID NO: 57917 - DNA, 52 bp, Homo sapiens; identical to SEQ ID NO: 37299
  chr19:17906008-17906060
  hyper

SEQ ID NO: 57918 - DNA, 6 bp, Homo sapiens
  chr19:17958484-17958490
  hyper
caaccc

SEQ ID NO: 57919 - DNA, 149 bp, Homo sapiens; identical to SEQ ID NO: 13255
  chr19:17983002-17983151
  hyper

SEQ ID NO: 57920 - DNA, 132 bp, Homo sapiens
  chr19:17983405-17983537
  hyper
gccagcttctgaactcggtcctcaccgccctgctcttcatgcccgtcttctaccgcctgggcctcaccagcacctacgaggtaccggacagaggcccgggggtaggacctgccccactggcagtgctgggac

SEQ ID NO: 57921 - DNA, 285 bp, Homo sapiens; identical to SEQ ID NO: 37303
  chr19:17984627-17984912
  hyper

SEQ ID NO: 57922 - DNA, 40 bp, Homo sapiens; identical to SEQ ID NO: 37304
  chr19:18062522-18062562
  hyper

SEQ ID NO: 57923 - DNA, 188 bp, Homo sapiens; identical to SEQ ID NO: 37305
  chr19:18077737-18077925
  hyper

SEQ ID NO: 57924 - DNA, 136 bp, Homo sapiens; identical to SEQ ID NO: 37306
  chr19:18078136-18078272
  hyper

SEQ ID NO: 57925 - DNA, 30 bp, Homo sapiens; identical to SEQ ID NO: 37307
  chr19:18336422-18336452
  hyper

SEQ ID NO: 57926 - DNA, 30 bp, Homo sapiens; identical to SEQ ID NO: 37308
  chr19:18336877-18336907
  hyper

SEQ ID NO: 57927 - DNA, 241 bp, Homo sapiens; identical to SEQ ID NO: 22937
  chr19:18343569-18343810
  hyper

SEQ ID NO: 57928 - DNA, 42 bp, Homo sapiens; identical to SEQ ID NO: 22938
  chr19:18343879-18343921
  hyper

SEQ ID NO: 57929 - DNA, 45 bp, Homo sapiens
  chr19:18714507-18714552
  hyper
gaggtggggtggacacggttcttgggccggccctgatgattttcc

SEQ ID NO: 57930 - DNA, 35 bp, Homo sapiens; identical to SEQ ID NO: 37312
  chr19:18715047-18715082
  hyper

SEQ ID NO: 57931 - DNA, 78 bp, Homo sapiens; identical to SEQ ID NO: 37313
  chr19:18716735-18716813
  hyper

SEQ ID NO: 57932 - DNA, 206 bp, Homo sapiens; identical to SEQ ID NO: 37314
  chr19:18718176-18718382
  hyper

SEQ ID NO: 57933 - DNA, 123 bp, Homo sapiens; identical to SEQ ID NO: 37315
  chr19:18723837-18723960
  hyper

SEQ ID NO: 57934 - DNA, 20 bp, Homo sapiens
  chr19:18898213-18898233
  hyper
aaaccagccaagccccgccc

SEQ ID NO: 57935 - DNA, 112 bp, Homo sapiens; identical to SEQ ID NO: 13264
  chr19:18899103-18899215
  hyper

SEQ ID NO: 57936 - DNA, 267 bp, Homo sapiens; identical to SEQ ID NO: 37319
  chr19:18900266-18900533
  hyper

SEQ ID NO: 57937 - DNA, 146 bp, Homo sapiens; identical to SEQ ID NO: 37320
  chr19:18900756-18900902
  hyper

SEQ ID NO: 57938 - DNA, 510 bp, Homo sapiens
  chr19:18901318-18901828
  hyper
tgtgtctctgtctcccgtctcttctctctcccgaccgccccgccgcgctcaccgcacgcgtcacactccatcaccgtgtttttcaggaacgtgatctccctgacctgcaggggtgggatggaatcagcggggtcccaacctctcctcatccctcgggtctcccctctctctaccccggggtccctttctacagcctcttttcgccaaggactccctacccgccgacccccttccctccccatctcctctccaccttctcgggtacttcctctctcctcgctgggaactgagacccccttccgttccctggcactccctgccccgcacccgggccccgcacctgctgccgcagcagctcccgcacgtcctgcagcgccgcgttggtttcctgcagttcccgaagcatctgcgggcccaggtctgagcctgcggcggcaggggacctggtgaggcgtcatggggccggggaatcccaccaccaactcccaccgttgcagcgaacccggacct

SEQ ID NO: 57939 - DNA, 178 bp, Homo sapiens
  chr19:18902095-18902273
  hyper
gggtggctgctcgctttctaccgcccacgaggcccgcggggcctatttatccccaaggcacggccggccccagggacggcccaccacagccctgcccaacgtccagcctcaaggtaaacagatggcgctggcccctgcgttcaagtccccgcccggaatgccccgcgaagtcgcccgc

SEQ ID NO: 57940 - DNA, 4 bp, Homo sapiens
  chr19:18980714-18980718
  hyper
tccc

SEQ ID NO: 57941 - DNA, 30 bp, Homo sapiens; identical to SEQ ID NO: 37323
  chr19:18981207-18981237
  hyper

SEQ ID NO: 57942 - DNA, 294 bp, Homo sapiens; identical to SEQ ID NO: 37324
  chr19:19006016-19006310
  hyper

SEQ ID NO: 57943 - DNA, 572 bp, Homo sapiens; identical to SEQ ID NO: 37325
  chr19:19006592-19007164
  hyper

SEQ ID NO: 57944 - DNA, 269 bp, Homo sapiens; identical to SEQ ID NO: 37326
  chr19:19322660-19322929
  hyper

SEQ ID NO: 57945 - DNA, 73 bp, Homo sapiens; identical to SEQ ID NO: 37327
  chr19:19373696-19373769
  hyper

SEQ ID NO: 57946 - DNA, 35 bp, Homo sapiens; identical to SEQ ID NO: 37328
  chr19:19383770-19383805
  hyper

SEQ ID NO: 57947 - DNA, 309 bp, Homo sapiens; identical to SEQ ID NO: 37329
  chr19:19649094-19649403
  hyper

SEQ ID NO: 57948 - DNA, 347 bp, Homo sapiens; identical to SEQ ID NO: 37330
  chr19:19651135-19651482
  hyper

SEQ ID NO: 57949 - DNA, 336 bp, Homo sapiens; identical to SEQ ID NO: 4606
  chr19:19651512-19651848
  hyper

SEQ ID NO: 57950 - DNA, 438 bp, Homo sapiens; identical to SEQ ID NO: 37333
  chr19:19843591-19844029
  hyper

SEQ ID NO: 57951 - DNA, 209 bp, Homo sapiens; identical to SEQ ID NO: 37334
  chr19:19932203-19932412
  hyper

SEQ ID NO: 57952 - DNA, 120 bp, Homo sapiens; identical to SEQ ID NO: 37335
  chr19:19932472-19932592
  hyper

SEQ ID NO: 57953 - DNA, 28 bp, Homo sapiens
  chr19:19932652-19932680
  hyper
atgcttgaggccccgccccctcaggtcc

SEQ ID NO: 57954 - DNA, 7 bp, Homo sapiens
  chr19:20011714-20011721
  hyper
ccggacc

SEQ ID NO: 57955 - DNA, 74 bp, Homo sapiens; identical to SEQ ID NO: 37338
  chr19:20011722-20011796
  hyper

SEQ ID NO: 57956 - DNA, 7 bp, Homo sapiens
  chr19:20012149-20012156
  hyper
gcacccg

SEQ ID NO: 57957 - DNA, 723 bp, Homo sapiens; identical to SEQ ID NO: 37340
  chr19:20149645-20150368
  hyper

SEQ ID NO: 57958 - DNA, 251 bp, Homo sapiens; identical to SEQ ID NO: 37341
  chr19:20162654-20162905
  hyper

SEQ ID NO: 57959 - DNA, 388 bp, Homo sapiens; identical to SEQ ID NO: 13278
  chr19:20162906-20163294
  hyper

SEQ ID NO: 57960 - DNA, 132 bp, Homo sapiens
  chr19:20188872-20189004
  hyper
agcctctgtggccctgtgacctgcaggtattgggagatccacagctgagggacccccggaagcctagaaatggtgagagtgcctttccagcattccgagagaggggagggactggttggaaccgatgggaag

SEQ ID NO: 57961 - DNA, 19 bp, Homo sapiens
  chr19:20189438-20189457
  hyper
aagacgcaacttcctggtc

SEQ ID NO: 57962 - DNA, 11 bp, Homo sapiens
  chr19:21769289-21769300
  hyper
cggcacctgga

SEQ ID NO: 57963 - DNA, 21 bp, Homo sapiens
  chr19:21769579-21769600
  hyper
cgcctgcgtgggactccaggg

SEQ ID NO: 57964 - DNA, 89 bp, Homo sapiens
  chr19:22018434-22018523
  hyper
gcgtgacccaccgcgcccggccgactctcctgtttctaatagaccaaaagagggactagaaatgccacggaccaaagctcttcctattc

SEQ ID NO: 57965 - DNA, 44 bp, Homo sapiens; identical to SEQ ID NO: 37349
  chr19:22018914-22018958
  hyper

SEQ ID NO: 57966 - DNA, 218 bp, Homo sapiens; identical to SEQ ID NO: 37350
  chr19:22018959-22019177
  hyper

SEQ ID NO: 57967 - DNA, 225 bp, Homo sapiens; identical to SEQ ID NO: 22961
  chr19:22034813-22035038
  hyper

SEQ ID NO: 57968 - DNA, 80 bp, Homo sapiens
  chr19:22610555-22610635
  hyper
gccaggagtctggagcgcaggtgccgggcaggcagcactgggagcgctcggcgacttggctggaggccgaaggtgccgcc

SEQ ID NO: 57969 - DNA, 194 bp, Homo sapiens
  chr19:22715443-22715637
  hyper
tgagcaggcaattgctgccccgcccactctgggaagaggggcggggccgcccgctccagagggacggaagcggcggggccgccggatccagggacaatggggtggggcgggctttccctgggtgggcgcagcggcttcctgggtccccctcacgctctgggtcagagttcctttacaggcggacctgagaggca

SEQ ID NO: 57970 - DNA, 60 bp, Homo sapiens; identical to SEQ ID NO: 37356
  chr19:22715898-22715958
  hyper

SEQ ID NO: 57971 - DNA, 56 bp, Homo sapiens; identical to SEQ ID NO: 37357
  chr19:22806000-22806056
  hyper

SEQ ID NO: 57972 - DNA, 17 bp, Homo sapiens
  chr19:22806297-22806314
  hyper
cgcggggagcccagccc

SEQ ID NO: 57973 - DNA, 96 bp, Homo sapiens; identical to SEQ ID NO: 37359
  chr19:22817131-22817227
  hyper

SEQ ID NO: 57974 - DNA, 107 bp, Homo sapiens; identical to SEQ ID NO: 37360
  chr19:23253781-23253888
  hyper

SEQ ID NO: 57975 - DNA, 75 bp, Homo sapiens
  chr19:23254114-23254189
  hyper
cgactcacaagggacgcgccagagctctggtcccattgagacagttcagctgaaggctgcgggccttcccgagct

SEQ ID NO: 57976 - DNA, 39 bp, Homo sapiens
  chr19:23254219-23254258
  hyper
cctcggcagctgccgctggagctccggaggacaagagaa

SEQ ID NO: 57977 - DNA, 37 bp, Homo sapiens; identical to SEQ ID NO: 22966
  chr19:23258694-23258731
  hyper

SEQ ID NO: 57978 - DNA, 115 bp, Homo sapiens
  chr19:23299633-23299748
  hyper
ggaggaagtcctgcccgaaaaggctgcagcctacgctgtcactcttcattcagtccagcatctgatcacatctgtcactcagggcctgagggggcggggccttaaacgttatcca

SEQ ID NO: 57979 - DNA, 30 bp, Homo sapiens; identical to SEQ ID NO: 37366
  chr19:23300324-23300354
  hyper

SEQ ID NO: 57980 - DNA, 30 bp, Homo sapiens; identical to SEQ ID NO: 13295
  chr19:23386702-23386732
  hyper

SEQ ID NO: 57981 - DNA, 496 bp, Homo sapiens; identical to SEQ ID NO: 37368
  chr19:23598350-23598846
  hyper

SEQ ID NO: 57982 - DNA, 209 bp, Homo sapiens; identical to SEQ ID NO: 37369
  chr19:23654103-23654312
  hyper

SEQ ID NO: 57983 - DNA, 52 bp, Homo sapiens
  chr19:24154540-24154592
  hyper
agctctgcagttctccgccctgcctggaaaggaagcggccccgccaggtagt

SEQ ID NO: 57984 - DNA, 23 bp, Homo sapiens
  chr19:24154621-24154644
  hyper
cttggccccgagggggtgacatc

SEQ ID NO: 57985 - DNA, 48 bp, Homo sapiens
  chr19:29284404-29284452
  hyper
ccggccagccgctgtcgctgtcgccgccgcactcgcctgtccggacgc

SEQ ID NO: 57986 - DNA, 362 bp, Homo sapiens; identical to SEQ ID NO: 22973
  chr19:30015572-30015934
  hyper

SEQ ID NO: 57987 - DNA, 202 bp, Homo sapiens
  chr19:30016712-30016914
  hyper
gctgtactccaaccagaaagacggtggtccctccgagcgacccccgaggagagagggggagcgctctggggcgggggcggggcgggctgtggcaggagaggggagggcgggggcgatgcagcggtggaggcggcttggcgcccagccactgaccgccccctcccttcccctcccctccccctctccccgcctctctccggct

SEQ ID NO: 57988 - DNA, 131 bp, Homo sapiens
  chr19:30018608-30018739
  hyper
tgctgggtagtgaaggaagcccccttggtcccatcaggctctccccgccctctgccactttgaggaccccagggctcccacggctgcgttccagaggccaccagaaaaccgagtaccggaaagccggcagg

SEQ ID NO: 57989 - DNA, 32 bp, Homo sapiens; identical to SEQ ID NO: 22976
  chr19:30019113-30019145
  hyper

SEQ ID NO: 57990 - DNA, 93 bp, Homo sapiens
  chr19:30019838-30019931
  hyper
ggtgttgcaggcttgcaggggacggggtagggggtggttgtgccaggctgcgaggggcccgggtcatggggttgctaactctgggaggagatg

SEQ ID NO: 57991 - DNA, 100 bp, Homo sapiens
  chr19:30019993-30020093
  hyper
cggttcagaggtgagggctccctgggtgtttgttgagagccgtagagcagtacttcccgaagtccccaccggggcgcaggggaggagcacttcgctgggg

SEQ ID NO: 57992 - DNA, 133 bp, Homo sapiens
  chr19:30020473-30020606
  hyper
gtgggcgtttggttaacgtgatggggacgtggggacacagtccaaagagctggctgcctggcgtccacgcagagttggaagccctatgccactgggtagacgcgggtgaaagggaagccggatcgtgatggtg

SEQ ID NO: 57993 - DNA, 196 bp, Homo sapiens; identical to SEQ ID NO: 37381
  chr19:30020843-30021039
  hyper

SEQ ID NO: 57994 - DNA, 103 bp, Homo sapiens; identical to SEQ ID NO: 13308
  chr19:30021252-30021355
  hyper

SEQ ID NO: 57995 - DNA, 402 bp, Homo sapiens; identical to SEQ ID NO: 37383
  chr19:30215009-30215411
  hyper

SEQ ID NO: 57996 - DNA, 30 bp, Homo sapiens; identical to SEQ ID NO: 37384
  chr19:30334621-30334651
  hyper

SEQ ID NO: 57997 - DNA, 69 bp, Homo sapiens
  chr19:30713411-30713480
  hyper
gccgggaggtctccccggggacccccactcagcttgctcaggtcctggaggcatgcagagggcgtcggc

SEQ ID NO: 57998 - DNA, 203 bp, Homo sapiens
  chr19:30713706-30713909
  hyper
cctccaggcctggaaggggctcccctggcctggaggccatgggcccggcccagaccggccagacaccgccagggacccccagaacgacgccaggacgcgcgccgggctccgtgcctcccacggcccaggcgaggccggcggctcgagggttaaaaggcgacccccattctgtaggggagaaagtgccttttctccaagtccat

SEQ ID NO: 57999 - DNA, 223 bp, Homo sapiens
  chr19:30714433-30714656
  hyper
gcagggtccgaggatgctggcagcggcaaggcccggtgcccgccgacggcgcgcctggggagaggaccaccggcggtgagggcccaggcccagcgcccagggcagctgcgacgcgtccgtctccaacgccggcacgctaacccagcgctcctcccagcgcaaagttttctgtgtctctcccctcactcttggactggttgcttgccaccgaatgactccttca

SEQ ID NO: 58000 - DNA, 114 bp, Homo sapiens
  chr19:30715288-30715402
  hyper
tttgcccagaggacccgccttgcaaagttgccttaaaaaagttattttgtttgataattaagtcctggagcccatcgcatgatgattattctacacccataaggcagagaacct

SEQ ID NO: 58001 - DNA, 103 bp, Homo sapiens; identical to SEQ ID NO: 22983
  chr19:30715766-30715869
  hyper

SEQ ID NO: 58002 - DNA, 97 bp, Homo sapiens
  chr19:30716216-30716313
  hyper
ggcgacaatggagagcgtttttaatggtacaatgcatttcacctaccagatagggggaggccgagccggggatggggatgtctgctggggctgggtg

SEQ ID NO: 58003 - DNA, 194 bp, Homo sapiens; identical to SEQ ID NO: 22984
  chr19:30716576-30716770
  hyper

SEQ ID NO: 58004 - DNA, 698 bp, Homo sapiens
  chr19:30718149-30718847
  hyper
tggggacaggtggaaagttaagtcccccccttttcacttctgtattgtgagtggttcctactgtgtgcctgttggagaacatgtccaccgttcccgagttaggtggaggattggaatgttggggggcggggagcgttggagttgaggacgcagtggccaggggctgggggccgagaaagagcagggcggggtctcagccccgcgtgcgggtggcagcggcggccgggttttgtttgccagatattgttatgtctaacgggtgcctcgccggagacgtgatttgtcagccgccttcgttttcactttagcagaaaatacggcagctgcgaggtgtcccggcctgcggggctcgggcacccggtgcgtcctgggggctgggtcgtgtgcgcgggtgggagccggcggccggcggggccggggcgaggggcgagcgggaggggcggagtgagcgagcgcgcggtacggccctccggttcctcctgcgccttctcccggcagccgccgccgccgccgccgccgctgtgcaatttagcagaaatccgacaggggccgcgtttgctgagcgcatccggcggccgggcagcccgagcgggccgccgggcctggtcggccggtgtagaggcgcggagggggccggcggaggggaccggcggggatgggcgcgggaagcacgcctgaccagagcacgcgccgttccc

SEQ ID NO: 58005 - DNA, 18 bp, Homo sapiens
  chr19:30718913-30718931
  hyper
ccagggcttaggtgaact

SEQ ID NO: 58006 - DNA, 29 bp, Homo sapiens
  chr19:30718991-30719020
  hyper
ggtgagactgggaacgcgctgttttcttt

SEQ ID NO: 58007 - DNA, 213 bp, Homo sapiens
  chr19:30719236-30719449
  hyper
tggggacagggcccccgcccccgccggggtcgggtttgatggtgaaatagtaaacccacgcacggagggtcgccaggaaagtggacattaccgctttaattaacttcgagatgctccggcggcgggacctggcgtagccgtgacgcgcccccataaatctgcccggcccggggctgctccgagaactcgtacagtagcggcgtcagatccatc

SEQ ID NO: 58008 - DNA, 254 bp, Homo sapiens
  chr19:30865459-30865713
  hyper
cgccctgaagaaaggcgccttggcaccgcctcggtgcccaccagaaggtgcccggattgcctcttttgcgcaaagacaaagggggtaattttttggcaagaaaacaaacccaaggaaaacacaacaaactgagtgttgtttttttttctttccctcctgcaacttctcggaccgtctctgccctctctcctccagagagggcgagtttcatcctggagggaggccgggggagctgcgaggccacccccagccgg

SEQ ID NO: 58009 - DNA, 51 bp, Homo sapiens; identical to SEQ ID NO: 37395
  chr19:30866452-30866503
  hyper

SEQ ID NO: 58010 - DNA, 55 bp, Homo sapiens; identical to SEQ ID NO: 22988
  chr19:31839873-31839928
  hyper

SEQ ID NO: 58011 - DNA, 1236 bp, Homo sapiens; identical to SEQ ID NO: 37397
  chr19:31839941-31841177
  hyper

SEQ ID NO: 58012 - DNA, 59 bp, Homo sapiens; identical to SEQ ID NO: 37398
  chr19:31841442-31841501
  hyper

SEQ ID NO: 58013 - DNA, 92 bp, Homo sapiens; identical to SEQ ID NO: 22993
  chr19:31842389-31842481
  hyper

SEQ ID NO: 58014 - DNA, 30 bp, Homo sapiens; identical to SEQ ID NO: 37401
  chr19:31842828-31842858
  hyper

SEQ ID NO: 58015 - DNA, 78 bp, Homo sapiens; identical to SEQ ID NO: 22994
  chr19:32715595-32715673
  hyper

SEQ ID NO: 58016 - DNA, 26 bp, Homo sapiens
  chr19:32715741-32715767
  hyper
gctctcccgcccgctcgctgcccgcc

SEQ ID NO: 58017 - DNA, 43 bp, Homo sapiens; identical to SEQ ID NO: 37403
  chr19:33166926-33166969
  hyper

SEQ ID NO: 58018 - DNA, 128 bp, Homo sapiens; identical to SEQ ID NO: 22995
  chr19:33166988-33167116
  hyper

SEQ ID NO: 58019 - DNA, 30 bp, Homo sapiens; identical to SEQ ID NO: 37405
  chr19:33167843-33167873
  hyper

SEQ ID NO: 58020 - DNA, 42 bp, Homo sapiens; identical to SEQ ID NO: 37406
  chr19:33685611-33685653
  hyper

SEQ ID NO: 58021 - DNA, 80 bp, Homo sapiens; identical to SEQ ID NO: 37407
  chr19:33716537-33716617
  hyper

SEQ ID NO: 58022 - DNA, 58 bp, Homo sapiens; identical to SEQ ID NO: 37408
  chr19:33717533-33717591
  hyper

SEQ ID NO: 58023 - DNA, 37 bp, Homo sapiens; identical to SEQ ID NO: 37409
  chr19:33717859-33717896
  hyper

SEQ ID NO: 58024 - DNA, 57 bp, Homo sapiens
  chr19:33792524-33792581
  hyper
tcgcgcggaggtcggggtgcgcggcgcccagccccttgagcgcgctgccagggcccg

SEQ ID NO: 58025 - DNA, 225 bp, Homo sapiens
  chr19:33794450-33794675
  hyper
cgagggtgtccaggccgccgggctgccaggtccgagcacgcacagggagaactctgcccagtggttcgccgggcgctgtagtccccgggatcctagggaccgaggcggccaggccctggggccccttgagtgcggcagctaatgctctcaccgcggcgggggaaggagcttgccaccgagacccccagccacgtgcgtccctcgcattctttaccggggccgggg

SEQ ID NO: 58026 - DNA, 15 bp, Homo sapiens
  chr19:34112272-34112287
  hyper
atggatgcggacacc

SEQ ID NO: 58027 - DNA, 198 bp, Homo sapiens
  chr19:34112326-34112524
  hyper
cgagctgaagcccagggatatcccagaatcttcctcaggatcaatcttccgcctttcaccggccctgcgcccccgcagcatcgggtcctgggcgcgcgcccctgccccgctgtggtcaaggcccgccccggtgacgcctggtccttttcccgggttggcgccgcgtgcgacccaccgaggcagtggcagcactggccg

SEQ ID NO: 58028 - DNA, 82 bp, Homo sapiens; identical to SEQ ID NO: 37414
  chr19:34113221-34113303
  hyper

SEQ ID NO: 58029 - DNA, 419 bp, Homo sapiens
  chr19:34113587-34114006
  hyper
agcgctcggggcgctggggcttcctggcgcgctcggagccggggctccggacgggttgcggcgggcagagactatgggggaagtttaagtggccttggcttcctacccagcggctccgtcgcgcgcgtccccgacccgcaactctccagggcaccggcctgtgagtgctggaggcgagtgtgcgtgcgtcagcgatggtgtgaaggtgtgtgcgtgcgtgtgtcgggagtgcgggagtcggagcctggggcggctccagggggcggggaaatgatccgtttggccgcgggaccgagccgagctctgacggcggctgcaactccggctaccgactctgcagacccgctctggcctcgctggaggccagccgggccaggagggcgatcacgggttttggcagtgcccgatgctggggcttg

SEQ ID NO: 58030 - DNA, 17 bp, Homo sapiens
  chr19:34114286-34114303
  hyper
cgcgtcccggcccctct

SEQ ID NO: 58031 - DNA, 73 bp, Homo sapiens; identical to SEQ ID NO: 37418
  chr19:34175192-34175265
  hyper

SEQ ID NO: 58032 - DNA, 75 bp, Homo sapiens; identical to SEQ ID NO: 37419
  chr19:34175542-34175617
  hyper

SEQ ID NO: 58033 - DNA, 114 bp, Homo sapiens; identical to SEQ ID NO: 37420
  chr19:34288561-34288675
  hyper

SEQ ID NO: 58034 - DNA, 32 bp, Homo sapiens; identical to SEQ ID NO: 37421
  chr19:34311466-34311498
  hyper

SEQ ID NO: 58035 - DNA, 79 bp, Homo sapiens; identical to SEQ ID NO: 37422
  chr19:34396820-34396899
  hyper

SEQ ID NO: 58036 - DNA, 30 bp, Homo sapiens; identical to SEQ ID NO: 37423
  chr19:34972190-34972220
  hyper

SEQ ID NO: 58037 - DNA, 126 bp, Homo sapiens; identical to SEQ ID NO: 37424
  chr19:34972522-34972648
  hyper

SEQ ID NO: 58038 - DNA, 449 bp, Homo sapiens; identical to SEQ ID NO: 37425
  chr19:34972675-34973124
  hyper

SEQ ID NO: 58039 - DNA, 202 bp, Homo sapiens
  chr19:34973255-34973457
  hyper
cggacccgcgtcccggtcccgggccgccttcggtgggcagcgcccgctccagcgtttccagcctcggctcccggggctcggccggcgcctacgctgacttcctcccgcccggcgcctgccccgcgcccgctcgctccccggagcctgcggggccggctcccttcccgctgcctgcactcccgctgccccctggccgggaggg

SEQ ID NO: 58040 - DNA, 91 bp, Homo sapiens; identical to SEQ ID NO: 37427
  chr19:34973553-34973644
  hyper

SEQ ID NO: 58041 - DNA, 11 bp, Homo sapiens
  chr19:34973645-34973656
  hyper
gggctggctgg

SEQ ID NO: 58042 - DNA, 69 bp, Homo sapiens
  chr19:34973697-34973766
  hyper
ccctggggactggggagcgcaaagggtgagtgagtgcgcctggatccccagcagcggcttcacccctgc

SEQ ID NO: 58043 - DNA, 255 bp, Homo sapiens; identical to SEQ ID NO: 37429
  chr19:35068601-35068856
  hyper

SEQ ID NO: 58044 - DNA, 30 bp, Homo sapiens; identical to SEQ ID NO: 37430
  chr19:35168907-35168937
  hyper

SEQ ID NO: 58045 - DNA, 377 bp, Homo sapiens; identical to SEQ ID NO: 37431
  chr19:35263586-35263963
  hyper

SEQ ID NO: 58046 - DNA, 26 bp, Homo sapiens
  chr19:35395923-35395949
  hyper
cccagctgcaagggccggcgcaccca

SEQ ID NO: 58047 - DNA, 96 bp, Homo sapiens
  chr19:35396370-35396466
  hyper
cctagctagacaagtgcttctcacgatccagcgcgtttaccgctcggtttcgtcgccgctaaggggtggtggtgtctgatccgtcaggctctgcgc

SEQ ID NO: 58048 - DNA, 30 bp, Homo sapiens; identical to SEQ ID NO: 37434
  chr19:35503957-35503987
  hyper

SEQ ID NO: 58049 - DNA, 126 bp, Homo sapiens; identical to SEQ ID NO: 13334
  chr19:35531737-35531863
  hyper

SEQ ID NO: 58050 - DNA, 121 bp, Homo sapiens; identical to SEQ ID NO: 37436
  chr19:36024853-36024974
  hyper

SEQ ID NO: 58051 - DNA, 15 bp, Homo sapiens
  chr19:36048580-36048595
  hyper
ccaggctgaggtagg

SEQ ID NO: 58052 - DNA, 539 bp, Homo sapiens
  chr19:36048771-36049310
  hyper
aggctgtggacgggggaacggggcggggctgtggacgagggaacggggcggggctgaggagaggggcggggccgagagctcggtgcgggctctgagagctgcggggaagggtgaaggtggaagatggaggccttgtgtggaggggtccttggtagaaggtaagcgttaaggcggggctaggtgcagatttggagtcctggacgcagggaatgaacagaattagggtgcggagttgggctgggggcggatttggagagcgaggtgctccccatggacagtcccgccgaggagaagctgtgggcggggctgggtggtgggcggggccttgcctctggtggacggggccataggcggagcgggagatggggtggggtttggctgcggagagaaggggcaaggagcgaagcccctcgtggcccgctgatgtgggtgtggcctggggcggggcccgaggtgggcgggcccaggccgtgggcggggccggctgcgcacctggaacttgttggtggagttgaagggtatctcgcagacttttggga

SEQ ID NO: 58053 - DNA, 57 bp, Homo sapiens; identical to SEQ ID NO: 23006
  chr19:36335147-36335204
  hyper

SEQ ID NO: 58054 - DNA, 96 bp, Homo sapiens; identical to SEQ ID NO: 37439
  chr19:36336604-36336700
  hyper

SEQ ID NO: 58055 - DNA, 102 bp, Homo sapiens; identical to SEQ ID NO: 37440
  chr19:36337017-36337119
  hyper

SEQ ID NO: 58056 - DNA, 83 bp, Homo sapiens
  chr19:36347809-36347892
  hyper
cccagagacccaggccgcggaactggcaggcgtttcagagcgtcagaggctgcggatgagcagacttggaggactccaggcca

SEQ ID NO: 58057 - DNA, 147 bp, Homo sapiens; identical to SEQ ID NO: 37442
  chr19:36351801-36351948
  hyper

SEQ ID NO: 58058 - DNA, 30 bp, Homo sapiens; identical to SEQ ID NO: 13340
  chr19:36361080-36361110
  hyper

SEQ ID NO: 58059 - DNA, 215 bp, Homo sapiens
  chr19:36449891-36450106
  hyper
tgtttccagggctgccgcttcatcacggctttctcggaaaacgggggcgctgagaagcccaacttccagctatatatgtcgccaccgcccacagggcccccgacggcgatgctggtgacagcgctccctgcgtgggcgccactctccccgtgctccccgcgcctgcagccaggcacgacggtgtgggtgtgcccgcccggggcagaggagctgca

SEQ ID NO: 58060 - DNA, 15 bp, Homo sapiens
  chr19:36450544-36450559
  hyper
cgccccagggtcgct

SEQ ID NO: 58061 - DNA, 420 bp, Homo sapiens
  chr19:36523480-36523900
  hyper
acctcccccaggcccagccccccattcttctcctcccgcgtcaggcccctcagtcgcggctgccccctccccgggtttgtttatctcgggattcaggatgcttcgcccctccccttctccgcgggccgccccctccccatcttacctcgggcagacagcgctggggaccaaagtggagactggggagactgtgggagcaatggggtgtcggtgtcaggggacgtgatgggggaggcaagggagacagagagaaggggacgaggcccagacgccgacagggggtgggggcggagagggaggggcgcgactgcgcatgcgcctgctgcccccctaccggcggcgggggaggagggaccaggaggagggaccgggaggcgctcgcattgatggaggggccagaggcggcgactgaaaggggag

SEQ ID NO: 58062 - DNA, 11 bp, Homo sapiens
  chr19:36736016-36736027
  hyper
agacccggcga

SEQ ID NO: 58063 - DNA, 5 bp, Homo sapiens
  chr19:36736314-36736319
  hyper
cgacg

SEQ ID NO: 58064 - DNA, 88 bp, Homo sapiens
  chr19:36736491-36736579
  hyper
gcttgagatgcagcctcccagcttcgaggctaccacctgcccgaattggtgctttggcagagtctctggtgcccgggtgaatgggttc

SEQ ID NO: 58065 - DNA, 82 bp, Homo sapiens; identical to SEQ ID NO: 23013
  chr19:36822242-36822324
  hyper

SEQ ID NO: 58066 - DNA, 18 bp, Homo sapiens
  chr19:36912332-36912350
  hyper
cccggcaccaggggacgc

SEQ ID NO: 58067 - DNA, 81 bp, Homo sapiens; identical to SEQ ID NO: 37454
  chr19:36912480-36912561
  hyper

SEQ ID NO: 58068 - DNA, 15 bp, Homo sapiens
  chr19:37096575-37096590
  hyper
cgcgcgggcgcgcgc

SEQ ID NO: 58069 - DNA, 629 bp, Homo sapiens; identical to SEQ ID NO: 37457
  chr19:37157547-37158176
  hyper

SEQ ID NO: 58070 - DNA, 187 bp, Homo sapiens
  chr19:37263345-37263532
  hyper
ggtactgcacagacacgcaaagtcacacacccaccccgggacacgcagtccaaccacacagtcaccggttcttcacatccgcacgcacaacgagggtcgtccaggacacacacacccactccgggcgcgcacagtcacaagcgcccacctgatcacccagagtcagcaccacacagccacagtcaca

SEQ ID NO: 58071 - DNA, 638 bp, Homo sapiens
  chr19:37263584-37264222
  hyper
tcagccctccacacacaaaaggaccggagccggattcctcaccctcagcattctctggttccgctcggggccagcctagccaagttcctcaggactccaaggcgcggcggcagctaaatcggcacagcaaacggtcccgccacctggctaagaggaagccaaaatctcgcgagacgtggcgtcggcctgcgggatcctctgggaaatgtagtccagagcccgactgcgggcttccctatgcctctcatttccaagcctggcttgtttccttttaccgctcctctccaacgaggatcgcagagccctcatgccgagcggctcgctatggggccggctcgcccgctagagtggtcaggcctgattatccctggcagctctgttatctggggtaagacacaggaaaacgtgcttccggttctcggcggaagtagccccgaacggtagaaccgatgggaaatgtagtccagggcagaaaagcggtcaacccagccacgatgcgagccaaaggattcttggctccaagcctggtcctggctgttagtttggaactcatgcacccagatgctaactcgccctcagaatgcagaggggatgaaacactgaccggacaattcaatctgtatatgggtgagtccagg

SEQ ID NO: 58072 - DNA, 32 bp, Homo sapiens; identical to SEQ ID NO: 37459
  chr19:37287904-37287936
  hyper

SEQ ID NO: 58073 - DNA, 42 bp, Homo sapiens
  chr19:37288765-37288807
  hyper
agccaggtgttctgttgcagaacgcctcgaagggagggagtg

SEQ ID NO: 58074 - DNA, 30 bp, Homo sapiens; identical to SEQ ID NO: 37463
  chr19:37328802-37328832
  hyper

SEQ ID NO: 58075 - DNA, 165 bp, Homo sapiens; identical to SEQ ID NO: 37464
  chr19:37329224-37329389
  hyper

SEQ ID NO: 58076 - DNA, 257 bp, Homo sapiens; identical to SEQ ID NO: 37465
  chr19:37340845-37341102
  hyper

SEQ ID NO: 58077 - DNA, 32 bp, Homo sapiens; identical to SEQ ID NO: 37466
  chr19:37341165-37341197
  hyper

SEQ ID NO: 58078 - DNA, 292 bp, Homo sapiens
  chr19:37341469-37341761
  hyper
tgctgaagtgctgttcgcaggctatggaggaggcctggccaagcaaaaagggctcagaggagcctgactaaagcttggtctagggactccttgtcaggtgagactcccggaaggctccgatgggcagctcacctcaaagagatagttttgttggtgccagagtccgcgccaggggaatcgggatggctgggctgtagctttcggcaacctgtcgctttctggactacacttcccagaagcctctaggcccagggcactctcccgcgataactagattgtctcttgaggagtg

SEQ ID NO: 58079 - DNA, 171 bp, Homo sapiens
  chr19:37341962-37342133
  hyper
tgtacggttgtgactgggggcgtgtgtctgtgcgaccgtgtatggaactgtgagggcggggaggaggactttttgtttatgtttgtgcgggtgtgagtagagtttaattgtgaccgggttgggcactgtgtttgcgagtgtgaggttcctggaccgcggttgtgactgtat

SEQ ID NO: 58080 - DNA, 362 bp, Homo sapiens
  chr19:37406765-37407127
  hyper
ctccacctttcaggccgctccgcccgcaggggcccaaggcgccagctccccatcggtcttcggtatcctcacctaagccctttccagtcatcccggatgggaacttgcagacctgagccagttctcctggggaccaaaatatctcacctcccagatctaagggtcccgccaggagtgacgaaacgttcgaattcctgcgagaaaagtggcaggccaccaggccctctgggaaatgtagtccagagcgggacccacgccgattcctgtcagctcctcgcctgggcccacccgaaacggctgctccctcaactctcaacatccagccgagcctcggagttgcgggtcgccgtagcgctgcgcaa

SEQ ID NO: 58081 - DNA, 147 bp, Homo sapiens
  chr19:37407443-37407590
  hyper
ccagagtgtcccgagtagcggcagtggggagtgctcagggtacgctaatggtgagtggttgcagttgatgggacaaaaaactgtgatgggagttagtgtgggtgtgtggttgtgtgtgtgagtgtgacggcacgaataatctgatgg

SEQ ID NO: 58082 - DNA, 42 bp, Homo sapiens
  chr19:37464696-37464738
  hyper
gaggcctgggagggggcgggacaccctcgctgtacattctgg

SEQ ID NO: 58083 - DNA, 865 bp, Homo sapiens; identical to SEQ ID NO: 37473
  chr19:37957671-37958536
  hyper

SEQ ID NO: 58084 - DNA, 15 bp, Homo sapiens
  chr19:37959786-37959801
  hyper
cctcccaattttttt

SEQ ID NO: 58085 - DNA, 542 bp, Homo sapiens; identical to SEQ ID NO: 23026
  chr19:37959963-37960505
  hyper

SEQ ID NO: 58086 - DNA, 30 bp, Homo sapiens; identical to SEQ ID NO: 37476
  chr19:37960799-37960829
  hyper

SEQ ID NO: 58087 - DNA, 107 bp, Homo sapiens; identical to SEQ ID NO: 37477
  chr19:37997089-37997196
  hyper

SEQ ID NO: 58088 - DNA, 137 bp, Homo sapiens
  chr19:38042693-38042830
  hyper
tctgtgtgtgtttctgtgcaagtgttgcatgtctgtgtgtgtggggggggtggtgtctggtgaaaagaatgtgtctcgtgcggtggagcgccgtttctctgtagtccgcgggctctcttatgcgccctcttgtggtc

SEQ ID NO: 58089 - DNA, 40 bp, Homo sapiens; identical to SEQ ID NO: 37481
  chr19:38086122-38086162
  hyper

SEQ ID NO: 58090 - DNA, 52 bp, Homo sapiens
  chr19:38146010-38146062
  hyper
cctcttgggccttttcgctacggccgagcctaagtggctgaagcgcggacga

SEQ ID NO: 58091 - DNA, 210 bp, Homo sapiens
  chr19:38146247-38146457
  hyper
ggcccactccgcgctcttttccctcagaaaagcagcggccacagtggcgcccggctcccagccccagcctcacccgactcagaggatagcccagccctgggagtcagcggcgccagaatacgggagagcgcctgtctccgtcgcgaatgcgctagcgcgcgggggggcggaggcaagtcccgcagctgctccgggccgggaggggcgcgt

SEQ ID NO: 58092 - DNA, 696 bp, Homo sapiens
  chr19:38146568-38147264
  hyper
ccattaaagataatccaggcctgctcccctgtggacactgcggtccaaaatttaaaaaaacaatattccgcctttttatttttcatttggttctcggctcggagacaggcggaggctgcgagccccgccccgcccccagcgacgcctcaccggaacctttggaaatcggcttctgcctcgagtgcgcaagcgcgcggggggcgaacgctggggcccttcagggagcaagggagaagtgtggggccgcacctgccgaggggtcgggaggtttggaggagggtggaggttggctacaggatcccgatggggatggagtgttcaaatctaggcctgtagccgtgaccctggcgtgagttggatggaggaaaccccagtatcgcgagcctggaccaaggcgcggcgcgtgctgcctgtggtgtttgctgagtgacggccgccgcgcccccgcgtacctggaccgagtgcctggccgctggcggagtagtgtttccgtgcacggggctgctgcgtgcgcgtgtgccgttctctagcgggggattaggatggtgccgcagagaaggctgcgcggtggtgcctgactctgacgctggctgtagcgggtctctggggtctttgcggtttgtgtctgcgtttgtgacgtacctgacatcggatctgtgactgtggctctgcctcatccagcgttatttccagaat

SEQ ID NO: 58093 - DNA, 69 bp, Homo sapiens
  chr19:38182815-38182884
  hyper
caggtgacgatccctcgcgggcactcactctcgctcacactacaatcagatcctccatgcggctttcat

SEQ ID NO: 58094 - DNA, 175 bp, Homo sapiens
  chr19:38183299-38183474
  hyper
ggacgcggtagcggagctgctcaaagcgaggtgctcagccctgggaggctcagggctgcccgaggggcttagtcccagagccagtgctgtcaggggctgagcatgtgaatagggcagtcggaagaccatgtgtgtctgtggcttttaaatacaccccgaacgtctatctctttta

SEQ ID NO: 58095 - DNA, 141 bp, Homo sapiens; identical to SEQ ID NO: 37487
  chr19:38210017-38210158
  hyper

SEQ ID NO: 58096 - DNA, 180 bp, Homo sapiens; identical to SEQ ID NO: 37488
  chr19:38210571-38210751
  hyper

SEQ ID NO: 58097 - DNA, 73 bp, Homo sapiens
  chr19:38308466-38308539
  hyper
gtaacctggatgtgcagtgcgtgtcctttgcaaagcgtgcgttgctgtggctccgtggcgtcagcaacccttc

SEQ ID NO: 58098 - DNA, 30 bp, Homo sapiens; identical to SEQ ID NO: 13381
  chr19:38701199-38701229
  hyper

SEQ ID NO: 58099 - DNA, 500 bp, Homo sapiens; identical to SEQ ID NO: 13382
  chr19:38701550-38702050
  hyper

SEQ ID NO: 58100 - DNA, 92 bp, Homo sapiens; identical to SEQ ID NO: 37493
  chr19:38718791-38718883
  hyper

SEQ ID NO: 58101 - DNA, 310 bp, Homo sapiens; identical to SEQ ID NO: 37494
  chr19:38746768-38747078
  hyper

SEQ ID NO: 58102 - DNA, 53 bp, Homo sapiens; identical to SEQ ID NO: 23035
  chr19:38747106-38747159
  hyper

SEQ ID NO: 58103 - DNA, 68 bp, Homo sapiens; identical to SEQ ID NO: 37497
  chr19:38853068-38853136
  hyper

SEQ ID NO: 58104 - DNA, 339 bp, Homo sapiens; identical to SEQ ID NO: 37498
  chr19:38877688-38878027
  hyper

SEQ ID NO: 58105 - DNA, 35 bp, Homo sapiens; identical to SEQ ID NO: 37499
  chr19:38879840-38879875
  hyper

SEQ ID NO: 58106 - DNA, 170 bp, Homo sapiens; identical to SEQ ID NO: 37500
  chr19:38924266-38924436
  hyper

SEQ ID NO: 58107 - DNA, 95 bp, Homo sapiens; identical to SEQ ID NO: 13388
  chr19:38924437-38924532
  hyper

SEQ ID NO: 58108 - DNA, 85 bp, Homo sapiens; identical to SEQ ID NO: 37502
  chr19:39282953-39283038
  hyper

SEQ ID NO: 58109 - DNA, 86 bp, Homo sapiens; identical to SEQ ID NO: 37503
  chr19:39283060-39283146
  hyper

SEQ ID NO: 58110 - DNA, 362 bp, Homo sapiens; identical to SEQ ID NO: 37504
  chr19:39466200-39466562
  hyper

SEQ ID NO: 58111 - DNA, 92 bp, Homo sapiens; identical to SEQ ID NO: 37505
  chr19:39522783-39522875
  hyper

SEQ ID NO: 58112 - DNA, 118 bp, Homo sapiens; identical to SEQ ID NO: 37506
  chr19:39589701-39589819
  hyper

SEQ ID NO: 58113 - DNA, 56 bp, Homo sapiens; identical to SEQ ID NO: 37507
  chr19:39687591-39687647
  hyper

SEQ ID NO: 58114 - DNA, 133 bp, Homo sapiens
  chr19:39687844-39687977
  hyper
gaggagtgggggccgctgagcgggggcctggagctgccccagcgcctcacctggaagctgctcctgttgcggcggccgctctaccgcaacctgctgcgctcgcccaaccccgaaggtgcgcaagggcccagag

SEQ ID NO: 58115 - DNA, 153 bp, Homo sapiens
  chr19:39755358-39755511
  hyper
agtcacaaaaggagccctgcagggcggactcggctccaggtcgcgggcgcagggctatgccgggggagagcgggatgcaattcaaccctggttcacgccttcggggagctccctggttcagtacacgacaggcacgaccgtacgctgccagta

SEQ ID NO: 58116 - DNA, 415 bp, Homo sapiens; identical to SEQ ID NO: 37511
  chr19:39989727-39990142
  hyper

SEQ ID NO: 58117 - DNA, 78 bp, Homo sapiens
  chr19:39993399-39993477
  hyper
gcatccatgttcggccgggcccaccccagcacccctcctttgcctgtcctcgcagggcccgcctggagcctgctggcg

SEQ ID NO: 58118 - DNA, 270 bp, Homo sapiens
  chr19:39997813-39998083
  hyper
gcggcgcgcaccgctgctcctgcgcgctgggcttcggcggccgcgactgccgcgagcgcgcggacccgtgcgccgcgcgcccctgtgctcacggcggccgctgctacgcccacttctccggcctcgtctgcgcttgcgctcccggctacatgggagcgcggtgtgagttcccagtgcaccccgacggcgcaagcgccttgcccgcggccccgccgggcctcaggcccggggaccctcagcgctaccttttgcctccggctctgggactgc

SEQ ID NO: 58119 - DNA, 150 bp, Homo sapiens; identical to SEQ ID NO: 37515
  chr19:40005754-40005904
  hyper

SEQ ID NO: 58120 - DNA, 142 bp, Homo sapiens
  chr19:40006306-40006448
  hyper
atccgcccccggaacctgctccggagctgcctttgttgcccgaggaggaccctgagccggcgccgagcctgaagctcatcccgtcggtctccagcgaggccgggcccgccccggggccccttcccacgcgcaccccgctggc

SEQ ID NO: 58121 - DNA, 78 bp, Homo sapiens
  chr19:40006498-40006576
  hyper
cggccatcgggctggcggatccccccattcccagtcctgtcccctcgcccatcctggggaccatcccgtcggccatct

SEQ ID NO: 58122 - DNA, 23 bp, Homo sapiens
  chr19:40006639-40006662
  hyper
tcctgattcgagtgacctactgg

SEQ ID NO: 58123 - DNA, 204 bp, Homo sapiens; identical to SEQ ID NO: 37518
  chr19:40324814-40325018
  hyper

SEQ ID NO: 58124 - DNA, 55 bp, Homo sapiens
  chr19:40723945-40724000
  hyper
tggtgggcccgggggcgggggcgggcaggccgctagggcgggccccctgcgccgc

SEQ ID NO: 58125 - DNA, 171 bp, Homo sapiens
  chr19:40724263-40724434
  hyper
ccggggacagcgcgccgcgctgcattgtgggaaactcctgccgccgccgctgcagctaccgcatcgccccccgcggggctggtccccaccctttctccgccccctcacctccggcagccgactccggctgccccctatgggtctagggaaacccctcgagacttcccccat

SEQ ID NO: 58126 - DNA, 15 bp, Homo sapiens
  chr19:41019048-41019063
  hyper
ctgctggactggctt

SEQ ID NO: 58127 - DNA, 47 bp, Homo sapiens; identical to SEQ ID NO: 37522
  chr19:41019075-41019122
  hyper

SEQ ID NO: 58128 - DNA, 160 bp, Homo sapiens; identical to SEQ ID NO: 23050
  chr19:41025379-41025539
  hyper

SEQ ID NO: 58129 - DNA, 218 bp, Homo sapiens
  chr19:41025683-41025901
  hyper
ctacatgacctcgacgctttcctggactggctcgtgcgcgcccaggaggcggcgggcggcagcgaggggcccctgcccaacagcctagaagaggcggacgcgctgctggcgcgccacgctgcgctcaaggaggaggtggaccagcgcgaggaagactatgctcgcatcgtggcggccagcgaggcgctgctggccgccgacggcgcagagctgggccc

SEQ ID NO: 58130 - DNA, 48 bp, Homo sapiens; identical to SEQ ID NO: 37524
  chr19:41055131-41055179
  hyper

SEQ ID NO: 58131 - DNA, 47 bp, Homo sapiens
  chr19:41060306-41060353
  hyper
catgatgagtgaggacaagggcaaggtgcgcccgagctgggggtgcg

SEQ ID NO: 58132 - DNA, 32 bp, Homo sapiens
  chr19:41073555-41073587
  hyper
cctccatcctcagatcgagaaaatcaaagcgg

SEQ ID NO: 58133 - DNA, 181 bp, Homo sapiens
  chr19:41073677-41073858
  hyper
ggccagggggctatgaaaggggcttggagcccctggcccgccgagcctcggacacgctctcggccgaggtgcggactcgggtggggtatgtgcgccaggagctcaagcccgagcgcctccagccgcgcattgaccggctgccggagatcccggggagggtggagcccgcggccctgccggc

SEQ ID NO: 58134 - DNA, 132 bp, Homo sapiens; identical to SEQ ID NO: 37527
  chr19:41074018-41074150
  hyper

SEQ ID NO: 58135 - DNA, 43 bp, Homo sapiens; identical to SEQ ID NO: 37528
  chr19:41102899-41102942
  hyper

SEQ ID NO: 58136 - DNA, 13 bp, Homo sapiens
  chr19:41105989-41106002
  hyper
gctctactgaagc

SEQ ID NO: 58137 - DNA, 69 bp, Homo sapiens; identical to SEQ ID NO: 37530
  chr19:41106351-41106420
  hyper

SEQ ID NO: 58138 - DNA, 21 bp, Homo sapiens
  chr19:41119669-41119690
  hyper
ggggggcggtgtttgcaggga

SEQ ID NO: 58139 - DNA, 59 bp, Homo sapiens; identical to SEQ ID NO: 13408
  chr19:41354396-41354455
  hyper

SEQ ID NO: 58140 - DNA, 91 bp, Homo sapiens; identical to SEQ ID NO: 23055
  chr19:41354575-41354666
  hyper

SEQ ID NO: 58141 - DNA, 85 bp, Homo sapiens
  chr19:41354722-41354807
  hyper
cggagcagctccaaggggctccccaagggtggaggagagagggagtagggtgggagagagatggattcagcgccattgcccagca

SEQ ID NO: 58142 - DNA, 75 bp, Homo sapiens; identical to SEQ ID NO: 37535
  chr19:41596078-41596153
  hyper

SEQ ID NO: 58143 - DNA, 105 bp, Homo sapiens; identical to SEQ ID NO: 23058
  chr19:41641726-41641831
  hyper

SEQ ID NO: 58144 - DNA, 25 bp, Homo sapiens
  chr19:41641886-41641911
  hyper
cctcctttcccgtccccaccacagg

SEQ ID NO: 58145 - DNA, 219 bp, Homo sapiens; identical to SEQ ID NO: 23060
  chr19:42028283-42028502
  hyper

SEQ ID NO: 58146 - DNA, 193 bp, Homo sapiens; identical to SEQ ID NO: 23061
  chr19:42028549-42028742
  hyper

SEQ ID NO: 58147 - DNA, 46 bp, Homo sapiens; identical to SEQ ID NO: 37538
  chr19:42419428-42419474
  hyper

SEQ ID NO: 58148 - DNA, 60 bp, Homo sapiens; identical to SEQ ID NO: 37539
  chr19:42445049-42445109
  hyper

SEQ ID NO: 58149 - DNA, 115 bp, Homo sapiens; identical to SEQ ID NO: 37540
  chr19:42574036-42574151
  hyper

SEQ ID NO: 58150 - DNA, 221 bp, Homo sapiens; identical to SEQ ID NO: 37541
  chr19:42636368-42636589
  hyper

SEQ ID NO: 58151 - DNA, 116 bp, Homo sapiens; identical to SEQ ID NO: 37542
  chr19:42683705-42683821
  hyper

SEQ ID NO: 58152 - DNA, 42 bp, Homo sapiens; identical to SEQ ID NO: 37543
  chr19:42774775-42774817
  hyper

SEQ ID NO: 58153 - DNA, 184 bp, Homo sapiens; identical to SEQ ID NO: 37545
  chr19:42828316-42828500
  hyper

SEQ ID NO: 58154 - DNA, 114 bp, Homo sapiens; identical to SEQ ID NO: 37546
  chr19:42905723-42905837
  hyper

SEQ ID NO: 58155 - DNA, 68 bp, Homo sapiens; identical to SEQ ID NO: 13416
  chr19:42906129-42906197
  hyper

SEQ ID NO: 58156 - DNA, 54 bp, Homo sapiens; identical to SEQ ID NO: 37548
  chr19:42927424-42927478
  hyper

SEQ ID NO: 58157 - DNA, 238 bp, Homo sapiens; identical to SEQ ID NO: 37549
  chr19:42928122-42928360
  hyper

SEQ ID NO: 58158 - DNA, 140 bp, Homo sapiens; identical to SEQ ID NO: 37550
  chr19:44203673-44203813
  hyper

SEQ ID NO: 58159 - DNA, 229 bp, Homo sapiens; identical to SEQ ID NO: 37551
  chr19:44302881-44303110
  hyper

SEQ ID NO: 58160 - DNA, 61 bp, Homo sapiens; identical to SEQ ID NO: 37552
  chr19:44324840-44324901
  hyper

SEQ ID NO: 58161 - DNA, 15 bp, Homo sapiens
  chr19:44324902-44324917
  hyper
cgtcccaagggtttc

SEQ ID NO: 58162 - DNA, 46 bp, Homo sapiens; identical to SEQ ID NO: 37556
  chr19:44455621-44455667
  hyper

SEQ ID NO: 58163 - DNA, 110 bp, Homo sapiens; identical to SEQ ID NO: 37557
  chr19:44488496-44488606
  hyper

SEQ ID NO: 58164 - DNA, 431 bp, Homo sapiens; identical to SEQ ID NO: 37558
  chr19:44711532-44711963
  hyper

SEQ ID NO: 58165 - DNA, 83 bp, Homo sapiens
  chr19:44905416-44905499
  hyper
actgaccctaagcttcgacccgaagaggcacagcgcaagtcgctgtcacgaaacgtgaagatgcactgttttgtcaaacccag

SEQ ID NO: 58166 - DNA, 82 bp, Homo sapiens
  chr19:44905529-44905611
  hyper
gcccacgctcttcccatcctatcccgggtaggtcgggccgctgaacttccctagtctaccccacctacgaggccttatcatt

SEQ ID NO: 58167 - DNA, 45 bp, Homo sapiens
  chr19:45300099-45300144
  hyper
acagctcaggaagtccgggaacattattcgaccacagcaaacaag

SEQ ID NO: 58168 - DNA, 31 bp, Homo sapiens; identical to SEQ ID NO: 23070
  chr19:45656363-45656394
  hyper

SEQ ID NO: 58169 - DNA, 21 bp, Homo sapiens
  chr19:45656661-45656682
  hyper
gcagccccaggcacacgcggc

SEQ ID NO: 58170 - DNA, 48 bp, Homo sapiens
  chr19:45656913-45656961
  hyper
gcaggaacaccaggtaccacagtagctgcgggacgccccagccgctca

SEQ ID NO: 58171 - DNA, 35 bp, Homo sapiens; identical to SEQ ID NO: 23072
  chr19:45657177-45657212
  hyper

SEQ ID NO: 58172 - DNA, 57 bp, Homo sapiens
  chr19:45657284-45657341
  hyper
tagagccggcagaggagagatgggaggaggcaaaaagagatacgaggaagagccagg

SEQ ID NO: 58173 - DNA, 30 bp, Homo sapiens; identical to SEQ ID NO: 13431
  chr19:45755404-45755434
  hyper

SEQ ID NO: 58174 - DNA, 472 bp, Homo sapiens; identical to SEQ ID NO: 37570
  chr19:45826794-45827266
  hyper

SEQ ID NO: 58175 - DNA, 109 bp, Homo sapiens
  chr19:45888837-45888946
  hyper
agtcagcataaccctcgcggtaagggtcgcacttctcgaaggcggtggcgccgtcgctgagcgtggtggcgaagattgcagcgccgtgctgcaccagcgccatgcagat

SEQ ID NO: 58176 - DNA, 9 bp, Homo sapiens
  chr19:45889397-45889406
  hyper
ttgcgcggg

SEQ ID NO: 58177 - DNA, 58 bp, Homo sapiens; identical to SEQ ID NO: 37573
  chr19:45931217-45931275
  hyper

SEQ ID NO: 58178 - DNA, 329 bp, Homo sapiens
  chr19:46001719-46002048
  hyper
agggctgaaggatggcggtcctggcccgccagctgcagcgtctcctctggaccgcttgcaagaaaaaggagagggagaaggaggggagggaggaagaggaggaggaggaggcggggcgcagggcccccgaagggcctcggtctctgttgacagcgccgcgccgcgcccagcggccgcacgggggtgccgaggcgtctgggggcctgcgcttcggggcgagcgcagcgcaaggctggcgcgcgcgcatggaggatgctcactgcacttggctttcgttacctggtctgcccccgggctgggccttgtttgccgtcctcgacggccacggt

SEQ ID NO: 58179 - DNA, 33 bp, Homo sapiens; identical to SEQ ID NO: 23076
  chr19:46002320-46002353
  hyper

SEQ ID NO: 58180 - DNA, 91 bp, Homo sapiens; identical to SEQ ID NO: 37575
  chr19:46105207-46105298
  hyper

SEQ ID NO: 58181 - DNA, 34 bp, Homo sapiens; identical to SEQ ID NO: 37576
  chr19:46148823-46148857
  hyper

SEQ ID NO: 58182 - DNA, 65 bp, Homo sapiens; identical to SEQ ID NO: 37577
  chr19:46173896-46173961
  hyper

SEQ ID NO: 58183 - DNA, 113 bp, Homo sapiens; identical to SEQ ID NO: 37578
  chr19:46180359-46180472
  hyper

SEQ ID NO: 58184 - DNA, 21 bp, Homo sapiens
  chr19:46283058-46283079
  hyper
tcaccttcagaatctcgaagt

SEQ ID NO: 58185 - DNA, 21 bp, Homo sapiens
  chr19:46379893-46379914
  hyper
cgccttgccggctgcgtgtca

SEQ ID NO: 58186 - DNA, 229 bp, Homo sapiens
  chr19:46380148-46380377
  hyper
gcccccgccccccggccaacagcccaaatattattccgcgggaggagtcggtggtggcgggaggaggcccaggctgaaagaggctttcagggcggccaggcctggggcttcctgtccccaggctcgggcctcaggccgccccagtggggacctcaggtggccggaggggcggggtgttgttgtagggtcctcgggggagggtggggccatccgtcggggtgtctggtgg

SEQ ID NO: 58187 - DNA, 117 bp, Homo sapiens; identical to SEQ ID NO: 37581
  chr19:46476943-46477060
  hyper

SEQ ID NO: 58188 - DNA, 354 bp, Homo sapiens; identical to SEQ ID NO: 37582
  chr19:46477118-46477472
  hyper

SEQ ID NO: 58189 - DNA, 259 bp, Homo sapiens; identical to SEQ ID NO: 37583
  chr19:46519255-46519514
  hyper

SEQ ID NO: 58190 - DNA, 30 bp, Homo sapiens; identical to SEQ ID NO: 37584
  chr19:46907252-46907282
  hyper

SEQ ID NO: 58191 - DNA, 215 bp, Homo sapiens; identical to SEQ ID NO: 37585
  chr19:46907501-46907716
  hyper

SEQ ID NO: 58192 - DNA, 30 bp, Homo sapiens; identical to SEQ ID NO: 37586
  chr19:46908092-46908122
  hyper

SEQ ID NO: 58193 - DNA, 153 bp, Homo sapiens
  chr19:46916572-46916725
  hyper
agctccaagttggggcgcgcgggctgccagcgactcttcctgccccaggccccagggacgcggctggaacttgggacaggacttcgcagacaaagacggtccagtcgaagctattcaatatggccgaggcgctgggaggccccagcccgggcc

SEQ ID NO: 58194 - DNA, 103 bp, Homo sapiens
  chr19:46930026-46930129
  hyper
attttctgcaaagggcgcaggcgcctggggtcagcctgtggtctccatagcaacggtcggacgcgctgctaggttctggctctgactgcgcctgcgcggctgg

SEQ ID NO: 58195 - DNA, 275 bp, Homo sapiens; identical to SEQ ID NO: 37590
  chr19:46932061-46932336
  hyper

SEQ ID NO: 58196 - DNA, 52 bp, Homo sapiens
  chr19:46974500-46974552
  hyper
gccccggtgctcacacgtgtccctgaatctgcagcaaaaggccctaggaccc

SEQ ID NO: 58197 - DNA, 143 bp, Homo sapiens
  chr19:46992866-46993009
  hyper
gagggggcaaccgcgctccgctccacccgtcgccagaggctccacgcgcgggacagacccggctgctgcagcctgtgctggtctctgtgcaccgggacccttccctgcaggatctcaaggcctttacgcggctgctccttcga

SEQ ID NO: 58198 - DNA, 45 bp, Homo sapiens; identical to SEQ ID NO: 37597
  chr19:47143100-47143145
  hyper

SEQ ID NO: 58199 - DNA, 170 bp, Homo sapiens; identical to SEQ ID NO: 37599
  chr19:47523113-47523283
  hyper

SEQ ID NO: 58200 - DNA, 162 bp, Homo sapiens; identical to SEQ ID NO: 37600
  chr19:47523562-47523724
  hyper

SEQ ID NO: 58201 - DNA, 162 bp, Homo sapiens; identical to SEQ ID NO: 37601
  chr19:47524772-47524934
  hyper

SEQ ID NO: 58202 - DNA, 202 bp, Homo sapiens; identical to SEQ ID NO: 37602
  chr19:47742701-47742903
  hyper

SEQ ID NO: 58203 - DNA, 30 bp, Homo sapiens; identical to SEQ ID NO: 37603
  chr19:47746438-47746468
  hyper

SEQ ID NO: 58204 - DNA, 7 bp, Homo sapiens
  chr19:47910558-47910565
  hyper
gcccggg

SEQ ID NO: 58205 - DNA, 57 bp, Homo sapiens; identical to SEQ ID NO: 37605
  chr19:47921726-47921783
  hyper

SEQ ID NO: 58206 - DNA, 39 bp, Homo sapiens; identical to SEQ ID NO: 37606
  chr19:47925553-47925592
  hyper

SEQ ID NO: 58207 - DNA, 111 bp, Homo sapiens; identical to SEQ ID NO: 23087
  chr19:47933200-47933311
  hyper

SEQ ID NO: 58208 - DNA, 41 bp, Homo sapiens
  chr19:47933732-47933773
  hyper
gagacatacaggtcggaggggctttgcgccgccacccacag

SEQ ID NO: 58209 - DNA, 143 bp, Homo sapiens; identical to SEQ ID NO: 37608
  chr19:47960799-47960942
  hyper

SEQ ID NO: 58210 - DNA, 177 bp, Homo sapiens
  chr19:48076465-48076642
  hyper
cacgcgcggcgcaggcgcgcgtacgtgaccgcgggccgcctcacgcctcccagagcggcctcgcgcgtgcctcctggccgcgcgctctcggctgcttctccgaggggcggggcttgccgcgggcgggaaaggaggcggttggtcgccattttgggagggggcggttgagggcggaga

SEQ ID NO: 58211 - DNA, 49 bp, Homo sapiens; identical to SEQ ID NO: 37610
  chr19:48774925-48774974
  hyper

SEQ ID NO: 58212 - DNA, 41 bp, Homo sapiens; identical to SEQ ID NO: 37611
  chr19:48775188-48775229
  hyper

SEQ ID NO: 58213 - DNA, 32 bp, Homo sapiens; identical to SEQ ID NO: 37612
  chr19:48867764-48867796
  hyper

SEQ ID NO: 58214 - DNA, 231 bp, Homo sapiens; identical to SEQ ID NO: 37613
  chr19:48901882-48902113
  hyper

SEQ ID NO: 58215 - DNA, 85 bp, Homo sapiens; identical to SEQ ID NO: 37615
  chr19:48918604-48918689
  hyper

SEQ ID NO: 58216 - DNA, 14 bp, Homo sapiens
  chr19:48947361-48947375
  hyper
ggagaggatttggt

SEQ ID NO: 58217 - DNA, 42 bp, Homo sapiens; identical to SEQ ID NO: 37617
  chr19:48994825-48994867
  hyper

SEQ ID NO: 58218 - DNA, 105 bp, Homo sapiens
  chr19:49127674-49127779
  hyper
gaggacccggcgtgtgaggagggtgcgggggtcggggcagggaccggagtctaggggactgagggaccaagaggaacagagactcaggcccgggactggggcacc

SEQ ID NO: 58219 - DNA, 184 bp, Homo sapiens; identical to SEQ ID NO: 37619
  chr19:49242534-49242718
  hyper

SEQ ID NO: 58220 - DNA, 39 bp, Homo sapiens; identical to SEQ ID NO: 23093
  chr19:49399310-49399349
  hyper

SEQ ID NO: 58221 - DNA, 105 bp, Homo sapiens; identical to SEQ ID NO: 37621
  chr19:49560299-49560404
  hyper

SEQ ID NO: 58222 - DNA, 30 bp, Homo sapiens; identical to SEQ ID NO: 37622
  chr19:49649675-49649705
  hyper

SEQ ID NO: 58223 - DNA, 30 bp, Homo sapiens; identical to SEQ ID NO: 37623
  chr19:49652144-49652174
  hyper

SEQ ID NO: 58224 - DNA, 109 bp, Homo sapiens; identical to SEQ ID NO: 37624
  chr19:49924453-49924562
  hyper

SEQ ID NO: 58225 - DNA, 445 bp, Homo sapiens; identical to SEQ ID NO: 37625
  chr19:49925697-49926142
  hyper

SEQ ID NO: 58226 - DNA, 34 bp, Homo sapiens; identical to SEQ ID NO: 37626
  chr19:49926495-49926529
  hyper

SEQ ID NO: 58227 - DNA, 134 bp, Homo sapiens; identical to SEQ ID NO: 37627
  chr19:49932009-49932143
  hyper

SEQ ID NO: 58228 - DNA, 195 bp, Homo sapiens
  chr19:49936174-49936369
  hyper
ctggcatagacgtgaagaagcgccgccagggagtgctaaacttctgtgggggcgaggggagggccgctaagacggggagcggggctgagggcttctccgcgtcccttcagggaccacagtgtagttctgcagaaaccaaaggatcccgaccgcactgaaacttctatggacccaaaggcgcgggctacaccatgt

SEQ ID NO: 58229 - DNA, 11 bp, Homo sapiens
  chr19:49936853-49936864
  hyper
tagcccctctc

SEQ ID NO: 58230 - DNA, 304 bp, Homo sapiens
  chr19:49936894-49937198
  hyper
ctgcaggaaccgtccctgatctacacgctgtgcaggttcgtggcttgctatctctccccgccccttccccgaagatttggtcccggaccgtgagggggttcatgagtttcgcgctctctccgatggcgtcctcgatgtacttgcgctcctcctccgagatgctggggtgcagcgcgggggactcgtaggagacgagcagccagaacaggtaccagaagatcccgaagctgcctgggggggtcaggagggggatgggagcgaggtgaggaccggccccgctccgccccagcgccacccggaacca

SEQ ID NO: 58231 - DNA, 770 bp, Homo sapiens; identical to SEQ ID NO: 37630
  chr19:50194104-50194874
  hyper

SEQ ID NO: 58232 - DNA, 37 bp, Homo sapiens
  chr19:50316207-50316244
  hyper
acaccgaacccccttcggtttagatacaggcgtccaa

SEQ ID NO: 58233 - DNA, 245 bp, Homo sapiens
  chr19:50316468-50316713
  hyper
gagatggggagctgattggaagaggattaacttcccgccttcttcacccaactcaaacagaccctcaaaccctattcaggcacctcccccaaacccattaggttctcttccgccctagccggaagtcacggtacccctaacaaagatggcggcaaattgaatttgcaaagctttctagtttctccgaggaggtaaagagaaccaagaagccggattgaagatgatgactgcgccaaggcgttgcc

SEQ ID NO: 58234 - DNA, 15 bp, Homo sapiens
  chr19:50393562-50393577
  hyper
gaacaccttggtggc

SEQ ID NO: 58235 - DNA, 40 bp, Homo sapiens; identical to SEQ ID NO: 37633
  chr19:50393971-50394011
  hyper

SEQ ID NO: 58236 - DNA, 30 bp, Homo sapiens; identical to SEQ ID NO: 37635
  chr19:50651036-50651066
  hyper

SEQ ID NO: 58237 - DNA, 30 bp, Homo sapiens; identical to SEQ ID NO: 37636
  chr19:50651328-50651358
  hyper

SEQ ID NO: 58238 - DNA, 30 bp, Homo sapiens; identical to SEQ ID NO: 37637
  chr19:50706864-50706894
  hyper

SEQ ID NO: 58239 - DNA, 30 bp, Homo sapiens; identical to SEQ ID NO: 37638
  chr19:50815293-50815323
  hyper

SEQ ID NO: 58240 - DNA, 271 bp, Homo sapiens; identical to SEQ ID NO: 37639
  chr19:50815780-50816051
  hyper

SEQ ID NO: 58241 - DNA, 10 bp, Homo sapiens
  chr19:50816474-50816484
  hyper
gggaaggggg

SEQ ID NO: 58242 - DNA, 734 bp, Homo sapiens; identical to SEQ ID NO: 37641
  chr19:50818424-50819158
  hyper

SEQ ID NO: 58243 - DNA, 84 bp, Homo sapiens; identical to SEQ ID NO: 37642
  chr19:50829625-50829709
  hyper

SEQ ID NO: 58244 - DNA, 510 bp, Homo sapiens; identical to SEQ ID NO: 37643
  chr19:50831498-50832008
  hyper

SEQ ID NO: 58245 - DNA, 58 bp, Homo sapiens; identical to SEQ ID NO: 37644
  chr19:50832951-50833009
  hyper

SEQ ID NO: 58246 - DNA, 107 bp, Homo sapiens
  chr19:50833863-50833970
  hyper
aggaccgagggtagatgaggactggtgaggagggggcacgcaaggaggcagagaggacgggagaggggagaggccaaagcgccaggaagcaccgtcaagactgaggc

SEQ ID NO: 58247 - DNA, 35 bp, Homo sapiens; identical to SEQ ID NO: 13473
  chr19:50836356-50836391
  hyper

SEQ ID NO: 58248 - DNA, 32 bp, Homo sapiens; identical to SEQ ID NO: 37647
  chr19:50836392-50836424
  hyper

SEQ ID NO: 58249 - DNA, 66 bp, Homo sapiens; identical to SEQ ID NO: 37648
  chr19:50837323-50837389
  hyper

SEQ ID NO: 58250 - DNA, 30 bp, Homo sapiens; identical to SEQ ID NO: 37649
  chr19:51055016-51055046
  hyper

SEQ ID NO: 58251 - DNA, 56 bp, Homo sapiens; identical to SEQ ID NO: 37650
  chr19:51111640-51111696
  hyper

SEQ ID NO: 58252 - DNA, 67 bp, Homo sapiens; identical to SEQ ID NO: 37651
  chr19:51142512-51142579
  hyper

SEQ ID NO: 58253 - DNA, 171 bp, Homo sapiens; identical to SEQ ID NO: 37652
  chr19:51142587-51142758
  hyper

SEQ ID NO: 58254 - DNA, 277 bp, Homo sapiens; identical to SEQ ID NO: 37653
  chr19:51142834-51143111
  hyper

SEQ ID NO: 58255 - DNA, 477 bp, Homo sapiens
  chr19:51161720-51162197
  hyper
gttggaggtaaggtccggtgagatcagagagaaggagggatctcgagtgagtaggggcccgagtttgagtgacccagtagtgaccgggatagaggtctgagcctggaaaggcagctgtgagggggtggaagagactgagcacatagtaggtgtggggccaggggtgatagggtggggacaggcctggagtgcctagggtagagcgcagcctgcagtcgccagtggagggtcgggcctttgggcggtttgagatggagcctcgacagacagtgattaggacgcagaaccaggctaagagagcgtaaggagcctagagcgacccaggcgagagggcagggctggaggggagtttagggacggagcgatggtccgctggaccagggcctgtaaacgactccagggaccaggcagggactcttcgacgatcaaagccagggctgaaacgacctgcgagttccttttccgtccccacccccc

SEQ ID NO: 58256 - DNA, 49 bp, Homo sapiens; identical to SEQ ID NO: 37657
  chr19:51162729-51162778
  hyper

SEQ ID NO: 58257 - DNA, 15 bp, Homo sapiens
  chr19:51170723-51170738
  hyper
cagttttcaaggaac

SEQ ID NO: 58258 - DNA, 107 bp, Homo sapiens
  chr19:51171112-51171219
  hyper
cgaggactccttcagcgctcgctcgcgggcggccagggccagccccagcggggaggcgggatccagggccttgccggtcagcgggtgcaccaggggtcgcgggggca

SEQ ID NO: 58259 - DNA, 291 bp, Homo sapiens; identical to SEQ ID NO: 37660
  chr19:51197503-51197794
  hyper

SEQ ID NO: 58260 - DNA, 60 bp, Homo sapiens; identical to SEQ ID NO: 13484
  chr19:51198175-51198235
  hyper

SEQ ID NO: 58261 - DNA, 634 bp, Homo sapiens; identical to SEQ ID NO: 37662
  chr19:51198514-51199148
  hyper

SEQ ID NO: 58262 - DNA, 117 bp, Homo sapiens; identical to SEQ ID NO: 23114
  chr19:51227602-51227719
  hyper

SEQ ID NO: 58263 - DNA, 213 bp, Homo sapiens
  chr19:51227785-51227998
  hyper
gacacccgcgatgccgtgcaagccctgcaggaggcgcagggtcgcgccgagcgcgagcacggccgcttggagggtgagtccgcggcgcgcggggtggaaaaaaatgagactatctgggccaggaatgggactggttgagaaggtgaccctaggtgtccggggcgggagagttcgggagagctgctgtgtgctagcggacggggttagagagct

SEQ ID NO: 58264 - DNA, 21 bp, Homo sapiens
  chr19:51228248-51228269
  hyper
gcctccttctctacccggccc

SEQ ID NO: 58265 - DNA, 132 bp, Homo sapiens; identical to SEQ ID NO: 23117
  chr19:51228507-51228639
  hyper

SEQ ID NO: 58266 - DNA, 91 bp, Homo sapiens; identical to SEQ ID NO: 4680
  chr19:51228702-51228793
  hyper

SEQ ID NO: 58267 - DNA, 167 bp, Homo sapiens; identical to SEQ ID NO: 37667
  chr19:51281496-51281663
  hyper

SEQ ID NO: 58268 - DNA, 121 bp, Homo sapiens; identical to SEQ ID NO: 37668
  chr19:51412508-51412629
  hyper

SEQ ID NO: 58269 - DNA, 285 bp, Homo sapiens
  chr19:51520138-51520423
  hyper
ctcaaggagaatcagcgggagaggagtgacgggcccagaaatgcggaaaaggaccacaccgccccctggcggccacagcgcaagcccggtctctcctcctgctggaaggacaccggggaccgcacctccagctgtgggagttccgagagaccccgccctgcccgctcctccctggaggccgcctccacagccccccgtggcgtcctcggggatggatctcctcctacttgtttccgcagtgcgcggccgtcagcacccaactctggtccaccaggacacccgcgc

SEQ ID NO: 58270 - DNA, 39 bp, Homo sapiens
  chr19:51520453-51520492
  hyper
cctgccagggctgcgagccgcgcgcgcacggggagccat

SEQ ID NO: 58271 - DNA, 54 bp, Homo sapiens; identical to SEQ ID NO: 37670
  chr19:51522680-51522734
  hyper

SEQ ID NO: 58272 - DNA, 132 bp, Homo sapiens; identical to SEQ ID NO: 37671
  chr19:51568572-51568704
  hyper

SEQ ID NO: 58273 - DNA, 30 bp, Homo sapiens; identical to SEQ ID NO: 37672
  chr19:51814766-51814796
  hyper

SEQ ID NO: 58274 - DNA, 172 bp, Homo sapiens; identical to SEQ ID NO: 37673
  chr19:51815103-51815275
  hyper

SEQ ID NO: 58275 - DNA, 135 bp, Homo sapiens; identical to SEQ ID NO: 37674
  chr19:51830260-51830395
  hyper

SEQ ID NO: 58276 - DNA, 24 bp, Homo sapiens
  chr19:51830821-51830845
  hyper
gcggtgggagtgacccgaggtaca

SEQ ID NO: 58277 - DNA, 232 bp, Homo sapiens; identical to SEQ ID NO: 23121
  chr19:51831128-51831360
  hyper

SEQ ID NO: 58278 - DNA, 85 bp, Homo sapiens; identical to SEQ ID NO: 37677
  chr19:52074277-52074362
  hyper

SEQ ID NO: 58279 - DNA, 30 bp, Homo sapiens; identical to SEQ ID NO: 37678
  chr19:52097396-52097426
  hyper

SEQ ID NO: 58280 - DNA, 60 bp, Homo sapiens; identical to SEQ ID NO: 37679
  chr19:52205780-52205840
  hyper

SEQ ID NO: 58281 - DNA, 377 bp, Homo sapiens
  chr19:52207367-52207744
  hyper
accgcgggacgttctcctgcgtgatcaagcaagaccagcgccccctggcccggctctacttctttcttaacggtggggcggggcgcggccgcgtgagtgagcggggtcgggagaggggtggggctcgtgcctggctgacgtgcgcgcccccgcagtgacgggcccgcccccgcgggcggagacagagttgcaggcctcgttccgggaagtgctgcgctgggcgccgcgggatgccgagctgatcgagccctggaggcccagcctgggcgagctgctggccaggcccgaggctctgacgcccagcaatctgttcctgcttgcagtcctcggggccctcgcatcagcgagtgcgacagtgttggcgtggtgagttctgg

SEQ ID NO: 58282 - DNA, 93 bp, Homo sapiens
  chr19:52222430-52222523
  hyper
cgagtgggctgaaggcgcctctactcacctgcacgtagtccaccgaatctccgagcgccttgaaggctgtgtacatgacctcgcgcttgccgc

SEQ ID NO: 58283 - DNA, 17 bp, Homo sapiens
  chr19:52223142-52223159
  hyper
cgcgtcctgctgggagc

SEQ ID NO: 58284 - DNA, 214 bp, Homo sapiens; identical to SEQ ID NO: 37683
  chr19:52408028-52408242
  hyper

SEQ ID NO: 58285 - DNA, 30 bp, Homo sapiens; identical to SEQ ID NO: 37684
  chr19:52430054-52430084
  hyper

SEQ ID NO: 58286 - DNA, 76 bp, Homo sapiens; identical to SEQ ID NO: 37685
  chr19:52511308-52511384
  hyper

SEQ ID NO: 58287 - DNA, 434 bp, Homo sapiens; identical to SEQ ID NO: 37686
  chr19:52531450-52531884
  hyper

SEQ ID NO: 58288 - DNA, 89 bp, Homo sapiens; identical to SEQ ID NO: 37687
  chr19:52800826-52800915
  hyper

SEQ ID NO: 58289 - DNA, 93 bp, Homo sapiens; identical to SEQ ID NO: 37688
  chr19:52839463-52839556
  hyper

SEQ ID NO: 58290 - DNA, 46 bp, Homo sapiens; identical to SEQ ID NO: 37689
  chr19:52839996-52840042
  hyper

SEQ ID NO: 58291 - DNA, 38 bp, Homo sapiens; identical to SEQ ID NO: 37690
  chr19:52840043-52840081
  hyper

SEQ ID NO: 58292 - DNA, 29 bp, Homo sapiens
  chr19:52872845-52872874
  hyper
tgcagcgcacgacctcggctcactgcagc

SEQ ID NO: 58293 - DNA, 94 bp, Homo sapiens
  chr19:52873440-52873534
  hyper
gggccatgtagacagctcctgtcgcggagtttgcctgcttcaaatccttcagtgacccctagacacggcccgcgctgcgtaaagttctcacccg

SEQ ID NO: 58294 - DNA, 89 bp, Homo sapiens; identical to SEQ ID NO: 37694
  chr19:52900885-52900974
  hyper

SEQ ID NO: 58295 - DNA, 69 bp, Homo sapiens; identical to SEQ ID NO: 37695
  chr19:52900975-52901044
  hyper

SEQ ID NO: 58296 - DNA, 199 bp, Homo sapiens; identical to SEQ ID NO: 23131
  chr19:52956606-52956805
  hyper

SEQ ID NO: 58297 - DNA, 24 bp, Homo sapiens
  chr19:52956848-52956872
  hyper
ttggagcagcgggtgagtttccct

SEQ ID NO: 58298 - DNA, 1 bp, Homo sapiens
  chr19:52957230-52957231
  hyper
c

SEQ ID NO: 58299 - DNA, 33 bp, Homo sapiens; identical to SEQ ID NO: 37698
  chr19:53031314-53031347
  hyper

SEQ ID NO: 58300 - DNA, 50 bp, Homo sapiens
  chr19:53073354-53073404
  hyper
aaaaatagagtcgctgggagcgaggctgagagacgcacaggtcccgcccc

SEQ ID NO: 58301 - DNA, 158 bp, Homo sapiens
  chr19:53073405-53073563
  hyper
gccccgccctctgccggttctaaagggcaaggtctctccgcctggggccccgcctctacctcgatcaggccccgcccaccttctcgttggctccacccaggcctggctttagtcctgtgcgcacacatccgcgcagaccaggaagcggatcccgtgga

SEQ ID NO: 58302 - DNA, 51 bp, Homo sapiens; identical to SEQ ID NO: 23134
  chr19:53073987-53074038
  hyper

SEQ ID NO: 58303 - DNA, 38 bp, Homo sapiens; identical to SEQ ID NO: 37703
  chr19:53104584-53104622
  hyper

SEQ ID NO: 58304 - DNA, 58 bp, Homo sapiens; identical to SEQ ID NO: 37704
  chr19:53104953-53105011
  hyper

SEQ ID NO: 58305 - DNA, 280 bp, Homo sapiens; identical to SEQ ID NO: 37705
  chr19:53141079-53141359
  hyper

SEQ ID NO: 58306 - DNA, 200 bp, Homo sapiens; identical to SEQ ID NO: 37706
  chr19:53141419-53141619
  hyper

SEQ ID NO: 58307 - DNA, 216 bp, Homo sapiens; identical to SEQ ID NO: 37707
  chr19:53193364-53193580
  hyper

SEQ ID NO: 58308 - DNA, 30 bp, Homo sapiens; identical to SEQ ID NO: 37708
  chr19:53193928-53193958
  hyper

SEQ ID NO: 58309 - DNA, 46 bp, Homo sapiens
  chr19:53194235-53194281
  hyper
gtgcaggcgcgaaggcgggagcctgaggtcccagctactcaggaag

SEQ ID NO: 58310 - DNA, 111 bp, Homo sapiens; identical to SEQ ID NO: 37710
  chr19:53361072-53361183
  hyper

SEQ ID NO: 58311 - DNA, 403 bp, Homo sapiens; identical to SEQ ID NO: 37711
  chr19:53400389-53400792
  hyper

SEQ ID NO: 58312 - DNA, 80 bp, Homo sapiens; identical to SEQ ID NO: 37712
  chr19:53426559-53426639
  hyper

SEQ ID NO: 58313 - DNA, 36 bp, Homo sapiens; identical to SEQ ID NO: 37713
  chr19:53466073-53466109
  hyper

SEQ ID NO: 58314 - DNA, 187 bp, Homo sapiens; identical to SEQ ID NO: 37714
  chr19:53496179-53496366
  hyper

SEQ ID NO: 58315 - DNA, 1 bp, Homo sapiens
  chr19:53496648-53496649
  hyper
t

SEQ ID NO: 58316 - DNA, 135 bp, Homo sapiens; identical to SEQ ID NO: 37717
  chr19:53497254-53497389
  hyper

SEQ ID NO: 58317 - DNA, 173 bp, Homo sapiens
  chr19:53561495-53561668
  hyper
tatgcgggaagaagacgcgaatggcaggggacagggactggtctcagagcgagttttacccacatggcgaggtccgtatttacctcgggtgaagggcgcgatgcggggattttaaggtcagcagagcgggtgtggaaaagcgggacggcgaatcgaaggcttaatctacacct

SEQ ID NO: 58318 - DNA, 66 bp, Homo sapiens
  chr19:53561733-53561799
  hyper
ctgcacgtgcgcgcagagcccgggtagcctggggcggagcccggggagaggcggggtctgcagagg

SEQ ID NO: 58319 - DNA, 103 bp, Homo sapiens; identical to SEQ ID NO: 13514
  chr19:53635501-53635604
  hyper

SEQ ID NO: 58320 - DNA, 67 bp, Homo sapiens
  chr19:53635885-53635952
  hyper
ggaaaaggttttaagcgggaggaagaagcaaaaggccggggacggggagcagcctcaaagcgacttc

SEQ ID NO: 58321 - DNA, 181 bp, Homo sapiens
  chr19:53661466-53661647
  hyper
gactgcgaaggggaggcctggggagcagcagggcccggcacgaggaggagggaggtggcggggcgacggcgccttagaagaggggtggggtctgcaggatgccaggaccaggcagaggacgcggcctcgccggtaccggggctgaggagctgcgctccaggggccgacgagggcgaggctg

SEQ ID NO: 58322 - DNA, 247 bp, Homo sapiens; identical to SEQ ID NO: 23142
  chr19:53696167-53696414
  hyper

SEQ ID NO: 58323 - DNA, 69 bp, Homo sapiens; identical to SEQ ID NO: 23143
  chr19:53696580-53696649
  hyper

SEQ ID NO: 58324 - DNA, 13 bp, Homo sapiens
  chr19:53696650-53696663
  hyper
gtggggaaaggcc

SEQ ID NO: 58325 - DNA, 100 bp, Homo sapiens; identical to SEQ ID NO: 37725
  chr19:53700343-53700443
  hyper

SEQ ID NO: 58326 - DNA, 30 bp, Homo sapiens; identical to SEQ ID NO: 13521
  chr19:53757742-53757772
  hyper

SEQ ID NO: 58327 - DNA, 32 bp, Homo sapiens; identical to SEQ ID NO: 37729
  chr19:53868692-53868724
  hyper

SEQ ID NO: 58328 - DNA, 214 bp, Homo sapiens; identical to SEQ ID NO: 37730
  chr19:53868957-53869171
  hyper

SEQ ID NO: 58329 - DNA, 70 bp, Homo sapiens; identical to SEQ ID NO: 37731
  chr19:53966826-53966896
  hyper

SEQ ID NO: 58330 - DNA, 28 bp, Homo sapiens
  chr19:53970370-53970398
  hyper
agacgaggaaggaagcgctgcgggaggg

SEQ ID NO: 58331 - DNA, 43 bp, Homo sapiens
  chr19:53970458-53970501
  hyper
gcttcctgagtagctgggacctcaggctcctgcccccgcgcgc

SEQ ID NO: 58332 - DNA, 210 bp, Homo sapiens
  chr19:53970758-53970968
  hyper
cagacaattccagggcttttgaatagtgcctcaaccttactggccggtctcgactccaaaaccctaaaacaggcgctggagcgagggtgacggactcacaggtcccaccccggccccgccctctgcgccttccaaagggcaaagtctctccgcctctcgccccgcccctgcttcgtcaggccccgcccacctcccaggtcccgcccaggc

SEQ ID NO: 58333 - DNA, 288 bp, Homo sapiens
  chr19:53971157-53971445
  hyper
agagcaaattgagacgaccccgtgagagtccgggggtcgcttccttttgtgtttaaggtcgccctgaggctggtcccgtcccgggtctttctgctatagggcaatgtatacactttctatcgcgcatttttcctgctctaaacctttctctgactcctcccaccccgcgctttttgaagtcctcacccaaggggtggattctcgcccacttcggccggtggagcgcagaaccgcggccccagtcccgggaaggccgcgtcctctgtctggtcccgggatcctgcagac

SEQ ID NO: 58334 - DNA, 325 bp, Homo sapiens; identical to SEQ ID NO: 23149
  chr19:54024196-54024521
  hyper

SEQ ID NO: 58335 - DNA, 30 bp, Homo sapiens; identical to SEQ ID NO: 37738
  chr19:54371989-54372019
  hyper

SEQ ID NO: 58336 - DNA, 30 bp, Homo sapiens; identical to SEQ ID NO: 37739
  chr19:54382737-54382767
  hyper

SEQ ID NO: 58337 - DNA, 413 bp, Homo sapiens; identical to SEQ ID NO: 37740
  chr19:54409951-54410364
  hyper

SEQ ID NO: 58338 - DNA, 102 bp, Homo sapiens; identical to SEQ ID NO: 23152
  chr19:54411454-54411556
  hyper

SEQ ID NO: 58339 - DNA, 23 bp, Homo sapiens
  chr19:54411586-54411609
  hyper
cagtggagcggtgtgccttgtct

SEQ ID NO: 58340 - DNA, 91 bp, Homo sapiens; identical to SEQ ID NO: 37743
  chr19:54412658-54412749
  hyper

SEQ ID NO: 58341 - DNA, 65 bp, Homo sapiens
  chr19:54412808-54412873
  hyper
cgcccctcgaggtggctgcgagccgggtttggggcaacaagggacccgagtggctccaggggtgg

SEQ ID NO: 58342 - DNA, 7 bp, Homo sapiens
  chr19:54412985-54412992
  hyper
cactcct

SEQ ID NO: 58343 - DNA, 143 bp, Homo sapiens; identical to SEQ ID NO: 37745
  chr19:54413008-54413151
  hyper

SEQ ID NO: 58344 - DNA, 125 bp, Homo sapiens; identical to SEQ ID NO: 37746
  chr19:54413467-54413592
  hyper

SEQ ID NO: 58345 - DNA, 44 bp, Homo sapiens; identical to SEQ ID NO: 37747
  chr19:54445558-54445602
  hyper

SEQ ID NO: 58346 - DNA, 30 bp, Homo sapiens; identical to SEQ ID NO: 13533
  chr19:54463032-54463062
  hyper

SEQ ID NO: 58347 - DNA, 203 bp, Homo sapiens; identical to SEQ ID NO: 37749
  chr19:54465531-54465734
  hyper

SEQ ID NO: 58348 - DNA, 427 bp, Homo sapiens; identical to SEQ ID NO: 37750
  chr19:54466163-54466590
  hyper

SEQ ID NO: 58349 - DNA, 102 bp, Homo sapiens; identical to SEQ ID NO: 37751
  chr19:54481331-54481433
  hyper

SEQ ID NO: 58350 - DNA, 20 bp, Homo sapiens
  chr19:54481751-54481771
  hyper
gcggcgactctgcgccgtga

SEQ ID NO: 58351 - DNA, 356 bp, Homo sapiens
  chr19:54482817-54483173
  hyper
cagggagagtgatttcgataaataaagagggggaaagatattccaagagagagaaaaatagtccgaagaaaaaagaaaaggacaaagaaaaagagggagagaaaatcagaccgagaaatagagaaattttaaaaacaggagagagaatgaggcaacagtaaaataaaccagaacacagccggagagagagaatcacagaactgtcgggaggcgccgcgagatggggggccgggaagggggcgcaggcggccgcgtctgaccgccctcgctctccctccttttcctttccttcctcccccgcaggagttgtccgggcctccagcatcttccccatccttagcgccatcctgctgctg

SEQ ID NO: 58352 - DNA, 184 bp, Homo sapiens
  chr19:54483546-54483730
  hyper
atcccaagcccgccgtcctggagacggaaggggaggagctggggagggggtgggaccttgagacacaattgggctcttgaggatagagaggcggggctgggtcttggagggcgggcccaggagaggtagaaagtgatctgagcgccgatgaggagcctgctttaaggggcgggcctttggagac

SEQ ID NO: 58353 - DNA, 174 bp, Homo sapiens; identical to SEQ ID NO: 23160
  chr19:54485823-54485997
  hyper

SEQ ID NO: 58354 - DNA, 29 bp, Homo sapiens
  chr19:54486106-54486135
  hyper
cgcggcgggggagccgaggggcgtgtccg

SEQ ID NO: 58355 - DNA, 192 bp, Homo sapiens; identical to SEQ ID NO: 37760
  chr19:54494879-54495071
  hyper

SEQ ID NO: 58356 - DNA, 118 bp, Homo sapiens; identical to SEQ ID NO: 37761
  chr19:55684817-55684935
  hyper

SEQ ID NO: 58357 - DNA, 91 bp, Homo sapiens; identical to SEQ ID NO: 37762
  chr19:55685239-55685330
  hyper

SEQ ID NO: 58358 - DNA, 630 bp, Homo sapiens; identical to SEQ ID NO: 37763
  chr19:55690528-55691158
  hyper

SEQ ID NO: 58359 - DNA, 30 bp, Homo sapiens; identical to SEQ ID NO: 37764
  chr19:55865272-55865302
  hyper

SEQ ID NO: 58360 - DNA, 237 bp, Homo sapiens; identical to SEQ ID NO: 37765
  chr19:55952667-55952904
  hyper

SEQ ID NO: 58361 - DNA, 746 bp, Homo sapiens; identical to SEQ ID NO: 37766
  chr19:55953773-55954519
  hyper

SEQ ID NO: 58362 - DNA, 35 bp, Homo sapiens; identical to SEQ ID NO: 37767
  chr19:55962393-55962428
  hyper

SEQ ID NO: 58363 - DNA, 160 bp, Homo sapiens; identical to SEQ ID NO: 37768
  chr19:55963107-55963267
  hyper

SEQ ID NO: 58364 - DNA, 147 bp, Homo sapiens; identical to SEQ ID NO: 37769
  chr19:55963577-55963724
  hyper

SEQ ID NO: 58365 - DNA, 53 bp, Homo sapiens; identical to SEQ ID NO: 37770
  chr19:56015184-56015237
  hyper

SEQ ID NO: 58366 - DNA, 30 bp, Homo sapiens; identical to SEQ ID NO: 37771
  chr19:56728573-56728603
  hyper

SEQ ID NO: 58367 - DNA, 20 bp, Homo sapiens
  chr19:56728658-56728678
  hyper
cgatgatgactccagctttc

SEQ ID NO: 58368 - DNA, 22 bp, Homo sapiens
  chr19:56879479-56879501
  hyper
ccacggccgaactcacgcctac

SEQ ID NO: 58369 - DNA, 193 bp, Homo sapiens; identical to SEQ ID NO: 1401
  chr19:56904511-56904704
  hyper

SEQ ID NO: 58370 - DNA, 17 bp, Homo sapiens
  chr19:56904723-56904740
  hyper
cgttcttctcaggcctg

SEQ ID NO: 58371 - DNA, 153 bp, Homo sapiens
  chr19:56905203-56905356
  hyper
ccgtcactgtgtgtgcgtgattttgacagtgtgtggtggtagcttctgactccgcgtgggtcgttgaatgtatgactgggaccgtttagcggtggatacacaactgtgtgcggctgtggaagattgcctcatccgttacgttcccatttccgt

SEQ ID NO: 58372 - DNA, 178 bp, Homo sapiens
  chr19:56915142-56915320
  hyper
gcccacgacagtgcccgatacagcaggcgctcaataagtggcgaatgaaagacagggcaaggcggagagagaagaaacagaaagggaaagagaaagcccgggccgccagagcgcttaatcacacgtacatcctaccgggcccctctccagctggctcaggctccacactggtcctcca

SEQ ID NO: 58373 - DNA, 222 bp, Homo sapiens; identical to SEQ ID NO: 23171
  chr19:56915428-56915650
  hyper

SEQ ID NO: 58374 - DNA, 284 bp, Homo sapiens; identical to SEQ ID NO: 37780
  chr19:56915651-56915935
  hyper

SEQ ID NO: 58375 - DNA, 89 bp, Homo sapiens
  chr19:56988468-56988557
  hyper
cgggccgagaacccacgcaggcgcgagcccaccgcccacgcaagcacccgcgcagacgcccacgccatcgtggatgcgcaaacccacgc

SEQ ID NO: 58376 - DNA, 138 bp, Homo sapiens; identical to SEQ ID NO: 37782
  chr19:56988963-56989101
  hyper

SEQ ID NO: 58377 - DNA, 4 bp, Homo sapiens
  chr19:56989524-56989528
  hyper
cagt

SEQ ID NO: 58378 - DNA, 261 bp, Homo sapiens; identical to SEQ ID NO: 37784
  chr19:57018744-57019005
  hyper

SEQ ID NO: 58379 - DNA, 500 bp, Homo sapiens; identical to SEQ ID NO: 37785
  chr19:57019006-57019506
  hyper

SEQ ID NO: 58380 - DNA, 30 bp, Homo sapiens; identical to SEQ ID NO: 37786
  chr19:57019931-57019961
  hyper

SEQ ID NO: 58381 - DNA, 30 bp, Homo sapiens; identical to SEQ ID NO: 37787
  chr19:57049841-57049871
  hyper

SEQ ID NO: 58382 - DNA, 238 bp, Homo sapiens; identical to SEQ ID NO: 37788
  chr19:57078361-57078599
  hyper

SEQ ID NO: 58383 - DNA, 251 bp, Homo sapiens; identical to SEQ ID NO: 37789
  chr19:57079002-57079253
  hyper

SEQ ID NO: 58384 - DNA, 5 bp, Homo sapiens
  chr19:57106546-57106551
  hyper
ccact

SEQ ID NO: 58385 - DNA, 21 bp, Homo sapiens
  chr19:57106588-57106609
  hyper
cgcgcgcgggtttctgggaag

SEQ ID NO: 58386 - DNA, 73 bp, Homo sapiens; identical to SEQ ID NO: 37792
  chr19:57106836-57106909
  hyper

SEQ ID NO: 58387 - DNA, 232 bp, Homo sapiens
  chr19:57149347-57149579
  hyper
agggctttccccaggcggatgggttctttgaaggagggggaaaaaaaaaagtcttctccagctattctgtgtagagcgtcagcaccaccgaacgctaatgcttgaatggtttagaactgcggacagctcacgccagacagattcagcaccacggacagcccccaaggcagctcgtgatgtgaatggttcagcaccgcagacagctcaagcctcgccggacagccctgctgga

SEQ ID NO: 58388 - DNA, 631 bp, Homo sapiens
  chr19:57154254-57154885
  hyper
ccgctggccttggggcgtctgtcgcagggtacctcgaacataacctacgtgctcatcagctagagatggaccagctcggtaccacacccccctgcaaccacgccgcgggtaccccgcctctgcggctcatccactcccttccccacgcgcctccaggtgcaggcttcccgggggtggaggaggggaggaggacacccacgctccccaattcccccacctcccatctcccacctccccccacccccccgcagcctccgcgtctgcgcagccgcagtcagtgcggcgccagctctgcagagcccagacagggtccggttggggagggtgagtccttcgagggacccccgcgggcgggaaggaggcggagaaaaggggctgggggcgcgggcggcgatccggggatgcgcgcgcgagtatggatgcgcagagggtgtgtgtgcctgggcgagggtgaggggcagaaccgctccagggatagggtccggggagagggcgtctccaagcccgtccggtgggagaggaccggggtctgtcggggtcgggtctgtttctccgcagcggaggtctgtgtcctggcttgggggttgcaggtgaattccagcctcctcgtgaggaggggagcacagacctg

SEQ ID NO: 58389 - DNA, 82 bp, Homo sapiens
  chr19:57182912-57182994
  hyper
acacctgcaggaacacgcgcacactacacaccgttgctctcgcctcccggtatcaccttcgaacgcgctggccggccccctc

SEQ ID NO: 58390 - DNA, 36 bp, Homo sapiens; identical to SEQ ID NO: 37796
  chr19:57276895-57276931
  hyper

SEQ ID NO: 58391 - DNA, 114 bp, Homo sapiens; identical to SEQ ID NO: 37797
  chr19:57610714-57610828
  hyper

SEQ ID NO: 58392 - DNA, 38 bp, Homo sapiens
  chr19:57617484-57617522
  hyper
ggcctccctgcatcccggagcgcactggggatgaggac

SEQ ID NO: 58393 - DNA, 49 bp, Homo sapiens
  chr19:57618121-57618170
  hyper
agccgctgggggttcggcccaccccgcgaaccgagctcccggccctgtg

SEQ ID NO: 58394 - DNA, 40 bp, Homo sapiens
  chr19:57683295-57683335
  hyper
gggcgcgagcgggggtccggggccgcgagctggggtccgg

SEQ ID NO: 58395 - DNA, 110 bp, Homo sapiens; identical to SEQ ID NO: 37802
  chr19:57683576-57683686
  hyper

SEQ ID NO: 58396 - DNA, 94 bp, Homo sapiens; identical to SEQ ID NO: 37803
  chr19:57683805-57683899
  hyper

SEQ ID NO: 58397 - DNA, 100 bp, Homo sapiens; identical to SEQ ID NO: 37804
  chr19:57703285-57703385
  hyper

SEQ ID NO: 58398 - DNA, 30 bp, Homo sapiens; identical to SEQ ID NO: 37805
  chr19:57832233-57832263
  hyper

SEQ ID NO: 58399 - DNA, 175 bp, Homo sapiens
  chr19:57862783-57862958
  hyper
ccatgacccctgtcgtgggacgggcggcctctcgcggaggtgtctgccggggctgggctcttaccgaggcctccacacacgtcctcttgtccttgtctcccccagaagcagccgccttagtcttgtgagcgtttttacaccgggtagattgagacttggagtgctacactcagcc

SEQ ID NO: 58400 - DNA, 15 bp, Homo sapiens
  chr19:57989033-57989048
  hyper
aacactagtaagcgg

SEQ ID NO: 58401 - DNA, 342 bp, Homo sapiens; identical to SEQ ID NO: 37809
  chr19:57998952-57999294
  hyper

SEQ ID NO: 58402 - DNA, 54 bp, Homo sapiens; identical to SEQ ID NO: 23187
  chr19:58011070-58011124
  hyper

SEQ ID NO: 58403 - DNA, 64 bp, Homo sapiens; identical to SEQ ID NO: 23188
  chr19:58011281-58011345
  hyper

SEQ ID NO: 58404 - DNA, 178 bp, Homo sapiens; identical to SEQ ID NO: 37811
  chr19:58011346-58011524
  hyper

SEQ ID NO: 58405 - DNA, 28 bp, Homo sapiens
  chr19:58038557-58038585
  hyper
attgagtcctcacagcgcggcggactgc

SEQ ID NO: 58406 - DNA, 154 bp, Homo sapiens; identical to SEQ ID NO: 23190
  chr19:58038969-58039123
  hyper

SEQ ID NO: 58407 - DNA, 204 bp, Homo sapiens; identical to SEQ ID NO: 37814
  chr19:58070569-58070773
  hyper

SEQ ID NO: 58408 - DNA, 303 bp, Homo sapiens; identical to SEQ ID NO: 37815
  chr19:58071094-58071397
  hyper

SEQ ID NO: 58409 - DNA, 45 bp, Homo sapiens
  chr19:58094961-58095006
  hyper
cagagcaggagcagccgggggcgcggcccccacgtggcctcccgg

SEQ ID NO: 58410 - DNA, 154 bp, Homo sapiens; identical to SEQ ID NO: 37818
  chr19:58111112-58111266
  hyper

SEQ ID NO: 58411 - DNA, 91 bp, Homo sapiens
  chr19:58111541-58111632
  hyper
cccgaaactgagggacgcgtgaagggttttctgcagcccggaccgcactgtccggcacagtgaggcgctggtgctggatctcgtttctggt

SEQ ID NO: 58412 - DNA, 81 bp, Homo sapiens
  chr19:58111783-58111864
  hyper
actgagtttcaccagcacactgagggccacagcgcgtaggacagaagaggggcacggccccagtcacgcttctaaaagttt

SEQ ID NO: 58413 - DNA, 122 bp, Homo sapiens; identical to SEQ ID NO: 23194
  chr19:58125422-58125544
  hyper

SEQ ID NO: 58414 - DNA, 172 bp, Homo sapiens
  chr19:58125881-58126053
  hyper
cctttcccagactttcgcccgccccaaatcctgaagttccaaatgaggagcgcctgtctgagtccctgcagcgcaggccccagtgtccaaggcagcggggcgctggtgggtgggggcgagtgtgactggcagaggggcagcctgagcataggtttggagctggactgagccc

SEQ ID NO: 58415 - DNA, 39 bp, Homo sapiens; identical to SEQ ID NO: 37821
  chr19:58126054-58126093
  hyper

SEQ ID NO: 58416 - DNA, 55 bp, Homo sapiens; identical to SEQ ID NO: 37822
  chr19:58144370-58144425
  hyper

SEQ ID NO: 58417 - DNA, 366 bp, Homo sapiens; identical to SEQ ID NO: 37823
  chr19:58175608-58175974
  hyper

SEQ ID NO: 58418 - DNA, 105 bp, Homo sapiens
  chr19:58239088-58239193
  hyper
gtagagtgtggttcccactgagctatccttcaaggcaggggattctcggcctgggctcttgggaaaactcgaagtaggagggccaagttgtttgggaaaagtaac

SEQ ID NO: 58419 - DNA, 371 bp, Homo sapiens; identical to SEQ ID NO: 37829
  chr19:58281000-58281371
  hyper

SEQ ID NO: 58420 - DNA, 30 bp, Homo sapiens; identical to SEQ ID NO: 37830
  chr19:58361192-58361222
  hyper

SEQ ID NO: 58421 - DNA, 29 bp, Homo sapiens
  chr19:58361543-58361572
  hyper
gtaggaacactgaggcgctcacaggaggc

SEQ ID NO: 58422 - DNA, 37 bp, Homo sapiens
  chr19:58400042-58400079
  hyper
tccgggctgcagagccgtgaacaggcgctgctacctc

SEQ ID NO: 58423 - DNA, 242 bp, Homo sapiens
  chr19:58400175-58400417
  hyper
cacgtggttttaagcagagtcgggaggatagggcgaccagccaggagatatgggcacgacggtccgtatcctggcccaggagtgggtcacgctgggcgccgtcacagagctccagagtagcctctgtgcagcggaggacaactgctccccgacttctgggttcagtcaccacagtgcggacctagcgctcaggagcctctcctacaaataaatccaacaccaatcaaaatggccgccaccag

SEQ ID NO: 58424 - DNA, 55 bp, Homo sapiens
  chr19:58400518-58400573
  hyper
tgggtaatgtagttccctaggcaacaaggagggtaaagggcgcaattcccagagg

SEQ ID NO: 58425 - DNA, 403 bp, Homo sapiens; identical to SEQ ID NO: 37833
  chr19:58446443-58446846
  hyper

SEQ ID NO: 58426 - DNA, 194 bp, Homo sapiens; identical to SEQ ID NO: 37834
  chr19:58458530-58458724
  hyper

SEQ ID NO: 58427 - DNA, 31 bp, Homo sapiens; identical to SEQ ID NO: 23202
  chr19:58459201-58459232
  hyper

SEQ ID NO: 58428 - DNA, 835 bp, Homo sapiens
  chr19:58513683-58514518
  hyper
tgcttccagagctcccgacccaaatttcctcctcaagaccgacgcggccgcgacgctgcaaaagctcgtcccggcctcacctggctcgcggccggcggtcccccttgaaggcggcgcagcaggatcggggtctgcccgcctggggcgtttggcttttgtcccgcgccgaggtccggcccaggagtgcgcttgggagctcccggcgcggcctcggggacaaaggcccgcggagccgacgtgcagcagagttcacccaggcccgtccgaccagaaaacgaagaacgcccggaggcgggaggccggaggcaggctgctggctggagaaccgacggcaacgacggcgcaaagccggcgcggaaagggcaggcgcaggacccaccctgacgccgcctctcccagccggctctcctgaccccccaagccccgcagctacggcggccccacagcctgagcaaaggcctcacctcagccgcggacaatggcggctgcttccccggcgtcgaccggagcgcgccgcggggtctgctgggagctgtagttccaggcgggcacttccggcgtcgggcagcggcgccgccatgacaggttcctgggccgcgccgcctcgccctgcctgggcggggttgggacctttctggcacctgcgtcgaagccggcggcaggatggactttgttgtcccggtcccagaccaccctcctccaccgtcgcctcccactgcaaaaaggcctgggtaagtcgcggccccgcgggcctcggtttgcccatccgcaaaatggcgcctcgtggtaccgggtttcccgggaggagctcggcgagttctcagcgctctcgagg

SEQ ID NO: 58429 - DNA, 159 bp, Homo sapiens
  chr19:58514552-58514711
  hyper
aagtgactgctgttattctctttaagataaggaacctaattcgagctacccttctctgtgaagctcgacggctgagaacgtcagggctcgttcccaagtctctttccagaggccaggctttatgggagcatgggttaccagcgacgcaccctgtgagtt

SEQ ID NO: 58430 - DNA, 12 bp, Homo sapiens
  chr19:58520941-58520953
  hyper
tctttggcatca

SEQ ID NO: 58431 - DNA, 48 bp, Homo sapiens; identical to SEQ ID NO: 37838
  chr19:58521268-58521316
  hyper

SEQ ID NO: 58432 - DNA, 45 bp, Homo sapiens
  chr19:58545100-58545145
  hyper
ggacactgtataaaacggttgcgtgtctggaatgccgtcgttttg

SEQ ID NO: 58433 - DNA, 60 bp, Homo sapiens; identical to SEQ ID NO: 37842
  chr19:58570949-58571009
  hyper

SEQ ID NO: 58434 - DNA, 147 bp, Homo sapiens
  chr19:58609854-58610001
  hyper
ggtgagaaacggagaaacaaagacaaaaagacgcgcagaccgggagggagagaagcatgaaggcccacagacgctcgggggcagaccaagacgccctggggtccccgaaacagagatgtacagagtcggacacggaaagggagagac

SEQ ID NO: 58435 - DNA, 30 bp, Homo sapiens; identical to SEQ ID NO: 37846
  chr19:58629357-58629387
  hyper

SEQ ID NO: 58436 - DNA, 250 bp, Homo sapiens
  chr19:58662094-58662344
  hyper
gctcagggatgcgtcggcacttacggttggcggccggcggcagccatgttccgggcgattgcgcttgcgcggctgccgggacaaggatgtgcgcgtgcgcggagtccccgagcttcccccgcccaacgctggggcggccgcgggtaccgggttattcattaccctggcgtggacttgcctcggggcggacgcgcaggcatttactttctcctatggtctcctctgatttttaacccgatgctatcattct

SEQ ID NO: 58437 - DNA, 182 bp, Homo sapiens; identical to SEQ ID NO: 23207
  chr19:58666313-58666495
  hyper

SEQ ID NO: 58438 - DNA, 183 bp, Homo sapiens; identical to SEQ ID NO: 13601
  chr19:58666550-58666733
  hyper

SEQ ID NO: 58439 - DNA, 703 bp, Homo sapiens; identical to SEQ ID NO: 37850
  chr19:58694552-58695255
  hyper

SEQ ID NO: 58440 - DNA, 179 bp, Homo sapiens; identical to SEQ ID NO: 37851
  chr19:58740209-58740388
  hyper

SEQ ID NO: 58441 - DNA, 203 bp, Homo sapiens
  chr19:58951068-58951271
  hyper
caggatcctgagggccggaatcccagcgggtgagggcctggggcacactccacttacctgcgccgggcccatcagcaacgctggcaaccccattagaacctgtgggctgggcagggccataacaggaggcccagggctagccctgccgctgggccgaaccctcacacttccgctgggtgacggtcgcactcaggacctgtctt

SEQ ID NO: 58442 - DNA, 142 bp, Homo sapiens; identical to SEQ ID NO: 23212
  chr19:58951916-58952058
  hyper

SEQ ID NO: 58443 - DNA, 63 bp, Homo sapiens
  chr20:291085-291148
  hyper
aaggggagttgggggcgagcgccgaaatctgagtggctctttcaagcctccgttgccatagaa

SEQ ID NO: 58444 - DNA, 107 bp, Homo sapiens
  chr20:590327-590434
  hyper
ggccgcagcgagggacgcagcacactcacccccttgcgctggttgctgaggcagaaggtgcagatggagcgcggctggcggccgccgtcggcggcggcggggacggc

SEQ ID NO: 58445 - DNA, 97 bp, Homo sapiens
  chr20:590502-590599
  hyper
cgttggccaggtgcgcgatgtagctggacgccaggcgcacggtctcgatcttggacagcttgcggtccaccggctcggtggggatgagcgtgcgcag

SEQ ID NO: 58446 - DNA, 108 bp, Homo sapiens; identical to SEQ ID NO: 37859
  chr20:590967-591075
  hyper

SEQ ID NO: 58447 - DNA, 111 bp, Homo sapiens
  chr20:592449-592560
  hyper
gctgggctttggggaggagggaaacagccagcatgggccccctccccgcagggctggtcccacacacagccccagaccaggctgctgcttcctgagccgatgaattattac

SEQ ID NO: 58448 - DNA, 39 bp, Homo sapiens; identical to SEQ ID NO: 23215
  chr20:644787-644826
  hyper

SEQ ID NO: 58449 - DNA, 369 bp, Homo sapiens; identical to SEQ ID NO: 37862
  chr20:644985-645354
  hyper

SEQ ID NO: 58450 - DNA, 139 bp, Homo sapiens; identical to SEQ ID NO: 13613
  chr20:656937-657076
  hyper

SEQ ID NO: 58451 - DNA, 36 bp, Homo sapiens; identical to SEQ ID NO: 37864
  chr20:690741-690777
  hyper

SEQ ID NO: 58452 - DNA, 96 bp, Homo sapiens; identical to SEQ ID NO: 37865
  chr20:708614-708710
  hyper

SEQ ID NO: 58453 - DNA, 30 bp, Homo sapiens; identical to SEQ ID NO: 37866
  chr20:866071-866101
  hyper

SEQ ID NO: 58454 - DNA, 78 bp, Homo sapiens
  chr20:982671-982749
  hyper
gcccccggtctgccccgcagcgcctgcccggccgccctgcccagccaccccttgtaccttgcttcttccttcggttca

SEQ ID NO: 58455 - DNA, 209 bp, Homo sapiens
  chr20:982989-983198
  hyper
gcggggaggagccggcgcggcgggggcggcgcgttaaccagctcggggcccgggagcgcgcgcggggagggggcgggggtcacccgggtcggggccctcgagttcgatctgtcccgcagccggcggtcttgcgtctttcccgcccccagcactgcccccgagcacgtgcacgtgcccaccgccagccacaggtacgcacgcgcgcgcag

SEQ ID NO: 58456 - DNA, 50 bp, Homo sapiens; identical to SEQ ID NO: 37869
  chr20:1206113-1206163
  hyper

SEQ ID NO: 58457 - DNA, 440 bp, Homo sapiens
  chr20:1783321-1783761
  hyper
tccaggcagtaggttcgccagccattgcttgtgcgtcttcgcggagagagaggggggagatgccccggcgctccttacccggctggataagaccctttggggaacttgctgcttcgcaagtcttacttgtgaggacccggagggtttgcctttgaccccgcctgtgaccttaagaaaacccctttctaccctgcgcctgtcccacagctggaagtgataattttaagaatgaattaagcactcggtgtgtgacactgcggcactaagcactttctggactgtgttaggccccattttacagacggggaagctgaggcctccagaggcggagtaacctgctcatggttacaaagctggtcagcggcgggcaggatttgaatccagggttcccggttcctaatcctctgcttttaccacttaatttatcctgcctccaaggg

SEQ ID NO: 58458 - DNA, 155 bp, Homo sapiens; identical to SEQ ID NO: 37871
  chr20:2187759-2187914
  hyper

SEQ ID NO: 58459 - DNA, 6 bp, Homo sapiens
  chr20:2668922-2668928
  hyper
gttctg

SEQ ID NO: 58460 - DNA, 16 bp, Homo sapiens
  chr20:2672984-2673000
  hyper
agtccaggcacaaggc

SEQ ID NO: 58461 - DNA, 59 bp, Homo sapiens; identical to SEQ ID NO: 37876
  chr20:2731616-2731675
  hyper

SEQ ID NO: 58462 - DNA, 89 bp, Homo sapiens
  chr20:2780664-2780753
  hyper
gggaactggggctgccgagtcagcagccattgctcccagcagggagttgagggagtgtgagtgtgtatatgtgtgtgtgcactgtgagt

SEQ ID NO: 58463 - DNA, 279 bp, Homo sapiens
  chr20:2781452-2781731
  hyper
tcctctccgccgtctggggccaacccgcctcgttggcgcgctgcgcctttatagtctgcaaagccacactgaagagaccagagatcacctggtggccatcaagtcgaccaacaggaggcaaagccccttatctgagcaattcagaatgacacttccctattgtctaaagccacatctggtaccaagcttccgtcccaagaatttataagtaactagaatttctgtacgtttccggaatgagtgcacgttaagacccattgtgcaaactttgctgacatc

SEQ ID NO: 58464 - DNA, 185 bp, Homo sapiens
  chr20:2781761-2781946
  hyper
tttaccatgacctaagtgactaatgtggtccaaattaccctgcagttccccgcagggagctcagtcctctcttgctgaagcgcctactgcgctctgctgcctcgtcctttccgtctaataaaactttccttttcagacctacacggttgttgataagttcttttaccacccgggagccaaccact

SEQ ID NO: 58465 - DNA, 44 bp, Homo sapiens
  chr20:2785615-2785659
  hyper
caccatcaccaagcccggccctgcccctcctctcctttcccttc

SEQ ID NO: 58466 - DNA, 69 bp, Homo sapiens; identical to SEQ ID NO: 37881
  chr20:2820792-2820861
  hyper

SEQ ID NO: 58467 - DNA, 138 bp, Homo sapiens; identical to SEQ ID NO: 37882
  chr20:2852976-2853114
  hyper

SEQ ID NO: 58468 - DNA, 59 bp, Homo sapiens
  chr20:3052524-3052583
  hyper
cggattttgacgccccgcccttgaccgcggtcgaggcccccacggcgccccagcgcgtc

SEQ ID NO: 58469 - DNA, 280 bp, Homo sapiens
  chr20:3052836-3053116
  hyper
aactacctgccgtcgccctgccagtccggccagaaggcgtgcgggagcgggggccgctgcgcggtcttgggcctctgctgcagcccgggtgagcggggcaaggcgctccggggccagggggaggcgggcgggggtgcggccgggattcccctgactccacctcttcctccagacggctgccacgccgaccctgcctgcgacgcggaagccaccttctcccagcgctgaaacttgatggctccgaacaccctcgaagcgcgccactcgcttcccccatagc

SEQ ID NO: 58470 - DNA, 266 bp, Homo sapiens; identical to SEQ ID NO: 37885
  chr20:3063125-3063391
  hyper

SEQ ID NO: 58471 - DNA, 185 bp, Homo sapiens; identical to SEQ ID NO: 37886
  chr20:3063622-3063807
  hyper

SEQ ID NO: 58472 - DNA, 141 bp, Homo sapiens; identical to SEQ ID NO: 37887
  chr20:3073251-3073392
  hyper

SEQ ID NO: 58473 - DNA, 113 bp, Homo sapiens
  chr20:3073899-3074012
  hyper
gtccacgtgtgagcctcgccctaggctgccaattgagagttccacctccgcccagagagaccccacctcacccctccaacctggggcgcgcgggccggcggaggggtcctggg

SEQ ID NO: 58474 - DNA, 133 bp, Homo sapiens; identical to SEQ ID NO: 37889
  chr20:3218701-3218834
  hyper

SEQ ID NO: 58475 - DNA, 70 bp, Homo sapiens
  chr20:3220823-3220893
  hyper
tcagccgcgctgggacggagtcctcggccactgtgccctaaccatggtagaggaacggggacaggccggg

SEQ ID NO: 58476 - DNA, 70 bp, Homo sapiens
  chr20:3220943-3221013
  hyper
atgcatagattgggtgagtaaggctggcccagttctcctcccggcaagataagaacgcattaggagggaa

SEQ ID NO: 58477 - DNA, 39 bp, Homo sapiens; identical to SEQ ID NO: 37891
  chr20:3229253-3229292
  hyper

SEQ ID NO: 58478 - DNA, 21 bp, Homo sapiens
  chr20:3229612-3229633
  hyper
gagaaccggcacccgtgcacg

SEQ ID NO: 58479 - DNA, 30 bp, Homo sapiens; identical to SEQ ID NO: 37893
  chr20:3388937-3388967
  hyper

SEQ ID NO: 58480 - DNA, 238 bp, Homo sapiens; identical to SEQ ID NO: 37894
  chr20:3641310-3641548
  hyper

SEQ ID NO: 58481 - DNA, 26 bp, Homo sapiens
  chr20:3641937-3641963
  hyper
tgggaaaggcgcggggaggctgcagg

SEQ ID NO: 58482 - DNA, 246 bp, Homo sapiens; identical to SEQ ID NO: 37896
  chr20:3662517-3662763
  hyper

SEQ ID NO: 58483 - DNA, 2 bp, Homo sapiens
  chr20:3663018-3663020
  hyper
ag

SEQ ID NO: 58484 - DNA, 146 bp, Homo sapiens; identical to SEQ ID NO: 37898
  chr20:3713305-3713451
  hyper

SEQ ID NO: 58485 - DNA, 821 bp, Homo sapiens; identical to SEQ ID NO: 37899
  chr20:3758266-3759087
  hyper

SEQ ID NO: 58486 - DNA, 48 bp, Homo sapiens; identical to SEQ ID NO: 37900
  chr20:3766983-3767031
  hyper

SEQ ID NO: 58487 - DNA, 154 bp, Homo sapiens; identical to SEQ ID NO: 37901
  chr20:4202578-4202732
  hyper

SEQ ID NO: 58488 - DNA, 10 bp, Homo sapiens
  chr20:4229392-4229402
  hyper
tcccccgcgg

SEQ ID NO: 58489 - DNA, 73 bp, Homo sapiens; identical to SEQ ID NO: 23238
  chr20:4229432-4229505
  hyper

SEQ ID NO: 58490 - DNA, 51 bp, Homo sapiens
  chr20:4229735-4229786
  hyper
tcctgtgacgcggagcgcggctgtccgagagcggagctgcctggcccgggc

SEQ ID NO: 58491 - DNA, 63 bp, Homo sapiens
  chr20:4803007-4803070
  hyper
ctctcccgaaaaacacgttctaggcgccgggattccagatacctgggaaatagagtgcacgca

SEQ ID NO: 58492 - DNA, 271 bp, Homo sapiens
  chr20:4803650-4803921
  hyper
tagaaggaggactagctccaagccacaactttcttcggacccaaggcaggccggctggggctccgcgcctacacggcccctggcgggggtccgcgcgccccgggagccccgcggctcggggaggaaagaggagacaagagacaggcgaggattacggggctgacccagccggggtagggaccatcgtggaaaaactttggcgaggtggggggacgcggaaagagagcggcccgcgccctgcaccttgcgccgggcatcccgcgccagtgcc

SEQ ID NO: 58493 - DNA, 30 bp, Homo sapiens; identical to SEQ ID NO: 37905
  chr20:4981307-4981337
  hyper

SEQ ID NO: 58494 - DNA, 148 bp, Homo sapiens; identical to SEQ ID NO: 23240
  chr20:5296900-5297048
  hyper

SEQ ID NO: 58495 - DNA, 65 bp, Homo sapiens; identical to SEQ ID NO: 37908
  chr20:5297672-5297737
  hyper

SEQ ID NO: 58496 - DNA, 180 bp, Homo sapiens; identical to SEQ ID NO: 37909
  chr20:5892057-5892237
  hyper

SEQ ID NO: 58497 - DNA, 495 bp, Homo sapiens; identical to SEQ ID NO: 37910
  chr20:6032710-6033205
  hyper

SEQ ID NO: 58498 - DNA, 256 bp, Homo sapiens; identical to SEQ ID NO: 13649
  chr20:6033206-6033462
  hyper

SEQ ID NO: 58499 - DNA, 76 bp, Homo sapiens; identical to SEQ ID NO: 37912
  chr20:6103795-6103871
  hyper

SEQ ID NO: 58500 - DNA, 141 bp, Homo sapiens
  chr20:6748784-6748925
  hyper
gagagcacagccacccgcctcggcggcccgggactcggctcgactcgccggagaatgcgcccgaggacgacggggcgccagagccgcggtgctttcaactggcgagcgcgaatgggggtgcactggagtaaggcagagtga

SEQ ID NO: 58501 - DNA, 113 bp, Homo sapiens
  chr20:8112265-8112378
  hyper
actcaaggagaggagcgggagagggcaccctctttcttcctcggaaaataaaacctttgctttctttaggatgggctttctgtctcgaaagcacaacgtaaccgtttgcccgg

SEQ ID NO: 58502 - DNA, 331 bp, Homo sapiens
  chr20:8112408-8112739
  hyper
ggcgcggccaggtttcctcaaagagcctctcaactgcgctcttctctgctgataaatgataattctcttcaaaaagctggtttgtggctggcgctggagagctccagctagagccaaaagccaggggttgcctctttggttcctcccgatgggccccttttcccagccagttgggatccaaagacgctccggagctcgagcccaaattcccaagaaaaccccaaagagcgtaaggctcctggggacccctagcacctctgcaaccagggcacggggcatgctcagagcgaatgcgggaggcaggcgttggctgcaatggggctcgggagcc

SEQ ID NO: 58503 - DNA, 269 bp, Homo sapiens
  chr20:8113288-8113557
  hyper
atgagcccagatggccggggctcaacccggagtgcacgccttgcaactcaagcccgtgtgcgtgtccgacagcctcaagaagggcaccaaattcgtcaagtgggatgatgtaagtattggggcggcccgagtcggggcgctggctcgggcaccgggcagggcgggcgtcgtgggggtggggcaaggggcgcgttatgcaatgggcgcactgggagcgggcaggggcagcctcgggcgcacaggttggcatctgccaaagcggatgtcca

SEQ ID NO: 58504 - DNA, 39 bp, Homo sapiens
  chr20:8113605-8113644
  hyper
gccatcctttctgggtctggcaggcgccccctgagggtc

SEQ ID NO: 58505 - DNA, 30 bp, Homo sapiens; identical to SEQ ID NO: 37916
  chr20:8113912-8113942
  hyper

SEQ ID NO: 58506 - DNA, 50 bp, Homo sapiens; identical to SEQ ID NO: 37917
  chr20:9487096-9487146
  hyper

SEQ ID NO: 58507 - DNA, 81 bp, Homo sapiens; identical to SEQ ID NO: 37918
  chr20:9487211-9487292
  hyper

SEQ ID NO: 58508 - DNA, 48 bp, Homo sapiens
  chr20:9488328-9488376
  hyper
cgcacctggcgggctggaccgggacagggggcggtgcgcaccggggct

SEQ ID NO: 58509 - DNA, 8 bp, Homo sapiens
  chr20:9489708-9489716
  hyper
gcccaggg

SEQ ID NO: 58510 - DNA, 13 bp, Homo sapiens
  chr20:9495258-9495271
  hyper
ccgtggaccgccg

SEQ ID NO: 58511 - DNA, 63 bp, Homo sapiens
  chr20:9495509-9495572
  hyper
aaggaagaggggtccccagcatcgacagacttcgagttctcctgatgttgttccgtgagtagc

SEQ ID NO: 58512 - DNA, 4 bp, Homo sapiens
  chr20:9495573-9495577
  hyper
attt

SEQ ID NO: 58513 - DNA, 30 bp, Homo sapiens; identical to SEQ ID NO: 13658
  chr20:9496079-9496109
  hyper

SEQ ID NO: 58514 - DNA, 5 bp, Homo sapiens
  chr20:9819319-9819324
  hyper
tgctc

SEQ ID NO: 58515 - DNA, 248 bp, Homo sapiens; identical to SEQ ID NO: 37929
  chr20:9819466-9819714
  hyper

SEQ ID NO: 58516 - DNA, 131 bp, Homo sapiens; identical to SEQ ID NO: 23249
  chr20:10198600-10198731
  hyper

SEQ ID NO: 58517 - DNA, 10 bp, Homo sapiens
  chr20:10198945-10198955
  hyper
atgcccctac

SEQ ID NO: 58518 - DNA, 313 bp, Homo sapiens; identical to SEQ ID NO: 37932
  chr20:10199315-10199628
  hyper

SEQ ID NO: 58519 - DNA, 37 bp, Homo sapiens; identical to SEQ ID NO: 13664
  chr20:10200078-10200115
  hyper

SEQ ID NO: 58520 - DNA, 43 bp, Homo sapiens; identical to SEQ ID NO: 37934
  chr20:10200153-10200196
  hyper

SEQ ID NO: 58521 - DNA, 43 bp, Homo sapiens
  chr20:13200556-13200599
  hyper
taaatctttctaggacgcggagaaggaaggtaggaaattgggg

SEQ ID NO: 58522 - DNA, 367 bp, Homo sapiens; identical to SEQ ID NO: 37936
  chr20:13201198-13201565
  hyper

SEQ ID NO: 58523 - DNA, 30 bp, Homo sapiens; identical to SEQ ID NO: 37937
  chr20:13202494-13202524
  hyper

SEQ ID NO: 58524 - DNA, 41 bp, Homo sapiens; identical to SEQ ID NO: 37939
  chr20:17206884-17206925
  hyper

SEQ ID NO: 58525 - DNA, 250 bp, Homo sapiens; identical to SEQ ID NO: 37940
  chr20:17207260-17207510
  hyper

SEQ ID NO: 58526 - DNA, 196 bp, Homo sapiens
  chr20:17208389-17208585
  hyper
caggatgccatgctccggggatgctgtccgaggtaccaagttctcgaggctgcctggggatggagggatgaagccctgaacagctaagcctggcgttggctacttggccagggaagtctcccccacccccatcccccggagaaagaatagtttcctacagacgaggctggacgtttggacactgcaattcacctcg

SEQ ID NO: 58527 - DNA, 37 bp, Homo sapiens; identical to SEQ ID NO: 23253
  chr20:17208620-17208657
  hyper

SEQ ID NO: 58528 - DNA, 64 bp, Homo sapiens; identical to SEQ ID NO: 13668
  chr20:17208739-17208803
  hyper

SEQ ID NO: 58529 - DNA, 40 bp, Homo sapiens; identical to SEQ ID NO: 37944
  chr20:17209595-17209635
  hyper

SEQ ID NO: 58530 - DNA, 39 bp, Homo sapiens; identical to SEQ ID NO: 37945
  chr20:17919829-17919868
  hyper

SEQ ID NO: 58531 - DNA, 176 bp, Homo sapiens
  chr20:18039647-18039823
  hyper
agctgccgggtgctgcgggggcgcgtctggtcagggatgccctggagcccaaggctcacccaacagccagcctcacctgtctgtaacctgaccctccgcgctcccagcctacagggcccgggaatcaacacagcggttttccctgttcccttccgccctgaatggcccttggggac

SEQ ID NO: 58532 - DNA, 39 bp, Homo sapiens
  chr20:18039897-18039936
  hyper
ccggggctgcgggcgggaccggtgcgcggcgcctctagg

SEQ ID NO: 58533 - DNA, 57 bp, Homo sapiens; identical to SEQ ID NO: 13669
  chr20:19192824-19192881
  hyper

SEQ ID NO: 58534 - DNA, 257 bp, Homo sapiens; identical to SEQ ID NO: 37948
  chr20:19193359-19193616
  hyper

SEQ ID NO: 58535 - DNA, 111 bp, Homo sapiens; identical to SEQ ID NO: 37949
  chr20:19739455-19739566
  hyper

SEQ ID NO: 58536 - DNA, 90 bp, Homo sapiens
  chr20:19739696-19739786
  hyper
ttggcctccacccttggcctgggctcccaccagctcggcgtccacccaccggcggtggcgcgcccctcgaccgcgcggggacagcaggat

SEQ ID NO: 58537 - DNA, 96 bp, Homo sapiens
  chr20:20344402-20344498
  hyper
tcctcctgcggcaggcgaggcggggtgcaggtgtgagtggggtgggaggaaggggaaaggatcggggtcgccgcagcctttctggtcagtttcgct

SEQ ID NO: 58538 - DNA, 871 bp, Homo sapiens
  chr20:20344559-20345430
  hyper
ggtggaggacacctcttgcgccccaaggtcaatgtcatcccgatgggtcccgtgccgtcctgactctccctgacctaattctttggttatgactttctcaccttctgggcttcgcctctgccagctttcgccgacgtcgcccttcccgccgcccgcccgggccttcctacccgctctcctccctccctggcccgacggtcccactgaggcaaaaacaaacagccctgagggcacttcaaggagcgtgcagtggccccgacggtactctcggggggataaaagaggtggccagccacgccgtcggcccccggccgaataatgggcgcgcagcagattgccagggggcacttgaaactcgaggggagggaaatacttgagcgcggtccctccccgcgaggacgcacgacgcagcctcgcggatcgtcccttgttcgctctctttcatgcactctccttttgtgtggaattatctaaacgggagatccctggcagctttatgctaatgcgccgaacaaaggcaacggcccgcgggcgggaggcccggaaggtgcctggggccgggccgggcggggtggcggccaggcgggctgcgcgtgtctctcgcgtgcccctgggactgacacaacaacccctcattcctgcaaatacaaagcctctcaccggctcgggtcgggcgcacccggcgcagggaggcgctggtccctccgggcggcgggcactgcagcggtaacgcacggttcctgccggttgtggctcgggggactgagggccgggagtgggggcttctgtgaagccagaagagaagtctgcagcagagtggtgatgaggggcgctgacacctcacccccaacgccgacgtctccaaacgcga

SEQ ID NO: 58539 - DNA, 10 bp, Homo sapiens
  chr20:20346166-20346176
  hyper
gggtggtgaa

SEQ ID NO: 58540 - DNA, 127 bp, Homo sapiens; identical to SEQ ID NO: 23259
  chr20:20347333-20347460
  hyper

SEQ ID NO: 58541 - DNA, 68 bp, Homo sapiens; identical to SEQ ID NO: 23260
  chr20:20348154-20348222
  hyper

SEQ ID NO: 58542 - DNA, 28 bp, Homo sapiens
  chr20:20348257-20348285
  hyper
cggctccggctcgcggattgaaccctcc

SEQ ID NO: 58543 - DNA, 388 bp, Homo sapiens
  chr20:20348765-20349153
  hyper
ggcgcagagctgggccgagccgtcgccggcgccacgcgagtcccgcagccgccgcgcccgggcaatgggccgggggcactgagggccgccggggccgagcgcggaggggggaccgagccagtgccgtgccctcgggccgcgccaacatgccccgcggcttcctggtgaagcgcagcaagaagtccacgcccgtttcctaccgggtccgcggcggcgaggacggcgaccgcgcactgctgctctcgcccagctgcgggggcgcccgcgccgagcccccggcgccgagcccggtccccgggccgctgccgccgccgccgcccgcggagcgcgcccatgcagcgctcgccgccgcgcttgcctgcgcgcctgggccgcagccacccccgca

SEQ ID NO: 58544 - DNA, 319 bp, Homo sapiens
  chr20:20349255-20349574
  hyper
cttcgaacgcagcttcaacctgggctcgccggtctcggccgagtccttccccacgcccgccgcgctgctcggagggggcggcggcggcggcgcgagcggagctggcggaggcggcacctgcggcggcgacccgctgctcttcgcgcccgccgagctcaagatgggcacggcgttctcggctggcgccgaggcggcccgcggcccgggccccggccccccactgccccctgccgccgccctgcggcccccgggaaagcggcccccgccccctaccgccgcggagccgcccgccaaggcagtcaaggccccgggcgccaag

SEQ ID NO: 58545 - DNA, 942 bp, Homo sapiens
  chr20:20349604-20350546
  hyper
gaggacgaggtgaccacgtcgcccgtgctggggctcaagatcaaggagggcccggtggaggcgccgcggggccgcgcggggggcgcggcgcggccgctgggcgagttcatctgccagctgtgcaaggaggagtacgccgacccgttcgcgctggcgcagcacaaatgctcgcgcatcgtgcgtgtggagtaccgctgtcccgagtgcgccaaggtcttcagctgcccggccaacctggcctcgcaccgccgctggcacaaaccgcggcccgcgcccgccgccgcccgcgcgccggagccagaagcagcagccagggctgaggcgcgggaggcacccggcggcggcagcgaccgggacacgccgagccccggcggcgtgtccgagtcgggctccgaggacgggctctacgagtgccatcactgcgccaagaagttccgccgccaggcctacctacgcaagcacctgctggcgcaccaccaggcgctgcaggccaagggcgcgccgctagcgcccccggccgaggacctactggccttgtaccccgggcccgacgagaaggcgccccaggaggcggccggcgacggcgagggggccggcgtgctgggcctgagtgcgtccgccgagtgccacctgtgcccagtgtgcggagagtcgttcgccagcaagggcgctcaggagcgccacctgcgcctgctgcacgccgcccaggtgttcccctgcaagtactgcccggccaccttctacagctcgcccggccttacgcggcacatcaacaagtgccacccatccgaaaacagacaggtgatcctcctgcaggtgcccgtgcgcccggcctgctagagcgcgccctccaccccggcccccgaactgtgccttcgcttggagacccacaaagagagtgcgccctgcactccccgaacccgagtccgcgctgggggagcc

SEQ ID NO: 58546 - DNA, 60 bp, Homo sapiens
  chr20:21080654-21080714
  hyper
gcaaattctgacctccgatggcgcctatcaattaccccgcccgcagtgaaagcgaaagcg

SEQ ID NO: 58547 - DNA, 279 bp, Homo sapiens; identical to SEQ ID NO: 23266
  chr20:21082253-21082532
  hyper

SEQ ID NO: 58548 - DNA, 365 bp, Homo sapiens
  chr20:21082917-21083282
  hyper
aaaagatcctggagctaaagcctgcgcctacaccagagaggggaatttaagtttcccactctcgacgtgtctggaaccttccctctagccgcatacccacaaccccctgctccctggctcctcccagtgtcaaggaaggagaaagactcccaccctgtccccaaagtctcagactaactcgctccaggtcacaggacccactaagagggcctttccagctcatgcccggaacaggggtgcagcggcgaccctctgggatctggagagagagaatttaacacggccttcctgaagtacattcacgcaaatgtgagaaagacttcaacgcacagaatcgccaaagcccttgccgtcttaaataaatc

SEQ ID NO: 58549 - DNA, 109 bp, Homo sapiens
  chr20:21084361-21084470
  hyper
atgtgcgccaactcgcgctctggagacaggaaaaggtagcaccgctggcgtcctggcacgtcgagcgaacaatgccaccccacgcgtcactgatcgactcatcttgcag

SEQ ID NO: 58550 - DNA, 56 bp, Homo sapiens
  chr20:21085775-21085831
  hyper
ctgggttcagcccaccgggtcccctttcgaatgccatttcccagctgaaaatccag

SEQ ID NO: 58551 - DNA, 288 bp, Homo sapiens; identical to SEQ ID NO: 23269
  chr20:21085864-21086152
  hyper

SEQ ID NO: 58552 - DNA, 173 bp, Homo sapiens
  chr20:21086451-21086624
  hyper
ctccctcttcccccggacctgcctgaaccccgccgagcactaggcaaggccgggctctgcgggctggggaaaagaaggggcttggggtggcccaacccgaccgccacctcggcccggcctgcggggaaaccccacaaagtcaaggcgcggggcggggtcggggggatgggatc

SEQ ID NO: 58553 - DNA, 20 bp, Homo sapiens
  chr20:21372154-21372174
  hyper
ccgcgacctcgcagccgggg

SEQ ID NO: 58554 - DNA, 6 bp, Homo sapiens
  chr20:21372725-21372731
  hyper
ctattc

SEQ ID NO: 58555 - DNA, 43 bp, Homo sapiens; identical to SEQ ID NO: 23271
  chr20:21376207-21376250
  hyper

SEQ ID NO: 58556 - DNA, 106 bp, Homo sapiens
  chr20:21378551-21378657
  hyper
tataattgcggaatggggaacgtgctgctaagtttggggggagggtgttgcgggggcttgcttcgtcctctccagttatcagcccctcattcgctccatcacctaa

SEQ ID NO: 58557 - DNA, 445 bp, Homo sapiens
  chr20:21485930-21486375
  hyper
ctcgcggagacatctcgagtcccgcaggtgtctgagctgcgctgcgcgccccagccgggaagccttttcttatccaaccgcgccgccccgcggaaagcctgggtactgcagacgccctcaccggcccaccgacagctggttttgaagcgggggcttagaaaagtaaaggggacagtgtttggagccacgatgcctttgatgtgaggcggttccacccaacaatcaacgaatcaagctggaactgcaggccctacttttgttggggggaggaccttaaggaatgtcacccccttgtcccctaccctctgccccacgcccagcctctcagaaggcaccaggcgtgagtagagtgcgaggcgtccacaccctcgtgtcccttccattcccggacacctttgcaccctagccgaggcctcagcacggagtgagggttgcctggggtgcc

SEQ ID NO: 58558 - DNA, 36 bp, Homo sapiens; identical to SEQ ID NO: 23274
  chr20:21486881-21486917
  hyper

SEQ ID NO: 58559 - DNA, 199 bp, Homo sapiens; identical to SEQ ID NO: 23275
  chr20:21486954-21487153
  hyper

SEQ ID NO: 58560 - DNA, 163 bp, Homo sapiens
  chr20:21488351-21488514
  hyper
tttctgaagtggtttcccatcgcaccaagaggccagtgggatggatccccgcgcataattcaaaggaacgcgcgcgtctttagctcttcggggttggtaaccaagtggtccggccgggcgcaagtcgccttggaaccggctgcagcccaagtctagctgggcc

SEQ ID NO: 58561 - DNA, 206 bp, Homo sapiens; identical to SEQ ID NO: 37976
  chr20:21488591-21488797
  hyper

SEQ ID NO: 58562 - DNA, 57 bp, Homo sapiens; identical to SEQ ID NO: 37977
  chr20:21488998-21489055
  hyper

SEQ ID NO: 58563 - DNA, 107 bp, Homo sapiens; identical to SEQ ID NO: 37982
  chr20:21491616-21491723
  hyper

SEQ ID NO: 58564 - DNA, 111 bp, Homo sapiens; identical to SEQ ID NO: 37984
  chr20:21492990-21493101
  hyper

SEQ ID NO: 58565 - DNA, 206 bp, Homo sapiens
  chr20:21493102-21493308
  hyper
ccccggcagccagaccgtgcactggggggagggggagagagaagcgcgtcaggcgtctggaggccgcgcgcagcctgcaccagactcggagcaccctggatcctccgtgcgaccctggacctccgcgcctggcagcccagccccgctgcctttgccatgacccctgccttcctctacgcctgacgaagacgtcgggacctcccagg

SEQ ID NO: 58566 - DNA, 171 bp, Homo sapiens
  chr20:21494360-21494531
  hyper
cgtggcgctcccctgccccggcgggcgggggaggggggagttggggggagggactgggggaggggaggggggaattggctttaattattgggataattattatttttaaaaagagaaagaaactggggatggggaggaaaaaaatgaagcccaacccagtgcctctctctg

SEQ ID NO: 58567 - DNA, 73 bp, Homo sapiens
  chr20:21494703-21494776
  hyper
ccattgcccgagcgatcagtccatataaggctgggctccactcacgaacctggggaggcggggagagggggag

SEQ ID NO: 58568 - DNA, 51 bp, Homo sapiens; identical to SEQ ID NO: 37987
  chr20:21494991-21495042
  hyper

SEQ ID NO: 58569 - DNA, 274 bp, Homo sapiens
  chr20:21495986-21496260
  hyper
cgatgcctcgttttctccccagttttcttctcccacgcgagttctttagtgtggtctctttttggacgccttgggtgcgttcggagtacgcgctccacgtttccaggttaagtcaggttagtgtgaagtttccagccactctcggctctgggaactgaactttcccgggacttgcacttcctcctcggcgctggggttggaaaagaccacgccgcatttgccaccccttcttctagttaaaacttttttggggggggggtgcaggggtgtagat

SEQ ID NO: 58570 - DNA, 184 bp, Homo sapiens
  chr20:21496294-21496478
  hyper
tcaggaaggagctttgtctgggggcggggaggggcacagaaggccacccctgcggggtccaggtctagtcttcccacaacctgggctcctccgcgcgggccaagctgagcgcgcgggcaccgggtcctcctcgcgcgcagctgcagcggacgccgccgcgccccagctgcccccgggttgccag

SEQ ID NO: 58571 - DNA, 297 bp, Homo sapiens
  chr20:21498638-21498935
  hyper
aattctttccaggtaccgtcttgcacccaagcgagttcaatgtcctccgttccgtcaagtttgggtttgagctttgggctcagctgccgtggtctggagacctcgtaggcactctgcaagatgcctcgttctgctgcatgcttggggaggaagttgagctgggtgctggaagttctgaacccagcatgccccgggccggaggagatttgcttggtgtctccttagcgtcccgaacaccgcgcgcccctgctggggtaacctgaacagctggacccctcaactcgatctttattatca

SEQ ID NO: 58572 - DNA, 253 bp, Homo sapiens; identical to SEQ ID NO: 37991
  chr20:21499324-21499577
  hyper

SEQ ID NO: 58573 - DNA, 217 bp, Homo sapiens
  chr20:21500134-21500351
  hyper
aaatcaatggggaaggaaaatgtcacccaatctggtccctgagtgtggcgataaagacgttcaccttaaggatggcatctccaaaacagccccactttggcttcgacttccaatgcgggagcaggggctgcaggaagcagaggtgtcagctctcacgtcctggatgaaagaaataggggaatgcaccccaggagtactaccccgtgctgggaccttt

SEQ ID NO: 58574 - DNA, 313 bp, Homo sapiens
  chr20:21501724-21502037
  hyper
ctaagggctggttccgggaaggacagggaatgcacccttgggccctcgggcacagagagggggttcctagggctctgtctctctctctccaatgtgagccccagaggttcacaaccttcccctagacgcaacgtcccctttccacccccaagagccactaaagtcgagaaggcgccagaggagctccaaagggcctcctggtagtgtgtgcgtgtgtgttgtgggaggaggttggggcggagggggcgcccctcggagacaaggaccccaccgaggttcatttctgatcctctggcgatctctactgacacaa

SEQ ID NO: 58575 - DNA, 147 bp, Homo sapiens; identical to SEQ ID NO: 23283
  chr20:21502443-21502590
  hyper

SEQ ID NO: 58576 - DNA, 125 bp, Homo sapiens; identical to SEQ ID NO: 23284
  chr20:21503773-21503898
  hyper

SEQ ID NO: 58577 - DNA, 45 bp, Homo sapiens; identical to SEQ ID NO: 37997
  chr20:21503899-21503944
  hyper

SEQ ID NO: 58578 - DNA, 38 bp, Homo sapiens
  chr20:21682361-21682399
  hyper
cgcggagtttcgttgtgttgttacacaagccagctttt

SEQ ID NO: 58579 - DNA, 39 bp, Homo sapiens; identical to SEQ ID NO: 37999
  chr20:21682946-21682985
  hyper

SEQ ID NO: 58580 - DNA, 121 bp, Homo sapiens; identical to SEQ ID NO: 23286
  chr20:21683651-21683772
  hyper

SEQ ID NO: 58581 - DNA, 17 bp, Homo sapiens
  chr20:21683899-21683916
  hyper
cgcggactctgctaccg

SEQ ID NO: 58582 - DNA, 28 bp, Homo sapiens
  chr20:21684347-21684375
  hyper
cgtccccactccccgcacccccggagcc

SEQ ID NO: 58583 - DNA, 30 bp, Homo sapiens; identical to SEQ ID NO: 38003
  chr20:21685666-21685696
  hyper

SEQ ID NO: 58584 - DNA, 51 bp, Homo sapiens; identical to SEQ ID NO: 23288
  chr20:21686184-21686235
  hyper

SEQ ID NO: 58585 - DNA, 52 bp, Homo sapiens
  chr20:21686677-21686729
  hyper
ggtgggtcgggtccgcctgcctcccttccctctcgtccgctttccctgggcg

SEQ ID NO: 58586 - DNA, 45 bp, Homo sapiens; identical to SEQ ID NO: 38007
  chr20:21687755-21687800
  hyper

SEQ ID NO: 58587 - DNA, 44 bp, Homo sapiens
  chr20:21689912-21689956
  hyper
ggcctccaaccagcacggcgtgtacagcgccccgggcggcggct

SEQ ID NO: 58588 - DNA, 30 bp, Homo sapiens; identical to SEQ ID NO: 38009
  chr20:21693467-21693497
  hyper

SEQ ID NO: 58589 - DNA, 65 bp, Homo sapiens
  chr20:21694434-21694499
  hyper
ccacaggtcccaggacgtgctgtgcccacagtggtgagcgcatctggatccccggacctcgtggg

SEQ ID NO: 58590 - DNA, 46 bp, Homo sapiens
  chr20:21694529-21694575
  hyper
caactgcctcctacgtcggaggaatccaggccgctccagggaaatc

SEQ ID NO: 58591 - DNA, 77 bp, Homo sapiens
  chr20:21748368-21748445
  hyper
ttaatgggtgtccctcggagaggccgcacccgggagaaagcgctgacgcctccgacccagctccgcgcacagcggcg

SEQ ID NO: 58592 - DNA, 25 bp, Homo sapiens
  chr20:21748491-21748516
  hyper
ccctcaaatgcgtgtttgccctgct

SEQ ID NO: 58593 - DNA, 172 bp, Homo sapiens
  chr20:22557675-22557847
  hyper
acgggaggcattaattatttaaaaacgattagccttgccgtgtgtcctgcaggcgtcccatcatgttcagcgaagataaccagccacccgaggcgagccggggctcggagggcggcgggcgcgctccccagcaggcttcgggtgcggtggacacgggcgcacagcccaaggc

SEQ ID NO: 58594 - DNA, 10 bp, Homo sapiens
  chr20:22558627-22558637
  hyper
agttgagact

SEQ ID NO: 58595 - DNA, 27 bp, Homo sapiens
  chr20:22558669-22558696
  hyper
gtcaccatgctccggcctcagcctctt

SEQ ID NO: 58596 - DNA, 104 bp, Homo sapiens; identical to SEQ ID NO: 38015
  chr20:22559138-22559242
  hyper

SEQ ID NO: 58597 - DNA, 13 bp, Homo sapiens
  chr20:22559632-22559645
  hyper
gaaagcgcgcagt

SEQ ID NO: 58598 - DNA, 22 bp, Homo sapiens
  chr20:22559690-22559712
  hyper
atttaagcgggaggggggcgtg

SEQ ID NO: 58599 - DNA, 169 bp, Homo sapiens; identical to SEQ ID NO: 38018
  chr20:22559973-22560142
  hyper

SEQ ID NO: 58600 - DNA, 97 bp, Homo sapiens; identical to SEQ ID NO: 38019
  chr20:22560398-22560495
  hyper

SEQ ID NO: 58601 - DNA, 118 bp, Homo sapiens
  chr20:22562603-22562721
  hyper
caggcatgggggaaccgtagccggggtagtgcatcacctgttcgtaggccttgaggtccattttgtggggttggtggtggtggtggctgtggtggtgctgctgctccgaggacatgag

SEQ ID NO: 58602 - DNA, 46 bp, Homo sapiens
  chr20:22562840-22562886
  hyper
gcccgggagagggcgccggctctggggggctcagcgccgcagccgg

SEQ ID NO: 58603 - DNA, 211 bp, Homo sapiens; identical to SEQ ID NO: 38021
  chr20:22567354-22567565
  hyper

SEQ ID NO: 58604 - DNA, 133 bp, Homo sapiens; identical to SEQ ID NO: 38022
  chr20:22567605-22567738
  hyper

SEQ ID NO: 58605 - DNA, 75 bp, Homo sapiens; identical to SEQ ID NO: 38023
  chr20:23029003-23029078
  hyper

SEQ ID NO: 58606 - DNA, 30 bp, Homo sapiens; identical to SEQ ID NO: 13739
  chr20:23030745-23030775
  hyper

SEQ ID NO: 58607 - DNA, 45 bp, Homo sapiens; identical to SEQ ID NO: 38028
  chr20:23031034-23031079
  hyper

SEQ ID NO: 58608 - DNA, 255 bp, Homo sapiens
  chr20:23031293-23031548
  hyper
atttcgtccagagtccgaattgatacccacgtgcatagaaacgccacttgctcggcaaagggcactgaagagccaccgtcctgtggatgggcagggtggggggggggctggaggaggacatgggaatccgtcactttcgacctcttccggtggttcacttaccgggaatgcggaagagtgggtctccccctcgggtcgcccccataatggtgagaggcaaactgtttaaaaacacccttgcctctctcctctact

SEQ ID NO: 58609 - DNA, 102 bp, Homo sapiens; identical to SEQ ID NO: 38030
  chr20:24449601-24449703
  hyper

SEQ ID NO: 58610 - DNA, 472 bp, Homo sapiens
  chr20:24449759-24450231
  hyper
cgggcagcaaattcctgtcctcctagtcccccgcagctatcccccgcccccagcctctgtggccctcacattgtcagacactggccgcgggccaccatctggacgcgatcccccgctagggcctccctggtctgggccaaagttggtggccaccttcgcgcgggctgcgccctccttctcttccctgccctcctcccccggggcccgcgcccgctgcctccagcacgcgcgtcggcaggctcggcaagcgaagaggagcggctcgccccagggcgcccctcgcccagcctgccggccaggcgagcgcgacgagagtctccccgcaccccttcctctcccgggggccgagagggttgggctccgccccggcgccgcagctcccgactccccgccgctcgggctgccgccgctgccccgcgcccggcgctcggggcagccgggggcgcaggcggagagcgcagggcggggagag

SEQ ID NO: 58611 - DNA, 191 bp, Homo sapiens; identical to SEQ ID NO: 23298
  chr20:24450513-24450704
  hyper

SEQ ID NO: 58612 - DNA, 65 bp, Homo sapiens
  chr20:24451019-24451084
  hyper
ctggagcctctttcctctagccaggacaagacctgccttcaaaagctgtctggcccctggcagcc

SEQ ID NO: 58613 - DNA, 52 bp, Homo sapiens; identical to SEQ ID NO: 38033
  chr20:24451085-24451137
  hyper

SEQ ID NO: 58614 - DNA, 38 bp, Homo sapiens
  chr20:24451412-24451450
  hyper
gggggtttcgttgcacgcagaggcttgggcgcttggca

SEQ ID NO: 58615 - DNA, 429 bp, Homo sapiens
  chr20:24451592-24452021
  hyper
ttgggggtgtcgaggggaggggggctgggcgttacacagtggctccgttttctggttggaatcagttggtgaggcgtgcgcgcgcgagtccgtgtatctgtccgtctccctcctacagcccagcgtgtttggtctgagtccaaagaaggaggtggtgtgtgtgctgcgtagacctgcgcctgtggggtgagcagcctcatagcccccagagccggccaacttctccgtgctaggctgcgacctcaagggctgccgcgtcggggatcggaagtggtcttcaaagaggggtctaggtcgcgaaatcctggcagcagccgaagtgaaaaggagctgctaggaggcgggcggggggcagtctgatgtccgttctggcgcggacaggaagaaactgaagtcgaatttttagttgaattgcgtgctctgtgtttg

SEQ ID NO: 58616 - DNA, 26 bp, Homo sapiens
  chr20:25058359-25058385
  hyper
cggcggagttgagcacggagtctggc

SEQ ID NO: 58617 - DNA, 104 bp, Homo sapiens
  chr20:25058616-25058720
  hyper
gctatttctgaaggaaatagctcccgagggccaaccagccgccctcagggagagcgcccaggagcccccagcagcgcccacgtgcggtccggactcacgggcat

SEQ ID NO: 58618 - DNA, 61 bp, Homo sapiens; identical to SEQ ID NO: 23300
  chr20:25062880-25062941
  hyper

SEQ ID NO: 58619 - DNA, 53 bp, Homo sapiens; identical to SEQ ID NO: 23301
  chr20:25063727-25063780
  hyper

SEQ ID NO: 58620 - DNA, 721 bp, Homo sapiens
  chr20:25064458-25065179
  hyper
aggcagggtagtcgattctaaggtggcccgaccggggtcgcccgcgaatggaaagcctaaggggcgagggcggacgcgggcgccgtgcctgcagccccgggtgccgaccaagtggcctcacctgggacaggtcttggggtctccctcccctaggtctccctggaaggtaggcgatcacgggagtgacagaccccgagtagatagccagtgatccaaagacaccaaaaggccaggcggtaggagcccagcctcagacactctctatagtgaccgcggcgcctcgggaaggatcgtcttaaactcattttgcaggtgagagcaactgggacttattaacccagtcacatcggacacagagacgtggcgagggcgacacagagcaggagactcaatcaaggagcccgtattggagctctaaggggactcagagatgcagaaggaacgaacttctaaggggtcttgcaattcctggactggggcgttcctaatgcatcccgggaccccaatgccagggaggggcctgcaggaccccagcggtgggcgagttgtgtcctgggtcaccttgtgtttcgcagcgtggcggtggcaggagcccagcgcgggaggacattttcatagcctcctacagtgagaaacgccccccacccgacgctgcgctcatctgtgtccccgctgttgccggggctctggtatccacttgcgcgccctatgtggtggggat

SEQ ID NO: 58621 - DNA, 68 bp, Homo sapiens
  chr20:25065395-25065463
  hyper
gctccttccagcttccccctaccggataccacctgcaaatctattgccagaggcgcagctcccgcgaa

SEQ ID NO: 58622 - DNA, 35 bp, Homo sapiens; identical to SEQ ID NO: 38044
  chr20:25065766-25065801
  hyper

SEQ ID NO: 58623 - DNA, 29 bp, Homo sapiens
  chr20:25129464-25129493
  hyper
cgcccatccccgtgcgcacgtgttcgctg

SEQ ID NO: 58624 - DNA, 180 bp, Homo sapiens; identical to SEQ ID NO: 38046
  chr20:25565489-25565669
  hyper

SEQ ID NO: 58625 - DNA, 392 bp, Homo sapiens; identical to SEQ ID NO: 38047
  chr20:25565825-25566217
  hyper

SEQ ID NO: 58626 - DNA, 38 bp, Homo sapiens
  chr20:26188774-26188812
  hyper
gggcacctgggagcccgcagaggggcggctgagggaga

SEQ ID NO: 58627 - DNA, 68 bp, Homo sapiens; identical to SEQ ID NO: 38049
  chr20:26189330-26189398
  hyper

SEQ ID NO: 58628 - DNA, 23 bp, Homo sapiens
  chr20:26189578-26189601
  hyper
gaggggcccgcagaggcgctcag

SEQ ID NO: 58629 - DNA, 357 bp, Homo sapiens
  chr20:26189956-26190313
  hyper
cgtgggaggggcgcgtctcgtctcactcaaccgcctcgaaccccacaccgacgagctccctcaggacccacgcgcggacaccgaggcgccgaccggaggagggggcgctgggggtgggaacgacacaccaccgctcggcctcgggaacctgagggacaacccggagcgctccaggagcaccgcaaaggcccagggggagccaacgctcgcgcaaactccccgggagggcagcacgacgggccggcgggacagcacccccaccgctgcggaggggggccgcccgcaagtcgacaaccacaggaggcgagagcgaggggtgcctgccgcgtcagaggaccccccgacccaccccgcgag

SEQ ID NO: 58630 - DNA, 136 bp, Homo sapiens; identical to SEQ ID NO: 13761
  chr20:30063113-30063249
  hyper

SEQ ID NO: 58631 - DNA, 275 bp, Homo sapiens; identical to SEQ ID NO: 38053
  chr20:30063250-30063525
  hyper

SEQ ID NO: 58632 - DNA, 32 bp, Homo sapiens; identical to SEQ ID NO: 38054
  chr20:30193960-30193992
  hyper

SEQ ID NO: 58633 - DNA, 56 bp, Homo sapiens; identical to SEQ ID NO: 38055
  chr20:30556169-30556225
  hyper

SEQ ID NO: 58634 - DNA, 16 bp, Homo sapiens
  chr20:30582978-30582994
  hyper
gcgcttgctggagacc

SEQ ID NO: 58635 - DNA, 36 bp, Homo sapiens
  chr20:30639105-30639141
  hyper
ccagggtggttccttcgggcagggaactttgcatgg

SEQ ID NO: 58636 - DNA, 160 bp, Homo sapiens
  chr20:30639319-30639479
  hyper
agggtaaggcctttccagggtgggttggaatctttgaagactgtggcaggaatcccttgataggtggggttaggatctctgaagggcagggttggaatctttggaccggcggtatagacccctgggtattaaaactcttaggcggcgggaggttagatcg

SEQ ID NO: 58637 - DNA, 259 bp, Homo sapiens
  chr20:30639847-30640106
  hyper
atggatggtgctaatattttttttctcttcgtggagggtttgggatccttcttgcaggagacggaggttatgaccctcggggagccggttaggatcctggggtggcgtctgaatcttcggggaggtgttaggacacttggggcggagttagcctcgctcagggcgcggctaaggcgcccagatggcctgcgggcgccaccacgtccctggtcccagctcgggagcacatcagaggcttagaggcgagtgggaagggact

SEQ ID NO: 58638 - DNA, 173 bp, Homo sapiens
  chr20:30640270-30640443
  hyper
acgaggagcgggcgcccaggtgagtgccgcgcacaggggaccgggaatacccggcccgcgaggggtcccaggaggcggagggagcccaggagcctggggagggctggctacgggtgcggctgggggcagcgaggggagacggaacgtcgggggagccgcgggtagcccggggg

SEQ ID NO: 58639 - DNA, 45 bp, Homo sapiens; identical to SEQ ID NO: 38060
  chr20:30640724-30640769
  hyper

SEQ ID NO: 58640 - DNA, 139 bp, Homo sapiens
  chr20:30777885-30778024
  hyper
tggaggccgcttccccgcgcccaggggaagggaaggcggtcccggggcccgctgcggggtggagggacccgcgccccccagcttctcgggcccgggccgcggggaccgtgcgcgcgtccccctcccgggcaaggccggg

SEQ ID NO: 58641 - DNA, 33 bp, Homo sapiens; identical to SEQ ID NO: 38062
  chr20:31797604-31797637
  hyper

SEQ ID NO: 58642 - DNA, 49 bp, Homo sapiens; identical to SEQ ID NO: 38063
  chr20:32803885-32803934
  hyper

SEQ ID NO: 58643 - DNA, 192 bp, Homo sapiens; identical to SEQ ID NO: 38064
  chr20:32803954-32804146
  hyper

SEQ ID NO: 58644 - DNA, 30 bp, Homo sapiens; identical to SEQ ID NO: 38065
  chr20:32899446-32899476
  hyper

SEQ ID NO: 58645 - DNA, 261 bp, Homo sapiens; identical to SEQ ID NO: 38066
  chr20:33146323-33146584
  hyper

SEQ ID NO: 58646 - DNA, 9 bp, Homo sapiens
  chr20:34188608-34188617
  hyper
ttctttttc

SEQ ID NO: 58647 - DNA, 101 bp, Homo sapiens; identical to SEQ ID NO: 23317
  chr20:34189391-34189492
  hyper

SEQ ID NO: 58648 - DNA, 144 bp, Homo sapiens; identical to SEQ ID NO: 23318
  chr20:34189910-34190054
  hyper

SEQ ID NO: 58649 - DNA, 217 bp, Homo sapiens; identical to SEQ ID NO: 38071
  chr20:35491258-35491475
  hyper

SEQ ID NO: 58650 - DNA, 323 bp, Homo sapiens; identical to SEQ ID NO: 38072
  chr20:36012930-36013253
  hyper

SEQ ID NO: 58651 - DNA, 248 bp, Homo sapiens
  chr20:36531551-36531799
  hyper
cgtgcgctcgctccccgaagccggggctgggccggagccgggcgagggctgggagctgggccgggtccggggacagcgggcgaggggcagctgccggagccgggcagccaggccgctcagggcaggggacagctggcgccggttctgcggtctccggggcccagatgtgaggcggcggcgcccccggcccgagagcgcacgatgggggccccgctcgccgtagcgctgggcgccctccactacctggc

SEQ ID NO: 58652 - DNA, 81 bp, Homo sapiens
  chr20:36531910-36531991
  hyper
aaccccaacccgggccgcgccactccaacttggccgccccggggctcgaaccggcgccagtcgtggcgggcatcccggggc

SEQ ID NO: 58653 - DNA, 332 bp, Homo sapiens; identical to SEQ ID NO: 38074
  chr20:36888856-36889188
  hyper

SEQ ID NO: 58654 - DNA, 30 bp, Homo sapiens; identical to SEQ ID NO: 38075
  chr20:37274701-37274731
  hyper

SEQ ID NO: 58655 - DNA, 143 bp, Homo sapiens
  chr20:37302554-37302697
  hyper
aggggcgccgtggtgcggcatgaggctggagcctgatcactcggggtcttactggccacggtgaggagtcagggtttcatgcgcccctgcagtcagaaagcatggcccaaccccagtgccctaagtccggaaacattcaaagc

SEQ ID NO: 58656 - DNA, 58 bp, Homo sapiens
  chr20:37303343-37303401
  hyper
cgtcgcgcgctcgccccacgctaggaatgcaaactgtaggcgccgccagccccccctt

SEQ ID NO: 58657 - DNA, 114 bp, Homo sapiens
  chr20:37351679-37351793
  hyper
ttttccgtccgcccccgcccccacttccagtcacagccgctacttctccattcaggctgggactgccaggtggagccctgcggtttactgctcaggaggagcccggccaggaca

SEQ ID NO: 58658 - DNA, 567 bp, Homo sapiens
  chr20:37352626-37353193
  hyper
ttagccagaggatctggggctgcacagctcccggaccctggagggggtggtccgggggtgggagactgcgagcatcagcccacgccggccccctcccaccctgcggcggcgaggtgggaagggccaggatgcgagcttagcacctcccctagaaatgcagcacttcgcccccccacctcccctgccctcggcgctccctctttcacgcgctccctcccgcctccttcccaagggcgcccttcttctgcccccagctcacgtctgaatccctcggcgccccctttctcttctcctagccccttcctcacgtcccctgcctccgggtatttcctctctccaatcccccacccccgcaccgcctgattccgaggggcgggagcgcattgggctgcgcacgggtgggggcgccgcgccagcttcgcgtagctgctctgacgccgctgccgccgccgccgccgccgccgccctccgcagcccagctcgcgccccgcggcagctccgcagtgcactagccaccaccgccgccgccgccgctccgccagacctgctgccagcttgcccggtcca

SEQ ID NO: 58659 - DNA, 219 bp, Homo sapiens
  chr20:37353236-37353455
  hyper
agagagccccggggcgccgcgcggagagcaagcggagatagcgactttgcgccccccagccctcgccttcttgcatcgcgttccccgcatcctcgggtccttctgtcctttccgctgtccccaccgccgccatggccaccttgctccgcagcaagctgtccaacgtggccacgtccgtgtccaacaagtcccaggccaagatgagcggcatgttcgcca

SEQ ID NO: 58660 - DNA, 339 bp, Homo sapiens; identical to SEQ ID NO: 23328
  chr20:37353806-37354145
  hyper

SEQ ID NO: 58661 - DNA, 30 bp, Homo sapiens; identical to SEQ ID NO: 23329
  chr20:37355202-37355232
  hyper

SEQ ID NO: 58662 - DNA, 345 bp, Homo sapiens; identical to SEQ ID NO: 23330
  chr20:37355502-37355847
  hyper

SEQ ID NO: 58663 - DNA, 472 bp, Homo sapiens
  chr20:37357353-37357825
  hyper
agtgcgccctgccgccgcgcttgggaggccaagctttaaacatctctggttcctagtttctgattattcggggatgggggggatgggaggggacagggattcacgatccatcgcgtctgcgtttctgttgtcctttcttttccacaacaccctggttttggggggaggcggggtgcatttgcgggcagggttctctgtccttccaagtggggccccgacactttggttccagtcatcgagggggttgggaagggagggagagggggcgcagctcgcaggcgtggcaacttgaccttgggggaatatttcacatccatccagagctcggaatctacagcgtccagccatttccagcaagagcgcttcccattccggagacgtttcaaccctgcagcgggaaaggctgactgggaaatccattttgggtgggcaatttccttcaacgaagccggaaggcgagaagccgcggcgg

SEQ ID NO: 58664 - DNA, 52 bp, Homo sapiens
  chr20:37358190-37358242
  hyper
ggtgtgaggaggaagctgaagacggagagtgctgtagcggccccctcagctg

SEQ ID NO: 58665 - DNA, 104 bp, Homo sapiens; identical to SEQ ID NO: 38084
  chr20:37359606-37359710
  hyper

SEQ ID NO: 58666 - DNA, 241 bp, Homo sapiens; identical to SEQ ID NO: 38085
  chr20:37434112-37434353
  hyper

SEQ ID NO: 58667 - DNA, 64 bp, Homo sapiens; identical to SEQ ID NO: 23333
  chr20:37434488-37434552
  hyper

SEQ ID NO: 58668 - DNA, 150 bp, Homo sapiens; identical to SEQ ID NO: 23334
  chr20:37434744-37434894
  hyper

SEQ ID NO: 58669 - DNA, 174 bp, Homo sapiens; identical to SEQ ID NO: 23335
  chr20:37434930-37435104
  hyper

SEQ ID NO: 58670 - DNA, 152 bp, Homo sapiens; identical to SEQ ID NO: 23336
  chr20:37435218-37435370
  hyper

SEQ ID NO: 58671 - DNA, 56 bp, Homo sapiens
  chr20:37435860-37435916
  hyper
cctcctccaaggctggtaataaagcttcttagcccagccagcgactagctgtctac

SEQ ID NO: 58672 - DNA, 155 bp, Homo sapiens
  chr20:39316048-39316203
  hyper
tcgcctctcgcctgccgggacgccagagtccctctcctttcctcgttgctctcttcctggcgcggactactctccgggcagcaaagcagctgtcccggcttaacgcgcaaagttcagaaagccaggagtctccagatggccttggtgacttctcg

SEQ ID NO: 58673 - DNA, 13 bp, Homo sapiens
  chr20:39316322-39316335
  hyper
ccttagccaaggt

SEQ ID NO: 58674 - DNA, 199 bp, Homo sapiens
  chr20:39317392-39317591
  hyper
ttcttcacgtcgaacttgagcaggtcgaagtcgttgacatactccatggccagcgggctggtgggcagctctggccccatgctcagctccgcggccatcgctgaagcgaggcgcagccgccgctgccgcccgggaaactttgcggccggccggagcgcgccgagccaagcgcgggggggaagagcggagaagagctggg

SEQ ID NO: 58675 - DNA, 139 bp, Homo sapiens
  chr20:39318987-39319126
  hyper
cgatgtacaggtcctcgggtcccgtcttcgtactcagccgcgagcctcgagccgcgagctccgctctggtcgccccgttgaaattccgtgccccagcgttcgggggtgcccgtcggctgctccctgggccggaaggtcc

SEQ ID NO: 58676 - DNA, 13 bp, Homo sapiens
  chr20:39319653-39319666
  hyper
cctatttttaata

SEQ ID NO: 58677 - DNA, 40 bp, Homo sapiens; identical to SEQ ID NO: 38096
  chr20:39994691-39994731
  hyper

SEQ ID NO: 58678 - DNA, 20 bp, Homo sapiens
  chr20:39994762-39994782
  hyper
cggaccgcctttcctcctct

SEQ ID NO: 58679 - DNA, 144 bp, Homo sapiens
  chr20:39995002-39995146
  hyper
gggtgcccggggcctcgacgccccccgcgggtgcgggcaggtgggagcggcgacgcgcgcgggcccatccctccctcttcccgcccgccgcccgcccgcgcttacttgtgcggccccgggcgcagccgcgggcgccatcccgtc

SEQ ID NO: 58680 - DNA, 47 bp, Homo sapiens
  chr20:39995813-39995860
  hyper
actgctctccagggctctggagccgagatggccgtgactgggggcac

SEQ ID NO: 58681 - DNA, 494 bp, Homo sapiens
  chr20:41817292-41817786
  hyper
tacaccaaaagcaatcggtgctaagaaactttaaggtgattttgaacttggaagtacacctgcagcactcccttctcttccctccgccgctactcttgggggggggggggctcgggggtggaagctgcctgcggtggggcttggtgatgtgtaagaccctggactgtggtgccctccagcacccgccaacgtgcctttaggagcacggcaggcaccacccccccgcccccgctccccctactctggggaactacctctgctcaccgccttcccgtggccaaacccaaatatgagttccccgaacttttcaggagcggacgcgctcacgggtcaaatccactcccctccaagggccttaacacgggcgcccagctacctcggagaaaagccagcgggtagggcggaggtattgctctcggtcatcaacgcaaacatcccctcgggtgcctacagcggcctgcttaggggagcagcgtgttcagagcaaatggaga

SEQ ID NO: 58682 - DNA, 482 bp, Homo sapiens
  chr20:41818085-41818567
  hyper
cgcgaggggccgggctcgctggccggggcgcgcggggacactgcttcccgcgcctgcaagctgagacccgggttccggccatggggacccgcgcccccgcgagcccacacaactttctcctccgagggccccgcggctgggggcccgcgcgcatccaggagggagcggggagcccaggggagccgggcgggcgcactcacctgcggcgctctgagcccgggcgccgggcagtggcggcagctgcagcctcaggagcaggctgagggcgagcgcggcgaggctcgccatccgggcggcggcgggcagctcagccccttcccgcgggggccggggccgggactggggcgggcgcggggtggccccgcatcgccggcgcggccgctggctgtgcgcgcggctggctccgctcgggctcccggagccggcgctcctgcgttccaagccgaggcgcggcgcgaactgaggcgggaggctgggcgggg

SEQ ID NO: 58683 - DNA, 273 bp, Homo sapiens
  chr20:41818914-41819187
  hyper
gaagctgcagcagccgtttgaactcggggtggggaacaggtgaatgggggttcggtggcgagaagagggagggagggagcagccctcgcaactcaagataaggggccaggtgaattgcgaaagcgggtgggggcgtctgcccaaagctggggcaggcggctgctggccagggtctcgggcacaccctgagatgagaatttcatctaagagcgcgcgcgcgcacacacacacaacccactcacactcttctgggcgcatcgctgaccgcgccac

SEQ ID NO: 58684 - DNA, 30 bp, Homo sapiens; identical to SEQ ID NO: 38103
  chr20:42019069-42019099
  hyper

SEQ ID NO: 58685 - DNA, 272 bp, Homo sapiens
  chr20:42136058-42136330
  hyper
cggtccctgcgcccccgctgcgctctgctagctgtgatgcaggggttcgggggcaggaaaaatctcgacccgccacgcccgtgcggcaaacctgtcctaggttgagggggcatgaggcgcgcacaaccagggcctcgaaggcaggcaagagggcgcgggcgccacagaagcctgggcctgcgcctgggccgggcagatgtgcccggcgctcgggccccgcgctctgcgtcctgcagggaggcggacccgccccccgaacgcgcaggcgcgcg

SEQ ID NO: 58686 - DNA, 287 bp, Homo sapiens
  chr20:42136411-42136698
  hyper
gaccttgcgtcccctgggcgccgcgccaccccgctccgtccagggcggcgagggctcaggtctgcggccccggcgtctcgctccttccgagcgcctccggcggggggcgcgggctggggaggaggttcgggaaaacgccggggaaagcggtctgggcggagcgcgcagggggccaggcgggtgcgggactccaggcccagccgaccctgcggcgtggcttcgggctgcgatcaggaggggcgaggagggtggaggctgcgtgtttggagatacgcaatcaattaaga

SEQ ID NO: 58687 - DNA, 62 bp, Homo sapiens; identical to SEQ ID NO: 38105
  chr20:42543184-42543246
  hyper

SEQ ID NO: 58688 - DNA, 263 bp, Homo sapiens
  chr20:42543491-42543754
  hyper
actgcccgcgggagccgccgccgccgccgccgcgcccgccatggacgtccgcctgtacccctcggcgcccgcggtgggcgcgcggcccggggccgagccggccggcctggcgcacctggactattaccacggcggcaaggtaggcgggggcgggcgggggtccccggcgggcggggccggagtcacctggcagctcgggactcaggcgctcccggggtcacacggggccgcgcacatcagccccgccgacgggcacgggcggc

SEQ ID NO: 58689 - DNA, 238 bp, Homo sapiens; identical to SEQ ID NO: 23348
  chr20:42543853-42544091
  hyper

SEQ ID NO: 58690 - DNA, 31 bp, Homo sapiens
  chr20:42544984-42545015
  hyper
tgggcctccctgagtgcgccctcaggcccca

SEQ ID NO: 58691 - DNA, 170 bp, Homo sapiens; identical to SEQ ID NO: 13811
  chr20:42587835-42588005
  hyper

SEQ ID NO: 58692 - DNA, 30 bp, Homo sapiens; identical to SEQ ID NO: 38109
  chr20:42876029-42876059
  hyper

SEQ ID NO: 58693 - DNA, 35 bp, Homo sapiens; identical to SEQ ID NO: 38110
  chr20:42876632-42876667
  hyper

SEQ ID NO: 58694 - DNA, 61 bp, Homo sapiens; identical to SEQ ID NO: 38111
  chr20:43017338-43017399
  hyper

SEQ ID NO: 58695 - DNA, 42 bp, Homo sapiens
  chr20:43438029-43438071
  hyper
ctggctgaggttgtgcgcaggcctgggaggaggaggttcaag

SEQ ID NO: 58696 - DNA, 516 bp, Homo sapiens; identical to SEQ ID NO: 23350
  chr20:43438466-43438982
  hyper

SEQ ID NO: 58697 - DNA, 197 bp, Homo sapiens
  chr20:43439022-43439219
  hyper
cggcggcccggggccgggccgaggctccgctgcggggctggcgggcgcggcggggccggcgggcgggccaggagctggcggcgcgcggagcccgaggcgcgctgtgctgctggcggcggcggcggcggcggcggtggcggcggcggtggcggcgcagcgcgctctggtccgcggcgccccccgccggcagcgcgagg

SEQ ID NO: 58698 - DNA, 44 bp, Homo sapiens; identical to SEQ ID NO: 23353
  chr20:43439247-43439291
  hyper

SEQ ID NO: 58699 - DNA, 42 bp, Homo sapiens
  chr20:43439510-43439552
  hyper
cgctcaaagggtcccgcccaggcgggtcggcactcggcctcc

SEQ ID NO: 58700 - DNA, 102 bp, Homo sapiens; identical to SEQ ID NO: 38115
  chr20:43726528-43726630
  hyper

SEQ ID NO: 58701 - DNA, 24 bp, Homo sapiens
  chr20:43726764-43726788
  hyper
cgagtagcccgggttctccatggt

SEQ ID NO: 58702 - DNA, 30 bp, Homo sapiens; identical to SEQ ID NO: 38117
  chr20:43922213-43922243
  hyper

SEQ ID NO: 58703 - DNA, 63 bp, Homo sapiens
  chr20:44452668-44452731
  hyper
ctttcatcagagattcgatctcctcgtccgtcacgtgctccccggaggccctgaaaatctcag

SEQ ID NO: 58704 - DNA, 78 bp, Homo sapiens; identical to SEQ ID NO: 38119
  chr20:44519124-44519202
  hyper

SEQ ID NO: 58705 - DNA, 30 bp, Homo sapiens; identical to SEQ ID NO: 13818
  chr20:44540105-44540135
  hyper

SEQ ID NO: 58706 - DNA, 364 bp, Homo sapiens; identical to SEQ ID NO: 38121
  chr20:44540444-44540808
  hyper

SEQ ID NO: 58707 - DNA, 33 bp, Homo sapiens
  chr20:44639148-44639181
  hyper
gcgggcggtgattgacgacgcctttgcccgcgc

SEQ ID NO: 58708 - DNA, 15 bp, Homo sapiens
  chr20:44639731-44639746
  hyper
ctcccactcatcacc

SEQ ID NO: 58709 - DNA, 8 bp, Homo sapiens
  chr20:44639846-44639854
  hyper
cgctccta

SEQ ID NO: 58710 - DNA, 4 bp, Homo sapiens
  chr20:44640284-44640288
  hyper
actc

SEQ ID NO: 58711 - DNA, 25 bp, Homo sapiens
  chr20:44640312-44640337
  hyper
cgacggctaccgctggtgcgccacc

SEQ ID NO: 58712 - DNA, 33 bp, Homo sapiens; identical to SEQ ID NO: 38127
  chr20:44640787-44640820
  hyper

SEQ ID NO: 58713 - DNA, 261 bp, Homo sapiens; identical to SEQ ID NO: 38128
  chr20:44650230-44650491
  hyper

SEQ ID NO: 58714 - DNA, 58 bp, Homo sapiens; identical to SEQ ID NO: 38129
  chr20:44657782-44657840
  hyper

SEQ ID NO: 58715 - DNA, 34 bp, Homo sapiens; identical to SEQ ID NO: 38130
  chr20:44658183-44658217
  hyper

SEQ ID NO: 58716 - DNA, 171 bp, Homo sapiens; identical to SEQ ID NO: 38131
  chr20:44659126-44659297
  hyper

SEQ ID NO: 58717 - DNA, 30 bp, Homo sapiens; identical to SEQ ID NO: 38132
  chr20:44660307-44660337
  hyper

SEQ ID NO: 58718 - DNA, 30 bp, Homo sapiens; identical to SEQ ID NO: 38133
  chr20:44660605-44660635
  hyper

SEQ ID NO: 58719 - DNA, 72 bp, Homo sapiens; identical to SEQ ID NO: 23360
  chr20:44660877-44660949
  hyper

SEQ ID NO: 58720 - DNA, 30 bp, Homo sapiens; identical to SEQ ID NO: 38135
  chr20:44685865-44685895
  hyper

SEQ ID NO: 58721 - DNA, 31 bp, Homo sapiens
  chr20:44686762-44686793
  hyper
tgtacaggagacatcgcgtgtatttttaacg

SEQ ID NO: 58722 - DNA, 129 bp, Homo sapiens; identical to SEQ ID NO: 38138
  chr20:44687107-44687236
  hyper

SEQ ID NO: 58723 - DNA, 30 bp, Homo sapiens; identical to SEQ ID NO: 38139
  chr20:44747259-44747289
  hyper

SEQ ID NO: 58724 - DNA, 77 bp, Homo sapiens; identical to SEQ ID NO: 38140
  chr20:44803049-44803126
  hyper

SEQ ID NO: 58725 - DNA, 2 bp, Homo sapiens
  chr20:44803172-44803174
  hyper
cg

SEQ ID NO: 58726 - DNA, 135 bp, Homo sapiens
  chr20:44803675-44803810
  hyper
cttgtggtggcgcctgagggtgaggatcagcagcaccagcactgcgagggggacagagggggcaactgagggccaagcccctcccagggcattagaaggaccctctaccccatctcctcccgcctcccacccagc

SEQ ID NO: 58727 - DNA, 45 bp, Homo sapiens; identical to SEQ ID NO: 38142
  chr20:44879746-44879791
  hyper

SEQ ID NO: 58728 - DNA, 91 bp, Homo sapiens; identical to SEQ ID NO: 23366
  chr20:44880076-44880167
  hyper

SEQ ID NO: 58729 - DNA, 26 bp, Homo sapiens
  chr20:44880275-44880301
  hyper
cgggttggggccggcagatcctgcca

SEQ ID NO: 58730 - DNA, 157 bp, Homo sapiens; identical to SEQ ID NO: 13830
  chr20:44936314-44936471
  hyper

SEQ ID NO: 58731 - DNA, 92 bp, Homo sapiens; identical to SEQ ID NO: 38146
  chr20:44936608-44936700
  hyper

SEQ ID NO: 58732 - DNA, 179 bp, Homo sapiens
  chr20:44937023-44937202
  hyper
agcgagagggggagccgcggcggcgtgtgcgcgcgtgtgtgtgagcgagagagcgagagagcgagagagcgagggagtgagcgagcgagcgggagcgagggagtgtgcgtgtctgactggggggaagtgtgcaagggacggatcccttccttcctcccgcagcctctggtggagactcg

SEQ ID NO: 58733 - DNA, 34 bp, Homo sapiens
  chr20:44941484-44941518
  hyper
aggggacggggaggccgcccttggctgggggcgc

SEQ ID NO: 58734 - DNA, 166 bp, Homo sapiens
  chr20:45141834-45142000
  hyper
ctagctacttggatgcgtaaacctttcaccttcaccaagcgccttcttcgggcaaatcagggccctagagagagctcgcccgtggcctgcaggtcaggagcccaatcctgccctggctgcctcgcctcccgaccacaggaaaccctccctccaaagacagggagag

SEQ ID NO: 58735 - DNA, 386 bp, Homo sapiens; identical to SEQ ID NO: 38154
  chr20:45338398-45338784
  hyper

SEQ ID NO: 58736 - DNA, 1327 bp, Homo sapiens
  chr20:45523196-45524523
  hyper
ggaggtgcggggtgtcggtgggtggggaggaggctgggccctggcctccaggaccggcgagagtgagcgcgctctgctcggctgcaggctcaggaagcggcgcggcggcacgtgctgggccagagccccgcgccctgcgtccagccgccgggtgtgtgcgcccgcgtagcccagcgtcgcgcctcggcgcccccacgcgcccacgcagcggcgcggggacccgggcgggggcagagggagggcccggcccagggaggagaaggggccggtcctcccggcgcaggcagcagccgcggcagcccaggaggcggaggcagcggcaacggcagagacagcaacgtgcccgccgcagtcagcccggcctcgtcggacccgcaccggcccgcccgcccgcccgcaccgcgtcggggcgccctctccactgcgcgcggtgagtaccgccagcggcgcccaccccaggccgcccgccgggattcgccgggcggggggagttgttcaccgggaccccctcgccctgcgcctctttctggcactcgccaagcggggcctccgcagctgtcgggacgttctggggcgcacgggcctcccagggccaggaaggcacaagggcagaggggacagcagcagagcccccctctggaaaggctctcccaggctcggggccccagtttccccatgcgctttggggcaacgaccctgaagtttgctctcccgcgcgcgggacaagtgcatggcgcgcaggcggtgtagacgcggctgggtccttggcgttttgttcgattatggtcccggcggttcgcgataaggggcgctcccccagtccgcaaactcaagccctcaggtagtgtttatgggataaccaagaagcagagccaaccgctggaatcccggcttggggctggaacggcccgctgagactttgccttctagctattgatatatttcttttcaaaagtccgtttgcgctcggcccgctctggttcaggtctggggctttgaaccggggcagggaatcctggcgcctgctgcgggtagagttgaaacttagaaaagtttacatccgaagggtgtttagaaggcggcaaggatttcgttgtaatgggagaaagtgggaaatggaattgttttttagtcatgaagtctggaggttaaacggccgtgctggcccaggctccttcaatatattcctgcctgcctcccccccagcaataaatagtttataagctcaaggaatactaggaaagcgtgactggtgaacgtactcctatcgcaaaagactcagtgcgcttttctcagctgttgaactggaagcgccttttgcagtgcg

SEQ ID NO: 58737 - DNA, 25 bp, Homo sapiens
  chr20:45524553-45524578
  hyper
gagttgacagcgtgcaccctgccgc

SEQ ID NO: 58738 - DNA, 128 bp, Homo sapiens; identical to SEQ ID NO: 38156
  chr20:46413326-46413454
  hyper

SEQ ID NO: 58739 - DNA, 279 bp, Homo sapiens; identical to SEQ ID NO: 38157
  chr20:46414635-46414914
  hyper

SEQ ID NO: 58740 - DNA, 30 bp, Homo sapiens; identical to SEQ ID NO: 38158
  chr20:46415157-46415187
  hyper

SEQ ID NO: 58741 - DNA, 42 bp, Homo sapiens; identical to SEQ ID NO: 38159
  chr20:46415427-46415469
  hyper

SEQ ID NO: 58742 - DNA, 10 bp, Homo sapiens
  chr20:47443719-47443729
  hyper
atcctactcc

SEQ ID NO: 58743 - DNA, 146 bp, Homo sapiens; identical to SEQ ID NO: 23374
  chr20:47444282-47444428
  hyper

SEQ ID NO: 58744 - DNA, 129 bp, Homo sapiens; identical to SEQ ID NO: 4825
  chr20:47444452-47444581
  hyper

SEQ ID NO: 58745 - DNA, 184 bp, Homo sapiens; identical to SEQ ID NO: 4826
  chr20:47444609-47444793
  hyper

SEQ ID NO: 58746 - DNA, 295 bp, Homo sapiens; identical to SEQ ID NO: 4827
  chr20:47444920-47445215
  hyper

SEQ ID NO: 58747 - DNA, 227 bp, Homo sapiens; identical to SEQ ID NO: 23378
  chr20:47935268-47935495
  hyper

SEQ ID NO: 58748 - DNA, 361 bp, Homo sapiens
  chr20:47935567-47935928
  hyper
gagcacaagaggcgcaggcaggaaggagagcgcctggtgcgagagaggaaggagcgcacccagtaagcggtgtcgggggggtcgtgaagcttggagggcctcgaggggagggaggcgcttgggttgaggtagggcgccagatttcgcaaatcaaaatacagcacacccagttaaactcgaatttcagataaacaaatctttctagagaaaaatatgtcctaaatatcgcatgggatatacttatactaaaaaattatttgttgtttttctgaaattgaaatctaactcggagtcctgtattttatctgagagccccagctggggacgggcgcggggccaagagagctgcgagggaggaggg

SEQ ID NO: 58749 - DNA, 25 bp, Homo sapiens
  chr20:47936027-47936052
  hyper
gatggaaagacgctcaaagcggagg

SEQ ID NO: 58750 - DNA, 138 bp, Homo sapiens; identical to SEQ ID NO: 38168
  chr20:48099124-48099262
  hyper

SEQ ID NO: 58751 - DNA, 30 bp, Homo sapiens; identical to SEQ ID NO: 13849
  chr20:48099543-48099573
  hyper

SEQ ID NO: 58752 - DNA, 30 bp, Homo sapiens; identical to SEQ ID NO: 38170
  chr20:48100342-48100372
  hyper

SEQ ID NO: 58753 - DNA, 53 bp, Homo sapiens; identical to SEQ ID NO: 38171
  chr20:48184239-48184292
  hyper

SEQ ID NO: 58754 - DNA, 53 bp, Homo sapiens
  chr20:48184328-48184381
  hyper
cgattcgccccgggggacctaccggaccccgcaccttcccaccttgcaccttc

SEQ ID NO: 58755 - DNA, 220 bp, Homo sapiens
  chr20:48184435-48184655
  hyper
cccacctccgagggtctcgccttgcccgggatactggagcgggactcgggccgggccggccgcgggctccgagacccttgggctgcagcccgggcgggagccgccccctttgtctggcggggccgagcggagcaggacactcaccgcgtgcggcggcggctcagtagcagcagcagcaacagtgcggccaggaggccgaggagcgcggcccaagccatcg

SEQ ID NO: 58756 - DNA, 109 bp, Homo sapiens; identical to SEQ ID NO: 38173
  chr20:48788910-48789019
  hyper

SEQ ID NO: 58757 - DNA, 129 bp, Homo sapiens; identical to SEQ ID NO: 38174
  chr20:49435030-49435159
  hyper

SEQ ID NO: 58758 - DNA, 30 bp, Homo sapiens; identical to SEQ ID NO: 38175
  chr20:49575750-49575780
  hyper

SEQ ID NO: 58759 - DNA, 33 bp, Homo sapiens; identical to SEQ ID NO: 38176
  chr20:49576086-49576119
  hyper

SEQ ID NO: 58760 - DNA, 11 bp, Homo sapiens
  chr20:49639123-49639134
  hyper
cggcggcgaac

SEQ ID NO: 58761 - DNA, 50 bp, Homo sapiens; identical to SEQ ID NO: 38178
  chr20:49639135-49639185
  hyper

SEQ ID NO: 58762 - DNA, 317 bp, Homo sapiens; identical to SEQ ID NO: 38179
  chr20:49639217-49639534
  hyper

SEQ ID NO: 58763 - DNA, 3 bp, Homo sapiens
  chr20:49639774-49639777
  hyper
tcg

SEQ ID NO: 58764 - DNA, 68 bp, Homo sapiens
  chr20:49640157-49640225
  hyper
atgtgctagatattaaaaccccactctccgctgccccggggccgcgctccacgcgcttacacatcctg

SEQ ID NO: 58765 - DNA, 45 bp, Homo sapiens; identical to SEQ ID NO: 38183
  chr20:49708478-49708523
  hyper

SEQ ID NO: 58766 - DNA, 118 bp, Homo sapiens; identical to SEQ ID NO: 38184
  chr20:49836918-49837036
  hyper

SEQ ID NO: 58767 - DNA, 270 bp, Homo sapiens; identical to SEQ ID NO: 38185
  chr20:50157750-50158020
  hyper

SEQ ID NO: 58768 - DNA, 65 bp, Homo sapiens; identical to SEQ ID NO: 38186
  chr20:50158354-50158419
  hyper

SEQ ID NO: 58769 - DNA, 30 bp, Homo sapiens; identical to SEQ ID NO: 38187
  chr20:50179106-50179136
  hyper

SEQ ID NO: 58770 - DNA, 48 bp, Homo sapiens; identical to SEQ ID NO: 38188
  chr20:50417842-50417890
  hyper

SEQ ID NO: 58771 - DNA, 45 bp, Homo sapiens; identical to SEQ ID NO: 23389
  chr20:50720392-50720437
  hyper

SEQ ID NO: 58772 - DNA, 23 bp, Homo sapiens
  chr20:50722193-50722216
  hyper
actttaatgtgcgcacgagtcac

SEQ ID NO: 58773 - DNA, 31 bp, Homo sapiens
  chr20:51589908-51589939
  hyper
cgccgagctcctcgcccgccctccttgcccc

SEQ ID NO: 58774 - DNA, 85 bp, Homo sapiens
  chr20:52789475-52789560
  hyper
ggtagtcgcgataggccttccacggtttgatctccagccgctgcgggtacgcgctctcggtgcggtacagcgcttccagcaggca

SEQ ID NO: 58775 - DNA, 26 bp, Homo sapiens
  chr20:52790155-52790181
  hyper
atggggtggggcgaggttggtacgag

SEQ ID NO: 58776 - DNA, 39 bp, Homo sapiens; identical to SEQ ID NO: 38198
  chr20:52790612-52790651
  hyper

SEQ ID NO: 58777 - DNA, 329 bp, Homo sapiens; identical to SEQ ID NO: 38199
  chr20:53091752-53092081
  hyper

SEQ ID NO: 58778 - DNA, 51 bp, Homo sapiens
  chr20:53092141-53092192
  hyper
tccttctcggccgggaggaggcagggctggatccctcagccgccgccgctc

SEQ ID NO: 58779 - DNA, 157 bp, Homo sapiens
  chr20:53092376-53092533
  hyper
tctccaactttctcccaccgactgcttgtcttgaccctgccctccaccctccccagagccacttcgggtgcgcgctcttgggtaaagggggggtcaccggctgtctgggatggcttccaattttaatgacatagtgaagcaagggtacgtgaggatc

SEQ ID NO: 58780 - DNA, 182 bp, Homo sapiens; identical to SEQ ID NO: 38203
  chr20:53092686-53092868
  hyper

SEQ ID NO: 58781 - DNA, 173 bp, Homo sapiens
  chr20:53092912-53093085
  hyper
cgccgccaacttaacttttccgggggatggatcggctggttgagaaagaggacacgcatactcggtgtgaacgaggtcacgaaccctctgaccccagggagagatttctgccaagcgtaaggtgtctttggatccccccacctctgtcccaggtgtcgtgtcaaaggcggtgc

SEQ ID NO: 58782 - DNA, 134 bp, Homo sapiens
  chr20:53093115-53093249
  hyper
tagatacttgaatctggattttccgtggttcgaagccggggtggtggatttctgttgctggaatacaccctggaggtccacggaagggttatttacgtggaacctgatacctggcatagcgcaagtgctcccta

SEQ ID NO: 58783 - DNA, 429 bp, Homo sapiens
  chr20:54578078-54578507
  hyper
tcatcaagccaaacacggagcaccaggtcgctaaacagcagctacagcttccgtcagctcttcccctactctcatcaacctcaaagtctgtctttccccagctatttgcaattctctgaaaggacatgagcccgggaagggagaactggctcccaagcgctttcctacaggagctcagcgcagttgccaaattccttttcctcccctcctccgcaacttttctctaagtaccggagaagggcttgctgcctactccgaggcagcggcagtgccagcggtgcctggcacacgaacagtggaacctgcaggcgagatctgacccccggctctgcccccgccctccgcggccacctgcccgatctctgaagagtgtggaagcccggggctctcttgggagagaagcttctctacctgggagaaacaaatcaa

SEQ ID NO: 58784 - DNA, 39 bp, Homo sapiens
  chr20:54578725-54578764
  hyper
taggggcccggaagaaatgggagccggggctggtgagag

SEQ ID NO: 58785 - DNA, 199 bp, Homo sapiens; identical to SEQ ID NO: 23394
  chr20:54580323-54580522
  hyper

SEQ ID NO: 58786 - DNA, 65 bp, Homo sapiens; identical to SEQ ID NO: 13872
  chr20:54919287-54919352
  hyper

SEQ ID NO: 58787 - DNA, 137 bp, Homo sapiens; identical to SEQ ID NO: 23396
  chr20:55199898-55200035
  hyper

SEQ ID NO: 58788 - DNA, 216 bp, Homo sapiens
  chr20:55200706-55200922
  hyper
ccccccggggcagggcagggggagagtcaggcatgtctctaacgggctccctagtagaaccgctaggaaagtggccttcaaccctaggcacctttgtggctttcaggtagttgggcgactaaaaattcacttttgcctgctgtgaaatgggacaggtggttgtcaggttagagactgtgcccacgaagtctcgtttggcgggccgggactgacgtg

SEQ ID NO: 58789 - DNA, 265 bp, Homo sapiens; identical to SEQ ID NO: 23398
  chr20:55201092-55201357
  hyper

SEQ ID NO: 58790 - DNA, 2 bp, Homo sapiens
  chr20:55201450-55201452
  hyper
gg

SEQ ID NO: 58791 - DNA, 184 bp, Homo sapiens
  chr20:55201580-55201764
  hyper
cgtctggggtgggggcaggggtggcggatgactcaggcctggggccgggagccctgtttccaaaggcaccacctcgcgcctctttggaagtggcgcgctgttggggcgctcccgctgttgcagaggcctggtttgcggtttcataggggcgtgggtccagggcttccagggagtaagtgagttt

SEQ ID NO: 58792 - DNA, 200 bp, Homo sapiens
  chr20:55202626-55202826
  hyper
tcttcctggacctgtgctctggagtgcctgcgggcctgggtctaatttctgcttctggcaggtgtccccctcccccgccgctaataccaggagcgctgcttctgcggtaacttattttacccccagaagcctgttttgggaccgaagtgtcagggtcctgtgtgtctttttatgcactgttctccttagtgcaaagccct

SEQ ID NO: 58793 - DNA, 218 bp, Homo sapiens
  chr20:55204104-55204322
  hyper
gtgacagaaggaaggcgcgtcgggggacccaggcctcgcaggtcttcggctgtcaacgaggcaccgcccactgactccgcgcttcgtccctcacagcgtggggctcggcgctgcgccaggcccgggtgcggggcggagctaggctgggactggctgggggccgccccgcccggcgcctgggcctccgcgccggcccccggggaggagttatgataatt

SEQ ID NO: 58794 - DNA, 362 bp, Homo sapiens
  chr20:55204604-55204966
  hyper
tgtggaaaataaccgataatgtcaagtacgaagaggactgcgaggtgagctggggctccggggtgcagccccgccccgccgaggacagtccgggaggcaggggccactggaccgaggtcggggacgagggcataggagccctggcctctcggtgggacgggatccacttctccggacaccccttagtccatttctgcggggcccctttcctgtatagggccttttcctaaatagcctcccctcgggaacgaggcctggaaagagaatggcaaatcccacccacacagcttaccgggcgctttcctaagcggcaaacagccctgcttcccgttttctcggaaaagtgccccgtctgcaaccct

SEQ ID NO: 58795 - DNA, 123 bp, Homo sapiens; identical to SEQ ID NO: 38215
  chr20:55205304-55205427
  hyper

SEQ ID NO: 58796 - DNA, 15 bp, Homo sapiens
  chr20:55205765-55205780
  hyper
ggggcgggggaggtg

SEQ ID NO: 58797 - DNA, 37 bp, Homo sapiens
  chr20:55206393-55206430
  hyper
cccctccctaccagcagctggcctactcccagtcggc

SEQ ID NO: 58798 - DNA, 42 bp, Homo sapiens; identical to SEQ ID NO: 38218
  chr20:55405254-55405296
  hyper

SEQ ID NO: 58799 - DNA, 30 bp, Homo sapiens; identical to SEQ ID NO: 38219
  chr20:55499420-55499450
  hyper

SEQ ID NO: 58800 - DNA, 225 bp, Homo sapiens
  chr20:55499791-55500016
  hyper
aaaggggggggaacccgattagttccaaataagcgtctcttaatcacccttatgaaggcgtaatttgcaaaacactcctaggaagtaacatctttttcatttcaggggaaaaaaaaagtgcattgataaaaaataagtagaacattttaattaaaactcataaagttgtggacatctggttgggattgttcgccgcggcggtgattagcggatccgtgcacctag

SEQ ID NO: 58801 - DNA, 217 bp, Homo sapiens
  chr20:55500085-55500302
  hyper
ttgtagtgcggggcctacgcctattagattccaatcagtttcgcctaaaaaggggaggagggcggagtgggaggggggcccagagttaaacacaggaaacaagcgttgagtgtgtgccaataaaaatggtcacaaatcagggctgctgatgtcataaccctgggggtcgggggtcagggggagtgaatgcgcctgaaagggaccgcctgtctgcggc

SEQ ID NO: 58802 - DNA, 63 bp, Homo sapiens; identical to SEQ ID NO: 38223
  chr20:55501052-55501115
  hyper

SEQ ID NO: 58803 - DNA, 87 bp, Homo sapiens; identical to SEQ ID NO: 38224
  chr20:55588889-55588976
  hyper

SEQ ID NO: 58804 - DNA, 56 bp, Homo sapiens; identical to SEQ ID NO: 38225
  chr20:55839612-55839668
  hyper

SEQ ID NO: 58805 - DNA, 87 bp, Homo sapiens; identical to SEQ ID NO: 38226
  chr20:55839692-55839779
  hyper

SEQ ID NO: 58806 - DNA, 205 bp, Homo sapiens
  chr20:55840929-55841134
  hyper
catgaacatgggtgccgagttgtgcttgccctggaggtgcgggcgcgggcggtggggcaagcccaaaatggagaggatctcgcgctgcatctcccgccgctcctggctgcggaggcgccggtggatgaagctcgagtgcacctcgttgtccaggctgaagtcggccagggcggagcgcagcaggaacaggggtgcccagagcgcc

SEQ ID NO: 58807 - DNA, 245 bp, Homo sapiens
  chr20:55841356-55841601
  hyper
tgctcggtgctggccccgggcccctcgccccgcactcgcccgggcgcaccgcagggcttggaaagcagccccggcgaacgaaaaggcgagtgaggaggcgggcgcgggtgggaggagcagccagcaagcctaggagtccagagagccaacgccggggaggcagcgaggaggcaggcgggcgggcgagcgctccttcttcccgctcctctggcgctctcgccctcgggcggcggcaacccaccctc

SEQ ID NO: 58808 - DNA, 41 bp, Homo sapiens
  chr20:55842055-55842096
  hyper
cggtgacccttgagccggtcttgcccctcagtccctgtatc

SEQ ID NO: 58809 - DNA, 98 bp, Homo sapiens
  chr20:55842189-55842287
  hyper
ccactcaccacctcccgcccccatcagacgctgctttctcctcccagagacctccaagacctgccaagctgaggttgtttcctcgcctcgcccctcgc

SEQ ID NO: 58810 - DNA, 47 bp, Homo sapiens
  chr20:56803351-56803398
  hyper
cccgcacggtcatgtcgccgcggcagtttgccactcggaacatctcc

SEQ ID NO: 58811 - DNA, 401 bp, Homo sapiens; identical to SEQ ID NO: 23405
  chr20:56803441-56803842
  hyper

SEQ ID NO: 58812 - DNA, 205 bp, Homo sapiens; identical to SEQ ID NO: 23406
  chr20:56803920-56804125
  hyper

SEQ ID NO: 58813 - DNA, 7 bp, Homo sapiens
  chr20:57089445-57089452
  hyper
ctacagg

SEQ ID NO: 58814 - DNA, 42 bp, Homo sapiens
  chr20:57224800-57224842
  hyper
tcctcacagtgaactcgcccagccctgctcgcggctctctcg

SEQ ID NO: 58815 - DNA, 106 bp, Homo sapiens
  chr20:57225307-57225413
  hyper
ccccgacccgctccggccgcgcgctgggccaggcccttggcctcaagcctcccgggcggctccgggccggacccgggtctccgtcgcgggacgccagcctgtttgt

SEQ ID NO: 58816 - DNA, 300 bp, Homo sapiens; identical to SEQ ID NO: 38233
  chr20:57875589-57875889
  hyper

SEQ ID NO: 58817 - DNA, 47 bp, Homo sapiens; identical to SEQ ID NO: 38234
  chr20:58152512-58152559
  hyper

SEQ ID NO: 58818 - DNA, 238 bp, Homo sapiens; identical to SEQ ID NO: 38235
  chr20:58179141-58179379
  hyper

SEQ ID NO: 58819 - DNA, 16 bp, Homo sapiens
  chr20:58179793-58179809
  hyper
gaatgggaataaacac

SEQ ID NO: 58820 - DNA, 41 bp, Homo sapiens
  chr20:58179854-58179895
  hyper
tgcagccggcgaggctattgtctccccgccctgaagccagc

SEQ ID NO: 58821 - DNA, 106 bp, Homo sapiens; identical to SEQ ID NO: 13893
  chr20:58180470-58180576
  hyper

SEQ ID NO: 58822 - DNA, 53 bp, Homo sapiens; identical to SEQ ID NO: 38239
  chr20:58508817-58508870
  hyper

SEQ ID NO: 58823 - DNA, 30 bp, Homo sapiens; identical to SEQ ID NO: 38240
  chr20:58514777-58514807
  hyper

SEQ ID NO: 58824 - DNA, 94 bp, Homo sapiens; identical to SEQ ID NO: 38241
  chr20:59804316-59804410
  hyper

SEQ ID NO: 58825 - DNA, 85 bp, Homo sapiens
  chr20:59826877-59826962
  hyper
cacccctgagctgcccgacctgggttcaagcccgggtcaggggagttagcaaggagacacctgaaaaataaaaggacagaatgga

SEQ ID NO: 58826 - DNA, 147 bp, Homo sapiens; identical to SEQ ID NO: 13897
  chr20:59829066-59829213
  hyper

SEQ ID NO: 58827 - DNA, 30 bp, Homo sapiens; identical to SEQ ID NO: 38245
  chr20:60794906-60794936
  hyper

SEQ ID NO: 58828 - DNA, 451 bp, Homo sapiens; identical to SEQ ID NO: 38246
  chr20:61339658-61340109
  hyper

SEQ ID NO: 58829 - DNA, 471 bp, Homo sapiens
  chr20:61340110-61340581
  hyper
gagagcgcgagggaggagattctgagcgagggaggggagcgcgcccgggcagcagtgcgtgcgctcctcccggcgccacaagctcgccccgcgcagcccgagccgggctgggcgctgtcctcgggggcctggggaaccgcgcggtttggagatcggaggcacctggaacccgtggcaagcgccgagccgggagacagcccgaggaaccacgggttctggagctaggagccggaagctgggagtccggaggagagcggagcccggagcccggagcccggggcggcgcgtctgggtctggcgcttcccgactggacggcgcgcccgctggtcttcgccacgcgccctcccctgggctcccgttcatcggtccccgcctgagacgcgcccactcctgcccggacttccagccccggaggcgccggacagagccgcggactccagcgcccaccatgcgcctcaacagctccgcgc

SEQ ID NO: 58830 - DNA, 79 bp, Homo sapiens; identical to SEQ ID NO: 13900
  chr20:61447684-61447763
  hyper

SEQ ID NO: 58831 - DNA, 30 bp, Homo sapiens; identical to SEQ ID NO: 38249
  chr20:61448109-61448139
  hyper

SEQ ID NO: 58832 - DNA, 96 bp, Homo sapiens
  chr20:61560322-61560418
  hyper
aaaaaaatggctttccgctgttataagcctccttcctaagactcagggtccgcagcagaataccctgacccaaaataaaaatactatgacaaaaat

SEQ ID NO: 58833 - DNA, 33 bp, Homo sapiens
  chr20:61560922-61560955
  hyper
cctcagtgcccggcgcgccgggggctgtatcgc

SEQ ID NO: 58834 - DNA, 375 bp, Homo sapiens; identical to SEQ ID NO: 38252
  chr20:61585299-61585674
  hyper

SEQ ID NO: 58835 - DNA, 30 bp, Homo sapiens; identical to SEQ ID NO: 38253
  chr20:61636897-61636927
  hyper

SEQ ID NO: 58836 - DNA, 187 bp, Homo sapiens; identical to SEQ ID NO: 23418
  chr20:61637281-61637468
  hyper

SEQ ID NO: 58837 - DNA, 167 bp, Homo sapiens
  chr20:61638631-61638798
  hyper
ccctagcgcaagagtccctggcgacacgcaggggccagagcgggggggcgcgccgcaatagcagcagcgccagcgccaacaccctgtcccgctgaggggccgcttcgggtcggggtcagggtcgtgggcgctctggtgcagccgcggcgcagcgtgtacccggagcc

SEQ ID NO: 58838 - DNA, 48 bp, Homo sapiens; identical to SEQ ID NO: 38258
  chr20:61639020-61639068
  hyper

SEQ ID NO: 58839 - DNA, 77 bp, Homo sapiens; identical to SEQ ID NO: 38259
  chr20:61664493-61664570
  hyper

SEQ ID NO: 58840 - DNA, 27 bp, Homo sapiens
  chr20:61703439-61703466
  hyper
gcgcctctgaccctccgctccgggctc

SEQ ID NO: 58841 - DNA, 160 bp, Homo sapiens; identical to SEQ ID NO: 23420
  chr20:61703875-61704035
  hyper

SEQ ID NO: 58842 - DNA, 180 bp, Homo sapiens; identical to SEQ ID NO: 13910
  chr20:61733260-61733440
  hyper

SEQ ID NO: 58843 - DNA, 394 bp, Homo sapiens; identical to SEQ ID NO: 38264
  chr20:61733694-61734088
  hyper

SEQ ID NO: 58844 - DNA, 65 bp, Homo sapiens; identical to SEQ ID NO: 38265
  chr20:61734101-61734166
  hyper

SEQ ID NO: 58845 - DNA, 20 bp, Homo sapiens
  chr20:61734481-61734501
  hyper
gctgccgcttctgatggagg

SEQ ID NO: 58846 - DNA, 97 bp, Homo sapiens
  chr20:61747797-61747894
  hyper
aagttccctggagttcgttgcagtggaatccatggcccaggtgagcacagctgcagggagctgcgcggggggagccgcagagctgggcacttgcgaa

SEQ ID NO: 58847 - DNA, 71 bp, Homo sapiens
  chr20:61747934-61748005
  hyper
cggagggcggggtgcggagatgccgttcagaacctcggacagcgccgcggcccatccggccagccagaagc

SEQ ID NO: 58848 - DNA, 418 bp, Homo sapiens; identical to SEQ ID NO: 38268
  chr20:61806420-61806838
  hyper

SEQ ID NO: 58849 - DNA, 334 bp, Homo sapiens; identical to SEQ ID NO: 38269
  chr20:61807183-61807517
  hyper

SEQ ID NO: 58850 - DNA, 143 bp, Homo sapiens; identical to SEQ ID NO: 38270
  chr20:61807775-61807918
  hyper

SEQ ID NO: 58851 - DNA, 23 bp, Homo sapiens
  chr20:61808158-61808181
  hyper
cctagagggccagatcgggggcg

SEQ ID NO: 58852 - DNA, 111 bp, Homo sapiens; identical to SEQ ID NO: 23426
  chr20:61808270-61808381
  hyper

SEQ ID NO: 58853 - DNA, 46 bp, Homo sapiens; identical to SEQ ID NO: 23427
  chr20:61810089-61810135
  hyper

SEQ ID NO: 58854 - DNA, 1 bp, Homo sapiens
  chr20:61810159-61810160
  hyper
c

SEQ ID NO: 58855 - DNA, 25 bp, Homo sapiens
  chr20:61862355-61862380
  hyper
agtgtgctcttctgccggcgtgctc

SEQ ID NO: 58856 - DNA, 25 bp, Homo sapiens
  chr20:61862452-61862477
  hyper
ggtgcctgcccgctaggtctcaggg

SEQ ID NO: 58857 - DNA, 412 bp, Homo sapiens; identical to SEQ ID NO: 38279
  chr20:61884691-61885103
  hyper

SEQ ID NO: 58858 - DNA, 52 bp, Homo sapiens
  chr20:61885195-61885247
  hyper
cgggggcgggcggggccggtttgctcgcgggtgggcaggacgttctcacccc

SEQ ID NO: 58859 - DNA, 89 bp, Homo sapiens
  chr20:61885462-61885551
  hyper
ggccagcccatccagccgctgccccgcacctgtccccgccgctccggacccgcggccgccccccgcgcacgcacaccggggacgggacc

SEQ ID NO: 58860 - DNA, 208 bp, Homo sapiens
  chr20:61885860-61886068
  hyper
cgcccgctccccacgcgccgcagcctggaccccgccccctccgcatcccgttcccccctcctccccgcaacccccggcccagccccagccccgggtaacagctgcgctgcgtctcccctcccacccccgcctgcggcccctgggggcttcgcgccggccggagagggggaccgttcttaaaggggcgatggcgcggcctctcgggtag

SEQ ID NO: 58861 - DNA, 18 bp, Homo sapiens
  chr20:61886258-61886276
  hyper
aggcgttttctctgagag

SEQ ID NO: 58862 - DNA, 167 bp, Homo sapiens; identical to SEQ ID NO: 38285
  chr20:62102801-62102968
  hyper

SEQ ID NO: 58863 - DNA, 325 bp, Homo sapiens; identical to SEQ ID NO: 38286
  chr20:62103301-62103626
  hyper

SEQ ID NO: 58864 - DNA, 180 bp, Homo sapiens; identical to SEQ ID NO: 38287
  chr20:62103667-62103847
  hyper

SEQ ID NO: 58865 - DNA, 34 bp, Homo sapiens; identical to SEQ ID NO: 38290
  chr20:62283802-62283836
  hyper

SEQ ID NO: 58866 - DNA, 191 bp, Homo sapiens; identical to SEQ ID NO: 38291
  chr20:62369082-62369273
  hyper

SEQ ID NO: 58867 - DNA, 164 bp, Homo sapiens
  chr20:62461475-62461639
  hyper
tccgttcttcgccccatctggtctgtaccctggctcctcggtccagccctattgtgtgtgcttcgttaaacctacaaacagtgaatctgtcagcggggccaggggaaccccaactagcaggagccctccctctggcgcagagaattccccgtttgccttaggga

SEQ ID NO: 58868 - DNA, 50 bp, Homo sapiens; identical to SEQ ID NO: 38293
  chr20:62463147-62463197
  hyper

SEQ ID NO: 58869 - DNA, 130 bp, Homo sapiens; identical to SEQ ID NO: 38294
  chr20:62463622-62463752
  hyper

SEQ ID NO: 58870 - DNA, 87 bp, Homo sapiens; identical to SEQ ID NO: 38295
  chr20:62600722-62600809
  hyper

SEQ ID NO: 58871 - DNA, 82 bp, Homo sapiens; identical to SEQ ID NO: 38296
  chr20:62673837-62673919
  hyper

SEQ ID NO: 58872 - DNA, 15 bp, Homo sapiens
  chr20:62680421-62680436
  hyper
cgcggcccgggaccc

SEQ ID NO: 58873 - DNA, 41 bp, Homo sapiens; identical to SEQ ID NO: 38298
  chr20:62714767-62714808
  hyper

SEQ ID NO: 58874 - DNA, 274 bp, Homo sapiens; identical to SEQ ID NO: 38299
  chr20:62715272-62715546
  hyper

SEQ ID NO: 58875 - DNA, 749 bp, Homo sapiens; identical to SEQ ID NO: 38300
  chr20:62733381-62734130
  hyper

SEQ ID NO: 58876 - DNA, 132 bp, Homo sapiens; identical to SEQ ID NO: 38301
  chr20:62734172-62734304
  hyper

SEQ ID NO: 58877 - DNA, 30 bp, Homo sapiens; identical to SEQ ID NO: 38302
  chr20:62793356-62793386
  hyper

SEQ ID NO: 58878 - DNA, 101 bp, Homo sapiens; identical to SEQ ID NO: 13928
  chr20:62947884-62947985
  hyper

SEQ ID NO: 58879 - DNA, 315 bp, Homo sapiens; identical to SEQ ID NO: 38304
  chr20:62948007-62948322
  hyper

SEQ ID NO: 58880 - DNA, 291 bp, Homo sapiens; identical to SEQ ID NO: 38305
  chr21:15588524-15588815
  hyper

SEQ ID NO: 58881 - DNA, 152 bp, Homo sapiens; identical to SEQ ID NO: 38306
  chr21:16438562-16438714
  hyper

SEQ ID NO: 58882 - DNA, 61 bp, Homo sapiens; identical to SEQ ID NO: 38307
  chr21:18985496-18985557
  hyper

SEQ ID NO: 58883 - DNA, 30 bp, Homo sapiens; identical to SEQ ID NO: 38308
  chr21:19617785-19617815
  hyper

SEQ ID NO: 58884 - DNA, 53 bp, Homo sapiens; identical to SEQ ID NO: 38309
  chr21:22370172-22370225
  hyper

SEQ ID NO: 58885 - DNA, 96 bp, Homo sapiens
  chr21:22370236-22370332
  hyper
cggtcgcctgcagtatcagtatcagcatcagcatcagcatcagcatctgcatgagcatcagctcagctcagctcagctcagcatcagctcagctgt

SEQ ID NO: 58886 - DNA, 18 bp, Homo sapiens
  chr21:22370458-22370476
  hyper
ccctctaggcggaggcac

SEQ ID NO: 58887 - DNA, 136 bp, Homo sapiens
  chr21:22370552-22370688
  hyper
cgtgcagcgcggagggatacgcctcggccgcacctcccctcgccgcgcccccgcccccgccgccctccccgcccggctctgctgccgccgcggcggccgctgctgctgctgcttctgccgccgctgccgccgccgc

SEQ ID NO: 58888 - DNA, 9 bp, Homo sapiens
  chr21:22370718-22370727
  hyper
ttgcagtca

SEQ ID NO: 58889 - DNA, 1 bp, Homo sapiens
  chr21:26934367-26934368
  hyper
g

SEQ ID NO: 58890 - DNA, 15 bp, Homo sapiens
  chr21:26934786-26934801
  hyper
cgctggatggattcc

SEQ ID NO: 58891 - DNA, 30 bp, Homo sapiens; identical to SEQ ID NO: 38314
  chr21:27011446-27011476
  hyper

SEQ ID NO: 58892 - DNA, 52 bp, Homo sapiens; identical to SEQ ID NO: 38315
  chr21:27012069-27012121
  hyper

SEQ ID NO: 58893 - DNA, 28 bp, Homo sapiens
  chr21:27012148-27012176
  hyper
cgccaccgcctcctcctgctgctgctgc

SEQ ID NO: 58894 - DNA, 196 bp, Homo sapiens
  chr21:27012177-27012373
  hyper
ctacctggtggtcgccctgggctgtaagttgctcgggttcctctacccttcctgcctggaccagcctgcccccaccctccagccccccacggggcgctggctgacagtgtctgggcggctctgggccgaggtcgccgcggggcgtctgaccttgcgcccaggcgagcgggaaacccagggtgcccgcgagcggacg

SEQ ID NO: 58895 - DNA, 294 bp, Homo sapiens
  chr21:27012431-27012725
  hyper
gttctagatacagaaaattaagggttcccactagcaggttctcatctgtttgcaaagttggggtaagttttcagacagagggacgtgattcgaatgcaaaactcactacccactggtaagatgctaagaccccaagaaagatggcatcactgggaggcgggcgccggccacactttgagtccccggggagggggcagcgtccgcgtggtctgggctctgtagcgtcccagctgagccggcgatatgcagcgcacttgtggggcggaggtggagggaattcgtggctgctgagcc

SEQ ID NO: 58896 - DNA, 82 bp, Homo sapiens; identical to SEQ ID NO: 23440
  chr21:27944913-27944995
  hyper

SEQ ID NO: 58897 - DNA, 67 bp, Homo sapiens; identical to SEQ ID NO: 23441
  chr21:27945081-27945148
  hyper

SEQ ID NO: 58898 - DNA, 26 bp, Homo sapiens
  chr21:27945604-27945630
  hyper
cgggcagggggcgggggtggccccga

SEQ ID NO: 58899 - DNA, 243 bp, Homo sapiens
  chr21:28217690-28217933
  hyper
caatagcccctggctcggagccgctttccagcgagtgcaagaaccgggcagccgagcggtccttttatagtggaccagtgaaacccccacccccaccccactcctcccctttggcccttttccatcccaaagacgccgcccccggctccgttggtgctaaaccgcgctccgcgctgcgggctcgggagggggagggggcagcctccgcgctggctccacgccactgctcgtcaatctaggggc

SEQ ID NO: 58900 - DNA, 81 bp, Homo sapiens; identical to SEQ ID NO: 13938
  chr21:28218267-28218348
  hyper

SEQ ID NO: 58901 - DNA, 99 bp, Homo sapiens; identical to SEQ ID NO: 38322
  chr21:28218619-28218718
  hyper

SEQ ID NO: 58902 - DNA, 87 bp, Homo sapiens
  chr21:28219045-28219132
  hyper
ctccaagtagatctgggtcctttcctcgctcctccccagatcttccccacttcagttggccccagccagaagcgtcccttctagttc

SEQ ID NO: 58903 - DNA, 44 bp, Homo sapiens; identical to SEQ ID NO: 38324
  chr21:28338515-28338559
  hyper

SEQ ID NO: 58904 - DNA, 1 bp, Homo sapiens
  chr21:28339246-28339247
  hyper
g

SEQ ID NO: 58905 - DNA, 16 bp, Homo sapiens
  chr21:28339876-28339892
  hyper
tcccctttgcacaccc

SEQ ID NO: 58906 - DNA, 30 bp, Homo sapiens; identical to SEQ ID NO: 23444
  chr21:28340318-28340348
  hyper

SEQ ID NO: 58907 - DNA, 81 bp, Homo sapiens; identical to SEQ ID NO: 23445
  chr21:31311553-31311634
  hyper

SEQ ID NO: 58908 - DNA, 220 bp, Homo sapiens; identical to SEQ ID NO: 38330
  chr21:31311700-31311920
  hyper

SEQ ID NO: 58909 - DNA, 76 bp, Homo sapiens; identical to SEQ ID NO: 23446
  chr21:31312105-31312181
  hyper

SEQ ID NO: 58910 - DNA, 207 bp, Homo sapiens; identical to SEQ ID NO: 13945
  chr21:32716260-32716467
  hyper

SEQ ID NO: 58911 - DNA, 152 bp, Homo sapiens; identical to SEQ ID NO: 38334
  chr21:33245337-33245489
  hyper

SEQ ID NO: 58912 - DNA, 30 bp, Homo sapiens; identical to SEQ ID NO: 38335
  chr21:34392013-34392043
  hyper

SEQ ID NO: 58913 - DNA, 508 bp, Homo sapiens; identical to SEQ ID NO: 23448
  chr21:34392566-34393074
  hyper

SEQ ID NO: 58914 - DNA, 498 bp, Homo sapiens
  chr21:34396269-34396767
  hyper
ccccacccccccgctccctgcgtcgtccgagtgacagattctactaattgaacggttatgggtcatccttgtaaccgttggacgacataacaccacgcttcagttcttcatgttttaaatacatatttaacggatggctgcagagccagctgggaaacacgcggattgaaaaataatgctccagaaggcacgagactggggcgaaggcgagagcgggctgggcttctagcggagaccgcagagggagacatatctcagaactaggggcaataacgtgggtttctctttgtatttgtttattttgtaactttgctacttgaagaccaattatttactatgctaatttgtttgcttgtttttaaaaccgtacttgcacagtaaaagttccccaacaacggaagtaacccgacgttcctcacactccctaggagactgtgtgcgtgtgtgcccgcgcgtgcgctcacagtgtcaagtgctagcatccgagatctgcagaaa

SEQ ID NO: 58915 - DNA, 291 bp, Homo sapiens; identical to SEQ ID NO: 38339
  chr21:34397481-34397772
  hyper

SEQ ID NO: 58916 - DNA, 80 bp, Homo sapiens; identical to SEQ ID NO: 23451
  chr21:34397990-34398070
  hyper

SEQ ID NO: 58917 - DNA, 229 bp, Homo sapiens
  chr21:34398634-34398863
  hyper
gtgcgtgtgcgtgtgtttgctgcgtggtgtcgatggagataaggtggatccgtttgaggaaccaaatcattagttctctatctagatctccattctccccaaagaaaggccctcacttcccactcgtttattccagcccgggggctcagttttcccacacctaactgaaagcccgaagcctctagaatgccacccgcaccccgagggtcaccaacgctccctgaaataa

SEQ ID NO: 58918 - DNA, 41 bp, Homo sapiens
  chr21:34401144-34401185
  hyper
atgatgaggtaagtgcgcaatgctaagctgtttgctcacgt

SEQ ID NO: 58919 - DNA, 79 bp, Homo sapiens
  chr21:34401392-34401471
  hyper
atctgttttatttttgtaaaaacaaagtgctaaataatatttattacttgtttggttgcaaaaacggaataaatgactg

SEQ ID NO: 58920 - DNA, 90 bp, Homo sapiens; identical to SEQ ID NO: 38348
  chr21:34442167-34442257
  hyper

SEQ ID NO: 58921 - DNA, 5 bp, Homo sapiens
  chr21:34442665-34442670
  hyper
caggc

SEQ ID NO: 58922 - DNA, 373 bp, Homo sapiens
  chr21:34442730-34443103
  hyper
cgacggcccccctcctccccaaggctgcgcgcgagaagccggaggcgccggccgagcctccaggccccgggcccgggtcaggcgcgcacccgggcggcagcgcccggccggacgccaaggaggagcagcagcagcagctgcggcgcaagatcaacagccgcgagcggaagcgcatgcaggacctgaacctggccatggacgccctgcgcgaggtcatcctgccctactcagcggcgcactgccagggcgcgcccggccgcaagctctccaagatagccacgctgctgctcgcccgcaactacatcctactgctgggcagctcgctgcaggagctgcgccgcgcgctgggcgagggcgccgggcccgccgcgcc

SEQ ID NO: 58923 - DNA, 247 bp, Homo sapiens; identical to SEQ ID NO: 23455
  chr21:34443262-34443509
  hyper

SEQ ID NO: 58924 - DNA, 207 bp, Homo sapiens
  chr21:34443956-34444163
  hyper
gggacgtggcagacggacggaccctcggcggacaggtggtcggcgtcggggtgcggtgggtaggggcgaggacaacgcagggtgcgctgggttgggacgtgggtccacttttgtagaccagctgtttggagagctgtatttaagactcgcgtatccagtgttttgtcgcagagagttttcgctcttaaatcctgggggtttcttaga

SEQ ID NO: 58925 - DNA, 326 bp, Homo sapiens; identical to SEQ ID NO: 38353
  chr21:34481940-34482266
  hyper

SEQ ID NO: 58926 - DNA, 30 bp, Homo sapiens; identical to SEQ ID NO: 38354
  chr21:34499655-34499685
  hyper

SEQ ID NO: 58927 - DNA, 148 bp, Homo sapiens; identical to SEQ ID NO: 38355
  chr21:35574488-35574636
  hyper

SEQ ID NO: 58928 - DNA, 52 bp, Homo sapiens; identical to SEQ ID NO: 23457
  chr21:36041933-36041985
  hyper

SEQ ID NO: 58929 - DNA, 420 bp, Homo sapiens
  chr21:36042238-36042658
  hyper
ccgggtgggggacagcgtagacgcggaaggtccggcgggggacagcgtagacgcggagggcccgctgggggacaacatacaagccgagggcccggcgggggacagcgtagacgcggagggccgggtgggggacagcgtagacgcggaaggtccggcgggggacagcgtagacgcggagggccgggtgggggacagcgtagaggcgggggacccggcgggggacggcgtagaagcgggggtcccggcgggggacagcgtagaagccgaaggcccggcgggggacagcatggacgccgagggtccggcaggaagggcgcgccgggtctcgggtgagccgcagcaatcgggggacggcagcctctcgccccaggccgaggcaattgaggtcgcagccggggagagtgcggggcgcagccccgg

SEQ ID NO: 58930 - DNA, 293 bp, Homo sapiens; identical to SEQ ID NO: 23460
  chr21:36042861-36043154
  hyper

SEQ ID NO: 58931 - DNA, 51 bp, Homo sapiens; identical to SEQ ID NO: 38359
  chr21:38063644-38063695
  hyper

SEQ ID NO: 58932 - DNA, 156 bp, Homo sapiens; identical to SEQ ID NO: 23461
  chr21:38065799-38065955
  hyper

SEQ ID NO: 58933 - DNA, 112 bp, Homo sapiens; identical to SEQ ID NO: 38362
  chr21:38066820-38066932
  hyper

SEQ ID NO: 58934 - DNA, 30 bp, Homo sapiens; identical to SEQ ID NO: 38363
  chr21:38067379-38067409
  hyper

SEQ ID NO: 58935 - DNA, 30 bp, Homo sapiens; identical to SEQ ID NO: 38364
  chr21:38067871-38067901
  hyper

SEQ ID NO: 58936 - DNA, 256 bp, Homo sapiens; identical to SEQ ID NO: 23463
  chr21:38069203-38069459
  hyper

SEQ ID NO: 58937 - DNA, 97 bp, Homo sapiens
  chr21:38069496-38069593
  hyper
cgcattaaatcctcccgaagcccaggaggtgccagagcgggctcagggggccgcctgcggaagctgcggcaggggctgggtccgtagcctctaaccc

SEQ ID NO: 58938 - DNA, 13 bp, Homo sapiens
  chr21:38069793-38069806
  hyper
tgtgcgtccggct

SEQ ID NO: 58939 - DNA, 133 bp, Homo sapiens
  chr21:38070572-38070705
  hyper
catgggccccacctgcgccacctgcgcccaccctgtgaccctggctcagcgaccttggcccttaatcgcccaacgccgattcctcaaaattccggctgcgctgaatcgggctgcttttgccgccgccccggca

SEQ ID NO: 58940 - DNA, 376 bp, Homo sapiens; identical to SEQ ID NO: 38371
  chr21:38072027-38072403
  hyper

SEQ ID NO: 58941 - DNA, 102 bp, Homo sapiens
  chr21:38072905-38073007
  hyper
agggtcagcttcaggcgctgcgagtcagcggggatcacggtgaggcccaagcactgcaggctgaggccacagagcgaacacttgtgctgagccgggccctct

SEQ ID NO: 58942 - DNA, 100 bp, Homo sapiens; identical to SEQ ID NO: 23468
  chr21:38073070-38073170
  hyper

SEQ ID NO: 58943 - DNA, 61 bp, Homo sapiens; identical to SEQ ID NO: 23469
  chr21:38073239-38073300
  hyper

SEQ ID NO: 58944 - DNA, 30 bp, Homo sapiens; identical to SEQ ID NO: 38375
  chr21:38075927-38075957
  hyper

SEQ ID NO: 58945 - DNA, 35 bp, Homo sapiens; identical to SEQ ID NO: 13975
  chr21:38076386-38076421
  hyper

SEQ ID NO: 58946 - DNA, 25 bp, Homo sapiens
  chr21:38077206-38077231
  hyper
ggggagaacacgagggctccgacgc

SEQ ID NO: 58947 - DNA, 15 bp, Homo sapiens
  chr21:38077617-38077632
  hyper
cgaagtggtttgcaa

SEQ ID NO: 58948 - DNA, 35 bp, Homo sapiens; identical to SEQ ID NO: 38380
  chr21:38078760-38078795
  hyper

SEQ ID NO: 58949 - DNA, 80 bp, Homo sapiens
  chr21:38079908-38079988
  hyper
taggtttttagttgccgaatagggaagggtttgcgaagccgctgccctgggccgaggtgcattttacgcttccagaggtc

SEQ ID NO: 58950 - DNA, 59 bp, Homo sapiens
  chr21:38080684-38080743
  hyper
tagcttttgcggaggtggtgaagaagggcaggaggcctgttgagcggaggagtccgggg

SEQ ID NO: 58951 - DNA, 60 bp, Homo sapiens
  chr21:38081835-38081895
  hyper
gtcaagtgctttccaatctcacttccctcagcaggttccacccagcgcttgctctgtgcc

SEQ ID NO: 58952 - DNA, 246 bp, Homo sapiens
  chr21:38082684-38082930
  hyper
cgggtcggccgggtagccctgagcacagctcgccacttccaggtgggctgttggcgctggctggggacacatcccgatctttcaaatgccctttacagagcctcatcaacgacccgattcattcccccctcctgtcatttgtctctgccatcgaaaaatgcctaccgagagctgctctgcatttccgccctctattttgtgttttactttaaaataataataaaaaaaatgttggctgcaggacgc

SEQ ID NO: 58953 - DNA, 150 bp, Homo sapiens; identical to SEQ ID NO: 23474
  chr21:38119754-38119904
  hyper

SEQ ID NO: 58954 - DNA, 226 bp, Homo sapiens
  chr21:38120312-38120538
  hyper
agccccgccgccacctccccgcccggcgcgcccctgccgcactacctgggcgcctcggtcatcatcaccaacgggaggtgacccgctggccgcccgcgccaggagcctggacccggcctcccggggctgcggcgccaccgagcccggcaaatgcgcacgacctacattaatttatgcagagacagctgtttgaattggaccccgccgccgacttgcggatttccac

SEQ ID NO: 58955 - DNA, 24 bp, Homo sapiens
  chr21:38120553-38120577
  hyper
cgccggtgccgagggccgaggagc

SEQ ID NO: 58956 - DNA, 89 bp, Homo sapiens; identical to SEQ ID NO: 38388
  chr21:38378464-38378553
  hyper

SEQ ID NO: 58957 - DNA, 56 bp, Homo sapiens; identical to SEQ ID NO: 38389
  chr21:38378983-38379039
  hyper

SEQ ID NO: 58958 - DNA, 30 bp, Homo sapiens; identical to SEQ ID NO: 38390
  chr21:38379523-38379553
  hyper

SEQ ID NO: 58959 - DNA, 271 bp, Homo sapiens; identical to SEQ ID NO: 38391
  chr21:38593435-38593706
  hyper

SEQ ID NO: 58960 - DNA, 106 bp, Homo sapiens
  chr21:39047670-39047776
  hyper
gccgggctgggcagccgacgcaccgctaggtggcgcacgcgctcgctgcgtctttcagggctgcaggtacggtgcgggtttctggtgcgctgaccgcgctggggat

SEQ ID NO: 58961 - DNA, 238 bp, Homo sapiens; identical to SEQ ID NO: 38393
  chr21:39286637-39286875
  hyper

SEQ ID NO: 58962 - DNA, 37 bp, Homo sapiens; identical to SEQ ID NO: 13985
  chr21:39288011-39288048
  hyper

SEQ ID NO: 58963 - DNA, 30 bp, Homo sapiens; identical to SEQ ID NO: 13986
  chr21:39288362-39288392
  hyper

SEQ ID NO: 58964 - DNA, 95 bp, Homo sapiens; identical to SEQ ID NO: 38396
  chr21:39288790-39288885
  hyper

SEQ ID NO: 58965 - DNA, 130 bp, Homo sapiens; identical to SEQ ID NO: 38397
  chr21:39289195-39289325
  hyper

SEQ ID NO: 58966 - DNA, 82 bp, Homo sapiens; identical to SEQ ID NO: 38398
  chr21:40032153-40032235
  hyper

SEQ ID NO: 58967 - DNA, 46 bp, Homo sapiens; identical to SEQ ID NO: 38399
  chr21:40032796-40032842
  hyper

SEQ ID NO: 58968 - DNA, 105 bp, Homo sapiens; identical to SEQ ID NO: 38400
  chr21:40033106-40033211
  hyper

SEQ ID NO: 58969 - DNA, 395 bp, Homo sapiens; identical to SEQ ID NO: 38402
  chr21:42688823-42689218
  hyper

SEQ ID NO: 58970 - DNA, 82 bp, Homo sapiens; identical to SEQ ID NO: 38403
  chr21:42878710-42878792
  hyper

SEQ ID NO: 58971 - DNA, 42 bp, Homo sapiens; identical to SEQ ID NO: 38404
  chr21:42880442-42880484
  hyper

SEQ ID NO: 58972 - DNA, 30 bp, Homo sapiens; identical to SEQ ID NO: 38405
  chr21:44073368-44073398
  hyper

SEQ ID NO: 58973 - DNA, 102 bp, Homo sapiens; identical to SEQ ID NO: 38406
  chr21:44494676-44494778
  hyper

SEQ ID NO: 58974 - DNA, 454 bp, Homo sapiens
  chr21:44495155-44495609
  hyper
ggtttccaggtgggagatccagaccctactgagacccggaaaccgccggccactccgcctccggaagcgacactttgggacaaagctggggacaagtaagcccagaagatcctcgggaagccgagaatttcgcgctccgctctcccacccacgctccgcctcccgcttgcatcctacagctcagctgcggtctcgcctggggctcagggaagtgaggtcccaggaaaacctccatcccccgaacgcaacctgggcagagccccgcgtccctcccccagcgggcacccacctcgcgtgccgcccgcgcaacgacagcgtttaccgccaccccacacggtccgccaaaaagggcgatttgcaaacagccatttcccatccacaatgcagcgaactcaatgctgggcaccgaaacgtgcatctcccccggattcccaccccgcgtccctgctccacg

SEQ ID NO: 58975 - DNA, 194 bp, Homo sapiens; identical to SEQ ID NO: 38409
  chr21:44495838-44496032
  hyper

SEQ ID NO: 58976 - DNA, 346 bp, Homo sapiens; identical to SEQ ID NO: 38410
  chr21:44496398-44496744
  hyper

SEQ ID NO: 58977 - DNA, 71 bp, Homo sapiens
  chr21:44847520-44847591
  hyper
ggggcccgggggcctcgcgggctcgcgcgtggggctggcggcgcggatgccctggggcgctgcagaccccg

SEQ ID NO: 58978 - DNA, 221 bp, Homo sapiens
  chr21:44847622-44847843
  hyper
cttttgctgttaaaatctgaaatgttcagcaagttagaaacttgaaacctaaggaagcgtgaccggccgctctggaagcccccgccgcgcggccggtcccggccccggccctcagcggcgctggcgtctgcgcgtcccggggctgcccccgcagcatgtggggctgggaccctcttcccgcgcgggccccgggcggacgctgcgggcggtgacggagccag

SEQ ID NO: 58979 - DNA, 299 bp, Homo sapiens
  chr21:45148316-45148615
  hyper
tgctctcccctggaacgcctggaactagggtggtcaggctggggtggaggagctcccctggaatgttccagagcttcccccactcctgccgttctgagtcaccctgcctccccggaggaggaggaggatcagctgagccgccgcgctcacgtagtgtctggctgtctgcctgtctgcctcgctgtgagcagagtgggatgctgccgataaggcgcgcacgtgggccctgggaggagcccgaggcagccactcccgcacgtgggcaggaggagggctgctcacaccaccggccgagggag

SEQ ID NO: 58980 - DNA, 249 bp, Homo sapiens
  chr21:45148758-45149007
  hyper
ggaggaagttgcgaccctttctaagccatcccactggcctggactctgctgggattattttgaccccccagggcagagtgtagccatctgactggctttctctctcggcaggagacggggcgcacgcctgcaggtgggggagccccaatacgtcacacggatgagcggggcaaagcccagccccccaccccgcacccgcccgcccgcaatcctgccccctggctgcggcctccgcggctcttcccaccc

SEQ ID NO: 58981 - DNA, 51 bp, Homo sapiens; identical to SEQ ID NO: 14000
  chr21:45875681-45875732
  hyper

SEQ ID NO: 58982 - DNA, 3 bp, Homo sapiens
  chr21:46126721-46126724
  hyper
cct

SEQ ID NO: 58983 - DNA, 289 bp, Homo sapiens; identical to SEQ ID NO: 38417
  chr21:46127234-46127523
  hyper

SEQ ID NO: 58984 - DNA, 28 bp, Homo sapiens
  chr21:46127878-46127906
  hyper
ctagcctgtgccccccgattccccccct

SEQ ID NO: 58985 - DNA, 30 bp, Homo sapiens; identical to SEQ ID NO: 14004
  chr21:46128279-46128309
  hyper

SEQ ID NO: 58986 - DNA, 18 bp, Homo sapiens
  chr21:46128884-46128902
  hyper
cactgagcagggtcccgc

SEQ ID NO: 58987 - DNA, 158 bp, Homo sapiens
  chr21:46128938-46129096
  hyper
cactcaggacagggagaggcaatggaaagagacgtggccgccctcgcatcctgcagctcccgcactcccagcctcccagcctcccacccagccccccagagcccaccagtgaccccgcccactgggtcctcagatggctcccacgggatctcctgcct

SEQ ID NO: 58988 - DNA, 68 bp, Homo sapiens
  chr21:46129376-46129444
  hyper
atgagtcctagaaagcgagagacgagaggggaatgagcgccgaaaatcaaagcaggttcccctcctga

SEQ ID NO: 58989 - DNA, 149 bp, Homo sapiens
  chr21:46129485-46129634
  hyper
cccccagcctcgcgaccgcctgtgacctgcgggtcaaccacccgccgcggctccacgccgtgggcacagactcagggagcaggatgagaaagctgagacggcgcagccacggcccggtgccttcacgcgcacagcgacacagccccagc

SEQ ID NO: 58990 - DNA, 30 bp, Homo sapiens; identical to SEQ ID NO: 38422
  chr21:46130412-46130442
  hyper

SEQ ID NO: 58991 - DNA, 30 bp, Homo sapiens; identical to SEQ ID NO: 38423
  chr21:46132288-46132318
  hyper

SEQ ID NO: 58992 - DNA, 34 bp, Homo sapiens; identical to SEQ ID NO: 38424
  chr21:46143070-46143104
  hyper

SEQ ID NO: 58993 - DNA, 217 bp, Homo sapiens; identical to SEQ ID NO: 38425
  chr21:46351695-46351912
  hyper

SEQ ID NO: 58994 - DNA, 56 bp, Homo sapiens; identical to SEQ ID NO: 38426
  chr21:46352791-46352847
  hyper

SEQ ID NO: 58995 - DNA, 436 bp, Homo sapiens; identical to SEQ ID NO: 38427
  chr21:46438321-46438757
  hyper

SEQ ID NO: 58996 - DNA, 8 bp, Homo sapiens
  chr21:46438964-46438972
  hyper
ctggaggt

SEQ ID NO: 58997 - DNA, 15 bp, Homo sapiens
  chr21:46439007-46439022
  hyper
cgtctgtcccaggcc

SEQ ID NO: 58998 - DNA, 134 bp, Homo sapiens; identical to SEQ ID NO: 38430
  chr21:46706841-46706975
  hyper

SEQ ID NO: 58999 - DNA, 378 bp, Homo sapiens; identical to SEQ ID NO: 38431
  chr21:46825344-46825722
  hyper

SEQ ID NO: 59000 - DNA, 63 bp, Homo sapiens; identical to SEQ ID NO: 38432
  chr21:47010090-47010153
  hyper

SEQ ID NO: 59001 - DNA, 44 bp, Homo sapiens
  chr21:47010451-47010495
  hyper
ggtcggcggcgtcagcggcagctcccagacgacctaggactgca

SEQ ID NO: 59002 - DNA, 79 bp, Homo sapiens; identical to SEQ ID NO: 38434
  chr21:47010703-47010782
  hyper

SEQ ID NO: 59003 - DNA, 55 bp, Homo sapiens
  chr21:47062825-47062880
  hyper
ttcggggttgcggcacggctgggaattcaacggccattcccgtcccgtcgggccc

SEQ ID NO: 59004 - DNA, 106 bp, Homo sapiens
  chr21:47063432-47063538
  hyper
ttccagagaactttccgggctcggattggccgcgccggttgatgttccgccctttcattggcccgcggcgcccgctttcgcgagcctgcccttgggcgggggcggg

SEQ ID NO: 59005 - DNA, 288 bp, Homo sapiens; identical to SEQ ID NO: 23499
  chr21:47063962-47064250
  hyper

SEQ ID NO: 59006 - DNA, 74 bp, Homo sapiens; identical to SEQ ID NO: 38437
  chr21:47392726-47392800
  hyper

SEQ ID NO: 59007 - DNA, 30 bp, Homo sapiens; identical to SEQ ID NO: 38438
  chr21:47393095-47393125
  hyper

SEQ ID NO: 59008 - DNA, 324 bp, Homo sapiens; identical to SEQ ID NO: 38439
  chr21:47517989-47518313
  hyper

SEQ ID NO: 59009 - DNA, 427 bp, Homo sapiens
  chr21:47518349-47518776
  hyper
cggagccggcctgggcggggtgggggggtccctgtctgcgcccgagctcggtgctgggacccccgctcccgagacgaccccggcaccgcacgccccgccaggccccgcgtctgcgagcggttcgggtccggctccggcccgcggggaagacgccccggctggctgggacctccgggggcgcagggcctctccccgggccggacggaaggggcggcggggcggggggaggaggggctttcggtgcccgagggcgggactgggcggggaggggacgcgggtggccccgacgccccatcgctgcgcccctcccggcctggagcccaccagggccccgccaggcccaggagaagctgcagacggaggcggctccccagggcggcgggacccgggctgacagcgacccgcagcccctgccgggccgcccaca

SEQ ID NO: 59010 - DNA, 121 bp, Homo sapiens; identical to SEQ ID NO: 38441
  chr21:47717212-47717333
  hyper

SEQ ID NO: 59011 - DNA, 300 bp, Homo sapiens; identical to SEQ ID NO: 38442
  chr21:48087199-48087499
  hyper

SEQ ID NO: 59012 - DNA, 267 bp, Homo sapiens; identical to SEQ ID NO: 38443
  chr21:48087715-48087982
  hyper

SEQ ID NO: 59013 - DNA, 11 bp, Homo sapiens
  chr22:17081921-17081932
  hyper
attccttttcc

SEQ ID NO: 59014 - DNA, 33 bp, Homo sapiens; identical to SEQ ID NO: 38445
  chr22:17082347-17082380
  hyper

SEQ ID NO: 59015 - DNA, 108 bp, Homo sapiens; identical to SEQ ID NO: 38446
  chr22:17082786-17082894
  hyper

SEQ ID NO: 59016 - DNA, 59 bp, Homo sapiens
  chr22:17083003-17083062
  hyper
ccgaggagcctggagccccggccccgagccccccagccgcagacaaaagacctcggggc

SEQ ID NO: 59017 - DNA, 189 bp, Homo sapiens
  chr22:17083207-17083396
  hyper
ggcgggatgggggcggggcgggcccgcgggcggcggcagctcccggccccggccccacgcccctcggtagccgcccgcgcccggcctcccccgctccgcgccgcccgcccgggctcccgtcggcgcccggcttcgcacactttacttttcagtcgggccttttcagtgggtcttctccgcgactcttct

SEQ ID NO: 59018 - DNA, 29 bp, Homo sapiens
  chr22:17083524-17083553
  hyper
cggagctgtcaaaacgcccgggccaggtg

SEQ ID NO: 59019 - DNA, 209 bp, Homo sapiens; identical to SEQ ID NO: 38450
  chr22:17083858-17084067
  hyper

SEQ ID NO: 59020 - DNA, 15 bp, Homo sapiens
  chr22:17090840-17090855
  hyper
cggccaagagcggat

SEQ ID NO: 59021 - DNA, 142 bp, Homo sapiens
  chr22:17600944-17601086
  hyper
agcgccatggtgagacggaagcccgtggtgccgaagggcgcgcgtagctcgatgaggtctaggatggacgtgcccaggatcagcaccaccttgggagtgaaggcgatggagtagataagccaggccaggtaggcgaaggcga

SEQ ID NO: 59022 - DNA, 74 bp, Homo sapiens
  chr22:17601368-17601442
  hyper
ggtccagcaggccgccctgcgccagcagcagcaccacggacagcgcctggtagccccagcggcacctgggactg

SEQ ID NO: 59023 - DNA, 101 bp, Homo sapiens
  chr22:17602410-17602511
  hyper
ggcgggggtgcagtgcgtcacagtcgggtcgggagccctgtggcctggaggaagcgggaggaggcgcgggcagccgccagggcgaggcgacccggtgcggg

SEQ ID NO: 59024 - DNA, 15 bp, Homo sapiens
  chr22:17849412-17849427
  hyper
ttagcagtactccac

SEQ ID NO: 59025 - DNA, 376 bp, Homo sapiens; identical to SEQ ID NO: 38456
  chr22:17849501-17849877
  hyper

SEQ ID NO: 59026 - DNA, 340 bp, Homo sapiens
  chr22:17850114-17850454
  hyper
caaagtcctggagggcggagggcgcctcgtgagagttctcgggggtgcggcccgcgccccctgggtcctgcggatctgggcccgggggcgcgcgccccgcccctccccctccctggcggtgcagctgtccgggcgggggtggggcgggggccggggcccgcgtgggattaactaggaccggggcgggagtcgaccgcggccggcggggagggctagccccgctctggcgggcgggcgcgtggcaggggctcccggaggccccgagctcccgggaggcgctccggccaacttcgggccggtggggaccgggcctgggcgcggggctctgaaggtgtggaag

SEQ ID NO: 59027 - DNA, 73 bp, Homo sapiens
  chr22:17850621-17850694
  hyper
gcccggggctttgtgataactgggccgaaacccgagggtcctggagcgcggcgggtggcgggagcttgcggag

SEQ ID NO: 59028 - DNA, 78 bp, Homo sapiens; identical to SEQ ID NO: 38458
  chr22:17850953-17851031
  hyper

SEQ ID NO: 59029 - DNA, 30 bp, Homo sapiens; identical to SEQ ID NO: 38459
  chr22:18986543-18986573
  hyper

SEQ ID NO: 59030 - DNA, 678 bp, Homo sapiens
  chr22:19016854-19017532
  hyper
gagacccggccctgccggggttccctgcgccccagaccggaacccccagggctttggtcgttcccacagccgtcccgcgggccccctccacggtgcgtcgcctgggccccagcggtcgctaggctgcagcctggggctcccggccatcccgggcgctggcggcggtggaggcagcagggcggatggcggagcccggccgcccgtgggcccaggcgcgtagtgcgtacagagccagcgaggtgctgcggcgcggcacgggccgccggcgggatccggggccgcaatccaatgggccgggccaggaagacgcccgagccccgggccggatggctcgcctgcgcggccagctccgggccgaagcggcttcgcggtccgaggtgccgcggctgctgaagctggtggagcgtgcgggggccggggcggccgggcgcgggcgagaggaccggcgcgcacagccgcgggctccgtgtgctcggtatgcggggagccccgcggcggggccacctacccggcgggggtcctggaggtgagcgagcggcggctgcaggagggcctggcggcagtgcgcgaggagctgggcgccgggattgaggcgctgcgcgcggagcttcgagcggagctggatgccctgcgcgcgctgctgccgccgccgccgtccccgcctgcccgccgcgagcc

SEQ ID NO: 59031 - DNA, 27 bp, Homo sapiens
  chr22:19017567-19017594
  hyper
ccctgccgcggacgctcggcaccgtga

SEQ ID NO: 59032 - DNA, 282 bp, Homo sapiens; identical to SEQ ID NO: 23511
  chr22:19511567-19511849
  hyper

SEQ ID NO: 59033 - DNA, 67 bp, Homo sapiens; identical to SEQ ID NO: 1519
  chr22:19512252-19512319
  hyper

SEQ ID NO: 59034 - DNA, 27 bp, Homo sapiens
  chr22:19512376-19512403
  hyper
cgtagaggccctcgtaggggggctctc

SEQ ID NO: 59035 - DNA, 20 bp, Homo sapiens
  chr22:19706677-19706697
  hyper
ccccgcggctggatccgggc

SEQ ID NO: 59036 - DNA, 17 bp, Homo sapiens
  chr22:19711723-19711740
  hyper
gcgcccccagcgctgcg

SEQ ID NO: 59037 - DNA, 145 bp, Homo sapiens; identical to SEQ ID NO: 14032
  chr22:19742613-19742758
  hyper

SEQ ID NO: 59038 - DNA, 46 bp, Homo sapiens; identical to SEQ ID NO: 23515
  chr22:19742788-19742834
  hyper

SEQ ID NO: 59039 - DNA, 23 bp, Homo sapiens
  chr22:19742969-19742992
  hyper
agcactttcgtgggatggaggga

SEQ ID NO: 59040 - DNA, 46 bp, Homo sapiens
  chr22:19748598-19748644
  hyper
cctacccgtttgcgccggccgccggggccgccaccagcgccgccgc

SEQ ID NO: 59041 - DNA, 32 bp, Homo sapiens; identical to SEQ ID NO: 38472
  chr22:19748960-19748992
  hyper

SEQ ID NO: 59042 - DNA, 1439 bp, Homo sapiens; identical to SEQ ID NO: 38473
  chr22:20790689-20792128
  hyper

SEQ ID NO: 59043 - DNA, 146 bp, Homo sapiens; identical to SEQ ID NO: 38475
  chr22:21311370-21311516
  hyper

SEQ ID NO: 59044 - DNA, 32 bp, Homo sapiens; identical to SEQ ID NO: 38476
  chr22:21319163-21319195
  hyper

SEQ ID NO: 59045 - DNA, 213 bp, Homo sapiens; identical to SEQ ID NO: 38477
  chr22:21319645-21319858
  hyper

SEQ ID NO: 59046 - DNA, 249 bp, Homo sapiens; identical to SEQ ID NO: 38478
  chr22:21333767-21334016
  hyper

SEQ ID NO: 59047 - DNA, 81 bp, Homo sapiens; identical to SEQ ID NO: 38479
  chr22:21368301-21368382
  hyper

SEQ ID NO: 59048 - DNA, 152 bp, Homo sapiens
  chr22:21368435-21368587
  hyper
cgtccacaggccgccgtcgcctcttcctcctgctttttatcctccccagacctctggcaggaaccgctcatcgttacgcccctttcgcagcctcagaccctgaggcggagaccgcttggcgcctcacttagagcgcgacccggggatgtggg

SEQ ID NO: 59049 - DNA, 80 bp, Homo sapiens
  chr22:21368617-21368697
  hyper
tgtggcgtccatcgactggcgtctgccacggcaattagcgacgcgctcccccgcggcggtcgccccggcaacccagtgct

SEQ ID NO: 59050 - DNA, 30 bp, Homo sapiens; identical to SEQ ID NO: 38481
  chr22:21386579-21386609
  hyper

SEQ ID NO: 59051 - DNA, 71 bp, Homo sapiens; identical to SEQ ID NO: 38482
  chr22:21386912-21386983
  hyper

SEQ ID NO: 59052 - DNA, 201 bp, Homo sapiens; identical to SEQ ID NO: 38483
  chr22:21400082-21400283
  hyper

SEQ ID NO: 59053 - DNA, 90 bp, Homo sapiens; identical to SEQ ID NO: 23519
  chr22:22862697-22862787
  hyper

SEQ ID NO: 59054 - DNA, 88 bp, Homo sapiens; identical to SEQ ID NO: 4903
  chr22:22863219-22863307
  hyper

SEQ ID NO: 59055 - DNA, 88 bp, Homo sapiens; identical to SEQ ID NO: 38486
  chr22:23908151-23908239
  hyper

SEQ ID NO: 59056 - DNA, 279 bp, Homo sapiens; identical to SEQ ID NO: 38487
  chr22:23908636-23908915
  hyper

SEQ ID NO: 59057 - DNA, 153 bp, Homo sapiens
  chr22:24180534-24180687
  hyper
atacggtcataaggacgcccccgaagagaaacatgaagacgaagtcggccgtgcggccgcggaaggagccctcttccagcatgcggcagtagcggaacctacggcgtcggtataggaagtgccaccaggcggggcctcagtttccccgtcccg

SEQ ID NO: 59058 - DNA, 228 bp, Homo sapiens; identical to SEQ ID NO: 23524
  chr22:24180766-24180994
  hyper

SEQ ID NO: 59059 - DNA, 625 bp, Homo sapiens; identical to SEQ ID NO: 38489
  chr22:24181054-24181679
  hyper

SEQ ID NO: 59060 - DNA, 270 bp, Homo sapiens; identical to SEQ ID NO: 38490
  chr22:24551644-24551914
  hyper

SEQ ID NO: 59061 - DNA, 419 bp, Homo sapiens; identical to SEQ ID NO: 38491
  chr22:24552189-24552608
  hyper

SEQ ID NO: 59062 - DNA, 106 bp, Homo sapiens
  chr22:24820224-24820330
  hyper
tgtcccaaactgcaccggaaggcgcgcaggggtaggcggggagggaaggcaagtgcggcggccggcgcggcgcggggtgcggagccgcaggtagcgggcggggagc

SEQ ID NO: 59063 - DNA, 48 bp, Homo sapiens
  chr22:24820396-24820444
  hyper
tcgcgagctcctccagcagggatggaccgggggcgcagaggcgcttcc

SEQ ID NO: 59064 - DNA, 369 bp, Homo sapiens; identical to SEQ ID NO: 38493
  chr22:25678246-25678615
  hyper

SEQ ID NO: 59065 - DNA, 132 bp, Homo sapiens; identical to SEQ ID NO: 23527
  chr22:25678616-25678748
  hyper

SEQ ID NO: 59066 - DNA, 128 bp, Homo sapiens; identical to SEQ ID NO: 23528
  chr22:25679337-25679465
  hyper

SEQ ID NO: 59067 - DNA, 236 bp, Homo sapiens
  chr22:25816871-25817107
  hyper
tcctttgtggccacccggaggggagagacttggttgggaggcgccaaccgagctggccgctgggactctgcacccaggtgcgccaacccttgggcgcacgctccccgcagaccctcgctgaaggagcggtgggcggcgcgccgcgaccctggcgggctacagattacaccgcttgcagggcgctgctggggcgcgcagagcggggctgccccagggtggctcccccaggttggggc

SEQ ID NO: 59068 - DNA, 278 bp, Homo sapiens; identical to SEQ ID NO: 23530
  chr22:25817180-25817458
  hyper

SEQ ID NO: 59069 - DNA, 39 bp, Homo sapiens; identical to SEQ ID NO: 23531
  chr22:25817612-25817651
  hyper

SEQ ID NO: 59070 - DNA, 30 bp, Homo sapiens; identical to SEQ ID NO: 14049
  chr22:26564863-26564893
  hyper

SEQ ID NO: 59071 - DNA, 177 bp, Homo sapiens; identical to SEQ ID NO: 14050
  chr22:26565184-26565361
  hyper

SEQ ID NO: 59072 - DNA, 131 bp, Homo sapiens; identical to SEQ ID NO: 14051
  chr22:26565502-26565633
  hyper

SEQ ID NO: 59073 - DNA, 64 bp, Homo sapiens; identical to SEQ ID NO: 38501
  chr22:26565935-26565999
  hyper

SEQ ID NO: 59074 - DNA, 448 bp, Homo sapiens; identical to SEQ ID NO: 38502
  chr22:27053580-27054028
  hyper

SEQ ID NO: 59075 - DNA, 66 bp, Homo sapiens; identical to SEQ ID NO: 38503
  chr22:27069172-27069238
  hyper

SEQ ID NO: 59076 - DNA, 30 bp, Homo sapiens; identical to SEQ ID NO: 38504
  chr22:27695238-27695268
  hyper

SEQ ID NO: 59077 - DNA, 30 bp, Homo sapiens; identical to SEQ ID NO: 38505
  chr22:28196522-28196552
  hyper

SEQ ID NO: 59078 - DNA, 37 bp, Homo sapiens; identical to SEQ ID NO: 38506
  chr22:28196966-28197003
  hyper

SEQ ID NO: 59079 - DNA, 278 bp, Homo sapiens; identical to SEQ ID NO: 38507
  chr22:28197276-28197554
  hyper

SEQ ID NO: 59080 - DNA, 346 bp, Homo sapiens; identical to SEQ ID NO: 38508
  chr22:28198055-28198401
  hyper

SEQ ID NO: 59081 - DNA, 21 bp, Homo sapiens
  chr22:28838179-28838200
  hyper
ccttttccccatgatcgattc

SEQ ID NO: 59082 - DNA, 147 bp, Homo sapiens; identical to SEQ ID NO: 23540
  chr22:28838292-28838439
  hyper

SEQ ID NO: 59083 - DNA, 50 bp, Homo sapiens; identical to SEQ ID NO: 38510
  chr22:28838794-28838844
  hyper

SEQ ID NO: 59084 - DNA, 813 bp, Homo sapiens; identical to SEQ ID NO: 38511
  chr22:29075406-29076219
  hyper

SEQ ID NO: 59085 - DNA, 64 bp, Homo sapiens; identical to SEQ ID NO: 38512
  chr22:29426589-29426653
  hyper

SEQ ID NO: 59086 - DNA, 30 bp, Homo sapiens; identical to SEQ ID NO: 38513
  chr22:29709206-29709236
  hyper

SEQ ID NO: 59087 - DNA, 71 bp, Homo sapiens; identical to SEQ ID NO: 38514
  chr22:29875904-29875975
  hyper

SEQ ID NO: 59088 - DNA, 109 bp, Homo sapiens; identical to SEQ ID NO: 38515
  chr22:29876004-29876113
  hyper

SEQ ID NO: 59089 - DNA, 307 bp, Homo sapiens
  chr22:29876916-29877223
  hyper
gctgcaggaggagtgcggctacctgcggcgccaccaccaggaagaggtgggcgagctgctcggccagatccagggctccggcgccgcgcaggcgcagatgcaggccgagacgcgcgacgccctgaagtgcgacgtgacgtcggcgctgcgcgagattcgcgcgcagcttgaaggccacgcggtgcagagcacgctgcagtccgaggagtggttccgaggtacgcaggcgcgcgggtggggggaggggcgcccctgctgaccccgcagcgaacttttgggctgcgtgacccaagggggcgctgccgga

SEQ ID NO: 59090 - DNA, 286 bp, Homo sapiens
  chr22:29877299-29877585
  hyper
ggtctcttgtgggacgccccaactctgggttgtccttcggttccccctttccaggttctttacggctgtacttcaactctgggccccctgctgctctctaccccaagcttaggcgaccccactctgagatccctcccccgtcaagaaaaaaacaagtttcctctacaggaaaaaagtggtgcaggattctggtctgcaagcgctggagactcttagcccttctaagtagcaaggcttccccgccaatgctgccatgccctctcctacaccccgcaagaaactctat

SEQ ID NO: 59091 - DNA, 461 bp, Homo sapiens; identical to SEQ ID NO: 38517
  chr22:30115986-30116447
  hyper

SEQ ID NO: 59092 - DNA, 177 bp, Homo sapiens
  chr22:30116727-30116904
  hyper
ggcccagcccctgcccgcgtggtccccagcgctgcggaaacttgccgggccccgcagcggggtcacggggccgcgcagtcggcggtgacggtgcggcaacgcggcggactggggcgggggtccgcgctgagcccccagcgccggcccggccggagcacccgcatcctgatcccctcc

SEQ ID NO: 59093 - DNA, 462 bp, Homo sapiens; identical to SEQ ID NO: 38519
  chr22:30938045-30938507
  hyper

SEQ ID NO: 59094 - DNA, 74 bp, Homo sapiens
  chr22:30938584-30938658
  hyper
ccgcctcgggccgctgctctgcctgctgctccccgcgtcctgcgcctggtcaggagtggcgggtgaggaggagc

SEQ ID NO: 59095 - DNA, 30 bp, Homo sapiens; identical to SEQ ID NO: 38521
  chr22:31003156-31003186
  hyper

SEQ ID NO: 59096 - DNA, 114 bp, Homo sapiens; identical to SEQ ID NO: 23551
  chr22:31218396-31218510
  hyper

SEQ ID NO: 59097 - DNA, 254 bp, Homo sapiens
  chr22:31218540-31218794
  hyper
tgcacgcgtccgtgcaagcccccgggacccggcgccatgtagcgccccgccgattggaggctgccccgccgcgggaaatgaagggacgcggctgctgggacacggcctccgtgcgctccttctgcagctccggctgcctgaataaatttaagaagggttagtgcttgccgggcttccacccggagggaggccaggctccccgcgcatgcacgcccggtgcctggctttgctgcgtgatcgatccacgggagcct

SEQ ID NO: 59098 - DNA, 117 bp, Homo sapiens
  chr22:31218829-31218946
  hyper
gagcctcggggaacccctgtccccgcaccccgccggcgtgcgctcccggcttgcttcacgcgcggggcattttggagagggggctgcggctagagacttgtccgtctaattaaccta

SEQ ID NO: 59099 - DNA, 479 bp, Homo sapiens
  chr22:31480651-31481130
  hyper
tcagggttcttcagccgccacctccctctcttaagcgaggctcgggcggcgctggaaaagagttttggagagaagctggagcagtggttgaatctctgggaaaggacagatgagaacctgccccggtctcgggatcggtgcctctcgaagtctttccgaccccgggagcggctcctccagcacccggcgcccgccattactgcgccccgcgcgccggcccggcccccgctggcctcgtggcaagaacgggggcgtcccgagccgggctcctccccgcggggccgggccatataaggaaaagctaggcccgctccgcccgccctgcgccccagcgtctggccgatttggggacgcgggcagtcgcttccggccccggctcccgcacattcttgaggattgggccggggatgggaggaatggggacgcctggggacttgcacgccgcgtgcccctccaccacccgccgggacgccctctgc

SEQ ID NO: 59100 - DNA, 174 bp, Homo sapiens
  chr22:31481332-31481506
  hyper
ccttcagcgccccctggcgaggcttccctccaccgccggcgggacccccatgggcaaccgggggagctgggactgaaagcctggagagccccctccgttgtgctgttggggagactgaggcccagtgagacctcagggcctgccaggcgttcccaacagcgagggcagagagta

SEQ ID NO: 59101 - DNA, 378 bp, Homo sapiens; identical to SEQ ID NO: 38525
  chr22:32571939-32572317
  hyper

SEQ ID NO: 59102 - DNA, 87 bp, Homo sapiens
  chr22:33197652-33197739
  hyper
cccagcgctatatcactcggccgcccaggcagcggcgcagagcgggcagcaggcaggcggcgggcgctcagacggcttctcctcctc

SEQ ID NO: 59103 - DNA, 331 bp, Homo sapiens; identical to SEQ ID NO: 38527
  chr22:33197949-33198280
  hyper

SEQ ID NO: 59104 - DNA, 125 bp, Homo sapiens
  chr22:33454366-33454491
  hyper
tgcccctcaacgcgcgcgagcgcccccgcccggcggcccggcctccccgcgccgcggcgccccattggctcgggcaacgaggcccccggacggccccgcccacccgcgcccactccctcgcccac

SEQ ID NO: 59105 - DNA, 13 bp, Homo sapiens
  chr22:33454492-33454505
  hyper
cctctccccaacg

SEQ ID NO: 59106 - DNA, 30 bp, Homo sapiens; identical to SEQ ID NO: 14075
  chr22:35420285-35420315
  hyper

SEQ ID NO: 59107 - DNA, 30 bp, Homo sapiens; identical to SEQ ID NO: 14076
  chr22:36553195-36553225
  hyper

SEQ ID NO: 59108 - DNA, 30 bp, Homo sapiens; identical to SEQ ID NO: 38534
  chr22:36726916-36726946
  hyper

SEQ ID NO: 59109 - DNA, 589 bp, Homo sapiens; identical to SEQ ID NO: 38535
  chr22:37099177-37099766
  hyper

SEQ ID NO: 59110 - DNA, 57 bp, Homo sapiens; identical to SEQ ID NO: 38536
  chr22:37212414-37212471
  hyper

SEQ ID NO: 59111 - DNA, 92 bp, Homo sapiens; identical to SEQ ID NO: 38537
  chr22:37212682-37212774
  hyper

SEQ ID NO: 59112 - DNA, 93 bp, Homo sapiens; identical to SEQ ID NO: 38538
  chr22:37212813-37212906
  hyper

SEQ ID NO: 59113 - DNA, 117 bp, Homo sapiens; identical to SEQ ID NO: 38539
  chr22:37213161-37213278
  hyper

SEQ ID NO: 59114 - DNA, 209 bp, Homo sapiens; identical to SEQ ID NO: 38540
  chr22:37730661-37730870
  hyper

SEQ ID NO: 59115 - DNA, 325 bp, Homo sapiens; identical to SEQ ID NO: 38541
  chr22:37730926-37731251
  hyper

SEQ ID NO: 59116 - DNA, 87 bp, Homo sapiens; identical to SEQ ID NO: 38542
  chr22:37816102-37816189
  hyper

SEQ ID NO: 59117 - DNA, 11 bp, Homo sapiens
  chr22:38220642-38220653
  hyper
ctgggccgcag

SEQ ID NO: 59118 - DNA, 60 bp, Homo sapiens; identical to SEQ ID NO: 14080
  chr22:38221288-38221348
  hyper

SEQ ID NO: 59119 - DNA, 112 bp, Homo sapiens
  chr22:38476957-38477069
  hyper
gcgcgcccaccatgccgtaggagaggccgaaggcgacgcagaaggcgacgagggcgccgtaggagcgcgcgcgtgcgctgctcaggtctgtgagcccattggccagcagggc

SEQ ID NO: 59120 - DNA, 12 bp, Homo sapiens
  chr22:38477794-38477806
  hyper
gggacttcgaag

SEQ ID NO: 59121 - DNA, 35 bp, Homo sapiens; identical to SEQ ID NO: 38547
  chr22:38478441-38478476
  hyper

SEQ ID NO: 59122 - DNA, 288 bp, Homo sapiens; identical to SEQ ID NO: 38548
  chr22:38850818-38851106
  hyper

SEQ ID NO: 59123 - DNA, 100 bp, Homo sapiens; identical to SEQ ID NO: 38549
  chr22:38965918-38966018
  hyper

SEQ ID NO: 59124 - DNA, 158 bp, Homo sapiens; identical to SEQ ID NO: 38550
  chr22:39473204-39473362
  hyper

SEQ ID NO: 59125 - DNA, 157 bp, Homo sapiens; identical to SEQ ID NO: 38551
  chr22:39784321-39784478
  hyper

SEQ ID NO: 59126 - DNA, 66 bp, Homo sapiens; identical to SEQ ID NO: 38552
  chr22:39853091-39853157
  hyper

SEQ ID NO: 59127 - DNA, 128 bp, Homo sapiens
  chr22:39853393-39853521
  hyper
gggccgcgctgcctgcgatgccgggcgcccgccgcagccgctgccgccggagcccgggatggggcgagaggctgcggcggacgccagcatctccccgccggggaccccgggggccgcggagccgccgc

SEQ ID NO: 59128 - DNA, 134 bp, Homo sapiens; identical to SEQ ID NO: 38555
  chr22:39854212-39854346
  hyper

SEQ ID NO: 59129 - DNA, 30 bp, Homo sapiens; identical to SEQ ID NO: 14086
  chr22:39942115-39942145
  hyper

SEQ ID NO: 59130 - DNA, 303 bp, Homo sapiens; identical to SEQ ID NO: 38557
  chr22:39953480-39953783
  hyper

SEQ ID NO: 59131 - DNA, 60 bp, Homo sapiens; identical to SEQ ID NO: 23568
  chr22:39954516-39954576
  hyper

SEQ ID NO: 59132 - DNA, 30 bp, Homo sapiens; identical to SEQ ID NO: 38559
  chr22:40060586-40060616
  hyper

SEQ ID NO: 59133 - DNA, 211 bp, Homo sapiens; identical to SEQ ID NO: 38560
  chr22:40081794-40082005
  hyper

SEQ ID NO: 59134 - DNA, 349 bp, Homo sapiens; identical to SEQ ID NO: 38561
  chr22:42306171-42306520
  hyper

SEQ ID NO: 59135 - DNA, 142 bp, Homo sapiens; identical to SEQ ID NO: 38562
  chr22:42307095-42307237
  hyper

SEQ ID NO: 59136 - DNA, 45 bp, Homo sapiens; identical to SEQ ID NO: 23571
  chr22:42310042-42310087
  hyper

SEQ ID NO: 59137 - DNA, 528 bp, Homo sapiens
  chr22:42310220-42310748
  hyper
gcgctgcgacgccgcacacagcgtagacggccgtatggctgcgctcgcggccggggtcccggggcgctgcggtgtcgcgggcgcgggcgggcggccggcctgtctggacccaggccggcgtgtcgtagttggaacagcggctctggtcgaggcgccgcggcccgtcgtggcagcagaagcggtagccgcacgtgccgcagcagaagctgtaggctccggagctgcagttgaagggcgggtcccactggcccatcacgtcgtagtagccgcggcagcggtcgcccccctccggggctgtcgtgccgggcgccgcgggaccctgcgcctcgggggctcccgcgcggcccgacggcggccgcgccagcagcaacgcgagccgaagcgcgagcgcgagccggaggccgggaggacggcggccgccgagcagtccccgcgccccggcccgcgccatcgggcccgcgcctcccgctactgcgcccggtgcatggccgggcgccgcggctccctccggctcggctcctccgctcc

SEQ ID NO: 59138 - DNA, 165 bp, Homo sapiens
  chr22:42311356-42311521
  hyper
cctgtaccttacaggcgcggaggtcaaagcagcccggaattgccccgggacgggcagggccaccctctcacctccttcccgtcccctctgtccgttctgatcataacataaggagggccccttcccctctcggcgcctcgattttcccacctgtcaaatgggaag

SEQ ID NO: 59139 - DNA, 65 bp, Homo sapiens; identical to SEQ ID NO: 38565
  chr22:42315616-42315681
  hyper

SEQ ID NO: 59140 - DNA, 38 bp, Homo sapiens
  chr22:42353573-42353611
  hyper
gtgatgcttgggcctcgggctctgtgaagcctgaaggt

SEQ ID NO: 59141 - DNA, 132 bp, Homo sapiens
  chr22:42353892-42354024
  hyper
ctgagccgacttgcaaaggggataggcgggcggcaccgggcgccctcccccagcccgccccgcccgcccagcccggagacccccaaggcagagggaggccggcctgttggccctccacgctatccctctgca

SEQ ID NO: 59142 - DNA, 75 bp, Homo sapiens; identical to SEQ ID NO: 14093
  chr22:42679405-42679480
  hyper

SEQ ID NO: 59143 - DNA, 268 bp, Homo sapiens; identical to SEQ ID NO: 38568
  chr22:42679916-42680184
  hyper

SEQ ID NO: 59144 - DNA, 59 bp, Homo sapiens; identical to SEQ ID NO: 38569
  chr22:42696044-42696103
  hyper

SEQ ID NO: 59145 - DNA, 163 bp, Homo sapiens; identical to SEQ ID NO: 38570
  chr22:42896542-42896705
  hyper

SEQ ID NO: 59146 - DNA, 63 bp, Homo sapiens; identical to SEQ ID NO: 38571
  chr22:43116061-43116124
  hyper

SEQ ID NO: 59147 - DNA, 85 bp, Homo sapiens; identical to SEQ ID NO: 38572
  chr22:43738565-43738650
  hyper

SEQ ID NO: 59148 - DNA, 500 bp, Homo sapiens; identical to SEQ ID NO: 38573
  chr22:43739010-43739510
  hyper

SEQ ID NO: 59149 - DNA, 50 bp, Homo sapiens; identical to SEQ ID NO: 38574
  chr22:43739731-43739781
  hyper

SEQ ID NO: 59150 - DNA, 259 bp, Homo sapiens
  chr22:43739825-43740084
  hyper
cgtttcttgagcacctactggggaccgagtgcgggcgaggcagcagcgaaggaaccgggaggggaaacctcgtgaagatcacttgaaaattgacgttcaaaacaaacgaactttttagcactcgtcaaaggacagtggcccgtcagtgtgcttgtcacggggcggccgcaggacctgcgtctggaaccgggcgggcgcccgggacggacaatgccgcttggcggtcggtcccgcgggaggcccccgcacggggctaacc

SEQ ID NO: 59151 - DNA, 33 bp, Homo sapiens
  chr22:43740128-43740161
  hyper
cccctgtgacagaccgggcggggccaggaggag

SEQ ID NO: 59152 - DNA, 81 bp, Homo sapiens; identical to SEQ ID NO: 23580
  chr22:44258285-44258366
  hyper

SEQ ID NO: 59153 - DNA, 13 bp, Homo sapiens
  chr22:44258506-44258519
  hyper
tcctccccgcccc

SEQ ID NO: 59154 - DNA, 72 bp, Homo sapiens; identical to SEQ ID NO: 38578
  chr22:44263900-44263972
  hyper

SEQ ID NO: 59155 - DNA, 206 bp, Homo sapiens
  chr22:44287444-44287650
  hyper
taaatgaggctgtgccgggggtagagggcgcagagcacagcgccaggcaccagcgtctctgggctcgatccgctttcattaagctgtccccgccccttttcgcccccgcggtccgggactcaccgaccgacttgccgcagacgatgctgactgcgttgagcgccccagacgaggaaccgtagatgcggcgggcgccctggaggagg

SEQ ID NO: 59156 - DNA, 103 bp, Homo sapiens
  chr22:44287696-44287799
  hyper
cgcccaggtagccggcgccggagaaggacaggttccatctgccctcctcctctaagaagcccatggcgggtggaccgggcggggtgatcgggacgaggaaggg

SEQ ID NO: 59157 - DNA, 37 bp, Homo sapiens; identical to SEQ ID NO: 38580
  chr22:44319869-44319906
  hyper

SEQ ID NO: 59158 - DNA, 82 bp, Homo sapiens; identical to SEQ ID NO: 38581
  chr22:44320125-44320207
  hyper

SEQ ID NO: 59159 - DNA, 193 bp, Homo sapiens; identical to SEQ ID NO: 38582
  chr22:44420487-44420680
  hyper

SEQ ID NO: 59160 - DNA, 139 bp, Homo sapiens; identical to SEQ ID NO: 14101
  chr22:44726839-44726978
  hyper

SEQ ID NO: 59161 - DNA, 884 bp, Homo sapiens; identical to SEQ ID NO: 38584
  chr22:44727367-44728251
  hyper

SEQ ID NO: 59162 - DNA, 57 bp, Homo sapiens; identical to SEQ ID NO: 38585
  chr22:45016369-45016426
  hyper

SEQ ID NO: 59163 - DNA, 84 bp, Homo sapiens
  chr22:45403002-45403086
  hyper
actgaaaagggttagcgcatttgtcccaagccttcggtccagcccggcggcccagaccaggcgcgggccgcggcactgccatct

SEQ ID NO: 59164 - DNA, 47 bp, Homo sapiens
  chr22:45403133-45403180
  hyper
ccccctcccatcactttttaactttaaagactcgacacgaacgcccg

SEQ ID NO: 59165 - DNA, 30 bp, Homo sapiens; identical to SEQ ID NO: 38587
  chr22:45403911-45403941
  hyper

SEQ ID NO: 59166 - DNA, 284 bp, Homo sapiens
  chr22:45404433-45404717
  hyper
cgctgagcgcggcgatccgcggctgcctttcgtggagctgcttcttgaggtcgccgttctgcggaaacacggaggagcgggctcaggcaggccacccggggtcaggtgcaccccagcaccgcgggccgcggcaccccccgcccggagccccacgggcggggccggccgcagcgcaccccaagtttcccgggccgcgtcctgcacgcgcggcggccgggcagtgccgcgcggggccgcttacctgtggctgccgcctcatcggggcagctcgcggggcggggcgg

SEQ ID NO: 59167 - DNA, 257 bp, Homo sapiens
  chr22:45405061-45405318
  hyper
gggaccggctcacgaaggggccccctccaggcaccctcccagtcatgcagaccctacatcgcttaagagaagactccaggctcgggtcccacgcgtcctcgatcccgcaaactgtgcaggacagcgccaggggcaggcggaggggagcccagaagggggtccgcgcgtgtgctcactccctcgccccccgcccccgggcaggctccagcctggaagacccagagacccggaagagaggatgctgggctcgggtcccc

SEQ ID NO: 59168 - DNA, 14 bp, Homo sapiens
  chr22:45405418-45405432
  hyper
ctgcagctccatcc

SEQ ID NO: 59169 - DNA, 144 bp, Homo sapiens
  chr22:45405476-45405620
  hyper
cgggaagttgcgcggctccgcgggggccagagcgggcgcgggcggacgcggcctccgggctgggttgggggggacacgagccccctcccccacggccgaaagggaagggggctggcgaaggggaagacaggcttccgggcgccg

SEQ ID NO: 59170 - DNA, 232 bp, Homo sapiens; identical to SEQ ID NO: 23591
  chr22:45406039-45406271
  hyper

SEQ ID NO: 59171 - DNA, 57 bp, Homo sapiens
  chr22:45406328-45406385
  hyper
aattagtcgcgtcgccacattcccccgccgcctgatggcctccgtgttgtttaaaca

SEQ ID NO: 59172 - DNA, 48 bp, Homo sapiens; identical to SEQ ID NO: 38594
  chr22:45680744-45680792
  hyper

SEQ ID NO: 59173 - DNA, 76 bp, Homo sapiens; identical to SEQ ID NO: 38595
  chr22:45809534-45809610
  hyper

SEQ ID NO: 59174 - DNA, 34 bp, Homo sapiens; identical to SEQ ID NO: 38596
  chr22:45899024-45899058
  hyper

SEQ ID NO: 59175 - DNA, 39 bp, Homo sapiens
  chr22:46263809-46263848
  hyper
ccagactcactgcccacccccggccgagctggctgccag

SEQ ID NO: 59176 - DNA, 58 bp, Homo sapiens; identical to SEQ ID NO: 38600
  chr22:46367066-46367124
  hyper

SEQ ID NO: 59177 - DNA, 22 bp, Homo sapiens
  chr22:46368102-46368124
  hyper
cgacagtagaagcatggtgggc

SEQ ID NO: 59178 - DNA, 30 bp, Homo sapiens; identical to SEQ ID NO: 38602
  chr22:46373796-46373826
  hyper

SEQ ID NO: 59179 - DNA, 132 bp, Homo sapiens; identical to SEQ ID NO: 38603
  chr22:46440571-46440703
  hyper

SEQ ID NO: 59180 - DNA, 44 bp, Homo sapiens; identical to SEQ ID NO: 38604
  chr22:46512635-46512679
  hyper

SEQ ID NO: 59181 - DNA, 98 bp, Homo sapiens; identical to SEQ ID NO: 38605
  chr22:46658645-46658743
  hyper

SEQ ID NO: 59182 - DNA, 207 bp, Homo sapiens; identical to SEQ ID NO: 38606
  chr22:46932741-46932948
  hyper

SEQ ID NO: 59183 - DNA, 115 bp, Homo sapiens; identical to SEQ ID NO: 38608
  chr22:48885907-48886022
  hyper

SEQ ID NO: 59184 - DNA, 455 bp, Homo sapiens; identical to SEQ ID NO: 23593
  chr22:48886204-48886659
  hyper

SEQ ID NO: 59185 - DNA, 111 bp, Homo sapiens
  chr22:48886849-48886960
  hyper
ctagaaatgctgtggcaccgagcggggaggggtcgccaagcctgggggtctcaacccgagctgcccaggcagacgaggccaccgtgggtgcgccggcgcccctgggaactc

SEQ ID NO: 59186 - DNA, 82 bp, Homo sapiens; identical to SEQ ID NO: 38610
  chr22:48970842-48970924
  hyper

SEQ ID NO: 59187 - DNA, 201 bp, Homo sapiens; identical to SEQ ID NO: 1525
  chr22:48971758-48971959
  hyper

SEQ ID NO: 59188 - DNA, 176 bp, Homo sapiens; identical to SEQ ID NO: 1526
  chr22:48971960-48972136
  hyper

SEQ ID NO: 59189 - DNA, 120 bp, Homo sapiens; identical to SEQ ID NO: 38615
  chr22:50242347-50242467
  hyper

SEQ ID NO: 59190 - DNA, 775 bp, Homo sapiens; identical to SEQ ID NO: 38616
  chr22:50242748-50243523
  hyper

SEQ ID NO: 59191 - DNA, 154 bp, Homo sapiens; identical to SEQ ID NO: 38617
  chr22:50421887-50422041
  hyper

SEQ ID NO: 59192 - DNA, 53 bp, Homo sapiens; identical to SEQ ID NO: 38618
  chr22:50453483-50453536
  hyper

SEQ ID NO: 59193 - DNA, 176 bp, Homo sapiens; identical to SEQ ID NO: 23599
  chr22:50496971-50497147
  hyper

SEQ ID NO: 59194 - DNA, 12 bp, Homo sapiens
  chr22:50497287-50497299
  hyper
ggggtcccacgc

SEQ ID NO: 59195 - DNA, 30 bp, Homo sapiens; identical to SEQ ID NO: 38621
  chr22:50609166-50609196
  hyper

SEQ ID NO: 59196 - DNA, 48 bp, Homo sapiens
  chr22:50623624-50623672
  hyper
ccccctggaggcctccggacgatcggaagtgactgagcgtccgggtcc

SEQ ID NO: 59197 - DNA, 63 bp, Homo sapiens
  chr22:50623815-50623878
  hyper
cccgggtcggggaccgctctgggccgacccccggaggacggactaggccgatccccagaggga

SEQ ID NO: 59198 - DNA, 44 bp, Homo sapiens; identical to SEQ ID NO: 38624
  chr22:50987052-50987096
  hyper

SEQ ID NO: 59199 - DNA, 38 bp, Homo sapiens; identical to SEQ ID NO: 38627
  chr22:51111972-51112010
  hyper

SEQ ID NO: 59200 - DNA, 124 bp, Homo sapiens
  chr22:51112026-51112150
  hyper
cgtaaaactaaaattcacttcccagtcgcaggtggagactagtagcgccccctcccctaggcccttccccgtaggtcgcgcccccatcccgccgtcgctaaggtgacggggagggggcgacagg

SEQ ID NO: 59201 - DNA, 158 bp, Homo sapiens; identical to SEQ ID NO: 38629
  chrX:2846239-2846397
  hyper

SEQ ID NO: 59202 - DNA, 42 bp, Homo sapiens; identical to SEQ ID NO: 38630
  chrX:2846814-2846856
  hyper

SEQ ID NO: 59203 - DNA, 53 bp, Homo sapiens; identical to SEQ ID NO: 38631
  chrX:2847143-2847196
  hyper

SEQ ID NO: 59204 - DNA, 289 bp, Homo sapiens; identical to SEQ ID NO: 38632
  chrX:3263410-3263699
  hyper

SEQ ID NO: 59205 - DNA, 45 bp, Homo sapiens; identical to SEQ ID NO: 38633
  chrX:3264124-3264169
  hyper

SEQ ID NO: 59206 - DNA, 238 bp, Homo sapiens; identical to SEQ ID NO: 38634
  chrX:3264775-3265013
  hyper

SEQ ID NO: 59207 - DNA, 29 bp, Homo sapiens
  chrX:3265150-3265179
  hyper
cgggctggccccgccggcatcccactagc

SEQ ID NO: 59208 - DNA, 25 bp, Homo sapiens
  chrX:6143655-6143680
  hyper
ctggcaattctgcttcgtcaggata

SEQ ID NO: 59209 - DNA, 145 bp, Homo sapiens; identical to SEQ ID NO: 38637
  chrX:6143800-6143945
  hyper

SEQ ID NO: 59210 - DNA, 39 bp, Homo sapiens; identical to SEQ ID NO: 38638
  chrX:6144250-6144289
  hyper

SEQ ID NO: 59211 - DNA, 92 bp, Homo sapiens; identical to SEQ ID NO: 38639
  chrX:6144913-6145005
  hyper

SEQ ID NO: 59212 - DNA, 88 bp, Homo sapiens; identical to SEQ ID NO: 23608
  chrX:6145243-6145331
  hyper

SEQ ID NO: 59213 - DNA, 32 bp, Homo sapiens
  chrX:6145688-6145720
  hyper
tggagcccgctccccggtttacagaagcagcc

SEQ ID NO: 59214 - DNA, 15 bp, Homo sapiens
  chrX:6145835-6145850
  hyper
cgtcatcttatccga

SEQ ID NO: 59215 - DNA, 47 bp, Homo sapiens; identical to SEQ ID NO: 38642
  chrX:8698504-8698551
  hyper

SEQ ID NO: 59216 - DNA, 109 bp, Homo sapiens
  chrX:8698754-8698863
  hyper
agagtttccctgaagcgagaaattgggaacttggaacaggtgggcacctagggatagaggcgagaagaagaaggagagaaggatgagagaagagaaaaataagcggagg

SEQ ID NO: 59217 - DNA, 161 bp, Homo sapiens; identical to SEQ ID NO: 23611
  chrX:8698897-8699058
  hyper

SEQ ID NO: 59218 - DNA, 89 bp, Homo sapiens; identical to SEQ ID NO: 38644
  chrX:8699110-8699199
  hyper

SEQ ID NO: 59219 - DNA, 8 bp, Homo sapiens
  chrX:8699566-8699574
  hyper
tccacaca

SEQ ID NO: 59220 - DNA, 80 bp, Homo sapiens; identical to SEQ ID NO: 38646
  chrX:8700319-8700399
  hyper

SEQ ID NO: 59221 - DNA, 80 bp, Homo sapiens; identical to SEQ ID NO: 38647
  chrX:13707316-13707396
  hyper

SEQ ID NO: 59222 - DNA, 114 bp, Homo sapiens; identical to SEQ ID NO: 38648
  chrX:13955908-13956022
  hyper

SEQ ID NO: 59223 - DNA, 241 bp, Homo sapiens; identical to SEQ ID NO: 38649
  chrX:13956288-13956529
  hyper

SEQ ID NO: 59224 - DNA, 326 bp, Homo sapiens; identical to SEQ ID NO: 38650
  chrX:13956748-13957074
  hyper

SEQ ID NO: 59225 - DNA, 125 bp, Homo sapiens; identical to SEQ ID NO: 38651
  chrX:15756104-15756229
  hyper

SEQ ID NO: 59226 - DNA, 195 bp, Homo sapiens; identical to SEQ ID NO: 38652
  chrX:16729945-16730140
  hyper

SEQ ID NO: 59227 - DNA, 161 bp, Homo sapiens; identical to SEQ ID NO: 38653
  chrX:16730152-16730313
  hyper

SEQ ID NO: 59228 - DNA, 30 bp, Homo sapiens; identical to SEQ ID NO: 38654
  chrX:16730872-16730902
  hyper

SEQ ID NO: 59229 - DNA, 30 bp, Homo sapiens; identical to SEQ ID NO: 38655
  chrX:33744540-33744570
  hyper

SEQ ID NO: 59230 - DNA, 33 bp, Homo sapiens; identical to SEQ ID NO: 38656
  chrX:40017591-40017624
  hyper

SEQ ID NO: 59231 - DNA, 69 bp, Homo sapiens; identical to SEQ ID NO: 38657
  chrX:40017828-40017897
  hyper

SEQ ID NO: 59232 - DNA, 44 bp, Homo sapiens; identical to SEQ ID NO: 38658
  chrX:40031390-40031434
  hyper

SEQ ID NO: 59233 - DNA, 53 bp, Homo sapiens; identical to SEQ ID NO: 38659
  chrX:40034521-40034574
  hyper

SEQ ID NO: 59234 - DNA, 176 bp, Homo sapiens; identical to SEQ ID NO: 38660
  chrX:91035629-91035805
  hyper

SEQ ID NO: 59235 - DNA, 136 bp, Homo sapiens; identical to SEQ ID NO: 38661
  chrX:91037072-91037208
  hyper

SEQ ID NO: 59236 - DNA, 37 bp, Homo sapiens; identical to SEQ ID NO: 38662
  chrX:103087260-103087297
  hyper

SEQ ID NO: 59237 - DNA, 30 bp, Homo sapiens; identical to SEQ ID NO: 38663
  chrY:4869647-4869677
  hyper

SEQ ID NO: 59238 - DNA, 80 bp, Homo sapiens; identical to SEQ ID NO: 38664
  AC211950.2_11234-25326:40-120
  hyper

SEQ ID NO: 59239 - DNA, 227 bp, Homo sapiens
  AC211950.2_11234-25326:13516-13743
  hyper
ttatcaggagcctgccggtactttgggccgccaaatccctggcaggacaagattgagggcggagcttctcagatactgccttgggcaaacttctacgagcctgagagtgtgaagaatacggatttccaaaataggtcatgagggagacctctctcctcacttcccaatttcgccttcttcatctctcggaattagagagcacgttccagttggagaagcaccacctg

SEQ ID NO: 59240 - DNA, 60 bp, Homo sapiens; identical to SEQ ID NO: 38667
  AC231386.2_19255-24791:4032-4092
  hyper

SEQ ID NO: 59241 - DNA, 200 bp, Homo sapiens; identical to SEQ ID NO: 38668
  AC241442.1_28021-33880:358-558
  hyper

SEQ ID NO: 59242 - DNA, 137 bp, Homo sapiens
  AC241851.2_88-34049:15124-15261
  hyper
cggcttcttgcccccaccgcccgggctttttgcgccgcggctttttgctgctatttgtccctgccaccgcggcgttttgcccccgcagccgcggctccttgccccctacgcggcttcctgcctccgccaccgtggct

SEQ ID NO: 59243 - DNA, 194 bp, Homo sapiens
  AC241851.2_88-34049:15350-15544
  hyper
acagcggcggctttctgcccctgcctctgagggtttttgcggctttatgtccccgctgtcgtggctttttgccgccgcggcttttggccccctccgccgcggctttttgcggcttttggcacccaacgccgcggctttttggggcttttggtccccgccaccggggcttttttcccccaccgccgcaggttttt

SEQ ID NO: 59244 - DNA, 35 bp, Homo sapiens; identical to SEQ ID NO: 38670
  AC241851.2_88-34049:15844-15879
  hyper

SEQ ID NO: 59245 - DNA, 123 bp, Homo sapiens; identical to SEQ ID NO: 38671
  AEKP01168736.1_1-4752:1196-1319
  hyper

SEQ ID NO: 59246 - DNA, 125 bp, Homo sapiens
  AEKP01168736.1_1-4752:1629-1754
  hyper
ggggcgcgtgcaggtcggagccggcaggtgaggagccagggtctaagctagggcccggggtccaaaggaaaggctttcagatctgagctccgcggctctggcggcggtggagctgggagcccgcg

SEQ ID NO: 59247 - DNA, 344 bp, Homo sapiens; identical to SEQ ID NO: 23624
  AEKP01168736.1_1-4752:2287-2631
  hyper

SEQ ID NO: 59248 - DNA, 30 bp, Homo sapiens; identical to SEQ ID NO: 38674
  AEKP01171767.1_199-12179:11068-11098
  hyper

SEQ ID NO: 59249 - DNA, 86 bp, Homo sapiens; identical to SEQ ID NO: 38675
  AEKP01197830.1_1-1408:113-199
  hyper

SEQ ID NO: 59250 - DNA, 43 bp, Homo sapiens; identical to SEQ ID NO: 38676
  AEKP01197830.1_1-1408:476-519
  hyper

SEQ ID NO: 59251 - DNA, 32 bp, Homo sapiens; identical to SEQ ID NO: 38677
  GL000258.1:893217-893249
  hyper

SEQ ID NO: 59252 - DNA, 82 bp, Homo sapiens; identical to SEQ ID NO: 14151
  JH159140.1:144237-144319
  hyper

SEQ ID NO: 59253 - DNA, 170 bp, Homo sapiens; identical to SEQ ID NO: 38679
  JH636052.4:1361659-1361829
  hyper

SEQ ID NO: 59254 - DNA, 24 bp, Homo sapiens
  JH636052.4:1362108-1362132
  hyper
gacttgctcctacagcgcgggaaa

SEQ ID NO: 59255 - DNA, 24 bp, Homo sapiens
  JH636052.4:1362192-1362216
  hyper
tgatgtcaccgacagtgcctttcc

SEQ ID NO: 59256 - DNA, 30 bp, Homo sapiens; identical to SEQ ID NO: 38682
  JH636052.4:2280989-2281019
  hyper

SEQ ID NO: 59257 - DNA, 76 bp, Homo sapiens; identical to SEQ ID NO: 38683
  JH636052.4:2302666-2302742
  hyper

SEQ ID NO: 59258 - DNA, 51 bp, Homo sapiens
  JH636052.4:5118718-5118769
  hyper
ctgcgagggtcaggacggggcgaaggccattccgctgcccttccagcttcg

SEQ ID NO: 59259 - DNA, 26 bp, Homo sapiens
  JH636052.4:5118903-5118929
  hyper
tgataccagaacgagagttgactgtg

SEQ ID NO: 59260 - DNA, 218 bp, Homo sapiens; identical to SEQ ID NO: 38685
  JH636058.1:413209-413427
  hyper

SEQ ID NO: 59261 - DNA, 169 bp, Homo sapiens; identical to SEQ ID NO: 38686
  NW_001838403.1_1-2251:175-344
  hyper

SEQ ID NO: 59262 - DNA, 30 bp, Homo sapiens; identical to SEQ ID NO: 38687
  chr1:865434-865464
  hypo

SEQ ID NO: 59263 - DNA, 48 bp, Homo sapiens; identical to SEQ ID NO: 38688
  chr1:898728-898776
  hypo

SEQ ID NO: 59264 - DNA, 149 bp, Homo sapiens; identical to SEQ ID NO: 23630
  chr1:913955-914104
  hypo

SEQ ID NO: 59265 - DNA, 90 bp, Homo sapiens; identical to SEQ ID NO: 38690
  chr1:918405-918495
  hypo

SEQ ID NO: 59266 - DNA, 47 bp, Homo sapiens; identical to SEQ ID NO: 38691
  chr1:942338-942385
  hypo

SEQ ID NO: 59267 - DNA, 30 bp, Homo sapiens; identical to SEQ ID NO: 38692
  chr1:957607-957637
  hypo

SEQ ID NO: 59268 - DNA, 356 bp, Homo sapiens; identical to SEQ ID NO: 38693
  chr1:986529-986885
  hypo

SEQ ID NO: 59269 - DNA, 30 bp, Homo sapiens; identical to SEQ ID NO: 38694
  chr1:1045970-1046000
  hypo

SEQ ID NO: 59270 - DNA, 70 bp, Homo sapiens; identical to SEQ ID NO: 38695
  chr1:1050115-1050185
  hypo

SEQ ID NO: 59271 - DNA, 160 bp, Homo sapiens; identical to SEQ ID NO: 38696
  chr1:1067634-1067794
  hypo

SEQ ID NO: 59272 - DNA, 30 bp, Homo sapiens; identical to SEQ ID NO: 38697
  chr1:1080521-1080551
  hypo

SEQ ID NO: 59273 - DNA, 114 bp, Homo sapiens
  chr1:1080824-1080938
  hypo
gcacggctgacccaaccccatctcatgactgaccccacctgactttatggctcaccccagtgaccccatggccaaccccacctgacctcatggccgacccgatctgacctcatg

SEQ ID NO: 59274 - DNA, 30 bp, Homo sapiens; identical to SEQ ID NO: 38699
  chr1:1083645-1083675
  hypo

SEQ ID NO: 59275 - DNA, 30 bp, Homo sapiens; identical to SEQ ID NO: 38700
  chr1:1102634-1102664
  hypo

SEQ ID NO: 59276 - DNA, 159 bp, Homo sapiens; identical to SEQ ID NO: 38701
  chr1:1145553-1145712
  hypo

SEQ ID NO: 59277 - DNA, 41 bp, Homo sapiens; identical to SEQ ID NO: 23635
  chr1:1146693-1146734
  hypo

SEQ ID NO: 59278 - DNA, 39 bp, Homo sapiens
  chr1:1146818-1146857
  hypo
tgcagagttggcccaggagcgtggcggggcaggcggcct

SEQ ID NO: 59279 - DNA, 126 bp, Homo sapiens; identical to SEQ ID NO: 38703
  chr1:1168843-1168969
  hypo

SEQ ID NO: 59280 - DNA, 33 bp, Homo sapiens; identical to SEQ ID NO: 38704
  chr1:1173925-1173958
  hypo

SEQ ID NO: 59281 - DNA, 42 bp, Homo sapiens; identical to SEQ ID NO: 38706
  chr1:1234718-1234760
  hypo

SEQ ID NO: 59282 - DNA, 103 bp, Homo sapiens; identical to SEQ ID NO: 38707
  chr1:1235178-1235281
  hypo

SEQ ID NO: 59283 - DNA, 205 bp, Homo sapiens; identical to SEQ ID NO: 38709
  chr1:1238277-1238482
  hypo

SEQ ID NO: 59284 - DNA, 292 bp, Homo sapiens; identical to SEQ ID NO: 38710
  chr1:1245060-1245352
  hypo

SEQ ID NO: 59285 - DNA, 22 bp, Homo sapiens
  chr1:1253533-1253555
  hypo
gccaccgcgcctggccaaggca

SEQ ID NO: 59286 - DNA, 311 bp, Homo sapiens
  chr1:1267151-1267462
  hypo
ccatgaagcccagcctcatgttcctggccaaggcaggcagccgcgacatcgccgcctactgcaactacacgcagtaccagccccgtgtgctggctgtcatcgggccccactcgtcagagctcgccatggtcaccggcaagttcttcagcttcttcctcatgccccaggtgggcgccccccaccatcacccacccccacccagccctgcccgtgggagcccctgtgtcaggagatgcctcttggcccttgcaggtcagctacggtgctagcatggagctgctgagcgcccgggagaccttcccctccttctt

SEQ ID NO: 59287 - DNA, 207 bp, Homo sapiens; identical to SEQ ID NO: 23640
  chr1:1267699-1267906
  hypo

SEQ ID NO: 59288 - DNA, 27 bp, Homo sapiens
  chr1:1268158-1268185
  hypo
cgcgcaggaccccgtgaagccctggca

SEQ ID NO: 59289 - DNA, 88 bp, Homo sapiens; identical to SEQ ID NO: 38713
  chr1:1309067-1309155
  hypo

SEQ ID NO: 59290 - DNA, 69 bp, Homo sapiens
  chr1:1341743-1341812
  hypo
aaaccggggtacgttagatgctaggttcatgaggctgagacgggagtggtgaggcgcagtaatgaggcg

SEQ ID NO: 59291 - DNA, 46 bp, Homo sapiens; identical to SEQ ID NO: 38715
  chr1:1363856-1363902
  hypo

SEQ ID NO: 59292 - DNA, 30 bp, Homo sapiens; identical to SEQ ID NO: 38716
  chr1:1483034-1483064
  hypo

SEQ ID NO: 59293 - DNA, 23 bp, Homo sapiens
  chr1:1563170-1563193
  hypo
cgggccctgtgtgagcgcggctg

SEQ ID NO: 59294 - DNA, 36 bp, Homo sapiens
  chr1:1563223-1563259
  hypo
ctggcctgggtgccccctgcccgtgagtgcttgtcc

SEQ ID NO: 59295 - DNA, 103 bp, Homo sapiens; identical to SEQ ID NO: 38718
  chr1:1563663-1563766
  hypo

SEQ ID NO: 59296 - DNA, 62 bp, Homo sapiens; identical to SEQ ID NO: 38719
  chr1:1625749-1625811
  hypo

SEQ ID NO: 59297 - DNA, 24 bp, Homo sapiens
  chr1:1671766-1671790
  hypo
tctttttttttgagacgggagtct

SEQ ID NO: 59298 - DNA, 20 bp, Homo sapiens
  chr1:1839158-1839178
  hypo
ttttgttttttgagacggag

SEQ ID NO: 59299 - DNA, 140 bp, Homo sapiens; identical to SEQ ID NO: 38722
  chr1:1856211-1856351
  hypo

SEQ ID NO: 59300 - DNA, 30 bp, Homo sapiens; identical to SEQ ID NO: 38723
  chr1:1861852-1861882
  hypo

SEQ ID NO: 59301 - DNA, 410 bp, Homo sapiens; identical to SEQ ID NO: 38725
  chr1:1914707-1915117
  hypo

SEQ ID NO: 59302 - DNA, 69 bp, Homo sapiens; identical to SEQ ID NO: 38726
  chr1:1974645-1974714
  hypo

SEQ ID NO: 59303 - DNA, 30 bp, Homo sapiens; identical to SEQ ID NO: 38727
  chr1:1986234-1986264
  hypo

SEQ ID NO: 59304 - DNA, 177 bp, Homo sapiens; identical to SEQ ID NO: 38728
  chr1:2013405-2013582
  hypo

SEQ ID NO: 59305 - DNA, 138 bp, Homo sapiens
  chr1:2066352-2066490
  hypo
caggcaggggacagacggacccggcctgcgttggcctggggtgacttcacggctccactgtcagcaagcggccgtcccgtggtggatcctgtccgccctgcgaggacacctggctccatccacacctgggcctctgtc

SEQ ID NO: 59306 - DNA, 32 bp, Homo sapiens
  chr1:2125483-2125515
  hypo
gctccgggctcaccgtgcgcagtagctcggcc

SEQ ID NO: 59307 - DNA, 88 bp, Homo sapiens; identical to SEQ ID NO: 38731
  chr1:2141596-2141684
  hypo

SEQ ID NO: 59308 - DNA, 36 bp, Homo sapiens; identical to SEQ ID NO: 38732
  chr1:2170934-2170970
  hypo

SEQ ID NO: 59309 - DNA, 38 bp, Homo sapiens; identical to SEQ ID NO: 23645
  chr1:2263131-2263169
  hypo

SEQ ID NO: 59310 - DNA, 96 bp, Homo sapiens
  chr1:2263263-2263359
  hypo
tgcgcctctccctcgtgcggctctcccgcccctgcgcctctccctcgtgcgcctctcccgcccctgcgcctctccctcgtgcgcctctcccgcccc

SEQ ID NO: 59311 - DNA, 397 bp, Homo sapiens
  chr1:2267155-2267552
  hypo
gtgctggtcactctgcgagcaacccagcagctcctccacagtgtgcggggccaggcgagggctggtgggacgggtccccagggcacatcagcgggggcctcctcgcctccatagcccagcccagcccagcgcgcagctgcccccaatttgtagacagagtcccgatttgaggtggcagctgttgctggactccgagccccgagccccagcttcctcctggtagaaccggccggttacggccctgcatgtgctgtgcccgtagcactgccaggcccaggatggtgagatgtgacggccacaaaccccccacggtgtccccgcctgcacgtgccgcggtgtgcacctggtcccactcctgtcctccagctcacagagtcccctcaagccactgccctga

SEQ ID NO: 59312 - DNA, 40 bp, Homo sapiens
  chr1:2267690-2267730
  hypo
ccacttcatgccagcccaggcaagtcgcagggcagctgtt

SEQ ID NO: 59313 - DNA, 30 bp, Homo sapiens; identical to SEQ ID NO: 38735
  chr1:2268713-2268743
  hypo

SEQ ID NO: 59314 - DNA, 154 bp, Homo sapiens; identical to SEQ ID NO: 38736
  chr1:2275666-2275820
  hypo

SEQ ID NO: 59315 - DNA, 111 bp, Homo sapiens; identical to SEQ ID NO: 38737
  chr1:2276089-2276200
  hypo

SEQ ID NO: 59316 - DNA, 49 bp, Homo sapiens; identical to SEQ ID NO: 14177
  chr1:2307845-2307894
  hypo

SEQ ID NO: 59317 - DNA, 271 bp, Homo sapiens
  chr1:2308105-2308376
  hypo
ccccctccctgggtgcgcagcaatcaggtcagggcttggcatcctcggtacccaccgctggtgtccgggtgggagggctgagccaggcaagctttcatgcagcacttggtcagtccaagcacatttgagtgatcaattcaactgatccaatagcccggtcttgtctaattcacgttatcaatcacacctttgacaattcggctgtttctgtttcatgtaccccaagcaggaacgagcaagagcttattaaatagggtgcaggggaggctcc

SEQ ID NO: 59318 - DNA, 22 bp, Homo sapiens
  chr1:2308636-2308658
  hypo
ggtcacacgacctttggggaag

SEQ ID NO: 59319 - DNA, 18 bp, Homo sapiens
  chr1:2309850-2309868
  hypo
ggcagtaggcccaaacgt

SEQ ID NO: 59320 - DNA, 30 bp, Homo sapiens; identical to SEQ ID NO: 38742
  chr1:2310214-2310244
  hypo

SEQ ID NO: 59321 - DNA, 30 bp, Homo sapiens; identical to SEQ ID NO: 38744
  chr1:2336335-2336365
  hypo

SEQ ID NO: 59322 - DNA, 174 bp, Homo sapiens; identical to SEQ ID NO: 38745
  chr1:2338063-2338237
  hypo

SEQ ID NO: 59323 - DNA, 348 bp, Homo sapiens; identical to SEQ ID NO: 14181
  chr1:2359972-2360320
  hypo

SEQ ID NO: 59324 - DNA, 62 bp, Homo sapiens; identical to SEQ ID NO: 38747
  chr1:2382732-2382794
  hypo

SEQ ID NO: 59325 - DNA, 3 bp, Homo sapiens
  chr1:2396998-2397001
  hypo
tcc

SEQ ID NO: 59326 - DNA, 162 bp, Homo sapiens
  chr1:2397031-2397193
  hypo
acctgccacccgccgggccaaatgctctcaaagacagaattctgcttaaatgcccagaaaagagatttaggagatcagaatcttaagcaaattaacatgtgcagcgggcggcttttaatcaccgcctttaatcgcaggccgcggtgacggaaatcatctcct

SEQ ID NO: 59327 - DNA, 133 bp, Homo sapiens
  chr1:2428198-2428331
  hypo
tgctatgctgctgggcgccgggcgaggtcgaggactggcagtctgatgcccggtcaccggcgccacagcggcgtccagctggcaggtgtcgtccttcagcgagaccaaggcccaccagattctgcagcagaag

SEQ ID NO: 59328 - DNA, 30 bp, Homo sapiens; identical to SEQ ID NO: 38750
  chr1:2430463-2430493
  hypo

SEQ ID NO: 59329 - DNA, 30 bp, Homo sapiens; identical to SEQ ID NO: 38751
  chr1:2437269-2437299
  hypo

SEQ ID NO: 59330 - DNA, 136 bp, Homo sapiens; identical to SEQ ID NO: 38752
  chr1:2468656-2468792
  hypo

SEQ ID NO: 59331 - DNA, 18 bp, Homo sapiens
  chr1:2507045-2507063
  hypo
ctcacaggctcacagcgg

SEQ ID NO: 59332 - DNA, 81 bp, Homo sapiens; identical to SEQ ID NO: 38754
  chr1:2519808-2519889
  hypo

SEQ ID NO: 59333 - DNA, 51 bp, Homo sapiens; identical to SEQ ID NO: 38755
  chr1:2527420-2527471
  hypo

SEQ ID NO: 59334 - DNA, 66 bp, Homo sapiens; identical to SEQ ID NO: 14186
  chr1:2537084-2537150
  hypo

SEQ ID NO: 59335 - DNA, 125 bp, Homo sapiens; identical to SEQ ID NO: 38757
  chr1:2537758-2537883
  hypo

SEQ ID NO: 59336 - DNA, 47 bp, Homo sapiens; identical to SEQ ID NO: 38758
  chr1:2702425-2702472
  hypo

SEQ ID NO: 59337 - DNA, 113 bp, Homo sapiens; identical to SEQ ID NO: 14188
  chr1:2708372-2708485
  hypo

SEQ ID NO: 59338 - DNA, 503 bp, Homo sapiens; identical to SEQ ID NO: 38760
  chr1:2716736-2717239
  hypo

SEQ ID NO: 59339 - DNA, 163 bp, Homo sapiens; identical to SEQ ID NO: 38761
  chr1:2725529-2725692
  hypo

SEQ ID NO: 59340 - DNA, 92 bp, Homo sapiens; identical to SEQ ID NO: 38762
  chr1:2725899-2725991
  hypo

SEQ ID NO: 59341 - DNA, 30 bp, Homo sapiens; identical to SEQ ID NO: 38763
  chr1:2733570-2733600
  hypo

SEQ ID NO: 59342 - DNA, 90 bp, Homo sapiens; identical to SEQ ID NO: 38764
  chr1:2733660-2733750
  hypo

SEQ ID NO: 59343 - DNA, 30 bp, Homo sapiens; identical to SEQ ID NO: 38765
  chr1:2770901-2770931
  hypo

SEQ ID NO: 59344 - DNA, 36 bp, Homo sapiens; identical to SEQ ID NO: 38766
  chr1:2826189-2826225
  hypo

SEQ ID NO: 59345 - DNA, 36 bp, Homo sapiens; identical to SEQ ID NO: 38767
  chr1:2827849-2827885
  hypo

SEQ ID NO: 59346 - DNA, 30 bp, Homo sapiens; identical to SEQ ID NO: 38768
  chr1:2830021-2830051
  hypo

SEQ ID NO: 59347 - DNA, 161 bp, Homo sapiens; identical to SEQ ID NO: 38769
  chr1:2833818-2833979
  hypo

SEQ ID NO: 59348 - DNA, 30 bp, Homo sapiens; identical to SEQ ID NO: 38770
  chr1:2836432-2836462
  hypo

SEQ ID NO: 59349 - DNA, 34 bp, Homo sapiens; identical to SEQ ID NO: 38771
  chr1:2840699-2840733
  hypo

SEQ ID NO: 59350 - DNA, 30 bp, Homo sapiens; identical to SEQ ID NO: 38772
  chr1:2846793-2846823
  hypo

SEQ ID NO: 59351 - DNA, 43 bp, Homo sapiens; identical to SEQ ID NO: 38773
  chr1:2889049-2889092
  hypo

SEQ ID NO: 59352 - DNA, 30 bp, Homo sapiens; identical to SEQ ID NO: 38774
  chr1:2918482-2918512
  hypo

SEQ ID NO: 59353 - DNA, 30 bp, Homo sapiens; identical to SEQ ID NO: 38775
  chr1:2939161-2939191
  hypo

SEQ ID NO: 59354 - DNA, 45 bp, Homo sapiens; identical to SEQ ID NO: 38776
  chr1:3015491-3015536
  hypo

SEQ ID NO: 59355 - DNA, 141 bp, Homo sapiens; identical to SEQ ID NO: 38777
  chr1:3035035-3035176
  hypo

SEQ ID NO: 59356 - DNA, 30 bp, Homo sapiens; identical to SEQ ID NO: 38778
  chr1:3063272-3063302
  hypo

SEQ ID NO: 59357 - DNA, 30 bp, Homo sapiens; identical to SEQ ID NO: 38779
  chr1:3070343-3070373
  hypo

SEQ ID NO: 59358 - DNA, 121 bp, Homo sapiens; identical to SEQ ID NO: 38780
  chr1:3078720-3078841
  hypo

SEQ ID NO: 59359 - DNA, 17 bp, Homo sapiens
  chr1:3102636-3102653
  hypo
acactgggtggggcacg

SEQ ID NO: 59360 - DNA, 17 bp, Homo sapiens
  chr1:3102779-3102796
  hypo
gtcgcccatccccgtgg

SEQ ID NO: 59361 - DNA, 136 bp, Homo sapiens; identical to SEQ ID NO: 38782
  chr1:3111327-3111463
  hypo

SEQ ID NO: 59362 - DNA, 35 bp, Homo sapiens; identical to SEQ ID NO: 38783
  chr1:3129231-3129266
  hypo

SEQ ID NO: 59363 - DNA, 30 bp, Homo sapiens; identical to SEQ ID NO: 38784
  chr1:3179577-3179607
  hypo

SEQ ID NO: 59364 - DNA, 70 bp, Homo sapiens; identical to SEQ ID NO: 38785
  chr1:3183016-3183086
  hypo

SEQ ID NO: 59365 - DNA, 60 bp, Homo sapiens; identical to SEQ ID NO: 38786
  chr1:3184625-3184685
  hypo

SEQ ID NO: 59366 - DNA, 172 bp, Homo sapiens; identical to SEQ ID NO: 38787
  chr1:3217156-3217328
  hypo

SEQ ID NO: 59367 - DNA, 30 bp, Homo sapiens; identical to SEQ ID NO: 38788
  chr1:3294711-3294741
  hypo

SEQ ID NO: 59368 - DNA, 92 bp, Homo sapiens
  chr1:3321998-3322090
  hypo
agaaccaggccaaggcgggtgtccaggcagggcacgcgccaacggcatccgtctccccaggtgttcacggaccccagcaaccttcagcggca

SEQ ID NO: 59369 - DNA, 186 bp, Homo sapiens; identical to SEQ ID NO: 38790
  chr1:3325403-3325589
  hypo

SEQ ID NO: 59370 - DNA, 30 bp, Homo sapiens; identical to SEQ ID NO: 38791
  chr1:3327976-3328006
  hypo

SEQ ID NO: 59371 - DNA, 146 bp, Homo sapiens; identical to SEQ ID NO: 38792
  chr1:3342175-3342321
  hypo

SEQ ID NO: 59372 - DNA, 30 bp, Homo sapiens; identical to SEQ ID NO: 38793
  chr1:3350102-3350132
  hypo

SEQ ID NO: 59373 - DNA, 33 bp, Homo sapiens; identical to SEQ ID NO: 38794
  chr1:3372809-3372842
  hypo

SEQ ID NO: 59374 - DNA, 36 bp, Homo sapiens; identical to SEQ ID NO: 38795
  chr1:3408534-3408570
  hypo

SEQ ID NO: 59375 - DNA, 255 bp, Homo sapiens; identical to SEQ ID NO: 38796
  chr1:3411032-3411287
  hypo

SEQ ID NO: 59376 - DNA, 30 bp, Homo sapiens; identical to SEQ ID NO: 38797
  chr1:3417138-3417168
  hypo

SEQ ID NO: 59377 - DNA, 109 bp, Homo sapiens; identical to SEQ ID NO: 38798
  chr1:3463596-3463705
  hypo

SEQ ID NO: 59378 - DNA, 69 bp, Homo sapiens; identical to SEQ ID NO: 38799
  chr1:3466914-3466983
  hypo

SEQ ID NO: 59379 - DNA, 346 bp, Homo sapiens; identical to SEQ ID NO: 38800
  chr1:3467198-3467544
  hypo

SEQ ID NO: 59380 - DNA, 30 bp, Homo sapiens; identical to SEQ ID NO: 38801
  chr1:3470143-3470173
  hypo

SEQ ID NO: 59381 - DNA, 12 bp, Homo sapiens
  chr1:3601838-3601850
  hypo
ccctgagctcca

SEQ ID NO: 59382 - DNA, 94 bp, Homo sapiens; identical to SEQ ID NO: 38803
  chr1:3607472-3607566
  hypo

SEQ ID NO: 59383 - DNA, 57 bp, Homo sapiens; identical to SEQ ID NO: 38804
  chr1:3644717-3644774
  hypo

SEQ ID NO: 59384 - DNA, 30 bp, Homo sapiens; identical to SEQ ID NO: 38806
  chr1:3661766-3661796
  hypo

SEQ ID NO: 59385 - DNA, 30 bp, Homo sapiens; identical to SEQ ID NO: 38807
  chr1:3678034-3678064
  hypo

SEQ ID NO: 59386 - DNA, 68 bp, Homo sapiens; identical to SEQ ID NO: 38808
  chr1:3680032-3680100
  hypo

SEQ ID NO: 59387 - DNA, 30 bp, Homo sapiens; identical to SEQ ID NO: 38809
  chr1:3680304-3680334
  hypo

SEQ ID NO: 59388 - DNA, 26 bp, Homo sapiens
  chr1:3683818-3683844
  hypo
agctcaccaagcgggactgtgtcatc

SEQ ID NO: 59389 - DNA, 85 bp, Homo sapiens; identical to SEQ ID NO: 38811
  chr1:3684064-3684149
  hypo

SEQ ID NO: 59390 - DNA, 30 bp, Homo sapiens; identical to SEQ ID NO: 38812
  chr1:3786550-3786580
  hypo

SEQ ID NO: 59391 - DNA, 193 bp, Homo sapiens; identical to SEQ ID NO: 38813
  chr1:4082814-4083007
  hypo

SEQ ID NO: 59392 - DNA, 3 bp, Homo sapiens
  chr1:4111231-4111234
  hypo
ctg

SEQ ID NO: 59393 - DNA, 175 bp, Homo sapiens; identical to SEQ ID NO: 38815
  chr1:4212772-4212947
  hypo

SEQ ID NO: 59394 - DNA, 30 bp, Homo sapiens; identical to SEQ ID NO: 38816
  chr1:4279385-4279415
  hypo

SEQ ID NO: 59395 - DNA, 152 bp, Homo sapiens; identical to SEQ ID NO: 38817
  chr1:4402113-4402265
  hypo

SEQ ID NO: 59396 - DNA, 30 bp, Homo sapiens; identical to SEQ ID NO: 38818
  chr1:4426176-4426206
  hypo

SEQ ID NO: 59397 - DNA, 51 bp, Homo sapiens; identical to SEQ ID NO: 38819
  chr1:4486515-4486566
  hypo

SEQ ID NO: 59398 - DNA, 41 bp, Homo sapiens; identical to SEQ ID NO: 38820
  chr1:4542688-4542729
  hypo

SEQ ID NO: 59399 - DNA, 68 bp, Homo sapiens; identical to SEQ ID NO: 38821
  chr1:4652230-4652298
  hypo

SEQ ID NO: 59400 - DNA, 30 bp, Homo sapiens; identical to SEQ ID NO: 38822
  chr1:4659583-4659613
  hypo

SEQ ID NO: 59401 - DNA, 124 bp, Homo sapiens; identical to SEQ ID NO: 38823
  chr1:4677050-4677174
  hypo

SEQ ID NO: 59402 - DNA, 23 bp, Homo sapiens
  chr1:4711648-4711671
  hypo
taataataagctgggcgcggtgg

SEQ ID NO: 59403 - DNA, 235 bp, Homo sapiens; identical to SEQ ID NO: 38825
  chr1:4726593-4726828
  hypo

SEQ ID NO: 59404 - DNA, 148 bp, Homo sapiens; identical to SEQ ID NO: 38826
  chr1:4772507-4772655
  hypo

SEQ ID NO: 59405 - DNA, 143 bp, Homo sapiens; identical to SEQ ID NO: 38827
  chr1:4782357-4782500
  hypo

SEQ ID NO: 59406 - DNA, 43 bp, Homo sapiens; identical to SEQ ID NO: 38828
  chr1:5893925-5893968
  hypo

SEQ ID NO: 59407 - DNA, 38 bp, Homo sapiens; identical to SEQ ID NO: 38829
  chr1:5894998-5895036
  hypo

SEQ ID NO: 59408 - DNA, 30 bp, Homo sapiens; identical to SEQ ID NO: 38830
  chr1:6046247-6046277
  hypo

SEQ ID NO: 59409 - DNA, 148 bp, Homo sapiens; identical to SEQ ID NO: 38831
  chr1:6071300-6071448
  hypo

SEQ ID NO: 59410 - DNA, 30 bp, Homo sapiens; identical to SEQ ID NO: 38832
  chr1:6131731-6131761
  hypo

SEQ ID NO: 59411 - DNA, 38 bp, Homo sapiens
  chr1:6166315-6166353
  hypo
aacacagggaagtctcgaggacggctagatatctgtca

SEQ ID NO: 59412 - DNA, 124 bp, Homo sapiens
  chr1:6171810-6171934
  hypo
ccagcccggcctggccaaggatacgtcacgatgcccgccagcagccagtagtcatggcgccggtgccagatgtcgtagattttcccagaggatacagcagcccgctcctcgttctgccacagcg

SEQ ID NO: 59413 - DNA, 24 bp, Homo sapiens
  chr1:6280273-6280297
  hypo
tgaagtcttcgtccttgtcacagt

SEQ ID NO: 59414 - DNA, 30 bp, Homo sapiens; identical to SEQ ID NO: 14204
  chr1:6360980-6361010
  hypo

SEQ ID NO: 59415 - DNA, 111 bp, Homo sapiens; identical to SEQ ID NO: 38837
  chr1:6391430-6391541
  hypo

SEQ ID NO: 59416 - DNA, 45 bp, Homo sapiens
  chr1:6446308-6446353
  hypo
ttcctgggcctacccctccctgaccttccccgcccctggagttag

SEQ ID NO: 59417 - DNA, 30 bp, Homo sapiens; identical to SEQ ID NO: 38839
  chr1:6635034-6635064
  hypo

SEQ ID NO: 59418 - DNA, 30 bp, Homo sapiens; identical to SEQ ID NO: 38840
  chr1:6801549-6801579
  hypo

SEQ ID NO: 59419 - DNA, 195 bp, Homo sapiens; identical to SEQ ID NO: 38841
  chr1:6984148-6984343
  hypo

SEQ ID NO: 59420 - DNA, 30 bp, Homo sapiens; identical to SEQ ID NO: 38842
  chr1:7067759-7067789
  hypo

SEQ ID NO: 59421 - DNA, 30 bp, Homo sapiens; identical to SEQ ID NO: 38843
  chr1:7162881-7162911
  hypo

SEQ ID NO: 59422 - DNA, 30 bp, Homo sapiens; identical to SEQ ID NO: 38844
  chr1:7729014-7729044
  hypo

SEQ ID NO: 59423 - DNA, 39 bp, Homo sapiens; identical to SEQ ID NO: 38845
  chr1:10103760-10103799
  hypo

SEQ ID NO: 59424 - DNA, 30 bp, Homo sapiens; identical to SEQ ID NO: 38846
  chr1:10166597-10166627
  hypo

SEQ ID NO: 59425 - DNA, 18 bp, Homo sapiens
  chr1:10959337-10959355
  hypo
taccctgtagggggccgg

SEQ ID NO: 59426 - DNA, 101 bp, Homo sapiens; identical to SEQ ID NO: 38848
  chr1:11036267-11036368
  hypo

SEQ ID NO: 59427 - DNA, 80 bp, Homo sapiens; identical to SEQ ID NO: 38849
  chr1:11073881-11073961
  hypo

SEQ ID NO: 59428 - DNA, 38 bp, Homo sapiens; identical to SEQ ID NO: 38850
  chr1:11131698-11131736
  hypo

SEQ ID NO: 59429 - DNA, 30 bp, Homo sapiens; identical to SEQ ID NO: 38851
  chr1:11139771-11139801
  hypo

SEQ ID NO: 59430 - DNA, 30 bp, Homo sapiens; identical to SEQ ID NO: 38852
  chr1:11417987-11418017
  hypo

SEQ ID NO: 59431 - DNA, 75 bp, Homo sapiens; identical to SEQ ID NO: 38853
  chr1:11596484-11596559
  hypo

SEQ ID NO: 59432 - DNA, 76 bp, Homo sapiens; identical to SEQ ID NO: 38854
  chr1:11792825-11792901
  hypo

SEQ ID NO: 59433 - DNA, 83 bp, Homo sapiens; identical to SEQ ID NO: 38855
  chr1:11854720-11854803
  hypo

SEQ ID NO: 59434 - DNA, 54 bp, Homo sapiens; identical to SEQ ID NO: 23678
  chr1:11936694-11936748
  hypo

SEQ ID NO: 59435 - DNA, 1 bp, Homo sapiens
  chr1:11936778-11936779
  hypo
c

SEQ ID NO: 59436 - DNA, 76 bp, Homo sapiens; identical to SEQ ID NO: 38857
  chr1:12078805-12078881
  hypo

SEQ ID NO: 59437 - DNA, 28 bp, Homo sapiens
  chr1:12251415-12251443
  hypo
cgaggagcaggactgcggggaggagcga

SEQ ID NO: 59438 - DNA, 17 bp, Homo sapiens
  chr1:12805063-12805080
  hypo
aacgcatgcctcctctg

SEQ ID NO: 59439 - DNA, 194 bp, Homo sapiens; identical to SEQ ID NO: 38860
  chr1:14139406-14139600
  hypo

SEQ ID NO: 59440 - DNA, 13 bp, Homo sapiens
  chr1:14730412-14730425
  hypo
aagaagaggtctc

SEQ ID NO: 59441 - DNA, 30 bp, Homo sapiens; identical to SEQ ID NO: 38862
  chr1:15651124-15651154
  hypo

SEQ ID NO: 59442 - DNA, 30 bp, Homo sapiens; identical to SEQ ID NO: 38863
  chr1:15928989-15929019
  hypo

SEQ ID NO: 59443 - DNA, 88 bp, Homo sapiens; identical to SEQ ID NO: 38864
  chr1:16059358-16059446
  hypo

SEQ ID NO: 59444 - DNA, 130 bp, Homo sapiens
  chr1:16475207-16475337
  hypo
agcttcacgtggcgtgcctcgaagtcgctgctgacggtgatctcatcgggcgcaatggtgtcaatcttggtgaacaggcgcttctggaagttggtgccgtagtccaggtccgactcggcatagtagaggt

SEQ ID NO: 59445 - DNA, 243 bp, Homo sapiens; identical to SEQ ID NO: 38866
  chr1:16534520-16534763
  hypo

SEQ ID NO: 59446 - DNA, 67 bp, Homo sapiens; identical to SEQ ID NO: 38867
  chr1:16535138-16535205
  hypo

SEQ ID NO: 59447 - DNA, 30 bp, Homo sapiens; identical to SEQ ID NO: 38868
  chr1:16736310-16736340
  hypo

SEQ ID NO: 59448 - DNA, 10 bp, Homo sapiens
  chr1:17787462-17787472
  hypo
tggctcacgc

SEQ ID NO: 59449 - DNA, 16 bp, Homo sapiens
  chr1:18058862-18058878
  hypo
tcgtctaaaaaaaaaa

SEQ ID NO: 59450 - DNA, 63 bp, Homo sapiens; identical to SEQ ID NO: 38872
  chr1:18703385-18703448
  hypo

SEQ ID NO: 59451 - DNA, 30 bp, Homo sapiens; identical to SEQ ID NO: 38873
  chr1:18818951-18818981
  hypo

SEQ ID NO: 59452 - DNA, 68 bp, Homo sapiens; identical to SEQ ID NO: 38874
  chr1:19213653-19213721
  hypo

SEQ ID NO: 59453 - DNA, 103 bp, Homo sapiens; identical to SEQ ID NO: 38875
  chr1:19676719-19676822
  hypo

SEQ ID NO: 59454 - DNA, 35 bp, Homo sapiens; identical to SEQ ID NO: 38876
  chr1:20492304-20492339
  hypo

SEQ ID NO: 59455 - DNA, 25 bp, Homo sapiens
  chr1:20534656-20534681
  hypo
agtgagaccccgcatccaaaagaaa

SEQ ID NO: 59456 - DNA, 124 bp, Homo sapiens
  chr1:21042770-21042894
  hypo
taagagcagcacctgcggggctctcacagggtgcatacagggcttctttcgtgcatgggcacaggaagcactgccatacacaggtgatggcccaatgtctgcctgcaatgcagggagctggaca

SEQ ID NO: 59457 - DNA, 163 bp, Homo sapiens
  chr1:21042924-21043087
  hypo
ggcggggcacacagcgacaagagtccaggcagccagccggcagggacagggagtacaaagaagcgaaaacaggatggcacaggaagaacgaagcacagctttccaggcggcaaagacagggagaactgggggagctgggagtggggctcgtactttgccaggt

SEQ ID NO: 59458 - DNA, 30 bp, Homo sapiens; identical to SEQ ID NO: 38879
  chr1:21523157-21523187
  hypo

SEQ ID NO: 59459 - DNA, 30 bp, Homo sapiens; identical to SEQ ID NO: 38880
  chr1:21568339-21568369
  hypo

SEQ ID NO: 59460 - DNA, 30 bp, Homo sapiens; identical to SEQ ID NO: 38883
  chr1:21611198-21611228
  hypo

SEQ ID NO: 59461 - DNA, 120 bp, Homo sapiens; identical to SEQ ID NO: 38884
  chr1:22092109-22092229
  hypo

SEQ ID NO: 59462 - DNA, 25 bp, Homo sapiens
  chr1:22378609-22378634
  hypo
gaactggtagtgggccgggcgcggt

SEQ ID NO: 59463 - DNA, 119 bp, Homo sapiens; identical to SEQ ID NO: 38886
  chr1:22447958-22448077
  hypo

SEQ ID NO: 59464 - DNA, 184 bp, Homo sapiens; identical to SEQ ID NO: 38887
  chr1:22777513-22777697
  hypo

SEQ ID NO: 59465 - DNA, 30 bp, Homo sapiens; identical to SEQ ID NO: 38888
  chr1:22900903-22900933
  hypo

SEQ ID NO: 59466 - DNA, 8 bp, Homo sapiens
  chr1:22927402-22927410
  hypo
gtggagga

SEQ ID NO: 59467 - DNA, 99 bp, Homo sapiens
  chr1:22927482-22927581
  hypo
ggaccgggcgcagcggcctcgcttctcccagattgtcagtgtcctcgatgcgctcatccgcagccctgagagtctcagggccaccgccacagtcagcag

SEQ ID NO: 59468 - DNA, 33 bp, Homo sapiens; identical to SEQ ID NO: 38890
  chr1:23694078-23694111
  hypo

SEQ ID NO: 59469 - DNA, 40 bp, Homo sapiens; identical to SEQ ID NO: 38891
  chr1:23704242-23704282
  hypo

SEQ ID NO: 59470 - DNA, 30 bp, Homo sapiens; identical to SEQ ID NO: 38892
  chr1:23833122-23833152
  hypo

SEQ ID NO: 59471 - DNA, 30 bp, Homo sapiens; identical to SEQ ID NO: 38893
  chr1:23859450-23859480
  hypo

SEQ ID NO: 59472 - DNA, 35 bp, Homo sapiens; identical to SEQ ID NO: 38894
  chr1:24017587-24017622
  hypo

SEQ ID NO: 59473 - DNA, 127 bp, Homo sapiens; identical to SEQ ID NO: 38895
  chr1:24119136-24119263
  hypo

SEQ ID NO: 59474 - DNA, 30 bp, Homo sapiens; identical to SEQ ID NO: 38896
  chr1:24435099-24435129
  hypo

SEQ ID NO: 59475 - DNA, 164 bp, Homo sapiens
  chr1:24740829-24740993
  hypo
ccggccccaagccctgtttctaacagaagaaaaaaaaaaaaattgacatgggcgactatacaagggcagccacttagtattccaggagcccctcttcacacgcttcagggcagggcggtctcagcgaccttgtcactcccctgcttaaagtcctccaatggctc

SEQ ID NO: 59476 - DNA, 46 bp, Homo sapiens; identical to SEQ ID NO: 38898
  chr1:25220516-25220562
  hypo

SEQ ID NO: 59477 - DNA, 30 bp, Homo sapiens; identical to SEQ ID NO: 38899
  chr1:26337225-26337255
  hypo

SEQ ID NO: 59478 - DNA, 43 bp, Homo sapiens; identical to SEQ ID NO: 38900
  chr1:26969603-26969646
  hypo

SEQ ID NO: 59479 - DNA, 36 bp, Homo sapiens
  chr1:27190278-27190314
  hypo
tctggccaagaccactttcgacgaggccatggctga

SEQ ID NO: 59480 - DNA, 30 bp, Homo sapiens; identical to SEQ ID NO: 38902
  chr1:27628242-27628272
  hypo

SEQ ID NO: 59481 - DNA, 46 bp, Homo sapiens
  chr1:27844548-27844594
  hypo
agcacgctcctcaccagccctagctcaggctcggacctctctgact

SEQ ID NO: 59482 - DNA, 21 bp, Homo sapiens
  chr1:27868425-27868446
  hypo
ccaccgcgcctggcaaggagg

SEQ ID NO: 59483 - DNA, 217 bp, Homo sapiens; identical to SEQ ID NO: 38905
  chr1:27876116-27876333
  hypo

SEQ ID NO: 59484 - DNA, 72 bp, Homo sapiens; identical to SEQ ID NO: 38906
  chr1:28293332-28293404
  hypo

SEQ ID NO: 59485 - DNA, 82 bp, Homo sapiens; identical to SEQ ID NO: 38907
  chr1:28853681-28853763
  hypo

SEQ ID NO: 59486 - DNA, 41 bp, Homo sapiens; identical to SEQ ID NO: 38908
  chr1:28865194-28865235
  hypo

SEQ ID NO: 59487 - DNA, 23 bp, Homo sapiens
  chr1:28926140-28926163
  hypo
atggcacgcgcctgtggtgccac

SEQ ID NO: 59488 - DNA, 30 bp, Homo sapiens; identical to SEQ ID NO: 14220
  chr1:29074253-29074283
  hypo

SEQ ID NO: 59489 - DNA, 26 bp, Homo sapiens
  chr1:29462593-29462619
  hypo
gggcgcggtggctgacgcctgtaatc

SEQ ID NO: 59490 - DNA, 17 bp, Homo sapiens
  chr1:29463615-29463632
  hypo
ttgaatgttcagggccg

SEQ ID NO: 59491 - DNA, 40 bp, Homo sapiens; identical to SEQ ID NO: 38914
  chr1:29516596-29516636
  hypo

SEQ ID NO: 59492 - DNA, 30 bp, Homo sapiens; identical to SEQ ID NO: 38916
  chr1:30723094-30723124
  hypo

SEQ ID NO: 59493 - DNA, 174 bp, Homo sapiens; identical to SEQ ID NO: 38917
  chr1:31208078-31208252
  hypo

SEQ ID NO: 59494 - DNA, 23 bp, Homo sapiens
  chr1:32705550-32705573
  hypo
gcctgggccgagagcgtgtccat

SEQ ID NO: 59495 - DNA, 33 bp, Homo sapiens; identical to SEQ ID NO: 38919
  chr1:32741468-32741501
  hypo

SEQ ID NO: 59496 - DNA, 30 bp, Homo sapiens; identical to SEQ ID NO: 38920
  chr1:33220942-33220972
  hypo

SEQ ID NO: 59497 - DNA, 149 bp, Homo sapiens; identical to SEQ ID NO: 38921
  chr1:33441493-33441642
  hypo

SEQ ID NO: 59498 - DNA, 143 bp, Homo sapiens; identical to SEQ ID NO: 14223
  chr1:33473115-33473258
  hypo

SEQ ID NO: 59499 - DNA, 50 bp, Homo sapiens; identical to SEQ ID NO: 38923
  chr1:33631092-33631142
  hypo

SEQ ID NO: 59500 - DNA, 32 bp, Homo sapiens; identical to SEQ ID NO: 38924
  chr1:33798865-33798897
  hypo

SEQ ID NO: 59501 - DNA, 30 bp, Homo sapiens; identical to SEQ ID NO: 38925
  chr1:33981589-33981619
  hypo

SEQ ID NO: 59502 - DNA, 28 bp, Homo sapiens
  chr1:34130113-34130141
  hypo
attttaggccaggagcggtggctcatgc

SEQ ID NO: 59503 - DNA, 41 bp, Homo sapiens; identical to SEQ ID NO: 38927
  chr1:34180223-34180264
  hypo

SEQ ID NO: 59504 - DNA, 27 bp, Homo sapiens
  chr1:34979405-34979432
  hypo
aagaagagggctgggcgcagtggctca

SEQ ID NO: 59505 - DNA, 23 bp, Homo sapiens
  chr1:35660562-35660585
  hypo
aggcgggaccgggtgcggtggct

SEQ ID NO: 59506 - DNA, 110 bp, Homo sapiens
  chr1:35664746-35664856
  hypo
agatttatcaagttactttacctgtatgttttgcctcagggcatttgcacttgctctttactcagcctgcagtgttctccccactcgccccgccccggctctttgcacag

SEQ ID NO: 59507 - DNA, 66 bp, Homo sapiens; identical to SEQ ID NO: 38931
  chr1:36056253-36056319
  hypo

SEQ ID NO: 59508 - DNA, 120 bp, Homo sapiens; identical to SEQ ID NO: 38932
  chr1:36271442-36271562
  hypo

SEQ ID NO: 59509 - DNA, 137 bp, Homo sapiens
  chr1:36563342-36563479
  hypo
tataggtggccggcacgttgttcttgtacagggccacccacacgttggtgcccttgacgtgcacatggtaagcaaagtagtagacgccgcccacagggcaggtgaagatgccagtggctgggttgtagccgctgtgg

SEQ ID NO: 59510 - DNA, 72 bp, Homo sapiens
  chr1:36563522-36563594
  hypo
cggggaagggcgaggtgagcaccgcagtgaaggccggtgtggcatgggcagacagctcgcccagcccaaact

SEQ ID NO: 59511 - DNA, 180 bp, Homo sapiens; identical to SEQ ID NO: 38934
  chr1:37148125-37148305
  hypo

SEQ ID NO: 59512 - DNA, 30 bp, Homo sapiens; identical to SEQ ID NO: 38935
  chr1:37227648-37227678
  hypo

SEQ ID NO: 59513 - DNA, 30 bp, Homo sapiens; identical to SEQ ID NO: 38936
  chr1:38207058-38207088
  hypo

SEQ ID NO: 59514 - DNA, 87 bp, Homo sapiens; identical to SEQ ID NO: 38937
  chr1:38398355-38398442
  hypo

SEQ ID NO: 59515 - DNA, 30 bp, Homo sapiens; identical to SEQ ID NO: 38938
  chr1:39075313-39075343
  hypo

SEQ ID NO: 59516 - DNA, 28 bp, Homo sapiens
  chr1:39345389-39345417
  hypo
tctgttttttttgttcgtttgttttctg

SEQ ID NO: 59517 - DNA, 146 bp, Homo sapiens; identical to SEQ ID NO: 38940
  chr1:39416821-39416967
  hypo

SEQ ID NO: 59518 - DNA, 24 bp, Homo sapiens
  chr1:40025751-40025775
  hypo
gtgcccagccgaggtgacaccaga

SEQ ID NO: 59519 - DNA, 15 bp, Homo sapiens
  chr1:40349647-40349662
  hypo
cgtcttaaatggtag

SEQ ID NO: 59520 - DNA, 30 bp, Homo sapiens; identical to SEQ ID NO: 38943
  chr1:40409694-40409724
  hypo

SEQ ID NO: 59521 - DNA, 138 bp, Homo sapiens; identical to SEQ ID NO: 38945
  chr1:40905029-40905167
  hypo

SEQ ID NO: 59522 - DNA, 30 bp, Homo sapiens; identical to SEQ ID NO: 38946
  chr1:41117178-41117208
  hypo

SEQ ID NO: 59523 - DNA, 46 bp, Homo sapiens; identical to SEQ ID NO: 38947
  chr1:41288701-41288747
  hypo

SEQ ID NO: 59524 - DNA, 30 bp, Homo sapiens; identical to SEQ ID NO: 38948
  chr1:41486134-41486164
  hypo

SEQ ID NO: 59525 - DNA, 30 bp, Homo sapiens; identical to SEQ ID NO: 38949
  chr1:41967243-41967273
  hypo

SEQ ID NO: 59526 - DNA, 83 bp, Homo sapiens; identical to SEQ ID NO: 23696
  chr1:41991702-41991785
  hypo

SEQ ID NO: 59527 - DNA, 30 bp, Homo sapiens; identical to SEQ ID NO: 38951
  chr1:42802631-42802661
  hypo

SEQ ID NO: 59528 - DNA, 30 bp, Homo sapiens; identical to SEQ ID NO: 38952
  chr1:43209127-43209157
  hypo

SEQ ID NO: 59529 - DNA, 92 bp, Homo sapiens; identical to SEQ ID NO: 38953
  chr1:43826882-43826974
  hypo

SEQ ID NO: 59530 - DNA, 25 bp, Homo sapiens
  chr1:43834716-43834741
  hypo
aatttctacctccagcggcccctgg

SEQ ID NO: 59531 - DNA, 57 bp, Homo sapiens; identical to SEQ ID NO: 38955
  chr1:43991727-43991784
  hypo

SEQ ID NO: 59532 - DNA, 30 bp, Homo sapiens; identical to SEQ ID NO: 38956
  chr1:44000506-44000536
  hypo

SEQ ID NO: 59533 - DNA, 30 bp, Homo sapiens; identical to SEQ ID NO: 38957
  chr1:44016696-44016726
  hypo

SEQ ID NO: 59534 - DNA, 36 bp, Homo sapiens; identical to SEQ ID NO: 38958
  chr1:44043751-44043787
  hypo

SEQ ID NO: 59535 - DNA, 34 bp, Homo sapiens; identical to SEQ ID NO: 38959
  chr1:44068855-44068889
  hypo

SEQ ID NO: 59536 - DNA, 43 bp, Homo sapiens; identical to SEQ ID NO: 14234
  chr1:44351190-44351233
  hypo

SEQ ID NO: 59537 - DNA, 45 bp, Homo sapiens; identical to SEQ ID NO: 38961
  chr1:44463208-44463253
  hypo

SEQ ID NO: 59538 - DNA, 126 bp, Homo sapiens; identical to SEQ ID NO: 38962
  chr1:44463851-44463977
  hypo

SEQ ID NO: 59539 - DNA, 150 bp, Homo sapiens; identical to SEQ ID NO: 38963
  chr1:44497521-44497671
  hypo

SEQ ID NO: 59540 - DNA, 52 bp, Homo sapiens; identical to SEQ ID NO: 38964
  chr1:44584408-44584460
  hypo

SEQ ID NO: 59541 - DNA, 54 bp, Homo sapiens; identical to SEQ ID NO: 38965
  chr1:44718072-44718126
  hypo

SEQ ID NO: 59542 - DNA, 30 bp, Homo sapiens; identical to SEQ ID NO: 38967
  chr1:44794138-44794168
  hypo

SEQ ID NO: 59543 - DNA, 62 bp, Homo sapiens; identical to SEQ ID NO: 38968
  chr1:45103094-45103156
  hypo

SEQ ID NO: 59544 - DNA, 30 bp, Homo sapiens; identical to SEQ ID NO: 38969
  chr1:45106646-45106676
  hypo

SEQ ID NO: 59545 - DNA, 42 bp, Homo sapiens; identical to SEQ ID NO: 38970
  chr1:45156636-45156678
  hypo

SEQ ID NO: 59546 - DNA, 100 bp, Homo sapiens; identical to SEQ ID NO: 38971
  chr1:45280516-45280616
  hypo

SEQ ID NO: 59547 - DNA, 73 bp, Homo sapiens; identical to SEQ ID NO: 38972
  chr1:45293244-45293317
  hypo

SEQ ID NO: 59548 - DNA, 53 bp, Homo sapiens
  chr1:45308262-45308315
  hypo
ttctgagagcaggatacatatgtacacacacctgtcgtcgggtggacacagag

SEQ ID NO: 59549 - DNA, 16 bp, Homo sapiens
  chr1:45466077-45466093
  hypo
acgctgtataaataat

SEQ ID NO: 59550 - DNA, 16 bp, Homo sapiens
  chr1:45645619-45645635
  hypo
aggagccaagatggcc

SEQ ID NO: 59551 - DNA, 38 bp, Homo sapiens; identical to SEQ ID NO: 14239
  chr1:46079131-46079169
  hypo

SEQ ID NO: 59552 - DNA, 95 bp, Homo sapiens; identical to SEQ ID NO: 38977
  chr1:46921772-46921867
  hypo

SEQ ID NO: 59553 - DNA, 26 bp, Homo sapiens
  chr1:47749558-47749584
  hypo
tagcttttttttttgcgggggggtgg

SEQ ID NO: 59554 - DNA, 30 bp, Homo sapiens; identical to SEQ ID NO: 38979
  chr1:50918985-50919015
  hypo

SEQ ID NO: 59555 - DNA, 200 bp, Homo sapiens; identical to SEQ ID NO: 38980
  chr1:51099269-51099469
  hypo

SEQ ID NO: 59556 - DNA, 20 bp, Homo sapiens
  chr1:51176289-51176309
  hypo
ttcgagacagagtctcgctc

SEQ ID NO: 59557 - DNA, 19 bp, Homo sapiens
  chr1:51727596-51727615
  hypo
gctcactgcaacctccgtc

SEQ ID NO: 59558 - DNA, 78 bp, Homo sapiens; identical to SEQ ID NO: 38983
  chr1:51761832-51761910
  hypo

SEQ ID NO: 59559 - DNA, 47 bp, Homo sapiens
  chr1:51763298-51763345
  hypo
tcctgctggccttgccctacggctctcattatcggactgccaccatc

SEQ ID NO: 59560 - DNA, 213 bp, Homo sapiens; identical to SEQ ID NO: 38985
  chr1:51795524-51795737
  hypo

SEQ ID NO: 59561 - DNA, 128 bp, Homo sapiens; identical to SEQ ID NO: 38986
  chr1:52455042-52455170
  hypo

SEQ ID NO: 59562 - DNA, 16 bp, Homo sapiens
  chr1:53129138-53129154
  hypo
atcagaacatgtggcc

SEQ ID NO: 59563 - DNA, 41 bp, Homo sapiens; identical to SEQ ID NO: 38989
  chr1:53703048-53703089
  hypo

SEQ ID NO: 59564 - DNA, 75 bp, Homo sapiens; identical to SEQ ID NO: 38991
  chr1:53990562-53990637
  hypo

SEQ ID NO: 59565 - DNA, 36 bp, Homo sapiens; identical to SEQ ID NO: 23706
  chr1:54586590-54586626
  hypo

SEQ ID NO: 59566 - DNA, 261 bp, Homo sapiens; identical to SEQ ID NO: 23707
  chr1:54586736-54586997
  hypo

SEQ ID NO: 59567 - DNA, 30 bp, Homo sapiens; identical to SEQ ID NO: 38993
  chr1:54722666-54722696
  hypo

SEQ ID NO: 59568 - DNA, 30 bp, Homo sapiens; identical to SEQ ID NO: 38994
  chr1:54766254-54766284
  hypo

SEQ ID NO: 59569 - DNA, 33 bp, Homo sapiens; identical to SEQ ID NO: 38995
  chr1:54839900-54839933
  hypo

SEQ ID NO: 59570 - DNA, 17 bp, Homo sapiens
  chr1:54880702-54880719
  hypo
cccggccacgtagagca

SEQ ID NO: 59571 - DNA, 23 bp, Homo sapiens
  chr1:55231044-55231067
  hypo
tttgtttttttgagacggagttt

SEQ ID NO: 59572 - DNA, 70 bp, Homo sapiens; identical to SEQ ID NO: 38998
  chr1:55529166-55529236
  hypo

SEQ ID NO: 59573 - DNA, 30 bp, Homo sapiens; identical to SEQ ID NO: 38999
  chr1:62189867-62189897
  hypo

SEQ ID NO: 59574 - DNA, 30 bp, Homo sapiens; identical to SEQ ID NO: 39000
  chr1:62657668-62657698
  hypo

SEQ ID NO: 59575 - DNA, 34 bp, Homo sapiens; identical to SEQ ID NO: 39002
  chr1:70672893-70672927
  hypo

SEQ ID NO: 59576 - DNA, 79 bp, Homo sapiens; identical to SEQ ID NO: 39003
  chr1:72383504-72383583
  hypo

SEQ ID NO: 59577 - DNA, 30 bp, Homo sapiens; identical to SEQ ID NO: 39004
  chr1:76259201-76259231
  hypo

SEQ ID NO: 59578 - DNA, 24 bp, Homo sapiens
  chr1:76354586-76354610
  hypo
tttttttttttgagacggagtctc

SEQ ID NO: 59579 - DNA, 30 bp, Homo sapiens; identical to SEQ ID NO: 14245
  chr1:78244815-78244845
  hypo

SEQ ID NO: 59580 - DNA, 30 bp, Homo sapiens; identical to SEQ ID NO: 39008
  chr1:90292117-90292147
  hypo

SEQ ID NO: 59581 - DNA, 33 bp, Homo sapiens; identical to SEQ ID NO: 39009
  chr1:92494939-92494972
  hypo

SEQ ID NO: 59582 - DNA, 156 bp, Homo sapiens; identical to SEQ ID NO: 39010
  chr1:93222691-93222847
  hypo

SEQ ID NO: 59583 - DNA, 30 bp, Homo sapiens; identical to SEQ ID NO: 39011
  chr1:94048058-94048088
  hypo

SEQ ID NO: 59584 - DNA, 30 bp, Homo sapiens; identical to SEQ ID NO: 39012
  chr1:94048424-94048454
  hypo

SEQ ID NO: 59585 - DNA, 30 bp, Homo sapiens; identical to SEQ ID NO: 39014
  chr1:97185220-97185250
  hypo

SEQ ID NO: 59586 - DNA, 98 bp, Homo sapiens; identical to SEQ ID NO: 14249
  chr1:99611990-99612088
  hypo

SEQ ID NO: 59587 - DNA, 38 bp, Homo sapiens; identical to SEQ ID NO: 14250
  chr1:99612148-99612186
  hypo

SEQ ID NO: 59588 - DNA, 197 bp, Homo sapiens; identical to SEQ ID NO: 39017
  chr1:100436557-100436754
  hypo

SEQ ID NO: 59589 - DNA, 86 bp, Homo sapiens; identical to SEQ ID NO: 4943
  chr1:100437183-100437269
  hypo

SEQ ID NO: 59590 - DNA, 34 bp, Homo sapiens; identical to SEQ ID NO: 39019
  chr1:100814764-100814798
  hypo

SEQ ID NO: 59591 - DNA, 30 bp, Homo sapiens; identical to SEQ ID NO: 39020
  chr1:100928393-100928423
  hypo

SEQ ID NO: 59592 - DNA, 30 bp, Homo sapiens; identical to SEQ ID NO: 39021
  chr1:109076927-109076957
  hypo

SEQ ID NO: 59593 - DNA, 30 bp, Homo sapiens; identical to SEQ ID NO: 39022
  chr1:109370476-109370506
  hypo

SEQ ID NO: 59594 - DNA, 89 bp, Homo sapiens
  chr1:109585374-109585463
  hypo
tattccacaaatatacgtgatgttcaaccgagcttaattaagcatccaggaagtataaccataaggaagaatacaattacacaaacctg

SEQ ID NO: 59595 - DNA, 19 bp, Homo sapiens
  chr1:109585754-109585773
  hypo
actccgtctcacagaaaaa

SEQ ID NO: 59596 - DNA, 28 bp, Homo sapiens
  chr1:109593505-109593533
  hypo
tcaagggccaggcaccgcggctcacgcc

SEQ ID NO: 59597 - DNA, 30 bp, Homo sapiens; identical to SEQ ID NO: 39028
  chr1:109701309-109701339
  hypo

SEQ ID NO: 59598 - DNA, 30 bp, Homo sapiens; identical to SEQ ID NO: 39029
  chr1:109941519-109941549
  hypo

SEQ ID NO: 59599 - DNA, 30 bp, Homo sapiens; identical to SEQ ID NO: 39030
  chr1:110305575-110305605
  hypo

SEQ ID NO: 59600 - DNA, 99 bp, Homo sapiens; identical to SEQ ID NO: 39031
  chr1:110726670-110726769
  hypo

SEQ ID NO: 59601 - DNA, 60 bp, Homo sapiens; identical to SEQ ID NO: 39033
  chr1:110884160-110884220
  hypo

SEQ ID NO: 59602 - DNA, 31 bp, Homo sapiens; identical to SEQ ID NO: 39034
  chr1:111544898-111544929
  hypo

SEQ ID NO: 59603 - DNA, 64 bp, Homo sapiens; identical to SEQ ID NO: 23719
  chr1:112084890-112084954
  hypo

SEQ ID NO: 59604 - DNA, 105 bp, Homo sapiens
  chr1:112084984-112085089
  hypo
gtgccagctgagaggtggtagagcaggaagctgcctgaggacctccatttatttggtgaaaaactgggctccgcccttaagagagcaagtcgagggccgtgtagg

SEQ ID NO: 59605 - DNA, 16 bp, Homo sapiens
  chr1:112192214-112192230
  hypo
acgaccagaatattag

SEQ ID NO: 59606 - DNA, 152 bp, Homo sapiens; identical to SEQ ID NO: 39037
  chr1:112784462-112784614
  hypo

SEQ ID NO: 59607 - DNA, 86 bp, Homo sapiens; identical to SEQ ID NO: 39038
  chr1:113751201-113751287
  hypo

SEQ ID NO: 59608 - DNA, 80 bp, Homo sapiens; identical to SEQ ID NO: 39039
  chr1:115055238-115055318
  hypo

SEQ ID NO: 59609 - DNA, 115 bp, Homo sapiens; identical to SEQ ID NO: 39040
  chr1:116213930-116214045
  hypo

SEQ ID NO: 59610 - DNA, 125 bp, Homo sapiens
  chr1:116214318-116214443
  hypo
actgtgtaaggaaatggcagcatggcgaggtttgtgccgcggcctacaagcagggctgcatgctccccaggcagactgtggcagagccaagcccctcacttgtagggaagcgtgtctcctaggtg

SEQ ID NO: 59611 - DNA, 45 bp, Homo sapiens; identical to SEQ ID NO: 39042
  chr1:116214942-116214987
  hypo

SEQ ID NO: 59612 - DNA, 61 bp, Homo sapiens; identical to SEQ ID NO: 39043
  chr1:116574202-116574263
  hypo

SEQ ID NO: 59613 - DNA, 124 bp, Homo sapiens; identical to SEQ ID NO: 39044
  chr1:150602992-150603116
  hypo

SEQ ID NO: 59614 - DNA, 30 bp, Homo sapiens; identical to SEQ ID NO: 14264
  chr1:150850705-150850735
  hypo

SEQ ID NO: 59615 - DNA, 102 bp, Homo sapiens; identical to SEQ ID NO: 1538
  chr1:151252684-151252786
  hypo

SEQ ID NO: 59616 - DNA, 36 bp, Homo sapiens
  chr1:151300852-151300888
  hypo
ttcttccaaacaaaacgaaaccatattaggccaaac

SEQ ID NO: 59617 - DNA, 18 bp, Homo sapiens
  chr1:151300918-151300936
  hypo
cctctggtgttgcttttg

SEQ ID NO: 59618 - DNA, 30 bp, Homo sapiens; identical to SEQ ID NO: 39050
  chr1:151345799-151345829
  hypo

SEQ ID NO: 59619 - DNA, 30 bp, Homo sapiens; identical to SEQ ID NO: 39051
  chr1:151481617-151481647
  hypo

SEQ ID NO: 59620 - DNA, 32 bp, Homo sapiens; identical to SEQ ID NO: 39052
  chr1:151678615-151678647
  hypo

SEQ ID NO: 59621 - DNA, 40 bp, Homo sapiens; identical to SEQ ID NO: 39053
  chr1:152276060-152276100
  hypo

SEQ ID NO: 59622 - DNA, 51 bp, Homo sapiens; identical to SEQ ID NO: 39054
  chr1:152286249-152286300
  hypo

SEQ ID NO: 59623 - DNA, 16 bp, Homo sapiens
  chr1:152696808-152696824
  hypo
ggagtcttgctctgtc

SEQ ID NO: 59624 - DNA, 73 bp, Homo sapiens
  chr1:153540023-153540096
  hypo
agcctggcagtgaggcgctccagactcggcctgctgctgcgtgtcccttaaacacaccggcacatgcaactag

SEQ ID NO: 59625 - DNA, 88 bp, Homo sapiens; identical to SEQ ID NO: 23727
  chr1:153540154-153540242
  hypo

SEQ ID NO: 59626 - DNA, 150 bp, Homo sapiens; identical to SEQ ID NO: 39058
  chr1:153608334-153608484
  hypo

SEQ ID NO: 59627 - DNA, 43 bp, Homo sapiens; identical to SEQ ID NO: 39059
  chr1:153645007-153645050
  hypo

SEQ ID NO: 59628 - DNA, 54 bp, Homo sapiens
  chr1:153937070-153937124
  hypo
acaaggctccagaaacgaagcccagtaattccttaagtaaaagaggaatgtgaa

SEQ ID NO: 59629 - DNA, 22 bp, Homo sapiens
  chr1:154098531-154098553
  hypo
ccgcgcccggccaagaaatgtt

SEQ ID NO: 59630 - DNA, 22 bp, Homo sapiens
  chr1:154107501-154107523
  hypo
ccacgcccggcctctgtgtacc

SEQ ID NO: 59631 - DNA, 23 bp, Homo sapiens
  chr1:154156755-154156778
  hypo
gccggcctcggcctcccaaagtg

SEQ ID NO: 59632 - DNA, 30 bp, Homo sapiens; identical to SEQ ID NO: 39064
  chr1:154305492-154305522
  hypo

SEQ ID NO: 59633 - DNA, 54 bp, Homo sapiens; identical to SEQ ID NO: 39065
  chr1:154499777-154499831
  hypo

SEQ ID NO: 59634 - DNA, 46 bp, Homo sapiens; identical to SEQ ID NO: 39067
  chr1:154682497-154682543
  hypo

SEQ ID NO: 59635 - DNA, 30 bp, Homo sapiens; identical to SEQ ID NO: 39068
  chr1:154808785-154808815
  hypo

SEQ ID NO: 59636 - DNA, 30 bp, Homo sapiens; identical to SEQ ID NO: 39069
  chr1:154851806-154851836
  hypo

SEQ ID NO: 59637 - DNA, 98 bp, Homo sapiens; identical to SEQ ID NO: 14271
  chr1:155160925-155161023
  hypo

SEQ ID NO: 59638 - DNA, 30 bp, Homo sapiens; identical to SEQ ID NO: 39071
  chr1:155311790-155311820
  hypo

SEQ ID NO: 59639 - DNA, 21 bp, Homo sapiens
  chr1:155563460-155563481
  hypo
aataaaattgccattcgggcc

SEQ ID NO: 59640 - DNA, 6 bp, Homo sapiens
  chr1:155578921-155578927
  hypo
ccttgt

SEQ ID NO: 59641 - DNA, 59 bp, Homo sapiens; identical to SEQ ID NO: 39074
  chr1:155668700-155668759
  hypo

SEQ ID NO: 59642 - DNA, 17 bp, Homo sapiens
  chr1:155892702-155892719
  hypo
aaagacagtcctggccg

SEQ ID NO: 59643 - DNA, 31 bp, Homo sapiens; identical to SEQ ID NO: 39077
  chr1:155905287-155905318
  hypo

SEQ ID NO: 59644 - DNA, 30 bp, Homo sapiens; identical to SEQ ID NO: 39078
  chr1:155911924-155911954
  hypo

SEQ ID NO: 59645 - DNA, 30 bp, Homo sapiens; identical to SEQ ID NO: 39079
  chr1:155912603-155912633
  hypo

SEQ ID NO: 59646 - DNA, 23 bp, Homo sapiens
  chr1:155954259-155954282
  hypo
aaagccagacaaaggcgcccagg

SEQ ID NO: 59647 - DNA, 42 bp, Homo sapiens; identical to SEQ ID NO: 39081
  chr1:156030121-156030163
  hypo

SEQ ID NO: 59648 - DNA, 105 bp, Homo sapiens; identical to SEQ ID NO: 39082
  chr1:156031479-156031584
  hypo

SEQ ID NO: 59649 - DNA, 206 bp, Homo sapiens; identical to SEQ ID NO: 39083
  chr1:156253833-156254039
  hypo

SEQ ID NO: 59650 - DNA, 102 bp, Homo sapiens; identical to SEQ ID NO: 39084
  chr1:156271344-156271446
  hypo

SEQ ID NO: 59651 - DNA, 47 bp, Homo sapiens; identical to SEQ ID NO: 14276
  chr1:156433495-156433542
  hypo

SEQ ID NO: 59652 - DNA, 18 bp, Homo sapiens
  chr1:156441212-156441230
  hypo
gcccggccagaatcaact

SEQ ID NO: 59653 - DNA, 34 bp, Homo sapiens; identical to SEQ ID NO: 39087
  chr1:156690386-156690420
  hypo

SEQ ID NO: 59654 - DNA, 154 bp, Homo sapiens; identical to SEQ ID NO: 39089
  chr1:156843312-156843466
  hypo

SEQ ID NO: 59655 - DNA, 247 bp, Homo sapiens; identical to SEQ ID NO: 39090
  chr1:156849725-156849972
  hypo

SEQ ID NO: 59656 - DNA, 37 bp, Homo sapiens; identical to SEQ ID NO: 39091
  chr1:156866362-156866399
  hypo

SEQ ID NO: 59657 - DNA, 30 bp, Homo sapiens; identical to SEQ ID NO: 39092
  chr1:157086435-157086465
  hypo

SEQ ID NO: 59658 - DNA, 30 bp, Homo sapiens
  chr1:157247317-157247347
  hypo
gcttacctgggtatgggcattgtctgggcc

SEQ ID NO: 59659 - DNA, 75 bp, Homo sapiens; identical to SEQ ID NO: 23734
  chr1:157247388-157247463
  hypo

SEQ ID NO: 59660 - DNA, 136 bp, Homo sapiens; identical to SEQ ID NO: 23735
  chr1:157458773-157458909
  hypo

SEQ ID NO: 59661 - DNA, 38 bp, Homo sapiens; identical to SEQ ID NO: 39095
  chr1:157490582-157490620
  hypo

SEQ ID NO: 59662 - DNA, 191 bp, Homo sapiens; identical to SEQ ID NO: 39096
  chr1:157527405-157527596
  hypo

SEQ ID NO: 59663 - DNA, 87 bp, Homo sapiens; identical to SEQ ID NO: 39097
  chr1:157543012-157543099
  hypo

SEQ ID NO: 59664 - DNA, 36 bp, Homo sapiens; identical to SEQ ID NO: 39098
  chr1:157791984-157792020
  hypo

SEQ ID NO: 59665 - DNA, 202 bp, Homo sapiens
  chr1:157895211-157895413
  hypo
gatgctccaaggtgacgacaagaaacagggcgtgaggagggtaagaggccctatgggcactgtagtcttgtgatgggggaggtggtggcagcggcagcggtggcagagagctagaggagggtgagaaggtggacgcggggccatgtatcccgagctcttcaccagagcccagcacagctctgccggaagcacccctgcaggg

SEQ ID NO: 59666 - DNA, 89 bp, Homo sapiens
  chr1:157895443-157895532
  hypo
gaaagagtccagggccggcggggtgctatgaggcgaggacttcctgagccgaggaccgggtgggttgtgagttgcgaccagcctcgctg

SEQ ID NO: 59667 - DNA, 141 bp, Homo sapiens; identical to SEQ ID NO: 14282
  chr1:158169208-158169349
  hypo

SEQ ID NO: 59668 - DNA, 60 bp, Homo sapiens; identical to SEQ ID NO: 39101
  chr1:158237112-158237172
  hypo

SEQ ID NO: 59669 - DNA, 20 bp, Homo sapiens
  chr1:158366698-158366718
  hypo
tattttggccaggggcggtg

SEQ ID NO: 59670 - DNA, 30 bp, Homo sapiens; identical to SEQ ID NO: 39103
  chr1:158578092-158578122
  hypo

SEQ ID NO: 59671 - DNA, 16 bp, Homo sapiens
  chr1:158591676-158591692
  hypo
ggagtcttgctctgtc

SEQ ID NO: 59672 - DNA, 30 bp, Homo sapiens; identical to SEQ ID NO: 14287
  chr1:158639324-158639354
  hypo

SEQ ID NO: 59673 - DNA, 44 bp, Homo sapiens; identical to SEQ ID NO: 39108
  chr1:158672331-158672375
  hypo

SEQ ID NO: 59674 - DNA, 107 bp, Homo sapiens; identical to SEQ ID NO: 39109
  chr1:158723718-158723825
  hypo

SEQ ID NO: 59675 - DNA, 17 bp, Homo sapiens
  chr1:158730575-158730592
  hypo
ctgggtgcagtggctcg

SEQ ID NO: 59676 - DNA, 33 bp, Homo sapiens; identical to SEQ ID NO: 39111
  chr1:158748784-158748817
  hypo

SEQ ID NO: 59677 - DNA, 42 bp, Homo sapiens; identical to SEQ ID NO: 39112
  chr1:158815297-158815339
  hypo

SEQ ID NO: 59678 - DNA, 23 bp, Homo sapiens
  chr1:159448019-159448042
  hypo
tttttttttttgagacggagtct

SEQ ID NO: 59679 - DNA, 41 bp, Homo sapiens; identical to SEQ ID NO: 39114
  chr1:159650169-159650210
  hypo

SEQ ID NO: 59680 - DNA, 20 bp, Homo sapiens
  chr1:159679189-159679209
  hypo
aagagcgagactccgtctcg

SEQ ID NO: 59681 - DNA, 30 bp, Homo sapiens; identical to SEQ ID NO: 39116
  chr1:159683905-159683935
  hypo

SEQ ID NO: 59682 - DNA, 169 bp, Homo sapiens; identical to SEQ ID NO: 14290
  chr1:159883486-159883655
  hypo

SEQ ID NO: 59683 - DNA, 19 bp, Homo sapiens
  chr1:159930262-159930281
  hypo
ttttttcctttgagacgga

SEQ ID NO: 59684 - DNA, 30 bp, Homo sapiens; identical to SEQ ID NO: 14291
  chr1:159932029-159932059
  hypo

SEQ ID NO: 59685 - DNA, 71 bp, Homo sapiens; identical to SEQ ID NO: 39120
  chr1:160025702-160025773
  hypo

SEQ ID NO: 59686 - DNA, 33 bp, Homo sapiens
  chr1:160451202-160451235
  hypo
actggagctgttcctattcggccatcttggctg

SEQ ID NO: 59687 - DNA, 61 bp, Homo sapiens
  chr1:160693873-160693934
  hypo
tcacccgtggtaacccgagccctggtattatacacataggtcctgtcctcctgaaaacggg

SEQ ID NO: 59688 - DNA, 143 bp, Homo sapiens; identical to SEQ ID NO: 39123
  chr1:160787406-160787549
  hypo

SEQ ID NO: 59689 - DNA, 30 bp, Homo sapiens; identical to SEQ ID NO: 39124
  chr1:160820959-160820989
  hypo

SEQ ID NO: 59690 - DNA, 30 bp, Homo sapiens; identical to SEQ ID NO: 14294
  chr1:160853373-160853403
  hypo

SEQ ID NO: 59691 - DNA, 94 bp, Homo sapiens; identical to SEQ ID NO: 39126
  chr1:160880601-160880695
  hypo

SEQ ID NO: 59692 - DNA, 146 bp, Homo sapiens; identical to SEQ ID NO: 39127
  chr1:160953007-160953153
  hypo

SEQ ID NO: 59693 - DNA, 16 bp, Homo sapiens
  chr1:161007746-161007762
  hypo
ccgcttgcccatctga

SEQ ID NO: 59694 - DNA, 30 bp, Homo sapiens; identical to SEQ ID NO: 39130
  chr1:161044643-161044673
  hypo

SEQ ID NO: 59695 - DNA, 181 bp, Homo sapiens; identical to SEQ ID NO: 39131
  chr1:161056643-161056824
  hypo

SEQ ID NO: 59696 - DNA, 33 bp, Homo sapiens; identical to SEQ ID NO: 39132
  chr1:161358973-161359006
  hypo

SEQ ID NO: 59697 - DNA, 360 bp, Homo sapiens; identical to SEQ ID NO: 39133
  chr1:161367772-161368132
  hypo

SEQ ID NO: 59698 - DNA, 37 bp, Homo sapiens
  chr1:161442404-161442441
  hypo
ttcccctggagaccccggcgggcagtctctcgaccct

SEQ ID NO: 59699 - DNA, 102 bp, Homo sapiens
  chr1:161442471-161442573
  hypo
gtcgacctctctccctccgctctccctccgcgcccaacctcagttgcctggatgtgaggagagcctccccttctgccctcctcatcgcgccagcctgtcttg

SEQ ID NO: 59700 - DNA, 30 bp, Homo sapiens; identical to SEQ ID NO: 39136
  chr1:161493414-161493444
  hypo

SEQ ID NO: 59701 - DNA, 30 bp, Homo sapiens; identical to SEQ ID NO: 39137
  chr1:161577640-161577670
  hypo

SEQ ID NO: 59702 - DNA, 45 bp, Homo sapiens; identical to SEQ ID NO: 39138
  chr1:161879452-161879497
  hypo

SEQ ID NO: 59703 - DNA, 30 bp, Homo sapiens; identical to SEQ ID NO: 14301
  chr1:161913509-161913539
  hypo

SEQ ID NO: 59704 - DNA, 30 bp, Homo sapiens; identical to SEQ ID NO: 39140
  chr1:163363352-163363382
  hypo

SEQ ID NO: 59705 - DNA, 39 bp, Homo sapiens; identical to SEQ ID NO: 39141
  chr1:165664200-165664239
  hypo

SEQ ID NO: 59706 - DNA, 36 bp, Homo sapiens; identical to SEQ ID NO: 39142
  chr1:165809083-165809119
  hypo

SEQ ID NO: 59707 - DNA, 30 bp, Homo sapiens; identical to SEQ ID NO: 39143
  chr1:167505794-167505824
  hypo

SEQ ID NO: 59708 - DNA, 38 bp, Homo sapiens; identical to SEQ ID NO: 39144
  chr1:167789113-167789151
  hypo

SEQ ID NO: 59709 - DNA, 30 bp, Homo sapiens; identical to SEQ ID NO: 39146
  chr1:168058977-168059007
  hypo

SEQ ID NO: 59710 - DNA, 29 bp, Homo sapiens
  chr1:168116130-168116159
  hypo
actacacgtagaagccgggtgcggtggct

SEQ ID NO: 59711 - DNA, 30 bp, Homo sapiens; identical to SEQ ID NO: 14304
  chr1:168150766-168150796
  hypo

SEQ ID NO: 59712 - DNA, 120 bp, Homo sapiens; identical to SEQ ID NO: 39149
  chr1:171452999-171453119
  hypo

SEQ ID NO: 59713 - DNA, 30 bp, Homo sapiens; identical to SEQ ID NO: 39150
  chr1:171555031-171555061
  hypo

SEQ ID NO: 59714 - DNA, 17 bp, Homo sapiens
  chr1:172902655-172902672
  hypo
atagcagacttgggccg

SEQ ID NO: 59715 - DNA, 30 bp, Homo sapiens; identical to SEQ ID NO: 39153
  chr1:173090762-173090792
  hypo

SEQ ID NO: 59716 - DNA, 61 bp, Homo sapiens; identical to SEQ ID NO: 39154
  chr1:173477004-173477065
  hypo

SEQ ID NO: 59717 - DNA, 30 bp, Homo sapiens; identical to SEQ ID NO: 39155
  chr1:173794930-173794960
  hypo

SEQ ID NO: 59718 - DNA, 30 bp, Homo sapiens; identical to SEQ ID NO: 39156
  chr1:173897621-173897651
  hypo

SEQ ID NO: 59719 - DNA, 77 bp, Homo sapiens; identical to SEQ ID NO: 39157
  chr1:173993036-173993113
  hypo

SEQ ID NO: 59720 - DNA, 30 bp, Homo sapiens; identical to SEQ ID NO: 39158
  chr1:174421982-174422012
  hypo

SEQ ID NO: 59721 - DNA, 348 bp, Homo sapiens; identical to SEQ ID NO: 39160
  chr1:175355017-175355365
  hypo

SEQ ID NO: 59722 - DNA, 229 bp, Homo sapiens; identical to SEQ ID NO: 39161
  chr1:175365646-175365875
  hypo

SEQ ID NO: 59723 - DNA, 78 bp, Homo sapiens; identical to SEQ ID NO: 14308
  chr1:175372494-175372572
  hypo

SEQ ID NO: 59724 - DNA, 35 bp, Homo sapiens; identical to SEQ ID NO: 39163
  chr1:175375411-175375446
  hypo

SEQ ID NO: 59725 - DNA, 102 bp, Homo sapiens; identical to SEQ ID NO: 39165
  chr1:175472249-175472351
  hypo

SEQ ID NO: 59726 - DNA, 32 bp, Homo sapiens; identical to SEQ ID NO: 39166
  chr1:178531766-178531798
  hypo

SEQ ID NO: 59727 - DNA, 30 bp, Homo sapiens; identical to SEQ ID NO: 39167
  chr1:178857986-178858016
  hypo

SEQ ID NO: 59728 - DNA, 30 bp, Homo sapiens; identical to SEQ ID NO: 39168
  chr1:178994064-178994094
  hypo

SEQ ID NO: 59729 - DNA, 26 bp, Homo sapiens
  chr1:179262298-179262324
  hypo
gcgtgagccaccgcacctggcctcaa

SEQ ID NO: 59730 - DNA, 30 bp, Homo sapiens; identical to SEQ ID NO: 39170
  chr1:179781741-179781771
  hypo

SEQ ID NO: 59731 - DNA, 30 bp, Homo sapiens; identical to SEQ ID NO: 14309
  chr1:179849955-179849985
  hypo

SEQ ID NO: 59732 - DNA, 30 bp, Homo sapiens; identical to SEQ ID NO: 39172
  chr1:180096076-180096106
  hypo

SEQ ID NO: 59733 - DNA, 30 bp, Homo sapiens; identical to SEQ ID NO: 39173
  chr1:180137119-180137149
  hypo

SEQ ID NO: 59734 - DNA, 57 bp, Homo sapiens; identical to SEQ ID NO: 39174
  chr1:180235667-180235724
  hypo

SEQ ID NO: 59735 - DNA, 30 bp, Homo sapiens; identical to SEQ ID NO: 39175
  chr1:180910386-180910416
  hypo

SEQ ID NO: 59736 - DNA, 99 bp, Homo sapiens; identical to SEQ ID NO: 39176
  chr1:180925089-180925188
  hypo

SEQ ID NO: 59737 - DNA, 30 bp, Homo sapiens; identical to SEQ ID NO: 39177
  chr1:181727256-181727286
  hypo

SEQ ID NO: 59738 - DNA, 91 bp, Homo sapiens; identical to SEQ ID NO: 39178
  chr1:181922685-181922776
  hypo

SEQ ID NO: 59739 - DNA, 21 bp, Homo sapiens
  chr1:182815386-182815407
  hypo
tttgagatggagtttcgcttt

SEQ ID NO: 59740 - DNA, 30 bp, Homo sapiens; identical to SEQ ID NO: 39183
  chr1:191565747-191565777
  hypo

SEQ ID NO: 59741 - DNA, 150 bp, Homo sapiens; identical to SEQ ID NO: 39184
  chr1:191763150-191763300
  hypo

SEQ ID NO: 59742 - DNA, 30 bp, Homo sapiens; identical to SEQ ID NO: 39186
  chr1:197771436-197771466
  hypo

SEQ ID NO: 59743 - DNA, 160 bp, Homo sapiens; identical to SEQ ID NO: 39187
  chr1:200505065-200505225
  hypo

SEQ ID NO: 59744 - DNA, 30 bp, Homo sapiens; identical to SEQ ID NO: 14313
  chr1:200519350-200519380
  hypo

SEQ ID NO: 59745 - DNA, 30 bp, Homo sapiens; identical to SEQ ID NO: 14314
  chr1:200864028-200864058
  hypo

SEQ ID NO: 59746 - DNA, 49 bp, Homo sapiens; identical to SEQ ID NO: 39190
  chr1:200941620-200941669
  hypo

SEQ ID NO: 59747 - DNA, 30 bp, Homo sapiens; identical to SEQ ID NO: 14315
  chr1:201244396-201244426
  hypo

SEQ ID NO: 59748 - DNA, 196 bp, Homo sapiens; identical to SEQ ID NO: 39192
  chr1:201445702-201445898
  hypo

SEQ ID NO: 59749 - DNA, 39 bp, Homo sapiens; identical to SEQ ID NO: 39193
  chr1:201797433-201797472
  hypo

SEQ ID NO: 59750 - DNA, 30 bp, Homo sapiens; identical to SEQ ID NO: 39194
  chr1:201851118-201851148
  hypo

SEQ ID NO: 59751 - DNA, 101 bp, Homo sapiens; identical to SEQ ID NO: 39195
  chr1:201977862-201977963
  hypo

SEQ ID NO: 59752 - DNA, 30 bp, Homo sapiens; identical to SEQ ID NO: 39196
  chr1:201981114-201981144
  hypo

SEQ ID NO: 59753 - DNA, 42 bp, Homo sapiens; identical to SEQ ID NO: 14317
  chr1:201982442-201982484
  hypo

SEQ ID NO: 59754 - DNA, 31 bp, Homo sapiens; identical to SEQ ID NO: 23767
  chr1:201983200-201983231
  hypo

SEQ ID NO: 59755 - DNA, 98 bp, Homo sapiens; identical to SEQ ID NO: 39199
  chr1:201984047-201984145
  hypo

SEQ ID NO: 59756 - DNA, 159 bp, Homo sapiens; identical to SEQ ID NO: 39200
  chr1:201986490-201986649
  hypo

SEQ ID NO: 59757 - DNA, 30 bp, Homo sapiens; identical to SEQ ID NO: 39202
  chr1:202101759-202101789
  hypo

SEQ ID NO: 59758 - DNA, 139 bp, Homo sapiens; identical to SEQ ID NO: 39203
  chr1:202311995-202312134
  hypo

SEQ ID NO: 59759 - DNA, 30 bp, Homo sapiens; identical to SEQ ID NO: 39204
  chr1:202856302-202856332
  hypo

SEQ ID NO: 59760 - DNA, 37 bp, Homo sapiens; identical to SEQ ID NO: 39205
  chr1:202898225-202898262
  hypo

SEQ ID NO: 59761 - DNA, 33 bp, Homo sapiens; identical to SEQ ID NO: 39206
  chr1:202933730-202933763
  hypo

SEQ ID NO: 59762 - DNA, 79 bp, Homo sapiens; identical to SEQ ID NO: 39207
  chr1:202995301-202995380
  hypo

SEQ ID NO: 59763 - DNA, 30 bp, Homo sapiens; identical to SEQ ID NO: 39208
  chr1:203257678-203257708
  hypo

SEQ ID NO: 59764 - DNA, 33 bp, Homo sapiens; identical to SEQ ID NO: 39209
  chr1:203298181-203298214
  hypo

SEQ ID NO: 59765 - DNA, 55 bp, Homo sapiens
  chr1:203429594-203429649
  hypo
tatgctggacaaagggcggattcatatcgccagcaggatgaagcgggagagtgca

SEQ ID NO: 59766 - DNA, 22 bp, Homo sapiens
  chr1:203911836-203911858
  hypo
gattcaggacagggccgggcgt

SEQ ID NO: 59767 - DNA, 30 bp, Homo sapiens; identical to SEQ ID NO: 39212
  chr1:204333529-204333559
  hypo

SEQ ID NO: 59768 - DNA, 30 bp, Homo sapiens; identical to SEQ ID NO: 39213
  chr1:204535867-204535897
  hypo

SEQ ID NO: 59769 - DNA, 30 bp, Homo sapiens; identical to SEQ ID NO: 39214
  chr1:204536295-204536325
  hypo

SEQ ID NO: 59770 - DNA, 122 bp, Homo sapiens; identical to SEQ ID NO: 39215
  chr1:204587578-204587700
  hypo

SEQ ID NO: 59771 - DNA, 112 bp, Homo sapiens; identical to SEQ ID NO: 39216
  chr1:204588271-204588383
  hypo

SEQ ID NO: 59772 - DNA, 27 bp, Homo sapiens
  chr1:204721236-204721263
  hypo
gctacagacccacgcctcctgctgtat

SEQ ID NO: 59773 - DNA, 145 bp, Homo sapiens; identical to SEQ ID NO: 39218
  chr1:205310661-205310806
  hypo

SEQ ID NO: 59774 - DNA, 24 bp, Homo sapiens
  chr1:205311046-205311070
  hypo
gattacaggcgtgagccaccgcgc

SEQ ID NO: 59775 - DNA, 30 bp, Homo sapiens; identical to SEQ ID NO: 39220
  chr1:205548923-205548953
  hypo

SEQ ID NO: 59776 - DNA, 27 bp, Homo sapiens
  chr1:207227190-207227217
  hypo
ttcgagattttcccacgtccctcactt

SEQ ID NO: 59777 - DNA, 25 bp, Homo sapiens
  chr1:207598909-207598934
  hypo
ccaaactcaccgagtcatgcaggct

SEQ ID NO: 59778 - DNA, 30 bp, Homo sapiens; identical to SEQ ID NO: 14325
  chr1:207656486-207656516
  hypo

SEQ ID NO: 59779 - DNA, 137 bp, Homo sapiens; identical to SEQ ID NO: 39225
  chr1:207787630-207787767
  hypo

SEQ ID NO: 59780 - DNA, 30 bp, Homo sapiens; identical to SEQ ID NO: 39226
  chr1:207857205-207857235
  hypo

SEQ ID NO: 59781 - DNA, 129 bp, Homo sapiens; identical to SEQ ID NO: 39227
  chr1:207911135-207911264
  hypo

SEQ ID NO: 59782 - DNA, 116 bp, Homo sapiens; identical to SEQ ID NO: 39228
  chr1:207991495-207991611
  hypo

SEQ ID NO: 59783 - DNA, 30 bp, Homo sapiens; identical to SEQ ID NO: 39229
  chr1:207992298-207992328
  hypo

SEQ ID NO: 59784 - DNA, 115 bp, Homo sapiens; identical to SEQ ID NO: 39230
  chr1:208951412-208951527
  hypo

SEQ ID NO: 59785 - DNA, 137 bp, Homo sapiens; identical to SEQ ID NO: 39231
  chr1:209306205-209306342
  hypo

SEQ ID NO: 59786 - DNA, 185 bp, Homo sapiens; identical to SEQ ID NO: 39232
  chr1:209601396-209601581
  hypo

SEQ ID NO: 59787 - DNA, 191 bp, Homo sapiens; identical to SEQ ID NO: 39233
  chr1:209999773-209999964
  hypo

SEQ ID NO: 59788 - DNA, 33 bp, Homo sapiens; identical to SEQ ID NO: 39234
  chr1:211430421-211430454
  hypo

SEQ ID NO: 59789 - DNA, 180 bp, Homo sapiens; identical to SEQ ID NO: 39236
  chr1:213189664-213189844
  hypo

SEQ ID NO: 59790 - DNA, 101 bp, Homo sapiens; identical to SEQ ID NO: 39237
  chr1:213190144-213190245
  hypo

SEQ ID NO: 59791 - DNA, 41 bp, Homo sapiens; identical to SEQ ID NO: 39238
  chr1:215745246-215745287
  hypo

SEQ ID NO: 59792 - DNA, 30 bp, Homo sapiens; identical to SEQ ID NO: 39239
  chr1:217805039-217805069
  hypo

SEQ ID NO: 59793 - DNA, 30 bp, Homo sapiens; identical to SEQ ID NO: 39240
  chr1:219253291-219253321
  hypo

SEQ ID NO: 59794 - DNA, 39 bp, Homo sapiens; identical to SEQ ID NO: 39241
  chr1:220552763-220552802
  hypo

SEQ ID NO: 59795 - DNA, 52 bp, Homo sapiens
  chr1:220636414-220636466
  hypo
acaggtaggatctgccctcccaggtgtcgctgcagctgcagcacctgtggct

SEQ ID NO: 59796 - DNA, 30 bp, Homo sapiens; identical to SEQ ID NO: 39243
  chr1:221706708-221706738
  hypo

SEQ ID NO: 59797 - DNA, 30 bp, Homo sapiens; identical to SEQ ID NO: 39244
  chr1:222391027-222391057
  hypo

SEQ ID NO: 59798 - DNA, 165 bp, Homo sapiens; identical to SEQ ID NO: 39245
  chr1:222987570-222987735
  hypo

SEQ ID NO: 59799 - DNA, 30 bp, Homo sapiens; identical to SEQ ID NO: 39246
  chr1:223841897-223841927
  hypo

SEQ ID NO: 59800 - DNA, 189 bp, Homo sapiens; identical to SEQ ID NO: 39247
  chr1:223907491-223907680
  hypo

SEQ ID NO: 59801 - DNA, 30 bp, Homo sapiens; identical to SEQ ID NO: 39248
  chr1:224232559-224232589
  hypo

SEQ ID NO: 59802 - DNA, 24 bp, Homo sapiens
  chr1:224251284-224251308
  hypo
gattacaggcgtgagccaccacgc

SEQ ID NO: 59803 - DNA, 30 bp, Homo sapiens; identical to SEQ ID NO: 14332
  chr1:224267844-224267874
  hypo

SEQ ID NO: 59804 - DNA, 32 bp, Homo sapiens; identical to SEQ ID NO: 39251
  chr1:224300912-224300944
  hypo

SEQ ID NO: 59805 - DNA, 16 bp, Homo sapiens
  chr1:224361275-224361291
  hypo
acgtagagtgagattc

SEQ ID NO: 59806 - DNA, 121 bp, Homo sapiens; identical to SEQ ID NO: 14333
  chr1:226062878-226062999
  hypo

SEQ ID NO: 59807 - DNA, 86 bp, Homo sapiens; identical to SEQ ID NO: 39254
  chr1:226163129-226163215
  hypo

SEQ ID NO: 59808 - DNA, 30 bp, Homo sapiens; identical to SEQ ID NO: 39255
  chr1:226284013-226284043
  hypo

SEQ ID NO: 59809 - DNA, 127 bp, Homo sapiens; identical to SEQ ID NO: 39256
  chr1:226303892-226304019
  hypo

SEQ ID NO: 59810 - DNA, 49 bp, Homo sapiens; identical to SEQ ID NO: 39257
  chr1:226314981-226315030
  hypo

SEQ ID NO: 59811 - DNA, 43 bp, Homo sapiens; identical to SEQ ID NO: 39258
  chr1:226620644-226620687
  hypo

SEQ ID NO: 59812 - DNA, 30 bp, Homo sapiens; identical to SEQ ID NO: 39259
  chr1:226725373-226725403
  hypo

SEQ ID NO: 59813 - DNA, 20 bp, Homo sapiens
  chr1:226816426-226816446
  hypo
gtctccgtgacaactacaca

SEQ ID NO: 59814 - DNA, 30 bp, Homo sapiens; identical to SEQ ID NO: 39261
  chr1:226846375-226846405
  hypo

SEQ ID NO: 59815 - DNA, 87 bp, Homo sapiens; identical to SEQ ID NO: 39262
  chr1:226908374-226908461
  hypo

SEQ ID NO: 59816 - DNA, 38 bp, Homo sapiens; identical to SEQ ID NO: 39263
  chr1:226954853-226954891
  hypo

SEQ ID NO: 59817 - DNA, 35 bp, Homo sapiens; identical to SEQ ID NO: 39264
  chr1:227174055-227174090
  hypo

SEQ ID NO: 59818 - DNA, 42 bp, Homo sapiens; identical to SEQ ID NO: 14335
  chr1:227750829-227750871
  hypo

SEQ ID NO: 59819 - DNA, 30 bp, Homo sapiens; identical to SEQ ID NO: 14336
  chr1:227921541-227921571
  hypo

SEQ ID NO: 59820 - DNA, 30 bp, Homo sapiens; identical to SEQ ID NO: 39267
  chr1:227921780-227921810
  hypo

SEQ ID NO: 59821 - DNA, 61 bp, Homo sapiens; identical to SEQ ID NO: 39268
  chr1:227926624-227926685
  hypo

SEQ ID NO: 59822 - DNA, 30 bp, Homo sapiens; identical to SEQ ID NO: 39269
  chr1:227955886-227955916
  hypo

SEQ ID NO: 59823 - DNA, 221 bp, Homo sapiens; identical to SEQ ID NO: 39270
  chr1:228083399-228083620
  hypo

SEQ ID NO: 59824 - DNA, 30 bp, Homo sapiens; identical to SEQ ID NO: 39271
  chr1:228117865-228117895
  hypo

SEQ ID NO: 59825 - DNA, 19 bp, Homo sapiens
  chr1:228201251-228201270
  hypo
ggtgcgggttgggagagct

SEQ ID NO: 59826 - DNA, 37 bp, Homo sapiens; identical to SEQ ID NO: 39273
  chr1:228238537-228238574
  hypo

SEQ ID NO: 59827 - DNA, 30 bp, Homo sapiens; identical to SEQ ID NO: 39274
  chr1:228342820-228342850
  hypo

SEQ ID NO: 59828 - DNA, 30 bp, Homo sapiens; identical to SEQ ID NO: 39275
  chr1:228466507-228466537
  hypo

SEQ ID NO: 59829 - DNA, 164 bp, Homo sapiens; identical to SEQ ID NO: 39276
  chr1:228495832-228495996
  hypo

SEQ ID NO: 59830 - DNA, 38 bp, Homo sapiens; identical to SEQ ID NO: 39277
  chr1:228504430-228504468
  hypo

SEQ ID NO: 59831 - DNA, 156 bp, Homo sapiens; identical to SEQ ID NO: 23784
  chr1:228529016-228529172
  hypo

SEQ ID NO: 59832 - DNA, 30 bp, Homo sapiens; identical to SEQ ID NO: 14338
  chr1:228536492-228536522
  hypo

SEQ ID NO: 59833 - DNA, 30 bp, Homo sapiens; identical to SEQ ID NO: 14339
  chr1:228552593-228552623
  hypo

SEQ ID NO: 59834 - DNA, 163 bp, Homo sapiens; identical to SEQ ID NO: 39281
  chr1:228554806-228554969
  hypo

SEQ ID NO: 59835 - DNA, 97 bp, Homo sapiens
  chr1:228559238-228559335
  hypo
gcaccgcgtgctggaggaggaggccgccagggaggagcaggccaccctcctggccaaagccccctcattcgagactgccctccggctgcctgcctct

SEQ ID NO: 59836 - DNA, 46 bp, Homo sapiens; identical to SEQ ID NO: 39283
  chr1:228919370-228919416
  hypo

SEQ ID NO: 59837 - DNA, 28 bp, Homo sapiens
  chr1:229705999-229706027
  hypo
ttgctattacaggcgtaaaccaccgcac

SEQ ID NO: 59838 - DNA, 64 bp, Homo sapiens; identical to SEQ ID NO: 39285
  chr1:230107209-230107273
  hypo

SEQ ID NO: 59839 - DNA, 35 bp, Homo sapiens
  chr1:230404263-230404298
  hypo
tacagcacattaaacagaagcgtgtgctcaggccc

SEQ ID NO: 59840 - DNA, 72 bp, Homo sapiens; identical to SEQ ID NO: 39287
  chr1:230423782-230423854
  hypo

SEQ ID NO: 59841 - DNA, 30 bp, Homo sapiens; identical to SEQ ID NO: 39288
  chr1:230424489-230424519
  hypo

SEQ ID NO: 59842 - DNA, 30 bp, Homo sapiens; identical to SEQ ID NO: 39289
  chr1:230453332-230453362
  hypo

SEQ ID NO: 59843 - DNA, 53 bp, Homo sapiens; identical to SEQ ID NO: 14343
  chr1:230453632-230453685
  hypo

SEQ ID NO: 59844 - DNA, 30 bp, Homo sapiens; identical to SEQ ID NO: 39291
  chr1:230458365-230458395
  hypo

SEQ ID NO: 59845 - DNA, 128 bp, Homo sapiens; identical to SEQ ID NO: 39292
  chr1:230992827-230992955
  hypo

SEQ ID NO: 59846 - DNA, 53 bp, Homo sapiens; identical to SEQ ID NO: 39293
  chr1:231163086-231163139
  hypo

SEQ ID NO: 59847 - DNA, 96 bp, Homo sapiens; identical to SEQ ID NO: 39294
  chr1:231663293-231663389
  hypo

SEQ ID NO: 59848 - DNA, 120 bp, Homo sapiens; identical to SEQ ID NO: 39295
  chr1:231738873-231738993
  hypo

SEQ ID NO: 59849 - DNA, 30 bp, Homo sapiens; identical to SEQ ID NO: 39296
  chr1:232761388-232761418
  hypo

SEQ ID NO: 59850 - DNA, 278 bp, Homo sapiens; identical to SEQ ID NO: 39298
  chr1:234621065-234621343
  hypo

SEQ ID NO: 59851 - DNA, 30 bp, Homo sapiens; identical to SEQ ID NO: 39299
  chr1:234625024-234625054
  hypo

SEQ ID NO: 59852 - DNA, 30 bp, Homo sapiens; identical to SEQ ID NO: 39300
  chr1:234724806-234724836
  hypo

SEQ ID NO: 59853 - DNA, 30 bp, Homo sapiens; identical to SEQ ID NO: 39301
  chr1:234795478-234795508
  hypo

SEQ ID NO: 59854 - DNA, 30 bp, Homo sapiens; identical to SEQ ID NO: 39302
  chr1:234845113-234845143
  hypo

SEQ ID NO: 59855 - DNA, 169 bp, Homo sapiens; identical to SEQ ID NO: 39303
  chr1:234882410-234882579
  hypo

SEQ ID NO: 59856 - DNA, 30 bp, Homo sapiens; identical to SEQ ID NO: 14348
  chr1:234959409-234959439
  hypo

SEQ ID NO: 59857 - DNA, 76 bp, Homo sapiens; identical to SEQ ID NO: 39305
  chr1:235003807-235003883
  hypo

SEQ ID NO: 59858 - DNA, 39 bp, Homo sapiens; identical to SEQ ID NO: 39306
  chr1:235005711-235005750
  hypo

SEQ ID NO: 59859 - DNA, 152 bp, Homo sapiens; identical to SEQ ID NO: 39307
  chr1:235267072-235267224
  hypo

SEQ ID NO: 59860 - DNA, 76 bp, Homo sapiens; identical to SEQ ID NO: 39308
  chr1:235292638-235292714
  hypo

SEQ ID NO: 59861 - DNA, 120 bp, Homo sapiens; identical to SEQ ID NO: 39309
  chr1:235325361-235325481
  hypo

SEQ ID NO: 59862 - DNA, 31 bp, Homo sapiens; identical to SEQ ID NO: 39310
  chr1:235325541-235325572
  hypo

SEQ ID NO: 59863 - DNA, 30 bp, Homo sapiens; identical to SEQ ID NO: 39311
  chr1:235793720-235793750
  hypo

SEQ ID NO: 59864 - DNA, 20 bp, Homo sapiens
  chr1:236044137-236044157
  hypo
tttagcggccgggcacggtg

SEQ ID NO: 59865 - DNA, 30 bp, Homo sapiens; identical to SEQ ID NO: 39313
  chr1:236081438-236081468
  hypo

SEQ ID NO: 59866 - DNA, 24 bp, Homo sapiens
  chr1:236252519-236252543
  hypo
gcttaccaggccaggcgtggtggc

SEQ ID NO: 59867 - DNA, 111 bp, Homo sapiens; identical to SEQ ID NO: 39315
  chr1:236768713-236768824
  hypo

SEQ ID NO: 59868 - DNA, 40 bp, Homo sapiens; identical to SEQ ID NO: 39316
  chr1:236771396-236771436
  hypo

SEQ ID NO: 59869 - DNA, 30 bp, Homo sapiens; identical to SEQ ID NO: 39317
  chr1:236811244-236811274
  hypo

SEQ ID NO: 59870 - DNA, 30 bp, Homo sapiens; identical to SEQ ID NO: 39318
  chr1:236907863-236907893
  hypo

SEQ ID NO: 59871 - DNA, 30 bp, Homo sapiens; identical to SEQ ID NO: 39319
  chr1:237753724-237753754
  hypo

SEQ ID NO: 59872 - DNA, 32 bp, Homo sapiens; identical to SEQ ID NO: 39320
  chr1:238235533-238235565
  hypo

SEQ ID NO: 59873 - DNA, 19 bp, Homo sapiens
  chr1:239516662-239516681
  hypo
agagcgatactctgattaa

SEQ ID NO: 59874 - DNA, 192 bp, Homo sapiens; identical to SEQ ID NO: 39322
  chr1:239523114-239523306
  hypo

SEQ ID NO: 59875 - DNA, 42 bp, Homo sapiens; identical to SEQ ID NO: 39323
  chr1:239987383-239987425
  hypo

SEQ ID NO: 59876 - DNA, 95 bp, Homo sapiens
  chr1:240118753-240118848
  hypo
ccctgacacttcacccgcgagcctggataaaaaggctcccatgacctctctctttagccaaccccgctgggtgcaatattcagaagtgctccccg

SEQ ID NO: 59877 - DNA, 30 bp, Homo sapiens
  chr1:240118973-240119003
  hypo
atcagcacaccagcccgggggtctgcactc

SEQ ID NO: 59878 - DNA, 30 bp, Homo sapiens; identical to SEQ ID NO: 39325
  chr1:240308662-240308692
  hypo

SEQ ID NO: 59879 - DNA, 120 bp, Homo sapiens; identical to SEQ ID NO: 39326
  chr1:240372821-240372941
  hypo

SEQ ID NO: 59880 - DNA, 169 bp, Homo sapiens; identical to SEQ ID NO: 14351
  chr1:240463082-240463251
  hypo

SEQ ID NO: 59881 - DNA, 20 bp, Homo sapiens
  chr1:240893174-240893194
  hypo
gactccgtctcaaaaaaaaa

SEQ ID NO: 59882 - DNA, 55 bp, Homo sapiens; identical to SEQ ID NO: 39329
  chr1:241052144-241052199
  hypo

SEQ ID NO: 59883 - DNA, 39 bp, Homo sapiens; identical to SEQ ID NO: 39330
  chr1:241096456-241096495
  hypo

SEQ ID NO: 59884 - DNA, 30 bp, Homo sapiens; identical to SEQ ID NO: 39331
  chr1:241753208-241753238
  hypo

SEQ ID NO: 59885 - DNA, 30 bp, Homo sapiens; identical to SEQ ID NO: 39332
  chr1:241913315-241913345
  hypo

SEQ ID NO: 59886 - DNA, 30 bp, Homo sapiens; identical to SEQ ID NO: 39333
  chr1:242087568-242087598
  hypo

SEQ ID NO: 59887 - DNA, 19 bp, Homo sapiens
  chr1:242122940-242122959
  hypo
attacgggcatgagccacc

SEQ ID NO: 59888 - DNA, 177 bp, Homo sapiens; identical to SEQ ID NO: 14352
  chr1:242286750-242286927
  hypo

SEQ ID NO: 59889 - DNA, 28 bp, Homo sapiens
  chr1:242633355-242633383
  hypo
aggggctgccgggtgcggtggctcatgc

SEQ ID NO: 59890 - DNA, 147 bp, Homo sapiens; identical to SEQ ID NO: 39337
  chr1:242973101-242973248
  hypo

SEQ ID NO: 59891 - DNA, 30 bp, Homo sapiens; identical to SEQ ID NO: 14353
  chr1:243057075-243057105
  hypo

SEQ ID NO: 59892 - DNA, 33 bp, Homo sapiens; identical to SEQ ID NO: 39339
  chr1:243145074-243145107
  hypo

SEQ ID NO: 59893 - DNA, 36 bp, Homo sapiens; identical to SEQ ID NO: 39340
  chr1:244115683-244115719
  hypo

SEQ ID NO: 59894 - DNA, 30 bp, Homo sapiens; identical to SEQ ID NO: 39341
  chr1:244139857-244139887
  hypo

SEQ ID NO: 59895 - DNA, 98 bp, Homo sapiens; identical to SEQ ID NO: 39342
  chr1:244142970-244143068
  hypo

SEQ ID NO: 59896 - DNA, 105 bp, Homo sapiens; identical to SEQ ID NO: 39343
  chr1:244200765-244200870
  hypo

SEQ ID NO: 59897 - DNA, 132 bp, Homo sapiens; identical to SEQ ID NO: 39344
  chr1:244243999-244244131
  hypo

SEQ ID NO: 59898 - DNA, 30 bp, Homo sapiens; identical to SEQ ID NO: 39345
  chr1:244319117-244319147
  hypo

SEQ ID NO: 59899 - DNA, 30 bp, Homo sapiens; identical to SEQ ID NO: 39346
  chr1:244914578-244914608
  hypo

SEQ ID NO: 59900 - DNA, 180 bp, Homo sapiens; identical to SEQ ID NO: 39347
  chr1:245060866-245061046
  hypo

SEQ ID NO: 59901 - DNA, 34 bp, Homo sapiens; identical to SEQ ID NO: 23799
  chr1:245135719-245135753
  hypo

SEQ ID NO: 59902 - DNA, 30 bp, Homo sapiens; identical to SEQ ID NO: 39349
  chr1:245376976-245377006
  hypo

SEQ ID NO: 59903 - DNA, 151 bp, Homo sapiens; identical to SEQ ID NO: 39350
  chr1:245461494-245461645
  hypo

SEQ ID NO: 59904 - DNA, 43 bp, Homo sapiens; identical to SEQ ID NO: 39351
  chr1:245499703-245499746
  hypo

SEQ ID NO: 59905 - DNA, 26 bp, Homo sapiens
  chr1:245627605-245627631
  hypo
aggtaatgtgtgtcccgtcccccgac

SEQ ID NO: 59906 - DNA, 30 bp, Homo sapiens; identical to SEQ ID NO: 39353
  chr1:245750646-245750676
  hypo

SEQ ID NO: 59907 - DNA, 33 bp, Homo sapiens; identical to SEQ ID NO: 39354
  chr1:245753467-245753500
  hypo

SEQ ID NO: 59908 - DNA, 197 bp, Homo sapiens; identical to SEQ ID NO: 14356
  chr1:245772643-245772840
  hypo

SEQ ID NO: 59909 - DNA, 154 bp, Homo sapiens; identical to SEQ ID NO: 39356
  chr1:245986642-245986796
  hypo

SEQ ID NO: 59910 - DNA, 109 bp, Homo sapiens; identical to SEQ ID NO: 39357
  chr1:246172251-246172360
  hypo

SEQ ID NO: 59911 - DNA, 30 bp, Homo sapiens; identical to SEQ ID NO: 39358
  chr1:246330476-246330506
  hypo

SEQ ID NO: 59912 - DNA, 30 bp, Homo sapiens; identical to SEQ ID NO: 39359
  chr1:246363735-246363765
  hypo

SEQ ID NO: 59913 - DNA, 30 bp, Homo sapiens; identical to SEQ ID NO: 39361
  chr1:246991095-246991125
  hypo

SEQ ID NO: 59914 - DNA, 163 bp, Homo sapiens; identical to SEQ ID NO: 39362
  chr1:247185348-247185511
  hypo

SEQ ID NO: 59915 - DNA, 245 bp, Homo sapiens; identical to SEQ ID NO: 39363
  chr1:247589856-247590101
  hypo

SEQ ID NO: 59916 - DNA, 30 bp, Homo sapiens; identical to SEQ ID NO: 39364
  chr1:247615881-247615911
  hypo

SEQ ID NO: 59917 - DNA, 30 bp, Homo sapiens; identical to SEQ ID NO: 39365
  chr1:247694897-247694927
  hypo

SEQ ID NO: 59918 - DNA, 172 bp, Homo sapiens; identical to SEQ ID NO: 14360
  chr1:247709336-247709508
  hypo

SEQ ID NO: 59919 - DNA, 180 bp, Homo sapiens; identical to SEQ ID NO: 14361
  chr1:247752018-247752198
  hypo

SEQ ID NO: 59920 - DNA, 94 bp, Homo sapiens; identical to SEQ ID NO: 39369
  chr1:248026872-248026966
  hypo

SEQ ID NO: 59921 - DNA, 50 bp, Homo sapiens
  chr1:248027965-248028015
  hypo
gaggccaagcactgacgatgtgatccacggtgtcacctcaggagaaagtg

SEQ ID NO: 59922 - DNA, 57 bp, Homo sapiens
  chr1:248028202-248028259
  hypo
agaggtgccagcgcccggccctgggtctgctggaggtgaggccgggtgccagaaaag

SEQ ID NO: 59923 - DNA, 197 bp, Homo sapiens; identical to SEQ ID NO: 39371
  chr1:248034262-248034459
  hypo

SEQ ID NO: 59924 - DNA, 45 bp, Homo sapiens; identical to SEQ ID NO: 39372
  chr1:248047093-248047138
  hypo

SEQ ID NO: 59925 - DNA, 30 bp, Homo sapiens; identical to SEQ ID NO: 39373
  chr1:248047898-248047928
  hypo

SEQ ID NO: 59926 - DNA, 30 bp, Homo sapiens; identical to SEQ ID NO: 39374
  chr1:248074318-248074348
  hypo

SEQ ID NO: 59927 - DNA, 36 bp, Homo sapiens; identical to SEQ ID NO: 39376
  chr1:248098787-248098823
  hypo

SEQ ID NO: 59928 - DNA, 30 bp, Homo sapiens; identical to SEQ ID NO: 39377
  chr1:248099290-248099320
  hypo

SEQ ID NO: 59929 - DNA, 238 bp, Homo sapiens
  chr1:248099809-248100047
  hypo
ttggggaagtcagccactcggacgctggtgctcctcactgacttctcatcgctcctgtgctcgctgtagacggtgtttaactcagaatccacatgcaggatgttctcggttttcaggtgtgcgtgggtcagccggttctcgtgcagaaatctaagggtgtggcagagctggtgggccatgtgccagacatgtgggaggggaatggctggatgttattctccttcgggaactcaagggt

SEQ ID NO: 59930 - DNA, 28 bp, Homo sapiens
  chr1:248328673-248328701
  hypo
cacccgtgactcgccaggctccgtctga

SEQ ID NO: 59931 - DNA, 35 bp, Homo sapiens
  chr1:248328841-248328876
  hypo
ctccagaagcacaggatgtgcgaccttcagccttt

SEQ ID NO: 59932 - DNA, 30 bp, Homo sapiens; identical to SEQ ID NO: 39380
  chr1:248329246-248329276
  hypo

SEQ ID NO: 59933 - DNA, 233 bp, Homo sapiens; identical to SEQ ID NO: 39382
  chr2:314488-314721
  hypo

SEQ ID NO: 59934 - DNA, 70 bp, Homo sapiens; identical to SEQ ID NO: 39383
  chr2:484928-484998
  hypo

SEQ ID NO: 59935 - DNA, 14 bp, Homo sapiens
  chr2:496214-496228
  hypo
gaagctacaggagg

SEQ ID NO: 59936 - DNA, 69 bp, Homo sapiens; identical to SEQ ID NO: 39385
  chr2:503076-503145
  hypo

SEQ ID NO: 59937 - DNA, 142 bp, Homo sapiens; identical to SEQ ID NO: 39386
  chr2:503859-504001
  hypo

SEQ ID NO: 59938 - DNA, 64 bp, Homo sapiens; identical to SEQ ID NO: 39387
  chr2:522014-522078
  hypo

SEQ ID NO: 59939 - DNA, 49 bp, Homo sapiens; identical to SEQ ID NO: 39388
  chr2:647861-647910
  hypo

SEQ ID NO: 59940 - DNA, 3 bp, Homo sapiens
  chr2:720894-720897
  hypo
att

SEQ ID NO: 59941 - DNA, 30 bp, Homo sapiens; identical to SEQ ID NO: 39390
  chr2:925888-925918
  hypo

SEQ ID NO: 59942 - DNA, 30 bp, Homo sapiens; identical to SEQ ID NO: 39391
  chr2:951526-951556
  hypo

SEQ ID NO: 59943 - DNA, 49 bp, Homo sapiens; identical to SEQ ID NO: 39392
  chr2:973406-973455
  hypo

SEQ ID NO: 59944 - DNA, 156 bp, Homo sapiens; identical to SEQ ID NO: 39393
  chr2:1019358-1019514
  hypo

SEQ ID NO: 59945 - DNA, 108 bp, Homo sapiens; identical to SEQ ID NO: 39394
  chr2:1204810-1204918
  hypo

SEQ ID NO: 59946 - DNA, 62 bp, Homo sapiens; identical to SEQ ID NO: 39395
  chr2:1424987-1425049
  hypo

SEQ ID NO: 59947 - DNA, 30 bp, Homo sapiens; identical to SEQ ID NO: 39396
  chr2:1635811-1635841
  hypo

SEQ ID NO: 59948 - DNA, 30 bp, Homo sapiens; identical to SEQ ID NO: 39397
  chr2:1637034-1637064
  hypo

SEQ ID NO: 59949 - DNA, 33 bp, Homo sapiens; identical to SEQ ID NO: 39398
  chr2:1689084-1689117
  hypo

SEQ ID NO: 59950 - DNA, 41 bp, Homo sapiens; identical to SEQ ID NO: 39399
  chr2:1893020-1893061
  hypo

SEQ ID NO: 59951 - DNA, 30 bp, Homo sapiens; identical to SEQ ID NO: 39400
  chr2:1950712-1950742
  hypo

SEQ ID NO: 59952 - DNA, 156 bp, Homo sapiens; identical to SEQ ID NO: 39401
  chr2:1972852-1973008
  hypo

SEQ ID NO: 59953 - DNA, 30 bp, Homo sapiens; identical to SEQ ID NO: 39402
  chr2:2030884-2030914
  hypo

SEQ ID NO: 59954 - DNA, 30 bp, Homo sapiens; identical to SEQ ID NO: 39403
  chr2:2190112-2190142
  hypo

SEQ ID NO: 59955 - DNA, 106 bp, Homo sapiens; identical to SEQ ID NO: 39404
  chr2:2402544-2402650
  hypo

SEQ ID NO: 59956 - DNA, 189 bp, Homo sapiens; identical to SEQ ID NO: 14371
  chr2:2522670-2522859
  hypo

SEQ ID NO: 59957 - DNA, 50 bp, Homo sapiens; identical to SEQ ID NO: 39406
  chr2:2575682-2575732
  hypo

SEQ ID NO: 59958 - DNA, 83 bp, Homo sapiens; identical to SEQ ID NO: 39407
  chr2:2665528-2665611
  hypo

SEQ ID NO: 59959 - DNA, 447 bp, Homo sapiens; identical to SEQ ID NO: 39408
  chr2:2725048-2725495
  hypo

SEQ ID NO: 59960 - DNA, 92 bp, Homo sapiens; identical to SEQ ID NO: 39409
  chr2:2730695-2730787
  hypo

SEQ ID NO: 59961 - DNA, 30 bp, Homo sapiens; identical to SEQ ID NO: 39410
  chr2:2753113-2753143
  hypo

SEQ ID NO: 59962 - DNA, 40 bp, Homo sapiens; identical to SEQ ID NO: 39411
  chr2:2799315-2799355
  hypo

SEQ ID NO: 59963 - DNA, 30 bp, Homo sapiens; identical to SEQ ID NO: 39412
  chr2:2844886-2844916
  hypo

SEQ ID NO: 59964 - DNA, 110 bp, Homo sapiens; identical to SEQ ID NO: 39413
  chr2:2854353-2854463
  hypo

SEQ ID NO: 59965 - DNA, 30 bp, Homo sapiens; identical to SEQ ID NO: 39414
  chr2:2939589-2939619
  hypo

SEQ ID NO: 59966 - DNA, 92 bp, Homo sapiens; identical to SEQ ID NO: 39415
  chr2:2941866-2941958
  hypo

SEQ ID NO: 59967 - DNA, 105 bp, Homo sapiens; identical to SEQ ID NO: 39416
  chr2:3050299-3050404
  hypo

SEQ ID NO: 59968 - DNA, 30 bp, Homo sapiens; identical to SEQ ID NO: 39417
  chr2:3176032-3176062
  hypo

SEQ ID NO: 59969 - DNA, 30 bp, Homo sapiens; identical to SEQ ID NO: 39418
  chr2:3285842-3285872
  hypo

SEQ ID NO: 59970 - DNA, 30 bp, Homo sapiens; identical to SEQ ID NO: 14373
  chr2:3331786-3331816
  hypo

SEQ ID NO: 59971 - DNA, 33 bp, Homo sapiens; identical to SEQ ID NO: 39420
  chr2:3352677-3352710
  hypo

SEQ ID NO: 59972 - DNA, 181 bp, Homo sapiens; identical to SEQ ID NO: 39421
  chr2:3833780-3833961
  hypo

SEQ ID NO: 59973 - DNA, 129 bp, Homo sapiens; identical to SEQ ID NO: 39422
  chr2:3990793-3990922
  hypo

SEQ ID NO: 59974 - DNA, 30 bp, Homo sapiens; identical to SEQ ID NO: 39423
  chr2:4130725-4130755
  hypo

SEQ ID NO: 59975 - DNA, 57 bp, Homo sapiens; identical to SEQ ID NO: 14375
  chr2:5704308-5704365
  hypo

SEQ ID NO: 59976 - DNA, 34 bp, Homo sapiens; identical to SEQ ID NO: 39425
  chr2:6024520-6024554
  hypo

SEQ ID NO: 59977 - DNA, 30 bp, Homo sapiens; identical to SEQ ID NO: 39426
  chr2:6809103-6809133
  hypo

SEQ ID NO: 59978 - DNA, 30 bp, Homo sapiens; identical to SEQ ID NO: 39427
  chr2:6989494-6989524
  hypo

SEQ ID NO: 59979 - DNA, 30 bp, Homo sapiens; identical to SEQ ID NO: 14376
  chr2:7036178-7036208
  hypo

SEQ ID NO: 59980 - DNA, 387 bp, Homo sapiens; identical to SEQ ID NO: 39430
  chr2:7172412-7172799
  hypo

SEQ ID NO: 59981 - DNA, 17 bp, Homo sapiens
  chr2:7237246-7237263
  hypo
cccgcccctcatggtgg

SEQ ID NO: 59982 - DNA, 24 bp, Homo sapiens
  chr2:7605198-7605222
  hypo
aaaatgtaccgagttgtttctacc

SEQ ID NO: 59983 - DNA, 30 bp, Homo sapiens; identical to SEQ ID NO: 39433
  chr2:8768562-8768592
  hypo

SEQ ID NO: 59984 - DNA, 171 bp, Homo sapiens; identical to SEQ ID NO: 14378
  chr2:8833973-8834144
  hypo

SEQ ID NO: 59985 - DNA, 24 bp, Homo sapiens
  chr2:8834789-8834813
  hypo
atcgctttgcagcaacggaaatta

SEQ ID NO: 59986 - DNA, 23 bp, Homo sapiens
  chr2:8834873-8834896
  hypo
gcaaacgccgcaaataattttgc

SEQ ID NO: 59987 - DNA, 28 bp, Homo sapiens
  chr2:8835589-8835617
  hypo
gaccccctgcgcccggcctgaccacaca

SEQ ID NO: 59988 - DNA, 30 bp, Homo sapiens; identical to SEQ ID NO: 39438
  chr2:8860441-8860471
  hypo

SEQ ID NO: 59989 - DNA, 30 bp, Homo sapiens; identical to SEQ ID NO: 39439
  chr2:8870364-8870394
  hypo

SEQ ID NO: 59990 - DNA, 92 bp, Homo sapiens; identical to SEQ ID NO: 14381
  chr2:8978147-8978239
  hypo

SEQ ID NO: 59991 - DNA, 169 bp, Homo sapiens
  chr2:9134235-9134404
  hypo
atcacaccagccctgcggactctaaacatgctccgtgccaagaatggtcctaggcagacgggacacaaagatgagtaagtggaggtccttattcttaaggaatttagtttgggagggagacttgtaaagcaaacaaaaaaaaaatcaatgctccaggtgttatcagagt

SEQ ID NO: 59992 - DNA, 180 bp, Homo sapiens; identical to SEQ ID NO: 14383
  chr2:9352635-9352815
  hypo

SEQ ID NO: 59993 - DNA, 242 bp, Homo sapiens; identical to SEQ ID NO: 39443
  chr2:9960219-9960461
  hypo

SEQ ID NO: 59994 - DNA, 27 bp, Homo sapiens
  chr2:9960764-9960791
  hypo
tgccaacccgcccgatgactgtgtcta

SEQ ID NO: 59995 - DNA, 120 bp, Homo sapiens; identical to SEQ ID NO: 39446
  chr2:10151717-10151837
  hypo

SEQ ID NO: 59996 - DNA, 120 bp, Homo sapiens; identical to SEQ ID NO: 39447
  chr2:10151897-10152017
  hypo

SEQ ID NO: 59997 - DNA, 114 bp, Homo sapiens
  chr2:10153325-10153439
  hypo
atgggagagtcaggtggacaggattgcgtatagccggatcaggtgggcaggcatgcgtatgagcgagtcaggtgggcagacatgcgtatgggcgggtcaggtggacaggcgtgt

SEQ ID NO: 59998 - DNA, 120 bp, Homo sapiens; identical to SEQ ID NO: 39449
  chr2:10154039-10154159
  hypo

SEQ ID NO: 59999 - DNA, 241 bp, Homo sapiens
  chr2:10156389-10156630
  hypo
gtcaggtgggtaggcgtgtgtatggatgtgcatatgggcgggtcaggtggacaggtgtgtatatgggtgtacatgtgtgcacaggtgctactttactctgtgttcaacacgtgttcgtggacgtgctccaggcccaaggcgaaggaataggatgtagcaggggcagggtctccgccccatactcagagtccttgggctccgggaagacacaaccgataagtggttacggggatgcctggga

SEQ ID NO: 60000 - DNA, 30 bp, Homo sapiens; identical to SEQ ID NO: 39451
  chr2:10238076-10238106
  hypo

SEQ ID NO: 60001 - DNA, 30 bp, Homo sapiens; identical to SEQ ID NO: 39452
  chr2:10278078-10278108
  hypo

SEQ ID NO: 60002 - DNA, 51 bp, Homo sapiens; identical to SEQ ID NO: 39453
  chr2:10281143-10281194
  hypo

SEQ ID NO: 60003 - DNA, 77 bp, Homo sapiens; identical to SEQ ID NO: 14389
  chr2:10344641-10344718
  hypo

SEQ ID NO: 60004 - DNA, 30 bp, Homo sapiens; identical to SEQ ID NO: 39455
  chr2:10408242-10408272
  hypo

SEQ ID NO: 60005 - DNA, 30 bp, Homo sapiens; identical to SEQ ID NO: 39456
  chr2:10526275-10526305
  hypo

SEQ ID NO: 60006 - DNA, 30 bp, Homo sapiens; identical to SEQ ID NO: 39457
  chr2:10577316-10577346
  hypo

SEQ ID NO: 60007 - DNA, 30 bp, Homo sapiens; identical to SEQ ID NO: 39458
  chr2:10600641-10600671
  hypo

SEQ ID NO: 60008 - DNA, 30 bp, Homo sapiens; identical to SEQ ID NO: 39459
  chr2:10911393-10911423
  hypo

SEQ ID NO: 60009 - DNA, 226 bp, Homo sapiens; identical to SEQ ID NO: 39460
  chr2:10924927-10925153
  hypo

SEQ ID NO: 60010 - DNA, 88 bp, Homo sapiens; identical to SEQ ID NO: 39461
  chr2:11538637-11538725
  hypo

SEQ ID NO: 60011 - DNA, 148 bp, Homo sapiens; identical to SEQ ID NO: 39462
  chr2:11538785-11538933
  hypo

SEQ ID NO: 60012 - DNA, 126 bp, Homo sapiens; identical to SEQ ID NO: 39463
  chr2:11678173-11678299
  hypo

SEQ ID NO: 60013 - DNA, 120 bp, Homo sapiens; identical to SEQ ID NO: 39464
  chr2:11886072-11886192
  hypo

SEQ ID NO: 60014 - DNA, 34 bp, Homo sapiens; identical to SEQ ID NO: 39465
  chr2:12092493-12092527
  hypo

SEQ ID NO: 60015 - DNA, 117 bp, Homo sapiens; identical to SEQ ID NO: 39466
  chr2:12103180-12103297
  hypo

SEQ ID NO: 60016 - DNA, 30 bp, Homo sapiens; identical to SEQ ID NO: 39467
  chr2:12303872-12303902
  hypo

SEQ ID NO: 60017 - DNA, 76 bp, Homo sapiens; identical to SEQ ID NO: 39468
  chr2:12355766-12355842
  hypo

SEQ ID NO: 60018 - DNA, 19 bp, Homo sapiens
  chr2:15579677-15579696
  hypo
gtctacagctcccagcgtg

SEQ ID NO: 60019 - DNA, 30 bp, Homo sapiens; identical to SEQ ID NO: 39470
  chr2:15960211-15960241
  hypo

SEQ ID NO: 60020 - DNA, 68 bp, Homo sapiens; identical to SEQ ID NO: 39471
  chr2:18453289-18453357
  hypo

SEQ ID NO: 60021 - DNA, 39 bp, Homo sapiens; identical to SEQ ID NO: 39472
  chr2:20253274-20253313
  hypo

SEQ ID NO: 60022 - DNA, 42 bp, Homo sapiens; identical to SEQ ID NO: 14394
  chr2:20431336-20431378
  hypo

SEQ ID NO: 60023 - DNA, 142 bp, Homo sapiens; identical to SEQ ID NO: 14395
  chr2:20432683-20432825
  hypo

SEQ ID NO: 60024 - DNA, 30 bp, Homo sapiens; identical to SEQ ID NO: 39475
  chr2:20442384-20442414
  hypo

SEQ ID NO: 60025 - DNA, 30 bp, Homo sapiens; identical to SEQ ID NO: 14396
  chr2:20456198-20456228
  hypo

SEQ ID NO: 60026 - DNA, 30 bp, Homo sapiens; identical to SEQ ID NO: 39477
  chr2:20553860-20553890
  hypo

SEQ ID NO: 60027 - DNA, 21 bp, Homo sapiens
  chr2:24584330-24584351
  hypo
tggcacagtggctcacgcttg

SEQ ID NO: 60028 - DNA, 63 bp, Homo sapiens; identical to SEQ ID NO: 39480
  chr2:24775908-24775971
  hypo

SEQ ID NO: 60029 - DNA, 44 bp, Homo sapiens; identical to SEQ ID NO: 39481
  chr2:25241776-25241820
  hypo

SEQ ID NO: 60030 - DNA, 28 bp, Homo sapiens
  chr2:25439965-25439993
  hypo
gacagagaaagaccgtttctaaataagt

SEQ ID NO: 60031 - DNA, 47 bp, Homo sapiens
  chr2:26372997-26373044
  hypo
cttagtgacagtgtggtgccagacattccgtccgctgtcacaacagc

SEQ ID NO: 60032 - DNA, 142 bp, Homo sapiens; identical to SEQ ID NO: 39484
  chr2:26607241-26607383
  hypo

SEQ ID NO: 60033 - DNA, 42 bp, Homo sapiens; identical to SEQ ID NO: 14399
  chr2:27090590-27090632
  hypo

SEQ ID NO: 60034 - DNA, 24 bp, Homo sapiens
  chr2:27433305-27433329
  hypo
ctttttttttggagacggagtctc

SEQ ID NO: 60035 - DNA, 102 bp, Homo sapiens
  chr2:27578396-27578498
  hypo
aaaaatacacttctcatggaaggcagcagcaggatgtaatggtacaaattctggatacacagtaaaggaatagatgatcagtaaattcgtactgagtttcta

SEQ ID NO: 60036 - DNA, 111 bp, Homo sapiens; identical to SEQ ID NO: 23838
  chr2:27887555-27887666
  hypo

SEQ ID NO: 60037 - DNA, 212 bp, Homo sapiens; identical to SEQ ID NO: 39489
  chr2:28676953-28677165
  hypo

SEQ ID NO: 60038 - DNA, 40 bp, Homo sapiens; identical to SEQ ID NO: 39490
  chr2:29462699-29462739
  hypo

SEQ ID NO: 60039 - DNA, 81 bp, Homo sapiens; identical to SEQ ID NO: 39491
  chr2:29504693-29504774
  hypo

SEQ ID NO: 60040 - DNA, 87 bp, Homo sapiens; identical to SEQ ID NO: 39492
  chr2:30368623-30368710
  hypo

SEQ ID NO: 60041 - DNA, 37 bp, Homo sapiens; identical to SEQ ID NO: 39493
  chr2:30497257-30497294
  hypo

SEQ ID NO: 60042 - DNA, 79 bp, Homo sapiens; identical to SEQ ID NO: 39494
  chr2:32263984-32264063
  hypo

SEQ ID NO: 60043 - DNA, 18 bp, Homo sapiens
  chr2:32275102-32275120
  hypo
aaaaaatatctgggccgg

SEQ ID NO: 60044 - DNA, 44 bp, Homo sapiens; identical to SEQ ID NO: 39496
  chr2:32472347-32472391
  hypo

SEQ ID NO: 60045 - DNA, 30 bp, Homo sapiens; identical to SEQ ID NO: 39497
  chr2:32494200-32494230
  hypo

SEQ ID NO: 60046 - DNA, 119 bp, Homo sapiens
  chr2:32504378-32504497
  hypo
ttccagtgaccagacttactggctgctatgaaatcataaattatgtttacagaaatttcagtctgagaaagaacctagattttcctttttttttttttttttttttgagactgagtctc

SEQ ID NO: 60047 - DNA, 27 bp, Homo sapiens
  chr2:32551637-32551664
  hypo
tgtgagccaccgcgcccagcctaccct

SEQ ID NO: 60048 - DNA, 22 bp, Homo sapiens
  chr2:33313226-33313248
  hypo
atatggacagtgagccgggcgc

SEQ ID NO: 60049 - DNA, 30 bp, Homo sapiens; identical to SEQ ID NO: 39501
  chr2:33315571-33315601
  hypo

SEQ ID NO: 60050 - DNA, 34 bp, Homo sapiens; identical to SEQ ID NO: 39502
  chr2:33530065-33530099
  hypo

SEQ ID NO: 60051 - DNA, 70 bp, Homo sapiens; identical to SEQ ID NO: 39503
  chr2:33532830-33532900
  hypo

SEQ ID NO: 60052 - DNA, 105 bp, Homo sapiens; identical to SEQ ID NO: 39504
  chr2:33653875-33653980
  hypo

SEQ ID NO: 60053 - DNA, 66 bp, Homo sapiens; identical to SEQ ID NO: 39505
  chr2:36824207-36824273
  hypo

SEQ ID NO: 60054 - DNA, 177 bp, Homo sapiens; identical to SEQ ID NO: 39507
  chr2:42281964-42282141
  hypo

SEQ ID NO: 60055 - DNA, 30 bp, Homo sapiens; identical to SEQ ID NO: 39508
  chr2:42282578-42282608
  hypo

SEQ ID NO: 60056 - DNA, 30 bp, Homo sapiens; identical to SEQ ID NO: 39509
  chr2:43227374-43227404
  hypo

SEQ ID NO: 60057 - DNA, 189 bp, Homo sapiens; identical to SEQ ID NO: 4967
  chr2:43408168-43408357
  hypo

SEQ ID NO: 60058 - DNA, 39 bp, Homo sapiens; identical to SEQ ID NO: 14407
  chr2:43412683-43412722
  hypo

SEQ ID NO: 60059 - DNA, 107 bp, Homo sapiens; identical to SEQ ID NO: 39512
  chr2:43812086-43812193
  hypo

SEQ ID NO: 60060 - DNA, 40 bp, Homo sapiens; identical to SEQ ID NO: 14408
  chr2:43824353-43824393
  hypo

SEQ ID NO: 60061 - DNA, 87 bp, Homo sapiens; identical to SEQ ID NO: 39514
  chr2:44224206-44224293
  hypo

SEQ ID NO: 60062 - DNA, 9 bp, Homo sapiens
  chr2:44497699-44497708
  hypo
aggtgcaac

SEQ ID NO: 60063 - DNA, 30 bp, Homo sapiens; identical to SEQ ID NO: 39516
  chr2:47200712-47200742
  hypo

SEQ ID NO: 60064 - DNA, 30 bp, Homo sapiens; identical to SEQ ID NO: 39517
  chr2:47567513-47567543
  hypo

SEQ ID NO: 60065 - DNA, 30 bp, Homo sapiens; identical to SEQ ID NO: 39518
  chr2:47574359-47574389
  hypo

SEQ ID NO: 60066 - DNA, 23 bp, Homo sapiens
  chr2:47599482-47599505
  hypo
agaggcggtgacagccgggcatg

SEQ ID NO: 60067 - DNA, 30 bp, Homo sapiens; identical to SEQ ID NO: 39523
  chr2:52856863-52856893
  hypo

SEQ ID NO: 60068 - DNA, 30 bp, Homo sapiens; identical to SEQ ID NO: 39524
  chr2:55653035-55653065
  hypo

SEQ ID NO: 60069 - DNA, 16 bp, Homo sapiens
  chr2:55669245-55669261
  hypo
tggagccaagatggcc

SEQ ID NO: 60070 - DNA, 28 bp, Homo sapiens
  chr2:55874935-55874963
  hypo
gcgtgagccaccgcgcccagcagacatt

SEQ ID NO: 60071 - DNA, 166 bp, Homo sapiens; identical to SEQ ID NO: 39527
  chr2:58641373-58641539
  hypo

SEQ ID NO: 60072 - DNA, 44 bp, Homo sapiens; identical to SEQ ID NO: 39528
  chr2:59269682-59269726
  hypo

SEQ ID NO: 60073 - DNA, 45 bp, Homo sapiens; identical to SEQ ID NO: 39529
  chr2:60411741-60411786
  hypo

SEQ ID NO: 60074 - DNA, 30 bp, Homo sapiens; identical to SEQ ID NO: 14413
  chr2:60442223-60442253
  hypo

SEQ ID NO: 60075 - DNA, 110 bp, Homo sapiens; identical to SEQ ID NO: 14414
  chr2:60705907-60706017
  hypo

SEQ ID NO: 60076 - DNA, 170 bp, Homo sapiens
  chr2:60706804-60706974
  hypo
cgtcctgtactcctgccccagctctaatgcaataaaatgtcttttatcaatgtaattcaaggcaaagagtcaagggtctgtcaccattttaaagaggcttattacatggccacaaaaatttgcctcaggctcaaacctggcatgtaaggtatcagcgtgggacaggttct

SEQ ID NO: 60077 - DNA, 30 bp, Homo sapiens; identical to SEQ ID NO: 39533
  chr2:60733708-60733738
  hypo

SEQ ID NO: 60078 - DNA, 30 bp, Homo sapiens; identical to SEQ ID NO: 14415
  chr2:60887794-60887824
  hypo

SEQ ID NO: 60079 - DNA, 37 bp, Homo sapiens; identical to SEQ ID NO: 39535
  chr2:61231438-61231475
  hypo

SEQ ID NO: 60080 - DNA, 30 bp, Homo sapiens; identical to SEQ ID NO: 14416
  chr2:61406196-61406226
  hypo

SEQ ID NO: 60081 - DNA, 18 bp, Homo sapiens
  chr2:61992299-61992317
  hypo
aggcgtgagccaccgcgc

SEQ ID NO: 60082 - DNA, 56 bp, Homo sapiens; identical to SEQ ID NO: 39538
  chr2:62409597-62409653
  hypo

SEQ ID NO: 60083 - DNA, 86 bp, Homo sapiens; identical to SEQ ID NO: 4970
  chr2:62589799-62589885
  hypo

SEQ ID NO: 60084 - DNA, 30 bp, Homo sapiens; identical to SEQ ID NO: 39540
  chr2:64348216-64348246
  hypo

SEQ ID NO: 60085 - DNA, 145 bp, Homo sapiens; identical to SEQ ID NO: 39541
  chr2:64835504-64835649
  hypo

SEQ ID NO: 60086 - DNA, 92 bp, Homo sapiens; identical to SEQ ID NO: 39542
  chr2:65413492-65413584
  hypo

SEQ ID NO: 60087 - DNA, 30 bp, Homo sapiens; identical to SEQ ID NO: 39543
  chr2:65868490-65868520
  hypo

SEQ ID NO: 60088 - DNA, 30 bp, Homo sapiens; identical to SEQ ID NO: 39544
  chr2:66561514-66561544
  hypo

SEQ ID NO: 60089 - DNA, 39 bp, Homo sapiens; identical to SEQ ID NO: 39547
  chr2:68530252-68530291
  hypo

SEQ ID NO: 60090 - DNA, 39 bp, Homo sapiens; identical to SEQ ID NO: 39548
  chr2:68537171-68537210
  hypo

SEQ ID NO: 60091 - DNA, 164 bp, Homo sapiens
  chr2:68672689-68672853
  hypo
tcaaaataacaaacacgcacgacgtcttcgatcaccttcctgtaaaaccgggtttctagccggacccatgtcctcacagttcctgaatcaagttcaccgtctgtgcaagcgccacctgacagagctccctgcgacactgaaacgcgtttgggcacttcccacgt

SEQ ID NO: 60092 - DNA, 48 bp, Homo sapiens; identical to SEQ ID NO: 39550
  chr2:68882413-68882461
  hypo

SEQ ID NO: 60093 - DNA, 139 bp, Homo sapiens; identical to SEQ ID NO: 39551
  chr2:69182056-69182195
  hypo

SEQ ID NO: 60094 - DNA, 141 bp, Homo sapiens; identical to SEQ ID NO: 39552
  chr2:69720070-69720211
  hypo

SEQ ID NO: 60095 - DNA, 95 bp, Homo sapiens; identical to SEQ ID NO: 39553
  chr2:69914132-69914227
  hypo

SEQ ID NO: 60096 - DNA, 48 bp, Homo sapiens; identical to SEQ ID NO: 14421
  chr2:70364215-70364263
  hypo

SEQ ID NO: 60097 - DNA, 90 bp, Homo sapiens; identical to SEQ ID NO: 39555
  chr2:70367809-70367899
  hypo

SEQ ID NO: 60098 - DNA, 19 bp, Homo sapiens
  chr2:70477741-70477760
  hypo
gtcggctgagcggggcggc

SEQ ID NO: 60099 - DNA, 30 bp, Homo sapiens; identical to SEQ ID NO: 39557
  chr2:71270959-71270989
  hypo

SEQ ID NO: 60100 - DNA, 92 bp, Homo sapiens; identical to SEQ ID NO: 39559
  chr2:71455196-71455288
  hypo

SEQ ID NO: 60101 - DNA, 30 bp, Homo sapiens; identical to SEQ ID NO: 39560
  chr2:71502899-71502929
  hypo

SEQ ID NO: 60102 - DNA, 32 bp, Homo sapiens; identical to SEQ ID NO: 39561
  chr2:71622692-71622724
  hypo

SEQ ID NO: 60103 - DNA, 83 bp, Homo sapiens; identical to SEQ ID NO: 39562
  chr2:72778912-72778995
  hypo

SEQ ID NO: 60104 - DNA, 23 bp, Homo sapiens
  chr2:73440127-73440150
  hypo
caggtgatcctcccacgcatcac

SEQ ID NO: 60105 - DNA, 30 bp, Homo sapiens; identical to SEQ ID NO: 39565
  chr2:73723848-73723878
  hypo

SEQ ID NO: 60106 - DNA, 17 bp, Homo sapiens
  chr2:74425137-74425154
  hypo
atatggtctcactctcg

SEQ ID NO: 60107 - DNA, 72 bp, Homo sapiens
  chr2:74454002-74454074
  hypo
caggaggggaggttgcgctgcacctctgggttgcccaggccaacctgccaggcaggagggggaagcccgtgc

SEQ ID NO: 60108 - DNA, 58 bp, Homo sapiens; identical to SEQ ID NO: 23858
  chr2:74454261-74454319
  hypo

SEQ ID NO: 60109 - DNA, 22 bp, Homo sapiens
  chr2:74669781-74669803
  hypo
cataaagagcagctgcgcgcgg

SEQ ID NO: 60110 - DNA, 92 bp, Homo sapiens; identical to SEQ ID NO: 39570
  chr2:74700397-74700489
  hypo

SEQ ID NO: 60111 - DNA, 36 bp, Homo sapiens; identical to SEQ ID NO: 39571
  chr2:74733345-74733381
  hypo

SEQ ID NO: 60112 - DNA, 24 bp, Homo sapiens
  chr2:74874703-74874727
  hypo
tgggttcactttaaacgaaatgaa

SEQ ID NO: 60113 - DNA, 35 bp, Homo sapiens; identical to SEQ ID NO: 39573
  chr2:81421368-81421403
  hypo

SEQ ID NO: 60114 - DNA, 54 bp, Homo sapiens; identical to SEQ ID NO: 39574
  chr2:81424249-81424303
  hypo

SEQ ID NO: 60115 - DNA, 30 bp, Homo sapiens; identical to SEQ ID NO: 39575
  chr2:85533655-85533685
  hypo

SEQ ID NO: 60116 - DNA, 30 bp, Homo sapiens; identical to SEQ ID NO: 39576
  chr2:85542244-85542274
  hypo

SEQ ID NO: 60117 - DNA, 34 bp, Homo sapiens; identical to SEQ ID NO: 39577
  chr2:85769773-85769807
  hypo

SEQ ID NO: 60118 - DNA, 24 bp, Homo sapiens
  chr2:85838299-85838323
  hypo
cagcctgggcgacagagacctagt

SEQ ID NO: 60119 - DNA, 29 bp, Homo sapiens
  chr2:86423740-86423769
  hypo
atcaaaataaaacacgttaaatattaagc

SEQ ID NO: 60120 - DNA, 16 bp, Homo sapiens
  chr2:87056517-87056533
  hypo
gcgcctggctggcata

SEQ ID NO: 60121 - DNA, 80 bp, Homo sapiens; identical to SEQ ID NO: 39581
  chr2:87961966-87962046
  hypo

SEQ ID NO: 60122 - DNA, 30 bp, Homo sapiens; identical to SEQ ID NO: 39582
  chr2:88306721-88306751
  hypo

SEQ ID NO: 60123 - DNA, 87 bp, Homo sapiens; identical to SEQ ID NO: 39584
  chr2:88573562-88573649
  hypo

SEQ ID NO: 60124 - DNA, 157 bp, Homo sapiens
  chr2:88990264-88990421
  hypo
gcccataccagtgacttgcgctcacggaagagttctgaaggcctggaatgcgtttgaagatgagttcatgagcagacagaaaggattccactaacagccgagaaacacaaaggtcatgtgtttttagggacctccaagtggtcggtaaggttggggt

SEQ ID NO: 60125 - DNA, 34 bp, Homo sapiens; identical to SEQ ID NO: 39586
  chr2:89071947-89071981
  hypo

SEQ ID NO: 60126 - DNA, 30 bp, Homo sapiens; identical to SEQ ID NO: 39587
  chr2:89371674-89371704
  hypo

SEQ ID NO: 60127 - DNA, 38 bp, Homo sapiens; identical to SEQ ID NO: 39588
  chr2:90003862-90003900
  hypo

SEQ ID NO: 60128 - DNA, 89 bp, Homo sapiens; identical to SEQ ID NO: 39589
  chr2:95742095-95742184
  hypo

SEQ ID NO: 60129 - DNA, 30 bp, Homo sapiens; identical to SEQ ID NO: 39590
  chr2:95745768-95745798
  hypo

SEQ ID NO: 60130 - DNA, 49 bp, Homo sapiens
  chr2:95941629-95941678
  hypo
ctgggcagtgggggtcgggtcacccctcatgccctgctgcctgcccagg

SEQ ID NO: 60131 - DNA, 40 bp, Homo sapiens; identical to SEQ ID NO: 23864
  chr2:95941812-95941852
  hypo

SEQ ID NO: 60132 - DNA, 82 bp, Homo sapiens; identical to SEQ ID NO: 39592
  chr2:96784580-96784662
  hypo

SEQ ID NO: 60133 - DNA, 24 bp, Homo sapiens
  chr2:96872240-96872264
  hypo
cttaaaagtggaacacggccgggc

SEQ ID NO: 60134 - DNA, 30 bp, Homo sapiens; identical to SEQ ID NO: 39596
  chr2:97437788-97437818
  hypo

SEQ ID NO: 60135 - DNA, 30 bp, Homo sapiens; identical to SEQ ID NO: 39597
  chr2:97603228-97603258
  hypo

SEQ ID NO: 60136 - DNA, 119 bp, Homo sapiens; identical to SEQ ID NO: 39598
  chr2:97605950-97606069
  hypo

SEQ ID NO: 60137 - DNA, 32 bp, Homo sapiens; identical to SEQ ID NO: 39599
  chr2:97652373-97652405
  hypo

SEQ ID NO: 60138 - DNA, 30 bp, Homo sapiens; identical to SEQ ID NO: 14435
  chr2:98025687-98025717
  hypo

SEQ ID NO: 60139 - DNA, 30 bp, Homo sapiens; identical to SEQ ID NO: 39601
  chr2:98263541-98263571
  hypo

SEQ ID NO: 60140 - DNA, 30 bp, Homo sapiens; identical to SEQ ID NO: 39602
  chr2:98351134-98351164
  hypo

SEQ ID NO: 60141 - DNA, 30 bp, Homo sapiens; identical to SEQ ID NO: 39603
  chr2:98354137-98354167
  hypo

SEQ ID NO: 60142 - DNA, 145 bp, Homo sapiens; identical to SEQ ID NO: 39604
  chr2:98357736-98357881
  hypo

SEQ ID NO: 60143 - DNA, 189 bp, Homo sapiens; identical to SEQ ID NO: 39605
  chr2:98702143-98702332
  hypo

SEQ ID NO: 60144 - DNA, 30 bp, Homo sapiens; identical to SEQ ID NO: 39606
  chr2:98957314-98957344
  hypo

SEQ ID NO: 60145 - DNA, 30 bp, Homo sapiens; identical to SEQ ID NO: 39607
  chr2:99004156-99004186
  hypo

SEQ ID NO: 60146 - DNA, 88 bp, Homo sapiens; identical to SEQ ID NO: 39608
  chr2:99795933-99796021
  hypo

SEQ ID NO: 60147 - DNA, 139 bp, Homo sapiens
  chr2:99796330-99796469
  hypo
gagtttgtagttctgaccaaagcaccaaaccataaagggctcccctctgctgccccaaagcttctgtaacactttaattataagaagcttaaactagaaagaacagagggagcttagtccagaccgggagtgtcggggg

SEQ ID NO: 60148 - DNA, 39 bp, Homo sapiens; identical to SEQ ID NO: 39611
  chr2:99951448-99951487
  hypo

SEQ ID NO: 60149 - DNA, 30 bp, Homo sapiens; identical to SEQ ID NO: 39612
  chr2:100107667-100107697
  hypo

SEQ ID NO: 60150 - DNA, 162 bp, Homo sapiens; identical to SEQ ID NO: 39613
  chr2:100108060-100108222
  hypo

SEQ ID NO: 60151 - DNA, 177 bp, Homo sapiens; identical to SEQ ID NO: 39615
  chr2:101520526-101520703
  hypo

SEQ ID NO: 60152 - DNA, 40 bp, Homo sapiens
  chr2:101835057-101835097
  hypo
ctgggattacaggcatgagccaccgcgcccagcctagtca

SEQ ID NO: 60153 - DNA, 30 bp, Homo sapiens; identical to SEQ ID NO: 39617
  chr2:101893777-101893807
  hypo

SEQ ID NO: 60154 - DNA, 204 bp, Homo sapiens; identical to SEQ ID NO: 39618
  chr2:102246999-102247203
  hypo

SEQ ID NO: 60155 - DNA, 91 bp, Homo sapiens; identical to SEQ ID NO: 39619
  chr2:104014594-104014685
  hypo

SEQ ID NO: 60156 - DNA, 30 bp, Homo sapiens; identical to SEQ ID NO: 39620
  chr2:105719619-105719649
  hypo

SEQ ID NO: 60157 - DNA, 41 bp, Homo sapiens; identical to SEQ ID NO: 39621
  chr2:105858359-105858400
  hypo

SEQ ID NO: 60158 - DNA, 156 bp, Homo sapiens; identical to SEQ ID NO: 39622
  chr2:105972350-105972506
  hypo

SEQ ID NO: 60159 - DNA, 257 bp, Homo sapiens; identical to SEQ ID NO: 39623
  chr2:106016141-106016398
  hypo

SEQ ID NO: 60160 - DNA, 30 bp, Homo sapiens; identical to SEQ ID NO: 39625
  chr2:106111101-106111131
  hypo

SEQ ID NO: 60161 - DNA, 30 bp, Homo sapiens; identical to SEQ ID NO: 14441
  chr2:106672847-106672877
  hypo

SEQ ID NO: 60162 - DNA, 30 bp, Homo sapiens; identical to SEQ ID NO: 23871
  chr2:106959338-106959368
  hypo

SEQ ID NO: 60163 - DNA, 55 bp, Homo sapiens; identical to SEQ ID NO: 23872
  chr2:106959988-106960043
  hypo

SEQ ID NO: 60164 - DNA, 21 bp, Homo sapiens
  chr2:107278930-107278951
  hypo
ccaccgcgcctggcctatttt

SEQ ID NO: 60165 - DNA, 245 bp, Homo sapiens; identical to SEQ ID NO: 39630
  chr2:107460171-107460416
  hypo

SEQ ID NO: 60166 - DNA, 24 bp, Homo sapiens
  chr2:108104796-108104820
  hypo
tttttttttttgagacggagtccc

SEQ ID NO: 60167 - DNA, 47 bp, Homo sapiens; identical to SEQ ID NO: 39632
  chr2:108160878-108160925
  hypo

SEQ ID NO: 60168 - DNA, 59 bp, Homo sapiens
  chr2:109335074-109335133
  hypo
tacaggcgtgaaccacagcgcccggcggaatgcgtggattttggcataagacggtggtt

SEQ ID NO: 60169 - DNA, 30 bp, Homo sapiens; identical to SEQ ID NO: 39634
  chr2:111438469-111438499
  hypo

SEQ ID NO: 60170 - DNA, 40 bp, Homo sapiens; identical to SEQ ID NO: 39635
  chr2:111898079-111898119
  hypo

SEQ ID NO: 60171 - DNA, 157 bp, Homo sapiens; identical to SEQ ID NO: 39636
  chr2:113013160-113013317
  hypo

SEQ ID NO: 60172 - DNA, 38 bp, Homo sapiens; identical to SEQ ID NO: 39637
  chr2:113103393-113103431
  hypo

SEQ ID NO: 60173 - DNA, 30 bp, Homo sapiens; identical to SEQ ID NO: 39638
  chr2:114394659-114394689
  hypo

SEQ ID NO: 60174 - DNA, 16 bp, Homo sapiens
  chr2:114469916-114469932
  hypo
acggagtctcgctgtc

SEQ ID NO: 60175 - DNA, 225 bp, Homo sapiens
  chr2:114515303-114515528
  hypo
atcttggtcagatggcgtgaagaaattaaattttcttactcctatagtcgcgatgtagtgtacctcttaccttttaagtctcgtttcagtgaagttgaatgcatattctagcaactaataaaacaataccaatgaacattttttaattgatcgaatcagtttcaaactatcagcatcaaacacctctaataagtcattcagaaacctattgtgcagagtaaaaaa

SEQ ID NO: 60176 - DNA, 24 bp, Homo sapiens
  chr2:114515808-114515832
  hypo
gcgagactccgtctcaaaataaat

SEQ ID NO: 60177 - DNA, 37 bp, Homo sapiens; identical to SEQ ID NO: 39642
  chr2:118628528-118628565
  hypo

SEQ ID NO: 60178 - DNA, 270 bp, Homo sapiens; identical to SEQ ID NO: 39643
  chr2:120005499-120005769
  hypo

SEQ ID NO: 60179 - DNA, 30 bp, Homo sapiens; identical to SEQ ID NO: 39644
  chr2:120441329-120441359
  hypo

SEQ ID NO: 60180 - DNA, 81 bp, Homo sapiens; identical to SEQ ID NO: 39645
  chr2:120973474-120973555
  hypo

SEQ ID NO: 60181 - DNA, 211 bp, Homo sapiens; identical to SEQ ID NO: 39646
  chr2:120973770-120973981
  hypo

SEQ ID NO: 60182 - DNA, 255 bp, Homo sapiens; identical to SEQ ID NO: 23877
  chr2:120980098-120980353
  hypo

SEQ ID NO: 60183 - DNA, 97 bp, Homo sapiens; identical to SEQ ID NO: 23878
  chr2:120980395-120980492
  hypo

SEQ ID NO: 60184 - DNA, 120 bp, Homo sapiens; identical to SEQ ID NO: 39648
  chr2:121003516-121003636
  hypo

SEQ ID NO: 60185 - DNA, 30 bp, Homo sapiens; identical to SEQ ID NO: 39649
  chr2:121639825-121639855
  hypo

SEQ ID NO: 60186 - DNA, 24 bp, Homo sapiens
  chr2:122013325-122013349
  hypo
tttttttttttgagacggaatctc

SEQ ID NO: 60187 - DNA, 47 bp, Homo sapiens; identical to SEQ ID NO: 39651
  chr2:122088821-122088868
  hypo

SEQ ID NO: 60188 - DNA, 30 bp, Homo sapiens; identical to SEQ ID NO: 39652
  chr2:122104569-122104599
  hypo

SEQ ID NO: 60189 - DNA, 181 bp, Homo sapiens
  chr2:122495413-122495594
  hypo
ttacagcctgagggcagcatggctgctttaagagaccaaagaggcttgtgggggagaggcacactgggtggcgccggagggtcccccttaggaggtggcgttagcaccgaggcctgaaggctaaagagcggggtgtggagaaccgagcgcctgccgtccgctggaccggacaggcctgcac

SEQ ID NO: 60190 - DNA, 30 bp, Homo sapiens; identical to SEQ ID NO: 39654
  chr2:122511801-122511831
  hypo

SEQ ID NO: 60191 - DNA, 37 bp, Homo sapiens; identical to SEQ ID NO: 39655
  chr2:126237007-126237044
  hypo

SEQ ID NO: 60192 - DNA, 27 bp, Homo sapiens
  chr2:126347693-126347720
  hypo
accaacaaaataggccgggtgtagtgg

SEQ ID NO: 60193 - DNA, 21 bp, Homo sapiens
  chr2:126413305-126413326
  hypo
agcaatggccgggtgcggtgt

SEQ ID NO: 60194 - DNA, 30 bp, Homo sapiens; identical to SEQ ID NO: 39658
  chr2:127395350-127395380
  hypo

SEQ ID NO: 60195 - DNA, 30 bp, Homo sapiens; identical to SEQ ID NO: 39659
  chr2:127397957-127397987
  hypo

SEQ ID NO: 60196 - DNA, 81 bp, Homo sapiens; identical to SEQ ID NO: 39660
  chr2:127422857-127422938
  hypo

SEQ ID NO: 60197 - DNA, 21 bp, Homo sapiens
  chr2:127423058-127423079
  hypo
aaccaccgattcatgggacag

SEQ ID NO: 60198 - DNA, 30 bp, Homo sapiens; identical to SEQ ID NO: 39663
  chr2:127427725-127427755
  hypo

SEQ ID NO: 60199 - DNA, 25 bp, Homo sapiens
  chr2:127428985-127429010
  hypo
gctttatcacaggcacgagcacagg

SEQ ID NO: 60200 - DNA, 127 bp, Homo sapiens; identical to SEQ ID NO: 39665
  chr2:127433244-127433371
  hypo

SEQ ID NO: 60201 - DNA, 40 bp, Homo sapiens; identical to SEQ ID NO: 14455
  chr2:127435251-127435291
  hypo

SEQ ID NO: 60202 - DNA, 53 bp, Homo sapiens; identical to SEQ ID NO: 39667
  chr2:127438087-127438140
  hypo

SEQ ID NO: 60203 - DNA, 232 bp, Homo sapiens
  chr2:127438663-127438895
  hypo
acttggaaaatacagacagccatatgttagaagtaaacaaaaccactcctaacccgtctacttcttaaaagccggtacttaacatttgaagcgtatttcttttcatcgctttgttttaaggtttttgtggaatatttttcatcatttctatttagagggtcccgttttcttcacttaacatcaataccctaagcatttcttcctgttgctaagttcacgtgcaccccttccc

SEQ ID NO: 60204 - DNA, 113 bp, Homo sapiens; identical to SEQ ID NO: 39669
  chr2:127453528-127453641
  hypo

SEQ ID NO: 60205 - DNA, 21 bp, Homo sapiens
  chr2:127459661-127459682
  hypo
ccaccgcgctcagcccaggaa

SEQ ID NO: 60206 - DNA, 81 bp, Homo sapiens; identical to SEQ ID NO: 39671
  chr2:127801154-127801235
  hypo

SEQ ID NO: 60207 - DNA, 30 bp, Homo sapiens; identical to SEQ ID NO: 39672
  chr2:127809267-127809297
  hypo

SEQ ID NO: 60208 - DNA, 169 bp, Homo sapiens; identical to SEQ ID NO: 39673
  chr2:128050797-128050966
  hypo

SEQ ID NO: 60209 - DNA, 30 bp, Homo sapiens; identical to SEQ ID NO: 39674
  chr2:128293422-128293452
  hypo

SEQ ID NO: 60210 - DNA, 51 bp, Homo sapiens; identical to SEQ ID NO: 39675
  chr2:128380871-128380922
  hypo

SEQ ID NO: 60211 - DNA, 140 bp, Homo sapiens
  chr2:128616477-128616617
  hypo
aaatgatgctgttttcgacactggagaaaacaaaaggttgtacaataaggtaaataatcatagcttattagtcaacaatatcttagctcattagtcaacaatgtttagatggtcatattgtaaactctgttgatttaata

SEQ ID NO: 60212 - DNA, 80 bp, Homo sapiens
  chr2:128847723-128847803
  hypo
ttccattagtcatctccttcatcctcctctccttcctccccttcatcatgttggctcatgtttatttattaaaattattt

SEQ ID NO: 60213 - DNA, 30 bp, Homo sapiens; identical to SEQ ID NO: 39678
  chr2:129128223-129128253
  hypo

SEQ ID NO: 60214 - DNA, 171 bp, Homo sapiens; identical to SEQ ID NO: 39679
  chr2:130497037-130497208
  hypo

SEQ ID NO: 60215 - DNA, 178 bp, Homo sapiens; identical to SEQ ID NO: 39680
  chr2:130666498-130666676
  hypo

SEQ ID NO: 60216 - DNA, 30 bp, Homo sapiens; identical to SEQ ID NO: 39681
  chr2:130886777-130886807
  hypo

SEQ ID NO: 60217 - DNA, 135 bp, Homo sapiens; identical to SEQ ID NO: 39682
  chr2:130947982-130948117
  hypo

SEQ ID NO: 60218 - DNA, 42 bp, Homo sapiens; identical to SEQ ID NO: 39683
  chr2:131114462-131114504
  hypo

SEQ ID NO: 60219 - DNA, 61 bp, Homo sapiens; identical to SEQ ID NO: 39685
  chr2:131486943-131487004
  hypo

SEQ ID NO: 60220 - DNA, 261 bp, Homo sapiens; identical to SEQ ID NO: 14463
  chr2:131967115-131967376
  hypo

SEQ ID NO: 60221 - DNA, 103 bp, Homo sapiens; identical to SEQ ID NO: 39687
  chr2:132415272-132415375
  hypo

SEQ ID NO: 60222 - DNA, 30 bp, Homo sapiens; identical to SEQ ID NO: 39688
  chr2:132416768-132416798
  hypo

SEQ ID NO: 60223 - DNA, 30 bp, Homo sapiens; identical to SEQ ID NO: 39689
  chr2:135832320-135832350
  hypo

SEQ ID NO: 60224 - DNA, 36 bp, Homo sapiens; identical to SEQ ID NO: 39690
  chr2:140650928-140650964
  hypo

SEQ ID NO: 60225 - DNA, 30 bp, Homo sapiens; identical to SEQ ID NO: 39691
  chr2:143931491-143931521
  hypo

SEQ ID NO: 60226 - DNA, 41 bp, Homo sapiens; identical to SEQ ID NO: 39692
  chr2:145167740-145167781
  hypo

SEQ ID NO: 60227 - DNA, 43 bp, Homo sapiens; identical to SEQ ID NO: 39693
  chr2:145174534-145174577
  hypo

SEQ ID NO: 60228 - DNA, 21 bp, Homo sapiens
  chr2:145204291-145204312
  hypo
taacaattggctggacgcggt

SEQ ID NO: 60229 - DNA, 80 bp, Homo sapiens
  chr2:148776729-148776809
  hypo
atcggacatgattaccgtacacaatacagaagatactaagggctaagcaatgatgcataaacggggtccactgcccaaac

SEQ ID NO: 60230 - DNA, 38 bp, Homo sapiens; identical to SEQ ID NO: 39696
  chr2:149514655-149514693
  hypo

SEQ ID NO: 60231 - DNA, 79 bp, Homo sapiens; identical to SEQ ID NO: 39697
  chr2:152266023-152266102
  hypo

SEQ ID NO: 60232 - DNA, 30 bp, Homo sapiens; identical to SEQ ID NO: 39698
  chr2:162087925-162087955
  hypo

SEQ ID NO: 60233 - DNA, 40 bp, Homo sapiens; identical to SEQ ID NO: 39699
  chr2:162166372-162166412
  hypo

SEQ ID NO: 60234 - DNA, 6 bp, Homo sapiens
  chr2:170282975-170282981
  hypo
tggccc

SEQ ID NO: 60235 - DNA, 1 bp, Homo sapiens
  chr2:170551729-170551730
  hypo
c

SEQ ID NO: 60236 - DNA, 30 bp, Homo sapiens; identical to SEQ ID NO: 39702
  chr2:170584782-170584812
  hypo

SEQ ID NO: 60237 - DNA, 29 bp, Homo sapiens
  chr2:171624032-171624061
  hypo
tgagccaccgcgtccggccctcaacaaat

SEQ ID NO: 60238 - DNA, 23 bp, Homo sapiens
  chr2:171769313-171769336
  hypo
catctaatcgctttggtaacttc

SEQ ID NO: 60239 - DNA, 21 bp, Homo sapiens
  chr2:172129423-172129444
  hypo
ccaccgcgcctagatggggca

SEQ ID NO: 60240 - DNA, 11 bp, Homo sapiens
  chr2:172411125-172411136
  hypo
ggatagtcacc

SEQ ID NO: 60241 - DNA, 20 bp, Homo sapiens
  chr2:173036684-173036704
  hypo
caccgcgcccagcccaataa

SEQ ID NO: 60242 - DNA, 30 bp, Homo sapiens; identical to SEQ ID NO: 39711
  chr2:173291566-173291596
  hypo

SEQ ID NO: 60243 - DNA, 21 bp, Homo sapiens
  chr2:176030420-176030441
  hypo
ggagtctcgctgtgtcgccca

SEQ ID NO: 60244 - DNA, 79 bp, Homo sapiens; identical to SEQ ID NO: 39714
  chr2:176430829-176430908
  hypo

SEQ ID NO: 60245 - DNA, 20 bp, Homo sapiens
  chr2:176569563-176569583
  hypo
tagaccggagctgttcctat

SEQ ID NO: 60246 - DNA, 97 bp, Homo sapiens; identical to SEQ ID NO: 39716
  chr2:177498024-177498121
  hypo

SEQ ID NO: 60247 - DNA, 32 bp, Homo sapiens; identical to SEQ ID NO: 39717
  chr2:178089350-178089382
  hypo

SEQ ID NO: 60248 - DNA, 30 bp, Homo sapiens; identical to SEQ ID NO: 39718
  chr2:178131780-178131810
  hypo

SEQ ID NO: 60249 - DNA, 11 bp, Homo sapiens
  chr2:178972992-178973003
  hypo
cctggccagag

SEQ ID NO: 60250 - DNA, 136 bp, Homo sapiens
  chr2:178973042-178973178
  hypo
acctcacgccctgggctgcaagcgcagccggacgcgcgcgaccagtgatcgccagccaatggcaagccgggacccggtcccactgctgattggcccccagatcccgtgggatctcacctctcgcagaggcttaaag

SEQ ID NO: 60251 - DNA, 30 bp, Homo sapiens; identical to SEQ ID NO: 39721
  chr2:179672126-179672156
  hypo

SEQ ID NO: 60252 - DNA, 138 bp, Homo sapiens; identical to SEQ ID NO: 39722
  chr2:180886772-180886910
  hypo

SEQ ID NO: 60253 - DNA, 148 bp, Homo sapiens; identical to SEQ ID NO: 39723
  chr2:182422221-182422369
  hypo

SEQ ID NO: 60254 - DNA, 128 bp, Homo sapiens; identical to SEQ ID NO: 39724
  chr2:184406833-184406961
  hypo

SEQ ID NO: 60255 - DNA, 141 bp, Homo sapiens; identical to SEQ ID NO: 39725
  chr2:188235961-188236102
  hypo

SEQ ID NO: 60256 - DNA, 16 bp, Homo sapiens
  chr2:196302359-196302375
  hypo
ccgcaggtcacttcag

SEQ ID NO: 60257 - DNA, 30 bp, Homo sapiens; identical to SEQ ID NO: 39727
  chr2:196319761-196319791
  hypo

SEQ ID NO: 60258 - DNA, 30 bp, Homo sapiens; identical to SEQ ID NO: 39728
  chr2:197503336-197503366
  hypo

SEQ ID NO: 60259 - DNA, 102 bp, Homo sapiens; identical to SEQ ID NO: 39729
  chr2:200524640-200524742
  hypo

SEQ ID NO: 60260 - DNA, 30 bp, Homo sapiens; identical to SEQ ID NO: 14479
  chr2:203129332-203129362
  hypo

SEQ ID NO: 60261 - DNA, 23 bp, Homo sapiens
  chr2:203484340-203484363
  hypo
tgccatatcgggtgcaccagtta

SEQ ID NO: 60262 - DNA, 106 bp, Homo sapiens; identical to SEQ ID NO: 39732
  chr2:206757186-206757292
  hypo

SEQ ID NO: 60263 - DNA, 30 bp, Homo sapiens; identical to SEQ ID NO: 39733
  chr2:206859091-206859121
  hypo

SEQ ID NO: 60264 - DNA, 107 bp, Homo sapiens; identical to SEQ ID NO: 39735
  chr2:207557814-207557921
  hypo

SEQ ID NO: 60265 - DNA, 30 bp, Homo sapiens; identical to SEQ ID NO: 39736
  chr2:208140368-208140398
  hypo

SEQ ID NO: 60266 - DNA, 180 bp, Homo sapiens; identical to SEQ ID NO: 39737
  chr2:208574959-208575139
  hypo

SEQ ID NO: 60267 - DNA, 31 bp, Homo sapiens; identical to SEQ ID NO: 39738
  chr2:209094651-209094682
  hypo

SEQ ID NO: 60268 - DNA, 30 bp, Homo sapiens; identical to SEQ ID NO: 39739
  chr2:209225350-209225380
  hypo

SEQ ID NO: 60269 - DNA, 175 bp, Homo sapiens; identical to SEQ ID NO: 39740
  chr2:214080302-214080477
  hypo

SEQ ID NO: 60270 - DNA, 48 bp, Homo sapiens; identical to SEQ ID NO: 39741
  chr2:217675074-217675122
  hypo

SEQ ID NO: 60271 - DNA, 30 bp, Homo sapiens; identical to SEQ ID NO: 39742
  chr2:219250043-219250073
  hypo

SEQ ID NO: 60272 - DNA, 30 bp, Homo sapiens; identical to SEQ ID NO: 39743
  chr2:219251809-219251839
  hypo

SEQ ID NO: 60273 - DNA, 185 bp, Homo sapiens; identical to SEQ ID NO: 39744
  chr2:219284495-219284680
  hypo

SEQ ID NO: 60274 - DNA, 189 bp, Homo sapiens; identical to SEQ ID NO: 39745
  chr2:219431996-219432185
  hypo

SEQ ID NO: 60275 - DNA, 30 bp, Homo sapiens; identical to SEQ ID NO: 39746
  chr2:219611841-219611871
  hypo

SEQ ID NO: 60276 - DNA, 30 bp, Homo sapiens; identical to SEQ ID NO: 39747
  chr2:219773320-219773350
  hypo

SEQ ID NO: 60277 - DNA, 30 bp, Homo sapiens; identical to SEQ ID NO: 14482
  chr2:220316287-220316317
  hypo

SEQ ID NO: 60278 - DNA, 42 bp, Homo sapiens; identical to SEQ ID NO: 39750
  chr2:220384416-220384458
  hypo

SEQ ID NO: 60279 - DNA, 39 bp, Homo sapiens; identical to SEQ ID NO: 39751
  chr2:221861787-221861826
  hypo

SEQ ID NO: 60280 - DNA, 119 bp, Homo sapiens; identical to SEQ ID NO: 39752
  chr2:223753484-223753603
  hypo

SEQ ID NO: 60281 - DNA, 30 bp, Homo sapiens; identical to SEQ ID NO: 14483
  chr2:223764711-223764741
  hypo

SEQ ID NO: 60282 - DNA, 75 bp, Homo sapiens; identical to SEQ ID NO: 39754
  chr2:225394300-225394375
  hypo

SEQ ID NO: 60283 - DNA, 24 bp, Homo sapiens
  chr2:226298377-226298401
  hypo
aaaaaattagttgggcgtgatggc

SEQ ID NO: 60284 - DNA, 32 bp, Homo sapiens; identical to SEQ ID NO: 39756
  chr2:228264610-228264642
  hypo

SEQ ID NO: 60285 - DNA, 30 bp, Homo sapiens; identical to SEQ ID NO: 39758
  chr2:228735796-228735826
  hypo

SEQ ID NO: 60286 - DNA, 215 bp, Homo sapiens; identical to SEQ ID NO: 39759
  chr2:228888319-228888534
  hypo

SEQ ID NO: 60287 - DNA, 70 bp, Homo sapiens
  chr2:230795565-230795635
  hypo
ttttccctcctgctgtcatttaccccctcactgctcctcctgatggcagcaagtgcgcaaacattccctt

SEQ ID NO: 60288 - DNA, 37 bp, Homo sapiens; identical to SEQ ID NO: 39761
  chr2:231170274-231170311
  hypo

SEQ ID NO: 60289 - DNA, 99 bp, Homo sapiens; identical to SEQ ID NO: 39762
  chr2:232243072-232243171
  hypo

SEQ ID NO: 60290 - DNA, 30 bp, Homo sapiens; identical to SEQ ID NO: 39763
  chr2:232283743-232283773
  hypo

SEQ ID NO: 60291 - DNA, 40 bp, Homo sapiens; identical to SEQ ID NO: 39764
  chr2:232330287-232330327
  hypo

SEQ ID NO: 60292 - DNA, 39 bp, Homo sapiens; identical to SEQ ID NO: 39765
  chr2:232485651-232485690
  hypo

SEQ ID NO: 60293 - DNA, 16 bp, Homo sapiens
  chr2:232526123-232526139
  hypo
tttctactggccgggc

SEQ ID NO: 60294 - DNA, 30 bp, Homo sapiens; identical to SEQ ID NO: 39767
  chr2:232541215-232541245
  hypo

SEQ ID NO: 60295 - DNA, 27 bp, Homo sapiens
  chr2:232546676-232546703
  hypo
attaaaagagctggccgggcgcggtga

SEQ ID NO: 60296 - DNA, 25 bp, Homo sapiens
  chr2:232570350-232570375
  hypo
cctgcatgggaataacgtcagaaaa

SEQ ID NO: 60297 - DNA, 46 bp, Homo sapiens; identical to SEQ ID NO: 39770
  chr2:233322968-233323014
  hypo

SEQ ID NO: 60298 - DNA, 30 bp, Homo sapiens; identical to SEQ ID NO: 39771
  chr2:233474440-233474470
  hypo

SEQ ID NO: 60299 - DNA, 20 bp, Homo sapiens
  chr2:233750505-233750525
  hypo
gtgacacatggggcccggca

SEQ ID NO: 60300 - DNA, 30 bp, Homo sapiens; identical to SEQ ID NO: 14487
  chr2:233960620-233960650
  hypo

SEQ ID NO: 60301 - DNA, 55 bp, Homo sapiens; identical to SEQ ID NO: 39774
  chr2:233986907-233986962
  hypo

SEQ ID NO: 60302 - DNA, 116 bp, Homo sapiens; identical to SEQ ID NO: 39775
  chr2:233991021-233991137
  hypo

SEQ ID NO: 60303 - DNA, 30 bp, Homo sapiens; identical to SEQ ID NO: 39776
  chr2:233997245-233997275
  hypo

SEQ ID NO: 60304 - DNA, 111 bp, Homo sapiens; identical to SEQ ID NO: 39777
  chr2:234079674-234079785
  hypo

SEQ ID NO: 60305 - DNA, 176 bp, Homo sapiens; identical to SEQ ID NO: 39778
  chr2:234109964-234110140
  hypo

SEQ ID NO: 60306 - DNA, 30 bp, Homo sapiens; identical to SEQ ID NO: 39779
  chr2:234330364-234330394
  hypo

SEQ ID NO: 60307 - DNA, 43 bp, Homo sapiens; identical to SEQ ID NO: 39780
  chr2:234331271-234331314
  hypo

SEQ ID NO: 60308 - DNA, 380 bp, Homo sapiens; identical to SEQ ID NO: 39781
  chr2:234369732-234370112
  hypo

SEQ ID NO: 60309 - DNA, 30 bp, Homo sapiens; identical to SEQ ID NO: 39782
  chr2:235382081-235382111
  hypo

SEQ ID NO: 60310 - DNA, 92 bp, Homo sapiens; identical to SEQ ID NO: 39783
  chr2:236452425-236452517
  hypo

SEQ ID NO: 60311 - DNA, 24 bp, Homo sapiens
  chr2:236877238-236877262
  hypo
agccgacggcctgtccggcactgc

SEQ ID NO: 60312 - DNA, 110 bp, Homo sapiens; identical to SEQ ID NO: 39785
  chr2:238475095-238475205
  hypo

SEQ ID NO: 60313 - DNA, 235 bp, Homo sapiens
  chr2:239050963-239051198
  hypo
cttcagagccttgcccgtggacggtcaccttgtattctaattcctggcagtgggagatctgggggttccatatggggggccagggtggatggctgtgggagagcctggggtcctgggagacctaggcagtgactgcttaccggccgttcctaagacagccagcatttcccactgagccgggacaccctcgtgccgcctgctggaggccacccagggagcaggggcagggagaagc

SEQ ID NO: 60314 - DNA, 95 bp, Homo sapiens
  chr2:239051228-239051323
  hypo
atcggttctgaagatggttcaggaactccaggaatgcccctgaaaggcacatggtgcaaggagggagcagcttgtgcactcgggcacacgccatc

SEQ ID NO: 60315 - DNA, 30 bp, Homo sapiens; identical to SEQ ID NO: 39787
  chr2:239083135-239083165
  hypo

SEQ ID NO: 60316 - DNA, 30 bp, Homo sapiens; identical to SEQ ID NO: 39788
  chr2:239134032-239134062
  hypo

SEQ ID NO: 60317 - DNA, 42 bp, Homo sapiens; identical to SEQ ID NO: 39789
  chr2:239147417-239147459
  hypo

SEQ ID NO: 60318 - DNA, 30 bp, Homo sapiens; identical to SEQ ID NO: 39790
  chr2:239183260-239183290
  hypo

SEQ ID NO: 60319 - DNA, 184 bp, Homo sapiens; identical to SEQ ID NO: 39792
  chr2:239322426-239322610
  hypo

SEQ ID NO: 60320 - DNA, 63 bp, Homo sapiens
  chr2:239957267-239957330
  hypo
ctagcctagcagccccgctctcctgcgggctcccccgtgggccaagtctcctaaactgggcca

SEQ ID NO: 60321 - DNA, 66 bp, Homo sapiens
  chr2:239957448-239957514
  hypo
cgtcctccctcctgctggaggggactggacaccgttaatgacagcgaaaatcgcctggagttgatg

SEQ ID NO: 60322 - DNA, 127 bp, Homo sapiens; identical to SEQ ID NO: 39794
  chr2:239997460-239997587
  hypo

SEQ ID NO: 60323 - DNA, 57 bp, Homo sapiens; identical to SEQ ID NO: 39795
  chr2:240080496-240080553
  hypo

SEQ ID NO: 60324 - DNA, 134 bp, Homo sapiens; identical to SEQ ID NO: 39796
  chr2:240103588-240103722
  hypo

SEQ ID NO: 60325 - DNA, 121 bp, Homo sapiens; identical to SEQ ID NO: 39797
  chr2:240103944-240104065
  hypo

SEQ ID NO: 60326 - DNA, 25 bp, Homo sapiens
  chr2:240168786-240168811
  hypo
aggtgatgcagctatcggcaatggc

SEQ ID NO: 60327 - DNA, 58 bp, Homo sapiens; identical to SEQ ID NO: 23911
  chr2:240169051-240169109
  hypo

SEQ ID NO: 60328 - DNA, 50 bp, Homo sapiens; identical to SEQ ID NO: 39799
  chr2:240213736-240213786
  hypo

SEQ ID NO: 60329 - DNA, 58 bp, Homo sapiens; identical to SEQ ID NO: 39800
  chr2:240566166-240566224
  hypo

SEQ ID NO: 60330 - DNA, 55 bp, Homo sapiens; identical to SEQ ID NO: 39801
  chr2:240582300-240582355
  hypo

SEQ ID NO: 60331 - DNA, 44 bp, Homo sapiens
  chr2:240658183-240658227
  hypo
ggcagtgatgtctgtcggtaccccaaggcctgtgtggaggcagc

SEQ ID NO: 60332 - DNA, 88 bp, Homo sapiens
  chr2:240658421-240658509
  hypo
aggaagggctcacaccctgacaggtgcgatcagtcagggcagggaggcgggcagcaggactggccactggccccgataggtgctggtg

SEQ ID NO: 60333 - DNA, 42 bp, Homo sapiens; identical to SEQ ID NO: 39803
  chr2:240658874-240658916
  hypo

SEQ ID NO: 60334 - DNA, 203 bp, Homo sapiens; identical to SEQ ID NO: 39804
  chr2:240809498-240809701
  hypo

SEQ ID NO: 60335 - DNA, 13 bp, Homo sapiens
  chr2:241095772-241095785
  hypo
attcatgaagagt

SEQ ID NO: 60336 - DNA, 163 bp, Homo sapiens; identical to SEQ ID NO: 39806
  chr2:241107135-241107298
  hypo

SEQ ID NO: 60337 - DNA, 30 bp, Homo sapiens; identical to SEQ ID NO: 39807
  chr2:241262151-241262181
  hypo

SEQ ID NO: 60338 - DNA, 115 bp, Homo sapiens; identical to SEQ ID NO: 39808
  chr2:241350181-241350296
  hypo

SEQ ID NO: 60339 - DNA, 30 bp, Homo sapiens; identical to SEQ ID NO: 39809
  chr2:241398532-241398562
  hypo

SEQ ID NO: 60340 - DNA, 56 bp, Homo sapiens; identical to SEQ ID NO: 39811
  chr2:241543418-241543474
  hypo

SEQ ID NO: 60341 - DNA, 21 bp, Homo sapiens
  chr2:241544980-241545001
  hypo
ttctggggtgagtgtcgagat

SEQ ID NO: 60342 - DNA, 30 bp, Homo sapiens; identical to SEQ ID NO: 39813
  chr2:241662384-241662414
  hypo

SEQ ID NO: 60343 - DNA, 44 bp, Homo sapiens; identical to SEQ ID NO: 39814
  chr2:241721534-241721578
  hypo

SEQ ID NO: 60344 - DNA, 58 bp, Homo sapiens; identical to SEQ ID NO: 14500
  chr2:241722184-241722242
  hypo

SEQ ID NO: 60345 - DNA, 30 bp, Homo sapiens; identical to SEQ ID NO: 39816
  chr2:241861894-241861924
  hypo

SEQ ID NO: 60346 - DNA, 77 bp, Homo sapiens; identical to SEQ ID NO: 39817
  chr2:241862358-241862435
  hypo

SEQ ID NO: 60347 - DNA, 437 bp, Homo sapiens
  chr2:241864757-241865194
  hypo
gtctgactccctctccgcgtcaccccgccccgcgaaaggcacctccctcccagcccctggcaccttgtctcaggcattgagggacgggccaaggttgcagagccagagccaggagagctcggggcaggggcagatatcgcagggaggcaggagggcactgggctggcacctgggagagccaccttgatgctggcactcagtttaggggtcctttgtggggcccatggcaggtgggggcagagcagcggctgtgcacctgagcccaggtcagttaggcccagagggtttggggttccattcaagccccttgacttggggactctgagcgcctctcttaggagaggcttcctacccccaccatgccctgtgggttctctgtccaggagcaccggcctctgtcaggtgaacgcgctcctgcgggagcagctggaacatat

SEQ ID NO: 60348 - DNA, 82 bp, Homo sapiens
  chr2:241865346-241865428
  hypo
ctatggctgggtagcaggcagggacatggtgagggtgcactggctcagtggctgtccctcttggggacgaggccacagcttc

SEQ ID NO: 60349 - DNA, 254 bp, Homo sapiens; identical to SEQ ID NO: 39819
  chr2:242004922-242005176
  hypo

SEQ ID NO: 60350 - DNA, 78 bp, Homo sapiens; identical to SEQ ID NO: 39820
  chr2:242006616-242006694
  hypo

SEQ ID NO: 60351 - DNA, 17 bp, Homo sapiens
  chr2:242009374-242009391
  hypo
tgccacctctgcccacg

SEQ ID NO: 60352 - DNA, 237 bp, Homo sapiens
  chr2:242009421-242009658
  hypo
tgctggaggcttatgtcatcaatgtgaccaccagccagagcaccaagagccgctatgtccccaacgggaagctggcgtcctacacggtgcgcgacctgctgccgggacggcggtaccagctctctgtgatagcagtgcagagcacggagctcgggccgcagcacagcgagcccgcccacctctacatcatcacctgtgagtgccgtgggccctgcgcgtgggcggggccagtgtttg

SEQ ID NO: 60353 - DNA, 30 bp, Homo sapiens; identical to SEQ ID NO: 39822
  chr2:242011200-242011230
  hypo

SEQ ID NO: 60354 - DNA, 23 bp, Homo sapiens
  chr2:242021761-242021784
  hypo
aggcgtctgtcaccacgtgtaag

SEQ ID NO: 60355 - DNA, 30 bp, Homo sapiens; identical to SEQ ID NO: 39824
  chr2:242128768-242128798
  hypo

SEQ ID NO: 60356 - DNA, 30 bp, Homo sapiens; identical to SEQ ID NO: 39825
  chr2:242131916-242131946
  hypo

SEQ ID NO: 60357 - DNA, 30 bp, Homo sapiens; identical to SEQ ID NO: 39826
  chr2:242138318-242138348
  hypo

SEQ ID NO: 60358 - DNA, 74 bp, Homo sapiens; identical to SEQ ID NO: 39827
  chr2:242156554-242156628
  hypo

SEQ ID NO: 60359 - DNA, 106 bp, Homo sapiens; identical to SEQ ID NO: 39828
  chr2:242436356-242436462
  hypo

SEQ ID NO: 60360 - DNA, 120 bp, Homo sapiens; identical to SEQ ID NO: 39830
  chr2:242636866-242636986
  hypo

SEQ ID NO: 60361 - DNA, 86 bp, Homo sapiens; identical to SEQ ID NO: 39831
  chr2:242637046-242637132
  hypo

SEQ ID NO: 60362 - DNA, 71 bp, Homo sapiens; identical to SEQ ID NO: 39832
  chr2:242672951-242673022
  hypo

SEQ ID NO: 60363 - DNA, 105 bp, Homo sapiens
  chr2:242756039-242756144
  hypo
gcccaggtccctggacgtcctggtcagcggaacttcctcctctgggcagtggggtgccctgcacgtgctggggacagcagccctggcggagcaccggtccatgaa

SEQ ID NO: 60364 - DNA, 329 bp, Homo sapiens
  chr2:242756297-242756626
  hypo
cagcgcccgggacctcaccgaggaggccatcggtggtgccgtgcagggtaggcgggcagggtgccggtctgggtccctttgattggccacggtccacatggaagggagattccagcgggaaattgccattctgccccacccctgtctccagccacaagggaaccaaccatccctttccccaggactgttctgcgcctcccgtcccaggcaaatccctctccccaggaccgtcctgagcctcccgtcccagacaaatccctctccccaggactgttctgcgcctcccgtcccaggcaaatccctctccccaggaccgtcctgcacctccc

SEQ ID NO: 60365 - DNA, 135 bp, Homo sapiens; identical to SEQ ID NO: 39834
  chr2:242757497-242757632
  hypo

SEQ ID NO: 60366 - DNA, 30 bp, Homo sapiens; identical to SEQ ID NO: 39835
  chr2:242763132-242763162
  hypo

SEQ ID NO: 60367 - DNA, 98 bp, Homo sapiens; identical to SEQ ID NO: 39836
  chr2:242784279-242784377
  hypo

SEQ ID NO: 60368 - DNA, 39 bp, Homo sapiens; identical to SEQ ID NO: 39837
  chr2:242791597-242791636
  hypo

SEQ ID NO: 60369 - DNA, 165 bp, Homo sapiens; identical to SEQ ID NO: 39838
  chr2:242794852-242795017
  hypo

SEQ ID NO: 60370 - DNA, 30 bp, Homo sapiens; identical to SEQ ID NO: 39839
  chr2:242814897-242814927
  hypo

SEQ ID NO: 60371 - DNA, 104 bp, Homo sapiens
  chr2:242832880-242832984
  hypo
tggatacgtcccagccgaaatgttcaccgtgaatccggcaacctgtggagctgatttccatttctaaggaatgaggggggatggggaagaaccccccaggacag

SEQ ID NO: 60372 - DNA, 63 bp, Homo sapiens
  chr2:242833159-242833222
  hypo
cttggcaaggcaggtggcggcaccaacaggcccgggggggacctttcccggacacctggcctc

SEQ ID NO: 60373 - DNA, 80 bp, Homo sapiens
  chr2:242833478-242833558
  hypo
ttggttctgtggcctcggtttctgtcttcctgatggcacctctgtgacaggagctcagaccccggcatcagaccggcctc

SEQ ID NO: 60374 - DNA, 26 bp, Homo sapiens
  chr2:242836469-242836495
  hypo
tcagcccatcccacgcggagcctggg

SEQ ID NO: 60375 - DNA, 76 bp, Homo sapiens; identical to SEQ ID NO: 39844
  chr2:242891535-242891611
  hypo

SEQ ID NO: 60376 - DNA, 30 bp, Homo sapiens; identical to SEQ ID NO: 39845
  chr2:242892372-242892402
  hypo

SEQ ID NO: 60377 - DNA, 21 bp, Homo sapiens
  chr2:242925641-242925662
  hypo
aggagccgggagggccctggc

SEQ ID NO: 60378 - DNA, 114 bp, Homo sapiens; identical to SEQ ID NO: 39847
  chr2:242985077-242985191
  hypo

SEQ ID NO: 60379 - DNA, 30 bp, Homo sapiens; identical to SEQ ID NO: 39848
  chr3:1741068-1741098
  hypo

SEQ ID NO: 60380 - DNA, 191 bp, Homo sapiens; identical to SEQ ID NO: 39849
  chr3:2909417-2909608
  hypo

SEQ ID NO: 60381 - DNA, 38 bp, Homo sapiens; identical to SEQ ID NO: 39850
  chr3:3167655-3167693
  hypo

SEQ ID NO: 60382 - DNA, 30 bp, Homo sapiens; identical to SEQ ID NO: 39851
  chr3:3167988-3168018
  hypo

SEQ ID NO: 60383 - DNA, 30 bp, Homo sapiens; identical to SEQ ID NO: 39852
  chr3:4755974-4756004
  hypo

SEQ ID NO: 60384 - DNA, 87 bp, Homo sapiens; identical to SEQ ID NO: 39853
  chr3:5831053-5831140
  hypo

SEQ ID NO: 60385 - DNA, 30 bp, Homo sapiens; identical to SEQ ID NO: 39854
  chr3:5970953-5970983
  hypo

SEQ ID NO: 60386 - DNA, 30 bp, Homo sapiens; identical to SEQ ID NO: 39855
  chr3:9006374-9006404
  hypo

SEQ ID NO: 60387 - DNA, 17 bp, Homo sapiens
  chr3:9688167-9688184
  hypo
gccggattggtcatttc

SEQ ID NO: 60388 - DNA, 30 bp, Homo sapiens; identical to SEQ ID NO: 39857
  chr3:10127378-10127408
  hypo

SEQ ID NO: 60389 - DNA, 35 bp, Homo sapiens; identical to SEQ ID NO: 39859
  chr3:10452258-10452293
  hypo

SEQ ID NO: 60390 - DNA, 66 bp, Homo sapiens; identical to SEQ ID NO: 39860
  chr3:11581322-11581388
  hypo

SEQ ID NO: 60391 - DNA, 30 bp, Homo sapiens; identical to SEQ ID NO: 39861
  chr3:12039968-12039998
  hypo

SEQ ID NO: 60392 - DNA, 30 bp, Homo sapiens; identical to SEQ ID NO: 14520
  chr3:12586227-12586257
  hypo

SEQ ID NO: 60393 - DNA, 68 bp, Homo sapiens; identical to SEQ ID NO: 39863
  chr3:12867218-12867286
  hypo

SEQ ID NO: 60394 - DNA, 30 bp, Homo sapiens; identical to SEQ ID NO: 39864
  chr3:13083168-13083198
  hypo

SEQ ID NO: 60395 - DNA, 100 bp, Homo sapiens; identical to SEQ ID NO: 39865
  chr3:13083990-13084090
  hypo

SEQ ID NO: 60396 - DNA, 30 bp, Homo sapiens; identical to SEQ ID NO: 39866
  chr3:13096379-13096409
  hypo

SEQ ID NO: 60397 - DNA, 30 bp, Homo sapiens; identical to SEQ ID NO: 39867
  chr3:13367390-13367420
  hypo

SEQ ID NO: 60398 - DNA, 42 bp, Homo sapiens; identical to SEQ ID NO: 39868
  chr3:13373208-13373250
  hypo

SEQ ID NO: 60399 - DNA, 30 bp, Homo sapiens; identical to SEQ ID NO: 39869
  chr3:13442799-13442829
  hypo

SEQ ID NO: 60400 - DNA, 188 bp, Homo sapiens; identical to SEQ ID NO: 39870
  chr3:13612034-13612222
  hypo

SEQ ID NO: 60401 - DNA, 40 bp, Homo sapiens; identical to SEQ ID NO: 23934
  chr3:13679132-13679172
  hypo

SEQ ID NO: 60402 - DNA, 30 bp, Homo sapiens; identical to SEQ ID NO: 14522
  chr3:13680779-13680809
  hypo

SEQ ID NO: 60403 - DNA, 78 bp, Homo sapiens; identical to SEQ ID NO: 39873
  chr3:13860693-13860771
  hypo

SEQ ID NO: 60404 - DNA, 30 bp, Homo sapiens; identical to SEQ ID NO: 39874
  chr3:14197900-14197930
  hypo

SEQ ID NO: 60405 - DNA, 161 bp, Homo sapiens; identical to SEQ ID NO: 39875
  chr3:14443179-14443340
  hypo

SEQ ID NO: 60406 - DNA, 30 bp, Homo sapiens; identical to SEQ ID NO: 39876
  chr3:14676121-14676151
  hypo

SEQ ID NO: 60407 - DNA, 30 bp, Homo sapiens; identical to SEQ ID NO: 39877
  chr3:14964046-14964076
  hypo

SEQ ID NO: 60408 - DNA, 30 bp, Homo sapiens; identical to SEQ ID NO: 39878
  chr3:15105526-15105556
  hypo

SEQ ID NO: 60409 - DNA, 30 bp, Homo sapiens; identical to SEQ ID NO: 39879
  chr3:16952388-16952418
  hypo

SEQ ID NO: 60410 - DNA, 8 bp, Homo sapiens
  chr3:17001333-17001341
  hypo
atgcctgt

SEQ ID NO: 60411 - DNA, 66 bp, Homo sapiens; identical to SEQ ID NO: 14524
  chr3:17499802-17499868
  hypo

SEQ ID NO: 60412 - DNA, 36 bp, Homo sapiens; identical to SEQ ID NO: 39882
  chr3:18299798-18299834
  hypo

SEQ ID NO: 60413 - DNA, 92 bp, Homo sapiens; identical to SEQ ID NO: 39883
  chr3:19791264-19791356
  hypo

SEQ ID NO: 60414 - DNA, 31 bp, Homo sapiens; identical to SEQ ID NO: 39884
  chr3:20013239-20013270
  hypo

SEQ ID NO: 60415 - DNA, 20 bp, Homo sapiens
  chr3:20139710-20139730
  hypo
gacaacgtcccaaattaaaa

SEQ ID NO: 60416 - DNA, 81 bp, Homo sapiens; identical to SEQ ID NO: 39886
  chr3:21447519-21447600
  hypo

SEQ ID NO: 60417 - DNA, 91 bp, Homo sapiens; identical to SEQ ID NO: 39887
  chr3:22370592-22370683
  hypo

SEQ ID NO: 60418 - DNA, 158 bp, Homo sapiens; identical to SEQ ID NO: 39888
  chr3:32151266-32151424
  hypo

SEQ ID NO: 60419 - DNA, 197 bp, Homo sapiens; identical to SEQ ID NO: 39889
  chr3:33841159-33841356
  hypo

SEQ ID NO: 60420 - DNA, 76 bp, Homo sapiens; identical to SEQ ID NO: 39890
  chr3:33841656-33841732
  hypo

SEQ ID NO: 60421 - DNA, 17 bp, Homo sapiens
  chr3:34246982-34246999
  hypo
gggcgcggtgactcacg

SEQ ID NO: 60422 - DNA, 180 bp, Homo sapiens; identical to SEQ ID NO: 39892
  chr3:34690946-34691126
  hypo

SEQ ID NO: 60423 - DNA, 17 bp, Homo sapiens
  chr3:37296942-37296959
  hypo
cacgcctgacctttata

SEQ ID NO: 60424 - DNA, 37 bp, Homo sapiens; identical to SEQ ID NO: 39894
  chr3:37876204-37876241
  hypo

SEQ ID NO: 60425 - DNA, 32 bp, Homo sapiens; identical to SEQ ID NO: 39895
  chr3:38032423-38032455
  hypo

SEQ ID NO: 60426 - DNA, 30 bp, Homo sapiens; identical to SEQ ID NO: 39896
  chr3:38041112-38041142
  hypo

SEQ ID NO: 60427 - DNA, 147 bp, Homo sapiens; identical to SEQ ID NO: 39897
  chr3:38627339-38627486
  hypo

SEQ ID NO: 60428 - DNA, 30 bp, Homo sapiens; identical to SEQ ID NO: 39898
  chr3:38950258-38950288
  hypo

SEQ ID NO: 60429 - DNA, 37 bp, Homo sapiens; identical to SEQ ID NO: 14527
  chr3:40501058-40501095
  hypo

SEQ ID NO: 60430 - DNA, 52 bp, Homo sapiens; identical to SEQ ID NO: 39900
  chr3:41289147-41289199
  hypo

SEQ ID NO: 60431 - DNA, 149 bp, Homo sapiens; identical to SEQ ID NO: 39901
  chr3:42200630-42200779
  hypo

SEQ ID NO: 60432 - DNA, 11 bp, Homo sapiens
  chr3:42222719-42222730
  hypo
ttgcattgaaa

SEQ ID NO: 60433 - DNA, 94 bp, Homo sapiens
  chr3:42640761-42640855
  hypo
atgtgtattttatagtttaaaaaaaaaacttataaaatagtgtggtactcagacacagatcattggaacaaaaatccagaaacagacccacaca

SEQ ID NO: 60434 - DNA, 30 bp, Homo sapiens; identical to SEQ ID NO: 39904
  chr3:42851003-42851033
  hypo

SEQ ID NO: 60435 - DNA, 21 bp, Homo sapiens
  chr3:43664372-43664393
  hypo
tttgagatagagcctcgcaat

SEQ ID NO: 60436 - DNA, 30 bp, Homo sapiens; identical to SEQ ID NO: 39906
  chr3:44938829-44938859
  hypo

SEQ ID NO: 60437 - DNA, 34 bp, Homo sapiens; identical to SEQ ID NO: 39907
  chr3:44999995-45000029
  hypo

SEQ ID NO: 60438 - DNA, 30 bp, Homo sapiens; identical to SEQ ID NO: 39908
  chr3:45821641-45821671
  hypo

SEQ ID NO: 60439 - DNA, 30 bp, Homo sapiens; identical to SEQ ID NO: 14530
  chr3:45885052-45885082
  hypo

SEQ ID NO: 60440 - DNA, 37 bp, Homo sapiens; identical to SEQ ID NO: 39910
  chr3:46584785-46584822
  hypo

SEQ ID NO: 60441 - DNA, 46 bp, Homo sapiens; identical to SEQ ID NO: 39911
  chr3:46949012-46949058
  hypo

SEQ ID NO: 60442 - DNA, 22 bp, Homo sapiens
  chr3:47555871-47555893
  hypo
gccgacacggaattatatcttg

SEQ ID NO: 60443 - DNA, 459 bp, Homo sapiens; identical to SEQ ID NO: 39915
  chr3:48636676-48637135
  hypo

SEQ ID NO: 60444 - DNA, 30 bp, Homo sapiens; identical to SEQ ID NO: 39916
  chr3:48883988-48884018
  hypo

SEQ ID NO: 60445 - DNA, 30 bp, Homo sapiens; identical to SEQ ID NO: 14534
  chr3:48948476-48948506
  hypo

SEQ ID NO: 60446 - DNA, 90 bp, Homo sapiens; identical to SEQ ID NO: 39918
  chr3:49034204-49034294
  hypo

SEQ ID NO: 60447 - DNA, 21 bp, Homo sapiens
  chr3:49056918-49056939
  hypo
tttttttttttgagacggagt

SEQ ID NO: 60448 - DNA, 48 bp, Homo sapiens; identical to SEQ ID NO: 39920
  chr3:49057282-49057330
  hypo

SEQ ID NO: 60449 - DNA, 30 bp, Homo sapiens; identical to SEQ ID NO: 39921
  chr3:49140985-49141015
  hypo

SEQ ID NO: 60450 - DNA, 25 bp, Homo sapiens
  chr3:49189546-49189571
  hypo
ggccgggcacagtggcgcacgcctg

SEQ ID NO: 60451 - DNA, 51 bp, Homo sapiens; identical to SEQ ID NO: 39923
  chr3:49755535-49755586
  hypo

SEQ ID NO: 60452 - DNA, 229 bp, Homo sapiens
  chr3:49939702-49939931
  hypo
cgcctgcccccccaccgcgcccccagatcccctcagtgatggaagggaagcagcctgtgttcagccatgtgcatgcagctcacaagtaagggccccttctttcagcttaccgggttggggcaaaaactgggcgactggaagaagtcgaggcctcgccggaggcctggatggactggggattcacaacagcgctccacaccctcatcaattagtgtgtccagcaggtcaa

SEQ ID NO: 60453 - DNA, 196 bp, Homo sapiens
  chr3:49940398-49940594
  hypo
gagcgtgggctgaagctggcagccacggctgcgtccagtgaggatgccacgtagaaataggaggcctggccttgctcaaccacagttacacgggtgcccaatgggctggccacacagtcggggcagtcatcgggccggttatggtgggctgagaagaggcaggctggcgctgccagatgcacggctgtcccttggg

SEQ ID NO: 60454 - DNA, 43 bp, Homo sapiens; identical to SEQ ID NO: 39926
  chr3:50425370-50425413
  hypo

SEQ ID NO: 60455 - DNA, 30 bp, Homo sapiens; identical to SEQ ID NO: 39927
  chr3:50426624-50426654
  hypo

SEQ ID NO: 60456 - DNA, 192 bp, Homo sapiens; identical to SEQ ID NO: 39928
  chr3:50433950-50434142
  hypo

SEQ ID NO: 60457 - DNA, 14 bp, Homo sapiens
  chr3:50575602-50575616
  hypo
ggggctcaagcaat

SEQ ID NO: 60458 - DNA, 20 bp, Homo sapiens
  chr3:52352335-52352355
  hypo
acaggcgtgagccactgcgc

SEQ ID NO: 60459 - DNA, 128 bp, Homo sapiens; identical to SEQ ID NO: 39931
  chr3:52415830-52415958
  hypo

SEQ ID NO: 60460 - DNA, 30 bp, Homo sapiens; identical to SEQ ID NO: 39932
  chr3:52429714-52429744
  hypo

SEQ ID NO: 60461 - DNA, 30 bp, Homo sapiens; identical to SEQ ID NO: 39933
  chr3:52537738-52537768
  hypo

SEQ ID NO: 60462 - DNA, 240 bp, Homo sapiens; identical to SEQ ID NO: 14543
  chr3:52553207-52553447
  hypo

SEQ ID NO: 60463 - DNA, 30 bp, Homo sapiens; identical to SEQ ID NO: 39936
  chr3:52599737-52599767
  hypo

SEQ ID NO: 60464 - DNA, 135 bp, Homo sapiens; identical to SEQ ID NO: 39937
  chr3:52900714-52900849
  hypo

SEQ ID NO: 60465 - DNA, 31 bp, Homo sapiens; identical to SEQ ID NO: 39938
  chr3:53032137-53032168
  hypo

SEQ ID NO: 60466 - DNA, 111 bp, Homo sapiens
  chr3:53033524-53033635
  hypo
aagccttggccagtgctcttttggtgtatcccttcagcttccagaggggaagccacaccctgatgctatgttcaaacgctccagaagacaggagttcgtgtccttgcccct

SEQ ID NO: 60467 - DNA, 30 bp, Homo sapiens; identical to SEQ ID NO: 39940
  chr3:53217535-53217565
  hypo

SEQ ID NO: 60468 - DNA, 38 bp, Homo sapiens; identical to SEQ ID NO: 39941
  chr3:56718243-56718281
  hypo

SEQ ID NO: 60469 - DNA, 28 bp, Homo sapiens
  chr3:57740997-57741025
  hypo
gagccaccgcgcccggcctaattgctac

SEQ ID NO: 60470 - DNA, 187 bp, Homo sapiens; identical to SEQ ID NO: 39943
  chr3:58456517-58456704
  hypo

SEQ ID NO: 60471 - DNA, 30 bp, Homo sapiens; identical to SEQ ID NO: 39944
  chr3:67047776-67047806
  hypo

SEQ ID NO: 60472 - DNA, 31 bp, Homo sapiens; identical to SEQ ID NO: 39945
  chr3:68834960-68834991
  hypo

SEQ ID NO: 60473 - DNA, 81 bp, Homo sapiens; identical to SEQ ID NO: 39946
  chr3:69741003-69741084
  hypo

SEQ ID NO: 60474 - DNA, 21 bp, Homo sapiens
  chr3:70083716-70083737
  hypo
aggcgtggtggctcacgctta

SEQ ID NO: 60475 - DNA, 30 bp, Homo sapiens; identical to SEQ ID NO: 39948
  chr3:72305951-72305981
  hypo

SEQ ID NO: 60476 - DNA, 30 bp, Homo sapiens; identical to SEQ ID NO: 39949
  chr3:72773579-72773609
  hypo

SEQ ID NO: 60477 - DNA, 28 bp, Homo sapiens
  chr3:73045129-73045157
  hypo
tttttgaaacagtctcgctttgtcgcct

SEQ ID NO: 60478 - DNA, 22 bp, Homo sapiens
  chr3:73045583-73045605
  hypo
ttctgaacgtgaagtgtataca

SEQ ID NO: 60479 - DNA, 165 bp, Homo sapiens; identical to SEQ ID NO: 39952
  chr3:73498616-73498781
  hypo

SEQ ID NO: 60480 - DNA, 32 bp, Homo sapiens; identical to SEQ ID NO: 39953
  chr3:86960228-86960260
  hypo

SEQ ID NO: 60481 - DNA, 28 bp, Homo sapiens
  chr3:87226527-87226555
  hypo
tcagtgtgtttcacggaatagttttgga

SEQ ID NO: 60482 - DNA, 163 bp, Homo sapiens; identical to SEQ ID NO: 14551
  chr3:87782694-87782857
  hypo

SEQ ID NO: 60483 - DNA, 28 bp, Homo sapiens
  chr3:87881755-87881783
  hypo
gcgtgagccaccgcgcccagccagaata

SEQ ID NO: 60484 - DNA, 18 bp, Homo sapiens
  chr3:93697929-93697947
  hypo
tatttatttttgagacgg

SEQ ID NO: 60485 - DNA, 30 bp, Homo sapiens; identical to SEQ ID NO: 39959
  chr3:93801136-93801166
  hypo

SEQ ID NO: 60486 - DNA, 52 bp, Homo sapiens; identical to SEQ ID NO: 39960
  chr3:97200376-97200428
  hypo

SEQ ID NO: 60487 - DNA, 31 bp, Homo sapiens; identical to SEQ ID NO: 39961
  chr3:98029454-98029485
  hypo

SEQ ID NO: 60488 - DNA, 34 bp, Homo sapiens; identical to SEQ ID NO: 23958
  chr3:101231070-101231104
  hypo

SEQ ID NO: 60489 - DNA, 36 bp, Homo sapiens
  chr3:101397204-101397240
  hypo
tttcccccatggggtcgggcagtgagagcagaagac

SEQ ID NO: 60490 - DNA, 30 bp, Homo sapiens; identical to SEQ ID NO: 39964
  chr3:107632034-107632064
  hypo

SEQ ID NO: 60491 - DNA, 30 bp, Homo sapiens; identical to SEQ ID NO: 39965
  chr3:107771985-107772015
  hypo

SEQ ID NO: 60492 - DNA, 30 bp, Homo sapiens; identical to SEQ ID NO: 14555
  chr3:107833994-107834024
  hypo

SEQ ID NO: 60493 - DNA, 34 bp, Homo sapiens; identical to SEQ ID NO: 39967
  chr3:111988003-111988037
  hypo

SEQ ID NO: 60494 - DNA, 18 bp, Homo sapiens
  chr3:113557458-113557476
  hypo
tttcgcacattggggcag

SEQ ID NO: 60495 - DNA, 30 bp, Homo sapiens; identical to SEQ ID NO: 39969
  chr3:113958215-113958245
  hypo

SEQ ID NO: 60496 - DNA, 36 bp, Homo sapiens; identical to SEQ ID NO: 39970
  chr3:115502421-115502457
  hypo

SEQ ID NO: 60497 - DNA, 71 bp, Homo sapiens; identical to SEQ ID NO: 39971
  chr3:115752446-115752517
  hypo

SEQ ID NO: 60498 - DNA, 148 bp, Homo sapiens; identical to SEQ ID NO: 39972
  chr3:116990241-116990389
  hypo

SEQ ID NO: 60499 - DNA, 37 bp, Homo sapiens; identical to SEQ ID NO: 14558
  chr3:118976384-118976421
  hypo

SEQ ID NO: 60500 - DNA, 30 bp, Homo sapiens; identical to SEQ ID NO: 39974
  chr3:119055204-119055234
  hypo

SEQ ID NO: 60501 - DNA, 98 bp, Homo sapiens; identical to SEQ ID NO: 39975
  chr3:119815404-119815502
  hypo

SEQ ID NO: 60502 - DNA, 180 bp, Homo sapiens; identical to SEQ ID NO: 39976
  chr3:119815742-119815922
  hypo

SEQ ID NO: 60503 - DNA, 18 bp, Homo sapiens
  chr3:119817451-119817469
  hypo
aaacgctaggattactgg

SEQ ID NO: 60504 - DNA, 25 bp, Homo sapiens
  chr3:121265940-121265965
  hypo
aaataaaagagatctcgccggccgt

SEQ ID NO: 60505 - DNA, 30 bp, Homo sapiens; identical to SEQ ID NO: 39979
  chr3:121438641-121438671
  hypo

SEQ ID NO: 60506 - DNA, 82 bp, Homo sapiens; identical to SEQ ID NO: 39980
  chr3:121563924-121564006
  hypo

SEQ ID NO: 60507 - DNA, 34 bp, Homo sapiens; identical to SEQ ID NO: 39981
  chr3:121638037-121638071
  hypo

SEQ ID NO: 60508 - DNA, 30 bp, Homo sapiens; identical to SEQ ID NO: 39982
  chr3:121980857-121980887
  hypo

SEQ ID NO: 60509 - DNA, 30 bp, Homo sapiens; identical to SEQ ID NO: 39983
  chr3:122100925-122100955
  hypo

SEQ ID NO: 60510 - DNA, 38 bp, Homo sapiens; identical to SEQ ID NO: 39984
  chr3:122231278-122231316
  hypo

SEQ ID NO: 60511 - DNA, 25 bp, Homo sapiens
  chr3:122234217-122234242
  hypo
gcttgataacgtatgcgtagtatca

SEQ ID NO: 60512 - DNA, 91 bp, Homo sapiens; identical to SEQ ID NO: 39986
  chr3:122234549-122234640
  hypo

SEQ ID NO: 60513 - DNA, 29 bp, Homo sapiens
  chr3:122573648-122573677
  hypo
gactcaaaggctgggcgcggtggctcacg

SEQ ID NO: 60514 - DNA, 13 bp, Homo sapiens
  chr3:122702275-122702288
  hypo
gcacaataaatca

SEQ ID NO: 60515 - DNA, 102 bp, Homo sapiens; identical to SEQ ID NO: 14566
  chr3:125456444-125456546
  hypo

SEQ ID NO: 60516 - DNA, 39 bp, Homo sapiens; identical to SEQ ID NO: 14567
  chr3:125785793-125785832
  hypo

SEQ ID NO: 60517 - DNA, 98 bp, Homo sapiens; identical to SEQ ID NO: 39991
  chr3:126134590-126134688
  hypo

SEQ ID NO: 60518 - DNA, 35 bp, Homo sapiens; identical to SEQ ID NO: 39992
  chr3:126138969-126139004
  hypo

SEQ ID NO: 60519 - DNA, 167 bp, Homo sapiens; identical to SEQ ID NO: 39993
  chr3:126195886-126196053
  hypo

SEQ ID NO: 60520 - DNA, 77 bp, Homo sapiens; identical to SEQ ID NO: 39994
  chr3:127394832-127394909
  hypo

SEQ ID NO: 60521 - DNA, 48 bp, Homo sapiens; identical to SEQ ID NO: 39995
  chr3:127395914-127395962
  hypo

SEQ ID NO: 60522 - DNA, 68 bp, Homo sapiens; identical to SEQ ID NO: 39996
  chr3:127534964-127535032
  hypo

SEQ ID NO: 60523 - DNA, 90 bp, Homo sapiens; identical to SEQ ID NO: 39997
  chr3:127536741-127536831
  hypo

SEQ ID NO: 60524 - DNA, 52 bp, Homo sapiens; identical to SEQ ID NO: 39998
  chr3:127637657-127637709
  hypo

SEQ ID NO: 60525 - DNA, 30 bp, Homo sapiens; identical to SEQ ID NO: 39999
  chr3:128346689-128346719
  hypo

SEQ ID NO: 60526 - DNA, 80 bp, Homo sapiens; identical to SEQ ID NO: 40000
  chr3:128599546-128599626
  hypo

SEQ ID NO: 60527 - DNA, 34 bp, Homo sapiens; identical to SEQ ID NO: 40001
  chr3:128611894-128611928
  hypo

SEQ ID NO: 60528 - DNA, 30 bp, Homo sapiens; identical to SEQ ID NO: 40002
  chr3:128765921-128765951
  hypo

SEQ ID NO: 60529 - DNA, 41 bp, Homo sapiens; identical to SEQ ID NO: 40003
  chr3:128790177-128790218
  hypo

SEQ ID NO: 60530 - DNA, 72 bp, Homo sapiens; identical to SEQ ID NO: 40004
  chr3:130127080-130127152
  hypo

SEQ ID NO: 60531 - DNA, 217 bp, Homo sapiens; identical to SEQ ID NO: 40005
  chr3:130474409-130474626
  hypo

SEQ ID NO: 60532 - DNA, 30 bp, Homo sapiens; identical to SEQ ID NO: 40007
  chr3:133101687-133101717
  hypo

SEQ ID NO: 60533 - DNA, 220 bp, Homo sapiens; identical to SEQ ID NO: 40008
  chr3:134320427-134320647
  hypo

SEQ ID NO: 60534 - DNA, 30 bp, Homo sapiens; identical to SEQ ID NO: 40009
  chr3:134624264-134624294
  hypo

SEQ ID NO: 60535 - DNA, 109 bp, Homo sapiens
  chr3:136582951-136583060
  hypo
aataaaatgtgtatttatttttctaggcattatcctttgtccaggtttctgcagtgctttcaggtccatctaaataaaatttgaaacctacgtgtaatgttggccgggc

SEQ ID NO: 60536 - DNA, 17 bp, Homo sapiens
  chr3:137561189-137561206
  hypo
agtctagctattggccg

SEQ ID NO: 60537 - DNA, 84 bp, Homo sapiens; identical to SEQ ID NO: 40012
  chr3:137717830-137717914
  hypo

SEQ ID NO: 60538 - DNA, 22 bp, Homo sapiens
  chr3:138058968-138058990
  hypo
gccaccgcgcccagccagcatc

SEQ ID NO: 60539 - DNA, 53 bp, Homo sapiens
  chr3:141174296-141174349
  hypo
ggccgccattttcgtcgtctcttatcacgatgggaatcagcgttctctgctgc

SEQ ID NO: 60540 - DNA, 33 bp, Homo sapiens; identical to SEQ ID NO: 23976
  chr3:141482073-141482106
  hypo

SEQ ID NO: 60541 - DNA, 30 bp, Homo sapiens; identical to SEQ ID NO: 40016
  chr3:142337360-142337390
  hypo

SEQ ID NO: 60542 - DNA, 17 bp, Homo sapiens
  chr3:142802592-142802609
  hypo
agcgtgagccaccgtgc

SEQ ID NO: 60543 - DNA, 24 bp, Homo sapiens
  chr3:142853160-142853184
  hypo
gggctcaagcgatcctcccatcta

SEQ ID NO: 60544 - DNA, 30 bp, Homo sapiens; identical to SEQ ID NO: 40020
  chr3:142896285-142896315
  hypo

SEQ ID NO: 60545 - DNA, 35 bp, Homo sapiens; identical to SEQ ID NO: 5001
  chr3:142913215-142913250
  hypo

SEQ ID NO: 60546 - DNA, 30 bp, Homo sapiens; identical to SEQ ID NO: 40022
  chr3:142973621-142973651
  hypo

SEQ ID NO: 60547 - DNA, 30 bp, Homo sapiens; identical to SEQ ID NO: 40023
  chr3:142973851-142973881
  hypo

SEQ ID NO: 60548 - DNA, 21 bp, Homo sapiens
  chr3:142977041-142977062
  hypo
acagagcgatactccatctca

SEQ ID NO: 60549 - DNA, 45 bp, Homo sapiens; identical to SEQ ID NO: 14579
  chr3:143092973-143093018
  hypo

SEQ ID NO: 60550 - DNA, 34 bp, Homo sapiens; identical to SEQ ID NO: 40026
  chr3:143151477-143151511
  hypo

SEQ ID NO: 60551 - DNA, 38 bp, Homo sapiens; identical to SEQ ID NO: 40027
  chr3:143210840-143210878
  hypo

SEQ ID NO: 60552 - DNA, 26 bp, Homo sapiens
  chr3:146187920-146187946
  hypo
gtgaaaatgatgaggcgtgtagaatg

SEQ ID NO: 60553 - DNA, 37 bp, Homo sapiens; identical to SEQ ID NO: 40029
  chr3:146188305-146188342
  hypo

SEQ ID NO: 60554 - DNA, 43 bp, Homo sapiens; identical to SEQ ID NO: 40030
  chr3:148472167-148472210
  hypo

SEQ ID NO: 60555 - DNA, 20 bp, Homo sapiens
  chr3:148556015-148556035
  hypo
cagagcgagactctgtctca

SEQ ID NO: 60556 - DNA, 41 bp, Homo sapiens; identical to SEQ ID NO: 40032
  chr3:148705411-148705452
  hypo

SEQ ID NO: 60557 - DNA, 27 bp, Homo sapiens
  chr3:148802983-148803010
  hypo
actacaattatgggccggatgcggtgg

SEQ ID NO: 60558 - DNA, 30 bp, Homo sapiens; identical to SEQ ID NO: 40035
  chr3:149956581-149956611
  hypo

SEQ ID NO: 60559 - DNA, 161 bp, Homo sapiens; identical to SEQ ID NO: 14584
  chr3:150135175-150135336
  hypo

SEQ ID NO: 60560 - DNA, 88 bp, Homo sapiens; identical to SEQ ID NO: 40037
  chr3:150237908-150237996
  hypo

SEQ ID NO: 60561 - DNA, 90 bp, Homo sapiens; identical to SEQ ID NO: 40038
  chr3:152321039-152321129
  hypo

SEQ ID NO: 60562 - DNA, 30 bp, Homo sapiens; identical to SEQ ID NO: 40039
  chr3:152332728-152332758
  hypo

SEQ ID NO: 60563 - DNA, 27 bp, Homo sapiens
  chr3:152829598-152829625
  hypo
ggcgtgagcgaccgcacccagctgata

SEQ ID NO: 60564 - DNA, 30 bp, Homo sapiens; identical to SEQ ID NO: 40041
  chr3:152877598-152877628
  hypo

SEQ ID NO: 60565 - DNA, 25 bp, Homo sapiens
  chr3:152979662-152979687
  hypo
ccaccacgtccggccaactcatatt

SEQ ID NO: 60566 - DNA, 30 bp, Homo sapiens; identical to SEQ ID NO: 40043
  chr3:152999015-152999045
  hypo

SEQ ID NO: 60567 - DNA, 18 bp, Homo sapiens
  chr3:153018756-153018774
  hypo
aaaaatatgattggccgg

SEQ ID NO: 60568 - DNA, 23 bp, Homo sapiens
  chr3:154623592-154623615
  hypo
cgagactccgtctcaaaaaaaat

SEQ ID NO: 60569 - DNA, 101 bp, Homo sapiens; identical to SEQ ID NO: 40046
  chr3:157303466-157303567
  hypo

SEQ ID NO: 60570 - DNA, 30 bp, Homo sapiens; identical to SEQ ID NO: 40047
  chr3:166984418-166984448
  hypo

SEQ ID NO: 60571 - DNA, 30 bp, Homo sapiens; identical to SEQ ID NO: 40048
  chr3:168490451-168490481
  hypo

SEQ ID NO: 60572 - DNA, 64 bp, Homo sapiens; identical to SEQ ID NO: 40049
  chr3:169485397-169485461
  hypo

SEQ ID NO: 60573 - DNA, 47 bp, Homo sapiens
  chr3:169541102-169541149
  hypo
gctgccaggctccagggtctacattcttttttttttttttttctctt

SEQ ID NO: 60574 - DNA, 42 bp, Homo sapiens; identical to SEQ ID NO: 40052
  chr3:169980664-169980706
  hypo

SEQ ID NO: 60575 - DNA, 145 bp, Homo sapiens; identical to SEQ ID NO: 40054
  chr3:172033174-172033319
  hypo

SEQ ID NO: 60576 - DNA, 58 bp, Homo sapiens; identical to SEQ ID NO: 14590
  chr3:172384961-172385019
  hypo

SEQ ID NO: 60577 - DNA, 31 bp, Homo sapiens; identical to SEQ ID NO: 40059
  chr3:172470196-172470227
  hypo

SEQ ID NO: 60578 - DNA, 162 bp, Homo sapiens; identical to SEQ ID NO: 40060
  chr3:172727266-172727428
  hypo

SEQ ID NO: 60579 - DNA, 92 bp, Homo sapiens; identical to SEQ ID NO: 40061
  chr3:172858998-172859090
  hypo

SEQ ID NO: 60580 - DNA, 24 bp, Homo sapiens
  chr3:176545097-176545121
  hypo
aaaagagaatttttccgacgggtg

SEQ ID NO: 60581 - DNA, 41 bp, Homo sapiens; identical to SEQ ID NO: 40063
  chr3:176872455-176872496
  hypo

SEQ ID NO: 60582 - DNA, 77 bp, Homo sapiens; identical to SEQ ID NO: 40064
  chr3:176897068-176897145
  hypo

SEQ ID NO: 60583 - DNA, 28 bp, Homo sapiens
  chr3:178577720-178577748
  hypo
aaacaaaataaagttcggaaggggagcc

SEQ ID NO: 60584 - DNA, 30 bp, Homo sapiens; identical to SEQ ID NO: 40067
  chr3:179136841-179136871
  hypo

SEQ ID NO: 60585 - DNA, 23 bp, Homo sapiens
  chr3:179171196-179171219
  hypo
accgatcccggccccatattctt

SEQ ID NO: 60586 - DNA, 30 bp, Homo sapiens; identical to SEQ ID NO: 40070
  chr3:180042862-180042892
  hypo

SEQ ID NO: 60587 - DNA, 323 bp, Homo sapiens; identical to SEQ ID NO: 40071
  chr3:182314974-182315297
  hypo

SEQ ID NO: 60588 - DNA, 21 bp, Homo sapiens
  chr3:182704506-182704527
  hypo
agcaaatgggctgggcgcggt

SEQ ID NO: 60589 - DNA, 30 bp, Homo sapiens; identical to SEQ ID NO: 40073
  chr3:182800477-182800507
  hypo

SEQ ID NO: 60590 - DNA, 19 bp, Homo sapiens
  chr3:182812783-182812802
  hypo
tgccctggccaggcacggt

SEQ ID NO: 60591 - DNA, 52 bp, Homo sapiens; identical to SEQ ID NO: 40077
  chr3:182987877-182987929
  hypo

SEQ ID NO: 60592 - DNA, 30 bp, Homo sapiens; identical to SEQ ID NO: 40078
  chr3:183035309-183035339
  hypo

SEQ ID NO: 60593 - DNA, 29 bp, Homo sapiens
  chr3:183183673-183183702
  hypo
gtgagccactgccccgggccatgaaaaaa

SEQ ID NO: 60594 - DNA, 30 bp, Homo sapiens; identical to SEQ ID NO: 40080
  chr3:183603067-183603097
  hypo

SEQ ID NO: 60595 - DNA, 172 bp, Homo sapiens; identical to SEQ ID NO: 40081
  chr3:183622013-183622185
  hypo

SEQ ID NO: 60596 - DNA, 30 bp, Homo sapiens; identical to SEQ ID NO: 14600
  chr3:183648152-183648182
  hypo

SEQ ID NO: 60597 - DNA, 222 bp, Homo sapiens; identical to SEQ ID NO: 40083
  chr3:183684023-183684245
  hypo

SEQ ID NO: 60598 - DNA, 34 bp, Homo sapiens; identical to SEQ ID NO: 40084
  chr3:183713864-183713898
  hypo

SEQ ID NO: 60599 - DNA, 16 bp, Homo sapiens
  chr3:183965935-183965951
  hypo
ccggcagaaatgcatc

SEQ ID NO: 60600 - DNA, 26 bp, Homo sapiens
  chr3:184016195-184016221
  hypo
atgaggttaataggccgggcgcggtg

SEQ ID NO: 60601 - DNA, 51 bp, Homo sapiens
  chr3:184018136-184018187
  hypo
tccatgacttcagtgcccaagcctctcaaatttctgcgtccacactatggc

SEQ ID NO: 60602 - DNA, 71 bp, Homo sapiens; identical to SEQ ID NO: 40090
  chr3:184200659-184200730
  hypo

SEQ ID NO: 60603 - DNA, 30 bp, Homo sapiens; identical to SEQ ID NO: 40091
  chr3:184226786-184226816
  hypo

SEQ ID NO: 60604 - DNA, 109 bp, Homo sapiens; identical to SEQ ID NO: 40092
  chr3:184785147-184785256
  hypo

SEQ ID NO: 60605 - DNA, 16 bp, Homo sapiens
  chr3:185001919-185001935
  hypo
gcggccactttccttt

SEQ ID NO: 60606 - DNA, 23 bp, Homo sapiens
  chr3:185270882-185270905
  hypo
aaaagaaaaacaggccggcacgg

SEQ ID NO: 60607 - DNA, 30 bp, Homo sapiens; identical to SEQ ID NO: 14609
  chr3:185278325-185278355
  hypo

SEQ ID NO: 60608 - DNA, 73 bp, Homo sapiens
  chr3:185363001-185363074
  hypo
aactaaaagggatagcgtcgtgggagttcaggagagatccgagtggatggtgaagtggatggctgaagcctgc

SEQ ID NO: 60609 - DNA, 44 bp, Homo sapiens; identical to SEQ ID NO: 24001
  chr3:185363261-185363305
  hypo

SEQ ID NO: 60610 - DNA, 136 bp, Homo sapiens; identical to SEQ ID NO: 40098
  chr3:185385541-185385677
  hypo

SEQ ID NO: 60611 - DNA, 30 bp, Homo sapiens; identical to SEQ ID NO: 40099
  chr3:185504526-185504556
  hypo

SEQ ID NO: 60612 - DNA, 25 bp, Homo sapiens
  chr3:185551925-185551950
  hypo
atcccaggctgggtgcggtggctca

SEQ ID NO: 60613 - DNA, 91 bp, Homo sapiens; identical to SEQ ID NO: 40102
  chr3:185667518-185667609
  hypo

SEQ ID NO: 60614 - DNA, 21 bp, Homo sapiens
  chr3:186019128-186019149
  hypo
tccatgtgacgggtgcggtgg

SEQ ID NO: 60615 - DNA, 30 bp, Homo sapiens; identical to SEQ ID NO: 40104
  chr3:186495172-186495202
  hypo

SEQ ID NO: 60616 - DNA, 78 bp, Homo sapiens; identical to SEQ ID NO: 40105
  chr3:186527185-186527263
  hypo

SEQ ID NO: 60617 - DNA, 30 bp, Homo sapiens; identical to SEQ ID NO: 40106
  chr3:187416788-187416818
  hypo

SEQ ID NO: 60618 - DNA, 190 bp, Homo sapiens; identical to SEQ ID NO: 40107
  chr3:187870406-187870596
  hypo

SEQ ID NO: 60619 - DNA, 29 bp, Homo sapiens
  chr3:190065742-190065771
  hypo
agaccatgggctgggcgcggtggctcaca

SEQ ID NO: 60620 - DNA, 30 bp, Homo sapiens; identical to SEQ ID NO: 40109
  chr3:193093790-193093820
  hypo

SEQ ID NO: 60621 - DNA, 107 bp, Homo sapiens; identical to SEQ ID NO: 24003
  chr3:193548530-193548637
  hypo

SEQ ID NO: 60622 - DNA, 35 bp, Homo sapiens; identical to SEQ ID NO: 40112
  chr3:193588124-193588159
  hypo

SEQ ID NO: 60623 - DNA, 30 bp, Homo sapiens; identical to SEQ ID NO: 40113
  chr3:193656666-193656696
  hypo

SEQ ID NO: 60624 - DNA, 30 bp, Homo sapiens; identical to SEQ ID NO: 40114
  chr3:193774655-193774685
  hypo

SEQ ID NO: 60625 - DNA, 36 bp, Homo sapiens; identical to SEQ ID NO: 14616
  chr3:193922775-193922811
  hypo

SEQ ID NO: 60626 - DNA, 18 bp, Homo sapiens
  chr3:194041075-194041093
  hypo
agcactttgggaggccga

SEQ ID NO: 60627 - DNA, 29 bp, Homo sapiens
  chr3:194048919-194048948
  hypo
gggccctctgtggacgttagtctgctctg

SEQ ID NO: 60628 - DNA, 30 bp, Homo sapiens; identical to SEQ ID NO: 40118
  chr3:194128418-194128448
  hypo

SEQ ID NO: 60629 - DNA, 30 bp, Homo sapiens; identical to SEQ ID NO: 40119
  chr3:195183871-195183901
  hypo

SEQ ID NO: 60630 - DNA, 30 bp, Homo sapiens; identical to SEQ ID NO: 14618
  chr3:195536686-195536716
  hypo

SEQ ID NO: 60631 - DNA, 35 bp, Homo sapiens
  chr3:195586997-195587032
  hypo
caggatcacgagagccgcctctaacccacccccaa

SEQ ID NO: 60632 - DNA, 144 bp, Homo sapiens
  chr3:195587118-195587262
  hypo
ccacctgcagcgctttcgtccctacctggcgttcaccgttctcacccatcacatcagcacaacgtgaccttgtggggagccacctcctctgctcccaagacacctggtgcgtaacgattacagagcacccgtcctgccgtgatg

SEQ ID NO: 60633 - DNA, 72 bp, Homo sapiens; identical to SEQ ID NO: 40123
  chr3:195597490-195597562
  hypo

SEQ ID NO: 60634 - DNA, 108 bp, Homo sapiens; identical to SEQ ID NO: 40124
  chr3:195599732-195599840
  hypo

SEQ ID NO: 60635 - DNA, 485 bp, Homo sapiens; identical to SEQ ID NO: 40125
  chr3:195600086-195600571
  hypo

SEQ ID NO: 60636 - DNA, 112 bp, Homo sapiens; identical to SEQ ID NO: 40126
  chr3:195600916-195601028
  hypo

SEQ ID NO: 60637 - DNA, 40 bp, Homo sapiens; identical to SEQ ID NO: 40127
  chr3:195601324-195601364
  hypo

SEQ ID NO: 60638 - DNA, 30 bp, Homo sapiens; identical to SEQ ID NO: 40128
  chr3:195603893-195603923
  hypo

SEQ ID NO: 60639 - DNA, 37 bp, Homo sapiens; identical to SEQ ID NO: 40129
  chr3:195604262-195604299
  hypo

SEQ ID NO: 60640 - DNA, 30 bp, Homo sapiens; identical to SEQ ID NO: 40130
  chr3:195604945-195604975
  hypo

SEQ ID NO: 60641 - DNA, 55 bp, Homo sapiens; identical to SEQ ID NO: 40131
  chr3:195637288-195637343
  hypo

SEQ ID NO: 60642 - DNA, 72 bp, Homo sapiens
  chr3:195648722-195648794
  hypo
acagaggagcacttccgtcacccaggaacacggctctgatcaaggaattcaagaacccaacagaaaaataca

SEQ ID NO: 60643 - DNA, 30 bp, Homo sapiens; identical to SEQ ID NO: 40133
  chr3:195835032-195835062
  hypo

SEQ ID NO: 60644 - DNA, 30 bp, Homo sapiens; identical to SEQ ID NO: 40134
  chr3:195874797-195874827
  hypo

SEQ ID NO: 60645 - DNA, 16 bp, Homo sapiens
  chr3:195926800-195926816
  hypo
gcgacactctggctca

SEQ ID NO: 60646 - DNA, 36 bp, Homo sapiens; identical to SEQ ID NO: 40136
  chr3:195993024-195993060
  hypo

SEQ ID NO: 60647 - DNA, 37 bp, Homo sapiens; identical to SEQ ID NO: 40137
  chr3:196056123-196056160
  hypo

SEQ ID NO: 60648 - DNA, 30 bp, Homo sapiens; identical to SEQ ID NO: 40138
  chr3:196063648-196063678
  hypo

SEQ ID NO: 60649 - DNA, 26 bp, Homo sapiens
  chr3:196226403-196226429
  hypo
ctaaaacagcccggacgcggtggctc

SEQ ID NO: 60650 - DNA, 78 bp, Homo sapiens; identical to SEQ ID NO: 40141
  chr3:196256227-196256305
  hypo

SEQ ID NO: 60651 - DNA, 30 bp, Homo sapiens; identical to SEQ ID NO: 14628
  chr3:196294577-196294607
  hypo

SEQ ID NO: 60652 - DNA, 30 bp, Homo sapiens; identical to SEQ ID NO: 40143
  chr3:196386861-196386891
  hypo

SEQ ID NO: 60653 - DNA, 137 bp, Homo sapiens; identical to SEQ ID NO: 24015
  chr3:196387158-196387295
  hypo

SEQ ID NO: 60654 - DNA, 213 bp, Homo sapiens; identical to SEQ ID NO: 24016
  chr3:196387415-196387628
  hypo

SEQ ID NO: 60655 - DNA, 50 bp, Homo sapiens
  chr3:196388333-196388383
  hypo
tgcagcatgggcagacggtggccgactgggccatggtcacctgcaacctc

SEQ ID NO: 60656 - DNA, 17 bp, Homo sapiens
  chr3:196388581-196388598
  hypo
tccgtttactgacctgg

SEQ ID NO: 60657 - DNA, 41 bp, Homo sapiens; identical to SEQ ID NO: 40146
  chr3:196402166-196402207
  hypo

SEQ ID NO: 60658 - DNA, 30 bp, Homo sapiens; identical to SEQ ID NO: 40147
  chr3:196731020-196731050
  hypo

SEQ ID NO: 60659 - DNA, 216 bp, Homo sapiens
  chr3:196731313-196731529
  hypo
gctgagcacttcttggccttttccataaggctttctcactctgtcttacagatatctccccacaaacctaaacaatttcgagagggacttgtgttctgcaaccagtcacagaatatcaggtgagctgggcgtgtcttcactgacccacccgcccagggatgctgcactcctctccaccctgctcagaatcactagaatgaccgttctgtggctaca

SEQ ID NO: 60660 - DNA, 220 bp, Homo sapiens; identical to SEQ ID NO: 40149
  chr3:196754516-196754736
  hypo

SEQ ID NO: 60661 - DNA, 30 bp, Homo sapiens; identical to SEQ ID NO: 40150
  chr3:196784239-196784269
  hypo

SEQ ID NO: 60662 - DNA, 39 bp, Homo sapiens; identical to SEQ ID NO: 40151
  chr3:197313900-197313939
  hypo

SEQ ID NO: 60663 - DNA, 282 bp, Homo sapiens
  chr3:197327042-197327324
  hypo
ttctttacttttctagtcataacctattttcagctggaaaccagaaaggctggttctatgtgcagatggcaatgctgaggtttagaggtaaaacacccacctgaagtgaatagaggctggactggaacccaggatggctcacctggaggcggcgctcccatacggcacccggcagcctgttttgtacaggaacaatacttgccttcctccgcaaaaaacaaacaaacaaacaaaaaatgcaggggttgaaaagaaaactgcctgagctgaaaagttttgttg

SEQ ID NO: 60664 - DNA, 52 bp, Homo sapiens; identical to SEQ ID NO: 40153
  chr3:197327804-197327856
  hypo

SEQ ID NO: 60665 - DNA, 66 bp, Homo sapiens; identical to SEQ ID NO: 40154
  chr3:197402137-197402203
  hypo

SEQ ID NO: 60666 - DNA, 1 bp, Homo sapiens
  chr3:197685787-197685788
  hypo
t

SEQ ID NO: 60667 - DNA, 288 bp, Homo sapiens; identical to SEQ ID NO: 40157
  chr4:619531-619819
  hypo

SEQ ID NO: 60668 - DNA, 74 bp, Homo sapiens; identical to SEQ ID NO: 40158
  chr4:628132-628206
  hypo

SEQ ID NO: 60669 - DNA, 128 bp, Homo sapiens
  chr4:628444-628572
  hypo
ctctttcctctcttgcggcagtgccctcacttcagctcatttgctgacgagctcactgactacaagacaaagaatatgctggccacacccatcatgaatggcaaagacgtcgtggcggtgatcatggc

SEQ ID NO: 60670 - DNA, 312 bp, Homo sapiens
  chr4:650884-651196
  hypo
tccccgccaagcattcggctgtgtgcgtgtgctcatgtgtgtgcggtatgcatgcggccagggagaggacgacaaagggcccccccgggagcaggagcctctgcagagcacccgggagaccccacacagaagcactgcgacaccatggtggcagccccaggacctgcccgccgagccacggggcctggcacacaggcacatgggagggggcgcgccgggagcgctgagcgccagtgacactgccatcccctccagtccctgacacagttcctgggctggtcagtgatgaacaccgacacctacgacaagatg

SEQ ID NO: 60671 - DNA, 60 bp, Homo sapiens
  chr4:651261-651321
  hypo
ggacgagatccagctcatcctggtgcggcggggcaggacgtccaggggtcacccaggggt

SEQ ID NO: 60672 - DNA, 335 bp, Homo sapiens; identical to SEQ ID NO: 40161
  chr4:660894-661229
  hypo

SEQ ID NO: 60673 - DNA, 177 bp, Homo sapiens; identical to SEQ ID NO: 40162
  chr4:672016-672193
  hypo

SEQ ID NO: 60674 - DNA, 78 bp, Homo sapiens; identical to SEQ ID NO: 40163
  chr4:676743-676821
  hypo

SEQ ID NO: 60675 - DNA, 131 bp, Homo sapiens
  chr4:678501-678632
  hypo
actgaccagcttgagcccatccaggaacttctctgaggtggagctggcagccccggcagagggcggggtggggggcacactctcccacaggcagatggtggacagcaggcagacgacgccagcagggatgg

SEQ ID NO: 60676 - DNA, 30 bp, Homo sapiens; identical to SEQ ID NO: 40165
  chr4:679038-679068
  hypo

SEQ ID NO: 60677 - DNA, 59 bp, Homo sapiens; identical to SEQ ID NO: 14641
  chr4:718181-718240
  hypo

SEQ ID NO: 60678 - DNA, 76 bp, Homo sapiens; identical to SEQ ID NO: 40167
  chr4:738388-738464
  hypo

SEQ ID NO: 60679 - DNA, 33 bp, Homo sapiens; identical to SEQ ID NO: 40168
  chr4:759808-759841
  hypo

SEQ ID NO: 60680 - DNA, 161 bp, Homo sapiens; identical to SEQ ID NO: 40169
  chr4:828951-829112
  hypo

SEQ ID NO: 60681 - DNA, 51 bp, Homo sapiens
  chr4:829641-829692
  hypo
agctccccgaggaaagagtgcctttgcttcccttgacgtgtcctgcacttt

SEQ ID NO: 60682 - DNA, 183 bp, Homo sapiens
  chr4:955184-955367
  hypo
gccagctgggctcagcggggaccggggacgcccaccctgggctcgcccgcccactcggccggcggctcaccatgtgcacgacgcccgtcacgcccacaacctccagcagcccgtcgtccatgcgtggcttctcaaacctggtgtcgctgtcggagccccacaggtcggcccccgagccccagc

SEQ ID NO: 60683 - DNA, 882 bp, Homo sapiens
  chr4:955919-956801
  hypo
ccctgagctccccaacagctctgccggcaggcagagacaagagcaaggaccaccctggcaccaagccgagcacccaggagagggcagcatgggcaggtcctggccaggctctgtcgccagctggctcagcacaatccccagcagtggctactttctgtgtctccctcaactgcccgctttgcagaggggatgatgcgggcgcgtacacccgagtgtggctgggaagaggacgcccgttgtgacgcgtgtagcggggtcatatgcaggagcctggaaggcaccccacgccgggctgccctgtaccttggggggctctgcgtctgccgtgtcgttctctgcactgccagcctcgtgggcatccagcaggatggtccagcggtccatgagcacggcgtcggcctcgtccacagacagcagtacggagaacgggtcctcgccgctgtagcccgccccccagcggaggactcgaccaaggtcattccctgggacacaagcagacacagagcatctgtccacacccacccgcccatcagctgggtgcagaccccaccacgaggacagccagcccaggcctcggcaaaagctgcacaggaaggggtagaccctgaggccccctcctcggctgcacggctgagcccacctgtgcccaggggcaggatggccacagaaggctccgggcaggccagtcggtaccgtgtctcctccagggcgccaagcacccagcccacagtgccatcgccaccacacaccagcacccggaagcagggcacctgggagaacaggtggagcctagcgggagacaggaagtgtcctctaccagctgcgggcgcagcccatcccccacccaggctgcctcttccaagtgcccgtcctggccgtgtg

SEQ ID NO: 60684 - DNA, 30 bp, Homo sapiens; identical to SEQ ID NO: 40173
  chr4:957020-957050
  hypo

SEQ ID NO: 60685 - DNA, 35 bp, Homo sapiens; identical to SEQ ID NO: 40174
  chr4:1016331-1016366
  hypo

SEQ ID NO: 60686 - DNA, 45 bp, Homo sapiens
  chr4:1016747-1016792
  hypo
gctcctgggtgtggggccctcgggtggagctcctgggagctgggc

SEQ ID NO: 60687 - DNA, 150 bp, Homo sapiens; identical to SEQ ID NO: 40176
  chr4:1016852-1017002
  hypo

SEQ ID NO: 60688 - DNA, 30 bp, Homo sapiens; identical to SEQ ID NO: 40177
  chr4:1022834-1022864
  hypo

SEQ ID NO: 60689 - DNA, 194 bp, Homo sapiens; identical to SEQ ID NO: 40178
  chr4:1024234-1024428
  hypo

SEQ ID NO: 60690 - DNA, 53 bp, Homo sapiens; identical to SEQ ID NO: 24034
  chr4:1025875-1025928
  hypo

SEQ ID NO: 60691 - DNA, 119 bp, Homo sapiens
  chr4:1026074-1026193
  hypo
tctgaggggcaaccccaccagcctgcttgggccccagcgtcttctcagcgtctgcctcctgtgaaaaccttccactcagtaaaggagcacagtaggttggttgccgggccaggctgggg

SEQ ID NO: 60692 - DNA, 294 bp, Homo sapiens; identical to SEQ ID NO: 40180
  chr4:1036245-1036539
  hypo

SEQ ID NO: 60693 - DNA, 38 bp, Homo sapiens; identical to SEQ ID NO: 40181
  chr4:1282473-1282511
  hypo

SEQ ID NO: 60694 - DNA, 163 bp, Homo sapiens; identical to SEQ ID NO: 40182
  chr4:1299056-1299219
  hypo

SEQ ID NO: 60695 - DNA, 185 bp, Homo sapiens; identical to SEQ ID NO: 40183
  chr4:1299450-1299635
  hypo

SEQ ID NO: 60696 - DNA, 30 bp, Homo sapiens; identical to SEQ ID NO: 40184
  chr4:1331816-1331846
  hypo

SEQ ID NO: 60697 - DNA, 119 bp, Homo sapiens; identical to SEQ ID NO: 40185
  chr4:1332541-1332660
  hypo

SEQ ID NO: 60698 - DNA, 222 bp, Homo sapiens; identical to SEQ ID NO: 40186
  chr4:1332878-1333100
  hypo

SEQ ID NO: 60699 - DNA, 27 bp, Homo sapiens
  chr4:1338688-1338715
  hypo
ctggcagaagcttcccggcagagggat

SEQ ID NO: 60700 - DNA, 211 bp, Homo sapiens; identical to SEQ ID NO: 40189
  chr4:1504889-1505100
  hypo

SEQ ID NO: 60701 - DNA, 24 bp, Homo sapiens
  chr4:1512344-1512368
  hypo
tgcggttttaacctgcgttttcct

SEQ ID NO: 60702 - DNA, 21 bp, Homo sapiens
  chr4:1556398-1556419
  hypo
tgtccacccccagaccgcctt

SEQ ID NO: 60703 - DNA, 55 bp, Homo sapiens; identical to SEQ ID NO: 40192
  chr4:1562145-1562200
  hypo

SEQ ID NO: 60704 - DNA, 76 bp, Homo sapiens
  chr4:1576408-1576484
  hypo
ggggccttgcacacacgggcacccctgagacaggcgaggcctggacaggtgcaggaggtgggcctggagccggtgg

SEQ ID NO: 60705 - DNA, 130 bp, Homo sapiens
  chr4:1576528-1576658
  hypo
gcttgtctctggcaggagggcccacgccctgtgtgccaggctgctgggcctccccggacggaccggctgcccgaacccctcggctatggcaagctttcatggtctctgcctccctcggtgtcaacacatg

SEQ ID NO: 60706 - DNA, 118 bp, Homo sapiens; identical to SEQ ID NO: 40194
  chr4:1577697-1577815
  hypo

SEQ ID NO: 60707 - DNA, 154 bp, Homo sapiens; identical to SEQ ID NO: 40195
  chr4:1605613-1605767
  hypo

SEQ ID NO: 60708 - DNA, 119 bp, Homo sapiens
  chr4:1616563-1616682
  hypo
cacccagaggcaggtcgccccacacgcatttctccacggggtgccccatggccgtcctatgctgacggacaccagatggcatttcagcaccgggcacaggggccgctttaaacagcaaa

SEQ ID NO: 60709 - DNA, 30 bp, Homo sapiens; identical to SEQ ID NO: 40197
  chr4:1623727-1623757
  hypo

SEQ ID NO: 60710 - DNA, 74 bp, Homo sapiens; identical to SEQ ID NO: 40198
  chr4:1663439-1663513
  hypo

SEQ ID NO: 60711 - DNA, 357 bp, Homo sapiens; identical to SEQ ID NO: 40199
  chr4:1687122-1687479
  hypo

SEQ ID NO: 60712 - DNA, 66 bp, Homo sapiens; identical to SEQ ID NO: 40200
  chr4:1791278-1791344
  hypo

SEQ ID NO: 60713 - DNA, 345 bp, Homo sapiens; identical to SEQ ID NO: 40201
  chr4:1803132-1803477
  hypo

SEQ ID NO: 60714 - DNA, 335 bp, Homo sapiens; identical to SEQ ID NO: 40202
  chr4:1805302-1805637
  hypo

SEQ ID NO: 60715 - DNA, 61 bp, Homo sapiens
  chr4:1807294-1807355
  hypo
ctgacaaggacctgtcggacctggtgtctgagatggagatgatgaagatgatcgggaaaca

SEQ ID NO: 60716 - DNA, 308 bp, Homo sapiens
  chr4:1807384-1807692
  hypo
gcacgcagggcggtaggtgcggtagcggcggtggtgccggctgggcggccctcctgggcctggcagcccgtctgaggagcccgtgtccccagggcccctgtacgtgctggtggagtacgcggccaagggtaacctgcgggagtttctgcgggcgcggcggcccccgggcctggactactccttcgacacctgcaagccgcccgaggagcagctcaccttcaaggacctggtgtcctgtgcctaccaggtggcccggggcatggagtacttggcctcccagaaggtgggcagggcggcaggtgtgggtg

SEQ ID NO: 60717 - DNA, 260 bp, Homo sapiens; identical to SEQ ID NO: 40204
  chr4:1960118-1960378
  hypo

SEQ ID NO: 60718 - DNA, 30 bp, Homo sapiens; identical to SEQ ID NO: 40205
  chr4:1961374-1961404
  hypo

SEQ ID NO: 60719 - DNA, 155 bp, Homo sapiens; identical to SEQ ID NO: 40206
  chr4:1976939-1977094
  hypo

SEQ ID NO: 60720 - DNA, 56 bp, Homo sapiens
  chr4:1993715-1993771
  hypo
ggcctactcttccaccggtgcgcagatgcaagaaaacctgaagggtgagaagccgg

SEQ ID NO: 60721 - DNA, 155 bp, Homo sapiens
  chr4:1994180-1994335
  hypo
cctcccacgaggaaacgcagagagccaggccatggcgtgcctgtgcctctgccatgcgcccactgggctgctcacagtgtgagacagctgggctggctggcgctgggggtgaacaacagcgccctgccctgtccagacgccggggctgaaacccc

SEQ ID NO: 60722 - DNA, 74 bp, Homo sapiens; identical to SEQ ID NO: 14668
  chr4:1994756-1994830
  hypo

SEQ ID NO: 60723 - DNA, 30 bp, Homo sapiens; identical to SEQ ID NO: 40209
  chr4:2009272-2009302
  hypo

SEQ ID NO: 60724 - DNA, 299 bp, Homo sapiens; identical to SEQ ID NO: 40210
  chr4:2065601-2065900
  hypo

SEQ ID NO: 60725 - DNA, 30 bp, Homo sapiens; identical to SEQ ID NO: 40212
  chr4:2129422-2129452
  hypo

SEQ ID NO: 60726 - DNA, 141 bp, Homo sapiens; identical to SEQ ID NO: 40213
  chr4:2278785-2278926
  hypo

SEQ ID NO: 60727 - DNA, 87 bp, Homo sapiens
  chr4:2305585-2305672
  hypo
gagaagtgggcagtgcgctcggatgcggctcagggcaaggggcccggcgctggcacagcccgctcccactgccccgcacaggcacgc

SEQ ID NO: 60728 - DNA, 91 bp, Homo sapiens; identical to SEQ ID NO: 24054
  chr4:2305827-2305918
  hypo

SEQ ID NO: 60729 - DNA, 124 bp, Homo sapiens; identical to SEQ ID NO: 40215
  chr4:2459775-2459899
  hypo

SEQ ID NO: 60730 - DNA, 5 bp, Homo sapiens
  chr4:2527902-2527907
  hypo
aaact

SEQ ID NO: 60731 - DNA, 84 bp, Homo sapiens
  chr4:2926282-2926366
  hypo
gttgctctcctgggccgtcgtcatcctgggagctaggcactcctcctaagaggacctcttcaccggtttttgtctcgttctaga

SEQ ID NO: 60732 - DNA, 139 bp, Homo sapiens; identical to SEQ ID NO: 40218
  chr4:2932947-2933086
  hypo

SEQ ID NO: 60733 - DNA, 45 bp, Homo sapiens; identical to SEQ ID NO: 40220
  chr4:2987431-2987476
  hypo

SEQ ID NO: 60734 - DNA, 30 bp, Homo sapiens; identical to SEQ ID NO: 40221
  chr4:3252743-3252773
  hypo

SEQ ID NO: 60735 - DNA, 30 bp, Homo sapiens; identical to SEQ ID NO: 40222
  chr4:3292632-3292662
  hypo

SEQ ID NO: 60736 - DNA, 50 bp, Homo sapiens; identical to SEQ ID NO: 40223
  chr4:3310501-3310551
  hypo

SEQ ID NO: 60737 - DNA, 91 bp, Homo sapiens; identical to SEQ ID NO: 40224
  chr4:3313229-3313320
  hypo

SEQ ID NO: 60738 - DNA, 35 bp, Homo sapiens; identical to SEQ ID NO: 40225
  chr4:3418235-3418270
  hypo

SEQ ID NO: 60739 - DNA, 213 bp, Homo sapiens; identical to SEQ ID NO: 40226
  chr4:3445886-3446099
  hypo

SEQ ID NO: 60740 - DNA, 548 bp, Homo sapiens
  chr4:3446443-3446991
  hypo
acggctctgcaacatcggtgagtgggtcagccccccggggtgccctggggcagtgccgggtggacccaccgtgggccggcctcactgcccctctgcccgcagagcctgatgagcgctgcttcttggggaacggcactgggtaccgtggcgtggccagcacctcagcctcgggcctcagctgcctggcctggaactccgatctgctctaccaggagctgcacgtggactccgtgggcgccgcggccctgctgggcctgggcccccatgcctactgccggtcagcaccacgccgctccaggccgccgcatgcggggcaggcaggatttgtcctggggagaggccccccggctccctaggacccaggcggggccagctccgtccagacaggccccggaacctctgcctgggaggctgcccgagggagggccactctcttcccactgctccaggtgcggggaaccgccctgctgggggttccgatgccccctccccatgccctcttcgaggggcagtgtgactccctgccagcccccacttatgcaccgcag

SEQ ID NO: 60741 - DNA, 108 bp, Homo sapiens
  chr4:3447021-3447129
  hypo
ctacgtggtgaaggacagcgcgctctcctgggagtactgccgcctggaggcctgcggtgcgcggctggcggggggtgctgccttgggccccaccgaggtcacagcagt

SEQ ID NO: 60742 - DNA, 30 bp, Homo sapiens; identical to SEQ ID NO: 40229
  chr4:3449723-3449753
  hypo

SEQ ID NO: 60743 - DNA, 271 bp, Homo sapiens; identical to SEQ ID NO: 40230
  chr4:3475099-3475370
  hypo

SEQ ID NO: 60744 - DNA, 38 bp, Homo sapiens; identical to SEQ ID NO: 40231
  chr4:3664470-3664508
  hypo

SEQ ID NO: 60745 - DNA, 61 bp, Homo sapiens; identical to SEQ ID NO: 40232
  chr4:3690841-3690902
  hypo

SEQ ID NO: 60746 - DNA, 30 bp, Homo sapiens; identical to SEQ ID NO: 40233
  chr4:3702485-3702515
  hypo

SEQ ID NO: 60747 - DNA, 30 bp, Homo sapiens; identical to SEQ ID NO: 40234
  chr4:3782694-3782724
  hypo

SEQ ID NO: 60748 - DNA, 34 bp, Homo sapiens; identical to SEQ ID NO: 40235
  chr4:3783286-3783320
  hypo

SEQ ID NO: 60749 - DNA, 30 bp, Homo sapiens; identical to SEQ ID NO: 40236
  chr4:4251746-4251776
  hypo

SEQ ID NO: 60750 - DNA, 82 bp, Homo sapiens; identical to SEQ ID NO: 14678
  chr4:4256159-4256241
  hypo

SEQ ID NO: 60751 - DNA, 30 bp, Homo sapiens; identical to SEQ ID NO: 40238
  chr4:4417662-4417692
  hypo

SEQ ID NO: 60752 - DNA, 30 bp, Homo sapiens; identical to SEQ ID NO: 40239
  chr4:5171284-5171314
  hypo

SEQ ID NO: 60753 - DNA, 30 bp, Homo sapiens; identical to SEQ ID NO: 40240
  chr4:5458789-5458819
  hypo

SEQ ID NO: 60754 - DNA, 68 bp, Homo sapiens; identical to SEQ ID NO: 40241
  chr4:6537166-6537234
  hypo

SEQ ID NO: 60755 - DNA, 182 bp, Homo sapiens; identical to SEQ ID NO: 40242
  chr4:6540136-6540318
  hypo

SEQ ID NO: 60756 - DNA, 30 bp, Homo sapiens; identical to SEQ ID NO: 40243
  chr4:6627192-6627222
  hypo

SEQ ID NO: 60757 - DNA, 31 bp, Homo sapiens; identical to SEQ ID NO: 24061
  chr4:6670153-6670184
  hypo

SEQ ID NO: 60758 - DNA, 93 bp, Homo sapiens; identical to SEQ ID NO: 40245
  chr4:6719866-6719959
  hypo

SEQ ID NO: 60759 - DNA, 17 bp, Homo sapiens
  chr4:6748557-6748574
  hypo
gtcggcctgggtctgga

SEQ ID NO: 60760 - DNA, 44 bp, Homo sapiens; identical to SEQ ID NO: 40247
  chr4:6896389-6896433
  hypo

SEQ ID NO: 60761 - DNA, 19 bp, Homo sapiens
  chr4:7035959-7035978
  hypo
gagacgcagggaaggatgt

SEQ ID NO: 60762 - DNA, 151 bp, Homo sapiens; identical to SEQ ID NO: 40250
  chr4:7047052-7047203
  hypo

SEQ ID NO: 60763 - DNA, 24 bp, Homo sapiens
  chr4:7084531-7084555
  hypo
cgccatgcccggccccttgttcct

SEQ ID NO: 60764 - DNA, 30 bp, Homo sapiens; identical to SEQ ID NO: 40252
  chr4:7134112-7134142
  hypo

SEQ ID NO: 60765 - DNA, 30 bp, Homo sapiens; identical to SEQ ID NO: 40253
  chr4:7237615-7237645
  hypo

SEQ ID NO: 60766 - DNA, 32 bp, Homo sapiens; identical to SEQ ID NO: 40254
  chr4:7475475-7475507
  hypo

SEQ ID NO: 60767 - DNA, 30 bp, Homo sapiens; identical to SEQ ID NO: 24065
  chr4:7647740-7647770
  hypo

SEQ ID NO: 60768 - DNA, 28 bp, Homo sapiens
  chr4:7647945-7647973
  hypo
gcgcacacggggccggcaggctggggac

SEQ ID NO: 60769 - DNA, 30 bp, Homo sapiens; identical to SEQ ID NO: 40256
  chr4:7679932-7679962
  hypo

SEQ ID NO: 60770 - DNA, 339 bp, Homo sapiens; identical to SEQ ID NO: 40257
  chr4:7741325-7741664
  hypo

SEQ ID NO: 60771 - DNA, 30 bp, Homo sapiens; identical to SEQ ID NO: 40258
  chr4:7968495-7968525
  hypo

SEQ ID NO: 60772 - DNA, 105 bp, Homo sapiens; identical to SEQ ID NO: 40259
  chr4:8039486-8039591
  hypo

SEQ ID NO: 60773 - DNA, 114 bp, Homo sapiens; identical to SEQ ID NO: 40260
  chr4:8240177-8240291
  hypo

SEQ ID NO: 60774 - DNA, 32 bp, Homo sapiens; identical to SEQ ID NO: 40261
  chr4:8252769-8252801
  hypo

SEQ ID NO: 60775 - DNA, 105 bp, Homo sapiens; identical to SEQ ID NO: 40262
  chr4:8327019-8327124
  hypo

SEQ ID NO: 60776 - DNA, 30 bp, Homo sapiens; identical to SEQ ID NO: 40263
  chr4:8378202-8378232
  hypo

SEQ ID NO: 60777 - DNA, 30 bp, Homo sapiens; identical to SEQ ID NO: 40264
  chr4:8386144-8386174
  hypo

SEQ ID NO: 60778 - DNA, 50 bp, Homo sapiens; identical to SEQ ID NO: 40265
  chr4:8483913-8483963
  hypo

SEQ ID NO: 60779 - DNA, 106 bp, Homo sapiens
  chr4:8607707-8607813
  hypo
gcccccagtggagcccgaggtgaagctcatcggcaacattcatggcaacgaggtggcgggccgggagatgctcatctacctagcccagtacctgtgctctgagtac

SEQ ID NO: 60780 - DNA, 15 bp, Homo sapiens
  chr4:8608541-8608556
  hypo
acgtccgagtactac

SEQ ID NO: 60781 - DNA, 51 bp, Homo sapiens
  chr4:8608600-8608651
  hypo
cccccagcactactggtggggtaaggtaggagccgccgctgcccatgctgg

SEQ ID NO: 60782 - DNA, 39 bp, Homo sapiens; identical to SEQ ID NO: 40268
  chr4:8615881-8615920
  hypo

SEQ ID NO: 60783 - DNA, 30 bp, Homo sapiens; identical to SEQ ID NO: 40269
  chr4:8793763-8793793
  hypo

SEQ ID NO: 60784 - DNA, 124 bp, Homo sapiens; identical to SEQ ID NO: 40270
  chr4:8967222-8967346
  hypo

SEQ ID NO: 60785 - DNA, 30 bp, Homo sapiens; identical to SEQ ID NO: 40271
  chr4:10200240-10200270
  hypo

SEQ ID NO: 60786 - DNA, 30 bp, Homo sapiens; identical to SEQ ID NO: 40272
  chr4:15697120-15697150
  hypo

SEQ ID NO: 60787 - DNA, 33 bp, Homo sapiens; identical to SEQ ID NO: 40273
  chr4:15789491-15789524
  hypo

SEQ ID NO: 60788 - DNA, 100 bp, Homo sapiens; identical to SEQ ID NO: 40274
  chr4:16787098-16787198
  hypo

SEQ ID NO: 60789 - DNA, 30 bp, Homo sapiens; identical to SEQ ID NO: 40275
  chr4:24535112-24535142
  hypo

SEQ ID NO: 60790 - DNA, 37 bp, Homo sapiens; identical to SEQ ID NO: 40276
  chr4:36418721-36418758
  hypo

SEQ ID NO: 60791 - DNA, 97 bp, Homo sapiens; identical to SEQ ID NO: 40277
  chr4:36418818-36418915
  hypo

SEQ ID NO: 60792 - DNA, 174 bp, Homo sapiens; identical to SEQ ID NO: 40278
  chr4:39448304-39448478
  hypo

SEQ ID NO: 60793 - DNA, 98 bp, Homo sapiens; identical to SEQ ID NO: 5017
  chr4:39816677-39816775
  hypo

SEQ ID NO: 60794 - DNA, 38 bp, Homo sapiens; identical to SEQ ID NO: 5018
  chr4:39817075-39817113
  hypo

SEQ ID NO: 60795 - DNA, 30 bp, Homo sapiens; identical to SEQ ID NO: 40281
  chr4:40479216-40479246
  hypo

SEQ ID NO: 60796 - DNA, 100 bp, Homo sapiens; identical to SEQ ID NO: 40282
  chr4:40533094-40533194
  hypo

SEQ ID NO: 60797 - DNA, 23 bp, Homo sapiens
  chr4:40910280-40910303
  hypo
actgtgagaaaagaacgtttctg

SEQ ID NO: 60798 - DNA, 81 bp, Homo sapiens; identical to SEQ ID NO: 40284
  chr4:41314285-41314366
  hypo

SEQ ID NO: 60799 - DNA, 29 bp, Homo sapiens
  chr4:41994108-41994137
  hypo
ttgtaaaccttaggacgctgaggtgggtg

SEQ ID NO: 60800 - DNA, 151 bp, Homo sapiens; identical to SEQ ID NO: 40286
  chr4:42200720-42200871
  hypo

SEQ ID NO: 60801 - DNA, 30 bp, Homo sapiens; identical to SEQ ID NO: 40287
  chr4:42316051-42316081
  hypo

SEQ ID NO: 60802 - DNA, 90 bp, Homo sapiens; identical to SEQ ID NO: 40288
  chr4:43553281-43553371
  hypo

SEQ ID NO: 60803 - DNA, 30 bp, Homo sapiens; identical to SEQ ID NO: 40289
  chr4:45473432-45473462
  hypo

SEQ ID NO: 60804 - DNA, 19 bp, Homo sapiens
  chr4:48378645-48378664
  hypo
tttttttttttgagacgga

SEQ ID NO: 60805 - DNA, 37 bp, Homo sapiens; identical to SEQ ID NO: 40291
  chr4:52892695-52892732
  hypo

SEQ ID NO: 60806 - DNA, 178 bp, Homo sapiens; identical to SEQ ID NO: 40292
  chr4:55393642-55393820
  hypo

SEQ ID NO: 60807 - DNA, 31 bp, Homo sapiens; identical to SEQ ID NO: 40293
  chr4:55406444-55406475
  hypo

SEQ ID NO: 60808 - DNA, 68 bp, Homo sapiens; identical to SEQ ID NO: 40294
  chr4:57182183-57182251
  hypo

SEQ ID NO: 60809 - DNA, 16 bp, Homo sapiens
  chr4:61380678-61380694
  hypo
gaagcagtctggatgc

SEQ ID NO: 60810 - DNA, 30 bp, Homo sapiens; identical to SEQ ID NO: 40296
  chr4:72226942-72226972
  hypo

SEQ ID NO: 60811 - DNA, 32 bp, Homo sapiens; identical to SEQ ID NO: 40297
  chr4:74468507-74468539
  hypo

SEQ ID NO: 60812 - DNA, 29 bp, Homo sapiens
  chr4:75241002-75241031
  hypo
taaagtaatgactagcgattctttttttt

SEQ ID NO: 60813 - DNA, 44 bp, Homo sapiens; identical to SEQ ID NO: 24076
  chr4:75241435-75241479
  hypo

SEQ ID NO: 60814 - DNA, 27 bp, Homo sapiens
  chr4:76912383-76912410
  hypo
gtttatttttaatcccgcagtctaaaa

SEQ ID NO: 60815 - DNA, 184 bp, Homo sapiens
  chr4:76912733-76912917
  hypo
ttccctcttaggaggaaaaaagagcaacgagggtcatataagttaatgtgtatgattttagatatgtttttattttggttttggttgtttcaacttagcgtgacccatacaagggaaaagagggctggataaaatgtgatcatgttgaccattaataaatgcaattaatcgttaaaattcaacc

SEQ ID NO: 60816 - DNA, 30 bp, Homo sapiens; identical to SEQ ID NO: 40302
  chr4:77156176-77156206
  hypo

SEQ ID NO: 60817 - DNA, 30 bp, Homo sapiens; identical to SEQ ID NO: 40304
  chr4:79861382-79861412
  hypo

SEQ ID NO: 60818 - DNA, 177 bp, Homo sapiens; identical to SEQ ID NO: 40305
  chr4:81307899-81308076
  hypo

SEQ ID NO: 60819 - DNA, 30 bp, Homo sapiens; identical to SEQ ID NO: 40306
  chr4:82157454-82157484
  hypo

SEQ ID NO: 60820 - DNA, 28 bp, Homo sapiens
  chr4:83149079-83149107
  hypo
aacaggcaatgcagccgggcgcggtggc

SEQ ID NO: 60821 - DNA, 16 bp, Homo sapiens
  chr4:83301216-83301232
  hypo
gcgacaggccatgaat

SEQ ID NO: 60822 - DNA, 70 bp, Homo sapiens
  chr4:83323436-83323506
  hypo
tgcaaatgatctagacgcttgctggagttgacttgtttcatggtgagggctccttgaaacactggcacca

SEQ ID NO: 60823 - DNA, 152 bp, Homo sapiens; identical to SEQ ID NO: 40310
  chr4:83551716-83551868
  hypo

SEQ ID NO: 60824 - DNA, 41 bp, Homo sapiens; identical to SEQ ID NO: 14696
  chr4:84169961-84170002
  hypo

SEQ ID NO: 60825 - DNA, 30 bp, Homo sapiens; identical to SEQ ID NO: 40312
  chr4:86922651-86922681
  hypo

SEQ ID NO: 60826 - DNA, 37 bp, Homo sapiens; identical to SEQ ID NO: 14697
  chr4:87899606-87899643
  hypo

SEQ ID NO: 60827 - DNA, 22 bp, Homo sapiens
  chr4:88010193-88010215
  hypo
cgcatgtcgagtattaagccag

SEQ ID NO: 60828 - DNA, 30 bp, Homo sapiens; identical to SEQ ID NO: 40315
  chr4:88025280-88025310
  hypo

SEQ ID NO: 60829 - DNA, 128 bp, Homo sapiens; identical to SEQ ID NO: 40316
  chr4:89116521-89116649
  hypo

SEQ ID NO: 60830 - DNA, 20 bp, Homo sapiens
  chr4:89912577-89912597
  hypo
gactccgtctcaaaataaaa

SEQ ID NO: 60831 - DNA, 106 bp, Homo sapiens; identical to SEQ ID NO: 40318
  chr4:90043853-90043959
  hypo

SEQ ID NO: 60832 - DNA, 203 bp, Homo sapiens; identical to SEQ ID NO: 40319
  chr4:91168356-91168559
  hypo

SEQ ID NO: 60833 - DNA, 16 bp, Homo sapiens
  chr4:95127717-95127733
  hypo
aatgaataagatctag

SEQ ID NO: 60834 - DNA, 17 bp, Homo sapiens
  chr4:95762912-95762929
  hypo
ttcggccatcttggctc

SEQ ID NO: 60835 - DNA, 78 bp, Homo sapiens; identical to SEQ ID NO: 40322
  chr4:97118687-97118765
  hypo

SEQ ID NO: 60836 - DNA, 17 bp, Homo sapiens
  chr4:97118825-97118842
  hypo
cccgcggatctgacagg

SEQ ID NO: 60837 - DNA, 64 bp, Homo sapiens; identical to SEQ ID NO: 40324
  chr4:97442548-97442612
  hypo

SEQ ID NO: 60838 - DNA, 106 bp, Homo sapiens; identical to SEQ ID NO: 40325
  chr4:99495888-99495994
  hypo

SEQ ID NO: 60839 - DNA, 24 bp, Homo sapiens
  chr4:103350988-103351012
  hypo
ctgaggcaggagaatcgcttgaac

SEQ ID NO: 60840 - DNA, 27 bp, Homo sapiens
  chr4:103811714-103811741
  hypo
ggcttggtgcagtgacgacacacctgt

SEQ ID NO: 60841 - DNA, 30 bp, Homo sapiens; identical to SEQ ID NO: 40328
  chr4:107134495-107134525
  hypo

SEQ ID NO: 60842 - DNA, 23 bp, Homo sapiens
  chr4:107994276-107994299
  hypo
gggctacacgtggcacttgcagg

SEQ ID NO: 60843 - DNA, 122 bp, Homo sapiens; identical to SEQ ID NO: 40330
  chr4:108302152-108302274
  hypo

SEQ ID NO: 60844 - DNA, 26 bp, Homo sapiens
  chr4:109311251-109311277
  hypo
aataaaaacagccaacggcggccggg

SEQ ID NO: 60845 - DNA, 79 bp, Homo sapiens; identical to SEQ ID NO: 40332
  chr4:110735440-110735519
  hypo

SEQ ID NO: 60846 - DNA, 19 bp, Homo sapiens
  chr4:110735819-110735838
  hypo
gccccgcctacaaaggtat

SEQ ID NO: 60847 - DNA, 30 bp, Homo sapiens; identical to SEQ ID NO: 14701
  chr4:113154853-113154883
  hypo

SEQ ID NO: 60848 - DNA, 30 bp, Homo sapiens; identical to SEQ ID NO: 40335
  chr4:113199029-113199059
  hypo

SEQ ID NO: 60849 - DNA, 12 bp, Homo sapiens
  chr4:113559151-113559163
  hypo
tattaaaacatt

SEQ ID NO: 60850 - DNA, 84 bp, Homo sapiens
  chr4:113559422-113559506
  hypo
gcctgggccactgagagaggctgcgtctccaaacaaacatttttcatataatttcctcaggagaaattacgaaatacttttaaa

SEQ ID NO: 60851 - DNA, 30 bp, Homo sapiens; identical to SEQ ID NO: 40338
  chr4:114176916-114176946
  hypo

SEQ ID NO: 60852 - DNA, 89 bp, Homo sapiens; identical to SEQ ID NO: 14704
  chr4:123866964-123867053
  hypo

SEQ ID NO: 60853 - DNA, 34 bp, Homo sapiens; identical to SEQ ID NO: 40340
  chr4:124335284-124335318
  hypo

SEQ ID NO: 60854 - DNA, 100 bp, Homo sapiens; identical to SEQ ID NO: 40341
  chr4:128984233-128984333
  hypo

SEQ ID NO: 60855 - DNA, 30 bp, Homo sapiens; identical to SEQ ID NO: 40342
  chr4:136320705-136320735
  hypo

SEQ ID NO: 60856 - DNA, 37 bp, Homo sapiens; identical to SEQ ID NO: 40343
  chr4:140566711-140566748
  hypo

SEQ ID NO: 60857 - DNA, 30 bp, Homo sapiens; identical to SEQ ID NO: 40344
  chr4:140753539-140753569
  hypo

SEQ ID NO: 60858 - DNA, 59 bp, Homo sapiens; identical to SEQ ID NO: 40345
  chr4:140754226-140754285
  hypo

SEQ ID NO: 60859 - DNA, 30 bp, Homo sapiens; identical to SEQ ID NO: 40346
  chr4:141031335-141031365
  hypo

SEQ ID NO: 60860 - DNA, 30 bp, Homo sapiens; identical to SEQ ID NO: 40347
  chr4:144100466-144100496
  hypo

SEQ ID NO: 60861 - DNA, 43 bp, Homo sapiens; identical to SEQ ID NO: 40348
  chr4:146853888-146853931
  hypo

SEQ ID NO: 60862 - DNA, 32 bp, Homo sapiens; identical to SEQ ID NO: 40349
  chr4:147048518-147048550
  hypo

SEQ ID NO: 60863 - DNA, 20 bp, Homo sapiens
  chr4:153437373-153437393
  hypo
caactggtactggtccgtgg

SEQ ID NO: 60864 - DNA, 100 bp, Homo sapiens; identical to SEQ ID NO: 40351
  chr4:153535608-153535708
  hypo

SEQ ID NO: 60865 - DNA, 30 bp, Homo sapiens; identical to SEQ ID NO: 40352
  chr4:153702805-153702835
  hypo

SEQ ID NO: 60866 - DNA, 181 bp, Homo sapiens; identical to SEQ ID NO: 40353
  chr4:153918964-153919145
  hypo

SEQ ID NO: 60867 - DNA, 63 bp, Homo sapiens; identical to SEQ ID NO: 40354
  chr4:154216373-154216436
  hypo

SEQ ID NO: 60868 - DNA, 163 bp, Homo sapiens; identical to SEQ ID NO: 40355
  chr4:154216735-154216898
  hypo

SEQ ID NO: 60869 - DNA, 30 bp, Homo sapiens; identical to SEQ ID NO: 40356
  chr4:154372568-154372598
  hypo

SEQ ID NO: 60870 - DNA, 115 bp, Homo sapiens; identical to SEQ ID NO: 40357
  chr4:154540115-154540230
  hypo

SEQ ID NO: 60871 - DNA, 30 bp, Homo sapiens; identical to SEQ ID NO: 40358
  chr4:154702659-154702689
  hypo

SEQ ID NO: 60872 - DNA, 40 bp, Homo sapiens; identical to SEQ ID NO: 40359
  chr4:155321157-155321197
  hypo

SEQ ID NO: 60873 - DNA, 173 bp, Homo sapiens; identical to SEQ ID NO: 40360
  chr4:155677688-155677861
  hypo

SEQ ID NO: 60874 - DNA, 89 bp, Homo sapiens; identical to SEQ ID NO: 40361
  chr4:156676888-156676977
  hypo

SEQ ID NO: 60875 - DNA, 40 bp, Homo sapiens; identical to SEQ ID NO: 40362
  chr4:157119835-157119875
  hypo

SEQ ID NO: 60876 - DNA, 169 bp, Homo sapiens; identical to SEQ ID NO: 40363
  chr4:158740667-158740836
  hypo

SEQ ID NO: 60877 - DNA, 153 bp, Homo sapiens; identical to SEQ ID NO: 40364
  chr4:170484641-170484794
  hypo

SEQ ID NO: 60878 - DNA, 30 bp, Homo sapiens; identical to SEQ ID NO: 40365
  chr4:170919945-170919975
  hypo

SEQ ID NO: 60879 - DNA, 22 bp, Homo sapiens
  chr4:172596059-172596081
  hypo
taacatacgcccacttgggctc

SEQ ID NO: 60880 - DNA, 31 bp, Homo sapiens; identical to SEQ ID NO: 40367
  chr4:172903760-172903791
  hypo

SEQ ID NO: 60881 - DNA, 69 bp, Homo sapiens; identical to SEQ ID NO: 40368
  chr4:175940800-175940869
  hypo

SEQ ID NO: 60882 - DNA, 21 bp, Homo sapiens
  chr4:178599688-178599709
  hypo
ccactgcgcccagccgagtcc

SEQ ID NO: 60883 - DNA, 30 bp, Homo sapiens; identical to SEQ ID NO: 40370
  chr4:180818589-180818619
  hypo

SEQ ID NO: 60884 - DNA, 30 bp, Homo sapiens; identical to SEQ ID NO: 40371
  chr4:183959079-183959109
  hypo

SEQ ID NO: 60885 - DNA, 30 bp, Homo sapiens; identical to SEQ ID NO: 40372
  chr4:184205426-184205456
  hypo

SEQ ID NO: 60886 - DNA, 30 bp, Homo sapiens; identical to SEQ ID NO: 40375
  chr4:185833058-185833088
  hypo

SEQ ID NO: 60887 - DNA, 30 bp, Homo sapiens; identical to SEQ ID NO: 40376
  chr4:185913935-185913965
  hypo

SEQ ID NO: 60888 - DNA, 161 bp, Homo sapiens; identical to SEQ ID NO: 40377
  chr4:186348467-186348628
  hypo

SEQ ID NO: 60889 - DNA, 72 bp, Homo sapiens; identical to SEQ ID NO: 40378
  chr4:190474969-190475041
  hypo

SEQ ID NO: 60890 - DNA, 36 bp, Homo sapiens; identical to SEQ ID NO: 40379
  chr5:109867-109903
  hypo

SEQ ID NO: 60891 - DNA, 30 bp, Homo sapiens; identical to SEQ ID NO: 40380
  chr5:139715-139745
  hypo

SEQ ID NO: 60892 - DNA, 37 bp, Homo sapiens; identical to SEQ ID NO: 40381
  chr5:140350-140387
  hypo

SEQ ID NO: 60893 - DNA, 81 bp, Homo sapiens; identical to SEQ ID NO: 40382
  chr5:192215-192296
  hypo

SEQ ID NO: 60894 - DNA, 46 bp, Homo sapiens; identical to SEQ ID NO: 40383
  chr5:429731-429777
  hypo

SEQ ID NO: 60895 - DNA, 30 bp, Homo sapiens; identical to SEQ ID NO: 40384
  chr5:430228-430258
  hypo

SEQ ID NO: 60896 - DNA, 75 bp, Homo sapiens; identical to SEQ ID NO: 40385
  chr5:435499-435574
  hypo

SEQ ID NO: 60897 - DNA, 30 bp, Homo sapiens; identical to SEQ ID NO: 40386
  chr5:478182-478212
  hypo

SEQ ID NO: 60898 - DNA, 286 bp, Homo sapiens; identical to SEQ ID NO: 40387
  chr5:479388-479674
  hypo

SEQ ID NO: 60899 - DNA, 132 bp, Homo sapiens; identical to SEQ ID NO: 24090
  chr5:480880-481012
  hypo

SEQ ID NO: 60900 - DNA, 30 bp, Homo sapiens; identical to SEQ ID NO: 40389
  chr5:484548-484578
  hypo

SEQ ID NO: 60901 - DNA, 30 bp, Homo sapiens; identical to SEQ ID NO: 40390
  chr5:488495-488525
  hypo

SEQ ID NO: 60902 - DNA, 146 bp, Homo sapiens; identical to SEQ ID NO: 40391
  chr5:488846-488992
  hypo

SEQ ID NO: 60903 - DNA, 30 bp, Homo sapiens
  chr5:491305-491335
  hypo
aagctgtagcatccccggcagcagcggcgg

SEQ ID NO: 60904 - DNA, 608 bp, Homo sapiens
  chr5:491536-492144
  hypo
tgcagtcctcctcctctccctgggacctggtggccggcgagtgtggacggacccctacctctgcccagtgccggaggaagagcggcagcccctggccacctgcagcccccaagccgagctgccgagatgggaactcctccccaagcagaacacgtgctgggacctggggacgcgcaggggactggccttggtcacgagggcctacggggctgccagccacgtttctcacctgacacttaccgcctggaggccagggtgcggcaccccgacctttctgagatgaggcagcgccgcccctcccggaccccaccctgatcccggccggggcaacagtggcgcagactcacccatgagcccactgaggaagacgccgtagagggacagcccggtggtggccgcgttccacacggtacccacgacggcgtacaacaggatggtccccaggttgccgaagaagaggcggttgggcatgaagtagccggcgtccagcacgatggggggcagcaggtagaagaagaagacggtgggcgtcagtgtgaaggacgcgatgtggtcggccgcccagacgatgccgcccagcaccaggcccagcacgatgagcagggcgc

SEQ ID NO: 60905 - DNA, 197 bp, Homo sapiens; identical to SEQ ID NO: 40393
  chr5:516758-516955
  hypo

SEQ ID NO: 60906 - DNA, 30 bp, Homo sapiens; identical to SEQ ID NO: 40394
  chr5:519988-520018
  hypo

SEQ ID NO: 60907 - DNA, 49 bp, Homo sapiens; identical to SEQ ID NO: 40395
  chr5:537890-537939
  hypo

SEQ ID NO: 60908 - DNA, 72 bp, Homo sapiens; identical to SEQ ID NO: 24094
  chr5:538686-538758
  hypo

SEQ ID NO: 60909 - DNA, 145 bp, Homo sapiens; identical to SEQ ID NO: 24095
  chr5:538806-538951
  hypo

SEQ ID NO: 60910 - DNA, 45 bp, Homo sapiens
  chr5:554538-554583
  hypo
ggataaaccaggggtggggtctgggtcacaggatgacccgggggt

SEQ ID NO: 60911 - DNA, 48 bp, Homo sapiens
  chr5:554823-554871
  hypo
cgggatgaacggggttgggggctgggtcacgggatgaaccggggggtg

SEQ ID NO: 60912 - DNA, 43 bp, Homo sapiens
  chr5:554900-554943
  hypo
tcacgggctaaaccggggttgggggtgggtcacgggatgaacg

SEQ ID NO: 60913 - DNA, 30 bp, Homo sapiens; identical to SEQ ID NO: 40400
  chr5:555668-555698
  hypo

SEQ ID NO: 60914 - DNA, 250 bp, Homo sapiens; identical to SEQ ID NO: 40401
  chr5:556065-556315
  hypo

SEQ ID NO: 60915 - DNA, 30 bp, Homo sapiens; identical to SEQ ID NO: 40402
  chr5:583170-583200
  hypo

SEQ ID NO: 60916 - DNA, 30 bp, Homo sapiens; identical to SEQ ID NO: 40403
  chr5:595300-595330
  hypo

SEQ ID NO: 60917 - DNA, 30 bp, Homo sapiens; identical to SEQ ID NO: 40404
  chr5:601155-601185
  hypo

SEQ ID NO: 60918 - DNA, 47 bp, Homo sapiens; identical to SEQ ID NO: 40405
  chr5:676852-676899
  hypo

SEQ ID NO: 60919 - DNA, 24 bp, Homo sapiens
  chr5:677865-677889
  hypo
tgatcttgctgaagacgatgtcca

SEQ ID NO: 60920 - DNA, 54 bp, Homo sapiens
  chr5:678006-678060
  hypo
gccggaaggcctcctccagggcactgagctcaggggatgcggctgccccctcac

SEQ ID NO: 60921 - DNA, 54 bp, Homo sapiens; identical to SEQ ID NO: 40407
  chr5:684241-684295
  hypo

SEQ ID NO: 60922 - DNA, 30 bp, Homo sapiens; identical to SEQ ID NO: 40408
  chr5:891092-891122
  hypo

SEQ ID NO: 60923 - DNA, 36 bp, Homo sapiens; identical to SEQ ID NO: 40409
  chr5:891651-891687
  hypo

SEQ ID NO: 60924 - DNA, 95 bp, Homo sapiens; identical to SEQ ID NO: 40410
  chr5:1003105-1003200
  hypo

SEQ ID NO: 60925 - DNA, 135 bp, Homo sapiens; identical to SEQ ID NO: 40411
  chr5:1021355-1021490
  hypo

SEQ ID NO: 60926 - DNA, 288 bp, Homo sapiens
  chr5:1034312-1034600
  hypo
taggaggcgaggtcccggcccccacgtccccccacaggcactccagtgcgatgtctcggtggaggaggacgaccgccaggagtggacgttcacgctctatgactttgacaactgcgggaaggtcaccagggaggtaggtgagcttgtgtttgcgtcaggtccacagtagtagacagacggggcagacagactgtgctggcctcgcgatacctcagggggcaggaggggacctgcctgctgcgaggtcctcatgccagctgggcttgcgtctccccagggcccagttca

SEQ ID NO: 60927 - DNA, 82 bp, Homo sapiens
  chr5:1034653-1034735
  hypo
cactgcaaggctgccctcagggcactggaggcgctcacagggccacctgggcagacccaggctgctccgagaagatgcctgt

SEQ ID NO: 60928 - DNA, 30 bp, Homo sapiens; identical to SEQ ID NO: 40413
  chr5:1039154-1039184
  hypo

SEQ ID NO: 60929 - DNA, 836 bp, Homo sapiens; identical to SEQ ID NO: 40414
  chr5:1073480-1074316
  hypo

SEQ ID NO: 60930 - DNA, 9 bp, Homo sapiens
  chr5:1131378-1131387
  hypo
tcctgctcc

SEQ ID NO: 60931 - DNA, 125 bp, Homo sapiens; identical to SEQ ID NO: 5026
  chr5:1174263-1174388
  hypo

SEQ ID NO: 60932 - DNA, 70 bp, Homo sapiens; identical to SEQ ID NO: 40417
  chr5:1189557-1189627
  hypo

SEQ ID NO: 60933 - DNA, 21 bp, Homo sapiens
  chr5:1193360-1193381
  hypo
agaggagggacaggccgtgag

SEQ ID NO: 60934 - DNA, 108 bp, Homo sapiens
  chr5:1193772-1193880
  hypo
tacctcggagaactccgggcatgaatgtgcgaaaggcaggaacagacgtccacggcggctttcatcctcatggcgcaaacgggacccctaccgtcagcaatggagccg

SEQ ID NO: 60935 - DNA, 43 bp, Homo sapiens
  chr5:1193944-1193987
  hypo
tctgagcggaacagcgagccacctgcagcgtccagctcgagac

SEQ ID NO: 60936 - DNA, 55 bp, Homo sapiens
  chr5:1221142-1221197
  hypo
ctggcaaggggaggccgggcacctcgcagcacaccatctgttcgggtagcagaac

SEQ ID NO: 60937 - DNA, 37 bp, Homo sapiens; identical to SEQ ID NO: 40421
  chr5:1223271-1223308
  hypo

SEQ ID NO: 60938 - DNA, 343 bp, Homo sapiens; identical to SEQ ID NO: 40422
  chr5:1232902-1233245
  hypo

SEQ ID NO: 60939 - DNA, 50 bp, Homo sapiens; identical to SEQ ID NO: 40424
  chr5:1346659-1346709
  hypo

SEQ ID NO: 60940 - DNA, 30 bp, Homo sapiens; identical to SEQ ID NO: 40425
  chr5:1362773-1362803
  hypo

SEQ ID NO: 60941 - DNA, 27 bp, Homo sapiens
  chr5:1381058-1381085
  hypo
atgggacgccacatccgccagcaccct

SEQ ID NO: 60942 - DNA, 87 bp, Homo sapiens; identical to SEQ ID NO: 40427
  chr5:1381145-1381232
  hypo

SEQ ID NO: 60943 - DNA, 41 bp, Homo sapiens; identical to SEQ ID NO: 40428
  chr5:1384936-1384977
  hypo

SEQ ID NO: 60944 - DNA, 40 bp, Homo sapiens; identical to SEQ ID NO: 40429
  chr5:1406427-1406467
  hypo

SEQ ID NO: 60945 - DNA, 30 bp, Homo sapiens; identical to SEQ ID NO: 40430
  chr5:1422106-1422136
  hypo

SEQ ID NO: 60946 - DNA, 30 bp, Homo sapiens; identical to SEQ ID NO: 40431
  chr5:1662561-1662591
  hypo

SEQ ID NO: 60947 - DNA, 90 bp, Homo sapiens; identical to SEQ ID NO: 40432
  chr5:1662801-1662891
  hypo

SEQ ID NO: 60948 - DNA, 30 bp, Homo sapiens; identical to SEQ ID NO: 40433
  chr5:1704607-1704637
  hypo

SEQ ID NO: 60949 - DNA, 35 bp, Homo sapiens; identical to SEQ ID NO: 40434
  chr5:1746022-1746057
  hypo

SEQ ID NO: 60950 - DNA, 569 bp, Homo sapiens
  chr5:1746453-1747022
  hypo
ccaaggagggcagttcgctccggggcacctgtcaggggccccacacggctgcttttaggccaggggtggcaaagacgctgctgccgcctgctctgggctcggctcccatggctgtgaaggaccctcgtcactccccgtcgcctgcctgggctgcccggggaccctcctgctgcgtcagcacagagcctggaaccgcggccaaggcaggaagctcccctgtgaaggcaccaagcacggcagacgccctcacatcgccggggcccgtttccctgtggacgggaagtgggaacgtgacgtggacgtgacgtgggaacgtaacgtgacgtgacgtgacgtgacgtggcatggcgcgaggacagcgcggcgggagcggcgcctcagatccagcagggagggagacgaaaggcggatggaagaggggcccccggaccccgcccctcgaggcttgtgtgccgccctggctgcggcgttctgggcgacgggaaacagagtcaggacacagaccagggagggccggggcagagccagggcacctgcgggcgaggacggctgggtgctgggtccccggc

SEQ ID NO: 60951 - DNA, 79 bp, Homo sapiens
  chr5:1747098-1747177
  hypo
caccacagcggaagtcggtctctctcatcctggagtccgcgcggctgagggcgaggtgtccttccgggggccctgaggg

SEQ ID NO: 60952 - DNA, 86 bp, Homo sapiens; identical to SEQ ID NO: 40436
  chr5:1749854-1749940
  hypo

SEQ ID NO: 60953 - DNA, 30 bp, Homo sapiens; identical to SEQ ID NO: 40437
  chr5:1750588-1750618
  hypo

SEQ ID NO: 60954 - DNA, 30 bp, Homo sapiens; identical to SEQ ID NO: 40438
  chr5:1780761-1780791
  hypo

SEQ ID NO: 60955 - DNA, 30 bp, Homo sapiens; identical to SEQ ID NO: 40439
  chr5:1794613-1794643
  hypo

SEQ ID NO: 60956 - DNA, 228 bp, Homo sapiens; identical to SEQ ID NO: 40440
  chr5:1795233-1795461
  hypo

SEQ ID NO: 60957 - DNA, 194 bp, Homo sapiens; identical to SEQ ID NO: 40441
  chr5:1865547-1865741
  hypo

SEQ ID NO: 60958 - DNA, 34 bp, Homo sapiens; identical to SEQ ID NO: 40442
  chr5:1869209-1869243
  hypo

SEQ ID NO: 60959 - DNA, 39 bp, Homo sapiens; identical to SEQ ID NO: 40443
  chr5:1923035-1923074
  hypo

SEQ ID NO: 60960 - DNA, 138 bp, Homo sapiens; identical to SEQ ID NO: 40444
  chr5:1949531-1949669
  hypo

SEQ ID NO: 60961 - DNA, 28 bp, Homo sapiens
  chr5:1950766-1950794
  hypo
tctgaaacagcccctcggcagcttcacg

SEQ ID NO: 60962 - DNA, 277 bp, Homo sapiens
  chr5:1950960-1951237
  hypo
gtgcatgcctgcgtcatctgctgtgtatgtgtcatctgttgtgcatgcgtgtgtcgtctgctgtgggcgcgtgagtcatctgctctgtgtgcttgtgccgtctgctgtgcctgcgtcatcgtctgctgtgcgtgtgtcatctgtgcgtgtgtcatctgctgtgcgtgagtcatctgctgtgcgtgtgtcatctgtgcgtgtgtcatctgctgtgcgtgcgtgtgccctctactgtgggtgtgttcatcatctgctgtgcgtgcgttgtctgctgtgc

SEQ ID NO: 60963 - DNA, 110 bp, Homo sapiens; identical to SEQ ID NO: 40446
  chr5:1951574-1951684
  hypo

SEQ ID NO: 60964 - DNA, 35 bp, Homo sapiens; identical to SEQ ID NO: 40447
  chr5:2112239-2112274
  hypo

SEQ ID NO: 60965 - DNA, 408 bp, Homo sapiens; identical to SEQ ID NO: 40448
  chr5:2136910-2137318
  hypo

SEQ ID NO: 60966 - DNA, 37 bp, Homo sapiens; identical to SEQ ID NO: 40449
  chr5:2180638-2180675
  hypo

SEQ ID NO: 60967 - DNA, 30 bp, Homo sapiens; identical to SEQ ID NO: 40450
  chr5:2199933-2199963
  hypo

SEQ ID NO: 60968 - DNA, 127 bp, Homo sapiens; identical to SEQ ID NO: 40451
  chr5:2261622-2261749
  hypo

SEQ ID NO: 60969 - DNA, 68 bp, Homo sapiens; identical to SEQ ID NO: 14739
  chr5:2369614-2369682
  hypo

SEQ ID NO: 60970 - DNA, 164 bp, Homo sapiens; identical to SEQ ID NO: 40454
  chr5:2374826-2374990
  hypo

SEQ ID NO: 60971 - DNA, 30 bp, Homo sapiens; identical to SEQ ID NO: 40455
  chr5:2493697-2493727
  hypo

SEQ ID NO: 60972 - DNA, 184 bp, Homo sapiens; identical to SEQ ID NO: 40456
  chr5:2523567-2523751
  hypo

SEQ ID NO: 60973 - DNA, 6 bp, Homo sapiens
  chr5:2541481-2541487
  hypo
gtgtgc

SEQ ID NO: 60974 - DNA, 32 bp, Homo sapiens
  chr5:2541611-2541643
  hypo
gtgccgactctgatgtgcgtgtctatgtattg

SEQ ID NO: 60975 - DNA, 30 bp, Homo sapiens; identical to SEQ ID NO: 40458
  chr5:2547162-2547192
  hypo

SEQ ID NO: 60976 - DNA, 30 bp, Homo sapiens; identical to SEQ ID NO: 40459
  chr5:2865625-2865655
  hypo

SEQ ID NO: 60977 - DNA, 50 bp, Homo sapiens; identical to SEQ ID NO: 40460
  chr5:2890843-2890893
  hypo

SEQ ID NO: 60978 - DNA, 30 bp, Homo sapiens; identical to SEQ ID NO: 40461
  chr5:3027341-3027371
  hypo

SEQ ID NO: 60979 - DNA, 36 bp, Homo sapiens
  chr5:3031843-3031879
  hypo
ctgccaggggttcagcggggaggcagtgagcaggcc

SEQ ID NO: 60980 - DNA, 56 bp, Homo sapiens
  chr5:3032018-3032074
  hypo
aatcacccgtcactgtggctcatcccttgtgaccaagctgccgcacagagcagggt

SEQ ID NO: 60981 - DNA, 134 bp, Homo sapiens; identical to SEQ ID NO: 40464
  chr5:3221047-3221181
  hypo

SEQ ID NO: 60982 - DNA, 30 bp, Homo sapiens; identical to SEQ ID NO: 40465
  chr5:3269777-3269807
  hypo

SEQ ID NO: 60983 - DNA, 198 bp, Homo sapiens; identical to SEQ ID NO: 24127
  chr5:3324844-3325042
  hypo

SEQ ID NO: 60984 - DNA, 30 bp, Homo sapiens; identical to SEQ ID NO: 40467
  chr5:3422389-3422419
  hypo

SEQ ID NO: 60985 - DNA, 75 bp, Homo sapiens; identical to SEQ ID NO: 40468
  chr5:3454354-3454429
  hypo

SEQ ID NO: 60986 - DNA, 5 bp, Homo sapiens
  chr5:3674048-3674053
  hypo
ctctg

SEQ ID NO: 60987 - DNA, 225 bp, Homo sapiens; identical to SEQ ID NO: 40470
  chr5:3740792-3741017
  hypo

SEQ ID NO: 60988 - DNA, 30 bp, Homo sapiens; identical to SEQ ID NO: 40471
  chr5:3761119-3761149
  hypo

SEQ ID NO: 60989 - DNA, 30 bp, Homo sapiens; identical to SEQ ID NO: 40472
  chr5:3761593-3761623
  hypo

SEQ ID NO: 60990 - DNA, 64 bp, Homo sapiens; identical to SEQ ID NO: 40473
  chr5:3775375-3775439
  hypo

SEQ ID NO: 60991 - DNA, 165 bp, Homo sapiens; identical to SEQ ID NO: 14745
  chr5:3806428-3806593
  hypo

SEQ ID NO: 60992 - DNA, 149 bp, Homo sapiens; identical to SEQ ID NO: 40475
  chr5:3856433-3856582
  hypo

SEQ ID NO: 60993 - DNA, 165 bp, Homo sapiens; identical to SEQ ID NO: 40476
  chr5:3859680-3859845
  hypo

SEQ ID NO: 60994 - DNA, 19 bp, Homo sapiens
  chr5:3945363-3945382
  hypo
taatcccagcagtttcgga

SEQ ID NO: 60995 - DNA, 186 bp, Homo sapiens; identical to SEQ ID NO: 40478
  chr5:4083874-4084060
  hypo

SEQ ID NO: 60996 - DNA, 68 bp, Homo sapiens
  chr5:4144299-4144367
  hypo
tcctctcaaagccgtgatattctatgcaagcaacattcatagaagcacagcttactacatgtgttctg

SEQ ID NO: 60997 - DNA, 34 bp, Homo sapiens; identical to SEQ ID NO: 40480
  chr5:4278472-4278506
  hypo

SEQ ID NO: 60998 - DNA, 31 bp, Homo sapiens; identical to SEQ ID NO: 40481
  chr5:4279105-4279136
  hypo

SEQ ID NO: 60999 - DNA, 33 bp, Homo sapiens; identical to SEQ ID NO: 40482
  chr5:4581296-4581329
  hypo

SEQ ID NO: 61000 - DNA, 35 bp, Homo sapiens; identical to SEQ ID NO: 40483
  chr5:4629575-4629610
  hypo

SEQ ID NO: 61001 - DNA, 30 bp, Homo sapiens; identical to SEQ ID NO: 40484
  chr5:4630470-4630500
  hypo

SEQ ID NO: 61002 - DNA, 30 bp, Homo sapiens; identical to SEQ ID NO: 40485
  chr5:4866871-4866901
  hypo

SEQ ID NO: 61003 - DNA, 30 bp, Homo sapiens; identical to SEQ ID NO: 40486
  chr5:4867541-4867571
  hypo

SEQ ID NO: 61004 - DNA, 178 bp, Homo sapiens; identical to SEQ ID NO: 40487
  chr5:5296474-5296652
  hypo

SEQ ID NO: 61005 - DNA, 30 bp, Homo sapiens; identical to SEQ ID NO: 40488
  chr5:5303702-5303732
  hypo

SEQ ID NO: 61006 - DNA, 30 bp, Homo sapiens; identical to SEQ ID NO: 40489
  chr5:5571405-5571435
  hypo

SEQ ID NO: 61007 - DNA, 30 bp, Homo sapiens; identical to SEQ ID NO: 40490
  chr5:5577581-5577611
  hypo

SEQ ID NO: 61008 - DNA, 30 bp, Homo sapiens; identical to SEQ ID NO: 40491
  chr5:5652506-5652536
  hypo

SEQ ID NO: 61009 - DNA, 211 bp, Homo sapiens; identical to SEQ ID NO: 40492
  chr5:5719870-5720081
  hypo

SEQ ID NO: 61010 - DNA, 30 bp, Homo sapiens; identical to SEQ ID NO: 40493
  chr5:6219037-6219067
  hypo

SEQ ID NO: 61011 - DNA, 30 bp, Homo sapiens; identical to SEQ ID NO: 40494
  chr5:6478603-6478633
  hypo

SEQ ID NO: 61012 - DNA, 15 bp, Homo sapiens
  chr5:9011746-9011761
  hypo
cgatagggggagact

SEQ ID NO: 61013 - DNA, 86 bp, Homo sapiens; identical to SEQ ID NO: 40496
  chr5:10248731-10248817
  hypo

SEQ ID NO: 61014 - DNA, 167 bp, Homo sapiens; identical to SEQ ID NO: 14749
  chr5:10267279-10267446
  hypo

SEQ ID NO: 61015 - DNA, 30 bp, Homo sapiens; identical to SEQ ID NO: 40498
  chr5:10269033-10269063
  hypo

SEQ ID NO: 61016 - DNA, 30 bp, Homo sapiens; identical to SEQ ID NO: 40499
  chr5:10652405-10652435
  hypo

SEQ ID NO: 61017 - DNA, 45 bp, Homo sapiens; identical to SEQ ID NO: 40500
  chr5:10675402-10675447
  hypo

SEQ ID NO: 61018 - DNA, 30 bp, Homo sapiens; identical to SEQ ID NO: 40501
  chr5:10864262-10864292
  hypo

SEQ ID NO: 61019 - DNA, 30 bp, Homo sapiens; identical to SEQ ID NO: 40502
  chr5:14501805-14501835
  hypo

SEQ ID NO: 61020 - DNA, 32 bp, Homo sapiens; identical to SEQ ID NO: 40503
  chr5:14732032-14732064
  hypo

SEQ ID NO: 61021 - DNA, 30 bp, Homo sapiens; identical to SEQ ID NO: 40504
  chr5:14756455-14756485
  hypo

SEQ ID NO: 61022 - DNA, 83 bp, Homo sapiens; identical to SEQ ID NO: 40505
  chr5:14764724-14764807
  hypo

SEQ ID NO: 61023 - DNA, 19 bp, Homo sapiens
  chr5:14774559-14774578
  hypo
tcctcaagacacagtcgcg

SEQ ID NO: 61024 - DNA, 19 bp, Homo sapiens
  chr5:14774698-14774717
  hypo
acaacgcctggctaatcat

SEQ ID NO: 61025 - DNA, 27 bp, Homo sapiens
  chr5:15503239-15503266
  hypo
atagctgaggtcgggcgcggtggccca

SEQ ID NO: 61026 - DNA, 79 bp, Homo sapiens; identical to SEQ ID NO: 40509
  chr5:16032731-16032810
  hypo

SEQ ID NO: 61027 - DNA, 78 bp, Homo sapiens; identical to SEQ ID NO: 14754
  chr5:16436327-16436405
  hypo

SEQ ID NO: 61028 - DNA, 30 bp, Homo sapiens; identical to SEQ ID NO: 40511
  chr5:16744496-16744526
  hypo

SEQ ID NO: 61029 - DNA, 182 bp, Homo sapiens; identical to SEQ ID NO: 40512
  chr5:16809241-16809423
  hypo

SEQ ID NO: 61030 - DNA, 30 bp, Homo sapiens; identical to SEQ ID NO: 40514
  chr5:17327404-17327434
  hypo

SEQ ID NO: 61031 - DNA, 30 bp, Homo sapiens; identical to SEQ ID NO: 40515
  chr5:17492138-17492168
  hypo

SEQ ID NO: 61032 - DNA, 68 bp, Homo sapiens; identical to SEQ ID NO: 40516
  chr5:17502391-17502459
  hypo

SEQ ID NO: 61033 - DNA, 30 bp, Homo sapiens; identical to SEQ ID NO: 40517
  chr5:17512058-17512088
  hypo

SEQ ID NO: 61034 - DNA, 30 bp, Homo sapiens; identical to SEQ ID NO: 40518
  chr5:30694338-30694368
  hypo

SEQ ID NO: 61035 - DNA, 147 bp, Homo sapiens; identical to SEQ ID NO: 40519
  chr5:31111601-31111748
  hypo

SEQ ID NO: 61036 - DNA, 105 bp, Homo sapiens; identical to SEQ ID NO: 40520
  chr5:31572171-31572276
  hypo

SEQ ID NO: 61037 - DNA, 28 bp, Homo sapiens
  chr5:31691652-31691680
  hypo
ttctcttatctggcgccacctgctttta

SEQ ID NO: 61038 - DNA, 30 bp, Homo sapiens; identical to SEQ ID NO: 40522
  chr5:31889103-31889133
  hypo

SEQ ID NO: 61039 - DNA, 30 bp, Homo sapiens; identical to SEQ ID NO: 40523
  chr5:31982994-31983024
  hypo

SEQ ID NO: 61040 - DNA, 21 bp, Homo sapiens
  chr5:32526565-32526586
  hypo
cttctccacgccgggcgcggt

SEQ ID NO: 61041 - DNA, 79 bp, Homo sapiens; identical to SEQ ID NO: 40525
  chr5:32750220-32750299
  hypo

SEQ ID NO: 61042 - DNA, 30 bp, Homo sapiens; identical to SEQ ID NO: 40526
  chr5:32855659-32855689
  hypo

SEQ ID NO: 61043 - DNA, 59 bp, Homo sapiens; identical to SEQ ID NO: 40527
  chr5:33162543-33162602
  hypo

SEQ ID NO: 61044 - DNA, 25 bp, Homo sapiens
  chr5:33234426-33234451
  hypo
tgagctgacacgcctggctgaattt

SEQ ID NO: 61045 - DNA, 38 bp, Homo sapiens; identical to SEQ ID NO: 40529
  chr5:33298113-33298151
  hypo

SEQ ID NO: 61046 - DNA, 30 bp, Homo sapiens; identical to SEQ ID NO: 40530
  chr5:33443001-33443031
  hypo

SEQ ID NO: 61047 - DNA, 197 bp, Homo sapiens; identical to SEQ ID NO: 40531
  chr5:33550087-33550284
  hypo

SEQ ID NO: 61048 - DNA, 190 bp, Homo sapiens; identical to SEQ ID NO: 40532
  chr5:33880065-33880255
  hypo

SEQ ID NO: 61049 - DNA, 105 bp, Homo sapiens; identical to SEQ ID NO: 40533
  chr5:34839939-34840044
  hypo

SEQ ID NO: 61050 - DNA, 35 bp, Homo sapiens; identical to SEQ ID NO: 14761
  chr5:37255512-37255547
  hypo

SEQ ID NO: 61051 - DNA, 16 bp, Homo sapiens
  chr5:39343165-39343181
  hypo
tgaacaggaacagctc

SEQ ID NO: 61052 - DNA, 23 bp, Homo sapiens
  chr5:40190552-40190575
  hypo
agccgagacggcaccagtatact

SEQ ID NO: 61053 - DNA, 30 bp, Homo sapiens; identical to SEQ ID NO: 40537
  chr5:40861757-40861787
  hypo

SEQ ID NO: 61054 - DNA, 19 bp, Homo sapiens
  chr5:41777231-41777250
  hypo
aaaaggggccgggtgcggt

SEQ ID NO: 61055 - DNA, 25 bp, Homo sapiens
  chr5:43105351-43105376
  hypo
agcaagactccgtcccccccaaaaa

SEQ ID NO: 61056 - DNA, 17 bp, Homo sapiens
  chr5:43402630-43402647
  hypo
aaaattggtgtgtgccg

SEQ ID NO: 61057 - DNA, 106 bp, Homo sapiens; identical to SEQ ID NO: 40541
  chr5:44492896-44493002
  hypo

SEQ ID NO: 61058 - DNA, 43 bp, Homo sapiens; identical to SEQ ID NO: 40542
  chr5:44637083-44637126
  hypo

SEQ ID NO: 61059 - DNA, 21 bp, Homo sapiens
  chr5:44939696-44939717
  hypo
gaaggtggtgctgggcgcggt

SEQ ID NO: 61060 - DNA, 33 bp, Homo sapiens; identical to SEQ ID NO: 40544
  chr5:45225683-45225716
  hypo

SEQ ID NO: 61061 - DNA, 39 bp, Homo sapiens; identical to SEQ ID NO: 40545
  chr5:52888052-52888091
  hypo

SEQ ID NO: 61062 - DNA, 30 bp, Homo sapiens; identical to SEQ ID NO: 40546
  chr5:55309328-55309358
  hypo

SEQ ID NO: 61063 - DNA, 21 bp, Homo sapiens
  chr5:63373765-63373786
  hypo
taatttctggccgggcgagtt

SEQ ID NO: 61064 - DNA, 37 bp, Homo sapiens; identical to SEQ ID NO: 40548
  chr5:64860574-64860611
  hypo

SEQ ID NO: 61065 - DNA, 33 bp, Homo sapiens; identical to SEQ ID NO: 40550
  chr5:67573348-67573381
  hypo

SEQ ID NO: 61066 - DNA, 226 bp, Homo sapiens; identical to SEQ ID NO: 40551
  chr5:67840329-67840555
  hypo

SEQ ID NO: 61067 - DNA, 17 bp, Homo sapiens
  chr5:68391002-68391019
  hypo
gtaatagcattataacg

SEQ ID NO: 61068 - DNA, 35 bp, Homo sapiens; identical to SEQ ID NO: 40554
  chr5:68481446-68481481
  hypo

SEQ ID NO: 61069 - DNA, 30 bp, Homo sapiens; identical to SEQ ID NO: 40555
  chr5:72175493-72175523
  hypo

SEQ ID NO: 61070 - DNA, 240 bp, Homo sapiens; identical to SEQ ID NO: 40556
  chr5:72236805-72237045
  hypo

SEQ ID NO: 61071 - DNA, 21 bp, Homo sapiens
  chr5:74536034-74536055
  hypo
aatttttttttgagacggagt

SEQ ID NO: 61072 - DNA, 30 bp, Homo sapiens; identical to SEQ ID NO: 40558
  chr5:75819580-75819610
  hypo

SEQ ID NO: 61073 - DNA, 89 bp, Homo sapiens; identical to SEQ ID NO: 40559
  chr5:75963986-75964075
  hypo

SEQ ID NO: 61074 - DNA, 30 bp, Homo sapiens; identical to SEQ ID NO: 40560
  chr5:75969716-75969746
  hypo

SEQ ID NO: 61075 - DNA, 30 bp, Homo sapiens; identical to SEQ ID NO: 40561
  chr5:76327167-76327197
  hypo

SEQ ID NO: 61076 - DNA, 17 bp, Homo sapiens
  chr5:77047294-77047311
  hypo
gccggccagcctgacca

SEQ ID NO: 61077 - DNA, 20 bp, Homo sapiens
  chr5:78469259-78469279
  hypo
agtatttttctatttcgaaa

SEQ ID NO: 61078 - DNA, 115 bp, Homo sapiens; identical to SEQ ID NO: 40564
  chr5:78552615-78552730
  hypo

SEQ ID NO: 61079 - DNA, 35 bp, Homo sapiens; identical to SEQ ID NO: 40565
  chr5:78881941-78881976
  hypo

SEQ ID NO: 61080 - DNA, 95 bp, Homo sapiens; identical to SEQ ID NO: 40566
  chr5:78985096-78985191
  hypo

SEQ ID NO: 61081 - DNA, 87 bp, Homo sapiens
  chr5:79947497-79947584
  hypo
cgttaaagccactttcgtagtttattttgtatcaactggagttttttacaactcaggtgaattttagctttattgaggggaattgat

SEQ ID NO: 61082 - DNA, 77 bp, Homo sapiens
  chr5:79947707-79947784
  hypo
gtttatcactgctgtctcccgtgggggtgtggctaggctaagcgttttgagctgcgttgctgcgtgcttgatacttg

SEQ ID NO: 61083 - DNA, 32 bp, Homo sapiens; identical to SEQ ID NO: 40569
  chr5:81266658-81266690
  hypo

SEQ ID NO: 61084 - DNA, 16 bp, Homo sapiens
  chr5:81575049-81575065
  hypo
gcgcctggccatttaa

SEQ ID NO: 61085 - DNA, 23 bp, Homo sapiens
  chr5:88304080-88304103
  hypo
cgagagtccgtctcaaaaaaaaa

SEQ ID NO: 61086 - DNA, 19 bp, Homo sapiens
  chr5:88371483-88371502
  hypo
cggatctcctgaggtcggg

SEQ ID NO: 61087 - DNA, 7 bp, Homo sapiens
  chr5:94982225-94982232
  hypo
aaatttg

SEQ ID NO: 61088 - DNA, 21 bp, Homo sapiens
  chr5:95117541-95117562
  hypo
agactccgtctcaaaaaaaga

SEQ ID NO: 61089 - DNA, 30 bp, Homo sapiens; identical to SEQ ID NO: 14774
  chr5:98201074-98201104
  hypo

SEQ ID NO: 61090 - DNA, 23 bp, Homo sapiens
  chr5:102048048-102048071
  hypo
aagtgtggccgggcgcggtggct

SEQ ID NO: 61091 - DNA, 17 bp, Homo sapiens
  chr5:111306228-111306245
  hypo
gaagtcttactgggtcg

SEQ ID NO: 61092 - DNA, 128 bp, Homo sapiens; identical to SEQ ID NO: 40578
  chr5:111813766-111813894
  hypo

SEQ ID NO: 61093 - DNA, 79 bp, Homo sapiens; identical to SEQ ID NO: 40579
  chr5:111875281-111875360
  hypo

SEQ ID NO: 61094 - DNA, 206 bp, Homo sapiens; identical to SEQ ID NO: 40581
  chr5:112198294-112198500
  hypo

SEQ ID NO: 61095 - DNA, 32 bp, Homo sapiens; identical to SEQ ID NO: 40582
  chr5:115176272-115176304
  hypo

SEQ ID NO: 61096 - DNA, 39 bp, Homo sapiens; identical to SEQ ID NO: 40583
  chr5:117258279-117258318
  hypo

SEQ ID NO: 61097 - DNA, 30 bp, Homo sapiens; identical to SEQ ID NO: 14777
  chr5:126200056-126200086
  hypo

SEQ ID NO: 61098 - DNA, 30 bp, Homo sapiens; identical to SEQ ID NO: 40585
  chr5:126409452-126409482
  hypo

SEQ ID NO: 61099 - DNA, 30 bp, Homo sapiens; identical to SEQ ID NO: 40586
  chr5:126851264-126851294
  hypo

SEQ ID NO: 61100 - DNA, 92 bp, Homo sapiens; identical to SEQ ID NO: 40587
  chr5:131305994-131306086
  hypo

SEQ ID NO: 61101 - DNA, 193 bp, Homo sapiens; identical to SEQ ID NO: 40588
  chr5:131610019-131610212
  hypo

SEQ ID NO: 61102 - DNA, 30 bp, Homo sapiens; identical to SEQ ID NO: 40589
  chr5:131787174-131787204
  hypo

SEQ ID NO: 61103 - DNA, 83 bp, Homo sapiens; identical to SEQ ID NO: 40590
  chr5:132083881-132083964
  hypo

SEQ ID NO: 61104 - DNA, 30 bp, Homo sapiens; identical to SEQ ID NO: 40591
  chr5:132201467-132201497
  hypo

SEQ ID NO: 61105 - DNA, 4 bp, Homo sapiens
  chr5:133820040-133820044
  hypo
ttgt

SEQ ID NO: 61106 - DNA, 46 bp, Homo sapiens; identical to SEQ ID NO: 40593
  chr5:134242196-134242242
  hypo

SEQ ID NO: 61107 - DNA, 30 bp, Homo sapiens; identical to SEQ ID NO: 40594
  chr5:134583042-134583072
  hypo

SEQ ID NO: 61108 - DNA, 33 bp, Homo sapiens; identical to SEQ ID NO: 40595
  chr5:137548023-137548056
  hypo

SEQ ID NO: 61109 - DNA, 18 bp, Homo sapiens
  chr5:137769720-137769738
  hypo
gcccgtccaacattggtg

SEQ ID NO: 61110 - DNA, 30 bp, Homo sapiens; identical to SEQ ID NO: 40597
  chr5:138273660-138273690
  hypo

SEQ ID NO: 61111 - DNA, 105 bp, Homo sapiens; identical to SEQ ID NO: 40598
  chr5:138676299-138676404
  hypo

SEQ ID NO: 61112 - DNA, 91 bp, Homo sapiens; identical to SEQ ID NO: 40599
  chr5:139556302-139556393
  hypo

SEQ ID NO: 61113 - DNA, 29 bp, Homo sapiens
  chr5:139779106-139779135
  hypo
tgagccactgcgcccggccattttttttt

SEQ ID NO: 61114 - DNA, 95 bp, Homo sapiens; identical to SEQ ID NO: 40602
  chr5:142070580-142070675
  hypo

SEQ ID NO: 61115 - DNA, 158 bp, Homo sapiens; identical to SEQ ID NO: 40603
  chr5:142625575-142625733
  hypo

SEQ ID NO: 61116 - DNA, 30 bp, Homo sapiens; identical to SEQ ID NO: 40604
  chr5:142689842-142689872
  hypo

SEQ ID NO: 61117 - DNA, 21 bp, Homo sapiens
  chr5:147003406-147003427
  hypo
gttttgtttttgaaacggaat

SEQ ID NO: 61118 - DNA, 149 bp, Homo sapiens; identical to SEQ ID NO: 40606
  chr5:149014648-149014797
  hypo

SEQ ID NO: 61119 - DNA, 30 bp, Homo sapiens; identical to SEQ ID NO: 40607
  chr5:149624264-149624294
  hypo

SEQ ID NO: 61120 - DNA, 30 bp, Homo sapiens; identical to SEQ ID NO: 40608
  chr5:150901687-150901717
  hypo

SEQ ID NO: 61121 - DNA, 144 bp, Homo sapiens; identical to SEQ ID NO: 40609
  chr5:150911238-150911382
  hypo

SEQ ID NO: 61122 - DNA, 30 bp, Homo sapiens; identical to SEQ ID NO: 14784
  chr5:151383730-151383760
  hypo

SEQ ID NO: 61123 - DNA, 21 bp, Homo sapiens
  chr5:153118296-153118317
  hypo
ttggagaaggcatttcgctct

SEQ ID NO: 61124 - DNA, 78 bp, Homo sapiens; identical to SEQ ID NO: 40612
  chr5:153785990-153786068
  hypo

SEQ ID NO: 61125 - DNA, 193 bp, Homo sapiens
  chr5:154209733-154209926
  hypo
ttgtgtaggaaaaggcgagccagactcagggaacagtgggacccacttcccggcgctgtgcaagtcagagttccttgtaagcagggtctgggcctcacttatcatggatttgccctggtgcctttcactattggtcgaattgagtatttcggaaggagaacttgtttaaaagacagccaccgcccacacattc

SEQ ID NO: 61126 - DNA, 60 bp, Homo sapiens
  chr5:154318088-154318148
  hypo
ccaacgttttttgagcgctatgtgccagggcactttgctagttgtggaggtgttttaaag

SEQ ID NO: 61127 - DNA, 172 bp, Homo sapiens; identical to SEQ ID NO: 40615
  chr5:156874508-156874680
  hypo

SEQ ID NO: 61128 - DNA, 12 bp, Homo sapiens
  chr5:157078407-157078419
  hypo
cgagcctgcagt

SEQ ID NO: 61129 - DNA, 39 bp, Homo sapiens; identical to SEQ ID NO: 14789
  chr5:158612937-158612976
  hypo

SEQ ID NO: 61130 - DNA, 28 bp, Homo sapiens
  chr5:159672080-159672108
  hypo
ggtaggggctgggtgcggtggctcacgc

SEQ ID NO: 61131 - DNA, 30 bp, Homo sapiens; identical to SEQ ID NO: 40619
  chr5:159776532-159776562
  hypo

SEQ ID NO: 61132 - DNA, 17 bp, Homo sapiens
  chr5:160498400-160498417
  hypo
agtgccaagcatgagcg

SEQ ID NO: 61133 - DNA, 18 bp, Homo sapiens
  chr5:166363611-166363629
  hypo
gcaagcagagggagccgg

SEQ ID NO: 61134 - DNA, 146 bp, Homo sapiens; identical to SEQ ID NO: 40622
  chr5:166461205-166461351
  hypo

SEQ ID NO: 61135 - DNA, 8 bp, Homo sapiens
  chr5:166865441-166865449
  hypo
gctggagt

SEQ ID NO: 61136 - DNA, 141 bp, Homo sapiens; identical to SEQ ID NO: 14792
  chr5:168192180-168192321
  hypo

SEQ ID NO: 61137 - DNA, 30 bp, Homo sapiens; identical to SEQ ID NO: 40625
  chr5:168231749-168231779
  hypo

SEQ ID NO: 61138 - DNA, 48 bp, Homo sapiens
  chr5:168233348-168233396
  hypo
tccagcagccccacacgctgatggcctagtgggtgatgggctgggaca

SEQ ID NO: 61139 - DNA, 47 bp, Homo sapiens
  chr5:168233482-168233529
  hypo
aatctccatcaagccctttcctcgacagtccacgatgttattgctgc

SEQ ID NO: 61140 - DNA, 30 bp, Homo sapiens; identical to SEQ ID NO: 40627
  chr5:168253336-168253366
  hypo

SEQ ID NO: 61141 - DNA, 30 bp, Homo sapiens; identical to SEQ ID NO: 14793
  chr5:168268106-168268136
  hypo

SEQ ID NO: 61142 - DNA, 23 bp, Homo sapiens
  chr5:168289195-168289218
  hypo
tggactttggggactcgggggaa

SEQ ID NO: 61143 - DNA, 33 bp, Homo sapiens; identical to SEQ ID NO: 40630
  chr5:168337451-168337484
  hypo

SEQ ID NO: 61144 - DNA, 30 bp, Homo sapiens; identical to SEQ ID NO: 14795
  chr5:169157436-169157466
  hypo

SEQ ID NO: 61145 - DNA, 143 bp, Homo sapiens; identical to SEQ ID NO: 40633
  chr5:169658356-169658499
  hypo

SEQ ID NO: 61146 - DNA, 51 bp, Homo sapiens; identical to SEQ ID NO: 40634
  chr5:169660169-169660220
  hypo

SEQ ID NO: 61147 - DNA, 30 bp, Homo sapiens; identical to SEQ ID NO: 40635
  chr5:169932029-169932059
  hypo

SEQ ID NO: 61148 - DNA, 41 bp, Homo sapiens; identical to SEQ ID NO: 40636
  chr5:170811632-170811673
  hypo

SEQ ID NO: 61149 - DNA, 71 bp, Homo sapiens; identical to SEQ ID NO: 40637
  chr5:170919575-170919646
  hypo

SEQ ID NO: 61150 - DNA, 66 bp, Homo sapiens; identical to SEQ ID NO: 40638
  chr5:171247586-171247652
  hypo

SEQ ID NO: 61151 - DNA, 39 bp, Homo sapiens; identical to SEQ ID NO: 40639
  chr5:171533619-171533658
  hypo

SEQ ID NO: 61152 - DNA, 85 bp, Homo sapiens; identical to SEQ ID NO: 40640
  chr5:172235687-172235772
  hypo

SEQ ID NO: 61153 - DNA, 21 bp, Homo sapiens
  chr5:172384977-172384998
  hypo
tattagtaggccaggcgcagt

SEQ ID NO: 61154 - DNA, 81 bp, Homo sapiens; identical to SEQ ID NO: 40642
  chr5:172385298-172385379
  hypo

SEQ ID NO: 61155 - DNA, 196 bp, Homo sapiens; identical to SEQ ID NO: 40643
  chr5:172704334-172704530
  hypo

SEQ ID NO: 61156 - DNA, 30 bp, Homo sapiens; identical to SEQ ID NO: 40644
  chr5:174110957-174110987
  hypo

SEQ ID NO: 61157 - DNA, 30 bp, Homo sapiens; identical to SEQ ID NO: 40645
  chr5:175115079-175115109
  hypo

SEQ ID NO: 61158 - DNA, 136 bp, Homo sapiens; identical to SEQ ID NO: 40646
  chr5:175605006-175605142
  hypo

SEQ ID NO: 61159 - DNA, 30 bp, Homo sapiens; identical to SEQ ID NO: 14798
  chr5:175610717-175610747
  hypo

SEQ ID NO: 61160 - DNA, 17 bp, Homo sapiens
  chr5:175876289-175876306
  hypo
cccccaggccaggagcg

SEQ ID NO: 61161 - DNA, 17 bp, Homo sapiens
  chr5:175876606-175876623
  hypo
ttcgggagatcaaatgg

SEQ ID NO: 61162 - DNA, 19 bp, Homo sapiens
  chr5:175879322-175879341
  hypo
tgctcggattacaggcgtg

SEQ ID NO: 61163 - DNA, 30 bp, Homo sapiens; identical to SEQ ID NO: 14801
  chr5:175924856-175924886
  hypo

SEQ ID NO: 61164 - DNA, 64 bp, Homo sapiens; identical to SEQ ID NO: 40653
  chr5:175971806-175971870
  hypo

SEQ ID NO: 61165 - DNA, 30 bp, Homo sapiens; identical to SEQ ID NO: 14803
  chr5:175975036-175975066
  hypo

SEQ ID NO: 61166 - DNA, 32 bp, Homo sapiens; identical to SEQ ID NO: 40655
  chr5:175978988-175979020
  hypo

SEQ ID NO: 61167 - DNA, 106 bp, Homo sapiens; identical to SEQ ID NO: 40656
  chr5:176225880-176225986
  hypo

SEQ ID NO: 61168 - DNA, 30 bp, Homo sapiens; identical to SEQ ID NO: 40657
  chr5:176289703-176289733
  hypo

SEQ ID NO: 61169 - DNA, 30 bp, Homo sapiens; identical to SEQ ID NO: 40658
  chr5:176295217-176295247
  hypo

SEQ ID NO: 61170 - DNA, 188 bp, Homo sapiens; identical to SEQ ID NO: 40659
  chr5:176315326-176315514
  hypo

SEQ ID NO: 61171 - DNA, 34 bp, Homo sapiens; identical to SEQ ID NO: 40660
  chr5:176558851-176558885
  hypo

SEQ ID NO: 61172 - DNA, 163 bp, Homo sapiens; identical to SEQ ID NO: 40661
  chr5:176795125-176795288
  hypo

SEQ ID NO: 61173 - DNA, 99 bp, Homo sapiens; identical to SEQ ID NO: 40662
  chr5:177019952-177020051
  hypo

SEQ ID NO: 61174 - DNA, 207 bp, Homo sapiens
  chr5:177031197-177031404
  hypo
cggcctccctcggaagtgttccgtcttccacctgttcgtggcctgcctctcgctgggcttcttctccctactctggctgcagctcagctgctctggggacgtggcccgggcagtcaggggacaagggcaggagacctcgggccctccccgtgcctgccccccagagccgccccctgagcactgggaagaagacgcatcctggggccc

SEQ ID NO: 61175 - DNA, 25 bp, Homo sapiens
  chr5:177513856-177513881
  hypo
tatttttttttgagacggagtctgt

SEQ ID NO: 61176 - DNA, 30 bp, Homo sapiens; identical to SEQ ID NO: 40665
  chr5:177673744-177673774
  hypo

SEQ ID NO: 61177 - DNA, 37 bp, Homo sapiens; identical to SEQ ID NO: 24183
  chr5:177713468-177713505
  hypo

SEQ ID NO: 61178 - DNA, 181 bp, Homo sapiens; identical to SEQ ID NO: 40667
  chr5:177851456-177851637
  hypo

SEQ ID NO: 61179 - DNA, 55 bp, Homo sapiens; identical to SEQ ID NO: 40668
  chr5:177890891-177890946
  hypo

SEQ ID NO: 61180 - DNA, 30 bp, Homo sapiens; identical to SEQ ID NO: 14810
  chr5:177982679-177982709
  hypo

SEQ ID NO: 61181 - DNA, 139 bp, Homo sapiens; identical to SEQ ID NO: 40670
  chr5:177984059-177984198
  hypo

SEQ ID NO: 61182 - DNA, 153 bp, Homo sapiens; identical to SEQ ID NO: 40671
  chr5:178112320-178112473
  hypo

SEQ ID NO: 61183 - DNA, 165 bp, Homo sapiens; identical to SEQ ID NO: 40672
  chr5:178288343-178288508
  hypo

SEQ ID NO: 61184 - DNA, 30 bp, Homo sapiens; identical to SEQ ID NO: 40673
  chr5:178373124-178373154
  hypo

SEQ ID NO: 61185 - DNA, 53 bp, Homo sapiens; identical to SEQ ID NO: 40674
  chr5:178409990-178410043
  hypo

SEQ ID NO: 61186 - DNA, 110 bp, Homo sapiens; identical to SEQ ID NO: 40675
  chr5:178411620-178411730
  hypo

SEQ ID NO: 61187 - DNA, 143 bp, Homo sapiens; identical to SEQ ID NO: 40676
  chr5:178416053-178416196
  hypo

SEQ ID NO: 61188 - DNA, 99 bp, Homo sapiens; identical to SEQ ID NO: 40677
  chr5:178478886-178478985
  hypo

SEQ ID NO: 61189 - DNA, 90 bp, Homo sapiens; identical to SEQ ID NO: 40678
  chr5:178481810-178481900
  hypo

SEQ ID NO: 61190 - DNA, 130 bp, Homo sapiens; identical to SEQ ID NO: 40679
  chr5:178561609-178561739
  hypo

SEQ ID NO: 61191 - DNA, 41 bp, Homo sapiens; identical to SEQ ID NO: 40680
  chr5:178565442-178565483
  hypo

SEQ ID NO: 61192 - DNA, 27 bp, Homo sapiens
  chr5:178576499-178576526
  hypo
gtcactggtggccgcaggaaccaggag

SEQ ID NO: 61193 - DNA, 55 bp, Homo sapiens
  chr5:178655698-178655753
  hypo
actaaccaaagccagcggacatccactgcctgcggagcatctggggaaggctcct

SEQ ID NO: 61194 - DNA, 37 bp, Homo sapiens; identical to SEQ ID NO: 24187
  chr5:178655871-178655908
  hypo

SEQ ID NO: 61195 - DNA, 78 bp, Homo sapiens; identical to SEQ ID NO: 40683
  chr5:178665413-178665491
  hypo

SEQ ID NO: 61196 - DNA, 30 bp, Homo sapiens; identical to SEQ ID NO: 40684
  chr5:178737203-178737233
  hypo

SEQ ID NO: 61197 - DNA, 49 bp, Homo sapiens; identical to SEQ ID NO: 40685
  chr5:178854790-178854839
  hypo

SEQ ID NO: 61198 - DNA, 30 bp, Homo sapiens; identical to SEQ ID NO: 14816
  chr5:178878685-178878715
  hypo

SEQ ID NO: 61199 - DNA, 30 bp, Homo sapiens; identical to SEQ ID NO: 40687
  chr5:178882544-178882574
  hypo

SEQ ID NO: 61200 - DNA, 27 bp, Homo sapiens
  chr5:178969579-178969606
  hypo
agaatgggccaggtgcggtggctcacg

SEQ ID NO: 61201 - DNA, 35 bp, Homo sapiens; identical to SEQ ID NO: 40689
  chr5:178987430-178987465
  hypo

SEQ ID NO: 61202 - DNA, 209 bp, Homo sapiens
  chr5:179213904-179214113
  hypo
ctgggcccaacgaaacgcaaatgatccctagcagctgacagcagtctgctgcaaacacagcaaagttgagtcccagttgcagctgcagtgaccaccagccagcctctgtcatggcccccgagtgctgggcccagcaaggcgggctcaagagcagtaagcagcagtggcaggggtggggcccagcgggatcccagcatcgtggctctggc

SEQ ID NO: 61203 - DNA, 82 bp, Homo sapiens
  chr5:179214196-179214278
  hypo
gggactgagtgaggagaccagtcaccacccggtgcaaactgagtcccttccacgcgggaaagggccacgagcaattcatgtt

SEQ ID NO: 61204 - DNA, 50 bp, Homo sapiens; identical to SEQ ID NO: 40691
  chr5:179401725-179401775
  hypo

SEQ ID NO: 61205 - DNA, 230 bp, Homo sapiens; identical to SEQ ID NO: 40692
  chr5:179564509-179564739
  hypo

SEQ ID NO: 61206 - DNA, 30 bp, Homo sapiens; identical to SEQ ID NO: 40693
  chr5:180021394-180021424
  hypo

SEQ ID NO: 61207 - DNA, 30 bp, Homo sapiens; identical to SEQ ID NO: 40694
  chr5:180028510-180028540
  hypo

SEQ ID NO: 61208 - DNA, 47 bp, Homo sapiens; identical to SEQ ID NO: 40695
  chr5:180041104-180041151
  hypo

SEQ ID NO: 61209 - DNA, 30 bp, Homo sapiens; identical to SEQ ID NO: 40696
  chr5:180042128-180042158
  hypo

SEQ ID NO: 61210 - DNA, 81 bp, Homo sapiens; identical to SEQ ID NO: 40697
  chr5:180057500-180057581
  hypo

SEQ ID NO: 61211 - DNA, 88 bp, Homo sapiens; identical to SEQ ID NO: 40698
  chr5:180111814-180111902
  hypo

SEQ ID NO: 61212 - DNA, 90 bp, Homo sapiens; identical to SEQ ID NO: 40700
  chr5:180661538-180661628
  hypo

SEQ ID NO: 61213 - DNA, 37 bp, Homo sapiens; identical to SEQ ID NO: 40701
  chr5:180708092-180708129
  hypo

SEQ ID NO: 61214 - DNA, 213 bp, Homo sapiens; identical to SEQ ID NO: 40702
  chr5:180708822-180709035
  hypo

SEQ ID NO: 61215 - DNA, 30 bp, Homo sapiens; identical to SEQ ID NO: 40703
  chr6:304250-304280
  hypo

SEQ ID NO: 61216 - DNA, 35 bp, Homo sapiens; identical to SEQ ID NO: 14822
  chr6:348724-348759
  hypo

SEQ ID NO: 61217 - DNA, 48 bp, Homo sapiens; identical to SEQ ID NO: 40705
  chr6:448927-448975
  hypo

SEQ ID NO: 61218 - DNA, 17 bp, Homo sapiens
  chr6:736009-736026
  hypo
aacgtattagctggccg

SEQ ID NO: 61219 - DNA, 49 bp, Homo sapiens; identical to SEQ ID NO: 40707
  chr6:1004242-1004291
  hypo

SEQ ID NO: 61220 - DNA, 30 bp, Homo sapiens; identical to SEQ ID NO: 40708
  chr6:1637278-1637308
  hypo

SEQ ID NO: 61221 - DNA, 30 bp, Homo sapiens; identical to SEQ ID NO: 40709
  chr6:1708613-1708643
  hypo

SEQ ID NO: 61222 - DNA, 175 bp, Homo sapiens; identical to SEQ ID NO: 40710
  chr6:1726684-1726859
  hypo

SEQ ID NO: 61223 - DNA, 30 bp, Homo sapiens; identical to SEQ ID NO: 40711
  chr6:2244454-2244484
  hypo

SEQ ID NO: 61224 - DNA, 30 bp, Homo sapiens; identical to SEQ ID NO: 40712
  chr6:2684333-2684363
  hypo

SEQ ID NO: 61225 - DNA, 72 bp, Homo sapiens; identical to SEQ ID NO: 40713
  chr6:2737187-2737259
  hypo

SEQ ID NO: 61226 - DNA, 30 bp, Homo sapiens; identical to SEQ ID NO: 40714
  chr6:2920829-2920859
  hypo

SEQ ID NO: 61227 - DNA, 30 bp, Homo sapiens; identical to SEQ ID NO: 40715
  chr6:2939086-2939116
  hypo

SEQ ID NO: 61228 - DNA, 32 bp, Homo sapiens; identical to SEQ ID NO: 40717
  chr6:3065559-3065591
  hypo

SEQ ID NO: 61229 - DNA, 94 bp, Homo sapiens; identical to SEQ ID NO: 40718
  chr6:3104457-3104551
  hypo

SEQ ID NO: 61230 - DNA, 35 bp, Homo sapiens; identical to SEQ ID NO: 40719
  chr6:3225962-3225997
  hypo

SEQ ID NO: 61231 - DNA, 83 bp, Homo sapiens
  chr6:3285139-3285222
  hypo
gaatacaaatgtatccgtatagtgtccaacctacggccaacttcagctgcagttcttggagggcaacggggagaaagagaaaa

SEQ ID NO: 61232 - DNA, 30 bp, Homo sapiens; identical to SEQ ID NO: 40721
  chr6:3298330-3298360
  hypo

SEQ ID NO: 61233 - DNA, 158 bp, Homo sapiens; identical to SEQ ID NO: 40722
  chr6:3307337-3307495
  hypo

SEQ ID NO: 61234 - DNA, 30 bp, Homo sapiens; identical to SEQ ID NO: 40723
  chr6:3333125-3333155
  hypo

SEQ ID NO: 61235 - DNA, 197 bp, Homo sapiens; identical to SEQ ID NO: 40724
  chr6:3363773-3363970
  hypo

SEQ ID NO: 61236 - DNA, 43 bp, Homo sapiens; identical to SEQ ID NO: 40725
  chr6:4020326-4020369
  hypo

SEQ ID NO: 61237 - DNA, 181 bp, Homo sapiens; identical to SEQ ID NO: 40726
  chr6:4804543-4804724
  hypo

SEQ ID NO: 61238 - DNA, 33 bp, Homo sapiens; identical to SEQ ID NO: 40728
  chr6:4920708-4920741
  hypo

SEQ ID NO: 61239 - DNA, 65 bp, Homo sapiens
  chr6:4951182-4951247
  hypo
cttgcaaaccctcatgaggagcctgtccccagccctgttttccagcctctgcctgcatgggaggg

SEQ ID NO: 61240 - DNA, 31 bp, Homo sapiens
  chr6:5783294-5783325
  hypo
agcctccctgcctcacgcctcggggctgact

SEQ ID NO: 61241 - DNA, 181 bp, Homo sapiens; identical to SEQ ID NO: 40731
  chr6:5892797-5892978
  hypo

SEQ ID NO: 61242 - DNA, 30 bp, Homo sapiens; identical to SEQ ID NO: 14827
  chr6:6045657-6045687
  hypo

SEQ ID NO: 61243 - DNA, 30 bp, Homo sapiens; identical to SEQ ID NO: 40733
  chr6:6055082-6055112
  hypo

SEQ ID NO: 61244 - DNA, 7 bp, Homo sapiens
  chr6:6367079-6367086
  hypo
agcagtg

SEQ ID NO: 61245 - DNA, 130 bp, Homo sapiens; identical to SEQ ID NO: 40735
  chr6:6534781-6534911
  hypo

SEQ ID NO: 61246 - DNA, 198 bp, Homo sapiens; identical to SEQ ID NO: 40736
  chr6:6891420-6891618
  hypo

SEQ ID NO: 61247 - DNA, 30 bp, Homo sapiens; identical to SEQ ID NO: 40737
  chr6:7132823-7132853
  hypo

SEQ ID NO: 61248 - DNA, 95 bp, Homo sapiens; identical to SEQ ID NO: 40738
  chr6:7204204-7204299
  hypo

SEQ ID NO: 61249 - DNA, 27 bp, Homo sapiens
  chr6:7237769-7237796
  hypo
tttaagcgctcgcgttggggcttgcag

SEQ ID NO: 61250 - DNA, 22 bp, Homo sapiens
  chr6:7279451-7279473
  hypo
aatctatcttggggccgggtgc

SEQ ID NO: 61251 - DNA, 30 bp, Homo sapiens; identical to SEQ ID NO: 40741
  chr6:7911626-7911656
  hypo

SEQ ID NO: 61252 - DNA, 32 bp, Homo sapiens; identical to SEQ ID NO: 40742
  chr6:7911956-7911988
  hypo

SEQ ID NO: 61253 - DNA, 30 bp, Homo sapiens; identical to SEQ ID NO: 40743
  chr6:7920126-7920156
  hypo

SEQ ID NO: 61254 - DNA, 38 bp, Homo sapiens; identical to SEQ ID NO: 40744
  chr6:10595814-10595852
  hypo

SEQ ID NO: 61255 - DNA, 30 bp, Homo sapiens; identical to SEQ ID NO: 40745
  chr6:10776300-10776330
  hypo

SEQ ID NO: 61256 - DNA, 81 bp, Homo sapiens; identical to SEQ ID NO: 40746
  chr6:12287998-12288079
  hypo

SEQ ID NO: 61257 - DNA, 138 bp, Homo sapiens
  chr6:12288379-12288517
  hypo
tggggagggcatgggcggtggtttccgggtaggggccttgagaacatgttggtcctgactgttgtcagtgtttggtcaaagttgccaaaaggttaaaaaaaaaaaagtagggggagtccctgccaagacatatttccc

SEQ ID NO: 61258 - DNA, 47 bp, Homo sapiens
  chr6:12288681-12288728
  hypo
tgtcctccgggagctgtggcctccctgggccccggggctaggctgag

SEQ ID NO: 61259 - DNA, 159 bp, Homo sapiens; identical to SEQ ID NO: 40748
  chr6:13288514-13288673
  hypo

SEQ ID NO: 61260 - DNA, 30 bp, Homo sapiens; identical to SEQ ID NO: 14834
  chr6:13293172-13293202
  hypo

SEQ ID NO: 61261 - DNA, 156 bp, Homo sapiens; identical to SEQ ID NO: 40750
  chr6:14203256-14203412
  hypo

SEQ ID NO: 61262 - DNA, 30 bp, Homo sapiens; identical to SEQ ID NO: 40751
  chr6:14999193-14999223
  hypo

SEQ ID NO: 61263 - DNA, 75 bp, Homo sapiens; identical to SEQ ID NO: 40752
  chr6:15073578-15073653
  hypo

SEQ ID NO: 61264 - DNA, 40 bp, Homo sapiens; identical to SEQ ID NO: 40753
  chr6:15456031-15456071
  hypo

SEQ ID NO: 61265 - DNA, 21 bp, Homo sapiens
  chr6:16197009-16197030
  hypo
agtagaaaacaaaagcgggct

SEQ ID NO: 61266 - DNA, 151 bp, Homo sapiens; identical to SEQ ID NO: 40755
  chr6:16218420-16218571
  hypo

SEQ ID NO: 61267 - DNA, 145 bp, Homo sapiens; identical to SEQ ID NO: 40756
  chr6:16249815-16249960
  hypo

SEQ ID NO: 61268 - DNA, 22 bp, Homo sapiens
  chr6:16288325-16288347
  hypo
agccctcacagccctcgcttgc

SEQ ID NO: 61269 - DNA, 158 bp, Homo sapiens; identical to SEQ ID NO: 40758
  chr6:16293407-16293565
  hypo

SEQ ID NO: 61270 - DNA, 17 bp, Homo sapiens
  chr6:18035850-18035867
  hypo
gtcctcaccactctccg

SEQ ID NO: 61271 - DNA, 92 bp, Homo sapiens; identical to SEQ ID NO: 14840
  chr6:20239485-20239577
  hypo

SEQ ID NO: 61272 - DNA, 30 bp, Homo sapiens; identical to SEQ ID NO: 40761
  chr6:20691518-20691548
  hypo

SEQ ID NO: 61273 - DNA, 86 bp, Homo sapiens; identical to SEQ ID NO: 40762
  chr6:20702857-20702943
  hypo

SEQ ID NO: 61274 - DNA, 16 bp, Homo sapiens
  chr6:21687666-21687682
  hypo
ccgcctcaaaacaaaa

SEQ ID NO: 61275 - DNA, 30 bp, Homo sapiens; identical to SEQ ID NO: 40764
  chr6:24465059-24465089
  hypo

SEQ ID NO: 61276 - DNA, 30 bp, Homo sapiens; identical to SEQ ID NO: 40766
  chr6:25218551-25218581
  hypo

SEQ ID NO: 61277 - DNA, 61 bp, Homo sapiens; identical to SEQ ID NO: 40767
  chr6:25668982-25669043
  hypo

SEQ ID NO: 61278 - DNA, 30 bp, Homo sapiens; identical to SEQ ID NO: 40768
  chr6:25710967-25710997
  hypo

SEQ ID NO: 61279 - DNA, 74 bp, Homo sapiens; identical to SEQ ID NO: 40769
  chr6:25727962-25728036
  hypo

SEQ ID NO: 61280 - DNA, 23 bp, Homo sapiens
  chr6:26047695-26047718
  hypo
accgcgcccggcctccttgaagc

SEQ ID NO: 61281 - DNA, 27 bp, Homo sapiens
  chr6:26053446-26053473
  hypo
cgtgagccaccgcgcccagcctttttt

SEQ ID NO: 61282 - DNA, 31 bp, Homo sapiens; identical to SEQ ID NO: 40773
  chr6:27102699-27102730
  hypo

SEQ ID NO: 61283 - DNA, 30 bp, Homo sapiens; identical to SEQ ID NO: 40774
  chr6:27719898-27719928
  hypo

SEQ ID NO: 61284 - DNA, 51 bp, Homo sapiens; identical to SEQ ID NO: 40775
  chr6:27934894-27934945
  hypo

SEQ ID NO: 61285 - DNA, 30 bp, Homo sapiens; identical to SEQ ID NO: 40776
  chr6:28395568-28395598
  hypo

SEQ ID NO: 61286 - DNA, 19 bp, Homo sapiens
  chr6:33955486-33955505
  hypo
cgcatgtcaccctcacggc

SEQ ID NO: 61287 - DNA, 150 bp, Homo sapiens; identical to SEQ ID NO: 40778
  chr6:33995975-33996125
  hypo

SEQ ID NO: 61288 - DNA, 30 bp, Homo sapiens; identical to SEQ ID NO: 40779
  chr6:34034624-34034654
  hypo

SEQ ID NO: 61289 - DNA, 102 bp, Homo sapiens; identical to SEQ ID NO: 24213
  chr6:34170868-34170970
  hypo

SEQ ID NO: 61290 - DNA, 18 bp, Homo sapiens
  chr6:34171061-34171079
  hypo
caccgccaggagtgtggg

SEQ ID NO: 61291 - DNA, 30 bp, Homo sapiens; identical to SEQ ID NO: 40782
  chr6:34392006-34392036
  hypo

SEQ ID NO: 61292 - DNA, 30 bp, Homo sapiens; identical to SEQ ID NO: 14846
  chr6:34514348-34514378
  hypo

SEQ ID NO: 61293 - DNA, 29 bp, Homo sapiens
  chr6:34535577-34535606
  hypo
gccctgccatcatagcgctgacagcggct

SEQ ID NO: 61294 - DNA, 29 bp, Homo sapiens
  chr6:34535906-34535935
  hypo
ggcgtgagtcactgcgcccagccatatcc

SEQ ID NO: 61295 - DNA, 70 bp, Homo sapiens; identical to SEQ ID NO: 40786
  chr6:34671603-34671673
  hypo

SEQ ID NO: 61296 - DNA, 19 bp, Homo sapiens
  chr6:34723890-34723909
  hypo
gggcgcggtgggtcacgcc

SEQ ID NO: 61297 - DNA, 23 bp, Homo sapiens
  chr6:34854786-34854809
  hypo
tgggtccctgatcaccgggtgcg

SEQ ID NO: 61298 - DNA, 33 bp, Homo sapiens; identical to SEQ ID NO: 40790
  chr6:35026986-35027019
  hypo

SEQ ID NO: 61299 - DNA, 231 bp, Homo sapiens
  chr6:35149810-35150041
  hypo
caaatgtttcttgagcgctggcaacgtgccaggctccttgctgggccccaaggagggagccacaaacacggacaaattccaggacctgctggagctgttctcgggctctaacgtgaggcaaaactgtgcacaaatcctggggcactctggacactgagctccggaccccgtgcaggcggtagtcgcctctgcgcggagtaggagctttgtgggcctcccacccagcatcag

SEQ ID NO: 61300 - DNA, 27 bp, Homo sapiens
  chr6:35150080-35150107
  hypo
gcagccaccgggcgcccagctggggtc

SEQ ID NO: 61301 - DNA, 139 bp, Homo sapiens; identical to SEQ ID NO: 40792
  chr6:35309516-35309655
  hypo

SEQ ID NO: 61302 - DNA, 30 bp, Homo sapiens; identical to SEQ ID NO: 40793
  chr6:35454542-35454572
  hypo

SEQ ID NO: 61303 - DNA, 22 bp, Homo sapiens
  chr6:35895206-35895228
  hypo
tgagccacggtgcccggccccc

SEQ ID NO: 61304 - DNA, 74 bp, Homo sapiens
  chr6:36165588-36165662
  hypo
tctagagtttctccccggtgtctggaggcgtgggtgggacaaaacacgtctgtgtagagtcttgcatggtcgag

SEQ ID NO: 61305 - DNA, 130 bp, Homo sapiens; identical to SEQ ID NO: 40796
  chr6:36214662-36214792
  hypo

SEQ ID NO: 61306 - DNA, 101 bp, Homo sapiens; identical to SEQ ID NO: 40797
  chr6:36238341-36238442
  hypo

SEQ ID NO: 61307 - DNA, 30 bp, Homo sapiens; identical to SEQ ID NO: 14852
  chr6:36831576-36831606
  hypo

SEQ ID NO: 61308 - DNA, 30 bp, Homo sapiens; identical to SEQ ID NO: 40799
  chr6:36881595-36881625
  hypo

SEQ ID NO: 61309 - DNA, 42 bp, Homo sapiens; identical to SEQ ID NO: 40800
  chr6:36949243-36949285
  hypo

SEQ ID NO: 61310 - DNA, 46 bp, Homo sapiens; identical to SEQ ID NO: 40801
  chr6:37004177-37004223
  hypo

SEQ ID NO: 61311 - DNA, 177 bp, Homo sapiens; identical to SEQ ID NO: 24222
  chr6:37024382-37024559
  hypo

SEQ ID NO: 61312 - DNA, 60 bp, Homo sapiens
  chr6:37024589-37024649
  hypo
agcaggcaccctctgaggggcagagacctcgttccctcagctccccgtcctccatggtgt

SEQ ID NO: 61313 - DNA, 44 bp, Homo sapiens; identical to SEQ ID NO: 40803
  chr6:37053276-37053320
  hypo

SEQ ID NO: 61314 - DNA, 30 bp, Homo sapiens; identical to SEQ ID NO: 40804
  chr6:37275453-37275483
  hypo

SEQ ID NO: 61315 - DNA, 30 bp, Homo sapiens; identical to SEQ ID NO: 40805
  chr6:37358523-37358553
  hypo

SEQ ID NO: 61316 - DNA, 180 bp, Homo sapiens; identical to SEQ ID NO: 40806
  chr6:37391410-37391590
  hypo

SEQ ID NO: 61317 - DNA, 30 bp, Homo sapiens; identical to SEQ ID NO: 40807
  chr6:37557743-37557773
  hypo

SEQ ID NO: 61318 - DNA, 30 bp, Homo sapiens; identical to SEQ ID NO: 40809
  chr6:37791835-37791865
  hypo

SEQ ID NO: 61319 - DNA, 34 bp, Homo sapiens; identical to SEQ ID NO: 40810
  chr6:38018000-38018034
  hypo

SEQ ID NO: 61320 - DNA, 30 bp, Homo sapiens; identical to SEQ ID NO: 40811
  chr6:38137726-38137756
  hypo

SEQ ID NO: 61321 - DNA, 30 bp, Homo sapiens; identical to SEQ ID NO: 40812
  chr6:38183151-38183181
  hypo

SEQ ID NO: 61322 - DNA, 30 bp, Homo sapiens; identical to SEQ ID NO: 40813
  chr6:38684078-38684108
  hypo

SEQ ID NO: 61323 - DNA, 43 bp, Homo sapiens; identical to SEQ ID NO: 40814
  chr6:40244038-40244081
  hypo

SEQ ID NO: 61324 - DNA, 133 bp, Homo sapiens; identical to SEQ ID NO: 40815
  chr6:41709850-41709983
  hypo

SEQ ID NO: 61325 - DNA, 35 bp, Homo sapiens; identical to SEQ ID NO: 40816
  chr6:41715572-41715607
  hypo

SEQ ID NO: 61326 - DNA, 17 bp, Homo sapiens
  chr6:42062066-42062083
  hypo
gcctgagcaacacagcg

SEQ ID NO: 61327 - DNA, 29 bp, Homo sapiens
  chr6:42090829-42090858
  hypo
gagggacaggccgggcgcggtggctcacg

SEQ ID NO: 61328 - DNA, 88 bp, Homo sapiens; identical to SEQ ID NO: 40820
  chr6:42110870-42110958
  hypo

SEQ ID NO: 61329 - DNA, 36 bp, Homo sapiens; identical to SEQ ID NO: 40821
  chr6:42184577-42184613
  hypo

SEQ ID NO: 61330 - DNA, 176 bp, Homo sapiens; identical to SEQ ID NO: 40822
  chr6:42190336-42190512
  hypo

SEQ ID NO: 61331 - DNA, 224 bp, Homo sapiens; identical to SEQ ID NO: 40824
  chr6:42813314-42813538
  hypo

SEQ ID NO: 61332 - DNA, 37 bp, Homo sapiens; identical to SEQ ID NO: 40825
  chr6:42846392-42846429
  hypo

SEQ ID NO: 61333 - DNA, 53 bp, Homo sapiens
  chr6:42846609-42846662
  hypo
attacaggtgaaagccaccggcccgacctactgtttttcaggattctatatag

SEQ ID NO: 61334 - DNA, 137 bp, Homo sapiens
  chr6:43424470-43424607
  hypo
aaagacaaggacccagaacataatttctagtttgtgcaggacaacagggcagaggtcaggaacgctagcgcccatctctagtccttcagattgagatttcaccatctttaaattcaaaacatcggaaggagcagtcg

SEQ ID NO: 61335 - DNA, 30 bp, Homo sapiens; identical to SEQ ID NO: 14862
  chr6:43486338-43486368
  hypo

SEQ ID NO: 61336 - DNA, 41 bp, Homo sapiens; identical to SEQ ID NO: 14865
  chr6:44437145-44437186
  hypo

SEQ ID NO: 61337 - DNA, 30 bp, Homo sapiens; identical to SEQ ID NO: 40834
  chr6:44443992-44444022
  hypo

SEQ ID NO: 61338 - DNA, 119 bp, Homo sapiens; identical to SEQ ID NO: 40835
  chr6:45609047-45609166
  hypo

SEQ ID NO: 61339 - DNA, 26 bp, Homo sapiens
  chr6:47924456-47924482
  hypo
ctgctcctggccgagagtatggtttt

SEQ ID NO: 61340 - DNA, 172 bp, Homo sapiens; identical to SEQ ID NO: 40837
  chr6:49464924-49465096
  hypo

SEQ ID NO: 61341 - DNA, 142 bp, Homo sapiens
  chr6:49590413-49590555
  hypo
ccagcagtgtgaaaacgaactaatacaccaactaattcaagaaattgttttatctaatttcataatttctgttagtggaacaattattctgcagatttcaccccccttcccctttgatggaaaaccagactttttttttttt

SEQ ID NO: 61342 - DNA, 43 bp, Homo sapiens; identical to SEQ ID NO: 40839
  chr6:49590817-49590860
  hypo

SEQ ID NO: 61343 - DNA, 39 bp, Homo sapiens; identical to SEQ ID NO: 40840
  chr6:50207691-50207730
  hypo

SEQ ID NO: 61344 - DNA, 30 bp, Homo sapiens; identical to SEQ ID NO: 40841
  chr6:52102871-52102901
  hypo

SEQ ID NO: 61345 - DNA, 88 bp, Homo sapiens; identical to SEQ ID NO: 40842
  chr6:52156845-52156933
  hypo

SEQ ID NO: 61346 - DNA, 107 bp, Homo sapiens; identical to SEQ ID NO: 40843
  chr6:52268182-52268289
  hypo

SEQ ID NO: 61347 - DNA, 180 bp, Homo sapiens; identical to SEQ ID NO: 40844
  chr6:52928856-52929036
  hypo

SEQ ID NO: 61348 - DNA, 34 bp, Homo sapiens; identical to SEQ ID NO: 40845
  chr6:52929276-52929310
  hypo

SEQ ID NO: 61349 - DNA, 30 bp, Homo sapiens; identical to SEQ ID NO: 40846
  chr6:57979515-57979545
  hypo

SEQ ID NO: 61350 - DNA, 35 bp, Homo sapiens; identical to SEQ ID NO: 40847
  chr6:58504069-58504104
  hypo

SEQ ID NO: 61351 - DNA, 148 bp, Homo sapiens; identical to SEQ ID NO: 40848
  chr6:64150678-64150826
  hypo

SEQ ID NO: 61352 - DNA, 20 bp, Homo sapiens
  chr6:71277673-71277693
  hypo
caccgcgcccggtccgcaaa

SEQ ID NO: 61353 - DNA, 179 bp, Homo sapiens; identical to SEQ ID NO: 40850
  chr6:73764839-73765018
  hypo

SEQ ID NO: 61354 - DNA, 103 bp, Homo sapiens; identical to SEQ ID NO: 40851
  chr6:74234126-74234229
  hypo

SEQ ID NO: 61355 - DNA, 104 bp, Homo sapiens; identical to SEQ ID NO: 40852
  chr6:74698077-74698181
  hypo

SEQ ID NO: 61356 - DNA, 30 bp, Homo sapiens; identical to SEQ ID NO: 40853
  chr6:79699310-79699340
  hypo

SEQ ID NO: 61357 - DNA, 79 bp, Homo sapiens; identical to SEQ ID NO: 40855
  chr6:84513478-84513557
  hypo

SEQ ID NO: 61358 - DNA, 68 bp, Homo sapiens; identical to SEQ ID NO: 24239
  chr6:86302345-86302413
  hypo

SEQ ID NO: 61359 - DNA, 30 bp, Homo sapiens; identical to SEQ ID NO: 40857
  chr6:86415082-86415112
  hypo

SEQ ID NO: 61360 - DNA, 38 bp, Homo sapiens; identical to SEQ ID NO: 40858
  chr6:89857352-89857390
  hypo

SEQ ID NO: 61361 - DNA, 111 bp, Homo sapiens; identical to SEQ ID NO: 40859
  chr6:90367322-90367433
  hypo

SEQ ID NO: 61362 - DNA, 51 bp, Homo sapiens; identical to SEQ ID NO: 40860
  chr6:90644578-90644629
  hypo

SEQ ID NO: 61363 - DNA, 185 bp, Homo sapiens; identical to SEQ ID NO: 40861
  chr6:90661223-90661408
  hypo

SEQ ID NO: 61364 - DNA, 16 bp, Homo sapiens
  chr6:97299315-97299331
  hypo
ccgtctcaaaaaaaaa

SEQ ID NO: 61365 - DNA, 127 bp, Homo sapiens
  chr6:99396329-99396456
  hypo
tcatttccataccaacgttcagaagcctctgaccattacctctgatgaagaagatggtctggcagcctctcttactcattttgatttatttttggtagattcagtatggcactttatttatttattt

SEQ ID NO: 61366 - DNA, 29 bp, Homo sapiens
  chr6:99396718-99396747
  hypo
tgagccaccgcgcccgcccttggcacttt

SEQ ID NO: 61367 - DNA, 30 bp, Homo sapiens; identical to SEQ ID NO: 14876
  chr6:105750542-105750572
  hypo

SEQ ID NO: 61368 - DNA, 44 bp, Homo sapiens; identical to SEQ ID NO: 40866
  chr6:107075561-107075605
  hypo

SEQ ID NO: 61369 - DNA, 76 bp, Homo sapiens; identical to SEQ ID NO: 40867
  chr6:108274499-108274575
  hypo

SEQ ID NO: 61370 - DNA, 68 bp, Homo sapiens
  chr6:108280352-108280420
  hypo
gacagatttgaatctacgctgtgcccatcttgcagatgaagatttccccaagccgttacagatggttc

SEQ ID NO: 61371 - DNA, 38 bp, Homo sapiens; identical to SEQ ID NO: 40869
  chr6:109038585-109038623
  hypo

SEQ ID NO: 61372 - DNA, 24 bp, Homo sapiens
  chr6:109057736-109057760
  hypo
tgttaggaatattctcggcccggt

SEQ ID NO: 61373 - DNA, 82 bp, Homo sapiens; identical to SEQ ID NO: 14879
  chr6:109059835-109059917
  hypo

SEQ ID NO: 61374 - DNA, 137 bp, Homo sapiens; identical to SEQ ID NO: 40872
  chr6:116574057-116574194
  hypo

SEQ ID NO: 61375 - DNA, 30 bp, Homo sapiens; identical to SEQ ID NO: 40873
  chr6:118113403-118113433
  hypo

SEQ ID NO: 61376 - DNA, 30 bp, Homo sapiens; identical to SEQ ID NO: 40874
  chr6:119240714-119240744
  hypo

SEQ ID NO: 61377 - DNA, 30 bp, Homo sapiens; identical to SEQ ID NO: 40875
  chr6:119254223-119254253
  hypo

SEQ ID NO: 61378 - DNA, 38 bp, Homo sapiens
  chr6:119254678-119254716
  hypo
aaaaaagagagaaacacttatttcgtttggaaagagat

SEQ ID NO: 61379 - DNA, 20 bp, Homo sapiens
  chr6:119560062-119560082
  hypo
ttattatttttgagacggag

SEQ ID NO: 61380 - DNA, 42 bp, Homo sapiens; identical to SEQ ID NO: 40878
  chr6:119689647-119689689
  hypo

SEQ ID NO: 61381 - DNA, 30 bp, Homo sapiens; identical to SEQ ID NO: 40879
  chr6:119824210-119824240
  hypo

SEQ ID NO: 61382 - DNA, 28 bp, Homo sapiens
  chr6:119888174-119888202
  hypo
tgtctataaaatccggtgcactctgctg

SEQ ID NO: 61383 - DNA, 30 bp, Homo sapiens; identical to SEQ ID NO: 40881
  chr6:119888428-119888458
  hypo

SEQ ID NO: 61384 - DNA, 30 bp, Homo sapiens; identical to SEQ ID NO: 40882
  chr6:119989053-119989083
  hypo

SEQ ID NO: 61385 - DNA, 30 bp, Homo sapiens; identical to SEQ ID NO: 40883
  chr6:121370471-121370501
  hypo

SEQ ID NO: 61386 - DNA, 17 bp, Homo sapiens
  chr6:125013694-125013711
  hypo
gttcacacctgtaatcg

SEQ ID NO: 61387 - DNA, 77 bp, Homo sapiens; identical to SEQ ID NO: 40885
  chr6:125081173-125081250
  hypo

SEQ ID NO: 61388 - DNA, 36 bp, Homo sapiens; identical to SEQ ID NO: 40886
  chr6:125286431-125286467
  hypo

SEQ ID NO: 61389 - DNA, 105 bp, Homo sapiens; identical to SEQ ID NO: 40887
  chr6:125397724-125397829
  hypo

SEQ ID NO: 61390 - DNA, 30 bp, Homo sapiens; identical to SEQ ID NO: 40888
  chr6:129480603-129480633
  hypo

SEQ ID NO: 61391 - DNA, 30 bp, Homo sapiens; identical to SEQ ID NO: 40889
  chr6:130182604-130182634
  hypo

SEQ ID NO: 61392 - DNA, 30 bp, Homo sapiens; identical to SEQ ID NO: 40890
  chr6:130241934-130241964
  hypo

SEQ ID NO: 61393 - DNA, 149 bp, Homo sapiens; identical to SEQ ID NO: 40891
  chr6:130530028-130530177
  hypo

SEQ ID NO: 61394 - DNA, 30 bp, Homo sapiens; identical to SEQ ID NO: 40892
  chr6:130808098-130808128
  hypo

SEQ ID NO: 61395 - DNA, 32 bp, Homo sapiens; identical to SEQ ID NO: 40893
  chr6:131389791-131389823
  hypo

SEQ ID NO: 61396 - DNA, 30 bp, Homo sapiens; identical to SEQ ID NO: 40894
  chr6:131455819-131455849
  hypo

SEQ ID NO: 61397 - DNA, 61 bp, Homo sapiens; identical to SEQ ID NO: 40895
  chr6:131616389-131616450
  hypo

SEQ ID NO: 61398 - DNA, 77 bp, Homo sapiens
  chr6:134067471-134067548
  hypo
gagctctttaaagggctctgagcctgggattcttgggagagttccattgcattgtatggtcacggagattgacacag

SEQ ID NO: 61399 - DNA, 86 bp, Homo sapiens; identical to SEQ ID NO: 40898
  chr6:134589886-134589972
  hypo

SEQ ID NO: 61400 - DNA, 137 bp, Homo sapiens; identical to SEQ ID NO: 40899
  chr6:137144480-137144617
  hypo

SEQ ID NO: 61401 - DNA, 150 bp, Homo sapiens; identical to SEQ ID NO: 40900
  chr6:138790432-138790582
  hypo

SEQ ID NO: 61402 - DNA, 60 bp, Homo sapiens; identical to SEQ ID NO: 40901
  chr6:143557423-143557483
  hypo

SEQ ID NO: 61403 - DNA, 30 bp, Homo sapiens; identical to SEQ ID NO: 40902
  chr6:144522041-144522071
  hypo

SEQ ID NO: 61404 - DNA, 30 bp, Homo sapiens; identical to SEQ ID NO: 40903
  chr6:147981884-147981914
  hypo

SEQ ID NO: 61405 - DNA, 99 bp, Homo sapiens; identical to SEQ ID NO: 40904
  chr6:149177471-149177570
  hypo

SEQ ID NO: 61406 - DNA, 30 bp, Homo sapiens; identical to SEQ ID NO: 40905
  chr6:149460105-149460135
  hypo

SEQ ID NO: 61407 - DNA, 23 bp, Homo sapiens
  chr6:149498669-149498692
  hypo
aattctccatccaatcgagtctt

SEQ ID NO: 61408 - DNA, 34 bp, Homo sapiens; identical to SEQ ID NO: 40907
  chr6:149772982-149773016
  hypo

SEQ ID NO: 61409 - DNA, 30 bp, Homo sapiens; identical to SEQ ID NO: 40908
  chr6:149786129-149786159
  hypo

SEQ ID NO: 61410 - DNA, 30 bp, Homo sapiens; identical to SEQ ID NO: 40909
  chr6:150985942-150985972
  hypo

SEQ ID NO: 61411 - DNA, 151 bp, Homo sapiens; identical to SEQ ID NO: 40910
  chr6:152520849-152521000
  hypo

SEQ ID NO: 61412 - DNA, 63 bp, Homo sapiens
  chr6:154970495-154970558
  hypo
gtgtaagcatctaaacgccaaaatgcctcaacttcctacctgagctcaagaagtacaagaagt

SEQ ID NO: 61413 - DNA, 26 bp, Homo sapiens
  chr6:155568751-155568777
  hypo
gcacctggccacgcttcatggctttt

SEQ ID NO: 61414 - DNA, 20 bp, Homo sapiens
  chr6:155569305-155569325
  hypo
cctgacgggtgaggcggcgg

SEQ ID NO: 61415 - DNA, 30 bp, Homo sapiens; identical to SEQ ID NO: 14887
  chr6:155988231-155988261
  hypo

SEQ ID NO: 61416 - DNA, 30 bp, Homo sapiens; identical to SEQ ID NO: 40915
  chr6:157283403-157283433
  hypo

SEQ ID NO: 61417 - DNA, 30 bp, Homo sapiens; identical to SEQ ID NO: 40916
  chr6:157455406-157455436
  hypo

SEQ ID NO: 61418 - DNA, 39 bp, Homo sapiens; identical to SEQ ID NO: 14888
  chr6:157478299-157478338
  hypo

SEQ ID NO: 61419 - DNA, 48 bp, Homo sapiens; identical to SEQ ID NO: 40918
  chr6:157505817-157505865
  hypo

SEQ ID NO: 61420 - DNA, 27 bp, Homo sapiens
  chr6:157637384-157637411
  hypo
cagcttcctgtagctcgtcccaaggtc

SEQ ID NO: 61421 - DNA, 84 bp, Homo sapiens; identical to SEQ ID NO: 40920
  chr6:157638362-157638446
  hypo

SEQ ID NO: 61422 - DNA, 105 bp, Homo sapiens; identical to SEQ ID NO: 40921
  chr6:157913083-157913188
  hypo

SEQ ID NO: 61423 - DNA, 50 bp, Homo sapiens; identical to SEQ ID NO: 40922
  chr6:158093775-158093825
  hypo

SEQ ID NO: 61424 - DNA, 30 bp, Homo sapiens; identical to SEQ ID NO: 14891
  chr6:158119028-158119058
  hypo

SEQ ID NO: 61425 - DNA, 184 bp, Homo sapiens; identical to SEQ ID NO: 40924
  chr6:158489608-158489792
  hypo

SEQ ID NO: 61426 - DNA, 30 bp, Homo sapiens; identical to SEQ ID NO: 40925
  chr6:158978998-158979028
  hypo

SEQ ID NO: 61427 - DNA, 48 bp, Homo sapiens; identical to SEQ ID NO: 40926
  chr6:158982731-158982779
  hypo

SEQ ID NO: 61428 - DNA, 100 bp, Homo sapiens; identical to SEQ ID NO: 40927
  chr6:159049783-159049883
  hypo

SEQ ID NO: 61429 - DNA, 30 bp, Homo sapiens; identical to SEQ ID NO: 40928
  chr6:159113607-159113637
  hypo

SEQ ID NO: 61430 - DNA, 28 bp, Homo sapiens
  chr6:159151645-159151673
  hypo
actctcagcaacgcggaaagaaagcagc

SEQ ID NO: 61431 - DNA, 30 bp, Homo sapiens; identical to SEQ ID NO: 40930
  chr6:159194759-159194789
  hypo

SEQ ID NO: 61432 - DNA, 30 bp, Homo sapiens; identical to SEQ ID NO: 40931
  chr6:159253019-159253049
  hypo

SEQ ID NO: 61433 - DNA, 29 bp, Homo sapiens
  chr6:159270065-159270094
  hypo
catgctggccaggcacggtggctcacacc

SEQ ID NO: 61434 - DNA, 30 bp, Homo sapiens; identical to SEQ ID NO: 40933
  chr6:159456960-159456990
  hypo

SEQ ID NO: 61435 - DNA, 154 bp, Homo sapiens; identical to SEQ ID NO: 40934
  chr6:159569256-159569410
  hypo

SEQ ID NO: 61436 - DNA, 30 bp, Homo sapiens; identical to SEQ ID NO: 40935
  chr6:160450704-160450734
  hypo

SEQ ID NO: 61437 - DNA, 55 bp, Homo sapiens; identical to SEQ ID NO: 14894
  chr6:160511899-160511954
  hypo

SEQ ID NO: 61438 - DNA, 32 bp, Homo sapiens; identical to SEQ ID NO: 40937
  chr6:161259532-161259564
  hypo

SEQ ID NO: 61439 - DNA, 100 bp, Homo sapiens; identical to SEQ ID NO: 40938
  chr6:161609814-161609914
  hypo

SEQ ID NO: 61440 - DNA, 63 bp, Homo sapiens; identical to SEQ ID NO: 40939
  chr6:161672733-161672796
  hypo

SEQ ID NO: 61441 - DNA, 162 bp, Homo sapiens; identical to SEQ ID NO: 40940
  chr6:161685567-161685729
  hypo

SEQ ID NO: 61442 - DNA, 32 bp, Homo sapiens; identical to SEQ ID NO: 14896
  chr6:161690517-161690549
  hypo

SEQ ID NO: 61443 - DNA, 79 bp, Homo sapiens; identical to SEQ ID NO: 40942
  chr6:161780140-161780219
  hypo

SEQ ID NO: 61444 - DNA, 25 bp, Homo sapiens
  chr6:161795264-161795289
  hypo
tgtgttgtgtatatgcgtatgctgt

SEQ ID NO: 61445 - DNA, 24 bp, Homo sapiens
  chr6:161795349-161795373
  hypo
tgtgtgtaacgcatggtgtgcatg

SEQ ID NO: 61446 - DNA, 36 bp, Homo sapiens; identical to SEQ ID NO: 40945
  chr6:161989335-161989371
  hypo

SEQ ID NO: 61447 - DNA, 166 bp, Homo sapiens; identical to SEQ ID NO: 40946
  chr6:162257865-162258031
  hypo

SEQ ID NO: 61448 - DNA, 30 bp, Homo sapiens; identical to SEQ ID NO: 40947
  chr6:162280335-162280365
  hypo

SEQ ID NO: 61449 - DNA, 30 bp, Homo sapiens; identical to SEQ ID NO: 40948
  chr6:163673402-163673432
  hypo

SEQ ID NO: 61450 - DNA, 30 bp, Homo sapiens; identical to SEQ ID NO: 40949
  chr6:163915349-163915379
  hypo

SEQ ID NO: 61451 - DNA, 17 bp, Homo sapiens
  chr6:163945812-163945829
  hypo
tacgatcatctattcta

SEQ ID NO: 61452 - DNA, 43 bp, Homo sapiens; identical to SEQ ID NO: 40951
  chr6:163946785-163946828
  hypo

SEQ ID NO: 61453 - DNA, 30 bp, Homo sapiens; identical to SEQ ID NO: 40952
  chr6:164012441-164012471
  hypo

SEQ ID NO: 61454 - DNA, 117 bp, Homo sapiens; identical to SEQ ID NO: 40953
  chr6:164064007-164064124
  hypo

SEQ ID NO: 61455 - DNA, 18 bp, Homo sapiens
  chr6:164114295-164114313
  hypo
ttatttttttgagaccga

SEQ ID NO: 61456 - DNA, 30 bp, Homo sapiens; identical to SEQ ID NO: 40955
  chr6:164121841-164121871
  hypo

SEQ ID NO: 61457 - DNA, 30 bp, Homo sapiens; identical to SEQ ID NO: 40956
  chr6:164143599-164143629
  hypo

SEQ ID NO: 61458 - DNA, 30 bp, Homo sapiens; identical to SEQ ID NO: 40957
  chr6:164145369-164145399
  hypo

SEQ ID NO: 61459 - DNA, 30 bp, Homo sapiens; identical to SEQ ID NO: 40958
  chr6:164149978-164150008
  hypo

SEQ ID NO: 61460 - DNA, 92 bp, Homo sapiens; identical to SEQ ID NO: 40959
  chr6:164165801-164165893
  hypo

SEQ ID NO: 61461 - DNA, 30 bp, Homo sapiens; identical to SEQ ID NO: 40960
  chr6:164173782-164173812
  hypo

SEQ ID NO: 61462 - DNA, 77 bp, Homo sapiens; identical to SEQ ID NO: 40961
  chr6:164182851-164182928
  hypo

SEQ ID NO: 61463 - DNA, 44 bp, Homo sapiens; identical to SEQ ID NO: 14900
  chr6:164183729-164183773
  hypo

SEQ ID NO: 61464 - DNA, 15 bp, Homo sapiens
  chr6:164197003-164197018
  hypo
cgtcttctgacaaac

SEQ ID NO: 61465 - DNA, 64 bp, Homo sapiens; identical to SEQ ID NO: 24267
  chr6:164228363-164228427
  hypo

SEQ ID NO: 61466 - DNA, 30 bp, Homo sapiens; identical to SEQ ID NO: 40965
  chr6:164228847-164228877
  hypo

SEQ ID NO: 61467 - DNA, 94 bp, Homo sapiens; identical to SEQ ID NO: 40966
  chr6:164241357-164241451
  hypo

SEQ ID NO: 61468 - DNA, 30 bp, Homo sapiens; identical to SEQ ID NO: 40967
  chr6:164243378-164243408
  hypo

SEQ ID NO: 61469 - DNA, 38 bp, Homo sapiens
  chr6:164283216-164283254
  hypo
gggaggaggcattgccgggaagcatgtccccagcgtgg

SEQ ID NO: 61470 - DNA, 30 bp, Homo sapiens; identical to SEQ ID NO: 14906
  chr6:164288079-164288109
  hypo

SEQ ID NO: 61471 - DNA, 310 bp, Homo sapiens
  chr6:164322356-164322666
  hypo
aagtagaagtcctcacgggcaactccctgccatccacaccaacctccccttcttgttctctccttctcatcttaaactttcgagaggaagaagggttggtcaagggtgaacgttcctgggcatggtgagaggctgctctgtggtgcccactcacactgagagggaccagctggggacgcctgatggtgccactgaggctttggggtcccctttcagaggggggcatcttaacgcgagtcttacggtctttcctgggttcccatgctcggcggcggctcctccacaggcctgtcttccctttgttctggag

SEQ ID NO: 61472 - DNA, 86 bp, Homo sapiens; identical to SEQ ID NO: 40973
  chr6:164323845-164323931
  hypo

SEQ ID NO: 61473 - DNA, 108 bp, Homo sapiens; identical to SEQ ID NO: 40974
  chr6:164334224-164334332
  hypo

SEQ ID NO: 61474 - DNA, 16 bp, Homo sapiens
  chr6:166487246-166487262
  hypo
gcgcccggccgaagta

SEQ ID NO: 61475 - DNA, 46 bp, Homo sapiens; identical to SEQ ID NO: 40976
  chr6:166571891-166571937
  hypo

SEQ ID NO: 61476 - DNA, 34 bp, Homo sapiens; identical to SEQ ID NO: 40977
  chr6:166635593-166635627
  hypo

SEQ ID NO: 61477 - DNA, 127 bp, Homo sapiens; identical to SEQ ID NO: 40978
  chr6:166711375-166711502
  hypo

SEQ ID NO: 61478 - DNA, 32 bp, Homo sapiens; identical to SEQ ID NO: 40979
  chr6:166888304-166888336
  hypo

SEQ ID NO: 61479 - DNA, 191 bp, Homo sapiens; identical to SEQ ID NO: 40980
  chr6:166891668-166891859
  hypo

SEQ ID NO: 61480 - DNA, 11 bp, Homo sapiens
  chr6:166944356-166944367
  hypo
aaaaccgagtg

SEQ ID NO: 61481 - DNA, 109 bp, Homo sapiens; identical to SEQ ID NO: 24273
  chr6:166944403-166944512
  hypo

SEQ ID NO: 61482 - DNA, 30 bp, Homo sapiens; identical to SEQ ID NO: 40982
  chr6:166982961-166982991
  hypo

SEQ ID NO: 61483 - DNA, 79 bp, Homo sapiens; identical to SEQ ID NO: 40983
  chr6:167038238-167038317
  hypo

SEQ ID NO: 61484 - DNA, 210 bp, Homo sapiens; identical to SEQ ID NO: 40984
  chr6:167139240-167139450
  hypo

SEQ ID NO: 61485 - DNA, 159 bp, Homo sapiens; identical to SEQ ID NO: 40985
  chr6:167140362-167140521
  hypo

SEQ ID NO: 61486 - DNA, 79 bp, Homo sapiens; identical to SEQ ID NO: 40986
  chr6:167835047-167835126
  hypo

SEQ ID NO: 61487 - DNA, 33 bp, Homo sapiens; identical to SEQ ID NO: 40987
  chr6:168122617-168122650
  hypo

SEQ ID NO: 61488 - DNA, 62 bp, Homo sapiens; identical to SEQ ID NO: 40988
  chr6:168376121-168376183
  hypo

SEQ ID NO: 61489 - DNA, 131 bp, Homo sapiens; identical to SEQ ID NO: 40989
  chr6:168377422-168377553
  hypo

SEQ ID NO: 61490 - DNA, 33 bp, Homo sapiens; identical to SEQ ID NO: 40990
  chr6:168399961-168399994
  hypo

SEQ ID NO: 61491 - DNA, 196 bp, Homo sapiens; identical to SEQ ID NO: 40991
  chr6:168453289-168453485
  hypo

SEQ ID NO: 61492 - DNA, 30 bp, Homo sapiens; identical to SEQ ID NO: 40992
  chr6:168760650-168760680
  hypo

SEQ ID NO: 61493 - DNA, 18 bp, Homo sapiens
  chr6:168858296-168858314
  hypo
tgccggggtgggagcctg

SEQ ID NO: 61494 - DNA, 157 bp, Homo sapiens; identical to SEQ ID NO: 40994
  chr6:168947642-168947799
  hypo

SEQ ID NO: 61495 - DNA, 30 bp, Homo sapiens; identical to SEQ ID NO: 40995
  chr6:169400246-169400276
  hypo

SEQ ID NO: 61496 - DNA, 50 bp, Homo sapiens; identical to SEQ ID NO: 40996
  chr6:169562391-169562441
  hypo

SEQ ID NO: 61497 - DNA, 30 bp, Homo sapiens; identical to SEQ ID NO: 40997
  chr6:169562792-169562822
  hypo

SEQ ID NO: 61498 - DNA, 415 bp, Homo sapiens; identical to SEQ ID NO: 40998
  chr6:169632421-169632836
  hypo

SEQ ID NO: 61499 - DNA, 35 bp, Homo sapiens; identical to SEQ ID NO: 40999
  chr6:169637816-169637851
  hypo

SEQ ID NO: 61500 - DNA, 30 bp, Homo sapiens; identical to SEQ ID NO: 41000
  chr6:169713660-169713690
  hypo

SEQ ID NO: 61501 - DNA, 30 bp, Homo sapiens; identical to SEQ ID NO: 41001
  chr6:169740776-169740806
  hypo

SEQ ID NO: 61502 - DNA, 30 bp, Homo sapiens; identical to SEQ ID NO: 41002
  chr6:170065367-170065397
  hypo

SEQ ID NO: 61503 - DNA, 30 bp, Homo sapiens; identical to SEQ ID NO: 41003
  chr6:170201723-170201753
  hypo

SEQ ID NO: 61504 - DNA, 30 bp, Homo sapiens; identical to SEQ ID NO: 41004
  chr6:170240081-170240111
  hypo

SEQ ID NO: 61505 - DNA, 30 bp, Homo sapiens; identical to SEQ ID NO: 41005
  chr6:170263220-170263250
  hypo

SEQ ID NO: 61506 - DNA, 30 bp, Homo sapiens; identical to SEQ ID NO: 41006
  chr6:170361487-170361517
  hypo

SEQ ID NO: 61507 - DNA, 30 bp, Homo sapiens; identical to SEQ ID NO: 41007
  chr6:170368767-170368797
  hypo

SEQ ID NO: 61508 - DNA, 30 bp, Homo sapiens; identical to SEQ ID NO: 41008
  chr6:170402505-170402535
  hypo

SEQ ID NO: 61509 - DNA, 30 bp, Homo sapiens; identical to SEQ ID NO: 41009
  chr6:170408290-170408320
  hypo

SEQ ID NO: 61510 - DNA, 40 bp, Homo sapiens; identical to SEQ ID NO: 41010
  chr6:170454160-170454200
  hypo

SEQ ID NO: 61511 - DNA, 77 bp, Homo sapiens; identical to SEQ ID NO: 24277
  chr6:170475028-170475105
  hypo

SEQ ID NO: 61512 - DNA, 357 bp, Homo sapiens
  chr6:170475267-170475624
  hypo
ggcactgagagaccggtgccgccccccgccgtccacacaacccgggcctcgggcagcaccagcaggacttttattcctcaccccgcacgccgccgtccatctcctaggccagcgtgattcttctgagtgcagctgggtctcctcctgggagatccggtggctctagcagcgtgggtgctgggaacaggaccagcctcgccggcggacagtgtggacgcctgagggcaaaccctggaccactctctccccgggggactccgttcccgcctccagggagctgcgaacgctccttctgggacacctgttggcaagaaaccagttcaatcgtctcacttccagaaacgattctgtgttttg

SEQ ID NO: 61513 - DNA, 118 bp, Homo sapiens; identical to SEQ ID NO: 41012
  chr6:170493059-170493177
  hypo

SEQ ID NO: 61514 - DNA, 30 bp, Homo sapiens; identical to SEQ ID NO: 41013
  chr6:170569817-170569847
  hypo

SEQ ID NO: 61515 - DNA, 167 bp, Homo sapiens; identical to SEQ ID NO: 41015
  chr7:131076-131243
  hypo

SEQ ID NO: 61516 - DNA, 159 bp, Homo sapiens; identical to SEQ ID NO: 41016
  chr7:171340-171499
  hypo

SEQ ID NO: 61517 - DNA, 30 bp, Homo sapiens; identical to SEQ ID NO: 41017
  chr7:306966-306996
  hypo

SEQ ID NO: 61518 - DNA, 30 bp, Homo sapiens; identical to SEQ ID NO: 41018
  chr7:322785-322815
  hypo

SEQ ID NO: 61519 - DNA, 44 bp, Homo sapiens; identical to SEQ ID NO: 41019
  chr7:328564-328608
  hypo

SEQ ID NO: 61520 - DNA, 30 bp, Homo sapiens; identical to SEQ ID NO: 41021
  chr7:381568-381598
  hypo

SEQ ID NO: 61521 - DNA, 179 bp, Homo sapiens; identical to SEQ ID NO: 41023
  chr7:409602-409781
  hypo

SEQ ID NO: 61522 - DNA, 30 bp, Homo sapiens; identical to SEQ ID NO: 41024
  chr7:410011-410041
  hypo

SEQ ID NO: 61523 - DNA, 37 bp, Homo sapiens; identical to SEQ ID NO: 41025
  chr7:430257-430294
  hypo

SEQ ID NO: 61524 - DNA, 228 bp, Homo sapiens
  chr7:431492-431720
  hypo
agggagcggccgccagccgctaggatcccgatgccgccgcaagtaaggacaggcccgggtgctgccgcaggaggccaggcctgcgctcgccgctgtggaatgtgtgtttgtctgatgagcatccctgcagggccccagatggagggtgtgacaaggatgggggctgagtctccagggcccgggggcacctgcacgctgcccctggcaggggcccgggcatcccacctg

SEQ ID NO: 61525 - DNA, 45 bp, Homo sapiens; identical to SEQ ID NO: 41027
  chr7:476438-476483
  hypo

SEQ ID NO: 61526 - DNA, 30 bp, Homo sapiens; identical to SEQ ID NO: 41028
  chr7:494982-495012
  hypo

SEQ ID NO: 61527 - DNA, 40 bp, Homo sapiens
  chr7:497742-497782
  hypo
ctgggttaagagcagcgacaactgttcctattcataccgc

SEQ ID NO: 61528 - DNA, 30 bp, Homo sapiens; identical to SEQ ID NO: 41030
  chr7:502286-502316
  hypo

SEQ ID NO: 61529 - DNA, 279 bp, Homo sapiens; identical to SEQ ID NO: 41031
  chr7:502708-502987
  hypo

SEQ ID NO: 61530 - DNA, 135 bp, Homo sapiens
  chr7:503676-503811
  hypo
cagcccgggagggagcgtgaagtggaggatctcggcaggcgtggctgtgtccaggcaggcgggtgctgccgcgtccccggctgcagggtcttggttccccggagccacaggacggcagggcttcacggctccccg

SEQ ID NO: 61531 - DNA, 30 bp, Homo sapiens; identical to SEQ ID NO: 41033
  chr7:543015-543045
  hypo

SEQ ID NO: 61532 - DNA, 27 bp, Homo sapiens
  chr7:551572-551599
  hypo
caccagttcagcagccggcgcaggagc

SEQ ID NO: 61533 - DNA, 47 bp, Homo sapiens; identical to SEQ ID NO: 41035
  chr7:551972-552019
  hypo

SEQ ID NO: 61534 - DNA, 28 bp, Homo sapiens
  chr7:579020-579048
  hypo
ctcctgaggccggcgagtagattcctga

SEQ ID NO: 61535 - DNA, 70 bp, Homo sapiens; identical to SEQ ID NO: 41037
  chr7:803490-803560
  hypo

SEQ ID NO: 61536 - DNA, 30 bp, Homo sapiens; identical to SEQ ID NO: 41038
  chr7:808547-808577
  hypo

SEQ ID NO: 61537 - DNA, 75 bp, Homo sapiens; identical to SEQ ID NO: 41039
  chr7:819623-819698
  hypo

SEQ ID NO: 61538 - DNA, 520 bp, Homo sapiens; identical to SEQ ID NO: 41040
  chr7:834330-834850
  hypo

SEQ ID NO: 61539 - DNA, 59 bp, Homo sapiens; identical to SEQ ID NO: 41042
  chr7:915323-915382
  hypo

SEQ ID NO: 61540 - DNA, 68 bp, Homo sapiens; identical to SEQ ID NO: 41043
  chr7:959576-959644
  hypo

SEQ ID NO: 61541 - DNA, 73 bp, Homo sapiens; identical to SEQ ID NO: 41044
  chr7:959899-959972
  hypo

SEQ ID NO: 61542 - DNA, 44 bp, Homo sapiens; identical to SEQ ID NO: 41045
  chr7:966875-966919
  hypo

SEQ ID NO: 61543 - DNA, 60 bp, Homo sapiens; identical to SEQ ID NO: 41046
  chr7:986276-986336
  hypo

SEQ ID NO: 61544 - DNA, 34 bp, Homo sapiens; identical to SEQ ID NO: 41047
  chr7:1022042-1022076
  hypo

SEQ ID NO: 61545 - DNA, 48 bp, Homo sapiens; identical to SEQ ID NO: 41048
  chr7:1022919-1022967
  hypo

SEQ ID NO: 61546 - DNA, 30 bp, Homo sapiens; identical to SEQ ID NO: 41049
  chr7:1023349-1023379
  hypo

SEQ ID NO: 61547 - DNA, 54 bp, Homo sapiens; identical to SEQ ID NO: 41050
  chr7:1026923-1026977
  hypo

SEQ ID NO: 61548 - DNA, 190 bp, Homo sapiens; identical to SEQ ID NO: 41051
  chr7:1027200-1027390
  hypo

SEQ ID NO: 61549 - DNA, 167 bp, Homo sapiens
  chr7:1030005-1030172
  hypo
tggcgcgtgtgctgggggcggtgtgatgggacacctgctgtctgagacggccctggcccccgtcccagcgctgaccatgcacgtgagcggcaggcggcccctcaccgagaagagaggataagccgtggcacattcccacctgcgccacgtgaagcggcgccccaagg

SEQ ID NO: 61550 - DNA, 72 bp, Homo sapiens; identical to SEQ ID NO: 41053
  chr7:1037234-1037306
  hypo

SEQ ID NO: 61551 - DNA, 135 bp, Homo sapiens
  chr7:1054444-1054579
  hypo
gccacggcagcgttccggttggtgtcaccctgtcccggcctgagcccagctctcagatccgagcaccaattctgtctacagccccttcctgcctgcgggccctccctgccctgcagggacggtgcagtgagcaca

SEQ ID NO: 61552 - DNA, 350 bp, Homo sapiens; identical to SEQ ID NO: 41055
  chr7:1066042-1066392
  hypo

SEQ ID NO: 61553 - DNA, 30 bp, Homo sapiens; identical to SEQ ID NO: 41057
  chr7:1115722-1115752
  hypo

SEQ ID NO: 61554 - DNA, 37 bp, Homo sapiens; identical to SEQ ID NO: 41058
  chr7:1303471-1303508
  hypo

SEQ ID NO: 61555 - DNA, 38 bp, Homo sapiens; identical to SEQ ID NO: 24287
  chr7:1308497-1308535
  hypo

SEQ ID NO: 61556 - DNA, 30 bp, Homo sapiens; identical to SEQ ID NO: 41060
  chr7:1313980-1314010
  hypo

SEQ ID NO: 61557 - DNA, 68 bp, Homo sapiens; identical to SEQ ID NO: 41061
  chr7:1315892-1315960
  hypo

SEQ ID NO: 61558 - DNA, 30 bp, Homo sapiens; identical to SEQ ID NO: 41062
  chr7:1318952-1318982
  hypo

SEQ ID NO: 61559 - DNA, 167 bp, Homo sapiens
  chr7:1325643-1325810
  hypo
tcgcctggggacacacgtggtgcgtgtggcttttcagctgctcaacactcacttctgaggcccccgcggcgtggcacggcctgggcgttggatgcagcagtgaacgggacccacgcggggactcagggtatgacgggcagaggggtaggtggggtgggggcaggtga

SEQ ID NO: 61560 - DNA, 59 bp, Homo sapiens
  chr7:1325882-1325941
  hypo
aacccgggcgcactgggaggcacgatccaggcggagggagcagccgtgccagggccctg

SEQ ID NO: 61561 - DNA, 33 bp, Homo sapiens; identical to SEQ ID NO: 41064
  chr7:1331244-1331277
  hypo

SEQ ID NO: 61562 - DNA, 82 bp, Homo sapiens; identical to SEQ ID NO: 41065
  chr7:1333580-1333662
  hypo

SEQ ID NO: 61563 - DNA, 83 bp, Homo sapiens; identical to SEQ ID NO: 41066
  chr7:1351523-1351606
  hypo

SEQ ID NO: 61564 - DNA, 34 bp, Homo sapiens; identical to SEQ ID NO: 41067
  chr7:1363593-1363627
  hypo

SEQ ID NO: 61565 - DNA, 144 bp, Homo sapiens; identical to SEQ ID NO: 41068
  chr7:1365367-1365511
  hypo

SEQ ID NO: 61566 - DNA, 81 bp, Homo sapiens; identical to SEQ ID NO: 41069
  chr7:1368971-1369052
  hypo

SEQ ID NO: 61567 - DNA, 61 bp, Homo sapiens; identical to SEQ ID NO: 41070
  chr7:1384815-1384876
  hypo

SEQ ID NO: 61568 - DNA, 185 bp, Homo sapiens; identical to SEQ ID NO: 41071
  chr7:1395730-1395915
  hypo

SEQ ID NO: 61569 - DNA, 89 bp, Homo sapiens
  chr7:1416131-1416220
  hypo
agggcatcgtgcaggcactaaactcaatgctacaggagaattcctcgtggcacaggaaaggtctcatcgtataccgttgcgggaaaagg

SEQ ID NO: 61570 - DNA, 26 bp, Homo sapiens
  chr7:1423606-1423632
  hypo
ttgctgccttccccccgcccagtccc

SEQ ID NO: 61571 - DNA, 79 bp, Homo sapiens; identical to SEQ ID NO: 41074
  chr7:1451244-1451323
  hypo

SEQ ID NO: 61572 - DNA, 30 bp, Homo sapiens; identical to SEQ ID NO: 41075
  chr7:1453817-1453847
  hypo

SEQ ID NO: 61573 - DNA, 82 bp, Homo sapiens
  chr7:1458959-1459041
  hypo
cagctcccataaccccgtctcctcctcctcctcgccctcctcctcctcgctgtctctgcaccacttccacctgcccgggcct

SEQ ID NO: 61574 - DNA, 63 bp, Homo sapiens; identical to SEQ ID NO: 41077
  chr7:1460807-1460870
  hypo

SEQ ID NO: 61575 - DNA, 30 bp, Homo sapiens; identical to SEQ ID NO: 41078
  chr7:1503320-1503350
  hypo

SEQ ID NO: 61576 - DNA, 171 bp, Homo sapiens
  chr7:1503596-1503767
  hypo
agggaggtgtcctggccgagtggtgtttcccgcgggacttctcagagccttcatcacctgatacgcacctccactcttccagggagaggacacactgcacagtggttcccaaactgacttgcccacaggacccctgtggacggttgtggggcaccacgtcagcccccctgc

SEQ ID NO: 61577 - DNA, 63 bp, Homo sapiens; identical to SEQ ID NO: 41080
  chr7:1516637-1516700
  hypo

SEQ ID NO: 61578 - DNA, 42 bp, Homo sapiens; identical to SEQ ID NO: 41081
  chr7:1532979-1533021
  hypo

SEQ ID NO: 61579 - DNA, 49 bp, Homo sapiens
  chr7:1547262-1547311
  hypo
gggcaggaccacaggcgttccgtcatcctgggggggtgtgcagggtctg

SEQ ID NO: 61580 - DNA, 65 bp, Homo sapiens
  chr7:1547394-1547459
  hypo
ttggtgtctgttcaaattgtttgctcactttttgaaaatattttttatggccaggcgcgatggct

SEQ ID NO: 61581 - DNA, 30 bp, Homo sapiens; identical to SEQ ID NO: 14938
  chr7:1598982-1599012
  hypo

SEQ ID NO: 61582 - DNA, 159 bp, Homo sapiens; identical to SEQ ID NO: 41085
  chr7:1600538-1600697
  hypo

SEQ ID NO: 61583 - DNA, 30 bp, Homo sapiens; identical to SEQ ID NO: 41086
  chr7:1607585-1607615
  hypo

SEQ ID NO: 61584 - DNA, 73 bp, Homo sapiens; identical to SEQ ID NO: 41088
  chr7:1624815-1624888
  hypo

SEQ ID NO: 61585 - DNA, 66 bp, Homo sapiens
  chr7:1641708-1641774
  hypo
ctcgggatgcacctccgcactgtggggccatctgggtcagcccggacgcaccggcctctgtctggg

SEQ ID NO: 61586 - DNA, 34 bp, Homo sapiens
  chr7:1641923-1641957
  hypo
tgccttccaggtgaggcctcggtcattccaggtg

SEQ ID NO: 61587 - DNA, 30 bp, Homo sapiens; identical to SEQ ID NO: 41090
  chr7:1680203-1680233
  hypo

SEQ ID NO: 61588 - DNA, 100 bp, Homo sapiens; identical to SEQ ID NO: 41092
  chr7:1684968-1685068
  hypo

SEQ ID NO: 61589 - DNA, 27 bp, Homo sapiens
  chr7:1688950-1688977
  hypo
cctccctggatctcacgtcctcatttg

SEQ ID NO: 61590 - DNA, 65 bp, Homo sapiens; identical to SEQ ID NO: 41094
  chr7:1694007-1694072
  hypo

SEQ ID NO: 61591 - DNA, 34 bp, Homo sapiens; identical to SEQ ID NO: 41095
  chr7:1694952-1694986
  hypo

SEQ ID NO: 61592 - DNA, 50 bp, Homo sapiens; identical to SEQ ID NO: 41096
  chr7:1714947-1714997
  hypo

SEQ ID NO: 61593 - DNA, 57 bp, Homo sapiens; identical to SEQ ID NO: 41097
  chr7:1718027-1718084
  hypo

SEQ ID NO: 61594 - DNA, 206 bp, Homo sapiens; identical to SEQ ID NO: 41098
  chr7:1731744-1731950
  hypo

SEQ ID NO: 61595 - DNA, 59 bp, Homo sapiens
  chr7:1733378-1733437
  hypo
cccagagcaggtgtctgggagaccctgatcagtgctgacagacacggggtgcgggacac

SEQ ID NO: 61596 - DNA, 286 bp, Homo sapiens; identical to SEQ ID NO: 41100
  chr7:1734709-1734995
  hypo

SEQ ID NO: 61597 - DNA, 180 bp, Homo sapiens
  chr7:1775651-1775831
  hypo
cagcaggtgcacaggcgggccccccacctgctcctagctgggccgggtcaccgtggcaggccttgcggctcgaggcccaactgccctgatatgcctatcacagcctcatgggctctgcggcagagcccagggagacagacagggcgagagccaagctgcagaggcaggcagacgttagca

SEQ ID NO: 61598 - DNA, 30 bp, Homo sapiens; identical to SEQ ID NO: 41102
  chr7:1779654-1779684
  hypo

SEQ ID NO: 61599 - DNA, 90 bp, Homo sapiens; identical to SEQ ID NO: 41103
  chr7:1783212-1783302
  hypo

SEQ ID NO: 61600 - DNA, 69 bp, Homo sapiens; identical to SEQ ID NO: 41104
  chr7:1784330-1784399
  hypo

SEQ ID NO: 61601 - DNA, 186 bp, Homo sapiens; identical to SEQ ID NO: 41105
  chr7:1784690-1784876
  hypo

SEQ ID NO: 61602 - DNA, 104 bp, Homo sapiens
  chr7:1786410-1786514
  hypo
cacgagggcctggggcgcaaggcgtccatcctggagccactcacccggccgcggccccgcgacctcgcctactcgcagctgtccccgcagtaccacagcctgag

SEQ ID NO: 61603 - DNA, 14 bp, Homo sapiens
  chr7:1787152-1787166
  hypo
cgtggggggtgtgg

SEQ ID NO: 61604 - DNA, 95 bp, Homo sapiens
  chr7:1787324-1787419
  hypo
agccctgctggactcagggtgggtggaggctgtgcctgtggacggccggggtggccaggacggccaagggctgggaggcacgtcccccagcccag

SEQ ID NO: 61605 - DNA, 30 bp, Homo sapiens; identical to SEQ ID NO: 41108
  chr7:1795180-1795210
  hypo

SEQ ID NO: 61606 - DNA, 30 bp, Homo sapiens; identical to SEQ ID NO: 41110
  chr7:1838908-1838938
  hypo

SEQ ID NO: 61607 - DNA, 42 bp, Homo sapiens; identical to SEQ ID NO: 41111
  chr7:1849747-1849789
  hypo

SEQ ID NO: 61608 - DNA, 53 bp, Homo sapiens; identical to SEQ ID NO: 41112
  chr7:1931869-1931922
  hypo

SEQ ID NO: 61609 - DNA, 138 bp, Homo sapiens; identical to SEQ ID NO: 41113
  chr7:1962373-1962511
  hypo

SEQ ID NO: 61610 - DNA, 30 bp, Homo sapiens; identical to SEQ ID NO: 41114
  chr7:2024812-2024842
  hypo

SEQ ID NO: 61611 - DNA, 113 bp, Homo sapiens; identical to SEQ ID NO: 41115
  chr7:2056573-2056686
  hypo

SEQ ID NO: 61612 - DNA, 104 bp, Homo sapiens; identical to SEQ ID NO: 41116
  chr7:2110154-2110258
  hypo

SEQ ID NO: 61613 - DNA, 135 bp, Homo sapiens; identical to SEQ ID NO: 41118
  chr7:2206533-2206668
  hypo

SEQ ID NO: 61614 - DNA, 45 bp, Homo sapiens
  chr7:2232918-2232963
  hypo
agggccacccagctccgacagccaccacgtcctggagagaaagcg

SEQ ID NO: 61615 - DNA, 72 bp, Homo sapiens
  chr7:2238235-2238307
  hypo
ggtcaagagcatggaacacacacttcaggccccctctccaggctgcaggccaacaggcgtccatgagacaga

SEQ ID NO: 61616 - DNA, 85 bp, Homo sapiens; identical to SEQ ID NO: 41123
  chr7:2265530-2265615
  hypo

SEQ ID NO: 61617 - DNA, 30 bp, Homo sapiens; identical to SEQ ID NO: 41125
  chr7:2349402-2349432
  hypo

SEQ ID NO: 61618 - DNA, 83 bp, Homo sapiens; identical to SEQ ID NO: 41126
  chr7:2420313-2420396
  hypo

SEQ ID NO: 61619 - DNA, 30 bp, Homo sapiens; identical to SEQ ID NO: 41127
  chr7:2480354-2480384
  hypo

SEQ ID NO: 61620 - DNA, 30 bp, Homo sapiens; identical to SEQ ID NO: 41128
  chr7:2499688-2499718
  hypo

SEQ ID NO: 61621 - DNA, 38 bp, Homo sapiens; identical to SEQ ID NO: 41129
  chr7:2544589-2544627
  hypo

SEQ ID NO: 61622 - DNA, 194 bp, Homo sapiens; identical to SEQ ID NO: 41130
  chr7:2564711-2564905
  hypo

SEQ ID NO: 61623 - DNA, 186 bp, Homo sapiens; identical to SEQ ID NO: 41131
  chr7:2566041-2566227
  hypo

SEQ ID NO: 61624 - DNA, 113 bp, Homo sapiens
  chr7:2566487-2566600
  hypo
atgtttgaaaacaagcggaacgccgtccacgtgaaggggcccttctcggtggaggccgacccatccaggtaaggaaaccccggcccagatgggcttgcgtagggtggcctagg

SEQ ID NO: 61625 - DNA, 28 bp, Homo sapiens
  chr7:2566630-2566658
  hypo
gggtctctctaagcggcatgactctaca

SEQ ID NO: 61626 - DNA, 372 bp, Homo sapiens; identical to SEQ ID NO: 41133
  chr7:2686448-2686820
  hypo

SEQ ID NO: 61627 - DNA, 54 bp, Homo sapiens; identical to SEQ ID NO: 41134
  chr7:2700087-2700141
  hypo

SEQ ID NO: 61628 - DNA, 182 bp, Homo sapiens; identical to SEQ ID NO: 41135
  chr7:2718487-2718669
  hypo

SEQ ID NO: 61629 - DNA, 28 bp, Homo sapiens
  chr7:2731870-2731898
  hypo
gggttgaaagaggaccgagcttggccgg

SEQ ID NO: 61630 - DNA, 30 bp, Homo sapiens; identical to SEQ ID NO: 41138
  chr7:2747171-2747201
  hypo

SEQ ID NO: 61631 - DNA, 35 bp, Homo sapiens; identical to SEQ ID NO: 14955
  chr7:2798456-2798491
  hypo

SEQ ID NO: 61632 - DNA, 30 bp, Homo sapiens; identical to SEQ ID NO: 41140
  chr7:2916072-2916102
  hypo

SEQ ID NO: 61633 - DNA, 180 bp, Homo sapiens; identical to SEQ ID NO: 41141
  chr7:2923749-2923929
  hypo

SEQ ID NO: 61634 - DNA, 30 bp, Homo sapiens; identical to SEQ ID NO: 41142
  chr7:2958507-2958537
  hypo

SEQ ID NO: 61635 - DNA, 73 bp, Homo sapiens; identical to SEQ ID NO: 41143
  chr7:2966469-2966542
  hypo

SEQ ID NO: 61636 - DNA, 30 bp, Homo sapiens; identical to SEQ ID NO: 41144
  chr7:2976839-2976869
  hypo

SEQ ID NO: 61637 - DNA, 46 bp, Homo sapiens; identical to SEQ ID NO: 41145
  chr7:3026293-3026339
  hypo

SEQ ID NO: 61638 - DNA, 181 bp, Homo sapiens
  chr7:3033477-3033658
  hypo
gtctcccttctagctcgccaaatgctcagggttcctatattttaaaaaatcttgtcccatcaaactctgctttcaggaatggcacgaagagccgacacgcacggtgagcagctgccttctgcagatggaacgcctcacctgggacgcctcacctgggacgcctcacctgggacgcaggcgt

SEQ ID NO: 61639 - DNA, 110 bp, Homo sapiens
  chr7:3033688-3033798
  hypo
attcctgcccaagctcacatagcagggactggcccagccccattcactcatgcatgtctgaccccaaggcagggctggtggcctctaaatcctcccgctagggtttcagc

SEQ ID NO: 61640 - DNA, 206 bp, Homo sapiens
  chr7:3283498-3283704
  hypo
aatggagaaacagcccagagaggaaaagcgatttgcacagagtcacgcagctgaagactggcagatccaggctgtttgctgtcagtctgagctctcgaattctaagacgagccacttctctcgggaagccaggaaggctcctcgcaaatcctggtggagaagtggttacctcaaagccctttaagcacagtcataaacttaccttg

SEQ ID NO: 61641 - DNA, 38 bp, Homo sapiens; identical to SEQ ID NO: 41148
  chr7:3727142-3727180
  hypo

SEQ ID NO: 61642 - DNA, 34 bp, Homo sapiens; identical to SEQ ID NO: 41149
  chr7:4096353-4096387
  hypo

SEQ ID NO: 61643 - DNA, 30 bp, Homo sapiens; identical to SEQ ID NO: 41150
  chr7:4187836-4187866
  hypo

SEQ ID NO: 61644 - DNA, 93 bp, Homo sapiens; identical to SEQ ID NO: 41151
  chr7:4214921-4215014
  hypo

SEQ ID NO: 61645 - DNA, 30 bp, Homo sapiens; identical to SEQ ID NO: 41152
  chr7:4260867-4260897
  hypo

SEQ ID NO: 61646 - DNA, 30 bp, Homo sapiens; identical to SEQ ID NO: 41153
  chr7:4275488-4275518
  hypo

SEQ ID NO: 61647 - DNA, 86 bp, Homo sapiens; identical to SEQ ID NO: 41154
  chr7:4342691-4342777
  hypo

SEQ ID NO: 61648 - DNA, 73 bp, Homo sapiens; identical to SEQ ID NO: 41155
  chr7:4751426-4751499
  hypo

SEQ ID NO: 61649 - DNA, 30 bp, Homo sapiens; identical to SEQ ID NO: 41156
  chr7:4771572-4771602
  hypo

SEQ ID NO: 61650 - DNA, 90 bp, Homo sapiens; identical to SEQ ID NO: 41157
  chr7:4781955-4782045
  hypo

SEQ ID NO: 61651 - DNA, 87 bp, Homo sapiens; identical to SEQ ID NO: 14961
  chr7:4813783-4813870
  hypo

SEQ ID NO: 61652 - DNA, 114 bp, Homo sapiens; identical to SEQ ID NO: 41159
  chr7:4839337-4839451
  hypo

SEQ ID NO: 61653 - DNA, 175 bp, Homo sapiens; identical to SEQ ID NO: 41160
  chr7:4840176-4840351
  hypo

SEQ ID NO: 61654 - DNA, 30 bp, Homo sapiens; identical to SEQ ID NO: 41161
  chr7:4840692-4840722
  hypo

SEQ ID NO: 61655 - DNA, 104 bp, Homo sapiens; identical to SEQ ID NO: 41162
  chr7:4841057-4841161
  hypo

SEQ ID NO: 61656 - DNA, 141 bp, Homo sapiens
  chr7:4856843-4856984
  hypo
tgcagaagcagagcccgtccgtgcaccttggagacatagtagacgcactgctggaaggcgtacagcaccacctcctccagcaccgccatggcctcctcgctggccgtcagcgtgcaggagaacagcgattccttcgagcct

SEQ ID NO: 61657 - DNA, 144 bp, Homo sapiens; identical to SEQ ID NO: 41164
  chr7:4858153-4858297
  hypo

SEQ ID NO: 61658 - DNA, 59 bp, Homo sapiens; identical to SEQ ID NO: 41165
  chr7:4875008-4875067
  hypo

SEQ ID NO: 61659 - DNA, 30 bp, Homo sapiens; identical to SEQ ID NO: 41166
  chr7:4876594-4876624
  hypo

SEQ ID NO: 61660 - DNA, 111 bp, Homo sapiens; identical to SEQ ID NO: 41167
  chr7:4918378-4918489
  hypo

SEQ ID NO: 61661 - DNA, 39 bp, Homo sapiens; identical to SEQ ID NO: 41168
  chr7:4931853-4931892
  hypo

SEQ ID NO: 61662 - DNA, 22 bp, Homo sapiens
  chr7:4985877-4985899
  hypo
cccaccccgtgcacacaatccc

SEQ ID NO: 61663 - DNA, 30 bp, Homo sapiens; identical to SEQ ID NO: 14965
  chr7:5316401-5316431
  hypo

SEQ ID NO: 61664 - DNA, 30 bp, Homo sapiens; identical to SEQ ID NO: 41171
  chr7:5342905-5342935
  hypo

SEQ ID NO: 61665 - DNA, 30 bp, Homo sapiens; identical to SEQ ID NO: 41172
  chr7:5343856-5343886
  hypo

SEQ ID NO: 61666 - DNA, 142 bp, Homo sapiens; identical to SEQ ID NO: 41173
  chr7:5441304-5441446
  hypo

SEQ ID NO: 61667 - DNA, 116 bp, Homo sapiens; identical to SEQ ID NO: 41174
  chr7:5529839-5529955
  hypo

SEQ ID NO: 61668 - DNA, 34 bp, Homo sapiens; identical to SEQ ID NO: 41175
  chr7:5589502-5589536
  hypo

SEQ ID NO: 61669 - DNA, 30 bp, Homo sapiens; identical to SEQ ID NO: 41176
  chr7:5626228-5626258
  hypo

SEQ ID NO: 61670 - DNA, 30 bp, Homo sapiens; identical to SEQ ID NO: 41177
  chr7:5629903-5629933
  hypo

SEQ ID NO: 61671 - DNA, 201 bp, Homo sapiens; identical to SEQ ID NO: 41178
  chr7:5647869-5648070
  hypo

SEQ ID NO: 61672 - DNA, 26 bp, Homo sapiens
  chr7:5648393-5648419
  hypo
accccataccccgagggtggctcctc

SEQ ID NO: 61673 - DNA, 56 bp, Homo sapiens; identical to SEQ ID NO: 41180
  chr7:6060716-6060772
  hypo

SEQ ID NO: 61674 - DNA, 36 bp, Homo sapiens; identical to SEQ ID NO: 41183
  chr7:6143243-6143279
  hypo

SEQ ID NO: 61675 - DNA, 64 bp, Homo sapiens; identical to SEQ ID NO: 41184
  chr7:6241990-6242054
  hypo

SEQ ID NO: 61676 - DNA, 60 bp, Homo sapiens; identical to SEQ ID NO: 24319
  chr7:6443376-6443436
  hypo

SEQ ID NO: 61677 - DNA, 34 bp, Homo sapiens; identical to SEQ ID NO: 41186
  chr7:6443956-6443990
  hypo

SEQ ID NO: 61678 - DNA, 93 bp, Homo sapiens; identical to SEQ ID NO: 41187
  chr7:6444050-6444143
  hypo

SEQ ID NO: 61679 - DNA, 273 bp, Homo sapiens; identical to SEQ ID NO: 41188
  chr7:6499118-6499391
  hypo

SEQ ID NO: 61680 - DNA, 66 bp, Homo sapiens
  chr7:6524911-6524977
  hypo
ttgaatatttctacgggatggggacgtcacaagaaattgcaaacaaaaaaagctgacaaacaggat

SEQ ID NO: 61681 - DNA, 79 bp, Homo sapiens
  chr7:6525012-6525091
  hypo
aaacgcacagttcgcagttcaaaaagcagggcgggggcgaggacctggtgcggtggctcatgcctgtagtcccaacact

SEQ ID NO: 61682 - DNA, 166 bp, Homo sapiens; identical to SEQ ID NO: 41191
  chr7:6545837-6546003
  hypo

SEQ ID NO: 61683 - DNA, 62 bp, Homo sapiens
  chr7:6560173-6560235
  hypo
agggcagggccccaccgcggctttggcccggccacctgtgctggaagaagctctcgagggcc

SEQ ID NO: 61684 - DNA, 56 bp, Homo sapiens; identical to SEQ ID NO: 24324
  chr7:6560345-6560401
  hypo

SEQ ID NO: 61685 - DNA, 30 bp, Homo sapiens; identical to SEQ ID NO: 14975
  chr7:7102938-7102968
  hypo

SEQ ID NO: 61686 - DNA, 30 bp, Homo sapiens; identical to SEQ ID NO: 41194
  chr7:7105800-7105830
  hypo

SEQ ID NO: 61687 - DNA, 61 bp, Homo sapiens; identical to SEQ ID NO: 41195
  chr7:7109343-7109404
  hypo

SEQ ID NO: 61688 - DNA, 52 bp, Homo sapiens; identical to SEQ ID NO: 41196
  chr7:7111788-7111840
  hypo

SEQ ID NO: 61689 - DNA, 42 bp, Homo sapiens; identical to SEQ ID NO: 41197
  chr7:7113636-7113678
  hypo

SEQ ID NO: 61690 - DNA, 279 bp, Homo sapiens; identical to SEQ ID NO: 41198
  chr7:7605145-7605424
  hypo

SEQ ID NO: 61691 - DNA, 32 bp, Homo sapiens; identical to SEQ ID NO: 41200
  chr7:8391330-8391362
  hypo

SEQ ID NO: 61692 - DNA, 23 bp, Homo sapiens
  chr7:10730863-10730886
  hypo
aaacatttgggaggccgggtgcg

SEQ ID NO: 61693 - DNA, 37 bp, Homo sapiens; identical to SEQ ID NO: 41202
  chr7:10819400-10819437
  hypo

SEQ ID NO: 61694 - DNA, 30 bp, Homo sapiens; identical to SEQ ID NO: 41203
  chr7:10929379-10929409
  hypo

SEQ ID NO: 61695 - DNA, 37 bp, Homo sapiens; identical to SEQ ID NO: 41204
  chr7:12776917-12776954
  hypo

SEQ ID NO: 61696 - DNA, 43 bp, Homo sapiens; identical to SEQ ID NO: 41205
  chr7:16566510-16566553
  hypo

SEQ ID NO: 61697 - DNA, 180 bp, Homo sapiens; identical to SEQ ID NO: 41206
  chr7:16844151-16844331
  hypo

SEQ ID NO: 61698 - DNA, 27 bp, Homo sapiens
  chr7:17413241-17413268
  hypo
tgtgagccgccgcgcccaaccgcaaag

SEQ ID NO: 61699 - DNA, 24 bp, Homo sapiens
  chr7:20710238-20710262
  hypo
aagaagcaagctggccgggtgcgg

SEQ ID NO: 61700 - DNA, 18 bp, Homo sapiens
  chr7:20719888-20719906
  hypo
agagtgacttgaggccga

SEQ ID NO: 61701 - DNA, 139 bp, Homo sapiens; identical to SEQ ID NO: 41210
  chr7:20720174-20720313
  hypo

SEQ ID NO: 61702 - DNA, 43 bp, Homo sapiens; identical to SEQ ID NO: 41211
  chr7:20757794-20757837
  hypo

SEQ ID NO: 61703 - DNA, 173 bp, Homo sapiens; identical to SEQ ID NO: 41212
  chr7:22981026-22981199
  hypo

SEQ ID NO: 61704 - DNA, 30 bp, Homo sapiens; identical to SEQ ID NO: 41213
  chr7:23220685-23220715
  hypo

SEQ ID NO: 61705 - DNA, 36 bp, Homo sapiens; identical to SEQ ID NO: 41214
  chr7:23525036-23525072
  hypo

SEQ ID NO: 61706 - DNA, 30 bp, Homo sapiens; identical to SEQ ID NO: 41215
  chr7:23568103-23568133
  hypo

SEQ ID NO: 61707 - DNA, 30 bp, Homo sapiens; identical to SEQ ID NO: 41216
  chr7:23569271-23569301
  hypo

SEQ ID NO: 61708 - DNA, 48 bp, Homo sapiens; identical to SEQ ID NO: 41218
  chr7:23749757-23749805
  hypo

SEQ ID NO: 61709 - DNA, 120 bp, Homo sapiens; identical to SEQ ID NO: 41219
  chr7:24099277-24099397
  hypo

SEQ ID NO: 61710 - DNA, 224 bp, Homo sapiens; identical to SEQ ID NO: 41221
  chr7:24761204-24761428
  hypo

SEQ ID NO: 61711 - DNA, 30 bp, Homo sapiens; identical to SEQ ID NO: 41222
  chr7:24799881-24799911
  hypo

SEQ ID NO: 61712 - DNA, 30 bp, Homo sapiens; identical to SEQ ID NO: 41223
  chr7:24845483-24845513
  hypo

SEQ ID NO: 61713 - DNA, 190 bp, Homo sapiens; identical to SEQ ID NO: 41224
  chr7:25495487-25495677
  hypo

SEQ ID NO: 61714 - DNA, 84 bp, Homo sapiens; identical to SEQ ID NO: 41225
  chr7:25530809-25530893
  hypo

SEQ ID NO: 61715 - DNA, 186 bp, Homo sapiens; identical to SEQ ID NO: 41226
  chr7:25802276-25802462
  hypo

SEQ ID NO: 61716 - DNA, 42 bp, Homo sapiens; identical to SEQ ID NO: 41227
  chr7:26217181-26217223
  hypo

SEQ ID NO: 61717 - DNA, 17 bp, Homo sapiens
  chr7:26222458-26222475
  hypo
gctggagtgtggcagcg

SEQ ID NO: 61718 - DNA, 129 bp, Homo sapiens; identical to SEQ ID NO: 41230
  chr7:26652555-26652684
  hypo

SEQ ID NO: 61719 - DNA, 35 bp, Homo sapiens; identical to SEQ ID NO: 41231
  chr7:26762298-26762333
  hypo

SEQ ID NO: 61720 - DNA, 30 bp, Homo sapiens; identical to SEQ ID NO: 41232
  chr7:27531223-27531253
  hypo

SEQ ID NO: 61721 - DNA, 170 bp, Homo sapiens; identical to SEQ ID NO: 41233
  chr7:27555618-27555788
  hypo

SEQ ID NO: 61722 - DNA, 16 bp, Homo sapiens
  chr7:27686784-27686800
  hypo
gcgatatcacaacacc

SEQ ID NO: 61723 - DNA, 32 bp, Homo sapiens; identical to SEQ ID NO: 41235
  chr7:27903816-27903848
  hypo

SEQ ID NO: 61724 - DNA, 43 bp, Homo sapiens; identical to SEQ ID NO: 41236
  chr7:27907997-27908040
  hypo

SEQ ID NO: 61725 - DNA, 93 bp, Homo sapiens; identical to SEQ ID NO: 41237
  chr7:27916674-27916767
  hypo

SEQ ID NO: 61726 - DNA, 30 bp, Homo sapiens; identical to SEQ ID NO: 41238
  chr7:28050662-28050692
  hypo

SEQ ID NO: 61727 - DNA, 30 bp, Homo sapiens; identical to SEQ ID NO: 41239
  chr7:28055637-28055667
  hypo

SEQ ID NO: 61728 - DNA, 30 bp, Homo sapiens; identical to SEQ ID NO: 41240
  chr7:28266792-28266822
  hypo

SEQ ID NO: 61729 - DNA, 22 bp, Homo sapiens
  chr7:28988955-28988977
  hypo
gggcgcagtggctcacgcctgt

SEQ ID NO: 61730 - DNA, 141 bp, Homo sapiens; identical to SEQ ID NO: 41242
  chr7:28989217-28989358
  hypo

SEQ ID NO: 61731 - DNA, 30 bp, Homo sapiens; identical to SEQ ID NO: 41243
  chr7:29482512-29482542
  hypo

SEQ ID NO: 61732 - DNA, 38 bp, Homo sapiens; identical to SEQ ID NO: 41244
  chr7:29876677-29876715
  hypo

SEQ ID NO: 61733 - DNA, 30 bp, Homo sapiens; identical to SEQ ID NO: 41245
  chr7:30206504-30206534
  hypo

SEQ ID NO: 61734 - DNA, 30 bp, Homo sapiens; identical to SEQ ID NO: 41246
  chr7:30603406-30603436
  hypo

SEQ ID NO: 61735 - DNA, 163 bp, Homo sapiens; identical to SEQ ID NO: 41247
  chr7:30687826-30687989
  hypo

SEQ ID NO: 61736 - DNA, 30 bp, Homo sapiens; identical to SEQ ID NO: 41248
  chr7:30699730-30699760
  hypo

SEQ ID NO: 61737 - DNA, 133 bp, Homo sapiens; identical to SEQ ID NO: 41249
  chr7:30744677-30744810
  hypo

SEQ ID NO: 61738 - DNA, 92 bp, Homo sapiens; identical to SEQ ID NO: 41250
  chr7:30899935-30900027
  hypo

SEQ ID NO: 61739 - DNA, 84 bp, Homo sapiens; identical to SEQ ID NO: 41251
  chr7:31116600-31116684
  hypo

SEQ ID NO: 61740 - DNA, 238 bp, Homo sapiens; identical to SEQ ID NO: 41252
  chr7:31118297-31118535
  hypo

SEQ ID NO: 61741 - DNA, 158 bp, Homo sapiens; identical to SEQ ID NO: 41253
  chr7:32128181-32128339
  hypo

SEQ ID NO: 61742 - DNA, 15 bp, Homo sapiens
  chr7:32276919-32276934
  hypo
cgatctcctgacctc

SEQ ID NO: 61743 - DNA, 30 bp, Homo sapiens; identical to SEQ ID NO: 41255
  chr7:32323599-32323629
  hypo

SEQ ID NO: 61744 - DNA, 25 bp, Homo sapiens
  chr7:35190140-35190165
  hypo
atcttttttttgagacggggtcttg

SEQ ID NO: 61745 - DNA, 88 bp, Homo sapiens; identical to SEQ ID NO: 41257
  chr7:36428640-36428728
  hypo

SEQ ID NO: 61746 - DNA, 26 bp, Homo sapiens
  chr7:37025520-37025546
  hypo
tactcaccaagctcccgtaagtccat

SEQ ID NO: 61747 - DNA, 30 bp, Homo sapiens; identical to SEQ ID NO: 14984
  chr7:37264509-37264539
  hypo

SEQ ID NO: 61748 - DNA, 181 bp, Homo sapiens; identical to SEQ ID NO: 14985
  chr7:37279183-37279364
  hypo

SEQ ID NO: 61749 - DNA, 119 bp, Homo sapiens; identical to SEQ ID NO: 41261
  chr7:37399153-37399272
  hypo

SEQ ID NO: 61750 - DNA, 17 bp, Homo sapiens
  chr7:37423714-37423731
  hypo
gccgaaacatacaggtt

SEQ ID NO: 61751 - DNA, 146 bp, Homo sapiens; identical to SEQ ID NO: 41263
  chr7:37424328-37424474
  hypo

SEQ ID NO: 61752 - DNA, 30 bp, Homo sapiens; identical to SEQ ID NO: 41264
  chr7:37446822-37446852
  hypo

SEQ ID NO: 61753 - DNA, 30 bp, Homo sapiens; identical to SEQ ID NO: 41265
  chr7:37686948-37686978
  hypo

SEQ ID NO: 61754 - DNA, 148 bp, Homo sapiens; identical to SEQ ID NO: 41266
  chr7:37770953-37771101
  hypo

SEQ ID NO: 61755 - DNA, 175 bp, Homo sapiens; identical to SEQ ID NO: 41267
  chr7:37868787-37868962
  hypo

SEQ ID NO: 61756 - DNA, 30 bp, Homo sapiens; identical to SEQ ID NO: 41269
  chr7:37969938-37969968
  hypo

SEQ ID NO: 61757 - DNA, 37 bp, Homo sapiens; identical to SEQ ID NO: 41270
  chr7:38170685-38170722
  hypo

SEQ ID NO: 61758 - DNA, 24 bp, Homo sapiens
  chr7:38508456-38508480
  hypo
agtagaacatacagacggccgggc

SEQ ID NO: 61759 - DNA, 189 bp, Homo sapiens; identical to SEQ ID NO: 41272
  chr7:38740329-38740518
  hypo

SEQ ID NO: 61760 - DNA, 30 bp, Homo sapiens; identical to SEQ ID NO: 41273
  chr7:39192698-39192728
  hypo

SEQ ID NO: 61761 - DNA, 30 bp, Homo sapiens; identical to SEQ ID NO: 41274
  chr7:39317801-39317831
  hypo

SEQ ID NO: 61762 - DNA, 101 bp, Homo sapiens; identical to SEQ ID NO: 41275
  chr7:39921805-39921906
  hypo

SEQ ID NO: 61763 - DNA, 91 bp, Homo sapiens; identical to SEQ ID NO: 41276
  chr7:40157087-40157178
  hypo

SEQ ID NO: 61764 - DNA, 93 bp, Homo sapiens; identical to SEQ ID NO: 41277
  chr7:40407726-40407819
  hypo

SEQ ID NO: 61765 - DNA, 30 bp, Homo sapiens; identical to SEQ ID NO: 41278
  chr7:40943582-40943612
  hypo

SEQ ID NO: 61766 - DNA, 27 bp, Homo sapiens
  chr7:41814148-41814175
  hypo
ggaggccgaggtgggcggatcacgagg

SEQ ID NO: 61767 - DNA, 30 bp, Homo sapiens; identical to SEQ ID NO: 41280
  chr7:41923780-41923810
  hypo

SEQ ID NO: 61768 - DNA, 30 bp, Homo sapiens; identical to SEQ ID NO: 41281
  chr7:41943672-41943702
  hypo

SEQ ID NO: 61769 - DNA, 17 bp, Homo sapiens
  chr7:41981795-41981812
  hypo
gggcgtggtggctcacg

SEQ ID NO: 61770 - DNA, 30 bp, Homo sapiens; identical to SEQ ID NO: 41283
  chr7:42005469-42005499
  hypo

SEQ ID NO: 61771 - DNA, 177 bp, Homo sapiens; identical to SEQ ID NO: 41284
  chr7:43237814-43237991
  hypo

SEQ ID NO: 61772 - DNA, 25 bp, Homo sapiens
  chr7:43767877-43767902
  hypo
gtgaactctacggtaggtgaactat

SEQ ID NO: 61773 - DNA, 202 bp, Homo sapiens; identical to SEQ ID NO: 41286
  chr7:43865061-43865263
  hypo

SEQ ID NO: 61774 - DNA, 25 bp, Homo sapiens
  chr7:44083435-44083460
  hypo
ccaccgtgcccggcaggatttatat

SEQ ID NO: 61775 - DNA, 113 bp, Homo sapiens
  chr7:44151285-44151398
  hypo
gcctcccgcctgttccggagcctctctggggattctggcttgtcttacagggccctaggagccccagctgtcccccagaccctcgggtatgaggtgggtctgggtccttcctc

SEQ ID NO: 61776 - DNA, 299 bp, Homo sapiens
  chr7:44151428-44151727
  hypo
tcactgaggctcccgcccttgcaggggagcccgagttccgctacactgctgggatccatggcaacgaggtgctgggccgagagctgttgctgctgctcatgcagtacctgtgccgagagtaccgcgatgggaacccacgtgtgcgcagcctggtgcaggacacacgcatccacctggtgccctcactgaaccctgatggctacgaggtggcagcgcagatggtgggttgaagggtgaggctggccagggtccaggcagctgggggttgtgggggtgtgggtagccgatgcctaccctgc

SEQ ID NO: 61777 - DNA, 61 bp, Homo sapiens; identical to SEQ ID NO: 41289
  chr7:44152191-44152252
  hypo

SEQ ID NO: 61778 - DNA, 30 bp, Homo sapiens; identical to SEQ ID NO: 41290
  chr7:44193301-44193331
  hypo

SEQ ID NO: 61779 - DNA, 183 bp, Homo sapiens; identical to SEQ ID NO: 41291
  chr7:44258471-44258654
  hypo

SEQ ID NO: 61780 - DNA, 53 bp, Homo sapiens; identical to SEQ ID NO: 41292
  chr7:44259286-44259339
  hypo

SEQ ID NO: 61781 - DNA, 30 bp, Homo sapiens; identical to SEQ ID NO: 41293
  chr7:44275594-44275624
  hypo

SEQ ID NO: 61782 - DNA, 30 bp, Homo sapiens; identical to SEQ ID NO: 41294
  chr7:44431004-44431034
  hypo

SEQ ID NO: 61783 - DNA, 34 bp, Homo sapiens; identical to SEQ ID NO: 41295
  chr7:44517861-44517895
  hypo

SEQ ID NO: 61784 - DNA, 30 bp, Homo sapiens; identical to SEQ ID NO: 41296
  chr7:44717883-44717913
  hypo

SEQ ID NO: 61785 - DNA, 30 bp, Homo sapiens; identical to SEQ ID NO: 41297
  chr7:44801185-44801215
  hypo

SEQ ID NO: 61786 - DNA, 27 bp, Homo sapiens
  chr7:45027184-45027211
  hypo
attgttaagggacgaaagggccaagag

SEQ ID NO: 61787 - DNA, 34 bp, Homo sapiens; identical to SEQ ID NO: 41301
  chr7:45125675-45125709
  hypo

SEQ ID NO: 61788 - DNA, 61 bp, Homo sapiens; identical to SEQ ID NO: 41302
  chr7:45222910-45222971
  hypo

SEQ ID NO: 61789 - DNA, 44 bp, Homo sapiens; identical to SEQ ID NO: 41303
  chr7:45807457-45807501
  hypo

SEQ ID NO: 61790 - DNA, 113 bp, Homo sapiens; identical to SEQ ID NO: 41304
  chr7:47394819-47394932
  hypo

SEQ ID NO: 61791 - DNA, 30 bp, Homo sapiens; identical to SEQ ID NO: 41305
  chr7:47409179-47409209
  hypo

SEQ ID NO: 61792 - DNA, 203 bp, Homo sapiens; identical to SEQ ID NO: 41306
  chr7:47420119-47420322
  hypo

SEQ ID NO: 61793 - DNA, 142 bp, Homo sapiens; identical to SEQ ID NO: 41307
  chr7:47420382-47420524
  hypo

SEQ ID NO: 61794 - DNA, 30 bp, Homo sapiens; identical to SEQ ID NO: 41308
  chr7:47449194-47449224
  hypo

SEQ ID NO: 61795 - DNA, 61 bp, Homo sapiens; identical to SEQ ID NO: 41309
  chr7:47586473-47586534
  hypo

SEQ ID NO: 61796 - DNA, 30 bp, Homo sapiens; identical to SEQ ID NO: 41310
  chr7:47702782-47702812
  hypo

SEQ ID NO: 61797 - DNA, 16 bp, Homo sapiens
  chr7:49700766-49700782
  hypo
gcgcccccggccggtc

SEQ ID NO: 61798 - DNA, 171 bp, Homo sapiens; identical to SEQ ID NO: 41312
  chr7:49740620-49740791
  hypo

SEQ ID NO: 61799 - DNA, 30 bp, Homo sapiens; identical to SEQ ID NO: 41313
  chr7:50241354-50241384
  hypo

SEQ ID NO: 61800 - DNA, 153 bp, Homo sapiens; identical to SEQ ID NO: 41314
  chr7:50243557-50243710
  hypo

SEQ ID NO: 61801 - DNA, 30 bp, Homo sapiens; identical to SEQ ID NO: 41315
  chr7:50251382-50251412
  hypo

SEQ ID NO: 61802 - DNA, 50 bp, Homo sapiens
  chr7:50294401-50294451
  hypo
agactccatctcaaaaaaaaaaaaaaaaaaagattcctagtttcctaaga

SEQ ID NO: 61803 - DNA, 30 bp, Homo sapiens; identical to SEQ ID NO: 41317
  chr7:50337681-50337711
  hypo

SEQ ID NO: 61804 - DNA, 30 bp, Homo sapiens; identical to SEQ ID NO: 41319
  chr7:50423094-50423124
  hypo

SEQ ID NO: 61805 - DNA, 136 bp, Homo sapiens
  chr7:50438648-50438784
  hypo
ggagtgagcgatttaggaactcacagaagggcacggccaggcaactcgggccctggcaaatgttccatagagacagcatccatggggttgaaccaagcacaatgcctgcaaatcgggcaggcgggttcatggaatt

SEQ ID NO: 61806 - DNA, 139 bp, Homo sapiens; identical to SEQ ID NO: 41321
  chr7:50444259-50444398
  hypo

SEQ ID NO: 61807 - DNA, 30 bp, Homo sapiens; identical to SEQ ID NO: 41322
  chr7:50471189-50471219
  hypo

SEQ ID NO: 61808 - DNA, 31 bp, Homo sapiens
  chr7:50560557-50560588
  hypo
gcatcagctctgcagcgtctgcggcagcctc

SEQ ID NO: 61809 - DNA, 26 bp, Homo sapiens
  chr7:50560637-50560663
  hypo
cttctcaccaccgcactgactaagca

SEQ ID NO: 61810 - DNA, 19 bp, Homo sapiens
  chr7:52268638-52268657
  hypo
tttgtttgtttgagacgga

SEQ ID NO: 61811 - DNA, 30 bp, Homo sapiens; identical to SEQ ID NO: 41325
  chr7:52499272-52499302
  hypo

SEQ ID NO: 61812 - DNA, 43 bp, Homo sapiens; identical to SEQ ID NO: 41326
  chr7:52736850-52736893
  hypo

SEQ ID NO: 61813 - DNA, 30 bp, Homo sapiens; identical to SEQ ID NO: 41327
  chr7:53364402-53364432
  hypo

SEQ ID NO: 61814 - DNA, 58 bp, Homo sapiens; identical to SEQ ID NO: 41328
  chr7:54794734-54794792
  hypo

SEQ ID NO: 61815 - DNA, 30 bp, Homo sapiens; identical to SEQ ID NO: 41329
  chr7:54866907-54866937
  hypo

SEQ ID NO: 61816 - DNA, 37 bp, Homo sapiens; identical to SEQ ID NO: 15001
  chr7:55145943-55145980
  hypo

SEQ ID NO: 61817 - DNA, 42 bp, Homo sapiens; identical to SEQ ID NO: 41331
  chr7:55410245-55410287
  hypo

SEQ ID NO: 61818 - DNA, 30 bp, Homo sapiens; identical to SEQ ID NO: 41332
  chr7:55838624-55838654
  hypo

SEQ ID NO: 61819 - DNA, 267 bp, Homo sapiens
  chr7:56017856-56018123
  hypo
gcagagcttgcagtgagccgagattgtgagcgagactccgtctgaaaaaaaaaaaaaaatctaattgtatagaatattgttacaaccacacagaagaaaaaaaaagaatcccaagaaatgttgaacacagtgctgtcattgtacactctaaggacaaaaagaaccacaaaaaataatctcacgcatcacttagaaagtttgtttttagtcgggatattgttagtacaactccaaaagcatatagtgtatactataggatttagcatt

SEQ ID NO: 61820 - DNA, 30 bp, Homo sapiens; identical to SEQ ID NO: 41334
  chr7:56144506-56144536
  hypo

SEQ ID NO: 61821 - DNA, 42 bp, Homo sapiens; identical to SEQ ID NO: 41335
  chr7:57247720-57247762
  hypo

SEQ ID NO: 61822 - DNA, 21 bp, Homo sapiens
  chr7:57655640-57655661
  hypo
ccaccgcgcctggcccatata

SEQ ID NO: 61823 - DNA, 30 bp, Homo sapiens; identical to SEQ ID NO: 41337
  chr7:63393332-63393362
  hypo

SEQ ID NO: 61824 - DNA, 30 bp, Homo sapiens; identical to SEQ ID NO: 41338
  chr7:63574716-63574746
  hypo

SEQ ID NO: 61825 - DNA, 151 bp, Homo sapiens; identical to SEQ ID NO: 41339
  chr7:63666590-63666741
  hypo

SEQ ID NO: 61826 - DNA, 28 bp, Homo sapiens
  chr7:65236287-65236315
  hypo
tgaggctccctgggccgtgctatcccgg

SEQ ID NO: 61827 - DNA, 42 bp, Homo sapiens; identical to SEQ ID NO: 41341
  chr7:65879595-65879637
  hypo

SEQ ID NO: 61828 - DNA, 81 bp, Homo sapiens; identical to SEQ ID NO: 41342
  chr7:65880043-65880124
  hypo

SEQ ID NO: 61829 - DNA, 30 bp, Homo sapiens; identical to SEQ ID NO: 41343
  chr7:65969625-65969655
  hypo

SEQ ID NO: 61830 - DNA, 40 bp, Homo sapiens; identical to SEQ ID NO: 41344
  chr7:66215014-66215054
  hypo

SEQ ID NO: 61831 - DNA, 40 bp, Homo sapiens; identical to SEQ ID NO: 41345
  chr7:67161739-67161779
  hypo

SEQ ID NO: 61832 - DNA, 49 bp, Homo sapiens; identical to SEQ ID NO: 41346
  chr7:68000342-68000391
  hypo

SEQ ID NO: 61833 - DNA, 35 bp, Homo sapiens
  chr7:68204758-68204793
  hypo
ttcagaagtgactttcgaggaaatttggtcccgtt

SEQ ID NO: 61834 - DNA, 27 bp, Homo sapiens
  chr7:68982718-68982745
  hypo
tgtgagccaccgcgcctggccattgct

SEQ ID NO: 61835 - DNA, 100 bp, Homo sapiens; identical to SEQ ID NO: 41349
  chr7:69032251-69032351
  hypo

SEQ ID NO: 61836 - DNA, 42 bp, Homo sapiens; identical to SEQ ID NO: 15004
  chr7:69036110-69036152
  hypo

SEQ ID NO: 61837 - DNA, 179 bp, Homo sapiens; identical to SEQ ID NO: 15005
  chr7:69313694-69313873
  hypo

SEQ ID NO: 61838 - DNA, 30 bp, Homo sapiens; identical to SEQ ID NO: 41352
  chr7:69698849-69698879
  hypo

SEQ ID NO: 61839 - DNA, 18 bp, Homo sapiens
  chr7:70728615-70728633
  hypo
cctcagtgatctggccgg

SEQ ID NO: 61840 - DNA, 19 bp, Homo sapiens
  chr7:71256983-71257002
  hypo
actccgtctcaaaaaaaga

SEQ ID NO: 61841 - DNA, 30 bp, Homo sapiens; identical to SEQ ID NO: 41355
  chr7:71296085-71296115
  hypo

SEQ ID NO: 61842 - DNA, 30 bp, Homo sapiens; identical to SEQ ID NO: 41356
  chr7:71880817-71880847
  hypo

SEQ ID NO: 61843 - DNA, 30 bp, Homo sapiens; identical to SEQ ID NO: 41357
  chr7:75975426-75975456
  hypo

SEQ ID NO: 61844 - DNA, 49 bp, Homo sapiens; identical to SEQ ID NO: 41358
  chr7:76106331-76106380
  hypo

SEQ ID NO: 61845 - DNA, 28 bp, Homo sapiens
  chr7:77309374-77309402
  hypo
tggagtgcagtggtccgcctcccgggtt

SEQ ID NO: 61846 - DNA, 28 bp, Homo sapiens
  chr7:77309582-77309610
  hypo
aggcgtgagccatcgtgcccggccagac

SEQ ID NO: 61847 - DNA, 28 bp, Homo sapiens
  chr7:77928410-77928438
  hypo
aggcgtgagctaccgtgcctggctataa

SEQ ID NO: 61848 - DNA, 23 bp, Homo sapiens
  chr7:84936791-84936814
  hypo
accgcgctcggccttgtttacca

SEQ ID NO: 61849 - DNA, 39 bp, Homo sapiens; identical to SEQ ID NO: 41363
  chr7:86228129-86228168
  hypo

SEQ ID NO: 61850 - DNA, 42 bp, Homo sapiens; identical to SEQ ID NO: 41364
  chr7:86416083-86416125
  hypo

SEQ ID NO: 61851 - DNA, 16 bp, Homo sapiens
  chr7:90269563-90269579
  hypo
tcggccatcttggctc

SEQ ID NO: 61852 - DNA, 30 bp, Homo sapiens; identical to SEQ ID NO: 41366
  chr7:91510852-91510882
  hypo

SEQ ID NO: 61853 - DNA, 30 bp, Homo sapiens; identical to SEQ ID NO: 41367
  chr7:93055830-93055860
  hypo

SEQ ID NO: 61854 - DNA, 83 bp, Homo sapiens; identical to SEQ ID NO: 41368
  chr7:94138070-94138153
  hypo

SEQ ID NO: 61855 - DNA, 30 bp, Homo sapiens; identical to SEQ ID NO: 41369
  chr7:97591443-97591473
  hypo

SEQ ID NO: 61856 - DNA, 15 bp, Homo sapiens
  chr7:97600089-97600104
  hypo
cttagctattgaaaa

SEQ ID NO: 61857 - DNA, 41 bp, Homo sapiens; identical to SEQ ID NO: 15007
  chr7:97797757-97797798
  hypo

SEQ ID NO: 61858 - DNA, 30 bp, Homo sapiens; identical to SEQ ID NO: 41372
  chr7:97804272-97804302
  hypo

SEQ ID NO: 61859 - DNA, 30 bp, Homo sapiens; identical to SEQ ID NO: 41373
  chr7:97807742-97807772
  hypo

SEQ ID NO: 61860 - DNA, 30 bp, Homo sapiens; identical to SEQ ID NO: 41374
  chr7:97834167-97834197
  hypo

SEQ ID NO: 61861 - DNA, 27 bp, Homo sapiens
  chr7:97869134-97869161
  hypo
gtgactggccaggcacggtggctcatg

SEQ ID NO: 61862 - DNA, 213 bp, Homo sapiens
  chr7:97869401-97869614
  hypo
cagagcgacactccgtctcaaaaaaaacaaacaaaagaaaaaccctgtgagtaatcggaaatcggctggttttattggacttgccgctgataagatgcaaaagacaagcagtgactagaggatggggaggcgcttggttaatcaagggcttcaggaaattcgcttccgattcttcgaaatgttgcagcctattaggtgatacttgcagttgct

SEQ ID NO: 61863 - DNA, 23 bp, Homo sapiens
  chr7:97869644-97869667
  hypo
ggattttacggcacaaaacgtcc

SEQ ID NO: 61864 - DNA, 42 bp, Homo sapiens; identical to SEQ ID NO: 41377
  chr7:97882348-97882390
  hypo

SEQ ID NO: 61865 - DNA, 48 bp, Homo sapiens; identical to SEQ ID NO: 41378
  chr7:97899729-97899777
  hypo

SEQ ID NO: 61866 - DNA, 48 bp, Homo sapiens; identical to SEQ ID NO: 41379
  chr7:98121881-98121929
  hypo

SEQ ID NO: 61867 - DNA, 198 bp, Homo sapiens; identical to SEQ ID NO: 15009
  chr7:98183080-98183278
  hypo

SEQ ID NO: 61868 - DNA, 30 bp, Homo sapiens; identical to SEQ ID NO: 41381
  chr7:98970776-98970806
  hypo

SEQ ID NO: 61869 - DNA, 41 bp, Homo sapiens
  chr7:98971549-98971590
  hypo
actggggtctcttccatctgcctggccgccaggccacgtat

SEQ ID NO: 61870 - DNA, 263 bp, Homo sapiens; identical to SEQ ID NO: 41383
  chr7:98991519-98991782
  hypo

SEQ ID NO: 61871 - DNA, 389 bp, Homo sapiens; identical to SEQ ID NO: 41384
  chr7:99020748-99021137
  hypo

SEQ ID NO: 61872 - DNA, 22 bp, Homo sapiens
  chr7:99649204-99649226
  hypo
acggcgccgggccccctaggga

SEQ ID NO: 61873 - DNA, 43 bp, Homo sapiens; identical to SEQ ID NO: 41387
  chr7:99691859-99691902
  hypo

SEQ ID NO: 61874 - DNA, 37 bp, Homo sapiens; identical to SEQ ID NO: 15013
  chr7:99700198-99700235
  hypo

SEQ ID NO: 61875 - DNA, 87 bp, Homo sapiens; identical to SEQ ID NO: 41389
  chr7:99723146-99723233
  hypo

SEQ ID NO: 61876 - DNA, 41 bp, Homo sapiens; identical to SEQ ID NO: 41390
  chr7:99839918-99839959
  hypo

SEQ ID NO: 61877 - DNA, 21 bp, Homo sapiens
  chr7:99934962-99934983
  hypo
ccaccacgcccagctgccttg

SEQ ID NO: 61878 - DNA, 55 bp, Homo sapiens
  chr7:100088128-100088183
  hypo
catcccagcagaggtcgaggacggtgcccgggcctggaatggcagtgccgagggt

SEQ ID NO: 61879 - DNA, 5 bp, Homo sapiens
  chr7:100088312-100088317
  hypo
attcc

SEQ ID NO: 61880 - DNA, 89 bp, Homo sapiens; identical to SEQ ID NO: 41393
  chr7:100104071-100104160
  hypo

SEQ ID NO: 61881 - DNA, 30 bp, Homo sapiens; identical to SEQ ID NO: 41394
  chr7:100118785-100118815
  hypo

SEQ ID NO: 61882 - DNA, 89 bp, Homo sapiens; identical to SEQ ID NO: 41395
  chr7:100179713-100179802
  hypo

SEQ ID NO: 61883 - DNA, 83 bp, Homo sapiens; identical to SEQ ID NO: 41396
  chr7:100279918-100280001
  hypo

SEQ ID NO: 61884 - DNA, 39 bp, Homo sapiens; identical to SEQ ID NO: 41397
  chr7:100391505-100391544
  hypo

SEQ ID NO: 61885 - DNA, 300 bp, Homo sapiens; identical to SEQ ID NO: 41398
  chr7:100490045-100490345
  hypo

SEQ ID NO: 61886 - DNA, 22 bp, Homo sapiens
  chr7:100495308-100495330
  hypo
agcactctgggaggccgagaca

SEQ ID NO: 61887 - DNA, 17 bp, Homo sapiens
  chr7:100723832-100723849
  hypo
gtttgttttttgagacg

SEQ ID NO: 61888 - DNA, 145 bp, Homo sapiens; identical to SEQ ID NO: 41401
  chr7:100799106-100799251
  hypo

SEQ ID NO: 61889 - DNA, 30 bp, Homo sapiens; identical to SEQ ID NO: 41402
  chr7:100858230-100858260
  hypo

SEQ ID NO: 61890 - DNA, 39 bp, Homo sapiens; identical to SEQ ID NO: 41403
  chr7:100894771-100894810
  hypo

SEQ ID NO: 61891 - DNA, 34 bp, Homo sapiens; identical to SEQ ID NO: 41404
  chr7:100897086-100897120
  hypo

SEQ ID NO: 61892 - DNA, 30 bp, Homo sapiens; identical to SEQ ID NO: 41405
  chr7:100967105-100967135
  hypo

SEQ ID NO: 61893 - DNA, 16 bp, Homo sapiens
  chr7:101056509-101056525
  hypo
agacttgtggccgggc

SEQ ID NO: 61894 - DNA, 87 bp, Homo sapiens; identical to SEQ ID NO: 41407
  chr7:101131936-101132023
  hypo

SEQ ID NO: 61895 - DNA, 147 bp, Homo sapiens
  chr7:101241846-101241993
  hypo
cggaaactggcaagccgccggagggcctcgtcaaggctttgatgaccctgtgctgaggacgcaaatcctaggcctggccgacaccctgctccaaggaccaatgactgaggccagagagggtcccagatggagcctgggtaggggtga

SEQ ID NO: 61896 - DNA, 30 bp, Homo sapiens; identical to SEQ ID NO: 41410
  chr7:101627816-101627846
  hypo

SEQ ID NO: 61897 - DNA, 34 bp, Homo sapiens; identical to SEQ ID NO: 41411
  chr7:101630517-101630551
  hypo

SEQ ID NO: 61898 - DNA, 115 bp, Homo sapiens; identical to SEQ ID NO: 41412
  chr7:101652590-101652705
  hypo

SEQ ID NO: 61899 - DNA, 78 bp, Homo sapiens; identical to SEQ ID NO: 15018
  chr7:101656381-101656459
  hypo

SEQ ID NO: 61900 - DNA, 30 bp, Homo sapiens; identical to SEQ ID NO: 41414
  chr7:101707051-101707081
  hypo

SEQ ID NO: 61901 - DNA, 8 bp, Homo sapiens
  chr7:101707532-101707540
  hypo
ttgcccag

SEQ ID NO: 61902 - DNA, 38 bp, Homo sapiens; identical to SEQ ID NO: 41416
  chr7:101707600-101707638
  hypo

SEQ ID NO: 61903 - DNA, 97 bp, Homo sapiens; identical to SEQ ID NO: 41417
  chr7:102097002-102097099
  hypo

SEQ ID NO: 61904 - DNA, 29 bp, Homo sapiens
  chr7:102232246-102232275
  hypo
acaacctggtaaggtcggatcaacttcct

SEQ ID NO: 61905 - DNA, 30 bp, Homo sapiens; identical to SEQ ID NO: 41420
  chr7:105280417-105280447
  hypo

SEQ ID NO: 61906 - DNA, 30 bp, Homo sapiens; identical to SEQ ID NO: 41421
  chr7:105288193-105288223
  hypo

SEQ ID NO: 61907 - DNA, 30 bp, Homo sapiens; identical to SEQ ID NO: 41422
  chr7:106123211-106123241
  hypo

SEQ ID NO: 61908 - DNA, 90 bp, Homo sapiens; identical to SEQ ID NO: 41423
  chr7:106123301-106123391
  hypo

SEQ ID NO: 61909 - DNA, 290 bp, Homo sapiens; identical to SEQ ID NO: 41424
  chr7:106508656-106508946
  hypo

SEQ ID NO: 61910 - DNA, 32 bp, Homo sapiens; identical to SEQ ID NO: 41425
  chr7:106609365-106609397
  hypo

SEQ ID NO: 61911 - DNA, 42 bp, Homo sapiens; identical to SEQ ID NO: 41426
  chr7:106651496-106651538
  hypo

SEQ ID NO: 61912 - DNA, 37 bp, Homo sapiens; identical to SEQ ID NO: 41427
  chr7:106748373-106748410
  hypo

SEQ ID NO: 61913 - DNA, 43 bp, Homo sapiens; identical to SEQ ID NO: 41428
  chr7:106796956-106796999
  hypo

SEQ ID NO: 61914 - DNA, 41 bp, Homo sapiens; identical to SEQ ID NO: 41429
  chr7:106797653-106797694
  hypo

SEQ ID NO: 61915 - DNA, 24 bp, Homo sapiens
  chr7:106802882-106802906
  hypo
gcgagactccgtccataaaacaaa

SEQ ID NO: 61916 - DNA, 121 bp, Homo sapiens; identical to SEQ ID NO: 41431
  chr7:106837489-106837610
  hypo

SEQ ID NO: 61917 - DNA, 90 bp, Homo sapiens; identical to SEQ ID NO: 41432
  chr7:107148303-107148393
  hypo

SEQ ID NO: 61918 - DNA, 150 bp, Homo sapiens; identical to SEQ ID NO: 41434
  chr7:108515007-108515157
  hypo

SEQ ID NO: 61919 - DNA, 30 bp, Homo sapiens; identical to SEQ ID NO: 41435
  chr7:111662581-111662611
  hypo

SEQ ID NO: 61920 - DNA, 33 bp, Homo sapiens; identical to SEQ ID NO: 41436
  chr7:115738436-115738469
  hypo

SEQ ID NO: 61921 - DNA, 16 bp, Homo sapiens
  chr7:116492607-116492623
  hypo
ccgagtagctggaact

SEQ ID NO: 61922 - DNA, 16 bp, Homo sapiens
  chr7:123175665-123175681
  hypo
agagtcttgctctgtc

SEQ ID NO: 61923 - DNA, 72 bp, Homo sapiens
  chr7:128096987-128097059
  hypo
ttacaggtatgagccaccgcgcctggcctaagaaagtaaaagttttaagaagtgttcttgaattagtccaag

SEQ ID NO: 61924 - DNA, 30 bp, Homo sapiens; identical to SEQ ID NO: 1575
  chr7:128097589-128097619
  hypo

SEQ ID NO: 61925 - DNA, 103 bp, Homo sapiens; identical to SEQ ID NO: 41442
  chr7:128315917-128316020
  hypo

SEQ ID NO: 61926 - DNA, 30 bp, Homo sapiens; identical to SEQ ID NO: 41443
  chr7:128483019-128483049
  hypo

SEQ ID NO: 61927 - DNA, 54 bp, Homo sapiens; identical to SEQ ID NO: 41444
  chr7:128486164-128486218
  hypo

SEQ ID NO: 61928 - DNA, 40 bp, Homo sapiens; identical to SEQ ID NO: 41445
  chr7:128493190-128493230
  hypo

SEQ ID NO: 61929 - DNA, 30 bp, Homo sapiens; identical to SEQ ID NO: 41446
  chr7:128525170-128525200
  hypo

SEQ ID NO: 61930 - DNA, 47 bp, Homo sapiens; identical to SEQ ID NO: 41447
  chr7:128528840-128528887
  hypo

SEQ ID NO: 61931 - DNA, 30 bp, Homo sapiens; identical to SEQ ID NO: 15026
  chr7:128529102-128529132
  hypo

SEQ ID NO: 61932 - DNA, 30 bp, Homo sapiens; identical to SEQ ID NO: 41449
  chr7:128533290-128533320
  hypo

SEQ ID NO: 61933 - DNA, 30 bp, Homo sapiens; identical to SEQ ID NO: 41451
  chr7:129297274-129297304
  hypo

SEQ ID NO: 61934 - DNA, 30 bp, Homo sapiens; identical to SEQ ID NO: 41452
  chr7:129330294-129330324
  hypo

SEQ ID NO: 61935 - DNA, 258 bp, Homo sapiens; identical to SEQ ID NO: 41453
  chr7:129381062-129381320
  hypo

SEQ ID NO: 61936 - DNA, 30 bp, Homo sapiens; identical to SEQ ID NO: 41454
  chr7:129782524-129782554
  hypo

SEQ ID NO: 61937 - DNA, 167 bp, Homo sapiens
  chr7:129794426-129794593
  hypo
tccaagtgccagctgcgcagcctggcccagagtccgggcccaggagggcccgcagtgcctgcagctgcctggggaccacatgcgtgactggctggccccctgctcatcccgcctctctcctccgcctggcttcgcgccgcctgcctgccctcggggacaagcgtgcc

SEQ ID NO: 61938 - DNA, 18 bp, Homo sapiens
  chr7:129794721-129794739
  hypo
gtgcgcccatcagggtgt

SEQ ID NO: 61939 - DNA, 30 bp, Homo sapiens; identical to SEQ ID NO: 41456
  chr7:129846079-129846109
  hypo

SEQ ID NO: 61940 - DNA, 28 bp, Homo sapiens
  chr7:131011379-131011407
  hypo
aggtgtgagccaccgtgccgggcctggc

SEQ ID NO: 61941 - DNA, 30 bp, Homo sapiens; identical to SEQ ID NO: 15029
  chr7:131231034-131231064
  hypo

SEQ ID NO: 61942 - DNA, 35 bp, Homo sapiens; identical to SEQ ID NO: 41460
  chr7:132155933-132155968
  hypo

SEQ ID NO: 61943 - DNA, 34 bp, Homo sapiens; identical to SEQ ID NO: 41461
  chr7:132156088-132156122
  hypo

SEQ ID NO: 61944 - DNA, 117 bp, Homo sapiens; identical to SEQ ID NO: 41462
  chr7:132418949-132419066
  hypo

SEQ ID NO: 61945 - DNA, 30 bp, Homo sapiens; identical to SEQ ID NO: 41463
  chr7:134116597-134116627
  hypo

SEQ ID NO: 61946 - DNA, 30 bp, Homo sapiens; identical to SEQ ID NO: 41464
  chr7:134880911-134880941
  hypo

SEQ ID NO: 61947 - DNA, 104 bp, Homo sapiens; identical to SEQ ID NO: 41465
  chr7:134885144-134885248
  hypo

SEQ ID NO: 61948 - DNA, 30 bp, Homo sapiens; identical to SEQ ID NO: 41467
  chr7:134953117-134953147
  hypo

SEQ ID NO: 61949 - DNA, 37 bp, Homo sapiens; identical to SEQ ID NO: 41468
  chr7:135125375-135125412
  hypo

SEQ ID NO: 61950 - DNA, 84 bp, Homo sapiens; identical to SEQ ID NO: 41469
  chr7:135196033-135196117
  hypo

SEQ ID NO: 61951 - DNA, 24 bp, Homo sapiens
  chr7:135196357-135196381
  hypo
gattacagacgtgagccagggcac

SEQ ID NO: 61952 - DNA, 37 bp, Homo sapiens; identical to SEQ ID NO: 41471
  chr7:135234576-135234613
  hypo

SEQ ID NO: 61953 - DNA, 30 bp, Homo sapiens; identical to SEQ ID NO: 41472
  chr7:135391578-135391608
  hypo

SEQ ID NO: 61954 - DNA, 135 bp, Homo sapiens; identical to SEQ ID NO: 15032
  chr7:135401363-135401498
  hypo

SEQ ID NO: 61955 - DNA, 30 bp, Homo sapiens; identical to SEQ ID NO: 41474
  chr7:135898077-135898107
  hypo

SEQ ID NO: 61956 - DNA, 23 bp, Homo sapiens
  chr7:135965324-135965347
  hypo
accatgcccggcatgactgctct

SEQ ID NO: 61957 - DNA, 36 bp, Homo sapiens; identical to SEQ ID NO: 41476
  chr7:137092635-137092671
  hypo

SEQ ID NO: 61958 - DNA, 30 bp, Homo sapiens; identical to SEQ ID NO: 15033
  chr7:137664095-137664125
  hypo

SEQ ID NO: 61959 - DNA, 18 bp, Homo sapiens
  chr7:137693378-137693396
  hypo
acacggcctcggtgtgtt

SEQ ID NO: 61960 - DNA, 32 bp, Homo sapiens; identical to SEQ ID NO: 41479
  chr7:138845459-138845491
  hypo

SEQ ID NO: 61961 - DNA, 55 bp, Homo sapiens; identical to SEQ ID NO: 41480
  chr7:138912533-138912588
  hypo

SEQ ID NO: 61962 - DNA, 18 bp, Homo sapiens
  chr7:138913068-138913086
  hypo
gctgaggcaggagaacgg

SEQ ID NO: 61963 - DNA, 17 bp, Homo sapiens
  chr7:138913146-138913163
  hypo
ggcgacagagcaagact

SEQ ID NO: 61964 - DNA, 30 bp, Homo sapiens; identical to SEQ ID NO: 41483
  chr7:138957222-138957252
  hypo

SEQ ID NO: 61965 - DNA, 38 bp, Homo sapiens; identical to SEQ ID NO: 41484
  chr7:139027295-139027333
  hypo

SEQ ID NO: 61966 - DNA, 30 bp, Homo sapiens; identical to SEQ ID NO: 41485
  chr7:139112625-139112655
  hypo

SEQ ID NO: 61967 - DNA, 30 bp, Homo sapiens; identical to SEQ ID NO: 41486
  chr7:139245499-139245529
  hypo

SEQ ID NO: 61968 - DNA, 148 bp, Homo sapiens; identical to SEQ ID NO: 41487
  chr7:139650638-139650786
  hypo

SEQ ID NO: 61969 - DNA, 30 bp, Homo sapiens; identical to SEQ ID NO: 41488
  chr7:139919897-139919927
  hypo

SEQ ID NO: 61970 - DNA, 68 bp, Homo sapiens; identical to SEQ ID NO: 41490
  chr7:140007275-140007343
  hypo

SEQ ID NO: 61971 - DNA, 21 bp, Homo sapiens
  chr7:140026923-140026944
  hypo
acggagcgagattctgtctca

SEQ ID NO: 61972 - DNA, 31 bp, Homo sapiens; identical to SEQ ID NO: 41492
  chr7:140096707-140096738
  hypo

SEQ ID NO: 61973 - DNA, 30 bp, Homo sapiens; identical to SEQ ID NO: 41493
  chr7:140097278-140097308
  hypo

SEQ ID NO: 61974 - DNA, 80 bp, Homo sapiens; identical to SEQ ID NO: 41494
  chr7:140156598-140156678
  hypo

SEQ ID NO: 61975 - DNA, 50 bp, Homo sapiens; identical to SEQ ID NO: 41495
  chr7:140192162-140192212
  hypo

SEQ ID NO: 61976 - DNA, 30 bp, Homo sapiens; identical to SEQ ID NO: 41496
  chr7:144488206-144488236
  hypo

SEQ ID NO: 61977 - DNA, 20 bp, Homo sapiens
  chr7:144565939-144565959
  hypo
acaggcgtgagccaccgcgc

SEQ ID NO: 61978 - DNA, 22 bp, Homo sapiens
  chr7:146300226-146300248
  hypo
gggcgaggtggctcacgcctgt

SEQ ID NO: 61979 - DNA, 30 bp, Homo sapiens; identical to SEQ ID NO: 41499
  chr7:148500594-148500624
  hypo

SEQ ID NO: 61980 - DNA, 86 bp, Homo sapiens; identical to SEQ ID NO: 24374
  chr7:148640250-148640336
  hypo

SEQ ID NO: 61981 - DNA, 53 bp, Homo sapiens; identical to SEQ ID NO: 41501
  chr7:148842138-148842191
  hypo

SEQ ID NO: 61982 - DNA, 63 bp, Homo sapiens; identical to SEQ ID NO: 24375
  chr7:148846075-148846138
  hypo

SEQ ID NO: 61983 - DNA, 44 bp, Homo sapiens
  chr7:148846180-148846224
  hypo
agtccaggagttcgaggcagtccacaccgcgtctctaaaataaa

SEQ ID NO: 61984 - DNA, 38 bp, Homo sapiens; identical to SEQ ID NO: 41503
  chr7:148883975-148884013
  hypo

SEQ ID NO: 61985 - DNA, 71 bp, Homo sapiens; identical to SEQ ID NO: 24376
  chr7:150049533-150049604
  hypo

SEQ ID NO: 61986 - DNA, 56 bp, Homo sapiens; identical to SEQ ID NO: 41505
  chr7:150068969-150069025
  hypo

SEQ ID NO: 61987 - DNA, 82 bp, Homo sapiens; identical to SEQ ID NO: 41506
  chr7:150069445-150069527
  hypo

SEQ ID NO: 61988 - DNA, 143 bp, Homo sapiens; identical to SEQ ID NO: 41507
  chr7:150070146-150070289
  hypo

SEQ ID NO: 61989 - DNA, 30 bp, Homo sapiens
  chr7:150081206-150081236
  hypo
aactgcagcctgacccggtgcgcggagggc

SEQ ID NO: 61990 - DNA, 76 bp, Homo sapiens; identical to SEQ ID NO: 15042
  chr7:150746248-150746324
  hypo

SEQ ID NO: 61991 - DNA, 193 bp, Homo sapiens; identical to SEQ ID NO: 41510
  chr7:150758966-150759159
  hypo

SEQ ID NO: 61992 - DNA, 142 bp, Homo sapiens; identical to SEQ ID NO: 41511
  chr7:150773923-150774065
  hypo

SEQ ID NO: 61993 - DNA, 33 bp, Homo sapiens; identical to SEQ ID NO: 41512
  chr7:150774325-150774358
  hypo

SEQ ID NO: 61994 - DNA, 99 bp, Homo sapiens; identical to SEQ ID NO: 15043
  chr7:150774704-150774803
  hypo

SEQ ID NO: 61995 - DNA, 73 bp, Homo sapiens; identical to SEQ ID NO: 41514
  chr7:150811286-150811359
  hypo

SEQ ID NO: 61996 - DNA, 330 bp, Homo sapiens; identical to SEQ ID NO: 41515
  chr7:150823565-150823895
  hypo

SEQ ID NO: 61997 - DNA, 310 bp, Homo sapiens
  chr7:150870889-150871199
  hypo
tccccgtgccaagggccacagcctctgagatgcttcctaggcggctccagtgccatctccccagcaacggccttctgcttcccgttacttcctcgtcttccccatcttagcatctggcaccaccgtccaggggtccaagccaaaaacctgcgagtcgccctagacagcgctattctgcagccccctacatcccccccagcggcggccccccagttcttcccagggatcccgaatctcgcccgccgcgaccacctctggcctggaccaccgccgcaggtgccccccgacccacgcccgcagccaggacggt

SEQ ID NO: 61998 - DNA, 84 bp, Homo sapiens; identical to SEQ ID NO: 41517
  chr7:150872928-150873012
  hypo

SEQ ID NO: 61999 - DNA, 47 bp, Homo sapiens; identical to SEQ ID NO: 41518
  chr7:151082165-151082212
  hypo

SEQ ID NO: 62000 - DNA, 151 bp, Homo sapiens; identical to SEQ ID NO: 41519
  chr7:151553602-151553753
  hypo

SEQ ID NO: 62001 - DNA, 30 bp, Homo sapiens; identical to SEQ ID NO: 41520
  chr7:151585396-151585426
  hypo

SEQ ID NO: 62002 - DNA, 18 bp, Homo sapiens
  chr7:151591649-151591667
  hypo
ggctcaagccctccccga

SEQ ID NO: 62003 - DNA, 30 bp, Homo sapiens; identical to SEQ ID NO: 41522
  chr7:152159631-152159661
  hypo

SEQ ID NO: 62004 - DNA, 40 bp, Homo sapiens; identical to SEQ ID NO: 41523
  chr7:152337514-152337554
  hypo

SEQ ID NO: 62005 - DNA, 175 bp, Homo sapiens; identical to SEQ ID NO: 15049
  chr7:152693809-152693984
  hypo

SEQ ID NO: 62006 - DNA, 206 bp, Homo sapiens; identical to SEQ ID NO: 41525
  chr7:152782995-152783201
  hypo

SEQ ID NO: 62007 - DNA, 34 bp, Homo sapiens; identical to SEQ ID NO: 41526
  chr7:152984071-152984105
  hypo

SEQ ID NO: 62008 - DNA, 24 bp, Homo sapiens
  chr7:153041593-153041617
  hypo
tttttttttttgagacggagtctc

SEQ ID NO: 62009 - DNA, 38 bp, Homo sapiens; identical to SEQ ID NO: 41528
  chr7:153102258-153102296
  hypo

SEQ ID NO: 62010 - DNA, 80 bp, Homo sapiens; identical to SEQ ID NO: 41529
  chr7:153540019-153540099
  hypo

SEQ ID NO: 62011 - DNA, 30 bp, Homo sapiens; identical to SEQ ID NO: 41530
  chr7:153641678-153641708
  hypo

SEQ ID NO: 62012 - DNA, 30 bp, Homo sapiens; identical to SEQ ID NO: 41531
  chr7:153896397-153896427
  hypo

SEQ ID NO: 62013 - DNA, 40 bp, Homo sapiens; identical to SEQ ID NO: 41532
  chr7:154088244-154088284
  hypo

SEQ ID NO: 62014 - DNA, 30 bp, Homo sapiens; identical to SEQ ID NO: 41533
  chr7:154186455-154186485
  hypo

SEQ ID NO: 62015 - DNA, 45 bp, Homo sapiens; identical to SEQ ID NO: 41535
  chr7:154665013-154665058
  hypo

SEQ ID NO: 62016 - DNA, 41 bp, Homo sapiens; identical to SEQ ID NO: 41536
  chr7:154670093-154670134
  hypo

SEQ ID NO: 62017 - DNA, 43 bp, Homo sapiens; identical to SEQ ID NO: 41537
  chr7:154922507-154922550
  hypo

SEQ ID NO: 62018 - DNA, 30 bp, Homo sapiens; identical to SEQ ID NO: 41538
  chr7:155130764-155130794
  hypo

SEQ ID NO: 62019 - DNA, 44 bp, Homo sapiens; identical to SEQ ID NO: 41539
  chr7:155133192-155133236
  hypo

SEQ ID NO: 62020 - DNA, 30 bp, Homo sapiens; identical to SEQ ID NO: 41540
  chr7:155144931-155144961
  hypo

SEQ ID NO: 62021 - DNA, 43 bp, Homo sapiens; identical to SEQ ID NO: 41541
  chr7:155202839-155202882
  hypo

SEQ ID NO: 62022 - DNA, 16 bp, Homo sapiens
  chr7:155363288-155363304
  hypo
tccacagaacacctcc

SEQ ID NO: 62023 - DNA, 87 bp, Homo sapiens
  chr7:155363417-155363504
  hypo
cccctcacaggcccctccgcgagtgctgggcgtgcagcagacaaatggcatacaaaggtcctcgggccgcaccgccctagatacccg

SEQ ID NO: 62024 - DNA, 84 bp, Homo sapiens
  chr7:155580762-155580846
  hypo
caccatctgtgtccacgcagagggtcgggccgtgggagccgcgagtgtctggcccacacttctgttcttaacctcgcaatgtat

SEQ ID NO: 62025 - DNA, 51 bp, Homo sapiens
  chr7:155580876-155580927
  hypo
atcgacagctaaaaatccaaccaaggccgggcgcggtggttcacgcctgta

SEQ ID NO: 62026 - DNA, 212 bp, Homo sapiens
  chr7:155581553-155581765
  hypo
acagccagggaaagggctgaggcagagcaacgctgggtgaaccccgtcttcctgaggccacgtttgcaccgggaagagaacacagtgaaccccctgagcaccaacacgctcccacaccccccacgagcagcccagccctggggaggagcccgtccttctccctgcttgccacaccggccacgtccgtaaccctgcccagcatcccacccagg

SEQ ID NO: 62027 - DNA, 45 bp, Homo sapiens
  chr7:155582232-155582277
  hypo
gcggcctttgcttcccggtgctggctgtgcccagacgcctgggct

SEQ ID NO: 62028 - DNA, 37 bp, Homo sapiens; identical to SEQ ID NO: 41546
  chr7:155752556-155752593
  hypo

SEQ ID NO: 62029 - DNA, 105 bp, Homo sapiens; identical to SEQ ID NO: 41547
  chr7:155753582-155753687
  hypo

SEQ ID NO: 62030 - DNA, 34 bp, Homo sapiens; identical to SEQ ID NO: 41548
  chr7:155786790-155786824
  hypo

SEQ ID NO: 62031 - DNA, 52 bp, Homo sapiens; identical to SEQ ID NO: 41549
  chr7:155854343-155854395
  hypo

SEQ ID NO: 62032 - DNA, 30 bp, Homo sapiens; identical to SEQ ID NO: 41550
  chr7:155871902-155871932
  hypo

SEQ ID NO: 62033 - DNA, 175 bp, Homo sapiens; identical to SEQ ID NO: 41551
  chr7:155898977-155899152
  hypo

SEQ ID NO: 62034 - DNA, 24 bp, Homo sapiens
  chr7:155920548-155920572
  hypo
acttcttacctggctcgctgcaaa

SEQ ID NO: 62035 - DNA, 38 bp, Homo sapiens; identical to SEQ ID NO: 41553
  chr7:156012968-156013006
  hypo

SEQ ID NO: 62036 - DNA, 173 bp, Homo sapiens; identical to SEQ ID NO: 41554
  chr7:156025663-156025836
  hypo

SEQ ID NO: 62037 - DNA, 44 bp, Homo sapiens; identical to SEQ ID NO: 41555
  chr7:156138347-156138391
  hypo

SEQ ID NO: 62038 - DNA, 102 bp, Homo sapiens; identical to SEQ ID NO: 41556
  chr7:156177626-156177728
  hypo

SEQ ID NO: 62039 - DNA, 86 bp, Homo sapiens; identical to SEQ ID NO: 24392
  chr7:156744713-156744799
  hypo

SEQ ID NO: 62040 - DNA, 168 bp, Homo sapiens
  chr7:156832680-156832848
  hypo
caagtgtgctgaagacgcaaacctaacacgcaggaggcaggaaccgtctgaggcagcccccggcaaacgtcaggctgtgtggctcagacccggcacagcctccgcgatgggagctccggggggggctggctggggacaaggacaagcggacttgggagcgacggggtt

SEQ ID NO: 62041 - DNA, 38 bp, Homo sapiens
  chr7:156880561-156880599
  hypo
gcacggccctcggcgtggatatccggaaggcagccacc

SEQ ID NO: 62042 - DNA, 50 bp, Homo sapiens; identical to SEQ ID NO: 41561
  chr7:156883354-156883404
  hypo

SEQ ID NO: 62043 - DNA, 30 bp, Homo sapiens; identical to SEQ ID NO: 41562
  chr7:156924103-156924133
  hypo

SEQ ID NO: 62044 - DNA, 21 bp, Homo sapiens
  chr7:156929628-156929649
  hypo
ttatttattttgagacggagt

SEQ ID NO: 62045 - DNA, 81 bp, Homo sapiens; identical to SEQ ID NO: 41564
  chr7:157075212-157075293
  hypo

SEQ ID NO: 62046 - DNA, 171 bp, Homo sapiens; identical to SEQ ID NO: 41565
  chr7:157084426-157084597
  hypo

SEQ ID NO: 62047 - DNA, 30 bp, Homo sapiens; identical to SEQ ID NO: 24396
  chr7:157085343-157085373
  hypo

SEQ ID NO: 62048 - DNA, 108 bp, Homo sapiens
  chr7:157085487-157085595
  hypo
ctccaggacacagcctcaccctatcagggcagcgagggctggggcggacaggggagccgtagacagcccgtccctgggtgggcctggccttcccggccctgactcagc

SEQ ID NO: 62049 - DNA, 37 bp, Homo sapiens
  chr7:157085926-157085963
  hypo
gggagagctgctgcccggccgagcctctgctcccacg

SEQ ID NO: 62050 - DNA, 65 bp, Homo sapiens
  chr7:157086082-157086147
  hypo
gttctccggatctccagacgtttaggctgaaagtgcagagatttagaagtcggacagggagttgg

SEQ ID NO: 62051 - DNA, 71 bp, Homo sapiens; identical to SEQ ID NO: 41568
  chr7:157099869-157099940
  hypo

SEQ ID NO: 62052 - DNA, 30 bp, Homo sapiens; identical to SEQ ID NO: 41569
  chr7:157147812-157147842
  hypo

SEQ ID NO: 62053 - DNA, 48 bp, Homo sapiens; identical to SEQ ID NO: 41570
  chr7:157217366-157217414
  hypo

SEQ ID NO: 62054 - DNA, 46 bp, Homo sapiens; identical to SEQ ID NO: 41571
  chr7:157218481-157218527
  hypo

SEQ ID NO: 62055 - DNA, 30 bp, Homo sapiens; identical to SEQ ID NO: 41572
  chr7:157220595-157220625
  hypo

SEQ ID NO: 62056 - DNA, 30 bp, Homo sapiens; identical to SEQ ID NO: 41573
  chr7:157233964-157233994
  hypo

SEQ ID NO: 62057 - DNA, 36 bp, Homo sapiens; identical to SEQ ID NO: 41574
  chr7:157235760-157235796
  hypo

SEQ ID NO: 62058 - DNA, 261 bp, Homo sapiens; identical to SEQ ID NO: 41575
  chr7:157255061-157255322
  hypo

SEQ ID NO: 62059 - DNA, 236 bp, Homo sapiens; identical to SEQ ID NO: 24400
  chr7:157262579-157262815
  hypo

SEQ ID NO: 62060 - DNA, 276 bp, Homo sapiens; identical to SEQ ID NO: 24401
  chr7:157263018-157263294
  hypo

SEQ ID NO: 62061 - DNA, 30 bp, Homo sapiens; identical to SEQ ID NO: 41577
  chr7:157276023-157276053
  hypo

SEQ ID NO: 62062 - DNA, 143 bp, Homo sapiens; identical to SEQ ID NO: 41578
  chr7:157280216-157280359
  hypo

SEQ ID NO: 62063 - DNA, 108 bp, Homo sapiens; identical to SEQ ID NO: 41579
  chr7:157280626-157280734
  hypo

SEQ ID NO: 62064 - DNA, 30 bp, Homo sapiens; identical to SEQ ID NO: 41580
  chr7:157291421-157291451
  hypo

SEQ ID NO: 62065 - DNA, 33 bp, Homo sapiens; identical to SEQ ID NO: 41581
  chr7:157294288-157294321
  hypo

SEQ ID NO: 62066 - DNA, 30 bp, Homo sapiens; identical to SEQ ID NO: 41582
  chr7:157319640-157319670
  hypo

SEQ ID NO: 62067 - DNA, 30 bp, Homo sapiens; identical to SEQ ID NO: 41583
  chr7:157320767-157320797
  hypo

SEQ ID NO: 62068 - DNA, 142 bp, Homo sapiens; identical to SEQ ID NO: 41584
  chr7:157337964-157338106
  hypo

SEQ ID NO: 62069 - DNA, 83 bp, Homo sapiens; identical to SEQ ID NO: 41585
  chr7:157338308-157338391
  hypo

SEQ ID NO: 62070 - DNA, 30 bp, Homo sapiens; identical to SEQ ID NO: 41586
  chr7:157346704-157346734
  hypo

SEQ ID NO: 62071 - DNA, 151 bp, Homo sapiens; identical to SEQ ID NO: 41587
  chr7:157346983-157347134
  hypo

SEQ ID NO: 62072 - DNA, 37 bp, Homo sapiens; identical to SEQ ID NO: 41588
  chr7:157347797-157347834
  hypo

SEQ ID NO: 62073 - DNA, 129 bp, Homo sapiens; identical to SEQ ID NO: 41589
  chr7:157352962-157353091
  hypo

SEQ ID NO: 62074 - DNA, 69 bp, Homo sapiens; identical to SEQ ID NO: 41590
  chr7:157370495-157370564
  hypo

SEQ ID NO: 62075 - DNA, 209 bp, Homo sapiens; identical to SEQ ID NO: 41591
  chr7:157396449-157396658
  hypo

SEQ ID NO: 62076 - DNA, 189 bp, Homo sapiens; identical to SEQ ID NO: 41592
  chr7:157403604-157403793
  hypo

SEQ ID NO: 62077 - DNA, 152 bp, Homo sapiens; identical to SEQ ID NO: 41593
  chr7:157408585-157408737
  hypo

SEQ ID NO: 62078 - DNA, 101 bp, Homo sapiens; identical to SEQ ID NO: 41594
  chr7:157437497-157437598
  hypo

SEQ ID NO: 62079 - DNA, 77 bp, Homo sapiens; identical to SEQ ID NO: 41595
  chr7:157443179-157443256
  hypo

SEQ ID NO: 62080 - DNA, 88 bp, Homo sapiens; identical to SEQ ID NO: 41596
  chr7:157448438-157448526
  hypo

SEQ ID NO: 62081 - DNA, 160 bp, Homo sapiens; identical to SEQ ID NO: 41597
  chr7:157449174-157449334
  hypo

SEQ ID NO: 62082 - DNA, 93 bp, Homo sapiens; identical to SEQ ID NO: 41598
  chr7:157455478-157455571
  hypo

SEQ ID NO: 62083 - DNA, 30 bp, Homo sapiens; identical to SEQ ID NO: 41599
  chr7:157455840-157455870
  hypo

SEQ ID NO: 62084 - DNA, 44 bp, Homo sapiens; identical to SEQ ID NO: 41600
  chr7:157511451-157511495
  hypo

SEQ ID NO: 62085 - DNA, 152 bp, Homo sapiens; identical to SEQ ID NO: 41601
  chr7:157512238-157512390
  hypo

SEQ ID NO: 62086 - DNA, 52 bp, Homo sapiens; identical to SEQ ID NO: 41602
  chr7:157527557-157527609
  hypo

SEQ ID NO: 62087 - DNA, 30 bp, Homo sapiens; identical to SEQ ID NO: 41603
  chr7:157530181-157530211
  hypo

SEQ ID NO: 62088 - DNA, 30 bp, Homo sapiens; identical to SEQ ID NO: 41604
  chr7:157536702-157536732
  hypo

SEQ ID NO: 62089 - DNA, 103 bp, Homo sapiens; identical to SEQ ID NO: 41605
  chr7:157551220-157551323
  hypo

SEQ ID NO: 62090 - DNA, 48 bp, Homo sapiens; identical to SEQ ID NO: 15075
  chr7:157565500-157565548
  hypo

SEQ ID NO: 62091 - DNA, 30 bp, Homo sapiens; identical to SEQ ID NO: 15076
  chr7:157568187-157568217
  hypo

SEQ ID NO: 62092 - DNA, 30 bp, Homo sapiens; identical to SEQ ID NO: 41608
  chr7:157578615-157578645
  hypo

SEQ ID NO: 62093 - DNA, 278 bp, Homo sapiens
  chr7:157583900-157584178
  hypo
aagaagaatgagatacgtccatttgctgtgataagaaaagatattccacagtttcgtatttgttaagtattttcagcaaatcatggaacacgatgcaacacccgattccatgtttgaaaacagaacagaacaaaattcaacaagaaataagcgcccgcgtccacatattctcgtgcctggcgtgttttacgtgcttgggaagcggagcggccgctgggcttggctctgaggtcgggactggtgcaggcggatgcatgtatgtgcccgggtcccgcctc

SEQ ID NO: 62094 - DNA, 33 bp, Homo sapiens; identical to SEQ ID NO: 24410
  chr7:157584208-157584241
  hypo

SEQ ID NO: 62095 - DNA, 30 bp, Homo sapiens; identical to SEQ ID NO: 41610
  chr7:157584643-157584673
  hypo

SEQ ID NO: 62096 - DNA, 30 bp, Homo sapiens; identical to SEQ ID NO: 41611
  chr7:157585079-157585109
  hypo

SEQ ID NO: 62097 - DNA, 202 bp, Homo sapiens
  chr7:157588791-157588993
  hypo
tcagagggacctgcccagtcctgtcaattttccatctaaattacataactgtcctccttagagacgcggggatgcccaggcacaggcatgaaagatcggccttgaggttattttgtctctgcaagtattgatgcgaggacttgtggcgcttttctttcccggtgaactttcccaactgctgatgttacgtgcactaagcaca

SEQ ID NO: 62098 - DNA, 30 bp, Homo sapiens; identical to SEQ ID NO: 41613
  chr7:157601854-157601884
  hypo

SEQ ID NO: 62099 - DNA, 212 bp, Homo sapiens
  chr7:157606494-157606706
  hypo
cagaatggcctggagcgcgggtaaaacagctcggggccagccagagcttctgagccagggctgggcccaagaacgtgcatttgcgttgttccccaggtgatgctgctggtgaccccggggaccccgccgtgagagccccgacacaagtcgcggtttgtggtgctttggaggagtttgctccttagagtgagggggattgttctgccccaatg

SEQ ID NO: 62100 - DNA, 28 bp, Homo sapiens
  chr7:157606736-157606764
  hypo
gcgaggcagtggtcgccacacccacact

SEQ ID NO: 62101 - DNA, 123 bp, Homo sapiens; identical to SEQ ID NO: 41615
  chr7:157633412-157633535
  hypo

SEQ ID NO: 62102 - DNA, 30 bp, Homo sapiens; identical to SEQ ID NO: 41616
  chr7:157642058-157642088
  hypo

SEQ ID NO: 62103 - DNA, 30 bp, Homo sapiens; identical to SEQ ID NO: 41617
  chr7:157654407-157654437
  hypo

SEQ ID NO: 62104 - DNA, 30 bp, Homo sapiens; identical to SEQ ID NO: 41618
  chr7:157656677-157656707
  hypo

SEQ ID NO: 62105 - DNA, 213 bp, Homo sapiens; identical to SEQ ID NO: 41619
  chr7:157659256-157659469
  hypo

SEQ ID NO: 62106 - DNA, 30 bp, Homo sapiens; identical to SEQ ID NO: 41620
  chr7:157660091-157660121
  hypo

SEQ ID NO: 62107 - DNA, 30 bp, Homo sapiens; identical to SEQ ID NO: 41621
  chr7:157690247-157690277
  hypo

SEQ ID NO: 62108 - DNA, 30 bp, Homo sapiens; identical to SEQ ID NO: 41622
  chr7:157718446-157718476
  hypo

SEQ ID NO: 62109 - DNA, 30 bp, Homo sapiens; identical to SEQ ID NO: 41623
  chr7:157722621-157722651
  hypo

SEQ ID NO: 62110 - DNA, 161 bp, Homo sapiens; identical to SEQ ID NO: 15083
  chr7:157776781-157776942
  hypo

SEQ ID NO: 62111 - DNA, 17 bp, Homo sapiens
  chr7:157793339-157793356
  hypo
gtgggggctggtgtccg

SEQ ID NO: 62112 - DNA, 23 bp, Homo sapiens
  chr7:157793865-157793888
  hypo
tggtgcaacgtggggctggggtc

SEQ ID NO: 62113 - DNA, 81 bp, Homo sapiens; identical to SEQ ID NO: 41627
  chr7:157794503-157794584
  hypo

SEQ ID NO: 62114 - DNA, 30 bp, Homo sapiens; identical to SEQ ID NO: 15085
  chr7:157877477-157877507
  hypo

SEQ ID NO: 62115 - DNA, 90 bp, Homo sapiens; identical to SEQ ID NO: 41629
  chr7:157958578-157958668
  hypo

SEQ ID NO: 62116 - DNA, 78 bp, Homo sapiens; identical to SEQ ID NO: 41630
  chr7:157987024-157987102
  hypo

SEQ ID NO: 62117 - DNA, 30 bp, Homo sapiens; identical to SEQ ID NO: 41631
  chr7:158040286-158040316
  hypo

SEQ ID NO: 62118 - DNA, 50 bp, Homo sapiens; identical to SEQ ID NO: 41632
  chr7:158059313-158059363
  hypo

SEQ ID NO: 62119 - DNA, 30 bp, Homo sapiens; identical to SEQ ID NO: 41633
  chr7:158059960-158059990
  hypo

SEQ ID NO: 62120 - DNA, 39 bp, Homo sapiens; identical to SEQ ID NO: 41634
  chr7:158065365-158065404
  hypo

SEQ ID NO: 62121 - DNA, 30 bp, Homo sapiens; identical to SEQ ID NO: 41635
  chr7:158113225-158113255
  hypo

SEQ ID NO: 62122 - DNA, 30 bp, Homo sapiens; identical to SEQ ID NO: 41636
  chr7:158144262-158144292
  hypo

SEQ ID NO: 62123 - DNA, 132 bp, Homo sapiens; identical to SEQ ID NO: 41637
  chr7:158187607-158187739
  hypo

SEQ ID NO: 62124 - DNA, 30 bp, Homo sapiens; identical to SEQ ID NO: 41638
  chr7:158249183-158249213
  hypo

SEQ ID NO: 62125 - DNA, 44 bp, Homo sapiens; identical to SEQ ID NO: 41639
  chr7:158283192-158283236
  hypo

SEQ ID NO: 62126 - DNA, 436 bp, Homo sapiens; identical to SEQ ID NO: 41640
  chr7:158301251-158301687
  hypo

SEQ ID NO: 62127 - DNA, 30 bp, Homo sapiens; identical to SEQ ID NO: 41641
  chr7:158332352-158332382
  hypo

SEQ ID NO: 62128 - DNA, 65 bp, Homo sapiens; identical to SEQ ID NO: 41642
  chr7:158349464-158349529
  hypo

SEQ ID NO: 62129 - DNA, 240 bp, Homo sapiens; identical to SEQ ID NO: 41643
  chr7:158550099-158550339
  hypo

SEQ ID NO: 62130 - DNA, 30 bp, Homo sapiens; identical to SEQ ID NO: 41644
  chr7:158564374-158564404
  hypo

SEQ ID NO: 62131 - DNA, 35 bp, Homo sapiens; identical to SEQ ID NO: 41645
  chr7:158857187-158857222
  hypo

SEQ ID NO: 62132 - DNA, 30 bp, Homo sapiens; identical to SEQ ID NO: 41646
  chr7:158868457-158868487
  hypo

SEQ ID NO: 62133 - DNA, 30 bp, Homo sapiens; identical to SEQ ID NO: 41647
  chr7:158963513-158963543
  hypo

SEQ ID NO: 62134 - DNA, 128 bp, Homo sapiens; identical to SEQ ID NO: 41648
  chr8:245097-245225
  hypo

SEQ ID NO: 62135 - DNA, 52 bp, Homo sapiens; identical to SEQ ID NO: 41649
  chr8:644647-644699
  hypo

SEQ ID NO: 62136 - DNA, 30 bp, Homo sapiens; identical to SEQ ID NO: 41650
  chr8:700159-700189
  hypo

SEQ ID NO: 62137 - DNA, 30 bp, Homo sapiens; identical to SEQ ID NO: 41651
  chr8:854787-854817
  hypo

SEQ ID NO: 62138 - DNA, 30 bp, Homo sapiens; identical to SEQ ID NO: 41652
  chr8:889984-890014
  hypo

SEQ ID NO: 62139 - DNA, 164 bp, Homo sapiens; identical to SEQ ID NO: 41653
  chr8:914966-915130
  hypo

SEQ ID NO: 62140 - DNA, 70 bp, Homo sapiens; identical to SEQ ID NO: 41654
  chr8:962490-962560
  hypo

SEQ ID NO: 62141 - DNA, 145 bp, Homo sapiens; identical to SEQ ID NO: 41655
  chr8:972705-972850
  hypo

SEQ ID NO: 62142 - DNA, 126 bp, Homo sapiens; identical to SEQ ID NO: 41656
  chr8:976259-976385
  hypo

SEQ ID NO: 62143 - DNA, 30 bp, Homo sapiens; identical to SEQ ID NO: 41657
  chr8:1043872-1043902
  hypo

SEQ ID NO: 62144 - DNA, 47 bp, Homo sapiens; identical to SEQ ID NO: 41658
  chr8:1048584-1048631
  hypo

SEQ ID NO: 62145 - DNA, 115 bp, Homo sapiens; identical to SEQ ID NO: 41659
  chr8:1051541-1051656
  hypo

SEQ ID NO: 62146 - DNA, 53 bp, Homo sapiens; identical to SEQ ID NO: 41660
  chr8:1066123-1066176
  hypo

SEQ ID NO: 62147 - DNA, 34 bp, Homo sapiens; identical to SEQ ID NO: 41661
  chr8:1133089-1133123
  hypo

SEQ ID NO: 62148 - DNA, 39 bp, Homo sapiens; identical to SEQ ID NO: 41662
  chr8:1136184-1136223
  hypo

SEQ ID NO: 62149 - DNA, 19 bp, Homo sapiens
  chr8:1137245-1137264
  hypo
ggaatctcacacacacggg

SEQ ID NO: 62150 - DNA, 79 bp, Homo sapiens; identical to SEQ ID NO: 41664
  chr8:1139165-1139244
  hypo

SEQ ID NO: 62151 - DNA, 58 bp, Homo sapiens; identical to SEQ ID NO: 41665
  chr8:1151131-1151189
  hypo

SEQ ID NO: 62152 - DNA, 53 bp, Homo sapiens; identical to SEQ ID NO: 41666
  chr8:1153026-1153079
  hypo

SEQ ID NO: 62153 - DNA, 118 bp, Homo sapiens; identical to SEQ ID NO: 41667
  chr8:1153298-1153416
  hypo

SEQ ID NO: 62154 - DNA, 30 bp, Homo sapiens; identical to SEQ ID NO: 41668
  chr8:1201984-1202014
  hypo

SEQ ID NO: 62155 - DNA, 162 bp, Homo sapiens; identical to SEQ ID NO: 41669
  chr8:1246678-1246840
  hypo

SEQ ID NO: 62156 - DNA, 30 bp, Homo sapiens; identical to SEQ ID NO: 41670
  chr8:1269400-1269430
  hypo

SEQ ID NO: 62157 - DNA, 42 bp, Homo sapiens; identical to SEQ ID NO: 41671
  chr8:1281668-1281710
  hypo

SEQ ID NO: 62158 - DNA, 142 bp, Homo sapiens; identical to SEQ ID NO: 41672
  chr8:1302672-1302814
  hypo

SEQ ID NO: 62159 - DNA, 30 bp, Homo sapiens; identical to SEQ ID NO: 41673
  chr8:1303386-1303416
  hypo

SEQ ID NO: 62160 - DNA, 30 bp, Homo sapiens; identical to SEQ ID NO: 41674
  chr8:1306844-1306874
  hypo

SEQ ID NO: 62161 - DNA, 30 bp, Homo sapiens; identical to SEQ ID NO: 41675
  chr8:1340176-1340206
  hypo

SEQ ID NO: 62162 - DNA, 30 bp, Homo sapiens; identical to SEQ ID NO: 41676
  chr8:1362767-1362797
  hypo

SEQ ID NO: 62163 - DNA, 49 bp, Homo sapiens; identical to SEQ ID NO: 41677
  chr8:1380107-1380156
  hypo

SEQ ID NO: 62164 - DNA, 150 bp, Homo sapiens; identical to SEQ ID NO: 41678
  chr8:1423699-1423849
  hypo

SEQ ID NO: 62165 - DNA, 30 bp, Homo sapiens; identical to SEQ ID NO: 41679
  chr8:1443699-1443729
  hypo

SEQ ID NO: 62166 - DNA, 101 bp, Homo sapiens; identical to SEQ ID NO: 41680
  chr8:1471545-1471646
  hypo

SEQ ID NO: 62167 - DNA, 74 bp, Homo sapiens; identical to SEQ ID NO: 41681
  chr8:1501600-1501674
  hypo

SEQ ID NO: 62168 - DNA, 156 bp, Homo sapiens; identical to SEQ ID NO: 41682
  chr8:1574846-1575002
  hypo

SEQ ID NO: 62169 - DNA, 30 bp, Homo sapiens; identical to SEQ ID NO: 41683
  chr8:1588688-1588718
  hypo

SEQ ID NO: 62170 - DNA, 69 bp, Homo sapiens; identical to SEQ ID NO: 41684
  chr8:1588920-1588989
  hypo

SEQ ID NO: 62171 - DNA, 30 bp, Homo sapiens; identical to SEQ ID NO: 41685
  chr8:1616193-1616223
  hypo

SEQ ID NO: 62172 - DNA, 38 bp, Homo sapiens; identical to SEQ ID NO: 41686
  chr8:1645305-1645343
  hypo

SEQ ID NO: 62173 - DNA, 76 bp, Homo sapiens; identical to SEQ ID NO: 41687
  chr8:1778994-1779070
  hypo

SEQ ID NO: 62174 - DNA, 30 bp, Homo sapiens; identical to SEQ ID NO: 41688
  chr8:2536020-2536050
  hypo

SEQ ID NO: 62175 - DNA, 56 bp, Homo sapiens; identical to SEQ ID NO: 41689
  chr8:2652772-2652828
  hypo

SEQ ID NO: 62176 - DNA, 37 bp, Homo sapiens; identical to SEQ ID NO: 41690
  chr8:3769062-3769099
  hypo

SEQ ID NO: 62177 - DNA, 24 bp, Homo sapiens
  chr8:5949419-5949443
  hypo
ggcaaactccgtcttttctatccg

SEQ ID NO: 62178 - DNA, 21 bp, Homo sapiens
  chr8:6063185-6063206
  hypo
ataagacgatgaacaaggatc

SEQ ID NO: 62179 - DNA, 196 bp, Homo sapiens; identical to SEQ ID NO: 41693
  chr8:6434295-6434491
  hypo

SEQ ID NO: 62180 - DNA, 30 bp, Homo sapiens; identical to SEQ ID NO: 41694
  chr8:6542607-6542637
  hypo

SEQ ID NO: 62181 - DNA, 30 bp, Homo sapiens; identical to SEQ ID NO: 41695
  chr8:6932550-6932580
  hypo

SEQ ID NO: 62182 - DNA, 360 bp, Homo sapiens; identical to SEQ ID NO: 41696
  chr8:8639451-8639811
  hypo

SEQ ID NO: 62183 - DNA, 45 bp, Homo sapiens
  chr8:8748377-8748422
  hypo
tgaggttgtggaagacgtgctccttgagagccggactgtcctcaa

SEQ ID NO: 62184 - DNA, 206 bp, Homo sapiens
  chr8:8748713-8748919
  hypo
gcagccggtggttgagcaggtattgaaaatgggccttgcgccgtcgaaggttcttgtccgaaacgccatagtaggctgcgtgggggctggcagagcgcagctcgaagtcccgggccagtgcctcgtccaccaccttggccaagcggctcagtccctccgcgtcgtgcttctcctgcagggcgatctggcggtgaatgtccagacat

SEQ ID NO: 62185 - DNA, 62 bp, Homo sapiens
  chr8:8748956-8749018
  hypo
gggtgcccacgatgcacaccaccgcgtggggcactctcgccccgacccgatgcaagaaggag

SEQ ID NO: 62186 - DNA, 30 bp, Homo sapiens; identical to SEQ ID NO: 41699
  chr8:8898369-8898399
  hypo

SEQ ID NO: 62187 - DNA, 30 bp, Homo sapiens; identical to SEQ ID NO: 41700
  chr8:8898687-8898717
  hypo

SEQ ID NO: 62188 - DNA, 115 bp, Homo sapiens; identical to SEQ ID NO: 41701
  chr8:10005445-10005560
  hypo

SEQ ID NO: 62189 - DNA, 32 bp, Homo sapiens; identical to SEQ ID NO: 41702
  chr8:10192893-10192925
  hypo

SEQ ID NO: 62190 - DNA, 30 bp, Homo sapiens; identical to SEQ ID NO: 41703
  chr8:10261847-10261877
  hypo

SEQ ID NO: 62191 - DNA, 142 bp, Homo sapiens; identical to SEQ ID NO: 41704
  chr8:10528983-10529125
  hypo

SEQ ID NO: 62192 - DNA, 56 bp, Homo sapiens; identical to SEQ ID NO: 41705
  chr8:10548206-10548262
  hypo

SEQ ID NO: 62193 - DNA, 30 bp, Homo sapiens; identical to SEQ ID NO: 41706
  chr8:11704567-11704597
  hypo

SEQ ID NO: 62194 - DNA, 43 bp, Homo sapiens
  chr8:11705917-11705960
  hypo
taccagaccaggctacgagtgcccttccgggtagaacactgat

SEQ ID NO: 62195 - DNA, 19 bp, Homo sapiens
  chr8:11706136-11706155
  hypo
aaggcgaggctgcaggcag

SEQ ID NO: 62196 - DNA, 37 bp, Homo sapiens; identical to SEQ ID NO: 41708
  chr8:11708426-11708463
  hypo

SEQ ID NO: 62197 - DNA, 149 bp, Homo sapiens; identical to SEQ ID NO: 41711
  chr8:12671777-12671926
  hypo

SEQ ID NO: 62198 - DNA, 86 bp, Homo sapiens; identical to SEQ ID NO: 41712
  chr8:12831656-12831742
  hypo

SEQ ID NO: 62199 - DNA, 89 bp, Homo sapiens; identical to SEQ ID NO: 41713
  chr8:12949930-12950019
  hypo

SEQ ID NO: 62200 - DNA, 108 bp, Homo sapiens; identical to SEQ ID NO: 41714
  chr8:12952416-12952524
  hypo

SEQ ID NO: 62201 - DNA, 90 bp, Homo sapiens; identical to SEQ ID NO: 41715
  chr8:12956998-12957088
  hypo

SEQ ID NO: 62202 - DNA, 20 bp, Homo sapiens
  chr8:13003493-13003513
  hypo
aatatactgtagggccgggc

SEQ ID NO: 62203 - DNA, 30 bp, Homo sapiens; identical to SEQ ID NO: 41718
  chr8:13654931-13654961
  hypo

SEQ ID NO: 62204 - DNA, 80 bp, Homo sapiens; identical to SEQ ID NO: 41719
  chr8:14898122-14898202
  hypo

SEQ ID NO: 62205 - DNA, 95 bp, Homo sapiens; identical to SEQ ID NO: 41720
  chr8:20317378-20317473
  hypo

SEQ ID NO: 62206 - DNA, 125 bp, Homo sapiens; identical to SEQ ID NO: 41721
  chr8:20431789-20431914
  hypo

SEQ ID NO: 62207 - DNA, 33 bp, Homo sapiens; identical to SEQ ID NO: 41722
  chr8:21302252-21302285
  hypo

SEQ ID NO: 62208 - DNA, 173 bp, Homo sapiens; identical to SEQ ID NO: 41723
  chr8:21393876-21394049
  hypo

SEQ ID NO: 62209 - DNA, 30 bp, Homo sapiens; identical to SEQ ID NO: 41724
  chr8:21563318-21563348
  hypo

SEQ ID NO: 62210 - DNA, 101 bp, Homo sapiens; identical to SEQ ID NO: 41725
  chr8:21608043-21608144
  hypo

SEQ ID NO: 62211 - DNA, 15 bp, Homo sapiens
  chr8:22101753-22101768
  hypo
cgaaattgtgatacg

SEQ ID NO: 62212 - DNA, 233 bp, Homo sapiens; identical to SEQ ID NO: 41727
  chr8:23290404-23290637
  hypo

SEQ ID NO: 62213 - DNA, 30 bp, Homo sapiens; identical to SEQ ID NO: 41728
  chr8:23331189-23331219
  hypo

SEQ ID NO: 62214 - DNA, 30 bp, Homo sapiens; identical to SEQ ID NO: 41729
  chr8:23340639-23340669
  hypo

SEQ ID NO: 62215 - DNA, 30 bp, Homo sapiens; identical to SEQ ID NO: 41730
  chr8:23380796-23380826
  hypo

SEQ ID NO: 62216 - DNA, 30 bp, Homo sapiens; identical to SEQ ID NO: 41731
  chr8:23395420-23395450
  hypo

SEQ ID NO: 62217 - DNA, 38 bp, Homo sapiens; identical to SEQ ID NO: 15103
  chr8:23399594-23399632
  hypo

SEQ ID NO: 62218 - DNA, 5 bp, Homo sapiens
  chr8:23423918-23423923
  hypo
tccct

SEQ ID NO: 62219 - DNA, 96 bp, Homo sapiens; identical to SEQ ID NO: 24435
  chr8:23423974-23424070
  hypo

SEQ ID NO: 62220 - DNA, 30 bp, Homo sapiens; identical to SEQ ID NO: 41734
  chr8:23430870-23430900
  hypo

SEQ ID NO: 62221 - DNA, 41 bp, Homo sapiens; identical to SEQ ID NO: 41735
  chr8:25318815-25318856
  hypo

SEQ ID NO: 62222 - DNA, 216 bp, Homo sapiens; identical to SEQ ID NO: 41736
  chr8:25397045-25397261
  hypo

SEQ ID NO: 62223 - DNA, 30 bp, Homo sapiens; identical to SEQ ID NO: 41737
  chr8:26267175-26267205
  hypo

SEQ ID NO: 62224 - DNA, 18 bp, Homo sapiens
  chr8:27914784-27914802
  hypo
tgctattgataaatacgg

SEQ ID NO: 62225 - DNA, 30 bp, Homo sapiens; identical to SEQ ID NO: 41739
  chr8:27931084-27931114
  hypo

SEQ ID NO: 62226 - DNA, 30 bp, Homo sapiens; identical to SEQ ID NO: 41740
  chr8:28938557-28938587
  hypo

SEQ ID NO: 62227 - DNA, 30 bp, Homo sapiens; identical to SEQ ID NO: 41741
  chr8:29157762-29157792
  hypo

SEQ ID NO: 62228 - DNA, 28 bp, Homo sapiens
  chr8:29596408-29596436
  hypo
tttttaggctgggcacggtagttcatgc

SEQ ID NO: 62229 - DNA, 28 bp, Homo sapiens
  chr8:29596676-29596704
  hypo
cagaacaagactccgtctcaaaaaaaaa

SEQ ID NO: 62230 - DNA, 148 bp, Homo sapiens; identical to SEQ ID NO: 41744
  chr8:32987430-32987578
  hypo

SEQ ID NO: 62231 - DNA, 30 bp, Homo sapiens; identical to SEQ ID NO: 41745
  chr8:37706125-37706155
  hypo

SEQ ID NO: 62232 - DNA, 30 bp, Homo sapiens; identical to SEQ ID NO: 41747
  chr8:38005823-38005853
  hypo

SEQ ID NO: 62233 - DNA, 31 bp, Homo sapiens; identical to SEQ ID NO: 41748
  chr8:38786050-38786081
  hypo

SEQ ID NO: 62234 - DNA, 148 bp, Homo sapiens; identical to SEQ ID NO: 41749
  chr8:41146864-41147012
  hypo

SEQ ID NO: 62235 - DNA, 30 bp, Homo sapiens; identical to SEQ ID NO: 41750
  chr8:41510183-41510213
  hypo

SEQ ID NO: 62236 - DNA, 82 bp, Homo sapiens; identical to SEQ ID NO: 41751
  chr8:41523651-41523733
  hypo

SEQ ID NO: 62237 - DNA, 137 bp, Homo sapiens; identical to SEQ ID NO: 41752
  chr8:41554224-41554361
  hypo

SEQ ID NO: 62238 - DNA, 61 bp, Homo sapiens; identical to SEQ ID NO: 41753
  chr8:41566351-41566412
  hypo

SEQ ID NO: 62239 - DNA, 52 bp, Homo sapiens; identical to SEQ ID NO: 41754
  chr8:41594902-41594954
  hypo

SEQ ID NO: 62240 - DNA, 64 bp, Homo sapiens; identical to SEQ ID NO: 41755
  chr8:41611241-41611305
  hypo

SEQ ID NO: 62241 - DNA, 53 bp, Homo sapiens; identical to SEQ ID NO: 41756
  chr8:41668167-41668220
  hypo

SEQ ID NO: 62242 - DNA, 30 bp, Homo sapiens; identical to SEQ ID NO: 41757
  chr8:41689306-41689336
  hypo

SEQ ID NO: 62243 - DNA, 33 bp, Homo sapiens; identical to SEQ ID NO: 41759
  chr8:42036407-42036440
  hypo

SEQ ID NO: 62244 - DNA, 127 bp, Homo sapiens; identical to SEQ ID NO: 41760
  chr8:42144632-42144759
  hypo

SEQ ID NO: 62245 - DNA, 23 bp, Homo sapiens
  chr8:42333901-42333924
  hypo
tgagccaccgtgcccggccggtt

SEQ ID NO: 62246 - DNA, 30 bp, Homo sapiens; identical to SEQ ID NO: 15108
  chr8:42699267-42699297
  hypo

SEQ ID NO: 62247 - DNA, 42 bp, Homo sapiens; identical to SEQ ID NO: 41764
  chr8:43401723-43401765
  hypo

SEQ ID NO: 62248 - DNA, 153 bp, Homo sapiens; identical to SEQ ID NO: 41765
  chr8:43416676-43416829
  hypo

SEQ ID NO: 62249 - DNA, 30 bp, Homo sapiens; identical to SEQ ID NO: 41766
  chr8:47016307-47016337
  hypo

SEQ ID NO: 62250 - DNA, 124 bp, Homo sapiens; identical to SEQ ID NO: 41767
  chr8:47093290-47093414
  hypo

SEQ ID NO: 62251 - DNA, 183 bp, Homo sapiens; identical to SEQ ID NO: 41768
  chr8:47155037-47155220
  hypo

SEQ ID NO: 62252 - DNA, 108 bp, Homo sapiens; identical to SEQ ID NO: 41769
  chr8:47334490-47334598
  hypo

SEQ ID NO: 62253 - DNA, 30 bp, Homo sapiens; identical to SEQ ID NO: 41770
  chr8:47355877-47355907
  hypo

SEQ ID NO: 62254 - DNA, 37 bp, Homo sapiens; identical to SEQ ID NO: 41771
  chr8:48045032-48045069
  hypo

SEQ ID NO: 62255 - DNA, 168 bp, Homo sapiens; identical to SEQ ID NO: 15113
  chr8:48294168-48294336
  hypo

SEQ ID NO: 62256 - DNA, 30 bp, Homo sapiens; identical to SEQ ID NO: 41773
  chr8:48676823-48676853
  hypo

SEQ ID NO: 62257 - DNA, 45 bp, Homo sapiens; identical to SEQ ID NO: 41774
  chr8:48796372-48796417
  hypo

SEQ ID NO: 62258 - DNA, 251 bp, Homo sapiens; identical to SEQ ID NO: 41775
  chr8:49334991-49335242
  hypo

SEQ ID NO: 62259 - DNA, 45 bp, Homo sapiens; identical to SEQ ID NO: 41776
  chr8:49496375-49496420
  hypo

SEQ ID NO: 62260 - DNA, 59 bp, Homo sapiens; identical to SEQ ID NO: 41777
  chr8:49572124-49572183
  hypo

SEQ ID NO: 62261 - DNA, 267 bp, Homo sapiens; identical to SEQ ID NO: 41778
  chr8:49608941-49609208
  hypo

SEQ ID NO: 62262 - DNA, 30 bp, Homo sapiens; identical to SEQ ID NO: 41779
  chr8:49773216-49773246
  hypo

SEQ ID NO: 62263 - DNA, 137 bp, Homo sapiens; identical to SEQ ID NO: 41780
  chr8:49808681-49808818
  hypo

SEQ ID NO: 62264 - DNA, 192 bp, Homo sapiens
  chr8:49959260-49959452
  hypo
ggagtcgctgtactgtattcacggctcttgttatatgatttatgctggcattatctaaactgagaagcggacaatcctttattcaaaggcgagctccctctattttgtgttgccgctcatggagtcctaaggtcggagccccataggagctgccagcagagtcccaatggaggtgagcggctcatttcagct

SEQ ID NO: 62265 - DNA, 120 bp, Homo sapiens; identical to SEQ ID NO: 41782
  chr8:50015598-50015718
  hypo

SEQ ID NO: 62266 - DNA, 156 bp, Homo sapiens; identical to SEQ ID NO: 41783
  chr8:50314445-50314601
  hypo

SEQ ID NO: 62267 - DNA, 58 bp, Homo sapiens; identical to SEQ ID NO: 41784
  chr8:50377787-50377845
  hypo

SEQ ID NO: 62268 - DNA, 34 bp, Homo sapiens; identical to SEQ ID NO: 15119
  chr8:52432891-52432925
  hypo

SEQ ID NO: 62269 - DNA, 97 bp, Homo sapiens; identical to SEQ ID NO: 41786
  chr8:53352314-53352411
  hypo

SEQ ID NO: 62270 - DNA, 30 bp, Homo sapiens; identical to SEQ ID NO: 41787
  chr8:53805607-53805637
  hypo

SEQ ID NO: 62271 - DNA, 40 bp, Homo sapiens; identical to SEQ ID NO: 41788
  chr8:55191496-55191536
  hypo

SEQ ID NO: 62272 - DNA, 30 bp, Homo sapiens; identical to SEQ ID NO: 41789
  chr8:55285908-55285938
  hypo

SEQ ID NO: 62273 - DNA, 30 bp, Homo sapiens; identical to SEQ ID NO: 15120
  chr8:55689465-55689495
  hypo

SEQ ID NO: 62274 - DNA, 32 bp, Homo sapiens; identical to SEQ ID NO: 41791
  chr8:55787831-55787863
  hypo

SEQ ID NO: 62275 - DNA, 30 bp, Homo sapiens; identical to SEQ ID NO: 41792
  chr8:56362016-56362046
  hypo

SEQ ID NO: 62276 - DNA, 78 bp, Homo sapiens; identical to SEQ ID NO: 41793
  chr8:56364255-56364333
  hypo

SEQ ID NO: 62277 - DNA, 95 bp, Homo sapiens; identical to SEQ ID NO: 41794
  chr8:56539998-56540093
  hypo

SEQ ID NO: 62278 - DNA, 27 bp, Homo sapiens
  chr8:56688545-56688572
  hypo
ctaaatcccttggatcgattgactgta

SEQ ID NO: 62279 - DNA, 30 bp, Homo sapiens; identical to SEQ ID NO: 41796
  chr8:56883198-56883228
  hypo

SEQ ID NO: 62280 - DNA, 78 bp, Homo sapiens; identical to SEQ ID NO: 41797
  chr8:56929748-56929826
  hypo

SEQ ID NO: 62281 - DNA, 39 bp, Homo sapiens; identical to SEQ ID NO: 41798
  chr8:57566358-57566397
  hypo

SEQ ID NO: 62282 - DNA, 30 bp, Homo sapiens; identical to SEQ ID NO: 41799
  chr8:57995953-57995983
  hypo

SEQ ID NO: 62283 - DNA, 65 bp, Homo sapiens
  chr8:58106115-58106180
  hypo
gggcagctggttgaggtgcgcatgcgcactggcacctaacggctcttcttcgagtcttctcagag

SEQ ID NO: 62284 - DNA, 35 bp, Homo sapiens; identical to SEQ ID NO: 41801
  chr8:58106674-58106709
  hypo

SEQ ID NO: 62285 - DNA, 54 bp, Homo sapiens; identical to SEQ ID NO: 24452
  chr8:58116950-58117004
  hypo

SEQ ID NO: 62286 - DNA, 63 bp, Homo sapiens; identical to SEQ ID NO: 24453
  chr8:58130301-58130364
  hypo

SEQ ID NO: 62287 - DNA, 241 bp, Homo sapiens
  chr8:58130574-58130815
  hypo
ctcagtgttgctggtggcaagagtgtggtacgagagtggttgggcgtggtttgaatatctagaaaaggcgagctgagggtagatttttgaacagtccggagtaggaggggtagagacatattctatgggccacagccacattctcaggatgctcgtggctgtaaatagtagatgacccaagtaagagcggctgaagccataggcaccagaattgtgttggcatcgtcgtgtcacgctcacg

SEQ ID NO: 62288 - DNA, 38 bp, Homo sapiens; identical to SEQ ID NO: 41804
  chr8:58716351-58716389
  hypo

SEQ ID NO: 62289 - DNA, 30 bp, Homo sapiens; identical to SEQ ID NO: 41806
  chr8:61272270-61272300
  hypo

SEQ ID NO: 62290 - DNA, 30 bp, Homo sapiens; identical to SEQ ID NO: 41807
  chr8:61777517-61777547
  hypo

SEQ ID NO: 62291 - DNA, 97 bp, Homo sapiens
  chr8:61789877-61789974
  hypo
tggtcgcaataatgacgacgaggcggatggcggcggggaggctagagcccatttcagaagcctgcagtgaggattccaccagttcacatgcatcggg

SEQ ID NO: 62292 - DNA, 30 bp, Homo sapiens; identical to SEQ ID NO: 41809
  chr8:63056935-63056965
  hypo

SEQ ID NO: 62293 - DNA, 37 bp, Homo sapiens; identical to SEQ ID NO: 41810
  chr8:64023507-64023544
  hypo

SEQ ID NO: 62294 - DNA, 22 bp, Homo sapiens
  chr8:64511304-64511326
  hypo
aatagaacgaagaaaggaggac

SEQ ID NO: 62295 - DNA, 23 bp, Homo sapiens
  chr8:65385213-65385236
  hypo
cgagactccgtctcaaaaaaaaa

SEQ ID NO: 62296 - DNA, 30 bp, Homo sapiens; identical to SEQ ID NO: 41813
  chr8:65519445-65519475
  hypo

SEQ ID NO: 62297 - DNA, 90 bp, Homo sapiens; identical to SEQ ID NO: 15127
  chr8:65749819-65749909
  hypo

SEQ ID NO: 62298 - DNA, 33 bp, Homo sapiens; identical to SEQ ID NO: 41815
  chr8:66055590-66055623
  hypo

SEQ ID NO: 62299 - DNA, 162 bp, Homo sapiens; identical to SEQ ID NO: 41818
  chr8:67117765-67117927
  hypo

SEQ ID NO: 62300 - DNA, 68 bp, Homo sapiens; identical to SEQ ID NO: 41819
  chr8:68347722-68347790
  hypo

SEQ ID NO: 62301 - DNA, 260 bp, Homo sapiens; identical to SEQ ID NO: 41820
  chr8:71017232-71017492
  hypo

SEQ ID NO: 62302 - DNA, 213 bp, Homo sapiens; identical to SEQ ID NO: 41821
  chr8:71368455-71368668
  hypo

SEQ ID NO: 62303 - DNA, 43 bp, Homo sapiens; identical to SEQ ID NO: 41822
  chr8:74086196-74086239
  hypo

SEQ ID NO: 62304 - DNA, 32 bp, Homo sapiens; identical to SEQ ID NO: 15130
  chr8:74332813-74332845
  hypo

SEQ ID NO: 62305 - DNA, 30 bp, Homo sapiens; identical to SEQ ID NO: 41824
  chr8:74674435-74674465
  hypo

SEQ ID NO: 62306 - DNA, 48 bp, Homo sapiens
  chr8:74759463-74759511
  hypo
caccataatggctaataaaaacaggaaaagaaacgcaacctcactggt

SEQ ID NO: 62307 - DNA, 145 bp, Homo sapiens; identical to SEQ ID NO: 41827
  chr8:78532944-78533089
  hypo

SEQ ID NO: 62308 - DNA, 162 bp, Homo sapiens; identical to SEQ ID NO: 41828
  chr8:80483857-80484019
  hypo

SEQ ID NO: 62309 - DNA, 22 bp, Homo sapiens
  chr8:82903036-82903058
  hypo
tggcagacgctcctccctcagc

SEQ ID NO: 62310 - DNA, 30 bp, Homo sapiens; identical to SEQ ID NO: 41830
  chr8:83282016-83282046
  hypo

SEQ ID NO: 62311 - DNA, 114 bp, Homo sapiens; identical to SEQ ID NO: 41831
  chr8:86370822-86370936
  hypo

SEQ ID NO: 62312 - DNA, 30 bp, Homo sapiens; identical to SEQ ID NO: 41832
  chr8:86389645-86389675
  hypo

SEQ ID NO: 62313 - DNA, 40 bp, Homo sapiens; identical to SEQ ID NO: 41833
  chr8:86405563-86405603
  hypo

SEQ ID NO: 62314 - DNA, 26 bp, Homo sapiens
  chr8:86417676-86417702
  hypo
agaatcacaagcgtgagccactgtgc

SEQ ID NO: 62315 - DNA, 7 bp, Homo sapiens
  chr8:86436651-86436658
  hypo
cctgtgg

SEQ ID NO: 62316 - DNA, 30 bp, Homo sapiens; identical to SEQ ID NO: 41837
  chr8:86849611-86849641
  hypo

SEQ ID NO: 62317 - DNA, 19 bp, Homo sapiens
  chr8:86926063-86926082
  hypo
accacgcctggctaatttt

SEQ ID NO: 62318 - DNA, 498 bp, Homo sapiens; identical to SEQ ID NO: 41839
  chr8:88885698-88886196
  hypo

SEQ ID NO: 62319 - DNA, 17 bp, Homo sapiens
  chr8:89830498-89830515
  hypo
gccggaaaacatatgtc

SEQ ID NO: 62320 - DNA, 36 bp, Homo sapiens; identical to SEQ ID NO: 41841
  chr8:90768546-90768582
  hypo

SEQ ID NO: 62321 - DNA, 35 bp, Homo sapiens; identical to SEQ ID NO: 41842
  chr8:90768822-90768857
  hypo

SEQ ID NO: 62322 - DNA, 30 bp, Homo sapiens; identical to SEQ ID NO: 15135
  chr8:91130098-91130128
  hypo

SEQ ID NO: 62323 - DNA, 22 bp, Homo sapiens
  chr8:91163928-91163950
  hypo
gtaatccctgcacttcggcagg

SEQ ID NO: 62324 - DNA, 195 bp, Homo sapiens; identical to SEQ ID NO: 41846
  chr8:91865364-91865559
  hypo

SEQ ID NO: 62325 - DNA, 30 bp, Homo sapiens; identical to SEQ ID NO: 41848
  chr8:93449207-93449237
  hypo

SEQ ID NO: 62326 - DNA, 226 bp, Homo sapiens; identical to SEQ ID NO: 41849
  chr8:93848232-93848458
  hypo

SEQ ID NO: 62327 - DNA, 174 bp, Homo sapiens; identical to SEQ ID NO: 41850
  chr8:95211968-95212142
  hypo

SEQ ID NO: 62328 - DNA, 77 bp, Homo sapiens; identical to SEQ ID NO: 15137
  chr8:95416054-95416131
  hypo

SEQ ID NO: 62329 - DNA, 30 bp, Homo sapiens; identical to SEQ ID NO: 41852
  chr8:95622883-95622913
  hypo

SEQ ID NO: 62330 - DNA, 25 bp, Homo sapiens
  chr8:95816428-95816453
  hypo
tcaaaaaattaaatgcgggccgggc

SEQ ID NO: 62331 - DNA, 28 bp, Homo sapiens
  chr8:95837639-95837667
  hypo
atagagtaagactcggaaaaaaaaaaaa

SEQ ID NO: 62332 - DNA, 30 bp, Homo sapiens; identical to SEQ ID NO: 41855
  chr8:95904181-95904211
  hypo

SEQ ID NO: 62333 - DNA, 172 bp, Homo sapiens; identical to SEQ ID NO: 41856
  chr8:96208663-96208835
  hypo

SEQ ID NO: 62334 - DNA, 30 bp, Homo sapiens; identical to SEQ ID NO: 41857
  chr8:97039387-97039417
  hypo

SEQ ID NO: 62335 - DNA, 23 bp, Homo sapiens
  chr8:97272415-97272438
  hypo
actgcgctcggcccattctgcga

SEQ ID NO: 62336 - DNA, 6 bp, Homo sapiens
  chr8:97339840-97339846
  hypo
ggcctg

SEQ ID NO: 62337 - DNA, 7 bp, Homo sapiens
  chr8:97340195-97340202
  hypo
gggacaa

SEQ ID NO: 62338 - DNA, 37 bp, Homo sapiens; identical to SEQ ID NO: 41860
  chr8:97977869-97977906
  hypo

SEQ ID NO: 62339 - DNA, 30 bp, Homo sapiens; identical to SEQ ID NO: 41861
  chr8:97982654-97982684
  hypo

SEQ ID NO: 62340 - DNA, 39 bp, Homo sapiens; identical to SEQ ID NO: 41862
  chr8:98404793-98404832
  hypo

SEQ ID NO: 62341 - DNA, 30 bp, Homo sapiens; identical to SEQ ID NO: 15140
  chr8:98738336-98738366
  hypo

SEQ ID NO: 62342 - DNA, 22 bp, Homo sapiens
  chr8:98748478-98748500
  hypo
gactgggcgacggagggagact

SEQ ID NO: 62343 - DNA, 79 bp, Homo sapiens; identical to SEQ ID NO: 41865
  chr8:99130932-99131011
  hypo

SEQ ID NO: 62344 - DNA, 95 bp, Homo sapiens; identical to SEQ ID NO: 41866
  chr8:100026644-100026739
  hypo

SEQ ID NO: 62345 - DNA, 36 bp, Homo sapiens; identical to SEQ ID NO: 41867
  chr8:100245127-100245163
  hypo

SEQ ID NO: 62346 - DNA, 32 bp, Homo sapiens; identical to SEQ ID NO: 41868
  chr8:100359795-100359827
  hypo

SEQ ID NO: 62347 - DNA, 103 bp, Homo sapiens; identical to SEQ ID NO: 41869
  chr8:100904181-100904284
  hypo

SEQ ID NO: 62348 - DNA, 216 bp, Homo sapiens; identical to SEQ ID NO: 41870
  chr8:100906569-100906785
  hypo

SEQ ID NO: 62349 - DNA, 150 bp, Homo sapiens; identical to SEQ ID NO: 41871
  chr8:101156747-101156897
  hypo

SEQ ID NO: 62350 - DNA, 23 bp, Homo sapiens
  chr8:101241341-101241364
  hypo
aatgaggaagtaggccgggcgtg

SEQ ID NO: 62351 - DNA, 30 bp, Homo sapiens; identical to SEQ ID NO: 41873
  chr8:101299821-101299851
  hypo

SEQ ID NO: 62352 - DNA, 30 bp, Homo sapiens; identical to SEQ ID NO: 41874
  chr8:101438141-101438171
  hypo

SEQ ID NO: 62353 - DNA, 78 bp, Homo sapiens; identical to SEQ ID NO: 41875
  chr8:101693784-101693862
  hypo

SEQ ID NO: 62354 - DNA, 30 bp, Homo sapiens; identical to SEQ ID NO: 41876
  chr8:101717092-101717122
  hypo

SEQ ID NO: 62355 - DNA, 42 bp, Homo sapiens; identical to SEQ ID NO: 41877
  chr8:101729504-101729546
  hypo

SEQ ID NO: 62356 - DNA, 40 bp, Homo sapiens; identical to SEQ ID NO: 41878
  chr8:101872226-101872266
  hypo

SEQ ID NO: 62357 - DNA, 51 bp, Homo sapiens; identical to SEQ ID NO: 41879
  chr8:102039492-102039543
  hypo

SEQ ID NO: 62358 - DNA, 213 bp, Homo sapiens; identical to SEQ ID NO: 41880
  chr8:102155655-102155868
  hypo

SEQ ID NO: 62359 - DNA, 30 bp, Homo sapiens; identical to SEQ ID NO: 41881
  chr8:103403324-103403354
  hypo

SEQ ID NO: 62360 - DNA, 20 bp, Homo sapiens
  chr8:104235237-104235257
  hypo
tttaaaactttttggcgggc

SEQ ID NO: 62361 - DNA, 165 bp, Homo sapiens; identical to SEQ ID NO: 41884
  chr8:104382635-104382800
  hypo

SEQ ID NO: 62362 - DNA, 23 bp, Homo sapiens
  chr8:104488605-104488628
  hypo
actgcgcccggcccataatatat

SEQ ID NO: 62363 - DNA, 30 bp, Homo sapiens; identical to SEQ ID NO: 41886
  chr8:105386063-105386093
  hypo

SEQ ID NO: 62364 - DNA, 30 bp, Homo sapiens; identical to SEQ ID NO: 41887
  chr8:105456591-105456621
  hypo

SEQ ID NO: 62365 - DNA, 20 bp, Homo sapiens
  chr8:105645632-105645652
  hypo
gcgagcgagggctgttggca

SEQ ID NO: 62366 - DNA, 30 bp, Homo sapiens; identical to SEQ ID NO: 41889
  chr8:106433918-106433948
  hypo

SEQ ID NO: 62367 - DNA, 30 bp, Homo sapiens; identical to SEQ ID NO: 15145
  chr8:106500552-106500582
  hypo

SEQ ID NO: 62368 - DNA, 16 bp, Homo sapiens
  chr8:106706503-106706519
  hypo
gcgcccagcctctcca

SEQ ID NO: 62369 - DNA, 30 bp, Homo sapiens; identical to SEQ ID NO: 41892
  chr8:107359293-107359323
  hypo

SEQ ID NO: 62370 - DNA, 185 bp, Homo sapiens; identical to SEQ ID NO: 41893
  chr8:107531614-107531799
  hypo

SEQ ID NO: 62371 - DNA, 150 bp, Homo sapiens; identical to SEQ ID NO: 41894
  chr8:108134676-108134826
  hypo

SEQ ID NO: 62372 - DNA, 77 bp, Homo sapiens; identical to SEQ ID NO: 41895
  chr8:108582504-108582581
  hypo

SEQ ID NO: 62373 - DNA, 17 bp, Homo sapiens
  chr8:108582641-108582658
  hypo
ggcggagaaaatattac

SEQ ID NO: 62374 - DNA, 30 bp, Homo sapiens; identical to SEQ ID NO: 41897
  chr8:108588091-108588121
  hypo

SEQ ID NO: 62375 - DNA, 41 bp, Homo sapiens; identical to SEQ ID NO: 41898
  chr8:108593714-108593755
  hypo

SEQ ID NO: 62376 - DNA, 30 bp, Homo sapiens; identical to SEQ ID NO: 41899
  chr8:108601942-108601972
  hypo

SEQ ID NO: 62377 - DNA, 30 bp, Homo sapiens; identical to SEQ ID NO: 41900
  chr8:108957755-108957785
  hypo

SEQ ID NO: 62378 - DNA, 16 bp, Homo sapiens
  chr8:110274990-110275006
  hypo
aaacctgaatgtggcc

SEQ ID NO: 62379 - DNA, 171 bp, Homo sapiens; identical to SEQ ID NO: 15148
  chr8:110548417-110548588
  hypo

SEQ ID NO: 62380 - DNA, 30 bp, Homo sapiens; identical to SEQ ID NO: 15149
  chr8:110961977-110962007
  hypo

SEQ ID NO: 62381 - DNA, 30 bp, Homo sapiens; identical to SEQ ID NO: 41905
  chr8:111586661-111586691
  hypo

SEQ ID NO: 62382 - DNA, 34 bp, Homo sapiens; identical to SEQ ID NO: 41906
  chr8:112636593-112636627
  hypo

SEQ ID NO: 62383 - DNA, 30 bp, Homo sapiens; identical to SEQ ID NO: 41907
  chr8:113146243-113146273
  hypo

SEQ ID NO: 62384 - DNA, 191 bp, Homo sapiens; identical to SEQ ID NO: 41908
  chr8:113175066-113175257
  hypo

SEQ ID NO: 62385 - DNA, 38 bp, Homo sapiens; identical to SEQ ID NO: 41909
  chr8:113221643-113221681
  hypo

SEQ ID NO: 62386 - DNA, 30 bp, Homo sapiens; identical to SEQ ID NO: 41910
  chr8:115649508-115649538
  hypo

SEQ ID NO: 62387 - DNA, 170 bp, Homo sapiens; identical to SEQ ID NO: 41911
  chr8:116710279-116710449
  hypo

SEQ ID NO: 62388 - DNA, 30 bp, Homo sapiens; identical to SEQ ID NO: 15150
  chr8:117824014-117824044
  hypo

SEQ ID NO: 62389 - DNA, 16 bp, Homo sapiens
  chr8:120695441-120695457
  hypo
gcgcccagcctttata

SEQ ID NO: 62390 - DNA, 38 bp, Homo sapiens; identical to SEQ ID NO: 15151
  chr8:121206396-121206434
  hypo

SEQ ID NO: 62391 - DNA, 30 bp, Homo sapiens; identical to SEQ ID NO: 41916
  chr8:121354745-121354775
  hypo

SEQ ID NO: 62392 - DNA, 30 bp, Homo sapiens; identical to SEQ ID NO: 41917
  chr8:121566445-121566475
  hypo

SEQ ID NO: 62393 - DNA, 30 bp, Homo sapiens; identical to SEQ ID NO: 41918
  chr8:121573169-121573199
  hypo

SEQ ID NO: 62394 - DNA, 75 bp, Homo sapiens; identical to SEQ ID NO: 41919
  chr8:121712263-121712338
  hypo

SEQ ID NO: 62395 - DNA, 183 bp, Homo sapiens; identical to SEQ ID NO: 41920
  chr8:121732132-121732315
  hypo

SEQ ID NO: 62396 - DNA, 89 bp, Homo sapiens; identical to SEQ ID NO: 41921
  chr8:121825686-121825775
  hypo

SEQ ID NO: 62397 - DNA, 144 bp, Homo sapiens; identical to SEQ ID NO: 41922
  chr8:121982491-121982635
  hypo

SEQ ID NO: 62398 - DNA, 43 bp, Homo sapiens
  chr8:123695489-123695532
  hypo
gagaaatttaaagggcgagagatggcggcaggccagttgcgcc

SEQ ID NO: 62399 - DNA, 39 bp, Homo sapiens
  chr8:123695660-123695699
  hypo
ggtgagggagaagcagtggaggaacggtcagaagagatg

SEQ ID NO: 62400 - DNA, 347 bp, Homo sapiens; identical to SEQ ID NO: 41924
  chr8:123966045-123966392
  hypo

SEQ ID NO: 62401 - DNA, 105 bp, Homo sapiens; identical to SEQ ID NO: 41925
  chr8:124055130-124055235
  hypo

SEQ ID NO: 62402 - DNA, 45 bp, Homo sapiens; identical to SEQ ID NO: 41926
  chr8:124055535-124055580
  hypo

SEQ ID NO: 62403 - DNA, 17 bp, Homo sapiens
  chr8:124288888-124288905
  hypo
gccgatgactaggtttt

SEQ ID NO: 62404 - DNA, 20 bp, Homo sapiens
  chr8:124428122-124428142
  hypo
gcacccggccctaaacacta

SEQ ID NO: 62405 - DNA, 64 bp, Homo sapiens
  chr8:125452302-125452366
  hypo
tgccaaacacactcacgcacctgactatcctgtcagtaagggattgttttttggtgtttgtttg

SEQ ID NO: 62406 - DNA, 36 bp, Homo sapiens; identical to SEQ ID NO: 41930
  chr8:125452639-125452675
  hypo

SEQ ID NO: 62407 - DNA, 30 bp, Homo sapiens; identical to SEQ ID NO: 41931
  chr8:125568984-125569014
  hypo

SEQ ID NO: 62408 - DNA, 121 bp, Homo sapiens; identical to SEQ ID NO: 41932
  chr8:126267003-126267124
  hypo

SEQ ID NO: 62409 - DNA, 30 bp, Homo sapiens; identical to SEQ ID NO: 41933
  chr8:126284175-126284205
  hypo

SEQ ID NO: 62410 - DNA, 97 bp, Homo sapiens; identical to SEQ ID NO: 15154
  chr8:127305217-127305314
  hypo

SEQ ID NO: 62411 - DNA, 39 bp, Homo sapiens; identical to SEQ ID NO: 41936
  chr8:128864120-128864159
  hypo

SEQ ID NO: 62412 - DNA, 63 bp, Homo sapiens
  chr8:128872322-128872385
  hypo
cagggctaccaggaacggtgtgtgtgcctctgggcagggccacttcctagaaccatggggctg

SEQ ID NO: 62413 - DNA, 24 bp, Homo sapiens
  chr8:128872415-128872439
  hypo
tccaggagacgaggagcaggtcct

SEQ ID NO: 62414 - DNA, 265 bp, Homo sapiens; identical to SEQ ID NO: 41938
  chr8:128888983-128889248
  hypo

SEQ ID NO: 62415 - DNA, 35 bp, Homo sapiens; identical to SEQ ID NO: 41940
  chr8:128962506-128962541
  hypo

SEQ ID NO: 62416 - DNA, 202 bp, Homo sapiens; identical to SEQ ID NO: 41941
  chr8:129069803-129070005
  hypo

SEQ ID NO: 62417 - DNA, 30 bp, Homo sapiens; identical to SEQ ID NO: 41942
  chr8:130080387-130080417
  hypo

SEQ ID NO: 62418 - DNA, 30 bp, Homo sapiens; identical to SEQ ID NO: 15159
  chr8:130116433-130116463
  hypo

SEQ ID NO: 62419 - DNA, 203 bp, Homo sapiens; identical to SEQ ID NO: 41944
  chr8:130288699-130288902
  hypo

SEQ ID NO: 62420 - DNA, 209 bp, Homo sapiens; identical to SEQ ID NO: 41945
  chr8:130368840-130369049
  hypo

SEQ ID NO: 62421 - DNA, 14 bp, Homo sapiens
  chr8:130369364-130369378
  hypo
gaccctgagaagtt

SEQ ID NO: 62422 - DNA, 31 bp, Homo sapiens; identical to SEQ ID NO: 41947
  chr8:130461175-130461206
  hypo

SEQ ID NO: 62423 - DNA, 201 bp, Homo sapiens; identical to SEQ ID NO: 41948
  chr8:130583277-130583478
  hypo

SEQ ID NO: 62424 - DNA, 23 bp, Homo sapiens
  chr8:131922190-131922213
  hypo
tttttttttttgagacggagttt

SEQ ID NO: 62425 - DNA, 30 bp, Homo sapiens; identical to SEQ ID NO: 41950
  chr8:132284091-132284121
  hypo

SEQ ID NO: 62426 - DNA, 30 bp, Homo sapiens; identical to SEQ ID NO: 41951
  chr8:132783128-132783158
  hypo

SEQ ID NO: 62427 - DNA, 36 bp, Homo sapiens; identical to SEQ ID NO: 41952
  chr8:133062829-133062865
  hypo

SEQ ID NO: 62428 - DNA, 132 bp, Homo sapiens; identical to SEQ ID NO: 15163
  chr8:133811037-133811169
  hypo

SEQ ID NO: 62429 - DNA, 179 bp, Homo sapiens; identical to SEQ ID NO: 41955
  chr8:134470121-134470300
  hypo

SEQ ID NO: 62430 - DNA, 45 bp, Homo sapiens; identical to SEQ ID NO: 41956
  chr8:134541589-134541634
  hypo

SEQ ID NO: 62431 - DNA, 34 bp, Homo sapiens; identical to SEQ ID NO: 41957
  chr8:135301251-135301285
  hypo

SEQ ID NO: 62432 - DNA, 154 bp, Homo sapiens; identical to SEQ ID NO: 41958
  chr8:138910227-138910381
  hypo

SEQ ID NO: 62433 - DNA, 30 bp, Homo sapiens; identical to SEQ ID NO: 41959
  chr8:140630956-140630986
  hypo

SEQ ID NO: 62434 - DNA, 37 bp, Homo sapiens; identical to SEQ ID NO: 41960
  chr8:140691457-140691494
  hypo

SEQ ID NO: 62435 - DNA, 89 bp, Homo sapiens; identical to SEQ ID NO: 24485
  chr8:140834148-140834237
  hypo

SEQ ID NO: 62436 - DNA, 130 bp, Homo sapiens; identical to SEQ ID NO: 41962
  chr8:140834841-140834971
  hypo

SEQ ID NO: 62437 - DNA, 30 bp, Homo sapiens; identical to SEQ ID NO: 41964
  chr8:141018127-141018157
  hypo

SEQ ID NO: 62438 - DNA, 30 bp, Homo sapiens; identical to SEQ ID NO: 41965
  chr8:141054547-141054577
  hypo

SEQ ID NO: 62439 - DNA, 41 bp, Homo sapiens; identical to SEQ ID NO: 41966
  chr8:141106960-141107001
  hypo

SEQ ID NO: 62440 - DNA, 133 bp, Homo sapiens; identical to SEQ ID NO: 41967
  chr8:141107540-141107673
  hypo

SEQ ID NO: 62441 - DNA, 218 bp, Homo sapiens; identical to SEQ ID NO: 41969
  chr8:141202517-141202735
  hypo

SEQ ID NO: 62442 - DNA, 30 bp, Homo sapiens; identical to SEQ ID NO: 41970
  chr8:141249579-141249609
  hypo

SEQ ID NO: 62443 - DNA, 196 bp, Homo sapiens; identical to SEQ ID NO: 41971
  chr8:141466557-141466753
  hypo

SEQ ID NO: 62444 - DNA, 30 bp, Homo sapiens; identical to SEQ ID NO: 41972
  chr8:141566854-141566884
  hypo

SEQ ID NO: 62445 - DNA, 47 bp, Homo sapiens
  chr8:141588132-141588179
  hypo
cagacaatcctggccaccactcaggcctccgccgcccagagagagca

SEQ ID NO: 62446 - DNA, 30 bp, Homo sapiens; identical to SEQ ID NO: 41974
  chr8:141594857-141594887
  hypo

SEQ ID NO: 62447 - DNA, 67 bp, Homo sapiens
  chr8:141596819-141596886
  hypo
ctctctacgccacaccggagtagaacaaagcacttgccaacacgtggccctgttctcaggtggctcc

SEQ ID NO: 62448 - DNA, 75 bp, Homo sapiens
  chr8:141597022-141597097
  hypo
tacaaggtgctcatgcagttacttaaccgagcctcacaaccataccacaaaggggcacaccgctggctgcaagaa

SEQ ID NO: 62449 - DNA, 30 bp, Homo sapiens; identical to SEQ ID NO: 41976
  chr8:141600227-141600257
  hypo

SEQ ID NO: 62450 - DNA, 30 bp, Homo sapiens; identical to SEQ ID NO: 41977
  chr8:141602372-141602402
  hypo

SEQ ID NO: 62451 - DNA, 35 bp, Homo sapiens; identical to SEQ ID NO: 41978
  chr8:141624396-141624431
  hypo

SEQ ID NO: 62452 - DNA, 30 bp, Homo sapiens; identical to SEQ ID NO: 41979
  chr8:142231672-142231702
  hypo

SEQ ID NO: 62453 - DNA, 30 bp, Homo sapiens; identical to SEQ ID NO: 41980
  chr8:142243948-142243978
  hypo

SEQ ID NO: 62454 - DNA, 30 bp, Homo sapiens; identical to SEQ ID NO: 41981
  chr8:142244184-142244214
  hypo

SEQ ID NO: 62455 - DNA, 22 bp, Homo sapiens
  chr8:142313512-142313534
  hypo
gcaggaacgagcctctgtgccc

SEQ ID NO: 62456 - DNA, 30 bp, Homo sapiens; identical to SEQ ID NO: 41984
  chr8:142323052-142323082
  hypo

SEQ ID NO: 62457 - DNA, 34 bp, Homo sapiens
  chr8:142367790-142367824
  hypo
aagacgtacagcgccagcccgttgagcaccagcc

SEQ ID NO: 62458 - DNA, 72 bp, Homo sapiens; identical to SEQ ID NO: 41986
  chr8:142432225-142432297
  hypo

SEQ ID NO: 62459 - DNA, 30 bp, Homo sapiens; identical to SEQ ID NO: 41987
  chr8:142439319-142439349
  hypo

SEQ ID NO: 62460 - DNA, 42 bp, Homo sapiens; identical to SEQ ID NO: 41988
  chr8:142452256-142452298
  hypo

SEQ ID NO: 62461 - DNA, 30 bp, Homo sapiens; identical to SEQ ID NO: 41989
  chr8:142501450-142501480
  hypo

SEQ ID NO: 62462 - DNA, 15 bp, Homo sapiens
  chr8:142535328-142535343
  hypo
gagagagggtcagga

SEQ ID NO: 62463 - DNA, 11 bp, Homo sapiens
  chr8:142535496-142535507
  hypo
gacctgcctgc

SEQ ID NO: 62464 - DNA, 144 bp, Homo sapiens; identical to SEQ ID NO: 41991
  chr8:142553829-142553973
  hypo

SEQ ID NO: 62465 - DNA, 37 bp, Homo sapiens; identical to SEQ ID NO: 41992
  chr8:142560165-142560202
  hypo

SEQ ID NO: 62466 - DNA, 124 bp, Homo sapiens; identical to SEQ ID NO: 41994
  chr8:142583056-142583180
  hypo

SEQ ID NO: 62467 - DNA, 144 bp, Homo sapiens; identical to SEQ ID NO: 41995
  chr8:142593584-142593728
  hypo

SEQ ID NO: 62468 - DNA, 30 bp, Homo sapiens; identical to SEQ ID NO: 41996
  chr8:142680135-142680165
  hypo

SEQ ID NO: 62469 - DNA, 30 bp, Homo sapiens; identical to SEQ ID NO: 15174
  chr8:142694812-142694842
  hypo

SEQ ID NO: 62470 - DNA, 193 bp, Homo sapiens; identical to SEQ ID NO: 41998
  chr8:142706678-142706871
  hypo

SEQ ID NO: 62471 - DNA, 114 bp, Homo sapiens; identical to SEQ ID NO: 41999
  chr8:142939132-142939246
  hypo

SEQ ID NO: 62472 - DNA, 97 bp, Homo sapiens; identical to SEQ ID NO: 42000
  chr8:143054769-143054866
  hypo

SEQ ID NO: 62473 - DNA, 97 bp, Homo sapiens; identical to SEQ ID NO: 42001
  chr8:143054986-143055083
  hypo

SEQ ID NO: 62474 - DNA, 33 bp, Homo sapiens; identical to SEQ ID NO: 42002
  chr8:143088493-143088526
  hypo

SEQ ID NO: 62475 - DNA, 31 bp, Homo sapiens
  chr8:143088999-143089030
  hypo
ggactaaagtcccctcgagcgcctcagggtc

SEQ ID NO: 62476 - DNA, 30 bp, Homo sapiens; identical to SEQ ID NO: 42004
  chr8:143090706-143090736
  hypo

SEQ ID NO: 62477 - DNA, 33 bp, Homo sapiens; identical to SEQ ID NO: 15178
  chr8:143097424-143097457
  hypo

SEQ ID NO: 62478 - DNA, 33 bp, Homo sapiens
  chr8:143105211-143105244
  hypo
ctgcgccagctcagccgtctgtctcaggcaggc

SEQ ID NO: 62479 - DNA, 30 bp, Homo sapiens; identical to SEQ ID NO: 42007
  chr8:143128771-143128801
  hypo

SEQ ID NO: 62480 - DNA, 30 bp, Homo sapiens; identical to SEQ ID NO: 42008
  chr8:143156215-143156245
  hypo

SEQ ID NO: 62481 - DNA, 102 bp, Homo sapiens; identical to SEQ ID NO: 42009
  chr8:143171156-143171258
  hypo

SEQ ID NO: 62482 - DNA, 39 bp, Homo sapiens; identical to SEQ ID NO: 42010
  chr8:143198927-143198966
  hypo

SEQ ID NO: 62483 - DNA, 144 bp, Homo sapiens; identical to SEQ ID NO: 42011
  chr8:143210699-143210843
  hypo

SEQ ID NO: 62484 - DNA, 66 bp, Homo sapiens; identical to SEQ ID NO: 42012
  chr8:143217605-143217671
  hypo

SEQ ID NO: 62485 - DNA, 30 bp, Homo sapiens; identical to SEQ ID NO: 42013
  chr8:143265172-143265202
  hypo

SEQ ID NO: 62486 - DNA, 43 bp, Homo sapiens; identical to SEQ ID NO: 42014
  chr8:143314664-143314707
  hypo

SEQ ID NO: 62487 - DNA, 365 bp, Homo sapiens; identical to SEQ ID NO: 42015
  chr8:143317093-143317458
  hypo

SEQ ID NO: 62488 - DNA, 30 bp, Homo sapiens; identical to SEQ ID NO: 42016
  chr8:143326109-143326139
  hypo

SEQ ID NO: 62489 - DNA, 32 bp, Homo sapiens; identical to SEQ ID NO: 42017
  chr8:143333080-143333112
  hypo

SEQ ID NO: 62490 - DNA, 278 bp, Homo sapiens; identical to SEQ ID NO: 42018
  chr8:143333390-143333668
  hypo

SEQ ID NO: 62491 - DNA, 76 bp, Homo sapiens; identical to SEQ ID NO: 42019
  chr8:143334563-143334639
  hypo

SEQ ID NO: 62492 - DNA, 30 bp, Homo sapiens; identical to SEQ ID NO: 42020
  chr8:143386910-143386940
  hypo

SEQ ID NO: 62493 - DNA, 179 bp, Homo sapiens; identical to SEQ ID NO: 42021
  chr8:143405792-143405971
  hypo

SEQ ID NO: 62494 - DNA, 241 bp, Homo sapiens; identical to SEQ ID NO: 42022
  chr8:143436977-143437218
  hypo

SEQ ID NO: 62495 - DNA, 52 bp, Homo sapiens; identical to SEQ ID NO: 42023
  chr8:143463629-143463681
  hypo

SEQ ID NO: 62496 - DNA, 268 bp, Homo sapiens
  chr8:143509189-143509457
  hypo
cgctccctttctccacggcacctctgtgattctcgtcacctgccaacaccagcaccagggctgcccctcctgacggccccctcgccgtctttctgggcacactccatcggcacagcgtcttcactgtcctcctgacaaacctcgtgccacccccatcagcttcagcaccacctccacagcagccgtggccagcaccgacgtccttttccgtcaccgtcaagcctcaaaactgggaccgtgggtaatggcgtcaccccatccgccgtct

SEQ ID NO: 62497 - DNA, 64 bp, Homo sapiens; identical to SEQ ID NO: 42025
  chr8:143511468-143511532
  hypo

SEQ ID NO: 62498 - DNA, 40 bp, Homo sapiens; identical to SEQ ID NO: 42026
  chr8:143535787-143535827
  hypo

SEQ ID NO: 62499 - DNA, 49 bp, Homo sapiens; identical to SEQ ID NO: 42027
  chr8:143538439-143538488
  hypo

SEQ ID NO: 62500 - DNA, 205 bp, Homo sapiens; identical to SEQ ID NO: 42028
  chr8:143556064-143556269
  hypo

SEQ ID NO: 62501 - DNA, 257 bp, Homo sapiens
  chr8:143557723-143557980
  hypo
cagtgagggaggtggcgcggggtatgggagacaggacccacaggaagggtcccctggtgaccagatgagggctggtgccaggctgggcactctggtccctggctcccagctgcccagtggagccaggtggcccagtgctgccgaactcagagcactgtggccacagagagagaggacgggggcaaagaaccgctcctgtgctgacctaagcccgtcctgcagccgctgggcgcaccagctcccggagccagtccctg

SEQ ID NO: 62502 - DNA, 80 bp, Homo sapiens; identical to SEQ ID NO: 42030
  chr8:143558389-143558469
  hypo

SEQ ID NO: 62503 - DNA, 294 bp, Homo sapiens; identical to SEQ ID NO: 42031
  chr8:143561118-143561412
  hypo

SEQ ID NO: 62504 - DNA, 150 bp, Homo sapiens; identical to SEQ ID NO: 42032
  chr8:143567944-143568094
  hypo

SEQ ID NO: 62505 - DNA, 30 bp, Homo sapiens; identical to SEQ ID NO: 42033
  chr8:143573208-143573238
  hypo

SEQ ID NO: 62506 - DNA, 109 bp, Homo sapiens
  chr8:143587382-143587491
  hypo
gcgcctgtgggcgcctgtgggactgtcatgcaccagaatgtgtccctggggccacatgtgtgagcagcgtgctgactgagcacctgggcgaccccgaggtggagtaaac

SEQ ID NO: 62507 - DNA, 242 bp, Homo sapiens; identical to SEQ ID NO: 42035
  chr8:143595579-143595821
  hypo

SEQ ID NO: 62508 - DNA, 30 bp, Homo sapiens; identical to SEQ ID NO: 42036
  chr8:143599108-143599138
  hypo

SEQ ID NO: 62509 - DNA, 30 bp, Homo sapiens; identical to SEQ ID NO: 42037
  chr8:143599572-143599602
  hypo

SEQ ID NO: 62510 - DNA, 47 bp, Homo sapiens; identical to SEQ ID NO: 42038
  chr8:143618365-143618412
  hypo

SEQ ID NO: 62511 - DNA, 34 bp, Homo sapiens; identical to SEQ ID NO: 42039
  chr8:143620764-143620798
  hypo

SEQ ID NO: 62512 - DNA, 24 bp, Homo sapiens
  chr8:143621956-143621980
  hypo
caaggtgggtacatgcgagggagg

SEQ ID NO: 62513 - DNA, 21 bp, Homo sapiens
  chr8:143622096-143622117
  hypo
gcgtcccgagagtgctgtggc

SEQ ID NO: 62514 - DNA, 61 bp, Homo sapiens; identical to SEQ ID NO: 42041
  chr8:143623394-143623455
  hypo

SEQ ID NO: 62515 - DNA, 30 bp, Homo sapiens; identical to SEQ ID NO: 42042
  chr8:143623905-143623935
  hypo

SEQ ID NO: 62516 - DNA, 30 bp, Homo sapiens; identical to SEQ ID NO: 42043
  chr8:143624997-143625027
  hypo

SEQ ID NO: 62517 - DNA, 34 bp, Homo sapiens; identical to SEQ ID NO: 42044
  chr8:143631480-143631514
  hypo

SEQ ID NO: 62518 - DNA, 30 bp, Homo sapiens; identical to SEQ ID NO: 42045
  chr8:143656193-143656223
  hypo

SEQ ID NO: 62519 - DNA, 30 bp, Homo sapiens; identical to SEQ ID NO: 42048
  chr8:143827179-143827209
  hypo

SEQ ID NO: 62520 - DNA, 61 bp, Homo sapiens; identical to SEQ ID NO: 42049
  chr8:143833212-143833273
  hypo

SEQ ID NO: 62521 - DNA, 99 bp, Homo sapiens; identical to SEQ ID NO: 42050
  chr8:143855667-143855766
  hypo

SEQ ID NO: 62522 - DNA, 6 bp, Homo sapiens
  chr8:143876958-143876964
  hypo
agtggc

SEQ ID NO: 62523 - DNA, 33 bp, Homo sapiens; identical to SEQ ID NO: 42052
  chr8:143879185-143879218
  hypo

SEQ ID NO: 62524 - DNA, 30 bp, Homo sapiens; identical to SEQ ID NO: 42053
  chr8:143882149-143882179
  hypo

SEQ ID NO: 62525 - DNA, 138 bp, Homo sapiens; identical to SEQ ID NO: 42054
  chr8:143960027-143960165
  hypo

SEQ ID NO: 62526 - DNA, 7 bp, Homo sapiens
  chr8:143993967-143993974
  hypo
tctgcct

SEQ ID NO: 62527 - DNA, 34 bp, Homo sapiens; identical to SEQ ID NO: 42056
  chr8:143996499-143996533
  hypo

SEQ ID NO: 62528 - DNA, 33 bp, Homo sapiens; identical to SEQ ID NO: 42057
  chr8:144015246-144015279
  hypo

SEQ ID NO: 62529 - DNA, 141 bp, Homo sapiens; identical to SEQ ID NO: 42058
  chr8:144027680-144027821
  hypo

SEQ ID NO: 62530 - DNA, 14 bp, Homo sapiens
  chr8:144069651-144069665
  hypo
ggtgcaggtggcat

SEQ ID NO: 62531 - DNA, 151 bp, Homo sapiens; identical to SEQ ID NO: 42060
  chr8:144070508-144070659
  hypo

SEQ ID NO: 62532 - DNA, 30 bp, Homo sapiens; identical to SEQ ID NO: 42061
  chr8:144090641-144090671
  hypo

SEQ ID NO: 62533 - DNA, 128 bp, Homo sapiens; identical to SEQ ID NO: 42062
  chr8:144164496-144164624
  hypo

SEQ ID NO: 62534 - DNA, 234 bp, Homo sapiens
  chr8:144203708-144203942
  hypo
gaaggagccgactcaaggctgagtcccgcagccccgtgagggcggagtggaggttacggggcgggagcgggacgggaatctgagctcccagcagccgagccgagaggaaacccctgctcctgcccatgagcccagcagagcacatgccctggatgtcgagacgcggtccacagagagatgggctcctgtgactgtcctcggataggcctctggacgccacgccctagtgcagct

SEQ ID NO: 62535 - DNA, 30 bp, Homo sapiens; identical to SEQ ID NO: 15194
  chr8:144208784-144208814
  hypo

SEQ ID NO: 62536 - DNA, 20 bp, Homo sapiens
  chr8:144226154-144226174
  hypo
tggctcagcgctgcccgcac

SEQ ID NO: 62537 - DNA, 16 bp, Homo sapiens
  chr8:144238806-144238822
  hypo
agacatgggcatgcac

SEQ ID NO: 62538 - DNA, 132 bp, Homo sapiens
  chr8:144238901-144239033
  hypo
cctggggtgtgtgtgtgtgaaggagcagggcgggcacgggtgtgtgtgcacatgctggctgcgtgggcaccgtttgtatgcttgtctgggcatgagtgtgtgtgcacatgctggctgcgtgggcaccactgt

SEQ ID NO: 62539 - DNA, 67 bp, Homo sapiens; identical to SEQ ID NO: 42068
  chr8:144292403-144292470
  hypo

SEQ ID NO: 62540 - DNA, 184 bp, Homo sapiens; identical to SEQ ID NO: 42069
  chr8:144293655-144293839
  hypo

SEQ ID NO: 62541 - DNA, 147 bp, Homo sapiens; identical to SEQ ID NO: 42070
  chr8:144312859-144313006
  hypo

SEQ ID NO: 62542 - DNA, 214 bp, Homo sapiens; identical to SEQ ID NO: 42071
  chr8:144326825-144327039
  hypo

SEQ ID NO: 62543 - DNA, 38 bp, Homo sapiens
  chr8:144330380-144330418
  hypo
agcctaagttgagtcgacagagccgttatggagaatgt

SEQ ID NO: 62544 - DNA, 511 bp, Homo sapiens; identical to SEQ ID NO: 42073
  chr8:144343481-144343992
  hypo

SEQ ID NO: 62545 - DNA, 49 bp, Homo sapiens
  chr8:144344244-144344293
  hypo
cctctgcacctcccacgcccctctccggcagcccctgcccacacccgca

SEQ ID NO: 62546 - DNA, 101 bp, Homo sapiens; identical to SEQ ID NO: 24521
  chr8:144344442-144344543
  hypo

SEQ ID NO: 62547 - DNA, 30 bp, Homo sapiens; identical to SEQ ID NO: 42075
  chr8:144347029-144347059
  hypo

SEQ ID NO: 62548 - DNA, 92 bp, Homo sapiens
  chr8:144360302-144360394
  hypo
ccctatggccaccagcgctctggacgccccactctgccaggtgagaacgagtttaggggtgcgggctggaggtcagtgtgtctgtccgaagt

SEQ ID NO: 62549 - DNA, 92 bp, Homo sapiens
  chr8:144360453-144360545
  hypo
tcagactgtctgcctgaaaggtaagggtgaggacgcctgcattctccttgttcagtaacacgcgtgggcagccaggccgaggtgctggctct

SEQ ID NO: 62550 - DNA, 12 bp, Homo sapiens
  chr8:144361823-144361835
  hypo
accgcacatggc

SEQ ID NO: 62551 - DNA, 57 bp, Homo sapiens; identical to SEQ ID NO: 15204
  chr8:144383350-144383407
  hypo

SEQ ID NO: 62552 - DNA, 35 bp, Homo sapiens; identical to SEQ ID NO: 42080
  chr8:144386583-144386618
  hypo

SEQ ID NO: 62553 - DNA, 30 bp, Homo sapiens; identical to SEQ ID NO: 42081
  chr8:144452062-144452092
  hypo

SEQ ID NO: 62554 - DNA, 34 bp, Homo sapiens; identical to SEQ ID NO: 42082
  chr8:144457801-144457835
  hypo

SEQ ID NO: 62555 - DNA, 179 bp, Homo sapiens; identical to SEQ ID NO: 15205
  chr8:144471637-144471816
  hypo

SEQ ID NO: 62556 - DNA, 32 bp, Homo sapiens; identical to SEQ ID NO: 42084
  chr8:144552577-144552609
  hypo

SEQ ID NO: 62557 - DNA, 30 bp, Homo sapiens; identical to SEQ ID NO: 42085
  chr8:144573375-144573405
  hypo

SEQ ID NO: 62558 - DNA, 83 bp, Homo sapiens; identical to SEQ ID NO: 15206
  chr8:144589999-144590082
  hypo

SEQ ID NO: 62559 - DNA, 175 bp, Homo sapiens; identical to SEQ ID NO: 42087
  chr8:144656770-144656945
  hypo

SEQ ID NO: 62560 - DNA, 95 bp, Homo sapiens
  chr8:144668814-144668909
  hypo
tggcctggctgaatccgctttgtgtgccccggccactcctgtcgggcagcagagccgcccagccgccccacgtgcagctctcacctggcgggagg

SEQ ID NO: 62561 - DNA, 37 bp, Homo sapiens; identical to SEQ ID NO: 42089
  chr8:144675999-144676036
  hypo

SEQ ID NO: 62562 - DNA, 177 bp, Homo sapiens; identical to SEQ ID NO: 42090
  chr8:144677837-144678014
  hypo

SEQ ID NO: 62563 - DNA, 79 bp, Homo sapiens; identical to SEQ ID NO: 42091
  chr8:144681634-144681713
  hypo

SEQ ID NO: 62564 - DNA, 122 bp, Homo sapiens; identical to SEQ ID NO: 42092
  chr8:144685577-144685699
  hypo

SEQ ID NO: 62565 - DNA, 185 bp, Homo sapiens; identical to SEQ ID NO: 42093
  chr8:145739768-145739953
  hypo

SEQ ID NO: 62566 - DNA, 30 bp, Homo sapiens; identical to SEQ ID NO: 42094
  chr8:145745121-145745151
  hypo

SEQ ID NO: 62567 - DNA, 27 bp, Homo sapiens
  chr8:145753490-145753517
  hypo
gcgtgcaggtgggggcggggaagctca

SEQ ID NO: 62568 - DNA, 20 bp, Homo sapiens
  chr8:145753547-145753567
  hypo
cggcccgagcccacttttcc

SEQ ID NO: 62569 - DNA, 18 bp, Homo sapiens
  chr8:145919061-145919079
  hypo
ggccgtaaaattctttga

SEQ ID NO: 62570 - DNA, 192 bp, Homo sapiens; identical to SEQ ID NO: 42098
  chr8:145979452-145979644
  hypo

SEQ ID NO: 62571 - DNA, 30 bp, Homo sapiens; identical to SEQ ID NO: 15213
  chr8:146013567-146013597
  hypo

SEQ ID NO: 62572 - DNA, 30 bp, Homo sapiens; identical to SEQ ID NO: 42100
  chr8:146050247-146050277
  hypo

SEQ ID NO: 62573 - DNA, 35 bp, Homo sapiens; identical to SEQ ID NO: 42102
  chr9:2727012-2727047
  hypo

SEQ ID NO: 62574 - DNA, 17 bp, Homo sapiens
  chr9:5230606-5230623
  hypo
caaacctttttgaaacg

SEQ ID NO: 62575 - DNA, 30 bp, Homo sapiens; identical to SEQ ID NO: 15216
  chr9:7164747-7164777
  hypo

SEQ ID NO: 62576 - DNA, 17 bp, Homo sapiens
  chr9:15277136-15277153
  hypo
aatttatgggctgggcg

SEQ ID NO: 62577 - DNA, 29 bp, Homo sapiens
  chr9:15533122-15533151
  hypo
cccggccagaaagacgtgtttactacaaa

SEQ ID NO: 62578 - DNA, 30 bp, Homo sapiens; identical to SEQ ID NO: 42109
  chr9:26958024-26958054
  hypo

SEQ ID NO: 62579 - DNA, 21 bp, Homo sapiens
  chr9:26976277-26976298
  hypo
aagaaagcttgaagtcgtaaa

SEQ ID NO: 62580 - DNA, 31 bp, Homo sapiens; identical to SEQ ID NO: 42111
  chr9:28641312-28641343
  hypo

SEQ ID NO: 62581 - DNA, 145 bp, Homo sapiens; identical to SEQ ID NO: 42112
  chr9:32999975-33000120
  hypo

SEQ ID NO: 62582 - DNA, 24 bp, Homo sapiens
  chr9:33647199-33647223
  hypo
gcgagactgcgtctcaaaaaaaaa

SEQ ID NO: 62583 - DNA, 30 bp, Homo sapiens; identical to SEQ ID NO: 42114
  chr9:33862299-33862329
  hypo

SEQ ID NO: 62584 - DNA, 20 bp, Homo sapiens
  chr9:34046353-34046373
  hypo
gtaaaggcttcatgccgggc

SEQ ID NO: 62585 - DNA, 39 bp, Homo sapiens; identical to SEQ ID NO: 42116
  chr9:34062515-34062554
  hypo

SEQ ID NO: 62586 - DNA, 99 bp, Homo sapiens; identical to SEQ ID NO: 42117
  chr9:34063196-34063295
  hypo

SEQ ID NO: 62587 - DNA, 56 bp, Homo sapiens; identical to SEQ ID NO: 42119
  chr9:34574808-34574864
  hypo

SEQ ID NO: 62588 - DNA, 30 bp, Homo sapiens; identical to SEQ ID NO: 42120
  chr9:35696547-35696577
  hypo

SEQ ID NO: 62589 - DNA, 95 bp, Homo sapiens; identical to SEQ ID NO: 42121
  chr9:35816242-35816337
  hypo

SEQ ID NO: 62590 - DNA, 22 bp, Homo sapiens
  chr9:36036080-36036102
  hypo
aggcacagtggctcacgcctgc

SEQ ID NO: 62591 - DNA, 53 bp, Homo sapiens; identical to SEQ ID NO: 42123
  chr9:36257376-36257429
  hypo

SEQ ID NO: 62592 - DNA, 23 bp, Homo sapiens
  chr9:36274726-36274749
  hypo
ttttttctcttgagacggagtct

SEQ ID NO: 62593 - DNA, 30 bp, Homo sapiens; identical to SEQ ID NO: 42125
  chr9:37134066-37134096
  hypo

SEQ ID NO: 62594 - DNA, 30 bp, Homo sapiens; identical to SEQ ID NO: 5090
  chr9:37467940-37467970
  hypo

SEQ ID NO: 62595 - DNA, 31 bp, Homo sapiens; identical to SEQ ID NO: 42128
  chr9:38646913-38646944
  hypo

SEQ ID NO: 62596 - DNA, 117 bp, Homo sapiens; identical to SEQ ID NO: 42129
  chr9:71223828-71223945
  hypo

SEQ ID NO: 62597 - DNA, 106 bp, Homo sapiens; identical to SEQ ID NO: 42130
  chr9:71425241-71425347
  hypo

SEQ ID NO: 62598 - DNA, 19 bp, Homo sapiens
  chr9:71501084-71501103
  hypo
actccgtctgaaaaaaaaa

SEQ ID NO: 62599 - DNA, 26 bp, Homo sapiens
  chr9:71655284-71655310
  hypo
atgtaaatatttatacgctgccgggc

SEQ ID NO: 62600 - DNA, 14 bp, Homo sapiens
  chr9:71734802-71734816
  hypo
cagtaacctggccc

SEQ ID NO: 62601 - DNA, 27 bp, Homo sapiens
  chr9:71921187-71921214
  hypo
tctgggcaagatgatcgccctgaataa

SEQ ID NO: 62602 - DNA, 44 bp, Homo sapiens; identical to SEQ ID NO: 42135
  chr9:72819967-72820011
  hypo

SEQ ID NO: 62603 - DNA, 173 bp, Homo sapiens; identical to SEQ ID NO: 42137
  chr9:74469850-74470023
  hypo

SEQ ID NO: 62604 - DNA, 30 bp, Homo sapiens; identical to SEQ ID NO: 42138
  chr9:78557098-78557128
  hypo

SEQ ID NO: 62605 - DNA, 44 bp, Homo sapiens; identical to SEQ ID NO: 42139
  chr9:79073406-79073450
  hypo

SEQ ID NO: 62606 - DNA, 30 bp, Homo sapiens; identical to SEQ ID NO: 15224
  chr9:79231349-79231379
  hypo

SEQ ID NO: 62607 - DNA, 17 bp, Homo sapiens
  chr9:79448387-79448404
  hypo
aaaccaaatacaggccg

SEQ ID NO: 62608 - DNA, 140 bp, Homo sapiens; identical to SEQ ID NO: 42142
  chr9:80852180-80852320
  hypo

SEQ ID NO: 62609 - DNA, 30 bp, Homo sapiens; identical to SEQ ID NO: 42143
  chr9:81359075-81359105
  hypo

SEQ ID NO: 62610 - DNA, 30 bp, Homo sapiens; identical to SEQ ID NO: 42144
  chr9:84294960-84294990
  hypo

SEQ ID NO: 62611 - DNA, 30 bp, Homo sapiens; identical to SEQ ID NO: 42145
  chr9:87326719-87326749
  hypo

SEQ ID NO: 62612 - DNA, 30 bp, Homo sapiens; identical to SEQ ID NO: 42146
  chr9:88832474-88832504
  hypo

SEQ ID NO: 62613 - DNA, 165 bp, Homo sapiens; identical to SEQ ID NO: 42147
  chr9:90322123-90322288
  hypo

SEQ ID NO: 62614 - DNA, 132 bp, Homo sapiens; identical to SEQ ID NO: 42148
  chr9:90421580-90421712
  hypo

SEQ ID NO: 62615 - DNA, 39 bp, Homo sapiens; identical to SEQ ID NO: 15227
  chr9:91914149-91914188
  hypo

SEQ ID NO: 62616 - DNA, 138 bp, Homo sapiens; identical to SEQ ID NO: 42150
  chr9:91995955-91996093
  hypo

SEQ ID NO: 62617 - DNA, 159 bp, Homo sapiens; identical to SEQ ID NO: 42151
  chr9:92897057-92897216
  hypo

SEQ ID NO: 62618 - DNA, 77 bp, Homo sapiens; identical to SEQ ID NO: 15229
  chr9:92980516-92980593
  hypo

SEQ ID NO: 62619 - DNA, 16 bp, Homo sapiens
  chr9:93462711-93462727
  hypo
ccgttctcctgcctca

SEQ ID NO: 62620 - DNA, 30 bp, Homo sapiens; identical to SEQ ID NO: 42155
  chr9:94572598-94572628
  hypo

SEQ ID NO: 62621 - DNA, 53 bp, Homo sapiens; identical to SEQ ID NO: 42156
  chr9:94573085-94573138
  hypo

SEQ ID NO: 62622 - DNA, 141 bp, Homo sapiens; identical to SEQ ID NO: 42157
  chr9:94658109-94658250
  hypo

SEQ ID NO: 62623 - DNA, 81 bp, Homo sapiens; identical to SEQ ID NO: 42158
  chr9:94863469-94863550
  hypo

SEQ ID NO: 62624 - DNA, 69 bp, Homo sapiens
  chr9:95417482-95417551
  hypo
ctttgcctaactcaccgacacatctgttcttccctcacgtggccctgtgtggccctgcagatgcagcga

SEQ ID NO: 62625 - DNA, 30 bp, Homo sapiens; identical to SEQ ID NO: 42160
  chr9:95485122-95485152
  hypo

SEQ ID NO: 62626 - DNA, 17 bp, Homo sapiens
  chr9:96230169-96230186
  hypo
cttttttttttgagacg

SEQ ID NO: 62627 - DNA, 54 bp, Homo sapiens; identical to SEQ ID NO: 42162
  chr9:96362025-96362079
  hypo

SEQ ID NO: 62628 - DNA, 327 bp, Homo sapiens; identical to SEQ ID NO: 42163
  chr9:97317331-97317658
  hypo

SEQ ID NO: 62629 - DNA, 30 bp, Homo sapiens; identical to SEQ ID NO: 42164
  chr9:97682189-97682219
  hypo

SEQ ID NO: 62630 - DNA, 30 bp, Homo sapiens; identical to SEQ ID NO: 42165
  chr9:97807798-97807828
  hypo

SEQ ID NO: 62631 - DNA, 30 bp, Homo sapiens; identical to SEQ ID NO: 42166
  chr9:97863868-97863898
  hypo

SEQ ID NO: 62632 - DNA, 96 bp, Homo sapiens; identical to SEQ ID NO: 42167
  chr9:97864916-97865012
  hypo

SEQ ID NO: 62633 - DNA, 30 bp, Homo sapiens; identical to SEQ ID NO: 42168
  chr9:97887619-97887649
  hypo

SEQ ID NO: 62634 - DNA, 317 bp, Homo sapiens; identical to SEQ ID NO: 42169
  chr9:100397395-100397712
  hypo

SEQ ID NO: 62635 - DNA, 41 bp, Homo sapiens; identical to SEQ ID NO: 42170
  chr9:100843360-100843401
  hypo

SEQ ID NO: 62636 - DNA, 120 bp, Homo sapiens; identical to SEQ ID NO: 42171
  chr9:100935554-100935674
  hypo

SEQ ID NO: 62637 - DNA, 30 bp, Homo sapiens; identical to SEQ ID NO: 42172
  chr9:100981193-100981223
  hypo

SEQ ID NO: 62638 - DNA, 94 bp, Homo sapiens; identical to SEQ ID NO: 42173
  chr9:100981840-100981934
  hypo

SEQ ID NO: 62639 - DNA, 30 bp, Homo sapiens; identical to SEQ ID NO: 42174
  chr9:101557939-101557969
  hypo

SEQ ID NO: 62640 - DNA, 19 bp, Homo sapiens
  chr9:101982656-101982675
  hypo
tacataagaatgtcccggc

SEQ ID NO: 62641 - DNA, 30 bp, Homo sapiens; identical to SEQ ID NO: 42176
  chr9:102107331-102107361
  hypo

SEQ ID NO: 62642 - DNA, 24 bp, Homo sapiens
  chr9:103174730-103174754
  hypo
aaatgtccccgtataaatgataaa

SEQ ID NO: 62643 - DNA, 101 bp, Homo sapiens; identical to SEQ ID NO: 42178
  chr9:103176794-103176895
  hypo

SEQ ID NO: 62644 - DNA, 196 bp, Homo sapiens; identical to SEQ ID NO: 42179
  chr9:107221358-107221554
  hypo

SEQ ID NO: 62645 - DNA, 76 bp, Homo sapiens; identical to SEQ ID NO: 42180
  chr9:107396386-107396462
  hypo

SEQ ID NO: 62646 - DNA, 30 bp, Homo sapiens; identical to SEQ ID NO: 42181
  chr9:114710299-114710329
  hypo

SEQ ID NO: 62647 - DNA, 6 bp, Homo sapiens
  chr9:115067926-115067932
  hypo
ataaga

SEQ ID NO: 62648 - DNA, 30 bp, Homo sapiens; identical to SEQ ID NO: 42183
  chr9:115087309-115087339
  hypo

SEQ ID NO: 62649 - DNA, 18 bp, Homo sapiens
  chr9:115087597-115087615
  hypo
gcccgtctgcacactggg

SEQ ID NO: 62650 - DNA, 146 bp, Homo sapiens; identical to SEQ ID NO: 42185
  chr9:115172301-115172447
  hypo

SEQ ID NO: 62651 - DNA, 30 bp, Homo sapiens; identical to SEQ ID NO: 42187
  chr9:115599305-115599335
  hypo

SEQ ID NO: 62652 - DNA, 30 bp, Homo sapiens; identical to SEQ ID NO: 42188
  chr9:115773781-115773811
  hypo

SEQ ID NO: 62653 - DNA, 30 bp, Homo sapiens; identical to SEQ ID NO: 42189
  chr9:116065790-116065820
  hypo

SEQ ID NO: 62654 - DNA, 30 bp, Homo sapiens; identical to SEQ ID NO: 42190
  chr9:116128876-116128906
  hypo

SEQ ID NO: 62655 - DNA, 30 bp, Homo sapiens; identical to SEQ ID NO: 15237
  chr9:116331277-116331307
  hypo

SEQ ID NO: 62656 - DNA, 19 bp, Homo sapiens
  chr9:116633864-116633883
  hypo
aattccacctgccgacgtg

SEQ ID NO: 62657 - DNA, 30 bp, Homo sapiens; identical to SEQ ID NO: 42194
  chr9:123150500-123150530
  hypo

SEQ ID NO: 62658 - DNA, 30 bp, Homo sapiens; identical to SEQ ID NO: 42195
  chr9:123272513-123272543
  hypo

SEQ ID NO: 62659 - DNA, 30 bp, Homo sapiens; identical to SEQ ID NO: 15239
  chr9:123287840-123287870
  hypo

SEQ ID NO: 62660 - DNA, 30 bp, Homo sapiens; identical to SEQ ID NO: 42197
  chr9:123294978-123295008
  hypo

SEQ ID NO: 62661 - DNA, 30 bp, Homo sapiens; identical to SEQ ID NO: 42198
  chr9:123295496-123295526
  hypo

SEQ ID NO: 62662 - DNA, 30 bp, Homo sapiens; identical to SEQ ID NO: 42199
  chr9:125551770-125551800
  hypo

SEQ ID NO: 62663 - DNA, 39 bp, Homo sapiens; identical to SEQ ID NO: 42200
  chr9:125623471-125623510
  hypo

SEQ ID NO: 62664 - DNA, 30 bp, Homo sapiens; identical to SEQ ID NO: 42201
  chr9:126110108-126110138
  hypo

SEQ ID NO: 62665 - DNA, 30 bp, Homo sapiens; identical to SEQ ID NO: 15240
  chr9:126125543-126125573
  hypo

SEQ ID NO: 62666 - DNA, 103 bp, Homo sapiens; identical to SEQ ID NO: 42203
  chr9:126132916-126133019
  hypo

SEQ ID NO: 62667 - DNA, 62 bp, Homo sapiens
  chr9:126133716-126133778
  hypo
tgcctccaggacctgcgactcgatggctgccacctccccttctttcctctgccactggataa

SEQ ID NO: 62668 - DNA, 84 bp, Homo sapiens
  chr9:126133856-126133940
  hypo
tgtaagtgtctggtggcggtggtggtggtggggtggggagtccttttcccaggatctgtcctgtgtcaccggggcttagtgtgt

SEQ ID NO: 62669 - DNA, 162 bp, Homo sapiens; identical to SEQ ID NO: 42205
  chr9:126140319-126140481
  hypo

SEQ ID NO: 62670 - DNA, 36 bp, Homo sapiens; identical to SEQ ID NO: 42206
  chr9:126141357-126141393
  hypo

SEQ ID NO: 62671 - DNA, 30 bp, Homo sapiens; identical to SEQ ID NO: 42207
  chr9:126145363-126145393
  hypo

SEQ ID NO: 62672 - DNA, 37 bp, Homo sapiens; identical to SEQ ID NO: 42208
  chr9:126153029-126153066
  hypo

SEQ ID NO: 62673 - DNA, 50 bp, Homo sapiens; identical to SEQ ID NO: 24556
  chr9:126154254-126154304
  hypo

SEQ ID NO: 62674 - DNA, 34 bp, Homo sapiens; identical to SEQ ID NO: 15243
  chr9:126158010-126158044
  hypo

SEQ ID NO: 62675 - DNA, 17 bp, Homo sapiens
  chr9:126160660-126160677
  hypo
cttttttatttgagacg

SEQ ID NO: 62676 - DNA, 44 bp, Homo sapiens; identical to SEQ ID NO: 15244
  chr9:126169447-126169491
  hypo

SEQ ID NO: 62677 - DNA, 23 bp, Homo sapiens
  chr9:127950771-127950794
  hypo
gcagtatacctaggccggcgcgg

SEQ ID NO: 62678 - DNA, 30 bp, Homo sapiens; identical to SEQ ID NO: 42214
  chr9:128750886-128750916
  hypo

SEQ ID NO: 62679 - DNA, 20 bp, Homo sapiens
  chr9:128759954-128759974
  hypo
aggatcggaaggaatcacac

SEQ ID NO: 62680 - DNA, 30 bp, Homo sapiens; identical to SEQ ID NO: 42216
  chr9:128777807-128777837
  hypo

SEQ ID NO: 62681 - DNA, 166 bp, Homo sapiens; identical to SEQ ID NO: 42217
  chr9:128824568-128824734
  hypo

SEQ ID NO: 62682 - DNA, 113 bp, Homo sapiens; identical to SEQ ID NO: 42218
  chr9:130179969-130180082
  hypo

SEQ ID NO: 62683 - DNA, 38 bp, Homo sapiens; identical to SEQ ID NO: 42219
  chr9:130248346-130248384
  hypo

SEQ ID NO: 62684 - DNA, 21 bp, Homo sapiens
  chr9:130326077-130326098
  hypo
tcaccgcgcccagcagagagg

SEQ ID NO: 62685 - DNA, 18 bp, Homo sapiens
  chr9:130505479-130505497
  hypo
ttaaatattcagttacgg

SEQ ID NO: 62686 - DNA, 30 bp, Homo sapiens; identical to SEQ ID NO: 42222
  chr9:130534900-130534930
  hypo

SEQ ID NO: 62687 - DNA, 30 bp, Homo sapiens; identical to SEQ ID NO: 42223
  chr9:130676213-130676243
  hypo

SEQ ID NO: 62688 - DNA, 30 bp, Homo sapiens; identical to SEQ ID NO: 42224
  chr9:130857460-130857490
  hypo

SEQ ID NO: 62689 - DNA, 21 bp, Homo sapiens
  chr9:131060946-131060967
  hypo
ccaccgcgcctggccccttgg

SEQ ID NO: 62690 - DNA, 30 bp, Homo sapiens; identical to SEQ ID NO: 42226
  chr9:131095785-131095815
  hypo

SEQ ID NO: 62691 - DNA, 20 bp, Homo sapiens
  chr9:131417485-131417505
  hypo
aaagttagcctgggccggcg

SEQ ID NO: 62692 - DNA, 278 bp, Homo sapiens; identical to SEQ ID NO: 42228
  chr9:131504870-131505148
  hypo

SEQ ID NO: 62693 - DNA, 39 bp, Homo sapiens
  chr9:131579999-131580038
  hypo
gttttttggaatattcgccccaggtttctgttccagcca

SEQ ID NO: 62694 - DNA, 34 bp, Homo sapiens; identical to SEQ ID NO: 42230
  chr9:131822149-131822183
  hypo

SEQ ID NO: 62695 - DNA, 115 bp, Homo sapiens
  chr9:131854116-131854231
  hypo
caggaaactataaggcgagccctggcctcgaatcatagctaaaaaacaaggatccgagaggtagatttaacagcagatgagagagagttaaaaaggaaaagcaaactggagggtg

SEQ ID NO: 62696 - DNA, 126 bp, Homo sapiens
  chr9:131854328-131854454
  hypo
cacactcacctgcttaccctgaccccgctccaacctgcccaaggtgcggtgctgggcagaagcccaactcttcaagccctcagaagcctctttgaaatatccacttttcgcggctgggcgcggtgg

SEQ ID NO: 62697 - DNA, 32 bp, Homo sapiens; identical to SEQ ID NO: 42232
  chr9:131868926-131868958
  hypo

SEQ ID NO: 62698 - DNA, 144 bp, Homo sapiens; identical to SEQ ID NO: 42233
  chr9:132040507-132040651
  hypo

SEQ ID NO: 62699 - DNA, 75 bp, Homo sapiens
  chr9:132402765-132402840
  hypo
cccagcgtcgggccgcgtttaagccacctgcccacccccggggctctcgctgaccttcaaagttgagattggccc

SEQ ID NO: 62700 - DNA, 266 bp, Homo sapiens
  chr9:132402883-132403149
  hypo
agccatcttgagcagggcgttgctcacgccttcctggtaaaagggagagtgggctttcctctccagcagctcagtgagaacaaggattcggctctcctcgctggcgacataactgggcctgggacaggagagaggctgagggtaggcacagctgtgggaccgggtgaccgcgcagcctgtgggttggtgggctttagtcctgctatcatcatcagcaagcagggccctggctctgtgggtcacaggggcttgggggaagctctgaa

SEQ ID NO: 62701 - DNA, 93 bp, Homo sapiens; identical to SEQ ID NO: 42235
  chr9:132491528-132491621
  hypo

SEQ ID NO: 62702 - DNA, 27 bp, Homo sapiens
  chr9:132815103-132815130
  hypo
ccaaagcaggttgggcgcagtgactca

SEQ ID NO: 62703 - DNA, 30 bp, Homo sapiens; identical to SEQ ID NO: 42237
  chr9:133510031-133510061
  hypo

SEQ ID NO: 62704 - DNA, 30 bp, Homo sapiens; identical to SEQ ID NO: 15253
  chr9:133518455-133518485
  hypo

SEQ ID NO: 62705 - DNA, 30 bp, Homo sapiens; identical to SEQ ID NO: 42239
  chr9:133767827-133767857
  hypo

SEQ ID NO: 62706 - DNA, 36 bp, Homo sapiens
  chr9:133773730-133773766
  hypo
gggtggcatggtgcccgcttaggcagtgttcactgc

SEQ ID NO: 62707 - DNA, 126 bp, Homo sapiens; identical to SEQ ID NO: 42241
  chr9:133779518-133779644
  hypo

SEQ ID NO: 62708 - DNA, 30 bp, Homo sapiens; identical to SEQ ID NO: 42242
  chr9:133782157-133782187
  hypo

SEQ ID NO: 62709 - DNA, 64 bp, Homo sapiens; identical to SEQ ID NO: 42243
  chr9:133864850-133864914
  hypo

SEQ ID NO: 62710 - DNA, 189 bp, Homo sapiens; identical to SEQ ID NO: 42244
  chr9:133865355-133865544
  hypo

SEQ ID NO: 62711 - DNA, 30 bp, Homo sapiens; identical to SEQ ID NO: 42246
  chr9:133936721-133936751
  hypo

SEQ ID NO: 62712 - DNA, 31 bp, Homo sapiens; identical to SEQ ID NO: 42247
  chr9:134119973-134120004
  hypo

SEQ ID NO: 62713 - DNA, 126 bp, Homo sapiens; identical to SEQ ID NO: 42248
  chr9:134135879-134136005
  hypo

SEQ ID NO: 62714 - DNA, 41 bp, Homo sapiens; identical to SEQ ID NO: 42249
  chr9:134136231-134136272
  hypo

SEQ ID NO: 62715 - DNA, 271 bp, Homo sapiens; identical to SEQ ID NO: 42251
  chr9:134191463-134191734
  hypo

SEQ ID NO: 62716 - DNA, 44 bp, Homo sapiens; identical to SEQ ID NO: 24568
  chr9:134717269-134717313
  hypo

SEQ ID NO: 62717 - DNA, 30 bp, Homo sapiens; identical to SEQ ID NO: 42254
  chr9:134724244-134724274
  hypo

SEQ ID NO: 62718 - DNA, 30 bp, Homo sapiens; identical to SEQ ID NO: 42255
  chr9:134818649-134818679
  hypo

SEQ ID NO: 62719 - DNA, 198 bp, Homo sapiens; identical to SEQ ID NO: 42256
  chr9:134913048-134913246
  hypo

SEQ ID NO: 62720 - DNA, 30 bp, Homo sapiens; identical to SEQ ID NO: 42257
  chr9:135027845-135027875
  hypo

SEQ ID NO: 62721 - DNA, 30 bp, Homo sapiens; identical to SEQ ID NO: 42258
  chr9:135054774-135054804
  hypo

SEQ ID NO: 62722 - DNA, 114 bp, Homo sapiens; identical to SEQ ID NO: 42259
  chr9:135102332-135102446
  hypo

SEQ ID NO: 62723 - DNA, 204 bp, Homo sapiens; identical to SEQ ID NO: 42260
  chr9:135512910-135513114
  hypo

SEQ ID NO: 62724 - DNA, 74 bp, Homo sapiens; identical to SEQ ID NO: 42262
  chr9:135768018-135768092
  hypo

SEQ ID NO: 62725 - DNA, 30 bp, Homo sapiens; identical to SEQ ID NO: 42263
  chr9:135833429-135833459
  hypo

SEQ ID NO: 62726 - DNA, 48 bp, Homo sapiens
  chr9:135865042-135865090
  hypo
tggagtgtcctgttccgcaggggatcccggccgggtccagtcctgagc

SEQ ID NO: 62727 - DNA, 34 bp, Homo sapiens
  chr9:135865161-135865195
  hypo
gccttcaagcgctcgtccacgctgtccacccacc

SEQ ID NO: 62728 - DNA, 33 bp, Homo sapiens
  chr9:135898878-135898911
  hypo
gggatctggatgcagcggctggggttggcaggg

SEQ ID NO: 62729 - DNA, 56 bp, Homo sapiens; identical to SEQ ID NO: 42266
  chr9:135908143-135908199
  hypo

SEQ ID NO: 62730 - DNA, 138 bp, Homo sapiens; identical to SEQ ID NO: 42267
  chr9:136375595-136375733
  hypo

SEQ ID NO: 62731 - DNA, 70 bp, Homo sapiens; identical to SEQ ID NO: 42268
  chr9:136383935-136384005
  hypo

SEQ ID NO: 62732 - DNA, 30 bp, Homo sapiens; identical to SEQ ID NO: 42269
  chr9:136521608-136521638
  hypo

SEQ ID NO: 62733 - DNA, 30 bp, Homo sapiens; identical to SEQ ID NO: 42270
  chr9:136559282-136559312
  hypo

SEQ ID NO: 62734 - DNA, 45 bp, Homo sapiens; identical to SEQ ID NO: 42271
  chr9:136573425-136573470
  hypo

SEQ ID NO: 62735 - DNA, 30 bp, Homo sapiens; identical to SEQ ID NO: 15265
  chr9:136999528-136999558
  hypo

SEQ ID NO: 62736 - DNA, 30 bp, Homo sapiens; identical to SEQ ID NO: 42273
  chr9:137248217-137248247
  hypo

SEQ ID NO: 62737 - DNA, 33 bp, Homo sapiens; identical to SEQ ID NO: 42274
  chr9:137427038-137427071
  hypo

SEQ ID NO: 62738 - DNA, 93 bp, Homo sapiens; identical to SEQ ID NO: 42275
  chr9:137457467-137457560
  hypo

SEQ ID NO: 62739 - DNA, 30 bp, Homo sapiens; identical to SEQ ID NO: 42276
  chr9:137539456-137539486
  hypo

SEQ ID NO: 62740 - DNA, 174 bp, Homo sapiens; identical to SEQ ID NO: 42277
  chr9:137580733-137580907
  hypo

SEQ ID NO: 62741 - DNA, 35 bp, Homo sapiens; identical to SEQ ID NO: 42278
  chr9:137602268-137602303
  hypo

SEQ ID NO: 62742 - DNA, 30 bp, Homo sapiens; identical to SEQ ID NO: 42279
  chr9:137624178-137624208
  hypo

SEQ ID NO: 62743 - DNA, 30 bp, Homo sapiens; identical to SEQ ID NO: 42280
  chr9:137631987-137632017
  hypo

SEQ ID NO: 62744 - DNA, 30 bp, Homo sapiens; identical to SEQ ID NO: 42281
  chr9:137638965-137638995
  hypo

SEQ ID NO: 62745 - DNA, 33 bp, Homo sapiens
  chr9:137656925-137656958
  hypo
acgagcctcgccgaccggagagggcgtgccagc

SEQ ID NO: 62746 - DNA, 18 bp, Homo sapiens
  chr9:137657128-137657146
  hypo
gagcgagccggtaatgag

SEQ ID NO: 62747 - DNA, 35 bp, Homo sapiens; identical to SEQ ID NO: 42284
  chr9:137685677-137685712
  hypo

SEQ ID NO: 62748 - DNA, 119 bp, Homo sapiens; identical to SEQ ID NO: 42285
  chr9:137694532-137694651
  hypo

SEQ ID NO: 62749 - DNA, 347 bp, Homo sapiens; identical to SEQ ID NO: 42286
  chr9:137710245-137710592
  hypo

SEQ ID NO: 62750 - DNA, 30 bp, Homo sapiens; identical to SEQ ID NO: 42287
  chr9:137711104-137711134
  hypo

SEQ ID NO: 62751 - DNA, 30 bp, Homo sapiens; identical to SEQ ID NO: 42288
  chr9:137716969-137716999
  hypo

SEQ ID NO: 62752 - DNA, 51 bp, Homo sapiens
  chr9:137718850-137718901
  hypo
caagcctgcagctctcgtgcccctgcatcagcttgaacggcctctccttca

SEQ ID NO: 62753 - DNA, 89 bp, Homo sapiens; identical to SEQ ID NO: 24575
  chr9:137719001-137719090
  hypo

SEQ ID NO: 62754 - DNA, 78 bp, Homo sapiens; identical to SEQ ID NO: 42290
  chr9:137719540-137719618
  hypo

SEQ ID NO: 62755 - DNA, 40 bp, Homo sapiens; identical to SEQ ID NO: 42291
  chr9:137724640-137724680
  hypo

SEQ ID NO: 62756 - DNA, 30 bp, Homo sapiens; identical to SEQ ID NO: 42292
  chr9:137726926-137726956
  hypo

SEQ ID NO: 62757 - DNA, 30 bp, Homo sapiens; identical to SEQ ID NO: 42293
  chr9:137730841-137730871
  hypo

SEQ ID NO: 62758 - DNA, 60 bp, Homo sapiens; identical to SEQ ID NO: 42294
  chr9:137734084-137734144
  hypo

SEQ ID NO: 62759 - DNA, 30 bp, Homo sapiens; identical to SEQ ID NO: 42295
  chr9:137851369-137851399
  hypo

SEQ ID NO: 62760 - DNA, 17 bp, Homo sapiens
  chr9:137854747-137854764
  hypo
cccggccgctccttaac

SEQ ID NO: 62761 - DNA, 21 bp, Homo sapiens
  chr9:138265251-138265272
  hypo
catggtcgcccactccctctg

SEQ ID NO: 62762 - DNA, 34 bp, Homo sapiens; identical to SEQ ID NO: 15269
  chr9:138289547-138289581
  hypo

SEQ ID NO: 62763 - DNA, 30 bp, Homo sapiens; identical to SEQ ID NO: 42299
  chr9:138290031-138290061
  hypo

SEQ ID NO: 62764 - DNA, 235 bp, Homo sapiens; identical to SEQ ID NO: 42300
  chr9:138393554-138393789
  hypo

SEQ ID NO: 62765 - DNA, 30 bp, Homo sapiens; identical to SEQ ID NO: 42301
  chr9:138416397-138416427
  hypo

SEQ ID NO: 62766 - DNA, 30 bp, Homo sapiens; identical to SEQ ID NO: 42302
  chr9:138506224-138506254
  hypo

SEQ ID NO: 62767 - DNA, 123 bp, Homo sapiens; identical to SEQ ID NO: 42303
  chr9:138557664-138557787
  hypo

SEQ ID NO: 62768 - DNA, 78 bp, Homo sapiens; identical to SEQ ID NO: 42304
  chr9:138562725-138562803
  hypo

SEQ ID NO: 62769 - DNA, 30 bp, Homo sapiens; identical to SEQ ID NO: 42306
  chr9:138577404-138577434
  hypo

SEQ ID NO: 62770 - DNA, 168 bp, Homo sapiens; identical to SEQ ID NO: 42307
  chr9:138577710-138577878
  hypo

SEQ ID NO: 62771 - DNA, 30 bp, Homo sapiens; identical to SEQ ID NO: 42308
  chr9:138587151-138587181
  hypo

SEQ ID NO: 62772 - DNA, 30 bp, Homo sapiens; identical to SEQ ID NO: 42309
  chr9:138591441-138591471
  hypo

SEQ ID NO: 62773 - DNA, 30 bp, Homo sapiens; identical to SEQ ID NO: 42310
  chr9:138598276-138598306
  hypo

SEQ ID NO: 62774 - DNA, 21 bp, Homo sapiens
  chr9:138627615-138627636
  hypo
gagggctctgccacccggcac

SEQ ID NO: 62775 - DNA, 50 bp, Homo sapiens; identical to SEQ ID NO: 42312
  chr9:138634173-138634223
  hypo

SEQ ID NO: 62776 - DNA, 30 bp, Homo sapiens; identical to SEQ ID NO: 42313
  chr9:138637950-138637980
  hypo

SEQ ID NO: 62777 - DNA, 30 bp, Homo sapiens; identical to SEQ ID NO: 42314
  chr9:138642836-138642866
  hypo

SEQ ID NO: 62778 - DNA, 48 bp, Homo sapiens; identical to SEQ ID NO: 42315
  chr9:138650116-138650164
  hypo

SEQ ID NO: 62779 - DNA, 30 bp, Homo sapiens; identical to SEQ ID NO: 42316
  chr9:138651295-138651325
  hypo

SEQ ID NO: 62780 - DNA, 39 bp, Homo sapiens; identical to SEQ ID NO: 42317
  chr9:138651662-138651701
  hypo

SEQ ID NO: 62781 - DNA, 30 bp, Homo sapiens; identical to SEQ ID NO: 42318
  chr9:138655771-138655801
  hypo

SEQ ID NO: 62782 - DNA, 73 bp, Homo sapiens
  chr9:138659727-138659800
  hypo
gctcccactcagggccgtggccaggagaagctgtcagctggtgtctccaggacacaccatccatagcatctga

SEQ ID NO: 62783 - DNA, 62 bp, Homo sapiens
  chr9:138659905-138659967
  hypo
tgtggctcctgaaccctgcccccaccctctgtcagcctgcacacgctcgggggacaggtgtg

SEQ ID NO: 62784 - DNA, 172 bp, Homo sapiens
  chr9:138660771-138660943
  hypo
tcaagtttgctggtgcgtctggggcacacgtgggtgatggtgtatctggggcagggcacgtgtgcacacgtgggtgatggtgcatctggggcagggcgcatgtgcacatgtgtgacggtgcgtctggggcaggacgcgtgtgcacacgtgggtgacggtgcgtctggggcag

SEQ ID NO: 62785 - DNA, 198 bp, Homo sapiens
  chr9:138661012-138661210
  hypo
gtctggggcagggcgcgtgtgcacacgtgggtgacagtgcatctggggcagggcacgtgtgcacgtgtgtgtcggtgtgtctggggcagggcgcgtgtgcatgctgttgggtgatggtgcgtctggggcagggcgcgtgtgcacacgtgggtgacggtgtgtctggggcagggcgcatgtgcacgcagttaggcgagc

SEQ ID NO: 62786 - DNA, 220 bp, Homo sapiens
  chr9:138661428-138661648
  hypo
gggcagggaccatgccgggtgcccggggaacggggggcaggccccatgccaggtgcccaggggacaggggtcagggcccacatggagtgcccaaggcacaggggccagggcctgccccgccctggaactcctcgctgagctgggagagaagcacaggagcgatggaaggtccaccgaggctcagaccaagtagggggttgaggtccacagactctcgggg

SEQ ID NO: 62787 - DNA, 71 bp, Homo sapiens
  chr9:138661870-138661941
  hypo
tcaccctgctggtgcacacgtcccgcggccagtgagtgccccgtgccccgggggaccgacctccatggcgg

SEQ ID NO: 62788 - DNA, 45 bp, Homo sapiens
  chr9:138666558-138666603
  hypo
atttctgtgcgcatgtgttgtgtgtgtgtccgggtgtgtccattt

SEQ ID NO: 62789 - DNA, 73 bp, Homo sapiens; identical to SEQ ID NO: 42323
  chr9:138671215-138671288
  hypo

SEQ ID NO: 62790 - DNA, 50 bp, Homo sapiens; identical to SEQ ID NO: 42324
  chr9:138675763-138675813
  hypo

SEQ ID NO: 62791 - DNA, 38 bp, Homo sapiens; identical to SEQ ID NO: 42325
  chr9:138678379-138678417
  hypo

SEQ ID NO: 62792 - DNA, 74 bp, Homo sapiens; identical to SEQ ID NO: 42326
  chr9:138743697-138743771
  hypo

SEQ ID NO: 62793 - DNA, 284 bp, Homo sapiens; identical to SEQ ID NO: 42327
  chr9:138780586-138780870
  hypo

SEQ ID NO: 62794 - DNA, 30 bp, Homo sapiens; identical to SEQ ID NO: 42328
  chr9:138781904-138781934
  hypo

SEQ ID NO: 62795 - DNA, 66 bp, Homo sapiens; identical to SEQ ID NO: 42329
  chr9:138831936-138832002
  hypo

SEQ ID NO: 62796 - DNA, 30 bp, Homo sapiens; identical to SEQ ID NO: 42330
  chr9:138851606-138851636
  hypo

SEQ ID NO: 62797 - DNA, 30 bp, Homo sapiens; identical to SEQ ID NO: 42331
  chr9:138873468-138873498
  hypo

SEQ ID NO: 62798 - DNA, 87 bp, Homo sapiens; identical to SEQ ID NO: 42332
  chr9:138994353-138994440
  hypo

SEQ ID NO: 62799 - DNA, 170 bp, Homo sapiens
  chr9:139000396-139000566
  hypo
aggcctgtcccatcccgagggaggcagatcctggctggagctggcggagacttacggccacaccctgccaaggtgtgcccactgggacccgggcccagcctgtcacggcgcctctccctgtgccatccgccagcccaggcttgattgagctccatatgaatattcataca

SEQ ID NO: 62800 - DNA, 99 bp, Homo sapiens; identical to SEQ ID NO: 42336
  chr9:139077555-139077654
  hypo

SEQ ID NO: 62801 - DNA, 141 bp, Homo sapiens; identical to SEQ ID NO: 42337
  chr9:139078960-139079101
  hypo

SEQ ID NO: 62802 - DNA, 30 bp, Homo sapiens; identical to SEQ ID NO: 15282
  chr9:139100397-139100427
  hypo

SEQ ID NO: 62803 - DNA, 40 bp, Homo sapiens; identical to SEQ ID NO: 42339
  chr9:139103561-139103601
  hypo

SEQ ID NO: 62804 - DNA, 30 bp, Homo sapiens; identical to SEQ ID NO: 42341
  chr9:139133153-139133183
  hypo

SEQ ID NO: 62805 - DNA, 136 bp, Homo sapiens; identical to SEQ ID NO: 42342
  chr9:139265293-139265429
  hypo

SEQ ID NO: 62806 - DNA, 30 bp, Homo sapiens; identical to SEQ ID NO: 42343
  chr9:139268822-139268852
  hypo

SEQ ID NO: 62807 - DNA, 65 bp, Homo sapiens; identical to SEQ ID NO: 42344
  chr9:139317772-139317837
  hypo

SEQ ID NO: 62808 - DNA, 28 bp, Homo sapiens
  chr9:139375871-139375899
  hypo
gagccaccgcgcccggcccagggaattt

SEQ ID NO: 62809 - DNA, 30 bp, Homo sapiens; identical to SEQ ID NO: 42346
  chr9:139412504-139412534
  hypo

SEQ ID NO: 62810 - DNA, 30 bp, Homo sapiens; identical to SEQ ID NO: 42347
  chr9:139419942-139419972
  hypo

SEQ ID NO: 62811 - DNA, 23 bp, Homo sapiens
  chr9:139421932-139421955
  hypo
cttccatgagtgacccgcacccc

SEQ ID NO: 62812 - DNA, 128 bp, Homo sapiens
  chr9:139421985-139422113
  hypo
caggggcggtggggagacccctctggggctaaaaagtgaggcttgagatagggaacgccagtctcccccgactggacgagagagctgccctgtccaccaagccacccagctctcgggctcccacggag

SEQ ID NO: 62813 - DNA, 40 bp, Homo sapiens; identical to SEQ ID NO: 15284
  chr9:139472499-139472539
  hypo

SEQ ID NO: 62814 - DNA, 30 bp, Homo sapiens; identical to SEQ ID NO: 42350
  chr9:139487465-139487495
  hypo

SEQ ID NO: 62815 - DNA, 30 bp, Homo sapiens; identical to SEQ ID NO: 42351
  chr9:139504374-139504404
  hypo

SEQ ID NO: 62816 - DNA, 157 bp, Homo sapiens; identical to SEQ ID NO: 42352
  chr9:139504823-139504980
  hypo

SEQ ID NO: 62817 - DNA, 101 bp, Homo sapiens; identical to SEQ ID NO: 42353
  chr9:139505621-139505722
  hypo

SEQ ID NO: 62818 - DNA, 76 bp, Homo sapiens; identical to SEQ ID NO: 42354
  chr9:139506440-139506516
  hypo

SEQ ID NO: 62819 - DNA, 30 bp, Homo sapiens; identical to SEQ ID NO: 42355
  chr9:139517238-139517268
  hypo

SEQ ID NO: 62820 - DNA, 46 bp, Homo sapiens; identical to SEQ ID NO: 42356
  chr9:139546557-139546603
  hypo

SEQ ID NO: 62821 - DNA, 51 bp, Homo sapiens; identical to SEQ ID NO: 15286
  chr9:139634047-139634098
  hypo

SEQ ID NO: 62822 - DNA, 130 bp, Homo sapiens; identical to SEQ ID NO: 42358
  chr9:139638401-139638531
  hypo

SEQ ID NO: 62823 - DNA, 138 bp, Homo sapiens; identical to SEQ ID NO: 42359
  chr9:139654706-139654844
  hypo

SEQ ID NO: 62824 - DNA, 30 bp, Homo sapiens; identical to SEQ ID NO: 42360
  chr9:139662292-139662322
  hypo

SEQ ID NO: 62825 - DNA, 267 bp, Homo sapiens
  chr9:139698658-139698925
  hypo
ggctgaatgcacttccgtgagttctaggtggacctggccaggaggcagctgggggccagcggctggagggcagcagagcgtctgggctggcacatgctctgaggcatgggcaaggagggccgtgagctgaggggccacgggcacaagtggtttaggaaaagggtgtggccattggccggggatgcagttccaaagtctagtaaggtgagcatggccaaccgcccgctggctttactgccattaggggccttgttgagacagctcccc

SEQ ID NO: 62826 - DNA, 202 bp, Homo sapiens
  chr9:139699051-139699253
  hypo
gaaggagaccagcgagaagtaccgccgggtaagccccaggccagggcctggctggctgcccatccccatgacagctgggtggacacaggctcagggccaccactcagggcccactccctgccaaggatgtctcatcccttccccgcccccacctcccatcagggccagatggacttggacttcccctcgaacctgatgagca

SEQ ID NO: 62827 - DNA, 41 bp, Homo sapiens; identical to SEQ ID NO: 42362
  chr9:139703929-139703970
  hypo

SEQ ID NO: 62828 - DNA, 151 bp, Homo sapiens
  chr9:139704279-139704430
  hypo
acccaagcatcaaaggaacttgtggctggggagaaggcttgactatttgaaatctcaggactcctctgtccaggagctcccagactcccgtggagtggaagcctgggggctcgctgaagaagtcacgtgactggaacgtgcttaatgcttg

SEQ ID NO: 62829 - DNA, 99 bp, Homo sapiens; identical to SEQ ID NO: 42364
  chr9:139705312-139705411
  hypo

SEQ ID NO: 62830 - DNA, 98 bp, Homo sapiens; identical to SEQ ID NO: 42365
  chr9:139714085-139714183
  hypo

SEQ ID NO: 62831 - DNA, 216 bp, Homo sapiens; identical to SEQ ID NO: 42366
  chr9:139717731-139717947
  hypo

SEQ ID NO: 62832 - DNA, 175 bp, Homo sapiens; identical to SEQ ID NO: 42367
  chr9:139734923-139735098
  hypo

SEQ ID NO: 62833 - DNA, 30 bp, Homo sapiens; identical to SEQ ID NO: 42368
  chr9:139779368-139779398
  hypo

SEQ ID NO: 62834 - DNA, 104 bp, Homo sapiens; identical to SEQ ID NO: 42369
  chr9:139794879-139794983
  hypo

SEQ ID NO: 62835 - DNA, 312 bp, Homo sapiens; identical to SEQ ID NO: 42370
  chr9:139809779-139810091
  hypo

SEQ ID NO: 62836 - DNA, 282 bp, Homo sapiens; identical to SEQ ID NO: 42371
  chr9:139818340-139818622
  hypo

SEQ ID NO: 62837 - DNA, 181 bp, Homo sapiens
  chr9:139888764-139888945
  hypo
actggaagtgccctgcggggaggggagcgcctgccccgggacaggattgaggaatgtgccagcccccatccacctggggcaccccgccccaccccggcctgactggtttgggagcccagtccggtcctggagatccctgaggccaccggttgcaggaggcctggagtctgcgccttcttag

SEQ ID NO: 62838 - DNA, 83 bp, Homo sapiens
  chr9:139888980-139889063
  hypo
ctgcccctgtggttctgggctatcgggctgagcgtcccaccctggggtttggggatgggaagtgatcccgagacctctggccc

SEQ ID NO: 62839 - DNA, 30 bp, Homo sapiens; identical to SEQ ID NO: 42374
  chr9:139904297-139904327
  hypo

SEQ ID NO: 62840 - DNA, 30 bp, Homo sapiens; identical to SEQ ID NO: 42375
  chr9:139913362-139913392
  hypo

SEQ ID NO: 62841 - DNA, 30 bp, Homo sapiens; identical to SEQ ID NO: 42376
  chr9:139916163-139916193
  hypo

SEQ ID NO: 62842 - DNA, 82 bp, Homo sapiens; identical to SEQ ID NO: 42377
  chr9:139978914-139978996
  hypo

SEQ ID NO: 62843 - DNA, 49 bp, Homo sapiens; identical to SEQ ID NO: 42378
  chr9:140030248-140030297
  hypo

SEQ ID NO: 62844 - DNA, 11 bp, Homo sapiens
  chr9:140030528-140030539
  hypo
aggtgctcagt

SEQ ID NO: 62845 - DNA, 40 bp, Homo sapiens; identical to SEQ ID NO: 42380
  chr9:140041778-140041818
  hypo

SEQ ID NO: 62846 - DNA, 119 bp, Homo sapiens; identical to SEQ ID NO: 42381
  chr9:140043219-140043338
  hypo

SEQ ID NO: 62847 - DNA, 30 bp, Homo sapiens; identical to SEQ ID NO: 42382
  chr9:140052371-140052401
  hypo

SEQ ID NO: 62848 - DNA, 196 bp, Homo sapiens; identical to SEQ ID NO: 42383
  chr9:140107128-140107324
  hypo

SEQ ID NO: 62849 - DNA, 177 bp, Homo sapiens; identical to SEQ ID NO: 42384
  chr9:140108225-140108402
  hypo

SEQ ID NO: 62850 - DNA, 30 bp, Homo sapiens; identical to SEQ ID NO: 42385
  chr9:140115123-140115153
  hypo

SEQ ID NO: 62851 - DNA, 229 bp, Homo sapiens
  chr9:140127654-140127883
  hypo
ccacagggctttcagcggctcggcggtgcacgggatcttcaactggctcacagtgctggtcctgctgccactggagagcgccacggccctgctggagaggctaagtgagctagccctgggtgccgccagcctgacacccagggcgcaggcgcccgacatcctcaaggtgctgacgaagccgctcacacacctcatcgtgcaggtgaggacggccaccgcccccgcccag

SEQ ID NO: 62852 - DNA, 90 bp, Homo sapiens
  chr9:140128080-140128170
  hypo
ccagttggactccgacatgatcatgagcagtgccacaggcaacgccactaacagcagtctcattaagcactggtgcggcaccacggggca

SEQ ID NO: 62853 - DNA, 80 bp, Homo sapiens
  chr9:140137230-140137310
  hypo
ctcagtccaccagctcgtagaaaacacagacgagacctactgcattgataacgaagctctctacgacatttgcttcagaa

SEQ ID NO: 62854 - DNA, 180 bp, Homo sapiens; identical to SEQ ID NO: 42388
  chr9:140137557-140137737
  hypo

SEQ ID NO: 62855 - DNA, 30 bp, Homo sapiens; identical to SEQ ID NO: 42389
  chr9:140140759-140140789
  hypo

SEQ ID NO: 62856 - DNA, 54 bp, Homo sapiens; identical to SEQ ID NO: 42390
  chr9:140144171-140144225
  hypo

SEQ ID NO: 62857 - DNA, 56 bp, Homo sapiens; identical to SEQ ID NO: 42391
  chr9:140147052-140147108
  hypo

SEQ ID NO: 62858 - DNA, 30 bp, Homo sapiens; identical to SEQ ID NO: 42392
  chr9:140167020-140167050
  hypo

SEQ ID NO: 62859 - DNA, 30 bp, Homo sapiens; identical to SEQ ID NO: 42393
  chr9:140198590-140198620
  hypo

SEQ ID NO: 62860 - DNA, 207 bp, Homo sapiens
  chr9:140245670-140245877
  hypo
acccagcaccctccccggggcacacggagggaagggtcaggcaggggtgcgggctgctttctttctggactgggcagggggccccagggcttcactcacccagcttggtgatagaggggtccgagaggagctgggccaccagccgggaaaaggcctgggctccctgccctgttggtggctgcgagagtgccaggacgtccagaagga

SEQ ID NO: 62861 - DNA, 120 bp, Homo sapiens; identical to SEQ ID NO: 42395
  chr9:140265734-140265854
  hypo

SEQ ID NO: 62862 - DNA, 30 bp, Homo sapiens; identical to SEQ ID NO: 42396
  chr9:140266433-140266463
  hypo

SEQ ID NO: 62863 - DNA, 61 bp, Homo sapiens; identical to SEQ ID NO: 15304
  chr9:140267262-140267323
  hypo

SEQ ID NO: 62864 - DNA, 158 bp, Homo sapiens; identical to SEQ ID NO: 42398
  chr9:140274104-140274262
  hypo

SEQ ID NO: 62865 - DNA, 30 bp, Homo sapiens; identical to SEQ ID NO: 42399
  chr9:140274632-140274662
  hypo

SEQ ID NO: 62866 - DNA, 30 bp, Homo sapiens; identical to SEQ ID NO: 42400
  chr9:140325615-140325645
  hypo

SEQ ID NO: 62867 - DNA, 30 bp, Homo sapiens; identical to SEQ ID NO: 42401
  chr9:140327964-140327994
  hypo

SEQ ID NO: 62868 - DNA, 41 bp, Homo sapiens; identical to SEQ ID NO: 42402
  chr9:140332500-140332541
  hypo

SEQ ID NO: 62869 - DNA, 128 bp, Homo sapiens
  chr9:140333018-140333146
  hypo
ctcccgtggccatagaggcatccccggggctcagacggcctcccgtggccatagaggcatccccggggctcagacggtctcccgtggccatagaggcatccccggggctcagacgcctcccgtggcca

SEQ ID NO: 62870 - DNA, 48 bp, Homo sapiens; identical to SEQ ID NO: 42404
  chr9:140352105-140352153
  hypo

SEQ ID NO: 62871 - DNA, 29 bp, Homo sapiens
  chr9:140382596-140382625
  hypo
ctgatgtctcgtcccgagcttcacttgca

SEQ ID NO: 62872 - DNA, 178 bp, Homo sapiens; identical to SEQ ID NO: 42406
  chr9:140389309-140389487
  hypo

SEQ ID NO: 62873 - DNA, 77 bp, Homo sapiens; identical to SEQ ID NO: 24613
  chr9:140392377-140392454
  hypo

SEQ ID NO: 62874 - DNA, 157 bp, Homo sapiens
  chr9:140392484-140392641
  hypo
cggtaaccgtgctttgcccatccccagctcctgcatgccagggcagcatggatgcggagtgtgtggcacccacggcctcacctgtatattgctcgcccggcctccacctccacccagtccagggcaaagtcgatttgccgcacgaaggacgacatcc

SEQ ID NO: 62875 - DNA, 167 bp, Homo sapiens; identical to SEQ ID NO: 15310
  chr9:140396560-140396727
  hypo

SEQ ID NO: 62876 - DNA, 71 bp, Homo sapiens; identical to SEQ ID NO: 15312
  chr9:140400208-140400279
  hypo

SEQ ID NO: 62877 - DNA, 30 bp, Homo sapiens; identical to SEQ ID NO: 42411
  chr9:140401540-140401570
  hypo

SEQ ID NO: 62878 - DNA, 30 bp, Homo sapiens; identical to SEQ ID NO: 42413
  chr9:140508520-140508550
  hypo

SEQ ID NO: 62879 - DNA, 23 bp, Homo sapiens
  chr9:140511850-140511873
  hypo
accgcacccggcccagtcaacaa

SEQ ID NO: 62880 - DNA, 152 bp, Homo sapiens; identical to SEQ ID NO: 42415
  chr9:140512180-140512332
  hypo

SEQ ID NO: 62881 - DNA, 33 bp, Homo sapiens; identical to SEQ ID NO: 42416
  chr9:140615444-140615477
  hypo

SEQ ID NO: 62882 - DNA, 207 bp, Homo sapiens; identical to SEQ ID NO: 42417
  chr9:140657710-140657917
  hypo

SEQ ID NO: 62883 - DNA, 76 bp, Homo sapiens; identical to SEQ ID NO: 42418
  chr9:140664584-140664660
  hypo

SEQ ID NO: 62884 - DNA, 45 bp, Homo sapiens; identical to SEQ ID NO: 15313
  chr9:140680320-140680365
  hypo

SEQ ID NO: 62885 - DNA, 34 bp, Homo sapiens; identical to SEQ ID NO: 42420
  chr9:140682888-140682922
  hypo

SEQ ID NO: 62886 - DNA, 30 bp, Homo sapiens; identical to SEQ ID NO: 42421
  chr9:140693933-140693963
  hypo

SEQ ID NO: 62887 - DNA, 60 bp, Homo sapiens
  chr9:140708986-140709046
  hypo
tcaggtggtaagtgccgctggtccgggtctgcaaaaacagtgcaggcgtctgtgacccca

SEQ ID NO: 62888 - DNA, 60 bp, Homo sapiens; identical to SEQ ID NO: 42423
  chr9:140727525-140727585
  hypo

SEQ ID NO: 62889 - DNA, 82 bp, Homo sapiens; identical to SEQ ID NO: 42424
  chr9:140770013-140770095
  hypo

SEQ ID NO: 62890 - DNA, 37 bp, Homo sapiens; identical to SEQ ID NO: 42425
  chr9:140793786-140793823
  hypo

SEQ ID NO: 62891 - DNA, 58 bp, Homo sapiens; identical to SEQ ID NO: 42426
  chr9:140969282-140969340
  hypo

SEQ ID NO: 62892 - DNA, 177 bp, Homo sapiens; identical to SEQ ID NO: 42427
  chr9:141022582-141022759
  hypo

SEQ ID NO: 62893 - DNA, 30 bp, Homo sapiens; identical to SEQ ID NO: 42428
  chr10:482288-482318
  hypo

SEQ ID NO: 62894 - DNA, 60 bp, Homo sapiens; identical to SEQ ID NO: 42429
  chr10:524611-524671
  hypo

SEQ ID NO: 62895 - DNA, 35 bp, Homo sapiens; identical to SEQ ID NO: 42430
  chr10:769828-769863
  hypo

SEQ ID NO: 62896 - DNA, 44 bp, Homo sapiens; identical to SEQ ID NO: 42432
  chr10:851432-851476
  hypo

SEQ ID NO: 62897 - DNA, 67 bp, Homo sapiens
  chr10:978811-978878
  hypo
ctgggatcaaggccccggcccttccccaaacccccaacccacacccgggaccaaaaggccccggccc

SEQ ID NO: 62898 - DNA, 72 bp, Homo sapiens
  chr10:978933-979005
  hypo
tggtagctcagggaggtgttcacactcctgccgtttccgtgaggatggtgacgactccgaactatagcagca

SEQ ID NO: 62899 - DNA, 149 bp, Homo sapiens; identical to SEQ ID NO: 42434
  chr10:1156723-1156872
  hypo

SEQ ID NO: 62900 - DNA, 52 bp, Homo sapiens; identical to SEQ ID NO: 42435
  chr10:1209169-1209221
  hypo

SEQ ID NO: 62901 - DNA, 132 bp, Homo sapiens; identical to SEQ ID NO: 42436
  chr10:1233108-1233240
  hypo

SEQ ID NO: 62902 - DNA, 30 bp, Homo sapiens; identical to SEQ ID NO: 42437
  chr10:1248527-1248557
  hypo

SEQ ID NO: 62903 - DNA, 41 bp, Homo sapiens; identical to SEQ ID NO: 42438
  chr10:1252314-1252355
  hypo

SEQ ID NO: 62904 - DNA, 221 bp, Homo sapiens; identical to SEQ ID NO: 42439
  chr10:1259797-1260018
  hypo

SEQ ID NO: 62905 - DNA, 30 bp, Homo sapiens; identical to SEQ ID NO: 42440
  chr10:1438451-1438481
  hypo

SEQ ID NO: 62906 - DNA, 127 bp, Homo sapiens; identical to SEQ ID NO: 42441
  chr10:1506252-1506379
  hypo

SEQ ID NO: 62907 - DNA, 30 bp, Homo sapiens; identical to SEQ ID NO: 42442
  chr10:1555620-1555650
  hypo

SEQ ID NO: 62908 - DNA, 40 bp, Homo sapiens; identical to SEQ ID NO: 42443
  chr10:1558592-1558632
  hypo

SEQ ID NO: 62909 - DNA, 46 bp, Homo sapiens; identical to SEQ ID NO: 42444
  chr10:1585353-1585399
  hypo

SEQ ID NO: 62910 - DNA, 140 bp, Homo sapiens; identical to SEQ ID NO: 42445
  chr10:1669194-1669334
  hypo

SEQ ID NO: 62911 - DNA, 180 bp, Homo sapiens; identical to SEQ ID NO: 42446
  chr10:1716300-1716480
  hypo

SEQ ID NO: 62912 - DNA, 90 bp, Homo sapiens; identical to SEQ ID NO: 42447
  chr10:1850230-1850320
  hypo

SEQ ID NO: 62913 - DNA, 80 bp, Homo sapiens; identical to SEQ ID NO: 42448
  chr10:1995028-1995108
  hypo

SEQ ID NO: 62914 - DNA, 30 bp, Homo sapiens; identical to SEQ ID NO: 15322
  chr10:2283030-2283060
  hypo

SEQ ID NO: 62915 - DNA, 102 bp, Homo sapiens; identical to SEQ ID NO: 42450
  chr10:2452926-2453028
  hypo

SEQ ID NO: 62916 - DNA, 30 bp, Homo sapiens; identical to SEQ ID NO: 42451
  chr10:2706731-2706761
  hypo

SEQ ID NO: 62917 - DNA, 193 bp, Homo sapiens; identical to SEQ ID NO: 42452
  chr10:2758979-2759172
  hypo

SEQ ID NO: 62918 - DNA, 30 bp, Homo sapiens; identical to SEQ ID NO: 42453
  chr10:2775311-2775341
  hypo

SEQ ID NO: 62919 - DNA, 78 bp, Homo sapiens; identical to SEQ ID NO: 15323
  chr10:3161042-3161120
  hypo

SEQ ID NO: 62920 - DNA, 84 bp, Homo sapiens; identical to SEQ ID NO: 42455
  chr10:3216467-3216551
  hypo

SEQ ID NO: 62921 - DNA, 19 bp, Homo sapiens
  chr10:3285550-3285569
  hypo
agccaggcgtgctggcgct

SEQ ID NO: 62922 - DNA, 70 bp, Homo sapiens
  chr10:3285698-3285768
  hypo
taacaataaatagcaaacagcagagagcatcatcttaaggttttgaaaatacatacgtattactattatg

SEQ ID NO: 62923 - DNA, 74 bp, Homo sapiens; identical to SEQ ID NO: 42458
  chr10:3329710-3329784
  hypo

SEQ ID NO: 62924 - DNA, 72 bp, Homo sapiens
  chr10:3330427-3330499
  hypo
agcgagcaggtgccacgtccacaccgggtgaggcgtgaggtgagggctcccccgcgccgccctggcgtccag

SEQ ID NO: 62925 - DNA, 9 bp, Homo sapiens
  chr10:3641413-3641422
  hypo
atgaggtca

SEQ ID NO: 62926 - DNA, 195 bp, Homo sapiens
  chr10:3678637-3678832
  hypo
gagatgtttttatgtggttcaccttcgaccttcatcagggtgactcaggaggcacattctgaagccactctccaacacttaagttttttgccaggtatttttcacaaagcaacgatttgaacaatgaaggagaaaatgtagcctcgcaacttcattcgtaaataatccagactaaccgcacggagtataatggat

SEQ ID NO: 62927 - DNA, 56 bp, Homo sapiens
  chr10:3895354-3895410
  hypo
gttcccaccacacagcggcggctcaactgcccaggctgtggggtttccagctgtgt

SEQ ID NO: 62928 - DNA, 128 bp, Homo sapiens
  chr10:4599789-4599917
  hypo
aagcgtttcacagtgcggtgacgatgggatccgcccatgtttgcacgtgccaggagcagcggtagcagcagctccagggaggtgcacacttgtcagcggcagtggggtgctggcgggtgccagagggc

SEQ ID NO: 62929 - DNA, 40 bp, Homo sapiens
  chr10:4599965-4600005
  hypo
ggtggagggcctgctggcagctgtgcgtgcagtgacactg

SEQ ID NO: 62930 - DNA, 185 bp, Homo sapiens; identical to SEQ ID NO: 42464
  chr10:5507960-5508145
  hypo

SEQ ID NO: 62931 - DNA, 30 bp, Homo sapiens; identical to SEQ ID NO: 42465
  chr10:5523260-5523290
  hypo

SEQ ID NO: 62932 - DNA, 70 bp, Homo sapiens; identical to SEQ ID NO: 42467
  chr10:5531049-5531119
  hypo

SEQ ID NO: 62933 - DNA, 48 bp, Homo sapiens; identical to SEQ ID NO: 42468
  chr10:5538890-5538938
  hypo

SEQ ID NO: 62934 - DNA, 877 bp, Homo sapiens; identical to SEQ ID NO: 42469
  chr10:5540651-5541528
  hypo

SEQ ID NO: 62935 - DNA, 47 bp, Homo sapiens; identical to SEQ ID NO: 42470
  chr10:5553281-5553328
  hypo

SEQ ID NO: 62936 - DNA, 74 bp, Homo sapiens; identical to SEQ ID NO: 42471
  chr10:5567136-5567210
  hypo

SEQ ID NO: 62937 - DNA, 30 bp, Homo sapiens; identical to SEQ ID NO: 42472
  chr10:5588268-5588298
  hypo

SEQ ID NO: 62938 - DNA, 160 bp, Homo sapiens; identical to SEQ ID NO: 42473
  chr10:5868078-5868238
  hypo

SEQ ID NO: 62939 - DNA, 365 bp, Homo sapiens
  chr10:5874775-5875140
  hypo
tcagcagttcaaaaccgtgctgacctgccagtacaagcaggccttgaggtcagtaaaaggtaacattacagacatcaaaagcaaattaaaaacccacagcctcagagaataactcctgatgccagctccttctcatggcaccccctgccccatcccaccagtgtcaggtcacaaagccccacactgcgccgggtggggatttaagattcccgctcccccacccctgccaccctgtagaacaaggcgctgccactcaagccagttccctgagaaccagtcggaccaggacaggcccctgaccacacccggcaaactggagtcctggccaaaggtgctgtgagtccatgaggtgctggcagggaggt

SEQ ID NO: 62940 - DNA, 48 bp, Homo sapiens; identical to SEQ ID NO: 42475
  chr10:5952951-5952999
  hypo

SEQ ID NO: 62941 - DNA, 21 bp, Homo sapiens
  chr10:6009743-6009764
  hypo
gggtgcggtagctcacgcctg

SEQ ID NO: 62942 - DNA, 30 bp, Homo sapiens; identical to SEQ ID NO: 42478
  chr10:6024581-6024611
  hypo

SEQ ID NO: 62943 - DNA, 24 bp, Homo sapiens
  chr10:6127024-6127048
  hypo
gagccaccgcgcccagccttcttt

SEQ ID NO: 62944 - DNA, 159 bp, Homo sapiens; identical to SEQ ID NO: 42481
  chr10:6159807-6159966
  hypo

SEQ ID NO: 62945 - DNA, 21 bp, Homo sapiens
  chr10:6162138-6162159
  hypo
ttttatggcacttgacgctgg

SEQ ID NO: 62946 - DNA, 24 bp, Homo sapiens
  chr10:6199196-6199220
  hypo
tttttttttttgagacggagtctc

SEQ ID NO: 62947 - DNA, 133 bp, Homo sapiens; identical to SEQ ID NO: 42484
  chr10:6462190-6462323
  hypo

SEQ ID NO: 62948 - DNA, 186 bp, Homo sapiens; identical to SEQ ID NO: 42485
  chr10:6505370-6505556
  hypo

SEQ ID NO: 62949 - DNA, 30 bp, Homo sapiens; identical to SEQ ID NO: 42486
  chr10:6528008-6528038
  hypo

SEQ ID NO: 62950 - DNA, 140 bp, Homo sapiens; identical to SEQ ID NO: 42487
  chr10:6531036-6531176
  hypo

SEQ ID NO: 62951 - DNA, 15 bp, Homo sapiens
  chr10:6564170-6564185
  hypo
cgggattacaagagt

SEQ ID NO: 62952 - DNA, 88 bp, Homo sapiens
  chr10:6577673-6577761
  hypo
tcttggtcttttgaagtctcccctcgccgcgcctctttagacgcacctgagatccatcaaagcggacagatcccgattacagtcccct

SEQ ID NO: 62953 - DNA, 21 bp, Homo sapiens
  chr10:6586866-6586887
  hypo
ccactgcgcccagacccacat

SEQ ID NO: 62954 - DNA, 171 bp, Homo sapiens; identical to SEQ ID NO: 42491
  chr10:7139938-7140109
  hypo

SEQ ID NO: 62955 - DNA, 65 bp, Homo sapiens; identical to SEQ ID NO: 42492
  chr10:7203062-7203127
  hypo

SEQ ID NO: 62956 - DNA, 28 bp, Homo sapiens
  chr10:7205705-7205733
  hypo
taatgggccacctcccgagggcagactc

SEQ ID NO: 62957 - DNA, 45 bp, Homo sapiens
  chr10:7213064-7213109
  hypo
gctgggtcctctccagcactctccaggcctcggccgttcctggcc

SEQ ID NO: 62958 - DNA, 30 bp, Homo sapiens; identical to SEQ ID NO: 15344
  chr10:7213658-7213688
  hypo

SEQ ID NO: 62959 - DNA, 108 bp, Homo sapiens; identical to SEQ ID NO: 42496
  chr10:7214167-7214275
  hypo

SEQ ID NO: 62960 - DNA, 30 bp, Homo sapiens; identical to SEQ ID NO: 42497
  chr10:7215974-7216004
  hypo

SEQ ID NO: 62961 - DNA, 121 bp, Homo sapiens
  chr10:7236090-7236211
  hypo
cgccaaggcctgcttcgttctgagtttgcttatggggtacgtctggacctcagtggaccattgagtgactctggttccagcttctcccaggtcccctacctcccctcgctgcaccccctcg

SEQ ID NO: 62962 - DNA, 30 bp, Homo sapiens; identical to SEQ ID NO: 42499
  chr10:7258531-7258561
  hypo

SEQ ID NO: 62963 - DNA, 22 bp, Homo sapiens
  chr10:7288388-7288410
  hypo
gaatgtgagagaggccgggtgc

SEQ ID NO: 62964 - DNA, 37 bp, Homo sapiens; identical to SEQ ID NO: 42501
  chr10:7290469-7290506
  hypo

SEQ ID NO: 62965 - DNA, 70 bp, Homo sapiens; identical to SEQ ID NO: 42502
  chr10:7339992-7340062
  hypo

SEQ ID NO: 62966 - DNA, 30 bp, Homo sapiens; identical to SEQ ID NO: 42503
  chr10:7391910-7391940
  hypo

SEQ ID NO: 62967 - DNA, 23 bp, Homo sapiens
  chr10:7414166-7414189
  hypo
gccacgcccggccttcttgaaat

SEQ ID NO: 62968 - DNA, 34 bp, Homo sapiens; identical to SEQ ID NO: 42506
  chr10:7472551-7472585
  hypo

SEQ ID NO: 62969 - DNA, 30 bp, Homo sapiens; identical to SEQ ID NO: 42507
  chr10:7608124-7608154
  hypo

SEQ ID NO: 62970 - DNA, 58 bp, Homo sapiens; identical to SEQ ID NO: 42508
  chr10:7765067-7765125
  hypo

SEQ ID NO: 62971 - DNA, 30 bp, Homo sapiens; identical to SEQ ID NO: 42509
  chr10:7780425-7780455
  hypo

SEQ ID NO: 62972 - DNA, 34 bp, Homo sapiens; identical to SEQ ID NO: 42510
  chr10:7985160-7985194
  hypo

SEQ ID NO: 62973 - DNA, 30 bp, Homo sapiens; identical to SEQ ID NO: 42511
  chr10:8025070-8025100
  hypo

SEQ ID NO: 62974 - DNA, 30 bp, Homo sapiens; identical to SEQ ID NO: 42512
  chr10:8067803-8067833
  hypo

SEQ ID NO: 62975 - DNA, 30 bp, Homo sapiens; identical to SEQ ID NO: 42513
  chr10:10770967-10770997
  hypo

SEQ ID NO: 62976 - DNA, 35 bp, Homo sapiens; identical to SEQ ID NO: 42514
  chr10:10867443-10867478
  hypo

SEQ ID NO: 62977 - DNA, 30 bp, Homo sapiens; identical to SEQ ID NO: 42515
  chr10:11344374-11344404
  hypo

SEQ ID NO: 62978 - DNA, 136 bp, Homo sapiens; identical to SEQ ID NO: 42516
  chr10:11357646-11357782
  hypo

SEQ ID NO: 62979 - DNA, 151 bp, Homo sapiens; identical to SEQ ID NO: 42517
  chr10:11472842-11472993
  hypo

SEQ ID NO: 62980 - DNA, 30 bp, Homo sapiens; identical to SEQ ID NO: 42518
  chr10:11486576-11486606
  hypo

SEQ ID NO: 62981 - DNA, 30 bp, Homo sapiens; identical to SEQ ID NO: 42519
  chr10:12139715-12139745
  hypo

SEQ ID NO: 62982 - DNA, 47 bp, Homo sapiens; identical to SEQ ID NO: 42520
  chr10:12531976-12532023
  hypo

SEQ ID NO: 62983 - DNA, 29 bp, Homo sapiens
  chr10:12554507-12554536
  hypo
cctcagcagctgcccgttgggagactcgg

SEQ ID NO: 62984 - DNA, 30 bp, Homo sapiens; identical to SEQ ID NO: 42522
  chr10:12844882-12844912
  hypo

SEQ ID NO: 62985 - DNA, 17 bp, Homo sapiens
  chr10:13130744-13130761
  hypo
gggcgcagtggctcacg

SEQ ID NO: 62986 - DNA, 78 bp, Homo sapiens; identical to SEQ ID NO: 42524
  chr10:13137622-13137700
  hypo

SEQ ID NO: 62987 - DNA, 30 bp, Homo sapiens; identical to SEQ ID NO: 42525
  chr10:13140531-13140561
  hypo

SEQ ID NO: 62988 - DNA, 126 bp, Homo sapiens; identical to SEQ ID NO: 15352
  chr10:13355078-13355204
  hypo

SEQ ID NO: 62989 - DNA, 43 bp, Homo sapiens; identical to SEQ ID NO: 42528
  chr10:13426126-13426169
  hypo

SEQ ID NO: 62990 - DNA, 149 bp, Homo sapiens; identical to SEQ ID NO: 42529
  chr10:13751257-13751406
  hypo

SEQ ID NO: 62991 - DNA, 161 bp, Homo sapiens; identical to SEQ ID NO: 42530
  chr10:13898478-13898639
  hypo

SEQ ID NO: 62992 - DNA, 86 bp, Homo sapiens; identical to SEQ ID NO: 42531
  chr10:14997207-14997293
  hypo

SEQ ID NO: 62993 - DNA, 38 bp, Homo sapiens; identical to SEQ ID NO: 42532
  chr10:15000601-15000639
  hypo

SEQ ID NO: 62994 - DNA, 98 bp, Homo sapiens; identical to SEQ ID NO: 42533
  chr10:15003062-15003160
  hypo

SEQ ID NO: 62995 - DNA, 19 bp, Homo sapiens
  chr10:15131223-15131242
  hypo
taaatatgtattggccggg

SEQ ID NO: 62996 - DNA, 30 bp, Homo sapiens; identical to SEQ ID NO: 42535
  chr10:15255872-15255902
  hypo

SEQ ID NO: 62997 - DNA, 30 bp, Homo sapiens; identical to SEQ ID NO: 42536
  chr10:15484112-15484142
  hypo

SEQ ID NO: 62998 - DNA, 25 bp, Homo sapiens
  chr10:15568453-15568478
  hypo
tgtgagccaccgcacccggcccatt

SEQ ID NO: 62999 - DNA, 29 bp, Homo sapiens
  chr10:15783189-15783218
  hypo
tgagccactatgcccggccgtgattatta

SEQ ID NO: 63000 - DNA, 16 bp, Homo sapiens
  chr10:15932019-15932035
  hypo
acgatgccaagcatta

SEQ ID NO: 63001 - DNA, 30 bp, Homo sapiens; identical to SEQ ID NO: 42540
  chr10:16714330-16714360
  hypo

SEQ ID NO: 63002 - DNA, 30 bp, Homo sapiens; identical to SEQ ID NO: 15355
  chr10:16715583-16715613
  hypo

SEQ ID NO: 63003 - DNA, 35 bp, Homo sapiens; identical to SEQ ID NO: 24653
  chr10:17429622-17429657
  hypo

SEQ ID NO: 63004 - DNA, 95 bp, Homo sapiens; identical to SEQ ID NO: 42544
  chr10:17579985-17580080
  hypo

SEQ ID NO: 63005 - DNA, 139 bp, Homo sapiens; identical to SEQ ID NO: 42545
  chr10:20069005-20069144
  hypo

SEQ ID NO: 63006 - DNA, 137 bp, Homo sapiens; identical to SEQ ID NO: 42546
  chr10:22033212-22033349
  hypo

SEQ ID NO: 63007 - DNA, 41 bp, Homo sapiens; identical to SEQ ID NO: 42547
  chr10:22450029-22450070
  hypo

SEQ ID NO: 63008 - DNA, 33 bp, Homo sapiens; identical to SEQ ID NO: 42548
  chr10:22567375-22567408
  hypo

SEQ ID NO: 63009 - DNA, 30 bp, Homo sapiens; identical to SEQ ID NO: 42549
  chr10:22823530-22823560
  hypo

SEQ ID NO: 63010 - DNA, 30 bp, Homo sapiens; identical to SEQ ID NO: 42550
  chr10:22833980-22834010
  hypo

SEQ ID NO: 63011 - DNA, 30 bp, Homo sapiens; identical to SEQ ID NO: 42551
  chr10:22870025-22870055
  hypo

SEQ ID NO: 63012 - DNA, 41 bp, Homo sapiens; identical to SEQ ID NO: 42552
  chr10:24841812-24841853
  hypo

SEQ ID NO: 63013 - DNA, 24 bp, Homo sapiens
  chr10:24842550-24842574
  hypo
caggaaagggccaggcgaggtggc

SEQ ID NO: 63014 - DNA, 30 bp, Homo sapiens; identical to SEQ ID NO: 42554
  chr10:24908432-24908462
  hypo

SEQ ID NO: 63015 - DNA, 42 bp, Homo sapiens; identical to SEQ ID NO: 42555
  chr10:24988521-24988563
  hypo

SEQ ID NO: 63016 - DNA, 148 bp, Homo sapiens; identical to SEQ ID NO: 42556
  chr10:25592447-25592595
  hypo

SEQ ID NO: 63017 - DNA, 32 bp, Homo sapiens; identical to SEQ ID NO: 42557
  chr10:26127993-26128025
  hypo

SEQ ID NO: 63018 - DNA, 30 bp, Homo sapiens; identical to SEQ ID NO: 42558
  chr10:26211012-26211042
  hypo

SEQ ID NO: 63019 - DNA, 80 bp, Homo sapiens; identical to SEQ ID NO: 42559
  chr10:26638401-26638481
  hypo

SEQ ID NO: 63020 - DNA, 30 bp, Homo sapiens; identical to SEQ ID NO: 42560
  chr10:26720842-26720872
  hypo

SEQ ID NO: 63021 - DNA, 132 bp, Homo sapiens; identical to SEQ ID NO: 42561
  chr10:26733284-26733416
  hypo

SEQ ID NO: 63022 - DNA, 30 bp, Homo sapiens; identical to SEQ ID NO: 15362
  chr10:26739045-26739075
  hypo

SEQ ID NO: 63023 - DNA, 21 bp, Homo sapiens
  chr10:26791280-26791301
  hypo
gtctcttgggccaggcgtggt

SEQ ID NO: 63024 - DNA, 39 bp, Homo sapiens; identical to SEQ ID NO: 42564
  chr10:26801561-26801600
  hypo

SEQ ID NO: 63025 - DNA, 99 bp, Homo sapiens; identical to SEQ ID NO: 42565
  chr10:26801660-26801759
  hypo

SEQ ID NO: 63026 - DNA, 20 bp, Homo sapiens
  chr10:26832097-26832117
  hypo
atgtttgttgaatgacggcc

SEQ ID NO: 63027 - DNA, 41 bp, Homo sapiens; identical to SEQ ID NO: 42567
  chr10:26877719-26877760
  hypo

SEQ ID NO: 63028 - DNA, 21 bp, Homo sapiens
  chr10:26907322-26907343
  hypo
agccaccgcacccggcccaaa

SEQ ID NO: 63029 - DNA, 30 bp, Homo sapiens; identical to SEQ ID NO: 15364
  chr10:26926812-26926842
  hypo

SEQ ID NO: 63030 - DNA, 45 bp, Homo sapiens; identical to SEQ ID NO: 42570
  chr10:26942249-26942294
  hypo

SEQ ID NO: 63031 - DNA, 22 bp, Homo sapiens
  chr10:28791009-28791031
  hypo
gccaccacgccctgccagtatg

SEQ ID NO: 63032 - DNA, 30 bp, Homo sapiens; identical to SEQ ID NO: 42572
  chr10:29164934-29164964
  hypo

SEQ ID NO: 63033 - DNA, 32 bp, Homo sapiens; identical to SEQ ID NO: 42573
  chr10:31006068-31006100
  hypo

SEQ ID NO: 63034 - DNA, 41 bp, Homo sapiens
  chr10:31892881-31892922
  hypo
catgctgcaaattcccgtggccagcacccgaggcctgctgg

SEQ ID NO: 63035 - DNA, 10 bp, Homo sapiens
  chr10:31893079-31893089
  hypo
gtccgctcca

SEQ ID NO: 63036 - DNA, 16 bp, Homo sapiens
  chr10:32171091-32171107
  hypo
tcggcctcccaaagtg

SEQ ID NO: 63037 - DNA, 19 bp, Homo sapiens
  chr10:32499025-32499044
  hypo
caaattctccagtcccgcc

SEQ ID NO: 63038 - DNA, 30 bp, Homo sapiens; identical to SEQ ID NO: 42577
  chr10:32638913-32638943
  hypo

SEQ ID NO: 63039 - DNA, 21 bp, Homo sapiens
  chr10:32736537-32736558
  hypo
taaaagggagcagggcgcaca

SEQ ID NO: 63040 - DNA, 30 bp, Homo sapiens; identical to SEQ ID NO: 42579
  chr10:33233494-33233524
  hypo

SEQ ID NO: 63041 - DNA, 31 bp, Homo sapiens; identical to SEQ ID NO: 15367
  chr10:38078895-38078926
  hypo

SEQ ID NO: 63042 - DNA, 61 bp, Homo sapiens; identical to SEQ ID NO: 42581
  chr10:38445833-38445894
  hypo

SEQ ID NO: 63043 - DNA, 30 bp, Homo sapiens; identical to SEQ ID NO: 42582
  chr10:42777495-42777525
  hypo

SEQ ID NO: 63044 - DNA, 30 bp, Homo sapiens; identical to SEQ ID NO: 42583
  chr10:43047017-43047047
  hypo

SEQ ID NO: 63045 - DNA, 36 bp, Homo sapiens; identical to SEQ ID NO: 42584
  chr10:43265217-43265253
  hypo

SEQ ID NO: 63046 - DNA, 30 bp, Homo sapiens; identical to SEQ ID NO: 42585
  chr10:43615515-43615545
  hypo

SEQ ID NO: 63047 - DNA, 24 bp, Homo sapiens
  chr10:43858319-43858343
  hypo
gagtccagtagtcctcgtggagac

SEQ ID NO: 63048 - DNA, 38 bp, Homo sapiens
  chr10:43905839-43905877
  hypo
gccctgtcattcaggcgggagtgcagtggtacaatcac

SEQ ID NO: 63049 - DNA, 44 bp, Homo sapiens; identical to SEQ ID NO: 42588
  chr10:43906064-43906108
  hypo

SEQ ID NO: 63050 - DNA, 118 bp, Homo sapiens; identical to SEQ ID NO: 42589
  chr10:44197833-44197951
  hypo

SEQ ID NO: 63051 - DNA, 30 bp, Homo sapiens; identical to SEQ ID NO: 42590
  chr10:44433895-44433925
  hypo

SEQ ID NO: 63052 - DNA, 37 bp, Homo sapiens; identical to SEQ ID NO: 42591
  chr10:44500784-44500821
  hypo

SEQ ID NO: 63053 - DNA, 86 bp, Homo sapiens; identical to SEQ ID NO: 42592
  chr10:44547328-44547414
  hypo

SEQ ID NO: 63054 - DNA, 38 bp, Homo sapiens; identical to SEQ ID NO: 42593
  chr10:44594208-44594246
  hypo

SEQ ID NO: 63055 - DNA, 34 bp, Homo sapiens; identical to SEQ ID NO: 42594
  chr10:44869035-44869069
  hypo

SEQ ID NO: 63056 - DNA, 30 bp, Homo sapiens; identical to SEQ ID NO: 42595
  chr10:46009848-46009878
  hypo

SEQ ID NO: 63057 - DNA, 28 bp, Homo sapiens
  chr10:46221028-46221056
  hypo
acaaacaaacaaacgacaacaaaaaaaa

SEQ ID NO: 63058 - DNA, 162 bp, Homo sapiens; identical to SEQ ID NO: 42597
  chr10:49393632-49393794
  hypo

SEQ ID NO: 63059 - DNA, 30 bp, Homo sapiens; identical to SEQ ID NO: 42598
  chr10:49541963-49541993
  hypo

SEQ ID NO: 63060 - DNA, 28 bp, Homo sapiens
  chr10:49652949-49652977
  hypo
cccagacggctggctcgcgtgtcagtgg

SEQ ID NO: 63061 - DNA, 30 bp, Homo sapiens; identical to SEQ ID NO: 15370
  chr10:49929928-49929958
  hypo

SEQ ID NO: 63062 - DNA, 30 bp, Homo sapiens; identical to SEQ ID NO: 42601
  chr10:50007569-50007599
  hypo

SEQ ID NO: 63063 - DNA, 30 bp, Homo sapiens; identical to SEQ ID NO: 42602
  chr10:50105263-50105293
  hypo

SEQ ID NO: 63064 - DNA, 88 bp, Homo sapiens
  chr10:50507469-50507557
  hypo
ctgagcagctggacacgcagagagcggaaggtacagcccagacacttgtctggctccttagcgtgggcagggaggctcaagttcatgg

SEQ ID NO: 63065 - DNA, 103 bp, Homo sapiens
  chr10:50507619-50507722
  hypo
gtgcagggtggtatgtgtgtgccgggagcccattggtgttggggctaaggttcttggtgtgctggatgggcctcggggaccacgtacccggaaccgtgtacat

SEQ ID NO: 63066 - DNA, 41 bp, Homo sapiens; identical to SEQ ID NO: 42604
  chr10:50748353-50748394
  hypo

SEQ ID NO: 63067 - DNA, 17 bp, Homo sapiens
  chr10:57918195-57918212
  hypo
atttgaatgtaaggccg

SEQ ID NO: 63068 - DNA, 47 bp, Homo sapiens; identical to SEQ ID NO: 42606
  chr10:69310972-69311019
  hypo

SEQ ID NO: 63069 - DNA, 30 bp, Homo sapiens; identical to SEQ ID NO: 42607
  chr10:69578014-69578044
  hypo

SEQ ID NO: 63070 - DNA, 80 bp, Homo sapiens; identical to SEQ ID NO: 15373
  chr10:70288112-70288192
  hypo

SEQ ID NO: 63071 - DNA, 96 bp, Homo sapiens; identical to SEQ ID NO: 15374
  chr10:70476540-70476636
  hypo

SEQ ID NO: 63072 - DNA, 18 bp, Homo sapiens
  chr10:70483311-70483329
  hypo
taaaagtaaatgggccgg

SEQ ID NO: 63073 - DNA, 30 bp, Homo sapiens; identical to SEQ ID NO: 42612
  chr10:72489875-72489905
  hypo

SEQ ID NO: 63074 - DNA, 136 bp, Homo sapiens; identical to SEQ ID NO: 42613
  chr10:73466313-73466449
  hypo

SEQ ID NO: 63075 - DNA, 30 bp, Homo sapiens; identical to SEQ ID NO: 42614
  chr10:73553133-73553163
  hypo

SEQ ID NO: 63076 - DNA, 23 bp, Homo sapiens
  chr10:73976938-73976961
  hypo
aatgaaagtgtaggccgggcgcg

SEQ ID NO: 63077 - DNA, 84 bp, Homo sapiens; identical to SEQ ID NO: 42616
  chr10:75501525-75501609
  hypo

SEQ ID NO: 63078 - DNA, 36 bp, Homo sapiens; identical to SEQ ID NO: 42617
  chr10:76784730-76784766
  hypo

SEQ ID NO: 63079 - DNA, 23 bp, Homo sapiens
  chr10:76997760-76997783
  hypo
accgcacccggccaagaatccat

SEQ ID NO: 63080 - DNA, 212 bp, Homo sapiens; identical to SEQ ID NO: 42619
  chr10:77022117-77022329
  hypo

SEQ ID NO: 63081 - DNA, 187 bp, Homo sapiens; identical to SEQ ID NO: 42620
  chr10:77893300-77893487
  hypo

SEQ ID NO: 63082 - DNA, 38 bp, Homo sapiens; identical to SEQ ID NO: 42621
  chr10:78600985-78601023
  hypo

SEQ ID NO: 63083 - DNA, 71 bp, Homo sapiens; identical to SEQ ID NO: 42622
  chr10:81070800-81070871
  hypo

SEQ ID NO: 63084 - DNA, 32 bp, Homo sapiens; identical to SEQ ID NO: 42623
  chr10:81921303-81921335
  hypo

SEQ ID NO: 63085 - DNA, 25 bp, Homo sapiens
  chr10:81966571-81966596
  hypo
aacaagctgctggttcgattttcct

SEQ ID NO: 63086 - DNA, 30 bp, Homo sapiens; identical to SEQ ID NO: 42625
  chr10:82607464-82607494
  hypo

SEQ ID NO: 63087 - DNA, 42 bp, Homo sapiens; identical to SEQ ID NO: 42626
  chr10:85949293-85949335
  hypo

SEQ ID NO: 63088 - DNA, 23 bp, Homo sapiens
  chr10:87967335-87967358
  hypo
tactaatggtttatgcgatggca

SEQ ID NO: 63089 - DNA, 40 bp, Homo sapiens; identical to SEQ ID NO: 42628
  chr10:88414219-88414259
  hypo

SEQ ID NO: 63090 - DNA, 30 bp, Homo sapiens; identical to SEQ ID NO: 15378
  chr10:89605951-89605981
  hypo

SEQ ID NO: 63091 - DNA, 23 bp, Homo sapiens
  chr10:94603312-94603335
  hypo
aagcatgcatttggccgggcgcg

SEQ ID NO: 63092 - DNA, 30 bp, Homo sapiens; identical to SEQ ID NO: 42632
  chr10:97202907-97202937
  hypo

SEQ ID NO: 63093 - DNA, 41 bp, Homo sapiens; identical to SEQ ID NO: 24677
  chr10:98129781-98129822
  hypo

SEQ ID NO: 63094 - DNA, 48 bp, Homo sapiens
  chr10:98130033-98130081
  hypo
ctttggtctgcacttcagccttcagcctgcccccgcactctggagcag

SEQ ID NO: 63095 - DNA, 59 bp, Homo sapiens; identical to SEQ ID NO: 42634
  chr10:98808749-98808808
  hypo

SEQ ID NO: 63096 - DNA, 30 bp, Homo sapiens; identical to SEQ ID NO: 42635
  chr10:100217214-100217244
  hypo

SEQ ID NO: 63097 - DNA, 30 bp, Homo sapiens; identical to SEQ ID NO: 42637
  chr10:103814237-103814267
  hypo

SEQ ID NO: 63098 - DNA, 18 bp, Homo sapiens
  chr10:103818196-103818214
  hypo
acacgaagagaaaaccca

SEQ ID NO: 63099 - DNA, 30 bp, Homo sapiens; identical to SEQ ID NO: 42640
  chr10:104160106-104160136
  hypo

SEQ ID NO: 63100 - DNA, 30 bp, Homo sapiens; identical to SEQ ID NO: 42641
  chr10:104161739-104161769
  hypo

SEQ ID NO: 63101 - DNA, 70 bp, Homo sapiens; identical to SEQ ID NO: 42642
  chr10:104823178-104823248
  hypo

SEQ ID NO: 63102 - DNA, 23 bp, Homo sapiens
  chr10:105119651-105119674
  hypo
aaaattgaacacagccgggcgtg

SEQ ID NO: 63103 - DNA, 133 bp, Homo sapiens
  chr10:105413784-105413917
  hypo
atcccttcattctcccagccctgctcaatgcctccaggaagccttctcgactatgcttgtcttcacccctgacacttcagctctgcaccatgcaacagggctactgagggaccatcagcgtggggttgtcatg

SEQ ID NO: 63104 - DNA, 30 bp, Homo sapiens; identical to SEQ ID NO: 42647
  chr10:105796706-105796736
  hypo

SEQ ID NO: 63105 - DNA, 21 bp, Homo sapiens
  chr10:108522437-108522458
  hypo
agccaccgtgcccagcctatt

SEQ ID NO: 63106 - DNA, 143 bp, Homo sapiens; identical to SEQ ID NO: 42649
  chr10:108578381-108578524
  hypo

SEQ ID NO: 63107 - DNA, 36 bp, Homo sapiens; identical to SEQ ID NO: 42650
  chr10:110168394-110168430
  hypo

SEQ ID NO: 63108 - DNA, 54 bp, Homo sapiens; identical to SEQ ID NO: 42651
  chr10:111902849-111902903
  hypo

SEQ ID NO: 63109 - DNA, 33 bp, Homo sapiens; identical to SEQ ID NO: 42652
  chr10:111946090-111946123
  hypo

SEQ ID NO: 63110 - DNA, 32 bp, Homo sapiens; identical to SEQ ID NO: 42653
  chr10:111979836-111979868
  hypo

SEQ ID NO: 63111 - DNA, 30 bp, Homo sapiens; identical to SEQ ID NO: 42654
  chr10:112079213-112079243
  hypo

SEQ ID NO: 63112 - DNA, 79 bp, Homo sapiens; identical to SEQ ID NO: 42655
  chr10:112524488-112524567
  hypo

SEQ ID NO: 63113 - DNA, 30 bp, Homo sapiens; identical to SEQ ID NO: 42656
  chr10:112553736-112553766
  hypo

SEQ ID NO: 63114 - DNA, 30 bp, Homo sapiens; identical to SEQ ID NO: 42657
  chr10:112582575-112582605
  hypo

SEQ ID NO: 63115 - DNA, 83 bp, Homo sapiens; identical to SEQ ID NO: 15387
  chr10:113623006-113623089
  hypo

SEQ ID NO: 63116 - DNA, 30 bp, Homo sapiens; identical to SEQ ID NO: 42659
  chr10:113748400-113748430
  hypo

SEQ ID NO: 63117 - DNA, 26 bp, Homo sapiens
  chr10:114571159-114571185
  hypo
aaggtgagtgcagaccgggcgcggtg

SEQ ID NO: 63118 - DNA, 34 bp, Homo sapiens; identical to SEQ ID NO: 42661
  chr10:114752064-114752098
  hypo

SEQ ID NO: 63119 - DNA, 213 bp, Homo sapiens; identical to SEQ ID NO: 42662
  chr10:114829478-114829691
  hypo

SEQ ID NO: 63120 - DNA, 30 bp, Homo sapiens; identical to SEQ ID NO: 42663
  chr10:115479125-115479155
  hypo

SEQ ID NO: 63121 - DNA, 34 bp, Homo sapiens; identical to SEQ ID NO: 15388
  chr10:115844821-115844855
  hypo

SEQ ID NO: 63122 - DNA, 42 bp, Homo sapiens
  chr10:116331156-116331198
  hypo
aacgggcgcctggaggcagaaagacatcgccctcaaggttat

SEQ ID NO: 63123 - DNA, 30 bp, Homo sapiens; identical to SEQ ID NO: 42666
  chr10:117011803-117011833
  hypo

SEQ ID NO: 63124 - DNA, 43 bp, Homo sapiens
  chr10:119807056-119807099
  hypo
gttctacctcatgtctaagactccatcacgactctatgggctc

SEQ ID NO: 63125 - DNA, 101 bp, Homo sapiens; identical to SEQ ID NO: 42668
  chr10:120767098-120767199
  hypo

SEQ ID NO: 63126 - DNA, 42 bp, Homo sapiens; identical to SEQ ID NO: 42669
  chr10:120791236-120791278
  hypo

SEQ ID NO: 63127 - DNA, 30 bp, Homo sapiens; identical to SEQ ID NO: 42670
  chr10:120922882-120922912
  hypo

SEQ ID NO: 63128 - DNA, 30 bp, Homo sapiens; identical to SEQ ID NO: 42671
  chr10:121249991-121250021
  hypo

SEQ ID NO: 63129 - DNA, 43 bp, Homo sapiens; identical to SEQ ID NO: 42672
  chr10:121256846-121256889
  hypo

SEQ ID NO: 63130 - DNA, 17 bp, Homo sapiens
  chr10:121354427-121354444
  hypo
cccggcctgaaggacaa

SEQ ID NO: 63131 - DNA, 30 bp, Homo sapiens; identical to SEQ ID NO: 42674
  chr10:121398024-121398054
  hypo

SEQ ID NO: 63132 - DNA, 98 bp, Homo sapiens; identical to SEQ ID NO: 42675
  chr10:121651072-121651170
  hypo

SEQ ID NO: 63133 - DNA, 30 bp, Homo sapiens; identical to SEQ ID NO: 42676
  chr10:122394238-122394268
  hypo

SEQ ID NO: 63134 - DNA, 120 bp, Homo sapiens; identical to SEQ ID NO: 15393
  chr10:122492432-122492552
  hypo

SEQ ID NO: 63135 - DNA, 139 bp, Homo sapiens; identical to SEQ ID NO: 42678
  chr10:123820813-123820952
  hypo

SEQ ID NO: 63136 - DNA, 38 bp, Homo sapiens; identical to SEQ ID NO: 42679
  chr10:125919683-125919721
  hypo

SEQ ID NO: 63137 - DNA, 58 bp, Homo sapiens; identical to SEQ ID NO: 24689
  chr10:126199077-126199135
  hypo

SEQ ID NO: 63138 - DNA, 30 bp, Homo sapiens; identical to SEQ ID NO: 42681
  chr10:126314006-126314036
  hypo

SEQ ID NO: 63139 - DNA, 73 bp, Homo sapiens; identical to SEQ ID NO: 42682
  chr10:126314814-126314887
  hypo

SEQ ID NO: 63140 - DNA, 28 bp, Homo sapiens
  chr10:126479341-126479369
  hypo
cttctttttttgagacggagtcacgctc

SEQ ID NO: 63141 - DNA, 28 bp, Homo sapiens
  chr10:126479609-126479637
  hypo
gcgtaagccaccacgcacccggccctct

SEQ ID NO: 63142 - DNA, 45 bp, Homo sapiens; identical to SEQ ID NO: 42686
  chr10:126712043-126712088
  hypo

SEQ ID NO: 63143 - DNA, 87 bp, Homo sapiens; identical to SEQ ID NO: 42687
  chr10:126809890-126809977
  hypo

SEQ ID NO: 63144 - DNA, 30 bp, Homo sapiens; identical to SEQ ID NO: 42688
  chr10:126814656-126814686
  hypo

SEQ ID NO: 63145 - DNA, 194 bp, Homo sapiens; identical to SEQ ID NO: 42689
  chr10:127380217-127380411
  hypo

SEQ ID NO: 63146 - DNA, 36 bp, Homo sapiens; identical to SEQ ID NO: 42690
  chr10:127451959-127451995
  hypo

SEQ ID NO: 63147 - DNA, 75 bp, Homo sapiens; identical to SEQ ID NO: 42691
  chr10:127463306-127463381
  hypo

SEQ ID NO: 63148 - DNA, 30 bp, Homo sapiens; identical to SEQ ID NO: 42692
  chr10:127475463-127475493
  hypo

SEQ ID NO: 63149 - DNA, 29 bp, Homo sapiens
  chr10:127601468-127601497
  hypo
gttgggattacaggcgtaagccatcgtgt

SEQ ID NO: 63150 - DNA, 30 bp, Homo sapiens; identical to SEQ ID NO: 42694
  chr10:128888749-128888779
  hypo

SEQ ID NO: 63151 - DNA, 105 bp, Homo sapiens
  chr10:129888885-129888990
  hypo
atttctttggctctgtatggcagtcacagctctaaagcttctagttgcagaagttactccagtgggaatactccaagtatgcctcgtcctcgcttgccttggctt

SEQ ID NO: 63152 - DNA, 107 bp, Homo sapiens; identical to SEQ ID NO: 42696
  chr10:129925726-129925833
  hypo

SEQ ID NO: 63153 - DNA, 30 bp, Homo sapiens; identical to SEQ ID NO: 42697
  chr10:129947242-129947272
  hypo

SEQ ID NO: 63154 - DNA, 24 bp, Homo sapiens
  chr10:130065702-130065726
  hypo
gcctagcagcgaggtctggaggct

SEQ ID NO: 63155 - DNA, 73 bp, Homo sapiens
  chr10:130203362-130203435
  hypo
ggcccacagtgtgaacggcgccctccaagatgagcagtgtgatgctccgcagagtcgtagacaggaaaagtgg

SEQ ID NO: 63156 - DNA, 71 bp, Homo sapiens
  chr10:130203480-130203551
  hypo
aatggacaacagggaaaatggaggcgcaggtgagaaaggaaggcaggtgaagcgcccgactcactccaagc

SEQ ID NO: 63157 - DNA, 25 bp, Homo sapiens
  chr10:130577739-130577764
  hypo
agcctccgaggattccgcctgagga

SEQ ID NO: 63158 - DNA, 20 bp, Homo sapiens
  chr10:130754356-130754376
  hypo
gacgccgatgctcctgcaga

SEQ ID NO: 63159 - DNA, 179 bp, Homo sapiens; identical to SEQ ID NO: 42702
  chr10:130946123-130946302
  hypo

SEQ ID NO: 63160 - DNA, 30 bp, Homo sapiens; identical to SEQ ID NO: 42703
  chr10:130946893-130946923
  hypo

SEQ ID NO: 63161 - DNA, 208 bp, Homo sapiens; identical to SEQ ID NO: 42704
  chr10:131058908-131059116
  hypo

SEQ ID NO: 63162 - DNA, 185 bp, Homo sapiens; identical to SEQ ID NO: 42705
  chr10:131606695-131606880
  hypo

SEQ ID NO: 63163 - DNA, 120 bp, Homo sapiens; identical to SEQ ID NO: 42706
  chr10:131641071-131641191
  hypo

SEQ ID NO: 63164 - DNA, 184 bp, Homo sapiens
  chr10:131647719-131647903
  hypo
atttgatgattaacacgccccacctcagcaggtgtgcaaggtgcgggggcggacacaaagactgcggcttccggagaggacggctagggggccgcctttgcaagtgctctccaaaataattggtcaccgttctcgagtgcttgggcgtcggcgcatcttgtaagcaacgcaggaagcctcgcac

SEQ ID NO: 63165 - DNA, 4 bp, Homo sapiens
  chr10:131647933-131647937
  hypo
gacc

SEQ ID NO: 63166 - DNA, 118 bp, Homo sapiens; identical to SEQ ID NO: 42708
  chr10:131739072-131739190
  hypo

SEQ ID NO: 63167 - DNA, 30 bp, Homo sapiens; identical to SEQ ID NO: 42709
  chr10:131739627-131739657
  hypo

SEQ ID NO: 63168 - DNA, 242 bp, Homo sapiens; identical to SEQ ID NO: 42710
  chr10:131825216-131825458
  hypo

SEQ ID NO: 63169 - DNA, 284 bp, Homo sapiens; identical to SEQ ID NO: 42711
  chr10:131844059-131844343
  hypo

SEQ ID NO: 63170 - DNA, 92 bp, Homo sapiens; identical to SEQ ID NO: 42712
  chr10:131844600-131844692
  hypo

SEQ ID NO: 63171 - DNA, 192 bp, Homo sapiens; identical to SEQ ID NO: 42713
  chr10:131845044-131845236
  hypo

SEQ ID NO: 63172 - DNA, 40 bp, Homo sapiens
  chr10:131936626-131936666
  hypo
tgatctaaattgagtgaaattttgccgactgaatttgaat

SEQ ID NO: 63173 - DNA, 30 bp, Homo sapiens; identical to SEQ ID NO: 42716
  chr10:132050805-132050835
  hypo

SEQ ID NO: 63174 - DNA, 30 bp, Homo sapiens; identical to SEQ ID NO: 42717
  chr10:132317215-132317245
  hypo

SEQ ID NO: 63175 - DNA, 207 bp, Homo sapiens; identical to SEQ ID NO: 42718
  chr10:132365689-132365896
  hypo

SEQ ID NO: 63176 - DNA, 174 bp, Homo sapiens; identical to SEQ ID NO: 42719
  chr10:132525800-132525974
  hypo

SEQ ID NO: 63177 - DNA, 165 bp, Homo sapiens; identical to SEQ ID NO: 42720
  chr10:132586486-132586651
  hypo

SEQ ID NO: 63178 - DNA, 30 bp, Homo sapiens; identical to SEQ ID NO: 42721
  chr10:132609284-132609314
  hypo

SEQ ID NO: 63179 - DNA, 167 bp, Homo sapiens; identical to SEQ ID NO: 42722
  chr10:132811738-132811905
  hypo

SEQ ID NO: 63180 - DNA, 164 bp, Homo sapiens; identical to SEQ ID NO: 42723
  chr10:132818146-132818310
  hypo

SEQ ID NO: 63181 - DNA, 30 bp, Homo sapiens; identical to SEQ ID NO: 42724
  chr10:132873813-132873843
  hypo

SEQ ID NO: 63182 - DNA, 119 bp, Homo sapiens; identical to SEQ ID NO: 15408
  chr10:132976493-132976612
  hypo

SEQ ID NO: 63183 - DNA, 191 bp, Homo sapiens; identical to SEQ ID NO: 42726
  chr10:132977044-132977235
  hypo

SEQ ID NO: 63184 - DNA, 57 bp, Homo sapiens; identical to SEQ ID NO: 42727
  chr10:133058363-133058420
  hypo

SEQ ID NO: 63185 - DNA, 30 bp, Homo sapiens; identical to SEQ ID NO: 42728
  chr10:133516048-133516078
  hypo

SEQ ID NO: 63186 - DNA, 186 bp, Homo sapiens; identical to SEQ ID NO: 42729
  chr10:133532610-133532796
  hypo

SEQ ID NO: 63187 - DNA, 30 bp, Homo sapiens; identical to SEQ ID NO: 42730
  chr10:133555035-133555065
  hypo

SEQ ID NO: 63188 - DNA, 251 bp, Homo sapiens; identical to SEQ ID NO: 42731
  chr10:133913806-133914057
  hypo

SEQ ID NO: 63189 - DNA, 30 bp, Homo sapiens; identical to SEQ ID NO: 42732
  chr10:133921177-133921207
  hypo

SEQ ID NO: 63190 - DNA, 119 bp, Homo sapiens; identical to SEQ ID NO: 42733
  chr10:133947276-133947395
  hypo

SEQ ID NO: 63191 - DNA, 86 bp, Homo sapiens; identical to SEQ ID NO: 42734
  chr10:133949349-133949435
  hypo

SEQ ID NO: 63192 - DNA, 133 bp, Homo sapiens
  chr10:133951469-133951602
  hypo
ggagccagggcctcccgctgtggtgtggggacaagccagcccagacaccgtcttccctgtcatccaaatgatggcacacgggcagtaaaccgtggactgaaaccggtggagctgctctaccacttacacaacc

SEQ ID NO: 63193 - DNA, 77 bp, Homo sapiens; identical to SEQ ID NO: 42736
  chr10:133955427-133955504
  hypo

SEQ ID NO: 63194 - DNA, 176 bp, Homo sapiens; identical to SEQ ID NO: 42737
  chr10:133962619-133962795
  hypo

SEQ ID NO: 63195 - DNA, 35 bp, Homo sapiens; identical to SEQ ID NO: 42738
  chr10:133979192-133979227
  hypo

SEQ ID NO: 63196 - DNA, 52 bp, Homo sapiens; identical to SEQ ID NO: 42739
  chr10:133982909-133982961
  hypo

SEQ ID NO: 63197 - DNA, 171 bp, Homo sapiens; identical to SEQ ID NO: 42740
  chr10:133984033-133984204
  hypo

SEQ ID NO: 63198 - DNA, 153 bp, Homo sapiens; identical to SEQ ID NO: 42741
  chr10:134012330-134012483
  hypo

SEQ ID NO: 63199 - DNA, 220 bp, Homo sapiens; identical to SEQ ID NO: 42742
  chr10:134014330-134014550
  hypo

SEQ ID NO: 63200 - DNA, 67 bp, Homo sapiens
  chr10:134016136-134016203
  hypo
cctctctccccagaacgtggagtacaacatcttcgagggagtggagtgccggggagcgcctgccgtg

SEQ ID NO: 63201 - DNA, 51 bp, Homo sapiens
  chr10:134016388-134016439
  hypo
ccagaacgcacccctggtcaacctggcccggcctcccgaggggtcaggaag

SEQ ID NO: 63202 - DNA, 30 bp, Homo sapiens; identical to SEQ ID NO: 42744
  chr10:134016763-134016793
  hypo

SEQ ID NO: 63203 - DNA, 30 bp, Homo sapiens; identical to SEQ ID NO: 42745
  chr10:134019334-134019364
  hypo

SEQ ID NO: 63204 - DNA, 66 bp, Homo sapiens
  chr10:134022875-134022941
  hypo
accaggcagaagctgttctctgcgggactttgctggaaaccactcccttgccgggcctttcccgtc

SEQ ID NO: 63205 - DNA, 30 bp, Homo sapiens; identical to SEQ ID NO: 42747
  chr10:134058791-134058821
  hypo

SEQ ID NO: 63206 - DNA, 119 bp, Homo sapiens; identical to SEQ ID NO: 42748
  chr10:134093662-134093781
  hypo

SEQ ID NO: 63207 - DNA, 243 bp, Homo sapiens; identical to SEQ ID NO: 42749
  chr10:134094008-134094251
  hypo

SEQ ID NO: 63208 - DNA, 31 bp, Homo sapiens
  chr10:134095563-134095594
  hypo
aggcagcagcccagccgctccgggggtgggg

SEQ ID NO: 63209 - DNA, 30 bp, Homo sapiens; identical to SEQ ID NO: 42751
  chr10:134118399-134118429
  hypo

SEQ ID NO: 63210 - DNA, 230 bp, Homo sapiens; identical to SEQ ID NO: 42752
  chr10:134123040-134123270
  hypo

SEQ ID NO: 63211 - DNA, 140 bp, Homo sapiens; identical to SEQ ID NO: 42753
  chr10:134272738-134272878
  hypo

SEQ ID NO: 63212 - DNA, 30 bp, Homo sapiens; identical to SEQ ID NO: 42754
  chr10:134292599-134292629
  hypo

SEQ ID NO: 63213 - DNA, 78 bp, Homo sapiens
  chr10:134301017-134301095
  hypo
gtcctgttttgtcttcgatgcttctctccggtgagctgcaggtggccacagagtcaggcttgggaagctgtgccgcaa

SEQ ID NO: 63214 - DNA, 104 bp, Homo sapiens; identical to SEQ ID NO: 24714
  chr10:134301212-134301316
  hypo

SEQ ID NO: 63215 - DNA, 29 bp, Homo sapiens
  chr10:134315613-134315642
  hypo
cgatctcctgacctcgtgatctgctggcc

SEQ ID NO: 63216 - DNA, 30 bp, Homo sapiens; identical to SEQ ID NO: 42757
  chr10:134341480-134341510
  hypo

SEQ ID NO: 63217 - DNA, 195 bp, Homo sapiens
  chr10:134481125-134481320
  hypo
taatgacatttgaatcgagcattaacaggcttaattactttaaaattgtcattttaatttacactgatatagtattgatcatacaagcagagattaagctgttcagtggagcagatgatggggaattaaacattaaagggtcctcagggggccgtgtgcgctgcccggcgcgagccggaagagggatgatatttc

SEQ ID NO: 63218 - DNA, 63 bp, Homo sapiens
  chr10:134481433-134481496
  hypo
ctccagtgattcatccgcctcaccaacatttatttatccagcaaattccggagctttgacctt

SEQ ID NO: 63219 - DNA, 30 bp, Homo sapiens; identical to SEQ ID NO: 42759
  chr10:134499348-134499378
  hypo

SEQ ID NO: 63220 - DNA, 167 bp, Homo sapiens; identical to SEQ ID NO: 42760
  chr10:134518611-134518778
  hypo

SEQ ID NO: 63221 - DNA, 60 bp, Homo sapiens; identical to SEQ ID NO: 42761
  chr10:134542152-134542212
  hypo

SEQ ID NO: 63222 - DNA, 152 bp, Homo sapiens; identical to SEQ ID NO: 42762
  chr10:134566190-134566342
  hypo

SEQ ID NO: 63223 - DNA, 72 bp, Homo sapiens
  chr10:134607898-134607970
  hypo
ctgagccccaccctgcgagggtgctctgagctctcagggcgttgcttctttgcccatttatcccgggtcttg

SEQ ID NO: 63224 - DNA, 13 bp, Homo sapiens
  chr10:134608183-134608196
  hypo
aaagaggggagga

SEQ ID NO: 63225 - DNA, 221 bp, Homo sapiens; identical to SEQ ID NO: 42764
  chr10:134610702-134610923
  hypo

SEQ ID NO: 63226 - DNA, 30 bp, Homo sapiens; identical to SEQ ID NO: 42765
  chr10:134640686-134640716
  hypo

SEQ ID NO: 63227 - DNA, 30 bp, Homo sapiens; identical to SEQ ID NO: 42766
  chr10:134647659-134647689
  hypo

SEQ ID NO: 63228 - DNA, 57 bp, Homo sapiens; identical to SEQ ID NO: 42767
  chr10:134648015-134648072
  hypo

SEQ ID NO: 63229 - DNA, 87 bp, Homo sapiens; identical to SEQ ID NO: 42768
  chr10:134662545-134662632
  hypo

SEQ ID NO: 63230 - DNA, 30 bp, Homo sapiens; identical to SEQ ID NO: 42769
  chr10:134664613-134664643
  hypo

SEQ ID NO: 63231 - DNA, 118 bp, Homo sapiens
  chr10:134665029-134665147
  hypo
cctcatgttccctcccggtcacctagctgcctgccggcaccctgcattccttggcattttccagaaccgtacctaagtggaggcgcacagagtgctgtctttccgtctggttcatttt

SEQ ID NO: 63232 - DNA, 30 bp, Homo sapiens
  chr10:134665202-134665232
  hypo
tctcacagccggcgtcggtgcaccgtgtgc

SEQ ID NO: 63233 - DNA, 51 bp, Homo sapiens; identical to SEQ ID NO: 42771
  chr10:134671588-134671639
  hypo

SEQ ID NO: 63234 - DNA, 30 bp, Homo sapiens; identical to SEQ ID NO: 42772
  chr10:134672451-134672481
  hypo

SEQ ID NO: 63235 - DNA, 162 bp, Homo sapiens; identical to SEQ ID NO: 42773
  chr10:134682685-134682847
  hypo

SEQ ID NO: 63236 - DNA, 21 bp, Homo sapiens
  chr10:134683679-134683700
  hypo
atgagacggtgaactgagtcg

SEQ ID NO: 63237 - DNA, 38 bp, Homo sapiens; identical to SEQ ID NO: 15428
  chr10:134690510-134690548
  hypo

SEQ ID NO: 63238 - DNA, 156 bp, Homo sapiens; identical to SEQ ID NO: 42776
  chr10:134692252-134692408
  hypo

SEQ ID NO: 63239 - DNA, 34 bp, Homo sapiens
  chr10:134693709-134693743
  hypo
gactctccgtgcgcacctgcgctccccacagagt

SEQ ID NO: 63240 - DNA, 42 bp, Homo sapiens; identical to SEQ ID NO: 42778
  chr10:134699364-134699406
  hypo

SEQ ID NO: 63241 - DNA, 144 bp, Homo sapiens; identical to SEQ ID NO: 24724
  chr10:134699728-134699872
  hypo

SEQ ID NO: 63242 - DNA, 164 bp, Homo sapiens
  chr10:134699909-134700073
  hypo
agtctccacgcaggcagcggagccatgtgacacgcagaggcaaaggtgcctgccttcagggcacacacaaaaatcgcctgcctgccgggaggtgagccccacccagcctccatagggcgccctgtgggccatcagtgcccccaaatgcacgaagccagcagggt

SEQ ID NO: 63243 - DNA, 32 bp, Homo sapiens; identical to SEQ ID NO: 42780
  chr10:134726267-134726299
  hypo

SEQ ID NO: 63244 - DNA, 30 bp, Homo sapiens; identical to SEQ ID NO: 42781
  chr10:134729962-134729992
  hypo

SEQ ID NO: 63245 - DNA, 30 bp, Homo sapiens; identical to SEQ ID NO: 42782
  chr10:134730720-134730750
  hypo

SEQ ID NO: 63246 - DNA, 177 bp, Homo sapiens; identical to SEQ ID NO: 42783
  chr10:134731838-134732015
  hypo

SEQ ID NO: 63247 - DNA, 337 bp, Homo sapiens
  chr10:134732884-134733221
  hypo
gacagacgtcccacacgccttgtttccgggccactttggccagctctgcccaaatctgtatcctgctcaccgagaacccaaacgagtgaaaggtgagtagacaagtgtggttgctgaagttagaaaacacctgggctggctgcctgagaaaaggccactgtggctctgcagtttcaaggtggcaaggagcccggcactcgcgctgggtacggcctggcgggtgcatgtcccagggtcgggcgcagctctccgctctccctgccagccagctgtgcgcggcacctcccttccctgtggtgagaagaaaggccacacaatccactccccgggggagtgc

SEQ ID NO: 63248 - DNA, 222 bp, Homo sapiens; identical to SEQ ID NO: 24727
  chr10:134733275-134733497
  hypo

SEQ ID NO: 63249 - DNA, 132 bp, Homo sapiens
  chr10:134733617-134733749
  hypo
cgctgacggtgtggtgccacgccttcgcacagaggtaggtgaaccggcccctgttcttcccggtggagactgagggcggaaatgcaaaggcaggtgttgcagctgctggccaagggccggggacgtgcccat

SEQ ID NO: 63250 - DNA, 193 bp, Homo sapiens; identical to SEQ ID NO: 42785
  chr10:134734077-134734270
  hypo

SEQ ID NO: 63251 - DNA, 233 bp, Homo sapiens
  chr10:134738145-134738378
  hypo
tcctcctatgcgccacgccctctgtggaggacacagcacaggtgagcgccccacctgtccagcttctccagcacgtccgcaacgccagccaggggcttccgcaggtggtgccgcaggttgtgctgcagcaggggcaggcaggtgttccactgcgtggcgcacaccacgtggatgacccgggggtcgcccaggcgcacggctcgctgcagcgcgacgtctagcctctgtatgat

SEQ ID NO: 63252 - DNA, 46 bp, Homo sapiens
  chr10:134738642-134738688
  hypo
gactcagcgggcgctgctcccttcctgatcccgtctctttcctggg

SEQ ID NO: 63253 - DNA, 87 bp, Homo sapiens; identical to SEQ ID NO: 42787
  chr10:134739185-134739272
  hypo

SEQ ID NO: 63254 - DNA, 30 bp, Homo sapiens; identical to SEQ ID NO: 42788
  chr10:134757661-134757691
  hypo

SEQ ID NO: 63255 - DNA, 67 bp, Homo sapiens; identical to SEQ ID NO: 42789
  chr10:134773913-134773980
  hypo

SEQ ID NO: 63256 - DNA, 32 bp, Homo sapiens; identical to SEQ ID NO: 42791
  chr10:134793940-134793972
  hypo

SEQ ID NO: 63257 - DNA, 30 bp, Homo sapiens; identical to SEQ ID NO: 42792
  chr10:134794902-134794932
  hypo

SEQ ID NO: 63258 - DNA, 44 bp, Homo sapiens; identical to SEQ ID NO: 42793
  chr10:134797644-134797688
  hypo

SEQ ID NO: 63259 - DNA, 54 bp, Homo sapiens; identical to SEQ ID NO: 42794
  chr10:134832061-134832115
  hypo

SEQ ID NO: 63260 - DNA, 30 bp, Homo sapiens; identical to SEQ ID NO: 42795
  chr10:134834266-134834296
  hypo

SEQ ID NO: 63261 - DNA, 304 bp, Homo sapiens; identical to SEQ ID NO: 42796
  chr10:134834639-134834943
  hypo

SEQ ID NO: 63262 - DNA, 95 bp, Homo sapiens; identical to SEQ ID NO: 42797
  chr10:134855674-134855769
  hypo

SEQ ID NO: 63263 - DNA, 60 bp, Homo sapiens; identical to SEQ ID NO: 42798
  chr10:134875820-134875880
  hypo

SEQ ID NO: 63264 - DNA, 41 bp, Homo sapiens; identical to SEQ ID NO: 42799
  chr10:134886279-134886320
  hypo

SEQ ID NO: 63265 - DNA, 49 bp, Homo sapiens; identical to SEQ ID NO: 15439
  chr10:134895296-134895345
  hypo

SEQ ID NO: 63266 - DNA, 177 bp, Homo sapiens; identical to SEQ ID NO: 42801
  chr10:134898411-134898588
  hypo

SEQ ID NO: 63267 - DNA, 96 bp, Homo sapiens; identical to SEQ ID NO: 42802
  chr10:134912118-134912214
  hypo

SEQ ID NO: 63268 - DNA, 216 bp, Homo sapiens; identical to SEQ ID NO: 42803
  chr10:134913796-134914012
  hypo

SEQ ID NO: 63269 - DNA, 102 bp, Homo sapiens; identical to SEQ ID NO: 42805
  chr10:134930914-134931016
  hypo

SEQ ID NO: 63270 - DNA, 255 bp, Homo sapiens; identical to SEQ ID NO: 42806
  chr10:134937581-134937836
  hypo

SEQ ID NO: 63271 - DNA, 232 bp, Homo sapiens
  chr10:134940913-134941145
  hypo
tggggaagcccaggacgaagcagcaaggcctgggcctggacctggggcttgccgagagctgcgcccctcccagctcgcacccccgaggagtgcgcagcgccccctcctctcccagggagtccaacctaatctttgcctttggacaaggcaggcctggtttgccttctatgggaggggcctggggacaaatagcgatttggcaacagcacagagctcagctgagaagggaaac

SEQ ID NO: 63272 - DNA, 106 bp, Homo sapiens
  chr10:134941178-134941284
  hypo
tgcccagagccagcctggaacctctcattcagggccctcagttccttctgcggccccaggatggcccgcccgtctgccctccgccttgccccgcccacccagctcc

SEQ ID NO: 63273 - DNA, 187 bp, Homo sapiens; identical to SEQ ID NO: 42808
  chr10:134941647-134941834
  hypo

SEQ ID NO: 63274 - DNA, 357 bp, Homo sapiens
  chr10:134942483-134942840
  hypo
cgccaagatgcactgcgagccactgacggcggacgaggcgcacgtgcacctgcaggaggagggcgccttcgggcacgacccccacctgcacgggtgccttcagggcagaactaagccgccctactttagccggcacccagcagaggagcccgagtacgcctaccacatcccatccagcctggatggcagcccccgcagctcgcgcacagacagcccccccagctctctggatggcccggcggggacacacacgctggcctgctgcacccagggcgaccccttccccatggtcacccagcccgagggcagtgatgggagccctgccctctacagctgccccacgcagccgggcaggga

SEQ ID NO: 63275 - DNA, 25 bp, Homo sapiens
  chr10:134943114-134943139
  hypo
tttcagaagccgttcacacccctgc

SEQ ID NO: 63276 - DNA, 30 bp, Homo sapiens; identical to SEQ ID NO: 42810
  chr10:134943582-134943612
  hypo

SEQ ID NO: 63277 - DNA, 30 bp, Homo sapiens; identical to SEQ ID NO: 42811
  chr10:134945693-134945723
  hypo

SEQ ID NO: 63278 - DNA, 104 bp, Homo sapiens; identical to SEQ ID NO: 42812
  chr10:134955053-134955157
  hypo

SEQ ID NO: 63279 - DNA, 30 bp, Homo sapiens; identical to SEQ ID NO: 42813
  chr10:134970630-134970660
  hypo

SEQ ID NO: 63280 - DNA, 30 bp, Homo sapiens; identical to SEQ ID NO: 42814
  chr10:134992431-134992461
  hypo

SEQ ID NO: 63281 - DNA, 651 bp, Homo sapiens; identical to SEQ ID NO: 42815
  chr10:134996258-134996909
  hypo

SEQ ID NO: 63282 - DNA, 35 bp, Homo sapiens; identical to SEQ ID NO: 42816
  chr10:135001392-135001427
  hypo

SEQ ID NO: 63283 - DNA, 56 bp, Homo sapiens; identical to SEQ ID NO: 24744
  chr10:135002007-135002063
  hypo

SEQ ID NO: 63284 - DNA, 46 bp, Homo sapiens
  chr10:135002156-135002202
  hypo
ggtgacgcacgcaccatcccatcccccccgccgtccccacccccca

SEQ ID NO: 63285 - DNA, 30 bp, Homo sapiens; identical to SEQ ID NO: 42818
  chr10:135010585-135010615
  hypo

SEQ ID NO: 63286 - DNA, 225 bp, Homo sapiens; identical to SEQ ID NO: 42819
  chr10:135011834-135012059
  hypo
